United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 220

SEQ ID NO: 9116022 - DNA, 22 bp, Homo sapiens
gggaatgtaagatatatactag

SEQ ID NO: 9116023 - DNA, 22 bp, Homo sapiens
gggaatgtgcagccacagtgag

SEQ ID NO: 9116024 - DNA, 22 bp, Homo sapiens
gggaatgtgcaggatcgtgggc

SEQ ID NO: 9116025 - DNA, 22 bp, Homo sapiens
ggcttgggagcaggcatgtgac

SEQ ID NO: 9116026 - DNA, 22 bp, Homo sapiens
ggcttcttaatcatgagagtga

SEQ ID NO: 9116027 - DNA, 22 bp, Homo sapiens
ggcaggcagaggctgagacagg

SEQ ID NO: 9116028 - DNA, 22 bp, Homo sapiens
ggcaggcagaggctgagacagg

SEQ ID NO: 9116029 - DNA, 22 bp, Homo sapiens
ggcaggcagaggctgagacagg

SEQ ID NO: 9116030 - DNA, 22 bp, Homo sapiens
ggcaggtggaagttggcagagc

SEQ ID NO: 9116031 - DNA, 22 bp, Homo sapiens
ggcaggtggacgtgctaaagct

SEQ ID NO: 9116032 - DNA, 22 bp, Homo sapiens
ggcaggtggaagttggcagagc

SEQ ID NO: 9116033 - DNA, 22 bp, Homo sapiens
ggcaggtggaagttggcagagc

SEQ ID NO: 9116034 - DNA, 22 bp, Homo sapiens
ggcagtcatcccacttggaacc

SEQ ID NO: 9116035 - DNA, 22 bp, Homo sapiens
ggcagtcagtgtggttcataaa

SEQ ID NO: 9116036 - DNA, 22 bp, Homo sapiens
ggcagtcagtttggagatggat

SEQ ID NO: 9116037 - DNA, 22 bp, Homo sapiens
ggcagtcatttaatccctgcat

SEQ ID NO: 9116038 - DNA, 21 bp, Homo sapiens
ggcaggtgggtctctgttgct

SEQ ID NO: 9116039 - DNA, 22 bp, Homo sapiens
ggcaggtggcactgctgctccc

SEQ ID NO: 9116040 - DNA, 22 bp, Homo sapiens
ggcaggtggcactgctgctccc

SEQ ID NO: 9116041 - DNA, 22 bp, Homo sapiens
ggcaggtggccaagtgtctaag

SEQ ID NO: 9116042 - DNA, 22 bp, Homo sapiens
ggcatgggccgaggtgcctcct

SEQ ID NO: 9116043 - DNA, 22 bp, Homo sapiens
ggcatgggccgaggtgcctcct

SEQ ID NO: 9116044 - DNA, 22 bp, Homo sapiens
ggcatggggtgtatgtggcacg

SEQ ID NO: 9116045 - DNA, 22 bp, Homo sapiens
ggcatggcctgtaagacggaga

SEQ ID NO: 9116046 - DNA, 22 bp, Homo sapiens
ggcagtgaacagaaatgcagaa

SEQ ID NO: 9116047 - DNA, 22 bp, Homo sapiens
ggcagtgaaaaagtatgtttcc

SEQ ID NO: 9116048 - DNA, 22 bp, Homo sapiens
ggcagtgaaaaagtatgtttcc

SEQ ID NO: 9116049 - DNA, 22 bp, Homo sapiens
ggcagtgaaaaagtatgtttcc

SEQ ID NO: 9116050 - DNA, 22 bp, Homo sapiens
ggcagtcttatcagcattggac

SEQ ID NO: 9116051 - DNA, 22 bp, Homo sapiens
ggcagtgaatgaaacagaggct

SEQ ID NO: 9116052 - DNA, 22 bp, Homo sapiens
ggcatggacgtctctgaggcca

SEQ ID NO: 9116053 - DNA, 22 bp, Homo sapiens
ggcagtgaatctgagagcctgg

SEQ ID NO: 9116054 - DNA, 22 bp, Homo sapiens
ggccaattccaggagccggcgg

SEQ ID NO: 9116055 - DNA, 22 bp, Homo sapiens
ggccaaggtgttctgatatgcc

SEQ ID NO: 9116056 - DNA, 22 bp, Homo sapiens
ggccacaacttgctcctagccc

SEQ ID NO: 9116057 - DNA, 22 bp, Homo sapiens
ggccacacagatgactgctttc

SEQ ID NO: 9116058 - DNA, 22 bp, Homo sapiens
ggccacagaacagctacaggac

SEQ ID NO: 9116059 - DNA, 22 bp, Homo sapiens
ggccacactctggtagaggtga

SEQ ID NO: 9116060 - DNA, 22 bp, Homo sapiens
ggccacagaacagctacaggac

SEQ ID NO: 9116061 - DNA, 19 bp, Homo sapiens
ggccaggctgactgtggtc

SEQ ID NO: 9116062 - DNA, 22 bp, Homo sapiens
ggcatgtgttgggaacagcatg

SEQ ID NO: 9116063 - DNA, 22 bp, Homo sapiens
ggcatgttgtttatgtttctgg

SEQ ID NO: 9116064 - DNA, 22 bp, Homo sapiens
ggcattaactctgtttcaattt

SEQ ID NO: 9116065 - DNA, 22 bp, Homo sapiens
ggccaaggctcttgagggctga

SEQ ID NO: 9116066 - DNA, 22 bp, Homo sapiens
ggccaaggctcttgagggctga

SEQ ID NO: 9116067 - DNA, 20 bp, Homo sapiens
ggcatgggtggggctcccag

SEQ ID NO: 9116068 - DNA, 22 bp, Homo sapiens
ggccaggtaagagtgcagccgc

SEQ ID NO: 9116069 - DNA, 22 bp, Homo sapiens
ggccaggtgcggtggctcacac

SEQ ID NO: 9116070 - DNA, 22 bp, Homo sapiens
ggccagggcctggggactgtcc

SEQ ID NO: 9116071 - DNA, 19 bp, Homo sapiens
ggccaggctgactgtggtc

SEQ ID NO: 9116072 - DNA, 19 bp, Homo sapiens
ggccaggctgactgtggtc

SEQ ID NO: 9116073 - DNA, 22 bp, Homo sapiens
ggccatctgcctcaatgtgtgc

SEQ ID NO: 9116074 - DNA, 22 bp, Homo sapiens
ggccatgagcagccctgtggga

SEQ ID NO: 9116075 - DNA, 21 bp, Homo sapiens
ggccatcctgggaagggctgc

SEQ ID NO: 9116076 - DNA, 22 bp, Homo sapiens
ggccagtcccctaatccagggc

SEQ ID NO: 9116077 - DNA, 22 bp, Homo sapiens
ggcctttgcgtccacgccgctt

SEQ ID NO: 9116078 - DNA, 22 bp, Homo sapiens
ggcctttgctggccctcaggct

SEQ ID NO: 9116079 - DNA, 21 bp, Homo sapiens
ggccttgtaacagagttgacc

SEQ ID NO: 9116080 - DNA, 22 bp, Homo sapiens
ggccttgtggaaggtatgagca

SEQ ID NO: 9116081 - DNA, 22 bp, Homo sapiens
ggccttggttccaaagcaggca

SEQ ID NO: 9116082 - DNA, 22 bp, Homo sapiens
ggcgaggccgggacaggctgga

SEQ ID NO: 9116083 - DNA, 22 bp, Homo sapiens
ggcgaggccgggacaggctgga

SEQ ID NO: 9116084 - DNA, 22 bp, Homo sapiens
ggcgaggccgggacaggctgga

SEQ ID NO: 9116085 - DNA, 20 bp, Homo sapiens
ggccttgggtttcgcctgtt

SEQ ID NO: 9116086 - DNA, 22 bp, Homo sapiens
ggccttgggtataggtgggtat

SEQ ID NO: 9116087 - DNA, 17 bp, Homo sapiens
ggccttggggcctcagt

SEQ ID NO: 9116088 - DNA, 17 bp, Homo sapiens
ggccttggggcctcagt

SEQ ID NO: 9116089 - DNA, 17 bp, Homo sapiens
ggccttgggctgctctt

SEQ ID NO: 9116090 - DNA, 22 bp, Homo sapiens
ggccttggggaggatggtgtcc

SEQ ID NO: 9116091 - DNA, 22 bp, Homo sapiens
ggccttgggctggctgcagtat

SEQ ID NO: 9116092 - DNA, 22 bp, Homo sapiens
ggccttggtgctctgtgttgca

SEQ ID NO: 9116093 - DNA, 22 bp, Homo sapiens
ggccttggtgccatggccagtt

SEQ ID NO: 9116094 - DNA, 22 bp, Homo sapiens
ggccttggtgccatggccagtt

SEQ ID NO: 9116095 - DNA, 22 bp, Homo sapiens
ggccttgggcgagtccctcagt

SEQ ID NO: 9116096 - DNA, 22 bp, Homo sapiens
ggcctgagggtgggctctcagt

SEQ ID NO: 9116097 - DNA, 22 bp, Homo sapiens
ggcctgagggtgggctctcagt

SEQ ID NO: 9116098 - DNA, 22 bp, Homo sapiens
ggcctgaggcgtcccagctgtg

SEQ ID NO: 9116099 - DNA, 22 bp, Homo sapiens
ggcctgagggtgggctctcagt

SEQ ID NO: 9116100 - DNA, 22 bp, Homo sapiens
ggcctgaggcgtcccagctgtg

SEQ ID NO: 9116101 - DNA, 22 bp, Homo sapiens
ggcctgaggcgtcccagctgtg

SEQ ID NO: 9116102 - DNA, 22 bp, Homo sapiens
ggcctgaggcgtcccagctgtg

SEQ ID NO: 9116103 - DNA, 22 bp, Homo sapiens
ggcctgagaatgtaccagatct

SEQ ID NO: 9116104 - DNA, 22 bp, Homo sapiens
ggcctgagaatgtaccagatct

SEQ ID NO: 9116105 - DNA, 22 bp, Homo sapiens
ggcctgaaataaagtagcagaa

SEQ ID NO: 9116106 - DNA, 22 bp, Homo sapiens
ggcctgaaatagctctgaggtt

SEQ ID NO: 9116107 - DNA, 22 bp, Homo sapiens
ggcctcttctgctcatactttc

SEQ ID NO: 9116108 - DNA, 22 bp, Homo sapiens
ggcctgaatgcctgagtgtggg

SEQ ID NO: 9116109 - DNA, 21 bp, Homo sapiens
ggcctgaaaaagtgaatgctt

SEQ ID NO: 9116110 - DNA, 21 bp, Homo sapiens
ggcctgagtataggacaggcc

SEQ ID NO: 9116111 - DNA, 22 bp, Homo sapiens
ggcctgagtcacatcaggagag

SEQ ID NO: 9116112 - DNA, 22 bp, Homo sapiens
ggcctgagtcacatcaggagag

SEQ ID NO: 9116113 - DNA, 22 bp, Homo sapiens
ggcctgagtcccacctggctgt

SEQ ID NO: 9116114 - DNA, 22 bp, Homo sapiens
ggccttgggatgtggctgcagc

SEQ ID NO: 9116115 - DNA, 22 bp, Homo sapiens
ggccttgggcagacacgtcaca

SEQ ID NO: 9116116 - DNA, 22 bp, Homo sapiens
ggccttgggcagacacgtcaca

SEQ ID NO: 9116117 - DNA, 22 bp, Homo sapiens
ggccttgggatgtggctgcagc

SEQ ID NO: 9116118 - DNA, 22 bp, Homo sapiens
ggcctgagtcccacctggctgt

SEQ ID NO: 9116119 - DNA, 22 bp, Homo sapiens
ggcctgcacagaggtggctcta

SEQ ID NO: 9116120 - DNA, 22 bp, Homo sapiens
ggcctcagtttcttcaactgta

SEQ ID NO: 9116121 - DNA, 22 bp, Homo sapiens
ggcctctggttcacagggagga

SEQ ID NO: 9116122 - DNA, 22 bp, Homo sapiens
ggcctcagtttcttcaactgta

SEQ ID NO: 9116123 - DNA, 22 bp, Homo sapiens
ggcctcagtttctccatgggtt

SEQ ID NO: 9116124 - DNA, 22 bp, Homo sapiens
ggcctcagtgggccgctgcagg

SEQ ID NO: 9116125 - DNA, 22 bp, Homo sapiens
ggcctcagggttgggcccatta

SEQ ID NO: 9116126 - DNA, 22 bp, Homo sapiens
ggcctcagggttgggcccatta

SEQ ID NO: 9116127 - DNA, 23 bp, Homo sapiens
ggcctctgtgttctgcccacatg

SEQ ID NO: 9116128 - DNA, 22 bp, Homo sapiens
ggcctctgtttggagccaggat

SEQ ID NO: 9116129 - DNA, 22 bp, Homo sapiens
ggcctcttatctggctcctgca

SEQ ID NO: 9116130 - DNA, 22 bp, Homo sapiens
ggcctctggttcgtggtgacct

SEQ ID NO: 9116131 - DNA, 22 bp, Homo sapiens
ggcctctggttcacagggagga

SEQ ID NO: 9116132 - DNA, 21 bp, Homo sapiens
ggcctctgtcatcctgggaag

SEQ ID NO: 9116133 - DNA, 22 bp, Homo sapiens
ggcctctggttcgtggtgacct

SEQ ID NO: 9116134 - DNA, 18 bp, Homo sapiens
ggcctcagcctggccgga

SEQ ID NO: 9116135 - DNA, 21 bp, Homo sapiens
ggcctcagccacctggctctg

SEQ ID NO: 9116136 - DNA, 22 bp, Homo sapiens
ggcctcagaggaggtgtgagtc

SEQ ID NO: 9116137 - DNA, 21 bp, Homo sapiens
ggcctcagccacctggctctg

SEQ ID NO: 9116138 - DNA, 23 bp, Homo sapiens
ggccatggagacttagaatgggc

SEQ ID NO: 9116139 - DNA, 22 bp, Homo sapiens
ggccatggaccccgagctgacc

SEQ ID NO: 9116140 - DNA, 22 bp, Homo sapiens
ggcctcagagaaggctgtgcgg

SEQ ID NO: 9116141 - DNA, 22 bp, Homo sapiens
ggccatggcgggagccggcgtc

SEQ ID NO: 9116142 - DNA, 23 bp, Homo sapiens
ggccatggagacttagaatgggc

SEQ ID NO: 9116143 - DNA, 22 bp, Homo sapiens
ggcctcagaccggagctggcca

SEQ ID NO: 9116144 - DNA, 22 bp, Homo sapiens
ggcaggaggtgagtggcgggtg

SEQ ID NO: 9116145 - DNA, 22 bp, Homo sapiens
ggcaggaggtgagtggcgggtg

SEQ ID NO: 9116146 - DNA, 22 bp, Homo sapiens
ggcaggaggtgagtggcgggtg

SEQ ID NO: 9116147 - DNA, 22 bp, Homo sapiens
ggcaggagggcggacaatgacc

SEQ ID NO: 9116148 - DNA, 22 bp, Homo sapiens
ggcaggagggcggacaatgacc

SEQ ID NO: 9116149 - DNA, 22 bp, Homo sapiens
ggcaggaggaagagttagcacc

SEQ ID NO: 9116150 - DNA, 22 bp, Homo sapiens
ggcaggaggaagagttagcacc

SEQ ID NO: 9116151 - DNA, 22 bp, Homo sapiens
ggcagaggtagctggaaccagg

SEQ ID NO: 9116152 - DNA, 22 bp, Homo sapiens
ggcagaggtagctggaaccagg

SEQ ID NO: 9116153 - DNA, 22 bp, Homo sapiens
ggcagaggtagctggaaccagg

SEQ ID NO: 9116154 - DNA, 20 bp, Homo sapiens
ggcagagggcctgggagaag

SEQ ID NO: 9116155 - DNA, 20 bp, Homo sapiens
ggcagagggcctgggagaag

SEQ ID NO: 9116156 - DNA, 22 bp, Homo sapiens
ggcaggcaaggcagcctggtga

SEQ ID NO: 9116157 - DNA, 22 bp, Homo sapiens
ggcaggcaagtctgctctgtga

SEQ ID NO: 9116158 - DNA, 22 bp, Homo sapiens
ggcaggcaaggcagcctggtga

SEQ ID NO: 9116159 - DNA, 22 bp, Homo sapiens
ggcaggcaagtctgctctgtga

SEQ ID NO: 9116160 - DNA, 22 bp, Homo sapiens
ggcaggcaagtctgctctgtga

SEQ ID NO: 9116161 - DNA, 22 bp, Homo sapiens
ggcaggcaacggaccactagtc

SEQ ID NO: 9116162 - DNA, 22 bp, Homo sapiens
ggcaggcaacggaccactagtc

SEQ ID NO: 9116163 - DNA, 22 bp, Homo sapiens
ggcaggaggtgagtggcgggtg

SEQ ID NO: 9116164 - DNA, 22 bp, Homo sapiens
ggcaggcaatgaggatgggaag

SEQ ID NO: 9116165 - DNA, 22 bp, Homo sapiens
ggcaggcaatgaggatgggaag

SEQ ID NO: 9116166 - DNA, 22 bp, Homo sapiens
ggcaggcacagtaatacatgtt

SEQ ID NO: 9116167 - DNA, 22 bp, Homo sapiens
ggcaggcacatttgggggccgt

SEQ ID NO: 9116168 - DNA, 22 bp, Homo sapiens
ggcaggcactgtgatagattct

SEQ ID NO: 9116169 - DNA, 22 bp, Homo sapiens
ggcaggcactgtgatagattct

SEQ ID NO: 9116170 - DNA, 22 bp, Homo sapiens
ggcaggcaccagctcagcaata

SEQ ID NO: 9116171 - DNA, 22 bp, Homo sapiens
ggcaggcaccagctcagcaata

SEQ ID NO: 9116172 - DNA, 22 bp, Homo sapiens
ggcaggcactgtgctaggcgct

SEQ ID NO: 9116173 - DNA, 22 bp, Homo sapiens
ggcaggcactgtgctaggcgct

SEQ ID NO: 9116174 - DNA, 22 bp, Homo sapiens
ggcaggcacatttgggggccgt

SEQ ID NO: 9116175 - DNA, 22 bp, Homo sapiens
ggcaggcactgtgctaggcgct

SEQ ID NO: 9116176 - DNA, 22 bp, Homo sapiens
ggcaggcactgtgctaggcgct

SEQ ID NO: 9116177 - DNA, 22 bp, Homo sapiens
ggcaggcactgtgttttgtgtt

SEQ ID NO: 9116178 - DNA, 22 bp, Homo sapiens
ggcaggcagaaaaatagaatat

SEQ ID NO: 9116179 - DNA, 22 bp, Homo sapiens
ggcaggcagaaaaatagaatat

SEQ ID NO: 9116180 - DNA, 20 bp, Homo sapiens
ggcaccaggctaggattgga

SEQ ID NO: 9116181 - DNA, 20 bp, Homo sapiens
ggcaccaggctaggattgga

SEQ ID NO: 9116182 - DNA, 22 bp, Homo sapiens
ggcaccaggatcagtctgtcat

SEQ ID NO: 9116183 - DNA, 23 bp, Homo sapiens
ggcaccaggccatggagcgggag

SEQ ID NO: 9116184 - DNA, 23 bp, Homo sapiens
ggcaccaggccatggagcgggag

SEQ ID NO: 9116185 - DNA, 22 bp, Homo sapiens
ggcaccaggacatgactcccag

SEQ ID NO: 9116186 - DNA, 22 bp, Homo sapiens
ggcaccaggacatgactcccag

SEQ ID NO: 9116187 - DNA, 22 bp, Homo sapiens
ggcagaggaagctggaagtggg

SEQ ID NO: 9116188 - DNA, 22 bp, Homo sapiens
ggcagaggaaggatgaattcac

SEQ ID NO: 9116189 - DNA, 22 bp, Homo sapiens
ggcagaggaaggatgaattcac

SEQ ID NO: 9116190 - DNA, 22 bp, Homo sapiens
ggcagaggagctggaaacatgg

SEQ ID NO: 9116191 - DNA, 22 bp, Homo sapiens
ggcagaggagctggaaacatgg

SEQ ID NO: 9116192 - DNA, 22 bp, Homo sapiens
ggcagaggagctggaaacatgg

SEQ ID NO: 9116193 - DNA, 22 bp, Homo sapiens
ggcacagccactttggagaact

SEQ ID NO: 9116194 - DNA, 22 bp, Homo sapiens
ggcacagcaggagctatgtgaa

SEQ ID NO: 9116195 - DNA, 22 bp, Homo sapiens
ggcacagccctctctgtggaca

SEQ ID NO: 9116196 - DNA, 22 bp, Homo sapiens
ggcacagctacttgctcactct

SEQ ID NO: 9116197 - DNA, 22 bp, Homo sapiens
ggcacagcgactaccatcgaaa

SEQ ID NO: 9116198 - DNA, 21 bp, Homo sapiens
ggcacagcctgaaatgcctca

SEQ ID NO: 9116199 - DNA, 22 bp, Homo sapiens
ggcacaggagctagtcaaagcc

SEQ ID NO: 9116200 - DNA, 17 bp, Homo sapiens
ggcaccagacggagagt

SEQ ID NO: 9116201 - DNA, 17 bp, Homo sapiens
ggcaccagacggagagt

SEQ ID NO: 9116202 - DNA, 17 bp, Homo sapiens
ggcaccagacggagagt

SEQ ID NO: 9116203 - DNA, 22 bp, Homo sapiens
ggcaccagcacttgggatggct

SEQ ID NO: 9116204 - DNA, 22 bp, Homo sapiens
ggcaccagcacttgggatggct

SEQ ID NO: 9116205 - DNA, 22 bp, Homo sapiens
ggcaccagccacctatttctag

SEQ ID NO: 9116206 - DNA, 22 bp, Homo sapiens
ggcaccagcaggcaccgatgcc

SEQ ID NO: 9116207 - DNA, 22 bp, Homo sapiens
ggcaccagcaggcaccgatgcc

SEQ ID NO: 9116208 - DNA, 22 bp, Homo sapiens
ggcacagctcaggtcccagctc

SEQ ID NO: 9116209 - DNA, 22 bp, Homo sapiens
ggcacagctcaggtcccagctc

SEQ ID NO: 9116210 - DNA, 22 bp, Homo sapiens
ggcacagctgatgcagacacac

SEQ ID NO: 9116211 - DNA, 22 bp, Homo sapiens
ggcacagctgatgcagacacac

SEQ ID NO: 9116212 - DNA, 22 bp, Homo sapiens
ggcacagctgatgcagacacac

SEQ ID NO: 9116213 - DNA, 22 bp, Homo sapiens
ggcacaggaatctgtgaagtgc

SEQ ID NO: 9116214 - DNA, 22 bp, Homo sapiens
ggagtcacctgggaggactggg

SEQ ID NO: 9116215 - DNA, 22 bp, Homo sapiens
ggagtcagaatggcagggtggt

SEQ ID NO: 9116216 - DNA, 22 bp, Homo sapiens
ggagtgaggcatttgtagctga

SEQ ID NO: 9116217 - DNA, 22 bp, Homo sapiens
ggagtctgatactgagttcctc

SEQ ID NO: 9116218 - DNA, 22 bp, Homo sapiens
ggagtctgattttttatgggtg

SEQ ID NO: 9116219 - DNA, 19 bp, Homo sapiens
ggagtctgagcccaggtat

SEQ ID NO: 9116220 - DNA, 22 bp, Homo sapiens
ggagtctgagtcctcatagaca

SEQ ID NO: 9116221 - DNA, 22 bp, Homo sapiens
ggagtctgagcttgtgtcctgg

SEQ ID NO: 9116222 - DNA, 22 bp, Homo sapiens
ggagtctgacccttagagatga

SEQ ID NO: 9116223 - DNA, 22 bp, Homo sapiens
ggagtctgactctgaccctgga

SEQ ID NO: 9116224 - DNA, 22 bp, Homo sapiens
ggagtcctggactccatctcac

SEQ ID NO: 9116225 - DNA, 22 bp, Homo sapiens
ggagtccatgcagcttgagaca

SEQ ID NO: 9116226 - DNA, 22 bp, Homo sapiens
ggagtccctgtccccatacgag

SEQ ID NO: 9116227 - DNA, 22 bp, Homo sapiens
ggagccagagcactggggagcc

SEQ ID NO: 9116228 - DNA, 22 bp, Homo sapiens
ggagccagaggctgctgctgtg

SEQ ID NO: 9116229 - DNA, 22 bp, Homo sapiens
ggagccagaggctgctgctgtg

SEQ ID NO: 9116230 - DNA, 22 bp, Homo sapiens
ggagccagaggctgctgctgtg

SEQ ID NO: 9116231 - DNA, 22 bp, Homo sapiens
ggagccagagggatgcagttga

SEQ ID NO: 9116232 - DNA, 22 bp, Homo sapiens
ggagccagagtctgcagtgtaa

SEQ ID NO: 9116233 - DNA, 22 bp, Homo sapiens
ggagtattgtagcttccagttc

SEQ ID NO: 9116234 - DNA, 23 bp, Homo sapiens
ggagtgcaatggcgccatctcgg

SEQ ID NO: 9116235 - DNA, 23 bp, Homo sapiens
ggagtgcaatggcgccatctcgg

SEQ ID NO: 9116236 - DNA, 23 bp, Homo sapiens
ggagtgcaatggcgccatctcgg

SEQ ID NO: 9116237 - DNA, 23 bp, Homo sapiens
ggagtgcaatggcgccatctcgg

SEQ ID NO: 9116238 - DNA, 22 bp, Homo sapiens
ggcaaacaggagagtaaagaga

SEQ ID NO: 9116239 - DNA, 22 bp, Homo sapiens
ggcaaagccctgcctggttcaa

SEQ ID NO: 9116240 - DNA, 22 bp, Homo sapiens
ggcaaacacacctcggtgagaa

SEQ ID NO: 9116241 - DNA, 22 bp, Homo sapiens
ggcaaacagacttgaccatctt

SEQ ID NO: 9116242 - DNA, 22 bp, Homo sapiens
ggcaaacaccaggcgagggagc

SEQ ID NO: 9116243 - DNA, 22 bp, Homo sapiens
ggcaaacagacttgaccatctt

SEQ ID NO: 9116244 - DNA, 22 bp, Homo sapiens
ggattttagagtacctaagtgt

SEQ ID NO: 9116245 - DNA, 22 bp, Homo sapiens
ggcaaaaacagcaatgactttt

SEQ ID NO: 9116246 - DNA, 22 bp, Homo sapiens
ggcaaaaaccataattactttt

SEQ ID NO: 9116247 - DNA, 22 bp, Homo sapiens
ggcaaaaaccacaattactttt

SEQ ID NO: 9116248 - DNA, 22 bp, Homo sapiens
ggcaaaaaccgcaataacttct

SEQ ID NO: 9116249 - DNA, 22 bp, Homo sapiens
ggcaacaactggacatagctgg

SEQ ID NO: 9116250 - DNA, 22 bp, Homo sapiens
ggcaaatttgtcttaagacacc

SEQ ID NO: 9116251 - DNA, 19 bp, Homo sapiens
ggcaaattgaggccagtca

SEQ ID NO: 9116252 - DNA, 22 bp, Homo sapiens
ggcaaattgctgcaattactta

SEQ ID NO: 9116253 - DNA, 22 bp, Homo sapiens
ggcaaagcggccctgtggccag

SEQ ID NO: 9116254 - DNA, 22 bp, Homo sapiens
ggcaaagccttccagctgttac

SEQ ID NO: 9116255 - DNA, 21 bp, Homo sapiens
ggcaacagatattttgcttag

SEQ ID NO: 9116256 - DNA, 22 bp, Homo sapiens
ggcaacatgggaaaattaacct

SEQ ID NO: 9116257 - DNA, 22 bp, Homo sapiens
ggcaagaaggcttcaggtagct

SEQ ID NO: 9116258 - DNA, 22 bp, Homo sapiens
ggcaagagggcagatggagtgc

SEQ ID NO: 9116259 - DNA, 22 bp, Homo sapiens
ggcaagagtgaggagtgtctct

SEQ ID NO: 9116260 - DNA, 22 bp, Homo sapiens
ggcaagatccaaggggctagga

SEQ ID NO: 9116261 - DNA, 22 bp, Homo sapiens
ggcaagcataacctgtacagcc

SEQ ID NO: 9116262 - DNA, 22 bp, Homo sapiens
ggacatgattagcagggagagc

SEQ ID NO: 9116263 - DNA, 22 bp, Homo sapiens
ggacatggaaatcggcttgctc

SEQ ID NO: 9116264 - DNA, 22 bp, Homo sapiens
ggacccacagattcttcattct

SEQ ID NO: 9116265 - DNA, 22 bp, Homo sapiens
ggagacagggttgaaccacgca

SEQ ID NO: 9116266 - DNA, 22 bp, Homo sapiens
ggaccatggacaaatttctaga

SEQ ID NO: 9116267 - DNA, 22 bp, Homo sapiens
ggagacagggttgaaccacgca

SEQ ID NO: 9116268 - DNA, 22 bp, Homo sapiens
ggaccatgaggagatgggcctc

SEQ ID NO: 9116269 - DNA, 22 bp, Homo sapiens
ggaccatctctagccagagctt

SEQ ID NO: 9116270 - DNA, 22 bp, Homo sapiens
ggagacagtatggcttgtagct

SEQ ID NO: 9116271 - DNA, 22 bp, Homo sapiens
ggagacagtatggcttgtagct

SEQ ID NO: 9116272 - DNA, 22 bp, Homo sapiens
ggagacagtatggcttgtagct

SEQ ID NO: 9116273 - DNA, 22 bp, Homo sapiens
ggacacaggcagctgggtgggt

SEQ ID NO: 9116274 - DNA, 22 bp, Homo sapiens
ggacacaggcagctgggtgggt

SEQ ID NO: 9116275 - DNA, 22 bp, Homo sapiens
ggacacagctgcagccacaccc

SEQ ID NO: 9116276 - DNA, 22 bp, Homo sapiens
ggacacagctgcagccacaccc

SEQ ID NO: 9116277 - DNA, 22 bp, Homo sapiens
ggacacagctgcagccacaccc

SEQ ID NO: 9116278 - DNA, 23 bp, Homo sapiens
ggacacaggccttgtctgcgcct

SEQ ID NO: 9116279 - DNA, 23 bp, Homo sapiens
ggacacaggccttgtctgcgcct

SEQ ID NO: 9116280 - DNA, 22 bp, Homo sapiens
ggacacagggctcactctctct

SEQ ID NO: 9116281 - DNA, 22 bp, Homo sapiens
ggacacagtggaagacagcttg

SEQ ID NO: 9116282 - DNA, 22 bp, Homo sapiens
ggacacagtggaagacagcttg

SEQ ID NO: 9116283 - DNA, 22 bp, Homo sapiens
ggacacagtggaagacagcttg

SEQ ID NO: 9116284 - DNA, 22 bp, Homo sapiens
ggacagtgtgggccatctcact

SEQ ID NO: 9116285 - DNA, 22 bp, Homo sapiens
ggagagaattccatggacatgt

SEQ ID NO: 9116286 - DNA, 22 bp, Homo sapiens
ggagagagacctccatgcccag

SEQ ID NO: 9116287 - DNA, 22 bp, Homo sapiens
ggagagagacctccatgcccag

SEQ ID NO: 9116288 - DNA, 22 bp, Homo sapiens
ggagcagcactgccacacagag

SEQ ID NO: 9116289 - DNA, 22 bp, Homo sapiens
ggagcagcactgccacacagag

SEQ ID NO: 9116290 - DNA, 22 bp, Homo sapiens
ggagcaggctctgtggtttcca

SEQ ID NO: 9116291 - DNA, 22 bp, Homo sapiens
ggagcatgcgctctgtgaccga

SEQ ID NO: 9116292 - DNA, 22 bp, Homo sapiens
ggagcagggaattacagcgcag

SEQ ID NO: 9116293 - DNA, 22 bp, Homo sapiens
ggagacatgcagactgagatac

SEQ ID NO: 9116294 - DNA, 22 bp, Homo sapiens
ggagacatattccagagctggg

SEQ ID NO: 9116295 - DNA, 22 bp, Homo sapiens
ggagaccagaaggaagcttcga

SEQ ID NO: 9116296 - DNA, 22 bp, Homo sapiens
ggagaccttaaggtgcttccta

SEQ ID NO: 9116297 - DNA, 22 bp, Homo sapiens
ggagactgatctgagtgataac

SEQ ID NO: 9116298 - DNA, 22 bp, Homo sapiens
ggagacagtgacttagagactg

SEQ ID NO: 9116299 - DNA, 22 bp, Homo sapiens
ggagacagtgacttagagactg

SEQ ID NO: 9116300 - DNA, 22 bp, Homo sapiens
ggagacagtggtagggcctaag

SEQ ID NO: 9116301 - DNA, 22 bp, Homo sapiens
ggagacagtgacttagagactg

SEQ ID NO: 9116302 - DNA, 22 bp, Homo sapiens
ggagacagtggtagggcctaag

SEQ ID NO: 9116303 - DNA, 22 bp, Homo sapiens
ggagagaactgacctgaaagga

SEQ ID NO: 9116304 - DNA, 22 bp, Homo sapiens
ggagagaactggctccttctag

SEQ ID NO: 9116305 - DNA, 22 bp, Homo sapiens
ggagagaaattgaggtagcaag

SEQ ID NO: 9116306 - DNA, 22 bp, Homo sapiens
ggagagaaattgaggtagcaag

SEQ ID NO: 9116307 - DNA, 22 bp, Homo sapiens
gctttattttgtgagggattac

SEQ ID NO: 9116308 - DNA, 17 bp, Homo sapiens
gctttccttgcccctcc

SEQ ID NO: 9116309 - DNA, 22 bp, Homo sapiens
gctttcctggccctgtccctgc

SEQ ID NO: 9116310 - DNA, 22 bp, Homo sapiens
gctttcctggccctgtccctgc

SEQ ID NO: 9116311 - DNA, 22 bp, Homo sapiens
gctttcagggtcactgtcaaca

SEQ ID NO: 9116312 - DNA, 22 bp, Homo sapiens
gctttcagccactgtgtttctg

SEQ ID NO: 9116313 - DNA, 21 bp, Homo sapiens
gctttcagaagtctcatagtt

SEQ ID NO: 9116314 - DNA, 22 bp, Homo sapiens
gctttgctgggtgcttcatgta

SEQ ID NO: 9116315 - DNA, 22 bp, Homo sapiens
gctttgctggcttgaaatgctg

SEQ ID NO: 9116316 - DNA, 22 bp, Homo sapiens
gctttgcttccttccccttcaa

SEQ ID NO: 9116317 - DNA, 22 bp, Homo sapiens
gctttgcttcctgttctagcct

SEQ ID NO: 9116318 - DNA, 22 bp, Homo sapiens
gctttgctgggtgcttcatgta

SEQ ID NO: 9116319 - DNA, 22 bp, Homo sapiens
gctttgcttcctgttctagcct

SEQ ID NO: 9116320 - DNA, 17 bp, Homo sapiens
gctttggaaagccttcc

SEQ ID NO: 9116321 - DNA, 22 bp, Homo sapiens
gctttggaaatatagactcaag

SEQ ID NO: 9116322 - DNA, 22 bp, Homo sapiens
gctttggaaatatagactcaag

SEQ ID NO: 9116323 - DNA, 22 bp, Homo sapiens
gctttctcttcactgatgttca

SEQ ID NO: 9116324 - DNA, 22 bp, Homo sapiens
gctttctgcctgggctccattt

SEQ ID NO: 9116325 - DNA, 22 bp, Homo sapiens
gctttctgattgcgaaaacaaa

SEQ ID NO: 9116326 - DNA, 22 bp, Homo sapiens
gctttgctatgactcaccagca

SEQ ID NO: 9116327 - DNA, 22 bp, Homo sapiens
gctttgctatgactcaccagca

SEQ ID NO: 9116328 - DNA, 22 bp, Homo sapiens
gctttgctggaatcaacgaatg

SEQ ID NO: 9116329 - DNA, 22 bp, Homo sapiens
gctttgctgaggtctgaggatt

SEQ ID NO: 9116330 - DNA, 22 bp, Homo sapiens
ggaagaggaggagccaggcttt

SEQ ID NO: 9116331 - DNA, 22 bp, Homo sapiens
ggaagaggaggagccaggcttt

SEQ ID NO: 9116332 - DNA, 22 bp, Homo sapiens
ggaagacagaagcctacagctt

SEQ ID NO: 9116333 - DNA, 22 bp, Homo sapiens
ggaagacaagcagtggctgagc

SEQ ID NO: 9116334 - DNA, 22 bp, Homo sapiens
ggaagaagggtcattggcagcc

SEQ ID NO: 9116335 - DNA, 19 bp, Homo sapiens
gctttggagggaggttcta

SEQ ID NO: 9116336 - DNA, 22 bp, Homo sapiens
gctttggagtcagaaagaccta

SEQ ID NO: 9116337 - DNA, 22 bp, Homo sapiens
gctttggaaggggctggtggag

SEQ ID NO: 9116338 - DNA, 17 bp, Homo sapiens
gctttggaagggtagac

SEQ ID NO: 9116339 - DNA, 22 bp, Homo sapiens
ggaagaggctgagccaggtccc

SEQ ID NO: 9116340 - DNA, 22 bp, Homo sapiens
ggaagaggctgaggccatgctg

SEQ ID NO: 9116341 - DNA, 22 bp, Homo sapiens
ggaagaggctgaggccatgctg

SEQ ID NO: 9116342 - DNA, 22 bp, Homo sapiens
ggaagaggctgaggccatgctg

SEQ ID NO: 9116343 - DNA, 22 bp, Homo sapiens
ggaagaggctctcattgagggc

SEQ ID NO: 9116344 - DNA, 22 bp, Homo sapiens
ggaagaggctctcattgagggc

SEQ ID NO: 9116345 - DNA, 22 bp, Homo sapiens
ggaagaggctctcattgagggc

SEQ ID NO: 9116346 - DNA, 22 bp, Homo sapiens
ggaagaggctctcattgagggc

SEQ ID NO: 9116347 - DNA, 22 bp, Homo sapiens
ggaagcagcctgaagccaaggg

SEQ ID NO: 9116348 - DNA, 20 bp, Homo sapiens
ggaagcagagaactgttttc

SEQ ID NO: 9116349 - DNA, 22 bp, Homo sapiens
ggaatcagatgaggggcagagc

SEQ ID NO: 9116350 - DNA, 22 bp, Homo sapiens
ggaatcagatgaggggcagagc

SEQ ID NO: 9116351 - DNA, 22 bp, Homo sapiens
ggaatcagagcagaggctgtta

SEQ ID NO: 9116352 - DNA, 22 bp, Homo sapiens
ggaagagggaaccacgactgta

SEQ ID NO: 9116353 - DNA, 22 bp, Homo sapiens
ggaagagggaaccacgactgta

SEQ ID NO: 9116354 - DNA, 22 bp, Homo sapiens
ggaatgagctcggagcagaagg

SEQ ID NO: 9116355 - DNA, 18 bp, Homo sapiens
ggaatgtggacaggctgg

SEQ ID NO: 9116356 - DNA, 22 bp, Homo sapiens
ggaatggtccaagaaagcacgt

SEQ ID NO: 9116357 - DNA, 22 bp, Homo sapiens
ggacaaaatccaaacttcttag

SEQ ID NO: 9116358 - DNA, 22 bp, Homo sapiens
ggaattggtttcaagggaaagt

SEQ ID NO: 9116359 - DNA, 17 bp, Homo sapiens
ggacacagctcatggct

SEQ ID NO: 9116360 - DNA, 17 bp, Homo sapiens
ggacacagctcatggct

SEQ ID NO: 9116361 - DNA, 17 bp, Homo sapiens
ggacacagctcatggct

SEQ ID NO: 9116362 - DNA, 17 bp, Homo sapiens
ggacacagctcatggct

SEQ ID NO: 9116363 - DNA, 18 bp, Homo sapiens
ggacacagataggtacag

SEQ ID NO: 9116364 - DNA, 18 bp, Homo sapiens
ggacacagataggtacag

SEQ ID NO: 9116365 - DNA, 22 bp, Homo sapiens
ggacacagccacttagggtacc

SEQ ID NO: 9116366 - DNA, 22 bp, Homo sapiens
gctgtgctatatctctgagtgt

SEQ ID NO: 9116367 - DNA, 19 bp, Homo sapiens
gctgtgcctctctcctgct

SEQ ID NO: 9116368 - DNA, 22 bp, Homo sapiens
gctggggctgggctgaggaaga

SEQ ID NO: 9116369 - DNA, 19 bp, Homo sapiens
gctggggcctgaccagaca

SEQ ID NO: 9116370 - DNA, 22 bp, Homo sapiens
gctgggcttctcaatgctgcct

SEQ ID NO: 9116371 - DNA, 19 bp, Homo sapiens
gctgggcttgggtttgtag

SEQ ID NO: 9116372 - DNA, 22 bp, Homo sapiens
gctgggcttggtttccctgctt

SEQ ID NO: 9116373 - DNA, 22 bp, Homo sapiens
gctgggcttggtttccctgctt

SEQ ID NO: 9116374 - DNA, 22 bp, Homo sapiens
gctgtgggtttccaatcctgga

SEQ ID NO: 9116375 - DNA, 22 bp, Homo sapiens
gctgtgggttcctggcatttga

SEQ ID NO: 9116376 - DNA, 22 bp, Homo sapiens
gctgtgggtttccaatcctgga

SEQ ID NO: 9116377 - DNA, 22 bp, Homo sapiens
gctgtgggtccggaccccacgg

SEQ ID NO: 9116378 - DNA, 22 bp, Homo sapiens
gctgtgggtgctggctccaccc

SEQ ID NO: 9116379 - DNA, 22 bp, Homo sapiens
gctgtgggtacaaatacacaat

SEQ ID NO: 9116380 - DNA, 22 bp, Homo sapiens
gctgtggggagagaacacacaa

SEQ ID NO: 9116381 - DNA, 22 bp, Homo sapiens
gctgtgggccatggccaagtga

SEQ ID NO: 9116382 - DNA, 22 bp, Homo sapiens
gctgtgggtaaacgctgagggt

SEQ ID NO: 9116383 - DNA, 22 bp, Homo sapiens
gctgtgggccacacggctgagt

SEQ ID NO: 9116384 - DNA, 22 bp, Homo sapiens
gctgtgggacaggtccagccag

SEQ ID NO: 9116385 - DNA, 22 bp, Homo sapiens
gctgtggcggcagcagctggtg

SEQ ID NO: 9116386 - DNA, 19 bp, Homo sapiens
gctgtgggacagcagggtg

SEQ ID NO: 9116387 - DNA, 22 bp, Homo sapiens
gctgtggctgtacagagaccat

SEQ ID NO: 9116388 - DNA, 19 bp, Homo sapiens
gctgtgtcatttcttagga

SEQ ID NO: 9116389 - DNA, 22 bp, Homo sapiens
gctgtgtatcagatgccacggg

SEQ ID NO: 9116390 - DNA, 22 bp, Homo sapiens
gctgtgtcctcacacagccttt

SEQ ID NO: 9116391 - DNA, 22 bp, Homo sapiens
gctgtgtcctcacacagccttt

SEQ ID NO: 9116392 - DNA, 22 bp, Homo sapiens
gctgtgtgaaaactgggcctgg

SEQ ID NO: 9116393 - DNA, 22 bp, Homo sapiens
gctgtgtgaaaactgggcctgg

SEQ ID NO: 9116394 - DNA, 17 bp, Homo sapiens
gcttgccttgtcttcct

SEQ ID NO: 9116395 - DNA, 23 bp, Homo sapiens
gcttgcctggtgtgtggctgacc

SEQ ID NO: 9116396 - DNA, 22 bp, Homo sapiens
gcttgcctggcatttctggggc

SEQ ID NO: 9116397 - DNA, 22 bp, Homo sapiens
gcttgcctatctggtggtcgtt

SEQ ID NO: 9116398 - DNA, 22 bp, Homo sapiens
gcttgcctatctggtggtcgtt

SEQ ID NO: 9116399 - DNA, 22 bp, Homo sapiens
gcttgcattctggatctatggt

SEQ ID NO: 9116400 - DNA, 22 bp, Homo sapiens
gcttgcatgatatggcatctgg

SEQ ID NO: 9116401 - DNA, 22 bp, Homo sapiens
gcttgcagtggttggcatgacc

SEQ ID NO: 9116402 - DNA, 22 bp, Homo sapiens
gcttgcagtggtgatgcccggg

SEQ ID NO: 9116403 - DNA, 22 bp, Homo sapiens
gcttgcagcaggtgcttaggaa

SEQ ID NO: 9116404 - DNA, 22 bp, Homo sapiens
gcttgcagcaggtgcttaggaa

SEQ ID NO: 9116405 - DNA, 22 bp, Homo sapiens
gcttgagttttgggacaaagcc

SEQ ID NO: 9116406 - DNA, 22 bp, Homo sapiens
gcttgagttttgggacaaagcc

SEQ ID NO: 9116407 - DNA, 22 bp, Homo sapiens
gcttctttggcaaccctgacat

SEQ ID NO: 9116408 - DNA, 22 bp, Homo sapiens
gcttgactaggctctggcgaca

SEQ ID NO: 9116409 - DNA, 18 bp, Homo sapiens
gctttatttcttggggaa

SEQ ID NO: 9116410 - DNA, 18 bp, Homo sapiens
gctttatttcttggggaa

SEQ ID NO: 9116411 - DNA, 20 bp, Homo sapiens
gcttgctttgtctgatgggc

SEQ ID NO: 9116412 - DNA, 22 bp, Homo sapiens
gctgggctgtagtttgctgacc

SEQ ID NO: 9116413 - DNA, 22 bp, Homo sapiens
gctgggctgtagtttgctgacc

SEQ ID NO: 9116414 - DNA, 22 bp, Homo sapiens
gctgggcttcacagagccttta

SEQ ID NO: 9116415 - DNA, 23 bp, Homo sapiens
gctgggcttactctttcagtgag

SEQ ID NO: 9116416 - DNA, 22 bp, Homo sapiens
gctgggcttcacctccagagtt

SEQ ID NO: 9116417 - DNA, 22 bp, Homo sapiens
gctgggcttcacctccagagtt

SEQ ID NO: 9116418 - DNA, 22 bp, Homo sapiens
gctgggcttcacagagccttta

SEQ ID NO: 9116419 - DNA, 22 bp, Homo sapiens
gctggctttatggggcttgtgg

SEQ ID NO: 9116420 - DNA, 22 bp, Homo sapiens
gctggctttatcgtcagactcc

SEQ ID NO: 9116421 - DNA, 21 bp, Homo sapiens
gctggctttcctggatgtgca

SEQ ID NO: 9116422 - DNA, 21 bp, Homo sapiens
gctggctttattctgcgtttg

SEQ ID NO: 9116423 - DNA, 22 bp, Homo sapiens
gctggctttgcactgggtgcat

SEQ ID NO: 9116424 - DNA, 22 bp, Homo sapiens
gctggctttgatcttcccatct

SEQ ID NO: 9116425 - DNA, 22 bp, Homo sapiens
gctggctttgtcaagggcagca

SEQ ID NO: 9116426 - DNA, 22 bp, Homo sapiens
gctgggctggccgccgagatcg

SEQ ID NO: 9116427 - DNA, 22 bp, Homo sapiens
gctgggctggaaggccaaggca

SEQ ID NO: 9116428 - DNA, 22 bp, Homo sapiens
gctgggctggaaggccaaggca

SEQ ID NO: 9116429 - DNA, 22 bp, Homo sapiens
gctgggctggaaggccaaggca

SEQ ID NO: 9116430 - DNA, 22 bp, Homo sapiens
gctgggaacacagccatgagag

SEQ ID NO: 9116431 - DNA, 22 bp, Homo sapiens
gctggcttttgaagtctagcta

SEQ ID NO: 9116432 - DNA, 22 bp, Homo sapiens
gctggcttttgaagtctagcta

SEQ ID NO: 9116433 - DNA, 22 bp, Homo sapiens
gctggctttgtggtctctcctc

SEQ ID NO: 9116434 - DNA, 22 bp, Homo sapiens
gctggctttgtcaagggcagca

SEQ ID NO: 9116435 - DNA, 21 bp, Homo sapiens
gctggctggctgaccggcctt

SEQ ID NO: 9116436 - DNA, 22 bp, Homo sapiens
gctggctgtggcttaagcaaac

SEQ ID NO: 9116437 - DNA, 22 bp, Homo sapiens
gctggctgttgaataatggcat

SEQ ID NO: 9116438 - DNA, 22 bp, Homo sapiens
gctggctgtgtttcatctctga

SEQ ID NO: 9116439 - DNA, 22 bp, Homo sapiens
gctggctgtgtttcatctctga

SEQ ID NO: 9116440 - DNA, 22 bp, Homo sapiens
gctggctgtgttccttctgcca

SEQ ID NO: 9116441 - DNA, 22 bp, Homo sapiens
gctggctgtgttccttctgcca

SEQ ID NO: 9116442 - DNA, 22 bp, Homo sapiens
gctggctgtgttccttctgcca

SEQ ID NO: 9116443 - DNA, 22 bp, Homo sapiens
gctggcttgacagaggcctggg

SEQ ID NO: 9116444 - DNA, 22 bp, Homo sapiens
gctggcttgatagtttctgctt

SEQ ID NO: 9116445 - DNA, 22 bp, Homo sapiens
gctggcttgtcccaggacaaag

SEQ ID NO: 9116446 - DNA, 22 bp, Homo sapiens
gctggcttgtcccaggacaaag

SEQ ID NO: 9116447 - DNA, 22 bp, Homo sapiens
gctggcttccttctgcagctag

SEQ ID NO: 9116448 - DNA, 22 bp, Homo sapiens
gctggcttccttctgcagctag

SEQ ID NO: 9116449 - DNA, 22 bp, Homo sapiens
gctggcttgacagaggcctggg

SEQ ID NO: 9116450 - DNA, 22 bp, Homo sapiens
gctggcttgacagaggcctggg

SEQ ID NO: 9116451 - DNA, 17 bp, Homo sapiens
gctggcttctccttgct

SEQ ID NO: 9116452 - DNA, 22 bp, Homo sapiens
gctggctgttggaggtacctgc

SEQ ID NO: 9116453 - DNA, 22 bp, Homo sapiens
gctggcttaatagggatgggct

SEQ ID NO: 9116454 - DNA, 21 bp, Homo sapiens
gctggcttcctgagggctgag

SEQ ID NO: 9116455 - DNA, 22 bp, Homo sapiens
gctggcttccatcagagggtga

SEQ ID NO: 9116456 - DNA, 22 bp, Homo sapiens
gctggcttccctacctgcacct

SEQ ID NO: 9116457 - DNA, 22 bp, Homo sapiens
gctggagaacccaggaggaaga

SEQ ID NO: 9116458 - DNA, 22 bp, Homo sapiens
gctggagacctcagagaaccca

SEQ ID NO: 9116459 - DNA, 22 bp, Homo sapiens
gctgctttataatctcggcaga

SEQ ID NO: 9116460 - DNA, 20 bp, Homo sapiens
gctgctttcaaatgacacgt

SEQ ID NO: 9116461 - DNA, 20 bp, Homo sapiens
gctgctttcaaatgacacgt

SEQ ID NO: 9116462 - DNA, 22 bp, Homo sapiens
gctgctttagaattgaaacaga

SEQ ID NO: 9116463 - DNA, 22 bp, Homo sapiens
gctgctttagacaggagaagca

SEQ ID NO: 9116464 - DNA, 22 bp, Homo sapiens
gctgctttactgaagagatatg

SEQ ID NO: 9116465 - DNA, 22 bp, Homo sapiens
gctggctgcgtcatcacagggc

SEQ ID NO: 9116466 - DNA, 22 bp, Homo sapiens
gctggagagataggcatggggt

SEQ ID NO: 9116467 - DNA, 22 bp, Homo sapiens
gctggctgctaggacagctaca

SEQ ID NO: 9116468 - DNA, 22 bp, Homo sapiens
gctggctgctaggacagctaca

SEQ ID NO: 9116469 - DNA, 22 bp, Homo sapiens
gctggctgctgttgagacttgt

SEQ ID NO: 9116470 - DNA, 22 bp, Homo sapiens
gctggctgcgtcatcacagggc

SEQ ID NO: 9116471 - DNA, 22 bp, Homo sapiens
gctggctgcgtcatcacagggc

SEQ ID NO: 9116472 - DNA, 22 bp, Homo sapiens
gctggctgctaggacagctaca

SEQ ID NO: 9116473 - DNA, 22 bp, Homo sapiens
gctggctggaatgggagaagaa

SEQ ID NO: 9116474 - DNA, 22 bp, Homo sapiens
gctggctggaactagcagttgg

SEQ ID NO: 9116475 - DNA, 22 bp, Homo sapiens
gctggctggaatgggagaagaa

SEQ ID NO: 9116476 - DNA, 22 bp, Homo sapiens
gctggctggaatgggagaagaa

SEQ ID NO: 9116477 - DNA, 19 bp, Homo sapiens
gctggctggaggagggaca

SEQ ID NO: 9116478 - DNA, 22 bp, Homo sapiens
gctggctggaggtgaggaagaa

SEQ ID NO: 9116479 - DNA, 23 bp, Homo sapiens
gctggctggcagtaaaggttgtt

SEQ ID NO: 9116480 - DNA, 22 bp, Homo sapiens
gctggctggcacgttcgcacgt

SEQ ID NO: 9116481 - DNA, 22 bp, Homo sapiens
gctggctggcgggtgcgtcctc

SEQ ID NO: 9116482 - DNA, 22 bp, Homo sapiens
gctggctggagtgagctaccct

SEQ ID NO: 9116483 - DNA, 22 bp, Homo sapiens
gctggctggagtgagctaccct

SEQ ID NO: 9116484 - DNA, 22 bp, Homo sapiens
gctggctggaggtgaggaagaa

SEQ ID NO: 9116485 - DNA, 22 bp, Homo sapiens
gcctctgtggctcagccttgct

SEQ ID NO: 9116486 - DNA, 22 bp, Homo sapiens
gcctctgtcatagctcatgtga

SEQ ID NO: 9116487 - DNA, 22 bp, Homo sapiens
gcctctgtcatagctcatgtga

SEQ ID NO: 9116488 - DNA, 22 bp, Homo sapiens
gcctgagattggacattattta

SEQ ID NO: 9116489 - DNA, 18 bp, Homo sapiens
gcctctgttgcttgcctg

SEQ ID NO: 9116490 - DNA, 22 bp, Homo sapiens
gcctgagcccaggtgtgcagag

SEQ ID NO: 9116491 - DNA, 22 bp, Homo sapiens
gcctgagcccaggtgtgcagag

SEQ ID NO: 9116492 - DNA, 19 bp, Homo sapiens
gcctgagccagccatgcaa

SEQ ID NO: 9116493 - DNA, 22 bp, Homo sapiens
gcctgagcaggcgtggaccatg

SEQ ID NO: 9116494 - DNA, 22 bp, Homo sapiens
gcctgagcaggcgtggaccatg

SEQ ID NO: 9116495 - DNA, 22 bp, Homo sapiens
gcctctggggcagctgagtcat

SEQ ID NO: 9116496 - DNA, 22 bp, Homo sapiens
gcctctggggcagctgagtcat

SEQ ID NO: 9116497 - DNA, 22 bp, Homo sapiens
gcctctggggtggagcccagca

SEQ ID NO: 9116498 - DNA, 22 bp, Homo sapiens
gcctctgggttggtgacaggct

SEQ ID NO: 9116499 - DNA, 22 bp, Homo sapiens
gcctctggtccctcatgctgtg

SEQ ID NO: 9116500 - DNA, 22 bp, Homo sapiens
gcctctggtccctcatgctgtg

SEQ ID NO: 9116501 - DNA, 22 bp, Homo sapiens
gcctctggtccctcatgctgtg

SEQ ID NO: 9116502 - DNA, 22 bp, Homo sapiens
gccttggctgatgtgcgaatga

SEQ ID NO: 9116503 - DNA, 22 bp, Homo sapiens
gccttggctgccaagctgctga

SEQ ID NO: 9116504 - DNA, 22 bp, Homo sapiens
gccttggctgttggagcttgat

SEQ ID NO: 9116505 - DNA, 22 bp, Homo sapiens
gccttggctgccaagctgctga

SEQ ID NO: 9116506 - DNA, 22 bp, Homo sapiens
gccttggctgatgtgcgaatga

SEQ ID NO: 9116507 - DNA, 22 bp, Homo sapiens
gccttggctccagccctttccg

SEQ ID NO: 9116508 - DNA, 23 bp, Homo sapiens
gccttggcgatccgtggggcatc

SEQ ID NO: 9116509 - DNA, 22 bp, Homo sapiens
gccttggccttcctaggcctga

SEQ ID NO: 9116510 - DNA, 22 bp, Homo sapiens
gccttggcccacagtgctcctg

SEQ ID NO: 9116511 - DNA, 22 bp, Homo sapiens
gccttggccttcctaggcctga

SEQ ID NO: 9116512 - DNA, 19 bp, Homo sapiens
gccttggcattctctgctt

SEQ ID NO: 9116513 - DNA, 22 bp, Homo sapiens
gccttggcaggctgataacatg

SEQ ID NO: 9116514 - DNA, 22 bp, Homo sapiens
gccttggccaacaccttgcaaa

SEQ ID NO: 9116515 - DNA, 19 bp, Homo sapiens
gccttggcattctctgctt

SEQ ID NO: 9116516 - DNA, 22 bp, Homo sapiens
gccttgggccagctgctctgga

SEQ ID NO: 9116517 - DNA, 22 bp, Homo sapiens
gccttgggaaagtgggaggaga

SEQ ID NO: 9116518 - DNA, 22 bp, Homo sapiens
gccttggctgttggagcttgat

SEQ ID NO: 9116519 - DNA, 22 bp, Homo sapiens
gccttgggattcttggatgctc

SEQ ID NO: 9116520 - DNA, 20 bp, Homo sapiens
gcctgagctattgccaggat

SEQ ID NO: 9116521 - DNA, 22 bp, Homo sapiens
gcctgagccgcctgagcggcgg

SEQ ID NO: 9116522 - DNA, 22 bp, Homo sapiens
gcctgagctactagggagtctg

SEQ ID NO: 9116523 - DNA, 20 bp, Homo sapiens
gcctgagctccgcctcctgt

SEQ ID NO: 9116524 - DNA, 22 bp, Homo sapiens
gccttgccgctcagcagtgggg

SEQ ID NO: 9116525 - DNA, 22 bp, Homo sapiens
gccttggagatcactgctcatg

SEQ ID NO: 9116526 - DNA, 22 bp, Homo sapiens
gccttggagatcactgctcatg

SEQ ID NO: 9116527 - DNA, 23 bp, Homo sapiens
gccttggagaagtcactcaggga

SEQ ID NO: 9116528 - DNA, 22 bp, Homo sapiens
gccttggactcgggtggactca

SEQ ID NO: 9116529 - DNA, 22 bp, Homo sapiens
gccttggaaagctggagcagtt

SEQ ID NO: 9116530 - DNA, 22 bp, Homo sapiens
gccttggactaccactcccaca

SEQ ID NO: 9116531 - DNA, 22 bp, Homo sapiens
gcctttgtaactcttttattgt

SEQ ID NO: 9116532 - DNA, 21 bp, Homo sapiens
gcctttggtttcttgtcctgc

SEQ ID NO: 9116533 - DNA, 19 bp, Homo sapiens
gcctttgttccttttgtct

SEQ ID NO: 9116534 - DNA, 22 bp, Homo sapiens
gcggggggcaggcagtacgttg

SEQ ID NO: 9116535 - DNA, 18 bp, Homo sapiens
gcctttggactgctccca

SEQ ID NO: 9116536 - DNA, 22 bp, Homo sapiens
gcctttggactgaggtagtcag

SEQ ID NO: 9116537 - DNA, 22 bp, Homo sapiens
gcctttggagatgtcataggat

SEQ ID NO: 9116538 - DNA, 22 bp, Homo sapiens
gcctttggagatgtcataggat

SEQ ID NO: 9116539 - DNA, 22 bp, Homo sapiens
gcctttggagaatccagtcatg

SEQ ID NO: 9116540 - DNA, 22 bp, Homo sapiens
gcctttggtgacaggcatgtgt

SEQ ID NO: 9116541 - DNA, 19 bp, Homo sapiens
gcctttgggcgttgttggg

SEQ ID NO: 9116542 - DNA, 22 bp, Homo sapiens
gcctttggatatattcagggat

SEQ ID NO: 9116543 - DNA, 22 bp, Homo sapiens
gcctttggatggtttttctatt

SEQ ID NO: 9116544 - DNA, 22 bp, Homo sapiens
gcctttggctctgtctgacctg

SEQ ID NO: 9116545 - DNA, 22 bp, Homo sapiens
gcctttgctgtgacaatgctgg

SEQ ID NO: 9116546 - DNA, 22 bp, Homo sapiens
gctacagagctctgtgaagaga

SEQ ID NO: 9116547 - DNA, 22 bp, Homo sapiens
gctccctgcctacacggacctt

SEQ ID NO: 9116548 - DNA, 22 bp, Homo sapiens
gctccctgcactctgcagccct

SEQ ID NO: 9116549 - DNA, 22 bp, Homo sapiens
gctccctgcactctgcagccct

SEQ ID NO: 9116550 - DNA, 17 bp, Homo sapiens
gctccctgaggacagct

SEQ ID NO: 9116551 - DNA, 17 bp, Homo sapiens
gctccctgaggacagct

SEQ ID NO: 9116552 - DNA, 17 bp, Homo sapiens
gctccctgaggacagct

SEQ ID NO: 9116553 - DNA, 22 bp, Homo sapiens
gctccctggtattgctgccact

SEQ ID NO: 9116554 - DNA, 22 bp, Homo sapiens
gctccctggtagccatgctctc

SEQ ID NO: 9116555 - DNA, 20 bp, Homo sapiens
gctccctggtagaaatgttt

SEQ ID NO: 9116556 - DNA, 21 bp, Homo sapiens
gctccctggctgtgtgacctg

SEQ ID NO: 9116557 - DNA, 20 bp, Homo sapiens
gctccaggtcagagaggacg

SEQ ID NO: 9116558 - DNA, 22 bp, Homo sapiens
gctccagtggactgggggaggc

SEQ ID NO: 9116559 - DNA, 22 bp, Homo sapiens
gctcccacaaccttcttgctcc

SEQ ID NO: 9116560 - DNA, 22 bp, Homo sapiens
gctcccacaaccttcttgctcc

SEQ ID NO: 9116561 - DNA, 22 bp, Homo sapiens
gctcccaactcaggcctcctcc

SEQ ID NO: 9116562 - DNA, 22 bp, Homo sapiens
gctccaggtgtcccaggtaaaa

SEQ ID NO: 9116563 - DNA, 22 bp, Homo sapiens
gctcccaccaggcagacctacc

SEQ ID NO: 9116564 - DNA, 22 bp, Homo sapiens
gctcccaccgccgctatgggta

SEQ ID NO: 9116565 - DNA, 22 bp, Homo sapiens
gctcccaccgccgctatgggta

SEQ ID NO: 9116566 - DNA, 22 bp, Homo sapiens
gctcccacctccagcctgagtt

SEQ ID NO: 9116567 - DNA, 22 bp, Homo sapiens
gctcccacctccagcctgagtt

SEQ ID NO: 9116568 - DNA, 22 bp, Homo sapiens
gctcccacctttgctatcagta

SEQ ID NO: 9116569 - DNA, 22 bp, Homo sapiens
gctcccaccttaaccttcacat

SEQ ID NO: 9116570 - DNA, 22 bp, Homo sapiens
gctccctgaaaagaacaaagtc

SEQ ID NO: 9116571 - DNA, 22 bp, Homo sapiens
gctcccagaaccaaggctgggg

SEQ ID NO: 9116572 - DNA, 22 bp, Homo sapiens
gctcccagaaccaaggctgggg

SEQ ID NO: 9116573 - DNA, 22 bp, Homo sapiens
gctcccagaaccaaggctgggg

SEQ ID NO: 9116574 - DNA, 22 bp, Homo sapiens
gctcccagaaccaaggctgggg

SEQ ID NO: 9116575 - DNA, 22 bp, Homo sapiens
gctcccactgcagccctgagcc

SEQ ID NO: 9116576 - DNA, 22 bp, Homo sapiens
gctcccacgcaattcttttcag

SEQ ID NO: 9116577 - DNA, 22 bp, Homo sapiens
gctccagggacccaagagaaaa

SEQ ID NO: 9116578 - DNA, 22 bp, Homo sapiens
gctccaggataataaagttgtt

SEQ ID NO: 9116579 - DNA, 22 bp, Homo sapiens
gctccagggtggatgacaattc

SEQ ID NO: 9116580 - DNA, 22 bp, Homo sapiens
gctccagggtcagctcagaact

SEQ ID NO: 9116581 - DNA, 22 bp, Homo sapiens
gctcagagttaaatatagtgct

SEQ ID NO: 9116582 - DNA, 23 bp, Homo sapiens
gctcagatgccctaggaggtggc

SEQ ID NO: 9116583 - DNA, 22 bp, Homo sapiens
gctcagagttaattggatgggt

SEQ ID NO: 9116584 - DNA, 19 bp, Homo sapiens
gctaccaaggcaagacaaa

SEQ ID NO: 9116585 - DNA, 22 bp, Homo sapiens
gctcagagcttgaagttccact

SEQ ID NO: 9116586 - DNA, 22 bp, Homo sapiens
gctcagaggagcatcataagga

SEQ ID NO: 9116587 - DNA, 22 bp, Homo sapiens
gctcagaggccactgttggaaa

SEQ ID NO: 9116588 - DNA, 22 bp, Homo sapiens
gctcagagggaacaaggggctg

SEQ ID NO: 9116589 - DNA, 22 bp, Homo sapiens
gctcagagggaacaaggggctg

SEQ ID NO: 9116590 - DNA, 23 bp, Homo sapiens
gctcagaggtttttctctggatg

SEQ ID NO: 9116591 - DNA, 22 bp, Homo sapiens
gctcagaggttgttcttgggtt

SEQ ID NO: 9116592 - DNA, 22 bp, Homo sapiens
gctcagaggttgttcttgggtt

SEQ ID NO: 9116593 - DNA, 22 bp, Homo sapiens
gctcagagggttttggccaagt

SEQ ID NO: 9116594 - DNA, 19 bp, Homo sapiens
gctcagagggccctgtgct

SEQ ID NO: 9116595 - DNA, 22 bp, Homo sapiens
gctcagagtggcctggctaggg

SEQ ID NO: 9116596 - DNA, 17 bp, Homo sapiens
gctcagagtacacgtgt

SEQ ID NO: 9116597 - DNA, 21 bp, Homo sapiens
gctcagagtattgcactgttt

SEQ ID NO: 9116598 - DNA, 22 bp, Homo sapiens
gctgctattagtcttctattca

SEQ ID NO: 9116599 - DNA, 20 bp, Homo sapiens
gctgcctgtttctgtaagta

SEQ ID NO: 9116600 - DNA, 22 bp, Homo sapiens
gctgccttatgtctattagtat

SEQ ID NO: 9116601 - DNA, 22 bp, Homo sapiens
gctgcctgtggcccttctgggt

SEQ ID NO: 9116602 - DNA, 22 bp, Homo sapiens
gctgcctgtggcccttctgggt

SEQ ID NO: 9116603 - DNA, 22 bp, Homo sapiens
gctgcctgtgtggccactcact

SEQ ID NO: 9116604 - DNA, 22 bp, Homo sapiens
gctgcctgtgtggccactcact

SEQ ID NO: 9116605 - DNA, 22 bp, Homo sapiens
gctgctgtctggtctgagggct

SEQ ID NO: 9116606 - DNA, 22 bp, Homo sapiens
gctgctgtctggtctgagggct

SEQ ID NO: 9116607 - DNA, 22 bp, Homo sapiens
gctgcttcctttcctgctgacc

SEQ ID NO: 9116608 - DNA, 22 bp, Homo sapiens
gctgcttcagggacgtgccagc

SEQ ID NO: 9116609 - DNA, 22 bp, Homo sapiens
gctgcttgattaggttgacact

SEQ ID NO: 9116610 - DNA, 22 bp, Homo sapiens
gctgctttaactggacggctcc

SEQ ID NO: 9116611 - DNA, 22 bp, Homo sapiens
gctgctttaaaatcagcatagc

SEQ ID NO: 9116612 - DNA, 22 bp, Homo sapiens
gctgcttcctttcctgctgacc

SEQ ID NO: 9116613 - DNA, 22 bp, Homo sapiens
gctgcttctctgatggagtcca

SEQ ID NO: 9116614 - DNA, 22 bp, Homo sapiens
gctgcctcactccagcccaata

SEQ ID NO: 9116615 - DNA, 22 bp, Homo sapiens
gctgccctgtggtccagcaggt

SEQ ID NO: 9116616 - DNA, 22 bp, Homo sapiens
gctgcctcaggcacctcctggc

SEQ ID NO: 9116617 - DNA, 22 bp, Homo sapiens
gctgcccattccactggatggt

SEQ ID NO: 9116618 - DNA, 22 bp, Homo sapiens
gctgccctaatatcacatgtta

SEQ ID NO: 9116619 - DNA, 22 bp, Homo sapiens
gctgcccagggtggagccggct

SEQ ID NO: 9116620 - DNA, 22 bp, Homo sapiens
gctgcccagttctgctgctgcc

SEQ ID NO: 9116621 - DNA, 22 bp, Homo sapiens
gctgcccagcaggccccagggg

SEQ ID NO: 9116622 - DNA, 22 bp, Homo sapiens
gctgcccagcaggccccagggg

SEQ ID NO: 9116623 - DNA, 22 bp, Homo sapiens
gctgcccacaaccccgtgtcta

SEQ ID NO: 9116624 - DNA, 22 bp, Homo sapiens
gctgagggcatgtgtggcgact

SEQ ID NO: 9116625 - DNA, 22 bp, Homo sapiens
gctgagggcatgtgtggcgact

SEQ ID NO: 9116626 - DNA, 22 bp, Homo sapiens
gctgagggcagcctcctaggtc

SEQ ID NO: 9116627 - DNA, 22 bp, Homo sapiens
gctgagggctgtaacagcagag

SEQ ID NO: 9116628 - DNA, 22 bp, Homo sapiens
gctgcccaatggtagtgtcttt

SEQ ID NO: 9116629 - DNA, 22 bp, Homo sapiens
gctgagggctgtaacagcagag

SEQ ID NO: 9116630 - DNA, 22 bp, Homo sapiens
gctctggggcccagggatcaca

SEQ ID NO: 9116631 - DNA, 22 bp, Homo sapiens
gctctggggatgcttctgccgt

SEQ ID NO: 9116632 - DNA, 22 bp, Homo sapiens
gctgaataggcacagagggcat

SEQ ID NO: 9116633 - DNA, 22 bp, Homo sapiens
gctgaataggggtcccaaagat

SEQ ID NO: 9116634 - DNA, 22 bp, Homo sapiens
gctctgggctgaatcatttatc

SEQ ID NO: 9116635 - DNA, 22 bp, Homo sapiens
gctctgggctgccctctggaca

SEQ ID NO: 9116636 - DNA, 22 bp, Homo sapiens
gctctgggccgggcaccagcct

SEQ ID NO: 9116637 - DNA, 22 bp, Homo sapiens
gctctgggccatcctggccggg

SEQ ID NO: 9116638 - DNA, 22 bp, Homo sapiens
gctctgggattaccagccttag

SEQ ID NO: 9116639 - DNA, 22 bp, Homo sapiens
gctctgggattaccagccttag

SEQ ID NO: 9116640 - DNA, 22 bp, Homo sapiens
gctctgggattaccagccttag

SEQ ID NO: 9116641 - DNA, 22 bp, Homo sapiens
gctctgggattaccagccttag

SEQ ID NO: 9116642 - DNA, 22 bp, Homo sapiens
gctctgggaattcagaaagcct

SEQ ID NO: 9116643 - DNA, 20 bp, Homo sapiens
gctctgggagggatgtgatg

SEQ ID NO: 9116644 - DNA, 22 bp, Homo sapiens
gctctgggaagtcctttaccat

SEQ ID NO: 9116645 - DNA, 22 bp, Homo sapiens
gctctgggaaggatcgtagtga

SEQ ID NO: 9116646 - DNA, 22 bp, Homo sapiens
gctctgggaactgactgccttc

SEQ ID NO: 9116647 - DNA, 22 bp, Homo sapiens
gctctggctcaaaccaccggct

SEQ ID NO: 9116648 - DNA, 22 bp, Homo sapiens
gctctggctcaaaccaccggct

SEQ ID NO: 9116649 - DNA, 18 bp, Homo sapiens
gctctggctcacctccag

SEQ ID NO: 9116650 - DNA, 18 bp, Homo sapiens
gctctggctcacctccag

SEQ ID NO: 9116651 - DNA, 18 bp, Homo sapiens
gctctggctcacctccag

SEQ ID NO: 9116652 - DNA, 18 bp, Homo sapiens
gctctggctcacctccag

SEQ ID NO: 9116653 - DNA, 22 bp, Homo sapiens
gctctggcttggggcactcgtc

SEQ ID NO: 9116654 - DNA, 22 bp, Homo sapiens
gctctgggaactgactgccttc

SEQ ID NO: 9116655 - DNA, 22 bp, Homo sapiens
gctcctctattccccacatttt

SEQ ID NO: 9116656 - DNA, 22 bp, Homo sapiens
gctctggctagttacctcttac

SEQ ID NO: 9116657 - DNA, 22 bp, Homo sapiens
gctcctctcccagagctgcagg

SEQ ID NO: 9116658 - DNA, 22 bp, Homo sapiens
gctccctgttctcagccatgat

SEQ ID NO: 9116659 - DNA, 22 bp, Homo sapiens
gctccctgttctcagccatgat

SEQ ID NO: 9116660 - DNA, 22 bp, Homo sapiens
gctgagactgacatgaagaggt

SEQ ID NO: 9116661 - DNA, 22 bp, Homo sapiens
gctgagacttccactgccatct

SEQ ID NO: 9116662 - DNA, 22 bp, Homo sapiens
gctgagagatcaaggcaggatt

SEQ ID NO: 9116663 - DNA, 22 bp, Homo sapiens
gctgagagatcaaggcaggatt

SEQ ID NO: 9116664 - DNA, 22 bp, Homo sapiens
gctgacacttagaagtgccctg

SEQ ID NO: 9116665 - DNA, 22 bp, Homo sapiens
gctgagaatgttcctactggta

SEQ ID NO: 9116666 - DNA, 22 bp, Homo sapiens
gctgagagcacatagaaggggc

SEQ ID NO: 9116667 - DNA, 22 bp, Homo sapiens
gctgagagcaaagcatgtctag

SEQ ID NO: 9116668 - DNA, 22 bp, Homo sapiens
gctgagagcaaggacaaagcat

SEQ ID NO: 9116669 - DNA, 17 bp, Homo sapiens
gctgagaggcagcacag

SEQ ID NO: 9116670 - DNA, 21 bp, Homo sapiens
gctgagaggttgggaagttca

SEQ ID NO: 9116671 - DNA, 22 bp, Homo sapiens
gctgagaggcagccagaccctc

SEQ ID NO: 9116672 - DNA, 22 bp, Homo sapiens
gctgagagtccaggaaaacatc

SEQ ID NO: 9116673 - DNA, 22 bp, Homo sapiens
gctgaggctcaatccccttctg

SEQ ID NO: 9116674 - DNA, 22 bp, Homo sapiens
gctgaggctcctcgggaggaca

SEQ ID NO: 9116675 - DNA, 22 bp, Homo sapiens
gctgaggctcctcgggaggaca

SEQ ID NO: 9116676 - DNA, 22 bp, Homo sapiens
gctgaggctcaatccccttctg

SEQ ID NO: 9116677 - DNA, 22 bp, Homo sapiens
gctgaggctcaagtcatgggtc

SEQ ID NO: 9116678 - DNA, 22 bp, Homo sapiens
gctgaggctgggagcagcctgt

SEQ ID NO: 9116679 - DNA, 22 bp, Homo sapiens
gctgaggctcctcgggaggaca

SEQ ID NO: 9116680 - DNA, 22 bp, Homo sapiens
gctgaggctgggagcagcctgt

SEQ ID NO: 9116681 - DNA, 22 bp, Homo sapiens
gctgaggctgggagcagcctgt

SEQ ID NO: 9116682 - DNA, 22 bp, Homo sapiens
gctgaggcttagctaaaaattt

SEQ ID NO: 9116683 - DNA, 22 bp, Homo sapiens
gctgagggaggctgaactgagt

SEQ ID NO: 9116684 - DNA, 22 bp, Homo sapiens
gctgagggaggctgaactgagt

SEQ ID NO: 9116685 - DNA, 22 bp, Homo sapiens
gctgaggccaggccccaccgga

SEQ ID NO: 9116686 - DNA, 22 bp, Homo sapiens
gctgaggccagtttaatgagga

SEQ ID NO: 9116687 - DNA, 22 bp, Homo sapiens
gctgaggccaggccccaccgga

SEQ ID NO: 9116688 - DNA, 22 bp, Homo sapiens
gctgaggccccagggtgatggg

SEQ ID NO: 9116689 - DNA, 22 bp, Homo sapiens
gctgaggcctcagaaggctgag

SEQ ID NO: 9116690 - DNA, 22 bp, Homo sapiens
gctgaggcctcagaaggctgag

SEQ ID NO: 9116691 - DNA, 22 bp, Homo sapiens
gctgaggcctcagaaggctgag

SEQ ID NO: 9116692 - DNA, 22 bp, Homo sapiens
gctgaggcggaaggattgctag

SEQ ID NO: 9116693 - DNA, 22 bp, Homo sapiens
gctgaggctcaagtcatgggtc

SEQ ID NO: 9116694 - DNA, 23 bp, Homo sapiens
gcacatactacacagaaaatggc

SEQ ID NO: 9116695 - DNA, 22 bp, Homo sapiens
gcacatacgtcagtggctgtca

SEQ ID NO: 9116696 - DNA, 22 bp, Homo sapiens
gcacatatgtaaatagctgcct

SEQ ID NO: 9116697 - DNA, 19 bp, Homo sapiens
gcagacaggtccagagagg

SEQ ID NO: 9116698 - DNA, 22 bp, Homo sapiens
gcacagtgtaccacagtcccta

SEQ ID NO: 9116699 - DNA, 21 bp, Homo sapiens
gcacagtgccaggcacacagt

SEQ ID NO: 9116700 - DNA, 18 bp, Homo sapiens
gcagagcagaagctcaag

SEQ ID NO: 9116701 - DNA, 18 bp, Homo sapiens
gcagagcagaagctcaag

SEQ ID NO: 9116702 - DNA, 22 bp, Homo sapiens
gcagagcaccctgcagtggtat

SEQ ID NO: 9116703 - DNA, 22 bp, Homo sapiens
gcagagaagatgcccaggcttc

SEQ ID NO: 9116704 - DNA, 22 bp, Homo sapiens
gcagagaagatgcccaggcttc

SEQ ID NO: 9116705 - DNA, 22 bp, Homo sapiens
gcagagaacccagcagattggc

SEQ ID NO: 9116706 - DNA, 22 bp, Homo sapiens
gcagagaacccagcagattggc

SEQ ID NO: 9116707 - DNA, 22 bp, Homo sapiens
gcagagaaagttttgtcctcag

SEQ ID NO: 9116708 - DNA, 22 bp, Homo sapiens
gcagacatgggatctattcaca

SEQ ID NO: 9116709 - DNA, 22 bp, Homo sapiens
gcagacatgaccaccaaccagg

SEQ ID NO: 9116710 - DNA, 22 bp, Homo sapiens
gcagacatgtgttctaacagga

SEQ ID NO: 9116711 - DNA, 21 bp, Homo sapiens
gcagactgccctgctgtcccc

SEQ ID NO: 9116712 - DNA, 22 bp, Homo sapiens
gcagacgtcaccgagtcgatgg

SEQ ID NO: 9116713 - DNA, 22 bp, Homo sapiens
gcagaccctgaactgggcatgg

SEQ ID NO: 9116714 - DNA, 22 bp, Homo sapiens
gcagacctcaggacatcattag

SEQ ID NO: 9116715 - DNA, 22 bp, Homo sapiens
gcagactggtcttcagccttgg

SEQ ID NO: 9116716 - DNA, 22 bp, Homo sapiens
gcagactgtatcaatgtcagta

SEQ ID NO: 9116717 - DNA, 22 bp, Homo sapiens
gcagactgtacctggaagaggg

SEQ ID NO: 9116718 - DNA, 22 bp, Homo sapiens
gcagactgtacctggaagaggg

SEQ ID NO: 9116719 - DNA, 21 bp, Homo sapiens
gcagactgccctgctgtcccc

SEQ ID NO: 9116720 - DNA, 22 bp, Homo sapiens
gcagactgcgagcgtgctggtg

SEQ ID NO: 9116721 - DNA, 22 bp, Homo sapiens
gcagaggtgaccagcagcaggg

SEQ ID NO: 9116722 - DNA, 22 bp, Homo sapiens
gcagaggtctcttcaaaataat

SEQ ID NO: 9116723 - DNA, 22 bp, Homo sapiens
gcagaggtgaccagcagcaggg

SEQ ID NO: 9116724 - DNA, 22 bp, Homo sapiens
gcagaggtctagcaccaagaat

SEQ ID NO: 9116725 - DNA, 22 bp, Homo sapiens
gcagaggtctagcaccaagaat

SEQ ID NO: 9116726 - DNA, 22 bp, Homo sapiens
gcagagtggtttcagagttgag

SEQ ID NO: 9116727 - DNA, 22 bp, Homo sapiens
gcagatggactgtatgacctga

SEQ ID NO: 9116728 - DNA, 22 bp, Homo sapiens
gcagaggcatttctgacgctgc

SEQ ID NO: 9116729 - DNA, 22 bp, Homo sapiens
gcagaggccaggccaccagcaa

SEQ ID NO: 9116730 - DNA, 22 bp, Homo sapiens
gcagaggccaggccaccagcaa

SEQ ID NO: 9116731 - DNA, 22 bp, Homo sapiens
gcagaggggaagctgaggaatt

SEQ ID NO: 9116732 - DNA, 22 bp, Homo sapiens
gcagagggggtacttcggccct

SEQ ID NO: 9116733 - DNA, 22 bp, Homo sapiens
gcagagggtcctgtgccagcag

SEQ ID NO: 9116734 - DNA, 22 bp, Homo sapiens
gcagagggtcctgtgccagcag

SEQ ID NO: 9116735 - DNA, 22 bp, Homo sapiens
gcagaggtcctagccaggagtc

SEQ ID NO: 9116736 - DNA, 22 bp, Homo sapiens
gcagaggtcctagccaggagtc

SEQ ID NO: 9116737 - DNA, 22 bp, Homo sapiens
gcagagcaggaaggaagtcagg

SEQ ID NO: 9116738 - DNA, 22 bp, Homo sapiens
gcagagcagagcctgcattggc

SEQ ID NO: 9116739 - DNA, 22 bp, Homo sapiens
gcagagcagaggtgcaggttgg

SEQ ID NO: 9116740 - DNA, 22 bp, Homo sapiens
gcagaggagtgattatgccgtg

SEQ ID NO: 9116741 - DNA, 22 bp, Homo sapiens
gcagagcagtactctcttgact

SEQ ID NO: 9116742 - DNA, 22 bp, Homo sapiens
gcagaggaggacccaggaatta

SEQ ID NO: 9116743 - DNA, 22 bp, Homo sapiens
gcagaggcacagccccagatga

SEQ ID NO: 9116744 - DNA, 22 bp, Homo sapiens
gcagaggatcaggctctggaaa

SEQ ID NO: 9116745 - DNA, 22 bp, Homo sapiens
gcagaggagtgattatgccgtg

SEQ ID NO: 9116746 - DNA, 22 bp, Homo sapiens
gcagaggatagcatatgaacct

SEQ ID NO: 9116747 - DNA, 22 bp, Homo sapiens
gcagaggatagcatatgaacct

SEQ ID NO: 9116748 - DNA, 21 bp, Homo sapiens
gcagaggcacggcaccaaggg

SEQ ID NO: 9116749 - DNA, 22 bp, Homo sapiens
gcagaggcacagccccagatga

SEQ ID NO: 9116750 - DNA, 22 bp, Homo sapiens
gcagaggcagggccctcctcca

SEQ ID NO: 9116751 - DNA, 22 bp, Homo sapiens
gcaaagacaaattagaactcct

SEQ ID NO: 9116752 - DNA, 22 bp, Homo sapiens
gcaaagatattagaatagagta

SEQ ID NO: 9116753 - DNA, 22 bp, Homo sapiens
gcaaagaaatgtcagtgagagg

SEQ ID NO: 9116754 - DNA, 22 bp, Homo sapiens
gcaaagaaagttttaatgaggt

SEQ ID NO: 9116755 - DNA, 22 bp, Homo sapiens
gcaaagaaagttttaatgaggt

SEQ ID NO: 9116756 - DNA, 22 bp, Homo sapiens
gcaaagaaagccaaggtctaac

SEQ ID NO: 9116757 - DNA, 22 bp, Homo sapiens
gaggcccagagaggttgcatga

SEQ ID NO: 9116758 - DNA, 20 bp, Homo sapiens
gaggcccagagaggtgaagc

SEQ ID NO: 9116759 - DNA, 20 bp, Homo sapiens
gaggcccagagaggtgaagc

SEQ ID NO: 9116760 - DNA, 22 bp, Homo sapiens
gaggccattcagctgggcagca

SEQ ID NO: 9116761 - DNA, 22 bp, Homo sapiens
gaggccataagaagttcttggg

SEQ ID NO: 9116762 - DNA, 22 bp, Homo sapiens
gcaaagcaagctgtcagcctca

SEQ ID NO: 9116763 - DNA, 22 bp, Homo sapiens
gcaaagcaagctgtcagcctca

SEQ ID NO: 9116764 - DNA, 22 bp, Homo sapiens
gcaaagcaagattcagatgtag

SEQ ID NO: 9116765 - DNA, 22 bp, Homo sapiens
gcaaagcaagattcagatgtag

SEQ ID NO: 9116766 - DNA, 22 bp, Homo sapiens
gcaaagcaagattcagatgtag

SEQ ID NO: 9116767 - DNA, 22 bp, Homo sapiens
gcaaagcaagattcagatgtag

SEQ ID NO: 9116768 - DNA, 22 bp, Homo sapiens
gcaaagcaagattcagatgtag

SEQ ID NO: 9116769 - DNA, 22 bp, Homo sapiens
gcaaagcaagattcagatgtag

SEQ ID NO: 9116770 - DNA, 22 bp, Homo sapiens
gcaaagcaaatgcctgaaggcg

SEQ ID NO: 9116771 - DNA, 22 bp, Homo sapiens
gcaaagcaaatgcctgaaggcg

SEQ ID NO: 9116772 - DNA, 22 bp, Homo sapiens
gcaaagcaaatgcctgaaggcg

SEQ ID NO: 9116773 - DNA, 22 bp, Homo sapiens
gcaaagcaaatgcctgaaggcg

SEQ ID NO: 9116774 - DNA, 22 bp, Homo sapiens
gcaaagcaatcaggagtagcat

SEQ ID NO: 9116775 - DNA, 22 bp, Homo sapiens
gcaaagcacaccctcagagttt

SEQ ID NO: 9116776 - DNA, 22 bp, Homo sapiens
gcaaagcacaccctcagagttt

SEQ ID NO: 9116777 - DNA, 22 bp, Homo sapiens
gcaaagcacaccctcagagttt

SEQ ID NO: 9116778 - DNA, 22 bp, Homo sapiens
gcaaagcacaccctcagagttt

SEQ ID NO: 9116779 - DNA, 22 bp, Homo sapiens
gcaaagcaatcaggagtagcat

SEQ ID NO: 9116780 - DNA, 22 bp, Homo sapiens
gcaaagcaatcaggagtagcat

SEQ ID NO: 9116781 - DNA, 22 bp, Homo sapiens
gcaaagcaagctgtcagcctca

SEQ ID NO: 9116782 - DNA, 22 bp, Homo sapiens
gcaaagcaatcaggagtagcat

SEQ ID NO: 9116783 - DNA, 22 bp, Homo sapiens
gcaaagctgggtgtgaatgcac

SEQ ID NO: 9116784 - DNA, 22 bp, Homo sapiens
gcaaagcattctgtggagtcta

SEQ ID NO: 9116785 - DNA, 22 bp, Homo sapiens
gcaaagcattctgtggagtcta

SEQ ID NO: 9116786 - DNA, 22 bp, Homo sapiens
gcaaagcattctgtggagtcta

SEQ ID NO: 9116787 - DNA, 22 bp, Homo sapiens
gcaaagcatcagtagaaatgtt

SEQ ID NO: 9116788 - DNA, 22 bp, Homo sapiens
gcaaagcatcagtagaaatgtt

SEQ ID NO: 9116789 - DNA, 22 bp, Homo sapiens
gcaaagcatcagtagaaatgtt

SEQ ID NO: 9116790 - DNA, 22 bp, Homo sapiens
gcaaagcatcagtagaaatgtt

SEQ ID NO: 9116791 - DNA, 22 bp, Homo sapiens
gcaaagcagtcttctgtgccta

SEQ ID NO: 9116792 - DNA, 22 bp, Homo sapiens
gcaaagcagtcttctgtgccta

SEQ ID NO: 9116793 - DNA, 22 bp, Homo sapiens
gcaaagcagtcttctgtgccta

SEQ ID NO: 9116794 - DNA, 22 bp, Homo sapiens
gcaaagcagaaccctctctatc

SEQ ID NO: 9116795 - DNA, 22 bp, Homo sapiens
gcaaagcacactggagatgtcg

SEQ ID NO: 9116796 - DNA, 22 bp, Homo sapiens
gcaaagcacactggagatgtcg

SEQ ID NO: 9116797 - DNA, 22 bp, Homo sapiens
gcaaagcagaaccctctctatc

SEQ ID NO: 9116798 - DNA, 22 bp, Homo sapiens
gcaaagcagaaccctctctatc

SEQ ID NO: 9116799 - DNA, 22 bp, Homo sapiens
gcaaagcacactggagatgtcg

SEQ ID NO: 9116800 - DNA, 22 bp, Homo sapiens
gcaaatacatgttgagcaccta

SEQ ID NO: 9116801 - DNA, 22 bp, Homo sapiens
gcaaataatatactttgatctc

SEQ ID NO: 9116802 - DNA, 22 bp, Homo sapiens
gcaaaggctagagacacaggga

SEQ ID NO: 9116803 - DNA, 22 bp, Homo sapiens
gcacacagtatatgctcattaa

SEQ ID NO: 9116804 - DNA, 19 bp, Homo sapiens
gcacacagtagggctggca

SEQ ID NO: 9116805 - DNA, 22 bp, Homo sapiens
gcacacagtatatgctcattaa

SEQ ID NO: 9116806 - DNA, 22 bp, Homo sapiens
gcacacatcttgtaatcctgag

SEQ ID NO: 9116807 - DNA, 22 bp, Homo sapiens
gcacacagtactatatgctaca

SEQ ID NO: 9116808 - DNA, 22 bp, Homo sapiens
gcacacagtagggattcaatga

SEQ ID NO: 9116809 - DNA, 22 bp, Homo sapiens
gcacacagtagggattcaatga

SEQ ID NO: 9116810 - DNA, 22 bp, Homo sapiens
gcacacagaacatttggatcct

SEQ ID NO: 9116811 - DNA, 22 bp, Homo sapiens
gcaaatatttctaattcctgaa

SEQ ID NO: 9116812 - DNA, 22 bp, Homo sapiens
gcaaatattcaagacttttcca

SEQ ID NO: 9116813 - DNA, 22 bp, Homo sapiens
gcaaatattcaagacttttcca

SEQ ID NO: 9116814 - DNA, 22 bp, Homo sapiens
gcacacttaatactcactgtgc

SEQ ID NO: 9116815 - DNA, 22 bp, Homo sapiens
gcacaccctctcaccagcactg

SEQ ID NO: 9116816 - DNA, 19 bp, Homo sapiens
gcacaccctgcaccaccat

SEQ ID NO: 9116817 - DNA, 22 bp, Homo sapiens
gcacagaacagagaaatagcca

SEQ ID NO: 9116818 - DNA, 22 bp, Homo sapiens
gcacagaaatgtctacacatgt

SEQ ID NO: 9116819 - DNA, 22 bp, Homo sapiens
gcacagaacagagaaatagcca

SEQ ID NO: 9116820 - DNA, 22 bp, Homo sapiens
gcacagaacactggtgagtccc

SEQ ID NO: 9116821 - DNA, 22 bp, Homo sapiens
gcacagaacactggtgagtccc

SEQ ID NO: 9116822 - DNA, 22 bp, Homo sapiens
gcacagggctgccaggcggctt

SEQ ID NO: 9116823 - DNA, 22 bp, Homo sapiens
gcacaggctccggaggagagct

SEQ ID NO: 9116824 - DNA, 22 bp, Homo sapiens
gcacaggccatgggaggacagc

SEQ ID NO: 9116825 - DNA, 22 bp, Homo sapiens
gcacaggtcaggagatgagatt

SEQ ID NO: 9116826 - DNA, 22 bp, Homo sapiens
gcagcccaggaccctggacaga

SEQ ID NO: 9116827 - DNA, 22 bp, Homo sapiens
gcagcccaggagcaggcgaccc

SEQ ID NO: 9116828 - DNA, 22 bp, Homo sapiens
gcagcccaggtgtagctctttg

SEQ ID NO: 9116829 - DNA, 18 bp, Homo sapiens
gcagcccctcttccttcc

SEQ ID NO: 9116830 - DNA, 18 bp, Homo sapiens
gcagcccctcttccttcc

SEQ ID NO: 9116831 - DNA, 22 bp, Homo sapiens
gcagccctaacctgtcatagtg

SEQ ID NO: 9116832 - DNA, 22 bp, Homo sapiens
gcagccctccctgggtgtgtct

SEQ ID NO: 9116833 - DNA, 22 bp, Homo sapiens
gcagccctagcgacaaattgat

SEQ ID NO: 9116834 - DNA, 22 bp, Homo sapiens
gcagccctagcgacaaattgat

SEQ ID NO: 9116835 - DNA, 22 bp, Homo sapiens
gcagccctaacctgtcatagtg

SEQ ID NO: 9116836 - DNA, 22 bp, Homo sapiens
gcagccccaggagacgcccagg

SEQ ID NO: 9116837 - DNA, 22 bp, Homo sapiens
gcagccctccctgggtgtgtct

SEQ ID NO: 9116838 - DNA, 22 bp, Homo sapiens
gcagccctcgctagctctcccc

SEQ ID NO: 9116839 - DNA, 22 bp, Homo sapiens
gcagccctcgggtactcacgtg

SEQ ID NO: 9116840 - DNA, 22 bp, Homo sapiens
gcagccctcgctagctctcccc

SEQ ID NO: 9116841 - DNA, 22 bp, Homo sapiens
gcagccctgcagctccacaccg

SEQ ID NO: 9116842 - DNA, 22 bp, Homo sapiens
gcagccctgcagctccacaccg

SEQ ID NO: 9116843 - DNA, 22 bp, Homo sapiens
gcagccctcttggtcactaggc

SEQ ID NO: 9116844 - DNA, 22 bp, Homo sapiens
gcagccctcttggtcactaggc

SEQ ID NO: 9116845 - DNA, 22 bp, Homo sapiens
gcagccctcgggtactcacgtg

SEQ ID NO: 9116846 - DNA, 22 bp, Homo sapiens
gcagatggtgccatgtcttgtg

SEQ ID NO: 9116847 - DNA, 21 bp, Homo sapiens
gcagatgggagtcatcaggct

SEQ ID NO: 9116848 - DNA, 22 bp, Homo sapiens
gcagatggctcagacactgggg

SEQ ID NO: 9116849 - DNA, 21 bp, Homo sapiens
gcagatgggaagagacgaggc

SEQ ID NO: 9116850 - DNA, 21 bp, Homo sapiens
gcagatgggaagagacgaggc

SEQ ID NO: 9116851 - DNA, 22 bp, Homo sapiens
gcagatgggagccccaggggag

SEQ ID NO: 9116852 - DNA, 22 bp, Homo sapiens
gcagatggagataaatggaact

SEQ ID NO: 9116853 - DNA, 22 bp, Homo sapiens
gcagatggatgtggacggcgcc

SEQ ID NO: 9116854 - DNA, 22 bp, Homo sapiens
gcagatggcagcccaggctggg

SEQ ID NO: 9116855 - DNA, 20 bp, Homo sapiens
gcagcctcaacaggcacagc

SEQ ID NO: 9116856 - DNA, 20 bp, Homo sapiens
gcagcctcaacaggcacagc

SEQ ID NO: 9116857 - DNA, 22 bp, Homo sapiens
gcagccctggcctggcctactt

SEQ ID NO: 9116858 - DNA, 22 bp, Homo sapiens
gcagccctggcctggcctactt

SEQ ID NO: 9116859 - DNA, 22 bp, Homo sapiens
gcagccctgcaggcagctccag

SEQ ID NO: 9116860 - DNA, 22 bp, Homo sapiens
gcagccctgcaggcagctccag

SEQ ID NO: 9116861 - DNA, 22 bp, Homo sapiens
gcagccctttctgggcagggga

SEQ ID NO: 9116862 - DNA, 22 bp, Homo sapiens
gcagcccttcaggtgaggggca

SEQ ID NO: 9116863 - DNA, 22 bp, Homo sapiens
gcagcccttcaggtgaggggca

SEQ ID NO: 9116864 - DNA, 20 bp, Homo sapiens
gcagccgtggagactaggag

SEQ ID NO: 9116865 - DNA, 20 bp, Homo sapiens
gcagccgtggagactaggag

SEQ ID NO: 9116866 - DNA, 22 bp, Homo sapiens
gcagccctttctgggcagggga

SEQ ID NO: 9116867 - DNA, 20 bp, Homo sapiens
gcagctgtgcattcttagga

SEQ ID NO: 9116868 - DNA, 22 bp, Homo sapiens
gcagctttctgcaatgtcatcc

SEQ ID NO: 9116869 - DNA, 22 bp, Homo sapiens
gcagctgtcggaaagctaagtg

SEQ ID NO: 9116870 - DNA, 22 bp, Homo sapiens
gcagctttctttttgcatgtct

SEQ ID NO: 9116871 - DNA, 22 bp, Homo sapiens
gcagctttcttgccctaatctt

SEQ ID NO: 9116872 - DNA, 22 bp, Homo sapiens
gcagctttctgggacagaaagg

SEQ ID NO: 9116873 - DNA, 22 bp, Homo sapiens
gcagctgtcgctaggagctgtg

SEQ ID NO: 9116874 - DNA, 22 bp, Homo sapiens
gcagctgtcgctaggagctgtg

SEQ ID NO: 9116875 - DNA, 22 bp, Homo sapiens
gcagctgtcgctaggagctgtg

SEQ ID NO: 9116876 - DNA, 22 bp, Homo sapiens
gcagctgtcatttacaacaggg

SEQ ID NO: 9116877 - DNA, 22 bp, Homo sapiens
gcaggaagcatagaagaatgcc

SEQ ID NO: 9116878 - DNA, 22 bp, Homo sapiens
gcaggaagcatagaagaatgcc

SEQ ID NO: 9116879 - DNA, 22 bp, Homo sapiens
gcaggaagggaaaggttgactc

SEQ ID NO: 9116880 - DNA, 22 bp, Homo sapiens
gcaggaagggaaaggttgactc

SEQ ID NO: 9116881 - DNA, 23 bp, Homo sapiens
gcaggacaacagagtgggaaggc

SEQ ID NO: 9116882 - DNA, 23 bp, Homo sapiens
gcaggacaacagagtgggaaggc

SEQ ID NO: 9116883 - DNA, 22 bp, Homo sapiens
gcaggaagaggctcgaagcccc

SEQ ID NO: 9116884 - DNA, 22 bp, Homo sapiens
gcaggaagatgagctcaggtaa

SEQ ID NO: 9116885 - DNA, 22 bp, Homo sapiens
gcaggaactggagctggatgtt

SEQ ID NO: 9116886 - DNA, 23 bp, Homo sapiens
gcaggaactcagggtaggcagca

SEQ ID NO: 9116887 - DNA, 22 bp, Homo sapiens
gcaggaacttgggtgaagtcag

SEQ ID NO: 9116888 - DNA, 22 bp, Homo sapiens
gcagctttttggatgtcagtta

SEQ ID NO: 9116889 - DNA, 22 bp, Homo sapiens
gcagctttgtggagaggcccat

SEQ ID NO: 9116890 - DNA, 22 bp, Homo sapiens
gcaggaacccagacaaccaggg

SEQ ID NO: 9116891 - DNA, 22 bp, Homo sapiens
gcaggcaggtggcatcttgtga

SEQ ID NO: 9116892 - DNA, 22 bp, Homo sapiens
gcaggcagtcatctttcatatt

SEQ ID NO: 9116893 - DNA, 19 bp, Homo sapiens
gcaggcagtggcattcgga

SEQ ID NO: 9116894 - DNA, 19 bp, Homo sapiens
gcaggcagtggcattcgga

SEQ ID NO: 9116895 - DNA, 22 bp, Homo sapiens
gcaggcagtcatctttcatatt

SEQ ID NO: 9116896 - DNA, 22 bp, Homo sapiens
gcaggcagtcatctttcatatt

SEQ ID NO: 9116897 - DNA, 19 bp, Homo sapiens
gcaggcagtggcattcgga

SEQ ID NO: 9116898 - DNA, 22 bp, Homo sapiens
gcaggcagttatttagtagaat

SEQ ID NO: 9116899 - DNA, 22 bp, Homo sapiens
gcaggcagttatttagtagaat

SEQ ID NO: 9116900 - DNA, 22 bp, Homo sapiens
gcagggaagacccggagcagcg

SEQ ID NO: 9116901 - DNA, 22 bp, Homo sapiens
gcagggaagtttgatctttttc

SEQ ID NO: 9116902 - DNA, 21 bp, Homo sapiens
gcagggacaaagcttcaggag

SEQ ID NO: 9116903 - DNA, 21 bp, Homo sapiens
gcagggacaaagcttcaggag

SEQ ID NO: 9116904 - DNA, 21 bp, Homo sapiens
gcagggacaaagcttcaggag

SEQ ID NO: 9116905 - DNA, 22 bp, Homo sapiens
gcagggaaggggcatgctggag

SEQ ID NO: 9116906 - DNA, 22 bp, Homo sapiens
gcagggaaggggacggaaccag

SEQ ID NO: 9116907 - DNA, 22 bp, Homo sapiens
gcagggaagttgtaatgtaatg

SEQ ID NO: 9116908 - DNA, 22 bp, Homo sapiens
gcagggaagggaaacagagacc

SEQ ID NO: 9116909 - DNA, 22 bp, Homo sapiens
gcagggaagatcttggagctgc

SEQ ID NO: 9116910 - DNA, 22 bp, Homo sapiens
gcagggaagatcttggagctgc

SEQ ID NO: 9116911 - DNA, 22 bp, Homo sapiens
gcagggaagatcttggagctgc

SEQ ID NO: 9116912 - DNA, 22 bp, Homo sapiens
gcagggaagacccggagcagcg

SEQ ID NO: 9116913 - DNA, 22 bp, Homo sapiens
gcagggaagacccggagcagcg

SEQ ID NO: 9116914 - DNA, 14 bp, Homo sapiens
gcaggcagatcact

SEQ ID NO: 9116915 - DNA, 14 bp, Homo sapiens
gcaggcagatcatt

SEQ ID NO: 9116916 - DNA, 22 bp, Homo sapiens
gcaggcagccacgattcccttg

SEQ ID NO: 9116917 - DNA, 22 bp, Homo sapiens
gcaggcagccacgattcccttg

SEQ ID NO: 9116918 - DNA, 22 bp, Homo sapiens
gcaggcaggtggcatcttgtga

SEQ ID NO: 9116919 - DNA, 15 bp, Homo sapiens
gcaggcagatcaccg

SEQ ID NO: 9116920 - DNA, 22 bp, Homo sapiens
gcaggcagatcacctgtcagga

SEQ ID NO: 9116921 - DNA, 22 bp, Homo sapiens
gcaggcagatcacctgtcagga

SEQ ID NO: 9116922 - DNA, 22 bp, Homo sapiens
gcaggcagatcacctgtcagga

SEQ ID NO: 9116923 - DNA, 22 bp, Homo sapiens
gcaggcagatcacctgtcagga

SEQ ID NO: 9116924 - DNA, 22 bp, Homo sapiens
gcaggcagatcacctgtcagga

SEQ ID NO: 9116925 - DNA, 22 bp, Homo sapiens
gcaggcagatcacctgtcagga

SEQ ID NO: 9116926 - DNA, 22 bp, Homo sapiens
gcaggcagatcacctgtcagga

SEQ ID NO: 9116927 - DNA, 22 bp, Homo sapiens
gcaggcagatcacctgtcagga

SEQ ID NO: 9116928 - DNA, 22 bp, Homo sapiens
gcaggcagagtcaatttgatcc

SEQ ID NO: 9116929 - DNA, 22 bp, Homo sapiens
gcaggcagaggtggaggagaca

SEQ ID NO: 9116930 - DNA, 22 bp, Homo sapiens
gcaggcagaggtggaggagaca

SEQ ID NO: 9116931 - DNA, 14 bp, Homo sapiens
gcaggcagatcacc

SEQ ID NO: 9116932 - DNA, 16 bp, Homo sapiens
gcaggcagatcacatg

SEQ ID NO: 9116933 - DNA, 22 bp, Homo sapiens
gcaggcagaggtggaggagaca

SEQ ID NO: 9116934 - DNA, 22 bp, Homo sapiens
gcaggcagaggtggaggagaca

SEQ ID NO: 9116935 - DNA, 22 bp, Homo sapiens
gcaggcagaggtggaggagaca

SEQ ID NO: 9116936 - DNA, 22 bp, Homo sapiens
gcaggcagaggtggaggagaca

SEQ ID NO: 9116937 - DNA, 22 bp, Homo sapiens
gcaggacacagatgcaaggcca

SEQ ID NO: 9116938 - DNA, 22 bp, Homo sapiens
gcaggacacagatgcaaggcca

SEQ ID NO: 9116939 - DNA, 22 bp, Homo sapiens
gcagggctgggtgggagacaga

SEQ ID NO: 9116940 - DNA, 22 bp, Homo sapiens
gcagggctttttgaaacatggt

SEQ ID NO: 9116941 - DNA, 22 bp, Homo sapiens
gcagggctgttcaggagggtgg

SEQ ID NO: 9116942 - DNA, 22 bp, Homo sapiens
gcagggctgtggacactttggt

SEQ ID NO: 9116943 - DNA, 22 bp, Homo sapiens
gcagggacagggcagggccttt

SEQ ID NO: 9116944 - DNA, 22 bp, Homo sapiens
gcagggacagggcagggccttt

SEQ ID NO: 9116945 - DNA, 22 bp, Homo sapiens
gcagggacatcttcagatcact

SEQ ID NO: 9116946 - DNA, 22 bp, Homo sapiens
gcagggacatctttgtctagta

SEQ ID NO: 9116947 - DNA, 18 bp, Homo sapiens
gcagggacacagggtcac

SEQ ID NO: 9116948 - DNA, 18 bp, Homo sapiens
gcagggacacagggtcac

SEQ ID NO: 9116949 - DNA, 22 bp, Homo sapiens
gcagggacaactgtgcacctga

SEQ ID NO: 9116950 - DNA, 22 bp, Homo sapiens
gcagggacaaggcaggtgttct

SEQ ID NO: 9116951 - DNA, 22 bp, Homo sapiens
gcagggaccaaaagaggcagta

SEQ ID NO: 9116952 - DNA, 21 bp, Homo sapiens
gcagggaccgcgacttctggg

SEQ ID NO: 9116953 - DNA, 22 bp, Homo sapiens
gcagggacctgccactgctgtc

SEQ ID NO: 9116954 - DNA, 22 bp, Homo sapiens
gcagggacctatgacgatggaa

SEQ ID NO: 9116955 - DNA, 22 bp, Homo sapiens
gcagggctctgctgtagtccta

SEQ ID NO: 9116956 - DNA, 22 bp, Homo sapiens
gccagggaggctgtagggtcct

SEQ ID NO: 9116957 - DNA, 22 bp, Homo sapiens
gccagggcaggggagcatctgc

SEQ ID NO: 9116958 - DNA, 17 bp, Homo sapiens
gccagggagaggaagcc

SEQ ID NO: 9116959 - DNA, 22 bp, Homo sapiens
gccaggcagctagcaacccctg

SEQ ID NO: 9116960 - DNA, 22 bp, Homo sapiens
gccaggcagctgggagggtgcc

SEQ ID NO: 9116961 - DNA, 22 bp, Homo sapiens
gccaggcaggccacgctgtgtt

SEQ ID NO: 9116962 - DNA, 22 bp, Homo sapiens
gccaggcaggtgtcggagccct

SEQ ID NO: 9116963 - DNA, 22 bp, Homo sapiens
gccaggcagatatgtgagctta

SEQ ID NO: 9116964 - DNA, 22 bp, Homo sapiens
gccaggcagagccccgtgcagc

SEQ ID NO: 9116965 - DNA, 22 bp, Homo sapiens
gccaggcagccaccctctgcga

SEQ ID NO: 9116966 - DNA, 22 bp, Homo sapiens
gccaggcagccaccctctgcga

SEQ ID NO: 9116967 - DNA, 22 bp, Homo sapiens
gccaggcagcaggaagccagtg

SEQ ID NO: 9116968 - DNA, 22 bp, Homo sapiens
gccagcctgtgcttggccaggc

SEQ ID NO: 9116969 - DNA, 22 bp, Homo sapiens
gccagcctgtgcttggccaggc

SEQ ID NO: 9116970 - DNA, 22 bp, Homo sapiens
gccagcctgtgcttggccaggc

SEQ ID NO: 9116971 - DNA, 22 bp, Homo sapiens
gccagcctgtgcttggccaggc

SEQ ID NO: 9116972 - DNA, 22 bp, Homo sapiens
gccagcctgtgcttggccaggc

SEQ ID NO: 9116973 - DNA, 22 bp, Homo sapiens
gccagcctgtgcttggccaggc

SEQ ID NO: 9116974 - DNA, 21 bp, Homo sapiens
gccagcctgtttacctgtggt

SEQ ID NO: 9116975 - DNA, 22 bp, Homo sapiens
gccagcctgtgggggctctgtg

SEQ ID NO: 9116976 - DNA, 22 bp, Homo sapiens
gccagcctgtgggggctctgtg

SEQ ID NO: 9116977 - DNA, 22 bp, Homo sapiens
gccagcctgtgggggctctgtg

SEQ ID NO: 9116978 - DNA, 22 bp, Homo sapiens
gccagccttctgtggcctgcaa

SEQ ID NO: 9116979 - DNA, 23 bp, Homo sapiens
gccagccttgctctcctgcagcc

SEQ ID NO: 9116980 - DNA, 23 bp, Homo sapiens
gccagccttgctctcctgcagcc

SEQ ID NO: 9116981 - DNA, 23 bp, Homo sapiens
gccagccttgctctcctgcagcc

SEQ ID NO: 9116982 - DNA, 23 bp, Homo sapiens
gccagccttgctctcctgcagcc

SEQ ID NO: 9116983 - DNA, 22 bp, Homo sapiens
gccagccttctgtggcctgcaa

SEQ ID NO: 9116984 - DNA, 22 bp, Homo sapiens
gccagccttctgtggcctgcaa

SEQ ID NO: 9116985 - DNA, 22 bp, Homo sapiens
gccagccttctgtggcctgcaa

SEQ ID NO: 9116986 - DNA, 22 bp, Homo sapiens
gccagccttctgtggcctgcaa

SEQ ID NO: 9116987 - DNA, 21 bp, Homo sapiens
gccagcctgtttacctgtggt

SEQ ID NO: 9116988 - DNA, 21 bp, Homo sapiens
gccagcctgtttacctgtggt

SEQ ID NO: 9116989 - DNA, 21 bp, Homo sapiens
gccagcctgtttacctgtggt

SEQ ID NO: 9116990 - DNA, 21 bp, Homo sapiens
gccagcctgtttacctgtggt

SEQ ID NO: 9116991 - DNA, 20 bp, Homo sapiens
gccagccctgacacaggagc

SEQ ID NO: 9116992 - DNA, 22 bp, Homo sapiens
gccagccctgggagacttatgg

SEQ ID NO: 9116993 - DNA, 18 bp, Homo sapiens
gccagccctccaacctcc

SEQ ID NO: 9116994 - DNA, 22 bp, Homo sapiens
gccaccccataggtgttaggtg

SEQ ID NO: 9116995 - DNA, 22 bp, Homo sapiens
gccaccccataggtgttaggtg

SEQ ID NO: 9116996 - DNA, 22 bp, Homo sapiens
gccacccccaagtaggtggtct

SEQ ID NO: 9116997 - DNA, 22 bp, Homo sapiens
gccaccccaacctccctaagtt

SEQ ID NO: 9116998 - DNA, 22 bp, Homo sapiens
gccaccccaacctccctaagtt

SEQ ID NO: 9116999 - DNA, 22 bp, Homo sapiens
gccaccatgtagcccattagag

SEQ ID NO: 9117000 - DNA, 22 bp, Homo sapiens
gccagctcagtttcaaagtagg

SEQ ID NO: 9117001 - DNA, 22 bp, Homo sapiens
gccagctcccaagtgagcccct

SEQ ID NO: 9117002 - DNA, 22 bp, Homo sapiens
gccagctcccaagtgagcccct

SEQ ID NO: 9117003 - DNA, 22 bp, Homo sapiens
gccagctcccaagtgagcccct

SEQ ID NO: 9117004 - DNA, 22 bp, Homo sapiens
gccagctctgtggctgtacttg

SEQ ID NO: 9117005 - DNA, 22 bp, Homo sapiens
gccagctctcattgtataggct

SEQ ID NO: 9117006 - DNA, 22 bp, Homo sapiens
gccagctcagatgcaggaagga

SEQ ID NO: 9117007 - DNA, 23 bp, Homo sapiens
gccagccttgctctcctgcagcc

SEQ ID NO: 9117008 - DNA, 23 bp, Homo sapiens
gccagccttgctctcctgcagcc

SEQ ID NO: 9117009 - DNA, 23 bp, Homo sapiens
gccagccttgctctcctgcagcc

SEQ ID NO: 9117010 - DNA, 22 bp, Homo sapiens
gccagctcagtgccaggcccct

SEQ ID NO: 9117011 - DNA, 22 bp, Homo sapiens
gccagctcagtgccaggcccct

SEQ ID NO: 9117012 - DNA, 22 bp, Homo sapiens
gccagctcagatgcaggaagga

SEQ ID NO: 9117013 - DNA, 22 bp, Homo sapiens
gccagctcagatgcaggaagga

SEQ ID NO: 9117014 - DNA, 22 bp, Homo sapiens
gccagctcagatgcaggaagga

SEQ ID NO: 9117015 - DNA, 22 bp, Homo sapiens
gccaggcactgctctaagccct

SEQ ID NO: 9117016 - DNA, 20 bp, Homo sapiens
gccaggcactgttctcaata

SEQ ID NO: 9117017 - DNA, 22 bp, Homo sapiens
gccaggcagacaggtcatcagg

SEQ ID NO: 9117018 - DNA, 22 bp, Homo sapiens
gccagctgaagccctggtggaa

SEQ ID NO: 9117019 - DNA, 22 bp, Homo sapiens
gccagctgaaatttcagttctg

SEQ ID NO: 9117020 - DNA, 22 bp, Homo sapiens
gccagctgaatttccaactgtt

SEQ ID NO: 9117021 - DNA, 22 bp, Homo sapiens
gccagctgaagggaagctcctg

SEQ ID NO: 9117022 - DNA, 22 bp, Homo sapiens
gcatgctgcaccagagcctctc

SEQ ID NO: 9117023 - DNA, 22 bp, Homo sapiens
gcatgctgagcccacgcctggg

SEQ ID NO: 9117024 - DNA, 22 bp, Homo sapiens
gcatggccaggaaaggtagaaa

SEQ ID NO: 9117025 - DNA, 22 bp, Homo sapiens
gcatggccaggaaaggtagaaa

SEQ ID NO: 9117026 - DNA, 22 bp, Homo sapiens
gcatggccatggcactatggac

SEQ ID NO: 9117027 - DNA, 22 bp, Homo sapiens
gcatggccttcagggacagctg

SEQ ID NO: 9117028 - DNA, 22 bp, Homo sapiens
gcatggcctctgtgcttgttgc

SEQ ID NO: 9117029 - DNA, 22 bp, Homo sapiens
gcatggcctccagccaacagca

SEQ ID NO: 9117030 - DNA, 22 bp, Homo sapiens
gcatggccttgctgtagtggta

SEQ ID NO: 9117031 - DNA, 22 bp, Homo sapiens
gcatggccttgtgctccttctc

SEQ ID NO: 9117032 - DNA, 22 bp, Homo sapiens
gcatggctattatgaggcagaa

SEQ ID NO: 9117033 - DNA, 22 bp, Homo sapiens
gcatggctggtgtcctgaggga

SEQ ID NO: 9117034 - DNA, 22 bp, Homo sapiens
gcatggctctggcctcagtgtg

SEQ ID NO: 9117035 - DNA, 22 bp, Homo sapiens
gcatggctcctgtcttactccc

SEQ ID NO: 9117036 - DNA, 22 bp, Homo sapiens
gcatggctattatgaggcagaa

SEQ ID NO: 9117037 - DNA, 22 bp, Homo sapiens
gcatggctgttgaagtcagctc

SEQ ID NO: 9117038 - DNA, 22 bp, Homo sapiens
gccacaggcttaggagggaggt

SEQ ID NO: 9117039 - DNA, 22 bp, Homo sapiens
gccacatgcaattgcagcacgt

SEQ ID NO: 9117040 - DNA, 22 bp, Homo sapiens
gccaccagcagaaaaggggcca

SEQ ID NO: 9117041 - DNA, 22 bp, Homo sapiens
gccaccagcagaaaaggggcca

SEQ ID NO: 9117042 - DNA, 22 bp, Homo sapiens
gccacattagccctcaccatct

SEQ ID NO: 9117043 - DNA, 22 bp, Homo sapiens
gccaccagggggctccagtgag

SEQ ID NO: 9117044 - DNA, 22 bp, Homo sapiens
gccaccagggggctccagtgag

SEQ ID NO: 9117045 - DNA, 22 bp, Homo sapiens
gccaccaggagcccagtccaaa

SEQ ID NO: 9117046 - DNA, 22 bp, Homo sapiens
gccaccagccccatgcgctgtg

SEQ ID NO: 9117047 - DNA, 22 bp, Homo sapiens
gccaccagccccatgcgctgtg

SEQ ID NO: 9117048 - DNA, 22 bp, Homo sapiens
gccaccaggagcccagtccaaa

SEQ ID NO: 9117049 - DNA, 22 bp, Homo sapiens
gccaccagtgggggcctgggca

SEQ ID NO: 9117050 - DNA, 22 bp, Homo sapiens
gccaccagtgggggcctgggca

SEQ ID NO: 9117051 - DNA, 22 bp, Homo sapiens
gccaccagtagctaacaacagt

SEQ ID NO: 9117052 - DNA, 22 bp, Homo sapiens
gccaccaggttagatccagcct

SEQ ID NO: 9117053 - DNA, 22 bp, Homo sapiens
gccaccagggggctccagtgag

SEQ ID NO: 9117054 - DNA, 22 bp, Homo sapiens
gcagtggctaagctcgcatgca

SEQ ID NO: 9117055 - DNA, 22 bp, Homo sapiens
gcagtggctaagctcgcatgca

SEQ ID NO: 9117056 - DNA, 22 bp, Homo sapiens
gcagtggctaggagtctggcgt

SEQ ID NO: 9117057 - DNA, 22 bp, Homo sapiens
gcagtggctaagctcgcatgca

SEQ ID NO: 9117058 - DNA, 22 bp, Homo sapiens
gcagtggccacatggaggagga

SEQ ID NO: 9117059 - DNA, 22 bp, Homo sapiens
gcagtggccacatggaggagga

SEQ ID NO: 9117060 - DNA, 22 bp, Homo sapiens
gcagtggctaggagtctggcgt

SEQ ID NO: 9117061 - DNA, 22 bp, Homo sapiens
gcagtgggaaggttggcacatg

SEQ ID NO: 9117062 - DNA, 22 bp, Homo sapiens
gcagtgggagcttaggcagtgc

SEQ ID NO: 9117063 - DNA, 22 bp, Homo sapiens
gcatgcagacagtctgagacca

SEQ ID NO: 9117064 - DNA, 22 bp, Homo sapiens
gcatgcaggaagggcttgggga

SEQ ID NO: 9117065 - DNA, 22 bp, Homo sapiens
gcatgcagagaatacctgtgat

SEQ ID NO: 9117066 - DNA, 18 bp, Homo sapiens
gcagtgactatggggatc

SEQ ID NO: 9117067 - DNA, 22 bp, Homo sapiens
gcagtgacatacctggagggca

SEQ ID NO: 9117068 - DNA, 22 bp, Homo sapiens
gcagtgacagggctgctgcctt

SEQ ID NO: 9117069 - DNA, 22 bp, Homo sapiens
gcaggggagtggatgatggatt

SEQ ID NO: 9117070 - DNA, 22 bp, Homo sapiens
gcagtggcatgatgtgggctca

SEQ ID NO: 9117071 - DNA, 22 bp, Homo sapiens
gcagtggcatgatgtgggctca

SEQ ID NO: 9117072 - DNA, 22 bp, Homo sapiens
gcagtggcatgatgtgggctca

SEQ ID NO: 9117073 - DNA, 23 bp, Homo sapiens
gcagtggaatgtctctgtttgga

SEQ ID NO: 9117074 - DNA, 17 bp, Homo sapiens
gcagtggaggggtagtt

SEQ ID NO: 9117075 - DNA, 22 bp, Homo sapiens
gcagtggatccaatggtatctt

SEQ ID NO: 9117076 - DNA, 22 bp, Homo sapiens
gcagtggatggccagcaggggc

SEQ ID NO: 9117077 - DNA, 22 bp, Homo sapiens
gcagtggcaccgctggctctgg

SEQ ID NO: 9117078 - DNA, 22 bp, Homo sapiens
gcccagcctccaagctccaagg

SEQ ID NO: 9117079 - DNA, 22 bp, Homo sapiens
gcccagcctccaagctccaagg

SEQ ID NO: 9117080 - DNA, 22 bp, Homo sapiens
gcccagcctccaagctccaagg

SEQ ID NO: 9117081 - DNA, 22 bp, Homo sapiens
gcccagccctgaggtcacagct

SEQ ID NO: 9117082 - DNA, 22 bp, Homo sapiens
gcccagccctgaggtcacagct

SEQ ID NO: 9117083 - DNA, 22 bp, Homo sapiens
gcccagctgcaccctggtgggt

SEQ ID NO: 9117084 - DNA, 22 bp, Homo sapiens
gcccagctggcttccagcacat

SEQ ID NO: 9117085 - DNA, 22 bp, Homo sapiens
gcccagctgagaagcgcggggc

SEQ ID NO: 9117086 - DNA, 22 bp, Homo sapiens
gcccagctgcaccctggtgggt

SEQ ID NO: 9117087 - DNA, 22 bp, Homo sapiens
gcccagctgagaagcgcggggc

SEQ ID NO: 9117088 - DNA, 22 bp, Homo sapiens
gcccagctcctctgcagaccct

SEQ ID NO: 9117089 - DNA, 22 bp, Homo sapiens
gcccagctcctctgcagaccct

SEQ ID NO: 9117090 - DNA, 22 bp, Homo sapiens
gcccagctccattcttggtgag

SEQ ID NO: 9117091 - DNA, 22 bp, Homo sapiens
gcccagcccctgggtggacgtg

SEQ ID NO: 9117092 - DNA, 22 bp, Homo sapiens
gcccagcagctggtggagaagg

SEQ ID NO: 9117093 - DNA, 22 bp, Homo sapiens
gcccagcagctggtggagaagg

SEQ ID NO: 9117094 - DNA, 22 bp, Homo sapiens
gcccagcagatctcagtgtctc

SEQ ID NO: 9117095 - DNA, 22 bp, Homo sapiens
gcccagcagatctcagtgtctc

SEQ ID NO: 9117096 - DNA, 22 bp, Homo sapiens
gcccagcacctctctcagggtt

SEQ ID NO: 9117097 - DNA, 22 bp, Homo sapiens
gcccagcacctctctcagggtt

SEQ ID NO: 9117098 - DNA, 22 bp, Homo sapiens
gcccagcacctctctcagggtt

SEQ ID NO: 9117099 - DNA, 22 bp, Homo sapiens
gcccagcactaaaagctttgct

SEQ ID NO: 9117100 - DNA, 22 bp, Homo sapiens
gcccagcactcctctctgacat

SEQ ID NO: 9117101 - DNA, 22 bp, Homo sapiens
gccaggggacgcggagcgacga

SEQ ID NO: 9117102 - DNA, 22 bp, Homo sapiens
gccagggggtcagcaggcactt

SEQ ID NO: 9117103 - DNA, 22 bp, Homo sapiens
gccagggtgagggctgagaggt

SEQ ID NO: 9117104 - DNA, 22 bp, Homo sapiens
gccagggtgagggctgagaggt

SEQ ID NO: 9117105 - DNA, 22 bp, Homo sapiens
gccagggttcgaatccgtatgg

SEQ ID NO: 9117106 - DNA, 22 bp, Homo sapiens
gcccagcacattgctgaggacc

SEQ ID NO: 9117107 - DNA, 22 bp, Homo sapiens
gcccagcacattgctgaggacc

SEQ ID NO: 9117108 - DNA, 22 bp, Homo sapiens
gcccagcacattgctgaggacc

SEQ ID NO: 9117109 - DNA, 22 bp, Homo sapiens
gcccagcacatctggccttgaa

SEQ ID NO: 9117110 - DNA, 22 bp, Homo sapiens
gcccagcacagctggaagagtc

SEQ ID NO: 9117111 - DNA, 22 bp, Homo sapiens
gccagggttgccaatgggggca

SEQ ID NO: 9117112 - DNA, 21 bp, Homo sapiens
gcccagcaaggtgagaaggcc

SEQ ID NO: 9117113 - DNA, 22 bp, Homo sapiens
gccccaccgagggtgcagtcct

SEQ ID NO: 9117114 - DNA, 22 bp, Homo sapiens
gcccatggtcagggaggcaggg

SEQ ID NO: 9117115 - DNA, 22 bp, Homo sapiens
gccccaagtccctatgtttcca

SEQ ID NO: 9117116 - DNA, 22 bp, Homo sapiens
gccccaagggagcccagcacac

SEQ ID NO: 9117117 - DNA, 22 bp, Homo sapiens
gcccatggcagaactgtgagca

SEQ ID NO: 9117118 - DNA, 22 bp, Homo sapiens
gcccatggcttccctaggcaca

SEQ ID NO: 9117119 - DNA, 22 bp, Homo sapiens
gcccatgggcctgaggccctag

SEQ ID NO: 9117120 - DNA, 22 bp, Homo sapiens
gcccagctgtctggcagggatg

SEQ ID NO: 9117121 - DNA, 22 bp, Homo sapiens
gcccagctttttgaggcaggca

SEQ ID NO: 9117122 - DNA, 22 bp, Homo sapiens
gcccagctggcttccagcacat

SEQ ID NO: 9117123 - DNA, 22 bp, Homo sapiens
gcccagctgtctggcagggatg

SEQ ID NO: 9117124 - DNA, 22 bp, Homo sapiens
gcccagctgtctggcagggatg

SEQ ID NO: 9117125 - DNA, 22 bp, Homo sapiens
gcccagctttttgaggcaggca

SEQ ID NO: 9117126 - DNA, 22 bp, Homo sapiens
gcccagctttttgaggcaggca

SEQ ID NO: 9117127 - DNA, 22 bp, Homo sapiens
gccctggatgtacaggcatgtt

SEQ ID NO: 9117128 - DNA, 22 bp, Homo sapiens
gccctggatggcaggagccatc

SEQ ID NO: 9117129 - DNA, 22 bp, Homo sapiens
gccctggatgctcatggcatca

SEQ ID NO: 9117130 - DNA, 22 bp, Homo sapiens
gccctggagggccagcgactgg

SEQ ID NO: 9117131 - DNA, 22 bp, Homo sapiens
gccctggatgctcatggcatca

SEQ ID NO: 9117132 - DNA, 22 bp, Homo sapiens
gccctgggattgggtggaggct

SEQ ID NO: 9117133 - DNA, 22 bp, Homo sapiens
gccctgggattgggtggaggct

SEQ ID NO: 9117134 - DNA, 22 bp, Homo sapiens
gccctgggattgggtggaggct

SEQ ID NO: 9117135 - DNA, 22 bp, Homo sapiens
gccctggccttcatctcagaca

SEQ ID NO: 9117136 - DNA, 22 bp, Homo sapiens
gccctggcctcctggaacaggc

SEQ ID NO: 9117137 - DNA, 22 bp, Homo sapiens
gccctgtgcgctgagttcaggg

SEQ ID NO: 9117138 - DNA, 22 bp, Homo sapiens
gccctgtgcgctgagttcaggg

SEQ ID NO: 9117139 - DNA, 22 bp, Homo sapiens
gccctgtggacagtgagaagtg

SEQ ID NO: 9117140 - DNA, 22 bp, Homo sapiens
gccctgggattgggtggaggct

SEQ ID NO: 9117141 - DNA, 22 bp, Homo sapiens
gccctgggcaaggttctggcca

SEQ ID NO: 9117142 - DNA, 22 bp, Homo sapiens
gccctgggcaaggttctggcca

SEQ ID NO: 9117143 - DNA, 22 bp, Homo sapiens
gccctgtgcgactctagaggtt

SEQ ID NO: 9117144 - DNA, 22 bp, Homo sapiens
gccctgtgccagtcacgctgtg

SEQ ID NO: 9117145 - DNA, 22 bp, Homo sapiens
gccccagcctcccgagtagctg

SEQ ID NO: 9117146 - DNA, 22 bp, Homo sapiens
gccccagcctcccgagtagctg

SEQ ID NO: 9117147 - DNA, 22 bp, Homo sapiens
gccccagcctcccgagtagctg

SEQ ID NO: 9117148 - DNA, 22 bp, Homo sapiens
gccccagccctgtggaccatgg

SEQ ID NO: 9117149 - DNA, 22 bp, Homo sapiens
gccccagccaaggtgacacgaa

SEQ ID NO: 9117150 - DNA, 22 bp, Homo sapiens
gccccagccctgtggaccatgg

SEQ ID NO: 9117151 - DNA, 22 bp, Homo sapiens
gccccagccaaggtgacacgaa

SEQ ID NO: 9117152 - DNA, 22 bp, Homo sapiens
gccccagccaaggtgacacgaa

SEQ ID NO: 9117153 - DNA, 22 bp, Homo sapiens
gccccagatggaggaagctggg

SEQ ID NO: 9117154 - DNA, 22 bp, Homo sapiens
gccccagctctgccacaactag

SEQ ID NO: 9117155 - DNA, 22 bp, Homo sapiens
gccccagctctgccacaactag

SEQ ID NO: 9117156 - DNA, 22 bp, Homo sapiens
gccccagcctgggaactggagg

SEQ ID NO: 9117157 - DNA, 17 bp, Homo sapiens
gccctggagccaggcta

SEQ ID NO: 9117158 - DNA, 22 bp, Homo sapiens
gccccaggggaggtgccctgca

SEQ ID NO: 9117159 - DNA, 22 bp, Homo sapiens
gccctggagctagactaggaca

SEQ ID NO: 9117160 - DNA, 22 bp, Homo sapiens
gcctcctgagtagctgggattg

SEQ ID NO: 9117161 - DNA, 22 bp, Homo sapiens
gcctcctgagtagctgggattg

SEQ ID NO: 9117162 - DNA, 22 bp, Homo sapiens
gcctcctgagaagccacaggct

SEQ ID NO: 9117163 - DNA, 22 bp, Homo sapiens
gcctcctgagaagccacaggct

SEQ ID NO: 9117164 - DNA, 22 bp, Homo sapiens
gcctcctggaagtcacatgttt

SEQ ID NO: 9117165 - DNA, 22 bp, Homo sapiens
gcctcctgcccagatgagtgat

SEQ ID NO: 9117166 - DNA, 22 bp, Homo sapiens
gcctcctgcccagatgagtgat

SEQ ID NO: 9117167 - DNA, 22 bp, Homo sapiens
gcctcctggattttagtgccat

SEQ ID NO: 9117168 - DNA, 22 bp, Homo sapiens
gcctctggagttgcttgtaaat

SEQ ID NO: 9117169 - DNA, 22 bp, Homo sapiens
gcctctgggctctgcccctggc

SEQ ID NO: 9117170 - DNA, 22 bp, Homo sapiens
gcctcctgggttcatgccattc

SEQ ID NO: 9117171 - DNA, 22 bp, Homo sapiens
gcctcctgaagtgctgggatta

SEQ ID NO: 9117172 - DNA, 22 bp, Homo sapiens
gcctcctgaagtgctgggatta

SEQ ID NO: 9117173 - DNA, 22 bp, Homo sapiens
gcctcctccttcccgagggtct

SEQ ID NO: 9117174 - DNA, 22 bp, Homo sapiens
gcctcctaccacaccctcagtc

SEQ ID NO: 9117175 - DNA, 22 bp, Homo sapiens
gcctccggagttgcagtgtctt

SEQ ID NO: 9117176 - DNA, 22 bp, Homo sapiens
gcctccggagtcacagtgtctt

SEQ ID NO: 9117177 - DNA, 22 bp, Homo sapiens
gccctgtgtgtttgcactgatt

SEQ ID NO: 9117178 - DNA, 22 bp, Homo sapiens
taactctagtcccaggcatgaa

SEQ ID NO: 9117179 - DNA, 19 bp, Homo sapiens
taactctttccttttcccc

SEQ ID NO: 9117180 - DNA, 22 bp, Homo sapiens
taactctttactatacatttat

SEQ ID NO: 9117181 - DNA, 22 bp, Homo sapiens
taacctttggtgaaatattaac

SEQ ID NO: 9117182 - DNA, 22 bp, Homo sapiens
taacctttctcttgtggctgac

SEQ ID NO: 9117183 - DNA, 22 bp, Homo sapiens
taacctttgttcaatgtaagat

SEQ ID NO: 9117184 - DNA, 22 bp, Homo sapiens
taactactaattgatgataatg

SEQ ID NO: 9117185 - DNA, 22 bp, Homo sapiens
taactaagtgactcaagtgatc

SEQ ID NO: 9117186 - DNA, 22 bp, Homo sapiens
taaattgaaaatctacagaaca

SEQ ID NO: 9117187 - DNA, 22 bp, Homo sapiens
taaattgctgattttagatgct

SEQ ID NO: 9117188 - DNA, 22 bp, Homo sapiens
taaattgcataagtacaaatga

SEQ ID NO: 9117189 - DNA, 22 bp, Homo sapiens
taaattgttttctagaagttgt

SEQ ID NO: 9117190 - DNA, 18 bp, Homo sapiens
taaattgcttcacctgag

SEQ ID NO: 9117191 - DNA, 22 bp, Homo sapiens
taaatttacccaaggaacatgt

SEQ ID NO: 9117192 - DNA, 22 bp, Homo sapiens
taaattcactcctggtagacct

SEQ ID NO: 9117193 - DNA, 22 bp, Homo sapiens
taaattcagtgagtaatttctg

SEQ ID NO: 9117194 - DNA, 22 bp, Homo sapiens
taaattcagtgagtaatttctg

SEQ ID NO: 9117195 - DNA, 22 bp, Homo sapiens
taacattaaaagagataattga

SEQ ID NO: 9117196 - DNA, 22 bp, Homo sapiens
taaatttttgttaacagcctct

SEQ ID NO: 9117197 - DNA, 23 bp, Homo sapiens
taaatttcttgattcttatgtga

SEQ ID NO: 9117198 - DNA, 22 bp, Homo sapiens
taacattaaaagagataattga

SEQ ID NO: 9117199 - DNA, 22 bp, Homo sapiens
taacattacagacaccttgtgt

SEQ ID NO: 9117200 - DNA, 22 bp, Homo sapiens
taaccaaagggcctaaggaatg

SEQ ID NO: 9117201 - DNA, 22 bp, Homo sapiens
taacattacagacaccttgtgt

SEQ ID NO: 9117202 - DNA, 22 bp, Homo sapiens
taacattacggacatctgtcag

SEQ ID NO: 9117203 - DNA, 22 bp, Homo sapiens
taaaggtagtgtgacatattgt

SEQ ID NO: 9117204 - DNA, 22 bp, Homo sapiens
taaaggtagttttaaaggtgct

SEQ ID NO: 9117205 - DNA, 22 bp, Homo sapiens
taaaggtatgtcttaatcaaac

SEQ ID NO: 9117206 - DNA, 22 bp, Homo sapiens
taaaggtcaagagatgctgtct

SEQ ID NO: 9117207 - DNA, 22 bp, Homo sapiens
taaagtataagcattggagtat

SEQ ID NO: 9117208 - DNA, 22 bp, Homo sapiens
taaaggttattgcactggagtt

SEQ ID NO: 9117209 - DNA, 22 bp, Homo sapiens
taaaggtccaaagagggctacg

SEQ ID NO: 9117210 - DNA, 22 bp, Homo sapiens
taaagtgcctcaggtcctgggt

SEQ ID NO: 9117211 - DNA, 22 bp, Homo sapiens
taaagtatccagttattcttct

SEQ ID NO: 9117212 - DNA, 22 bp, Homo sapiens
taaagtatattttttctcaata

SEQ ID NO: 9117213 - DNA, 22 bp, Homo sapiens
taaagtgctggatttgagtaaa

SEQ ID NO: 9117214 - DNA, 22 bp, Homo sapiens
taaagtgctgggattataggcc

SEQ ID NO: 9117215 - DNA, 22 bp, Homo sapiens
taaagtgcttatgataaccaag

SEQ ID NO: 9117216 - DNA, 22 bp, Homo sapiens
taaagtgcgacccagtccccag

SEQ ID NO: 9117217 - DNA, 22 bp, Homo sapiens
taaagtgctcataaaaatggat

SEQ ID NO: 9117218 - DNA, 23 bp, Homo sapiens
taaagtgctgatggtgagggagc

SEQ ID NO: 9117219 - DNA, 22 bp, Homo sapiens
taaagtgctcataaaaatggat

SEQ ID NO: 9117220 - DNA, 22 bp, Homo sapiens
taaagtgcttcctaacccagag

SEQ ID NO: 9117221 - DNA, 22 bp, Homo sapiens
taaagtgtctgcctcagctcag

SEQ ID NO: 9117222 - DNA, 22 bp, Homo sapiens
taaagtgtatgccatctctcat

SEQ ID NO: 9117223 - DNA, 23 bp, Homo sapiens
taaattacctttccagtgcaggg

SEQ ID NO: 9117224 - DNA, 22 bp, Homo sapiens
taaattaccctttagggaattg

SEQ ID NO: 9117225 - DNA, 23 bp, Homo sapiens
taaattacctttccagtgcaggg

SEQ ID NO: 9117226 - DNA, 22 bp, Homo sapiens
taaattaccctttagggaattg

SEQ ID NO: 9117227 - DNA, 22 bp, Homo sapiens
taaattagagccaggtaagttt

SEQ ID NO: 9117228 - DNA, 22 bp, Homo sapiens
taaattactcaatgcacataaa

SEQ ID NO: 9117229 - DNA, 22 bp, Homo sapiens
taaattcactcctggtagacct

SEQ ID NO: 9117230 - DNA, 22 bp, Homo sapiens
taaattcactcctggtagacct

SEQ ID NO: 9117231 - DNA, 20 bp, Homo sapiens
taaattagccttgaagatta

SEQ ID NO: 9117232 - DNA, 22 bp, Homo sapiens
taaattatggctggcagagcag

SEQ ID NO: 9117233 - DNA, 22 bp, Homo sapiens
taaattagggactttagttaat

SEQ ID NO: 9117234 - DNA, 22 bp, Homo sapiens
taaattagggactttagttaat

SEQ ID NO: 9117235 - DNA, 22 bp, Homo sapiens
taaaatttgtccctgagtgttg

SEQ ID NO: 9117236 - DNA, 22 bp, Homo sapiens
taaacaagctggactgataagt

SEQ ID NO: 9117237 - DNA, 18 bp, Homo sapiens
taaaattcaaggcagggt

SEQ ID NO: 9117238 - DNA, 22 bp, Homo sapiens
taaaattgcggtgaatatttcc

SEQ ID NO: 9117239 - DNA, 22 bp, Homo sapiens
taaaatgtttgcaagagaccag

SEQ ID NO: 9117240 - DNA, 22 bp, Homo sapiens
taaaatgtttgcaagagaccag

SEQ ID NO: 9117241 - DNA, 22 bp, Homo sapiens
taaaatgtgtttctgtatggtt

SEQ ID NO: 9117242 - DNA, 22 bp, Homo sapiens
taaacaagctgtctgatattct

SEQ ID NO: 9117243 - DNA, 22 bp, Homo sapiens
taaacaagctggactgataagt

SEQ ID NO: 9117244 - DNA, 22 bp, Homo sapiens
taaacaattcctctctaggcat

SEQ ID NO: 9117245 - DNA, 22 bp, Homo sapiens
taaacagaatgcgtaagaagtg

SEQ ID NO: 9117246 - DNA, 19 bp, Homo sapiens
gttttgtttgcagaactta

SEQ ID NO: 9117247 - DNA, 22 bp, Homo sapiens
gttttgttttgagtcaactcca

SEQ ID NO: 9117248 - DNA, 22 bp, Homo sapiens
gtttttatatcctgtggagtgt

SEQ ID NO: 9117249 - DNA, 22 bp, Homo sapiens
gtttttatctaatagcagttat

SEQ ID NO: 9117250 - DNA, 22 bp, Homo sapiens
gtttttattgtgtaaatgtggg

SEQ ID NO: 9117251 - DNA, 22 bp, Homo sapiens
taaaatgtagcttctaggctgg

SEQ ID NO: 9117252 - DNA, 19 bp, Homo sapiens
taaaatgtctgtggtcagt

SEQ ID NO: 9117253 - DNA, 19 bp, Homo sapiens
taaaatgtctgtggtcagt

SEQ ID NO: 9117254 - DNA, 19 bp, Homo sapiens
taaaatgtctgtggtcagt

SEQ ID NO: 9117255 - DNA, 22 bp, Homo sapiens
taaaatgatctctcatgttctt

SEQ ID NO: 9117256 - DNA, 22 bp, Homo sapiens
taaaatgatctctcatgttctt

SEQ ID NO: 9117257 - DNA, 22 bp, Homo sapiens
gttttcttcctgcaattggcat

SEQ ID NO: 9117258 - DNA, 22 bp, Homo sapiens
gttttgaatactactagaactt

SEQ ID NO: 9117259 - DNA, 22 bp, Homo sapiens
gttttctttgaatgcttctaga

SEQ ID NO: 9117260 - DNA, 22 bp, Homo sapiens
gttttctttgaatgcttctaga

SEQ ID NO: 9117261 - DNA, 21 bp, Homo sapiens
gttttctttgatagagggaag

SEQ ID NO: 9117262 - DNA, 18 bp, Homo sapiens
gttttgtggctagtagtg

SEQ ID NO: 9117263 - DNA, 22 bp, Homo sapiens
gttttgttgctgcagagctcaa

SEQ ID NO: 9117264 - DNA, 22 bp, Homo sapiens
gttttgtgaggcacccacaggt

SEQ ID NO: 9117265 - DNA, 22 bp, Homo sapiens
gttttggctctggcatgtggaa

SEQ ID NO: 9117266 - DNA, 22 bp, Homo sapiens
gttttggcagccgtgttcacat

SEQ ID NO: 9117267 - DNA, 18 bp, Homo sapiens
gttttgaattgtcttaca

SEQ ID NO: 9117268 - DNA, 22 bp, Homo sapiens
gtttcccaggctgtggggccct

SEQ ID NO: 9117269 - DNA, 22 bp, Homo sapiens
gtttccattgtcctatctatag

SEQ ID NO: 9117270 - DNA, 22 bp, Homo sapiens
gtttccatatttttagtgccaa

SEQ ID NO: 9117271 - DNA, 22 bp, Homo sapiens
gttacaaaggaagcttcactgc

SEQ ID NO: 9117272 - DNA, 22 bp, Homo sapiens
gttacaaaggaagcttcactgc

SEQ ID NO: 9117273 - DNA, 22 bp, Homo sapiens
gttacaaagcacttcaagtgaa

SEQ ID NO: 9117274 - DNA, 22 bp, Homo sapiens
gttacaaagcacttcaagtgaa

SEQ ID NO: 9117275 - DNA, 22 bp, Homo sapiens
gttacaaactcaggtgccaaaa

SEQ ID NO: 9117276 - DNA, 22 bp, Homo sapiens
gttacaaactcaggtgccaaaa

SEQ ID NO: 9117277 - DNA, 22 bp, Homo sapiens
gttacaaactcaggtgccaaaa

SEQ ID NO: 9117278 - DNA, 22 bp, Homo sapiens
gttaaggctgagcaggacactg

SEQ ID NO: 9117279 - DNA, 23 bp, Homo sapiens
gttaataatgaacactttctccc

SEQ ID NO: 9117280 - DNA, 22 bp, Homo sapiens
gttaatgtgtctgacacaatgg

SEQ ID NO: 9117281 - DNA, 22 bp, Homo sapiens
gttaacatttctaggtgcaggg

SEQ ID NO: 9117282 - DNA, 22 bp, Homo sapiens
gtgtgggaaggctaggatgctg

SEQ ID NO: 9117283 - DNA, 22 bp, Homo sapiens
gtgtggctgtttagtgactttc

SEQ ID NO: 9117284 - DNA, 22 bp, Homo sapiens
gtgtgggacgggtgagtggcca

SEQ ID NO: 9117285 - DNA, 22 bp, Homo sapiens
gtgtggctgattgacatggtca

SEQ ID NO: 9117286 - DNA, 22 bp, Homo sapiens
gtgtggctagaagtgtcttgtt

SEQ ID NO: 9117287 - DNA, 22 bp, Homo sapiens
gtgtgcctcccattagggtgta

SEQ ID NO: 9117288 - DNA, 22 bp, Homo sapiens
gtgtgcctcgccaagctgtcgg

SEQ ID NO: 9117289 - DNA, 22 bp, Homo sapiens
gtgctcctcacagtgtggccct

SEQ ID NO: 9117290 - DNA, 22 bp, Homo sapiens
gtgctcctggccacatgaagct

SEQ ID NO: 9117291 - DNA, 22 bp, Homo sapiens
gtgctctcctggctgccctgac

SEQ ID NO: 9117292 - DNA, 22 bp, Homo sapiens
gtgctctgatctgtctgacatc

SEQ ID NO: 9117293 - DNA, 23 bp, Homo sapiens
gtgctctgcggtctgctagtctg

SEQ ID NO: 9117294 - DNA, 22 bp, Homo sapiens
gtgctcactgtgagacgtcctg

SEQ ID NO: 9117295 - DNA, 22 bp, Homo sapiens
gtgctccctccttcctcaagga

SEQ ID NO: 9117296 - DNA, 22 bp, Homo sapiens
gtgctccctccttcctcaagga

SEQ ID NO: 9117297 - DNA, 22 bp, Homo sapiens
gtgctccattgtctagaactgg

SEQ ID NO: 9117298 - DNA, 23 bp, Homo sapiens
gtgtgccaagcactgtgccagga

SEQ ID NO: 9117299 - DNA, 23 bp, Homo sapiens
gtgtgccaagcactgtgccagga

SEQ ID NO: 9117300 - DNA, 22 bp, Homo sapiens
gtgtgccaacaaaagacagtgc

SEQ ID NO: 9117301 - DNA, 22 bp, Homo sapiens
gtgtgccaactatattaatatt

SEQ ID NO: 9117302 - DNA, 22 bp, Homo sapiens
gtgtgccaacaaaagacagtgc

SEQ ID NO: 9117303 - DNA, 22 bp, Homo sapiens
gtgtgccaagagatagttgctg

SEQ ID NO: 9117304 - DNA, 22 bp, Homo sapiens
gtgtgccaccagtcaaggtgaa

SEQ ID NO: 9117305 - DNA, 22 bp, Homo sapiens
gtgtgccaccactgacaggatt

SEQ ID NO: 9117306 - DNA, 22 bp, Homo sapiens
gtgtgccaccagtcaaggtgaa

SEQ ID NO: 9117307 - DNA, 22 bp, Homo sapiens
gtgtgccaggaactggctgctg

SEQ ID NO: 9117308 - DNA, 22 bp, Homo sapiens
gtgtgccagacatgatgctatg

SEQ ID NO: 9117309 - DNA, 22 bp, Homo sapiens
gtgtgccactgcctgaggaccc

SEQ ID NO: 9117310 - DNA, 22 bp, Homo sapiens
gtgtgccactgcctgaggaccc

SEQ ID NO: 9117311 - DNA, 22 bp, Homo sapiens
gtgtgccagacatgatgctatg

SEQ ID NO: 9117312 - DNA, 22 bp, Homo sapiens
gtgtgccaggaactggctgctg

SEQ ID NO: 9117313 - DNA, 22 bp, Homo sapiens
gtgtgccaggaactggctgctg

SEQ ID NO: 9117314 - DNA, 22 bp, Homo sapiens
gtgtgccagtcctgactcctga

SEQ ID NO: 9117315 - DNA, 22 bp, Homo sapiens
gtgtgccatttgcttcctgtta

SEQ ID NO: 9117316 - DNA, 22 bp, Homo sapiens
gtgtgcagtgagcaaaagatct

SEQ ID NO: 9117317 - DNA, 22 bp, Homo sapiens
gtgctgaactataaaaagcttt

SEQ ID NO: 9117318 - DNA, 18 bp, Homo sapiens
gtgtgcagttgcaggggt

SEQ ID NO: 9117319 - DNA, 21 bp, Homo sapiens
gtgctctgggcagcagagggc

SEQ ID NO: 9117320 - DNA, 21 bp, Homo sapiens
gtgctctgggcagcagagggc

SEQ ID NO: 9117321 - DNA, 22 bp, Homo sapiens
gtgctctgggctgcctgacatg

SEQ ID NO: 9117322 - DNA, 21 bp, Homo sapiens
gtgctctgggcagcagagggc

SEQ ID NO: 9117323 - DNA, 22 bp, Homo sapiens
gtgctctgtgtattaggatgtc

SEQ ID NO: 9117324 - DNA, 22 bp, Homo sapiens
gttgaggtgatgccagccctgc

SEQ ID NO: 9117325 - DNA, 22 bp, Homo sapiens
gttgagtgggttaggatgctga

SEQ ID NO: 9117326 - DNA, 22 bp, Homo sapiens
gttcatttatgatgtaacatgt

SEQ ID NO: 9117327 - DNA, 22 bp, Homo sapiens
gttcatgtttgtgtattgctca

SEQ ID NO: 9117328 - DNA, 22 bp, Homo sapiens
gttcatgtttgagaacaaggag

SEQ ID NO: 9117329 - DNA, 22 bp, Homo sapiens
gttcattctgaaaagcagcttg

SEQ ID NO: 9117330 - DNA, 22 bp, Homo sapiens
gttcagtcacgtgcccaagttc

SEQ ID NO: 9117331 - DNA, 22 bp, Homo sapiens
gttcatatttaactaagatagg

SEQ ID NO: 9117332 - DNA, 22 bp, Homo sapiens
gttcatattctaagtaactggc

SEQ ID NO: 9117333 - DNA, 22 bp, Homo sapiens
gttcagagaaagagacacctta

SEQ ID NO: 9117334 - DNA, 22 bp, Homo sapiens
gttcagagacacttattggaaa

SEQ ID NO: 9117335 - DNA, 22 bp, Homo sapiens
gttcagaaattaggagaataaa

SEQ ID NO: 9117336 - DNA, 22 bp, Homo sapiens
gttcagaaaacattggaataca

SEQ ID NO: 9117337 - DNA, 22 bp, Homo sapiens
gttcacatgtggtcatgctgtc

SEQ ID NO: 9117338 - DNA, 22 bp, Homo sapiens
gttcagcaagaatgtttctatt

SEQ ID NO: 9117339 - DNA, 22 bp, Homo sapiens
gttcagcaagtactcagtccac

SEQ ID NO: 9117340 - DNA, 21 bp, Homo sapiens
gttcagagattattgagtcat

SEQ ID NO: 9117341 - DNA, 22 bp, Homo sapiens
gttcagagtgggaatgatcact

SEQ ID NO: 9117342 - DNA, 22 bp, Homo sapiens
gttcagagtattaattgattta

SEQ ID NO: 9117343 - DNA, 22 bp, Homo sapiens
gttcagagtgggaatgatcact

SEQ ID NO: 9117344 - DNA, 22 bp, Homo sapiens
gttcacatcccagaaagagcat

SEQ ID NO: 9117345 - DNA, 22 bp, Homo sapiens
gttcaattaagttacaaattta

SEQ ID NO: 9117346 - DNA, 22 bp, Homo sapiens
gttcaatttagaaagcacagtt

SEQ ID NO: 9117347 - DNA, 21 bp, Homo sapiens
gttcaatagctctttgaatgc

SEQ ID NO: 9117348 - DNA, 22 bp, Homo sapiens
gttcaatttcagcatccattga

SEQ ID NO: 9117349 - DNA, 22 bp, Homo sapiens
gttcacaaagtactgtatgcat

SEQ ID NO: 9117350 - DNA, 22 bp, Homo sapiens
gttacaaaggactgggggccac

SEQ ID NO: 9117351 - DNA, 22 bp, Homo sapiens
gttacaaaggactgggggccac

SEQ ID NO: 9117352 - DNA, 22 bp, Homo sapiens
gttacaaaggtcataaaagtgt

SEQ ID NO: 9117353 - DNA, 22 bp, Homo sapiens
gttcaagttcatatctcttaac

SEQ ID NO: 9117354 - DNA, 21 bp, Homo sapiens
gttcaagttcctgctctgtga

SEQ ID NO: 9117355 - DNA, 22 bp, Homo sapiens
gttcaagtttctgagctttaat

SEQ ID NO: 9117356 - DNA, 22 bp, Homo sapiens
gttcaagtgtcaagtgttggaa

SEQ ID NO: 9117357 - DNA, 22 bp, Homo sapiens
gttcaagttatgcctttaccct

SEQ ID NO: 9117358 - DNA, 21 bp, Homo sapiens
gttcaagtgatcctcctgtct

SEQ ID NO: 9117359 - DNA, 22 bp, Homo sapiens
gttgcaaatgggaagatggtta

SEQ ID NO: 9117360 - DNA, 22 bp, Homo sapiens
gttgcaaatgggaagatggtta

SEQ ID NO: 9117361 - DNA, 22 bp, Homo sapiens
gttgcaaactcctacttctcat

SEQ ID NO: 9117362 - DNA, 22 bp, Homo sapiens
gttgatttagtgagtgagcagt

SEQ ID NO: 9117363 - DNA, 22 bp, Homo sapiens
gttgatttgaagagcagaaagt

SEQ ID NO: 9117364 - DNA, 22 bp, Homo sapiens
gttgatgaaaatgaattgcatg

SEQ ID NO: 9117365 - DNA, 22 bp, Homo sapiens
gttgcagatactgaagcacagg

SEQ ID NO: 9117366 - DNA, 22 bp, Homo sapiens
gttgcagactcaagaaaataaa

SEQ ID NO: 9117367 - DNA, 22 bp, Homo sapiens
gttgcagatgtggaactcgtgc

SEQ ID NO: 9117368 - DNA, 22 bp, Homo sapiens
gttgcagacactccacagtcga

SEQ ID NO: 9117369 - DNA, 22 bp, Homo sapiens
gttgcagacggggtgcactgaa

SEQ ID NO: 9117370 - DNA, 22 bp, Homo sapiens
gttgcaggaagcacacacatgt

SEQ ID NO: 9117371 - DNA, 22 bp, Homo sapiens
gttgcagcatcactgctgagtg

SEQ ID NO: 9117372 - DNA, 22 bp, Homo sapiens
gttgcctaggctggagtgcagt

SEQ ID NO: 9117373 - DNA, 22 bp, Homo sapiens
gttgccctggctctgcccagct

SEQ ID NO: 9117374 - DNA, 22 bp, Homo sapiens
gttgggaaggtgaacatgatgc

SEQ ID NO: 9117375 - DNA, 22 bp, Homo sapiens
gttgggaatttattccttttct

SEQ ID NO: 9117376 - DNA, 22 bp, Homo sapiens
gttgggaagtatccccaaagtt

SEQ ID NO: 9117377 - DNA, 22 bp, Homo sapiens
gttgggaagtgtagctccacct

SEQ ID NO: 9117378 - DNA, 22 bp, Homo sapiens
gttgctcaggcaggagtacagt

SEQ ID NO: 9117379 - DNA, 22 bp, Homo sapiens
gttggtcaggatggtctcaaac

SEQ ID NO: 9117380 - DNA, 22 bp, Homo sapiens
gttggtcaaggacagaggttca

SEQ ID NO: 9117381 - DNA, 20 bp, Homo sapiens
gttggtcactttgagcagga

SEQ ID NO: 9117382 - DNA, 19 bp, Homo sapiens
gttggtcattctacacaac

SEQ ID NO: 9117383 - DNA, 22 bp, Homo sapiens
gttggtcatatcattgaagctt

SEQ ID NO: 9117384 - DNA, 22 bp, Homo sapiens
gtttcatacagattattcatgg

SEQ ID NO: 9117385 - DNA, 22 bp, Homo sapiens
gtttcatacagattattcatgg

SEQ ID NO: 9117386 - DNA, 22 bp, Homo sapiens
gtttcatagctacgattttggg

SEQ ID NO: 9117387 - DNA, 22 bp, Homo sapiens
gtttcatagcatatacgtgtgt

SEQ ID NO: 9117388 - DNA, 22 bp, Homo sapiens
gtttcataattcaatcaaatga

SEQ ID NO: 9117389 - DNA, 22 bp, Homo sapiens
gtttcaggtttaggcacctgga

SEQ ID NO: 9117390 - DNA, 22 bp, Homo sapiens
gtttcaggttggacaacatgcc

SEQ ID NO: 9117391 - DNA, 22 bp, Homo sapiens
gtttcagggccttttatgtgtt

SEQ ID NO: 9117392 - DNA, 22 bp, Homo sapiens
gtttcatataccaagcacttga

SEQ ID NO: 9117393 - DNA, 22 bp, Homo sapiens
gtttcatatatagtaactgaaa

SEQ ID NO: 9117394 - DNA, 22 bp, Homo sapiens
gtttcatataccaagcacttga

SEQ ID NO: 9117395 - DNA, 22 bp, Homo sapiens
gtttcataggcatgtgacctat

SEQ ID NO: 9117396 - DNA, 22 bp, Homo sapiens
gtttcatatgcagttaacagca

SEQ ID NO: 9117397 - DNA, 22 bp, Homo sapiens
gtttcatatgcagttaacagca

SEQ ID NO: 9117398 - DNA, 22 bp, Homo sapiens
gtttcatggagagctgaatatt

SEQ ID NO: 9117399 - DNA, 22 bp, Homo sapiens
gtttcatgccatttccagattg

SEQ ID NO: 9117400 - DNA, 18 bp, Homo sapiens
gtttcatgcatgtgaaac

SEQ ID NO: 9117401 - DNA, 22 bp, Homo sapiens
gtttcatgactgatgttgttga

SEQ ID NO: 9117402 - DNA, 22 bp, Homo sapiens
gtttcatggttgtttgatggca

SEQ ID NO: 9117403 - DNA, 22 bp, Homo sapiens
gttgtaaatacagcagataatt

SEQ ID NO: 9117404 - DNA, 22 bp, Homo sapiens
gtttcagatttggtttcagaag

SEQ ID NO: 9117405 - DNA, 22 bp, Homo sapiens
gtttcagatatatttgtactta

SEQ ID NO: 9117406 - DNA, 22 bp, Homo sapiens
gtttcagagtagaacctcaagg

SEQ ID NO: 9117407 - DNA, 22 bp, Homo sapiens
gtttcagagttagtgctggctg

SEQ ID NO: 9117408 - DNA, 22 bp, Homo sapiens
gtttcagaaatgttctcctgct

SEQ ID NO: 9117409 - DNA, 22 bp, Homo sapiens
gtttcagaacaccccatttggg

SEQ ID NO: 9117410 - DNA, 22 bp, Homo sapiens
gtttcagaacaccccatttggg

SEQ ID NO: 9117411 - DNA, 22 bp, Homo sapiens
gtttcagagtagaacctcaagg

SEQ ID NO: 9117412 - DNA, 22 bp, Homo sapiens
gtttcagactattctgtttctg

SEQ ID NO: 9117413 - DNA, 22 bp, Homo sapiens
gtttcagaggtgttcattttca

SEQ ID NO: 9117414 - DNA, 22 bp, Homo sapiens
taagggttcagaatgcagtggt

SEQ ID NO: 9117415 - DNA, 22 bp, Homo sapiens
taaggtgagctgtataacaggg

SEQ ID NO: 9117416 - DNA, 22 bp, Homo sapiens
taaggtaattgttgctgaaatt

SEQ ID NO: 9117417 - DNA, 22 bp, Homo sapiens
taaggccgctgctgagtccttt

SEQ ID NO: 9117418 - DNA, 22 bp, Homo sapiens
taaggccattatggtgggcccg

SEQ ID NO: 9117419 - DNA, 22 bp, Homo sapiens
taaggccttgaaaggatgtcct

SEQ ID NO: 9117420 - DNA, 22 bp, Homo sapiens
taaggccttgaaaggatgtcct

SEQ ID NO: 9117421 - DNA, 22 bp, Homo sapiens
taaggcccgtgagtttcatatc

SEQ ID NO: 9117422 - DNA, 22 bp, Homo sapiens
taaggccaattaacaaccaggg

SEQ ID NO: 9117423 - DNA, 22 bp, Homo sapiens
taaggccaattacatatgttca

SEQ ID NO: 9117424 - DNA, 22 bp, Homo sapiens
taaggccagccagcaaatctgt

SEQ ID NO: 9117425 - DNA, 22 bp, Homo sapiens
taaggccaggctgtggtcggca

SEQ ID NO: 9117426 - DNA, 22 bp, Homo sapiens
taaggccaccgttatagaacca

SEQ ID NO: 9117427 - DNA, 22 bp, Homo sapiens
taaggccagcatgaatgcagca

SEQ ID NO: 9117428 - DNA, 22 bp, Homo sapiens
taaggcagtgagaagaaacagg

SEQ ID NO: 9117429 - DNA, 22 bp, Homo sapiens
taaggcagtagtgtctgtaggg

SEQ ID NO: 9117430 - DNA, 22 bp, Homo sapiens
taaggcagtgaaactattctgt

SEQ ID NO: 9117431 - DNA, 22 bp, Homo sapiens
taaggcagtgaaactattctgt

SEQ ID NO: 9117432 - DNA, 22 bp, Homo sapiens
taaggcagttttgcctgagata

SEQ ID NO: 9117433 - DNA, 22 bp, Homo sapiens
taaggcataaggaagatttgga

SEQ ID NO: 9117434 - DNA, 22 bp, Homo sapiens
taaggcagtgagaagaaacagg

SEQ ID NO: 9117435 - DNA, 22 bp, Homo sapiens
taaggcatgagtttatttcata

SEQ ID NO: 9117436 - DNA, 22 bp, Homo sapiens
taaggcataaggccagaggcta

SEQ ID NO: 9117437 - DNA, 20 bp, Homo sapiens
taaggcatcaagtttgggta

SEQ ID NO: 9117438 - DNA, 19 bp, Homo sapiens
taaggccaaaagtaagtgt

SEQ ID NO: 9117439 - DNA, 21 bp, Homo sapiens
taaggccaagtctatttctgt

SEQ ID NO: 9117440 - DNA, 22 bp, Homo sapiens
taaggccaagttcatatacaac

SEQ ID NO: 9117441 - DNA, 22 bp, Homo sapiens
taaggccaaactattatagttc

SEQ ID NO: 9117442 - DNA, 22 bp, Homo sapiens
taaggccaaggggccatagtct

SEQ ID NO: 9117443 - DNA, 22 bp, Homo sapiens
taaggcattagagtgaaagcaa

SEQ ID NO: 9117444 - DNA, 22 bp, Homo sapiens
taaggcatgctagcagtatgaa

SEQ ID NO: 9117445 - DNA, 22 bp, Homo sapiens
taaggcattatagagacagcct

SEQ ID NO: 9117446 - DNA, 22 bp, Homo sapiens
taaggcattctcatgctgtgaa

SEQ ID NO: 9117447 - DNA, 18 bp, Homo sapiens
taaggcattcttatgtga

SEQ ID NO: 9117448 - DNA, 23 bp, Homo sapiens
taaggcattttttctgtatcagt

SEQ ID NO: 9117449 - DNA, 22 bp, Homo sapiens
taaggcaaacaggaaagcaggc

SEQ ID NO: 9117450 - DNA, 22 bp, Homo sapiens
taaggcaaacaggaaagcaggc

SEQ ID NO: 9117451 - DNA, 22 bp, Homo sapiens
taaggcaaagaaccatagtaat

SEQ ID NO: 9117452 - DNA, 22 bp, Homo sapiens
taaggcaaagtgatttcttaaa

SEQ ID NO: 9117453 - DNA, 22 bp, Homo sapiens
taaggcaaaggggaagttatca

SEQ ID NO: 9117454 - DNA, 22 bp, Homo sapiens
taactgcagaggaaatgcatct

SEQ ID NO: 9117455 - DNA, 22 bp, Homo sapiens
taaggcaaagtgatttcttaaa

SEQ ID NO: 9117456 - DNA, 22 bp, Homo sapiens
taaggcaggaactggctgtttt

SEQ ID NO: 9117457 - DNA, 22 bp, Homo sapiens
taaggcaggtagatgactacgg

SEQ ID NO: 9117458 - DNA, 22 bp, Homo sapiens
taaggcaggtatggtaccaggc

SEQ ID NO: 9117459 - DNA, 22 bp, Homo sapiens
taaggcaggactggatagctat

SEQ ID NO: 9117460 - DNA, 22 bp, Homo sapiens
taaggcaggctttcatccagag

SEQ ID NO: 9117461 - DNA, 22 bp, Homo sapiens
taaggcaggtagatgactacgg

SEQ ID NO: 9117462 - DNA, 22 bp, Homo sapiens
taaggcaggctttcatccagag

SEQ ID NO: 9117463 - DNA, 22 bp, Homo sapiens
taagtaaatttataatgtgatt

SEQ ID NO: 9117464 - DNA, 22 bp, Homo sapiens
taagtacaaatgtatacataag

SEQ ID NO: 9117465 - DNA, 22 bp, Homo sapiens
taagtagtatgtttaacaaggg

SEQ ID NO: 9117466 - DNA, 22 bp, Homo sapiens
taagtagatgcaaaatggagtt

SEQ ID NO: 9117467 - DNA, 22 bp, Homo sapiens
taagtgagccctcagagtatgg

SEQ ID NO: 9117468 - DNA, 22 bp, Homo sapiens
taagtgagatctgaaatgaaat

SEQ ID NO: 9117469 - DNA, 22 bp, Homo sapiens
taagtgagggagctgggacttg

SEQ ID NO: 9117470 - DNA, 22 bp, Homo sapiens
taagtgagctagcagaagtgac

SEQ ID NO: 9117471 - DNA, 22 bp, Homo sapiens
taagtgagaaagacattaactg

SEQ ID NO: 9117472 - DNA, 22 bp, Homo sapiens
taagtgagaactaaaccttctg

SEQ ID NO: 9117473 - DNA, 20 bp, Homo sapiens
taagtgagaacatgtggtat

SEQ ID NO: 9117474 - DNA, 22 bp, Homo sapiens
taagtgagttcttgctagattt

SEQ ID NO: 9117475 - DNA, 22 bp, Homo sapiens
taatacatgtattccagagagt

SEQ ID NO: 9117476 - DNA, 22 bp, Homo sapiens
taatacatcattcatctaagga

SEQ ID NO: 9117477 - DNA, 22 bp, Homo sapiens
taataccactgtgctcattata

SEQ ID NO: 9117478 - DNA, 22 bp, Homo sapiens
taatacattacctaacctctct

SEQ ID NO: 9117479 - DNA, 22 bp, Homo sapiens
taagtgtctaaaaggcagaact

SEQ ID NO: 9117480 - DNA, 22 bp, Homo sapiens
taagtgttgatctgagtgctaa

SEQ ID NO: 9117481 - DNA, 22 bp, Homo sapiens
taagtgttattattctcacttt

SEQ ID NO: 9117482 - DNA, 22 bp, Homo sapiens
taatacagggcactttgagtga

SEQ ID NO: 9117483 - DNA, 22 bp, Homo sapiens
taataatagcagtagctgccac

SEQ ID NO: 9117484 - DNA, 22 bp, Homo sapiens
taatacagtttccaagccagct

SEQ ID NO: 9117485 - DNA, 22 bp, Homo sapiens
taatacatcattcatctaagga

SEQ ID NO: 9117486 - DNA, 22 bp, Homo sapiens
taatggcagagtcatgctttct

SEQ ID NO: 9117487 - DNA, 22 bp, Homo sapiens
taatggcagagtcatgctttct

SEQ ID NO: 9117488 - DNA, 22 bp, Homo sapiens
taatagcattatcatcaaaact

SEQ ID NO: 9117489 - DNA, 22 bp, Homo sapiens
taatagaatagtggaaacattg

SEQ ID NO: 9117490 - DNA, 22 bp, Homo sapiens
taatagaatagtggaaacattg

SEQ ID NO: 9117491 - DNA, 22 bp, Homo sapiens
taatagaaaggtattttttgca

SEQ ID NO: 9117492 - DNA, 22 bp, Homo sapiens
taatagaaaggtattttttgca

SEQ ID NO: 9117493 - DNA, 22 bp, Homo sapiens
taatagaatagtggaaacattg

SEQ ID NO: 9117494 - DNA, 22 bp, Homo sapiens
taattacaaagcaagcacaggg

SEQ ID NO: 9117495 - DNA, 22 bp, Homo sapiens
taattacaaagcaagcacaggg

SEQ ID NO: 9117496 - DNA, 22 bp, Homo sapiens
taattacaggtccaaaacaatc

SEQ ID NO: 9117497 - DNA, 22 bp, Homo sapiens
tacaaagaggtaattgcatata

SEQ ID NO: 9117498 - DNA, 22 bp, Homo sapiens
tacaaacttgttttaagtaagt

SEQ ID NO: 9117499 - DNA, 22 bp, Homo sapiens
tacaaactgttattattattgt

SEQ ID NO: 9117500 - DNA, 22 bp, Homo sapiens
tacaaacttgttttaagtaagt

SEQ ID NO: 9117501 - DNA, 20 bp, Homo sapiens
tacaaagaatgaggttcagg

SEQ ID NO: 9117502 - DNA, 18 bp, Homo sapiens
tacaaactccttgaaggc

SEQ ID NO: 9117503 - DNA, 22 bp, Homo sapiens
tacaaactccgaagtttgtacc

SEQ ID NO: 9117504 - DNA, 22 bp, Homo sapiens
tacaaactccgaagtttgtacc

SEQ ID NO: 9117505 - DNA, 22 bp, Homo sapiens
tacaaactctttatatttcata

SEQ ID NO: 9117506 - DNA, 22 bp, Homo sapiens
tacaaactgtccagcccagagg

SEQ ID NO: 9117507 - DNA, 22 bp, Homo sapiens
tacaaactgttattattattgt

SEQ ID NO: 9117508 - DNA, 22 bp, Homo sapiens
taattatgtatgcaagctcagt

SEQ ID NO: 9117509 - DNA, 22 bp, Homo sapiens
tacaaagctactcgagggcagg

SEQ ID NO: 9117510 - DNA, 22 bp, Homo sapiens
tacaaagcctggtagatatctg

SEQ ID NO: 9117511 - DNA, 22 bp, Homo sapiens
tacaaaggagaatagggtagca

SEQ ID NO: 9117512 - DNA, 22 bp, Homo sapiens
tacaaagcaaatcatctaagag

SEQ ID NO: 9117513 - DNA, 22 bp, Homo sapiens
tacagagttttcctgccaagaa

SEQ ID NO: 9117514 - DNA, 22 bp, Homo sapiens
tacagataactgaatgcagact

SEQ ID NO: 9117515 - DNA, 22 bp, Homo sapiens
tacagaagtaaataccaaaagc

SEQ ID NO: 9117516 - DNA, 22 bp, Homo sapiens
tacagagtatttttaatatggt

SEQ ID NO: 9117517 - DNA, 22 bp, Homo sapiens
tacagagtggtgagatcttttg

SEQ ID NO: 9117518 - DNA, 22 bp, Homo sapiens
tacagaaatcacatcgctttga

SEQ ID NO: 9117519 - DNA, 22 bp, Homo sapiens
tacagaaatcacatcgctttga

SEQ ID NO: 9117520 - DNA, 22 bp, Homo sapiens
tacagaaattgccaccagctct

SEQ ID NO: 9117521 - DNA, 22 bp, Homo sapiens
tacagaactgaagtagtgaaaa

SEQ ID NO: 9117522 - DNA, 22 bp, Homo sapiens
tacagaactgaagtagtgaaaa

SEQ ID NO: 9117523 - DNA, 22 bp, Homo sapiens
tacagcaatggttctaagagtc

SEQ ID NO: 9117524 - DNA, 22 bp, Homo sapiens
tacagcacaaagggcctttacc

SEQ ID NO: 9117525 - DNA, 22 bp, Homo sapiens
tacagcaatgctacaagatgac

SEQ ID NO: 9117526 - DNA, 22 bp, Homo sapiens
tacagattttgtgaagaagtgt

SEQ ID NO: 9117527 - DNA, 22 bp, Homo sapiens
tacagattgaggtttttaatat

SEQ ID NO: 9117528 - DNA, 23 bp, Homo sapiens
tacagcaaggacaacataggtgg

SEQ ID NO: 9117529 - DNA, 22 bp, Homo sapiens
tacagatattgtacagttatag

SEQ ID NO: 9117530 - DNA, 22 bp, Homo sapiens
tacagatatgtatgcacttttt

SEQ ID NO: 9117531 - DNA, 22 bp, Homo sapiens
tacagataggaggaatctgaaa

SEQ ID NO: 9117532 - DNA, 22 bp, Homo sapiens
tacagataggaggaatctgaaa

SEQ ID NO: 9117533 - DNA, 22 bp, Homo sapiens
tacagaaagacctctcgggaaa

SEQ ID NO: 9117534 - DNA, 20 bp, Homo sapiens
tacagaaacaggacttttgg

SEQ ID NO: 9117535 - DNA, 20 bp, Homo sapiens
tacagaaacaggacttttgg

SEQ ID NO: 9117536 - DNA, 22 bp, Homo sapiens
tacagaaagggatgattgatct

SEQ ID NO: 9117537 - DNA, 22 bp, Homo sapiens
tacagaaagggatgattgatct

SEQ ID NO: 9117538 - DNA, 20 bp, Homo sapiens
tacagaaacaggacttttgg

SEQ ID NO: 9117539 - DNA, 22 bp, Homo sapiens
tacagaaaaactggcattgaag

SEQ ID NO: 9117540 - DNA, 22 bp, Homo sapiens
tacactgaagtgtcttggtata

SEQ ID NO: 9117541 - DNA, 22 bp, Homo sapiens
tacactgaagtgtcttggtata

SEQ ID NO: 9117542 - DNA, 22 bp, Homo sapiens
tacactgaaagagaggattgaa

SEQ ID NO: 9117543 - DNA, 22 bp, Homo sapiens
tacactcttaggaattggttat

SEQ ID NO: 9117544 - DNA, 22 bp, Homo sapiens
tacactgaaagagaggattgaa

SEQ ID NO: 9117545 - DNA, 22 bp, Homo sapiens
tacactttttactacagattct

SEQ ID NO: 9117546 - DNA, 22 bp, Homo sapiens
tacagaaaaacatctggagccg

SEQ ID NO: 9117547 - DNA, 22 bp, Homo sapiens
tacactgagatgactttggttt

SEQ ID NO: 9117548 - DNA, 22 bp, Homo sapiens
tacactgagcaggaagaagtgg

SEQ ID NO: 9117549 - DNA, 22 bp, Homo sapiens
tacaaagtgaaataattctgag

SEQ ID NO: 9117550 - DNA, 22 bp, Homo sapiens
tacaaagtgagcaacctctttt

SEQ ID NO: 9117551 - DNA, 22 bp, Homo sapiens
tacaaagtcaccagcttcttgc

SEQ ID NO: 9117552 - DNA, 22 bp, Homo sapiens
tacaaagtcagaataacaggtg

SEQ ID NO: 9117553 - DNA, 22 bp, Homo sapiens
tacaaagtcagaataacaggtg

SEQ ID NO: 9117554 - DNA, 22 bp, Homo sapiens
tacaaagtttggggtcctcaaa

SEQ ID NO: 9117555 - DNA, 20 bp, Homo sapiens
tacaacaagtagagacatac

SEQ ID NO: 9117556 - DNA, 20 bp, Homo sapiens
tacaacaagtagagacatac

SEQ ID NO: 9117557 - DNA, 22 bp, Homo sapiens
tacaacaatttccacattagaa

SEQ ID NO: 9117558 - DNA, 22 bp, Homo sapiens
tacaacactggttcgacatgtg

SEQ ID NO: 9117559 - DNA, 22 bp, Homo sapiens
tacagtacacaggtaccaagct

SEQ ID NO: 9117560 - DNA, 22 bp, Homo sapiens
tacagtaagatgaaatagcaat

SEQ ID NO: 9117561 - DNA, 21 bp, Homo sapiens
tacagtaagttgggtggtcct

SEQ ID NO: 9117562 - DNA, 22 bp, Homo sapiens
tacagtaccctgatgaactaaa

SEQ ID NO: 9117563 - DNA, 22 bp, Homo sapiens
tacagtacctgccacgttgttg

SEQ ID NO: 9117564 - DNA, 22 bp, Homo sapiens
tacagtacagtctagactctgg

SEQ ID NO: 9117565 - DNA, 22 bp, Homo sapiens
tacagtaccagaaatgctaaga

SEQ ID NO: 9117566 - DNA, 22 bp, Homo sapiens
tacataccttgacggtagatgg

SEQ ID NO: 9117567 - DNA, 22 bp, Homo sapiens
tacatacattacctcatttagt

SEQ ID NO: 9117568 - DNA, 22 bp, Homo sapiens
tacatacatgtatgtgtgtatt

SEQ ID NO: 9117569 - DNA, 22 bp, Homo sapiens
tacatacattacctcatttagt

SEQ ID NO: 9117570 - DNA, 22 bp, Homo sapiens
tacatagagggtaatagcatca

SEQ ID NO: 9117571 - DNA, 21 bp, Homo sapiens
tacatagaggtgatatctgtt

SEQ ID NO: 9117572 - DNA, 21 bp, Homo sapiens
tacatagaggtgatatctgtt

SEQ ID NO: 9117573 - DNA, 19 bp, Homo sapiens
tacatacttattctaaaag

SEQ ID NO: 9117574 - DNA, 22 bp, Homo sapiens
tacatactttttcttgcaagca

SEQ ID NO: 9117575 - DNA, 22 bp, Homo sapiens
tacatagaatatttcacttaaa

SEQ ID NO: 9117576 - DNA, 22 bp, Homo sapiens
tacatagagaagttacagtgga

SEQ ID NO: 9117577 - DNA, 19 bp, Homo sapiens
tacaggcagtttctacaat

SEQ ID NO: 9117578 - DNA, 22 bp, Homo sapiens
tacaggcactgaaatgcttatt

SEQ ID NO: 9117579 - DNA, 22 bp, Homo sapiens
tacaggcactgaaatgcttatt

SEQ ID NO: 9117580 - DNA, 22 bp, Homo sapiens
tacaggatatcacttcatttct

SEQ ID NO: 9117581 - DNA, 22 bp, Homo sapiens
tacaggagcatggggaagggat

SEQ ID NO: 9117582 - DNA, 17 bp, Homo sapiens
tacaggagagcaggaac

SEQ ID NO: 9117583 - DNA, 22 bp, Homo sapiens
tacagcacggtgcatttactac

SEQ ID NO: 9117584 - DNA, 22 bp, Homo sapiens
tacagcacggtgcatttactac

SEQ ID NO: 9117585 - DNA, 22 bp, Homo sapiens
tacagtaactggaattcttctt

SEQ ID NO: 9117586 - DNA, 22 bp, Homo sapiens
tacagtaagatgaaatagcaat

SEQ ID NO: 9117587 - DNA, 22 bp, Homo sapiens
tacagtaaccttatttgtcatt

SEQ ID NO: 9117588 - DNA, 22 bp, Homo sapiens
tacaggcccatagtccctgctt

SEQ ID NO: 9117589 - DNA, 22 bp, Homo sapiens
tacaggcatgaatgaaatctgt

SEQ ID NO: 9117590 - DNA, 22 bp, Homo sapiens
tacaggcatgtagcatggtgat

SEQ ID NO: 9117591 - DNA, 22 bp, Homo sapiens
tacaggcatgtagcatggtgat

SEQ ID NO: 9117592 - DNA, 22 bp, Homo sapiens
tacaggcatgaatgaaatctgt

SEQ ID NO: 9117593 - DNA, 22 bp, Homo sapiens
tacaggcatgaatgaaatctgt

SEQ ID NO: 9117594 - DNA, 22 bp, Homo sapiens
tacaggcactgaaatgcttatt

SEQ ID NO: 9117595 - DNA, 22 bp, Homo sapiens
tacatcatggtgagcaggaggc

SEQ ID NO: 9117596 - DNA, 22 bp, Homo sapiens
tacatatagacagttactctag

SEQ ID NO: 9117597 - DNA, 22 bp, Homo sapiens
tacatatactgagtgatttgct

SEQ ID NO: 9117598 - DNA, 22 bp, Homo sapiens
tacatagctcctagtgatgcat

SEQ ID NO: 9117599 - DNA, 22 bp, Homo sapiens
tacatagctcctagtgatgcat

SEQ ID NO: 9117600 - DNA, 22 bp, Homo sapiens
tacataggtacagcctttttta

SEQ ID NO: 9117601 - DNA, 22 bp, Homo sapiens
tacatagcaaggaaatgacaga

SEQ ID NO: 9117602 - DNA, 22 bp, Homo sapiens
tacatctcatctgtgctctccg

SEQ ID NO: 9117603 - DNA, 22 bp, Homo sapiens
tacatctcatctgtgctctccg

SEQ ID NO: 9117604 - DNA, 22 bp, Homo sapiens
tacattcctgttagcatctaag

SEQ ID NO: 9117605 - DNA, 22 bp, Homo sapiens
tacattcccccaattaccaatg

SEQ ID NO: 9117606 - DNA, 22 bp, Homo sapiens
tacatgaaataggattctggag

SEQ ID NO: 9117607 - DNA, 22 bp, Homo sapiens
tacattgacttggattgttaga

SEQ ID NO: 9117608 - DNA, 21 bp, Homo sapiens
tacattgactacaaataaagc

SEQ ID NO: 9117609 - DNA, 22 bp, Homo sapiens
tacattctatatctgttacatc

SEQ ID NO: 9117610 - DNA, 22 bp, Homo sapiens
tacattcctgggctccacccta

SEQ ID NO: 9117611 - DNA, 22 bp, Homo sapiens
tacattccttcgtttagagatt

SEQ ID NO: 9117612 - DNA, 22 bp, Homo sapiens
tacattctgaaataaatggttt

SEQ ID NO: 9117613 - DNA, 22 bp, Homo sapiens
tacattctggaaaggcacagac

SEQ ID NO: 9117614 - DNA, 23 bp, Homo sapiens
tacattctgtatttttatagagt

SEQ ID NO: 9117615 - DNA, 22 bp, Homo sapiens
tacattctggtggagaaagtaa

SEQ ID NO: 9117616 - DNA, 22 bp, Homo sapiens
tacattgaaagtcatttaatcc

SEQ ID NO: 9117617 - DNA, 22 bp, Homo sapiens
tacattgaaagtcatttaatcc

SEQ ID NO: 9117618 - DNA, 22 bp, Homo sapiens
tagccctcatctgctcaaaagg

SEQ ID NO: 9117619 - DNA, 22 bp, Homo sapiens
tagccctcagcttggagcgtgg

SEQ ID NO: 9117620 - DNA, 22 bp, Homo sapiens
tagccctgtccttggcctgtgc

SEQ ID NO: 9117621 - DNA, 22 bp, Homo sapiens
tagccctgtccttggcctgtgc

SEQ ID NO: 9117622 - DNA, 21 bp, Homo sapiens
tagcccttctccacctcgccc

SEQ ID NO: 9117623 - DNA, 21 bp, Homo sapiens
tagcccttctccacctcgccc

SEQ ID NO: 9117624 - DNA, 22 bp, Homo sapiens
tagcccttgatgctgcggccag

SEQ ID NO: 9117625 - DNA, 19 bp, Homo sapiens
tagccctggccatcatgag

SEQ ID NO: 9117626 - DNA, 19 bp, Homo sapiens
tagccctggccatcatgag

SEQ ID NO: 9117627 - DNA, 22 bp, Homo sapiens
tagccctgctgtgatgtgaagt

SEQ ID NO: 9117628 - DNA, 19 bp, Homo sapiens
tagccctggccatcatgag

SEQ ID NO: 9117629 - DNA, 22 bp, Homo sapiens
tagccctggagcagggaaatac

SEQ ID NO: 9117630 - DNA, 22 bp, Homo sapiens
tagccctctttaatccttccct

SEQ ID NO: 9117631 - DNA, 21 bp, Homo sapiens
tagccctctctgtctgtgtac

SEQ ID NO: 9117632 - DNA, 22 bp, Homo sapiens
tagccctctccagcgaggtctg

SEQ ID NO: 9117633 - DNA, 22 bp, Homo sapiens
tagcccaggctggagggcagtg

SEQ ID NO: 9117634 - DNA, 22 bp, Homo sapiens
tagcagctccatttctctggca

SEQ ID NO: 9117635 - DNA, 22 bp, Homo sapiens
tagcagctccatttctctggca

SEQ ID NO: 9117636 - DNA, 22 bp, Homo sapiens
tagcagctatgccattttgaca

SEQ ID NO: 9117637 - DNA, 22 bp, Homo sapiens
tagcagctcacagcctcccatt

SEQ ID NO: 9117638 - DNA, 22 bp, Homo sapiens
tagcagctcactaactctgcgt

SEQ ID NO: 9117639 - DNA, 22 bp, Homo sapiens
tagcttaaaccaatctgaataa

SEQ ID NO: 9117640 - DNA, 22 bp, Homo sapiens
tagctctgccaaatggaggctg

SEQ ID NO: 9117641 - DNA, 22 bp, Homo sapiens
tagctcctggtgagcctactct

SEQ ID NO: 9117642 - DNA, 22 bp, Homo sapiens
tagctctgaccaagagactgag

SEQ ID NO: 9117643 - DNA, 22 bp, Homo sapiens
tagccgggtgtggtggaactcc

SEQ ID NO: 9117644 - DNA, 22 bp, Homo sapiens
tagccgggtgttgtgtcatgca

SEQ ID NO: 9117645 - DNA, 22 bp, Homo sapiens
tagccgggtgtggtggaactcc

SEQ ID NO: 9117646 - DNA, 22 bp, Homo sapiens
tagcctctggaatcctttctct

SEQ ID NO: 9117647 - DNA, 22 bp, Homo sapiens
tagcagcatttttgtagagtat

SEQ ID NO: 9117648 - DNA, 23 bp, Homo sapiens
tagcagcatttttagcctctgtc

SEQ ID NO: 9117649 - DNA, 22 bp, Homo sapiens
tagcagctacctggctaagagt

SEQ ID NO: 9117650 - DNA, 23 bp, Homo sapiens
tagcagcatttttagcctctgtc

SEQ ID NO: 9117651 - DNA, 22 bp, Homo sapiens
tagcagcattaattccatttgc

SEQ ID NO: 9117652 - DNA, 22 bp, Homo sapiens
tagcagcatcctgtggtgatgg

SEQ ID NO: 9117653 - DNA, 22 bp, Homo sapiens
tagcagcatgtaagtgagtaga

SEQ ID NO: 9117654 - DNA, 17 bp, Homo sapiens
tagcagcagtaattgtg

SEQ ID NO: 9117655 - DNA, 22 bp, Homo sapiens
tagcagcaggggaaacagctgt

SEQ ID NO: 9117656 - DNA, 22 bp, Homo sapiens
tagcagagcgggtgcgaggcgg

SEQ ID NO: 9117657 - DNA, 22 bp, Homo sapiens
tagcagagcagggatcagagcc

SEQ ID NO: 9117658 - DNA, 22 bp, Homo sapiens
tagaggtactcccctcaaagtt

SEQ ID NO: 9117659 - DNA, 22 bp, Homo sapiens
tagaggtagcaacaggactaga

SEQ ID NO: 9117660 - DNA, 22 bp, Homo sapiens
tagaggtagagttacattagtc

SEQ ID NO: 9117661 - DNA, 22 bp, Homo sapiens
tagaggtagatggtcagccaat

SEQ ID NO: 9117662 - DNA, 22 bp, Homo sapiens
tagaggggaatctgcctcctct

SEQ ID NO: 9117663 - DNA, 18 bp, Homo sapiens
tagaggggaagaccttta

SEQ ID NO: 9117664 - DNA, 20 bp, Homo sapiens
tagaggggacaatcattgcc

SEQ ID NO: 9117665 - DNA, 18 bp, Homo sapiens
tagagggggcctgggcat

SEQ ID NO: 9117666 - DNA, 22 bp, Homo sapiens
tagaggtataccaaaaaggcat

SEQ ID NO: 9117667 - DNA, 22 bp, Homo sapiens
tagaggtatttttgatggtcat

SEQ ID NO: 9117668 - DNA, 22 bp, Homo sapiens
tagaggtgagattgtggtgctg

SEQ ID NO: 9117669 - DNA, 22 bp, Homo sapiens
tagaggtgagatattttatttt

SEQ ID NO: 9117670 - DNA, 22 bp, Homo sapiens
tagcagaagttgcaaactaggg

SEQ ID NO: 9117671 - DNA, 22 bp, Homo sapiens
tagcagaaccagtcagtgagcc

SEQ ID NO: 9117672 - DNA, 22 bp, Homo sapiens
tagcagaaccagtcagtgagcc

SEQ ID NO: 9117673 - DNA, 22 bp, Homo sapiens
tagggaggctacttcttgtagg

SEQ ID NO: 9117674 - DNA, 22 bp, Homo sapiens
tagggaggctacttcttgtagg

SEQ ID NO: 9117675 - DNA, 22 bp, Homo sapiens
tagggaggagggttttcaaatc

SEQ ID NO: 9117676 - DNA, 22 bp, Homo sapiens
tagggaggagggttttcaaatc

SEQ ID NO: 9117677 - DNA, 22 bp, Homo sapiens
tagggatgaagttgctatttac

SEQ ID NO: 9117678 - DNA, 22 bp, Homo sapiens
taggcactggggaggcagcatg

SEQ ID NO: 9117679 - DNA, 22 bp, Homo sapiens
taggcactgtgtttgtaggagt

SEQ ID NO: 9117680 - DNA, 22 bp, Homo sapiens
taggcactggttgtggatagtt

SEQ ID NO: 9117681 - DNA, 22 bp, Homo sapiens
taggcacttaataaatggtata

SEQ ID NO: 9117682 - DNA, 22 bp, Homo sapiens
taggcacttggcgtgttggaga

SEQ ID NO: 9117683 - DNA, 22 bp, Homo sapiens
taggctgggcattctggccagg

SEQ ID NO: 9117684 - DNA, 22 bp, Homo sapiens
tagggagaaacaccaatttatt

SEQ ID NO: 9117685 - DNA, 22 bp, Homo sapiens
taggcaaggcatttggctcttg

SEQ ID NO: 9117686 - DNA, 22 bp, Homo sapiens
taggcaagtggaccagaggttt

SEQ ID NO: 9117687 - DNA, 22 bp, Homo sapiens
taggcaagtggaccagaggttt

SEQ ID NO: 9117688 - DNA, 22 bp, Homo sapiens
taggcaagttgcccaatctctc

SEQ ID NO: 9117689 - DNA, 22 bp, Homo sapiens
taggcactagacatggttacca

SEQ ID NO: 9117690 - DNA, 22 bp, Homo sapiens
taggcacaagaccatgcaaagg

SEQ ID NO: 9117691 - DNA, 22 bp, Homo sapiens
taggcacaaaatgaaaatggca

SEQ ID NO: 9117692 - DNA, 22 bp, Homo sapiens
taggcactggatgaccgaagag

SEQ ID NO: 9117693 - DNA, 22 bp, Homo sapiens
taggcactgagtacatattggt

SEQ ID NO: 9117694 - DNA, 22 bp, Homo sapiens
taggcactgggctaggacaggt

SEQ ID NO: 9117695 - DNA, 22 bp, Homo sapiens
taggcactgaccttctcagatt

SEQ ID NO: 9117696 - DNA, 22 bp, Homo sapiens
taggcactgaggggagcaaggt

SEQ ID NO: 9117697 - DNA, 22 bp, Homo sapiens
taggcactgaggggagcaaggt

SEQ ID NO: 9117698 - DNA, 22 bp, Homo sapiens
taggcactgagtacatattggt

SEQ ID NO: 9117699 - DNA, 22 bp, Homo sapiens
tagctttgacagttgcaggcag

SEQ ID NO: 9117700 - DNA, 22 bp, Homo sapiens
taggaaaagtctagattgatga

SEQ ID NO: 9117701 - DNA, 22 bp, Homo sapiens
taggaaaagtctagattgatga

SEQ ID NO: 9117702 - DNA, 22 bp, Homo sapiens
taggaaaagcacaggatgttct

SEQ ID NO: 9117703 - DNA, 22 bp, Homo sapiens
taggaaactaatacagtctgga

SEQ ID NO: 9117704 - DNA, 22 bp, Homo sapiens
taggatacaaattctgtaattt

SEQ ID NO: 9117705 - DNA, 22 bp, Homo sapiens
taggatgatcttgtagagagat

SEQ ID NO: 9117706 - DNA, 22 bp, Homo sapiens
tagaaacatgttctgttctgtt

SEQ ID NO: 9117707 - DNA, 22 bp, Homo sapiens
tagaaacatgagagaaactctt

SEQ ID NO: 9117708 - DNA, 22 bp, Homo sapiens
tagaaacatgagagaaactctt

SEQ ID NO: 9117709 - DNA, 22 bp, Homo sapiens
tagaaacatgagagaaactctt

SEQ ID NO: 9117710 - DNA, 22 bp, Homo sapiens
tagaaacatatgtttgagacat

SEQ ID NO: 9117711 - DNA, 22 bp, Homo sapiens
tagaaacatcagctaaccaaaa

SEQ ID NO: 9117712 - DNA, 22 bp, Homo sapiens
tagaaacatatgtttgagacat

SEQ ID NO: 9117713 - DNA, 22 bp, Homo sapiens
tagaaacctcagggaaatcttt

SEQ ID NO: 9117714 - DNA, 22 bp, Homo sapiens
tagaaacccatgtttattcagt

SEQ ID NO: 9117715 - DNA, 22 bp, Homo sapiens
tagaaaccctgccttagtagct

SEQ ID NO: 9117716 - DNA, 22 bp, Homo sapiens
tagaaacattcagttgcagtcc

SEQ ID NO: 9117717 - DNA, 22 bp, Homo sapiens
tagaaacccaggatttgtattt

SEQ ID NO: 9117718 - DNA, 22 bp, Homo sapiens
tagaaaccatctcactgctcag

SEQ ID NO: 9117719 - DNA, 22 bp, Homo sapiens
tagaaacagagagatatgcccc

SEQ ID NO: 9117720 - DNA, 22 bp, Homo sapiens
tagaaacagaatatgagtgaga

SEQ ID NO: 9117721 - DNA, 22 bp, Homo sapiens
tagaaacagaatatgagtgaga

SEQ ID NO: 9117722 - DNA, 22 bp, Homo sapiens
tagaaacagagcaggtggccca

SEQ ID NO: 9117723 - DNA, 22 bp, Homo sapiens
tagaaacagatgtttttgaaga

SEQ ID NO: 9117724 - DNA, 22 bp, Homo sapiens
tagaaacatataggatggcagg

SEQ ID NO: 9117725 - DNA, 22 bp, Homo sapiens
tagaaacagcatatattagccc

SEQ ID NO: 9117726 - DNA, 22 bp, Homo sapiens
tagaaacagcatatattagccc

SEQ ID NO: 9117727 - DNA, 22 bp, Homo sapiens
tagaaacagcatatattagccc

SEQ ID NO: 9117728 - DNA, 22 bp, Homo sapiens
tagaaacagaatatgagtgaga

SEQ ID NO: 9117729 - DNA, 22 bp, Homo sapiens
tagaaacagaaaactgtaatag

SEQ ID NO: 9117730 - DNA, 22 bp, Homo sapiens
tagaaaagccccagctggaggg

SEQ ID NO: 9117731 - DNA, 22 bp, Homo sapiens
tagaaacacagagagacccatg

SEQ ID NO: 9117732 - DNA, 19 bp, Homo sapiens
tactttttcaggacagagt

SEQ ID NO: 9117733 - DNA, 22 bp, Homo sapiens
tactttttgtctctttgaatgt

SEQ ID NO: 9117734 - DNA, 22 bp, Homo sapiens
tactttttgtctctttgaatgt

SEQ ID NO: 9117735 - DNA, 22 bp, Homo sapiens
tagaaaactaatacatgcttga

SEQ ID NO: 9117736 - DNA, 22 bp, Homo sapiens
tagaaaagccccagctggaggg

SEQ ID NO: 9117737 - DNA, 22 bp, Homo sapiens
tagaaaagataacattctgtgc

SEQ ID NO: 9117738 - DNA, 22 bp, Homo sapiens
tagaaaagataacattctgtgc

SEQ ID NO: 9117739 - DNA, 22 bp, Homo sapiens
tacttttctttgtcatgcatct

SEQ ID NO: 9117740 - DNA, 22 bp, Homo sapiens
tactttttatgataagaactga

SEQ ID NO: 9117741 - DNA, 22 bp, Homo sapiens
tactttttagcacagtgtgtgc

SEQ ID NO: 9117742 - DNA, 22 bp, Homo sapiens
tactttttatgataagaactga

SEQ ID NO: 9117743 - DNA, 22 bp, Homo sapiens
tactttttatgataagaactga

SEQ ID NO: 9117744 - DNA, 22 bp, Homo sapiens
tactttttatgataagaactga

SEQ ID NO: 9117745 - DNA, 22 bp, Homo sapiens
tacttttatgtgatgaaatctg

SEQ ID NO: 9117746 - DNA, 22 bp, Homo sapiens
tacttttagcctatttgattct

SEQ ID NO: 9117747 - DNA, 22 bp, Homo sapiens
tacattttctaggggaccaaga

SEQ ID NO: 9117748 - DNA, 22 bp, Homo sapiens
tacatttgttatagaaatgaag

SEQ ID NO: 9117749 - DNA, 22 bp, Homo sapiens
tacattttctaggggaccaaga

SEQ ID NO: 9117750 - DNA, 22 bp, Homo sapiens
taccaaaaagtgagccccagag

SEQ ID NO: 9117751 - DNA, 22 bp, Homo sapiens
taccaaaagcttgtttcataca

SEQ ID NO: 9117752 - DNA, 22 bp, Homo sapiens
taccaaaagcttgtttcataca

SEQ ID NO: 9117753 - DNA, 22 bp, Homo sapiens
taccaaaagcttgtttcataca

SEQ ID NO: 9117754 - DNA, 22 bp, Homo sapiens
taccaaaaccaagccattatct

SEQ ID NO: 9117755 - DNA, 22 bp, Homo sapiens
tactttgaccaccatctgatta

SEQ ID NO: 9117756 - DNA, 22 bp, Homo sapiens
tacttttagcctatttgattct

SEQ ID NO: 9117757 - DNA, 22 bp, Homo sapiens
tactttggttaatgaaatgtga

SEQ ID NO: 9117758 - DNA, 22 bp, Homo sapiens
tactttgcagcttgataaaatg

SEQ ID NO: 9117759 - DNA, 22 bp, Homo sapiens
tactttgcatgcttgtgtgatc

SEQ ID NO: 9117760 - DNA, 21 bp, Homo sapiens
tactttgcaatgtatctcctt

SEQ ID NO: 9117761 - DNA, 22 bp, Homo sapiens
tactttgcggcgcggaggagca

SEQ ID NO: 9117762 - DNA, 22 bp, Homo sapiens
tactttgctaaaatgtgcagaa

SEQ ID NO: 9117763 - DNA, 22 bp, Homo sapiens
tagaaaggcaagcgtgaaatat

SEQ ID NO: 9117764 - DNA, 22 bp, Homo sapiens
tagaaagctgagtaatacattt

SEQ ID NO: 9117765 - DNA, 22 bp, Homo sapiens
tagaaagctggaggaattcttt

SEQ ID NO: 9117766 - DNA, 22 bp, Homo sapiens
tagaaagcttggggtgtttaaa

SEQ ID NO: 9117767 - DNA, 22 bp, Homo sapiens
tagaaagctgagtaatacattt

SEQ ID NO: 9117768 - DNA, 22 bp, Homo sapiens
tagaaagcgttaaatctacaga

SEQ ID NO: 9117769 - DNA, 22 bp, Homo sapiens
tagaaagccctgtgttcactgc

SEQ ID NO: 9117770 - DNA, 19 bp, Homo sapiens
tagaaagccagaaaacaga

SEQ ID NO: 9117771 - DNA, 22 bp, Homo sapiens
tagaaagccctgtgttcactgc

SEQ ID NO: 9117772 - DNA, 21 bp, Homo sapiens
tagaaagtcaaagctatcagc

SEQ ID NO: 9117773 - DNA, 22 bp, Homo sapiens
tagaaagtaaatcagttttatt

SEQ ID NO: 9117774 - DNA, 22 bp, Homo sapiens
tagaaataaatctgcagctggg

SEQ ID NO: 9117775 - DNA, 22 bp, Homo sapiens
tagaaataaatctgcagctggg

SEQ ID NO: 9117776 - DNA, 22 bp, Homo sapiens
tagaaatgaatgtttaaaagtc

SEQ ID NO: 9117777 - DNA, 22 bp, Homo sapiens
tagaaatgaatgtttaaaagtc

SEQ ID NO: 9117778 - DNA, 22 bp, Homo sapiens
tagaaatgaatgtttaaaagtc

SEQ ID NO: 9117779 - DNA, 22 bp, Homo sapiens
tagaaatgattgagctgtaata

SEQ ID NO: 9117780 - DNA, 22 bp, Homo sapiens
tagaaatgattggttgagctct

SEQ ID NO: 9117781 - DNA, 22 bp, Homo sapiens
tagaaatgattgagctgtaata

SEQ ID NO: 9117782 - DNA, 22 bp, Homo sapiens
tagaaatgattgagctgtaata

SEQ ID NO: 9117783 - DNA, 22 bp, Homo sapiens
tagaaatgcagtgtactgtgtc

SEQ ID NO: 9117784 - DNA, 22 bp, Homo sapiens
tagaaatgcagtgtactgtgtc

SEQ ID NO: 9117785 - DNA, 22 bp, Homo sapiens
tagaaatgcccagattctgcta

SEQ ID NO: 9117786 - DNA, 22 bp, Homo sapiens
tagaaatgcccagattctgcta

SEQ ID NO: 9117787 - DNA, 22 bp, Homo sapiens
tagaaatgattggttgagctct

SEQ ID NO: 9117788 - DNA, 22 bp, Homo sapiens
tagaaatgattggttgagctct

SEQ ID NO: 9117789 - DNA, 22 bp, Homo sapiens
tagaaatgattggttgagctct

SEQ ID NO: 9117790 - DNA, 22 bp, Homo sapiens
tagacaatctcagcaaacacac

SEQ ID NO: 9117791 - DNA, 22 bp, Homo sapiens
tagacaatatttgaaagtagtg

SEQ ID NO: 9117792 - DNA, 22 bp, Homo sapiens
tagacaactggagatagtctga

SEQ ID NO: 9117793 - DNA, 22 bp, Homo sapiens
tagacaatatttgaaagtagtg

SEQ ID NO: 9117794 - DNA, 22 bp, Homo sapiens
tagaaatggagaacagattaat

SEQ ID NO: 9117795 - DNA, 22 bp, Homo sapiens
tagaaatggagaacagattaat

SEQ ID NO: 9117796 - DNA, 22 bp, Homo sapiens
tagaaatggagaacagattaat

SEQ ID NO: 9117797 - DNA, 22 bp, Homo sapiens
tagaatgtggaggtaacagact

SEQ ID NO: 9117798 - DNA, 22 bp, Homo sapiens
tagacactgtatgagctgggtg

SEQ ID NO: 9117799 - DNA, 22 bp, Homo sapiens
tagacagatgttttctggctgt

SEQ ID NO: 9117800 - DNA, 22 bp, Homo sapiens
tagacagaatccagcccacgcc

SEQ ID NO: 9117801 - DNA, 22 bp, Homo sapiens
tagacagatttaaaggaatgga

SEQ ID NO: 9117802 - DNA, 22 bp, Homo sapiens
tagacacatcttcatccacaat

SEQ ID NO: 9117803 - DNA, 22 bp, Homo sapiens
tagaggggaaaatgcgtattaa

SEQ ID NO: 9117804 - DNA, 22 bp, Homo sapiens
tagaggcctgaaagaatgatca

SEQ ID NO: 9117805 - DNA, 22 bp, Homo sapiens
tatacacacctccaaagcagga

SEQ ID NO: 9117806 - DNA, 22 bp, Homo sapiens
tatacacacctccaaagcagga

SEQ ID NO: 9117807 - DNA, 22 bp, Homo sapiens
tatacacaaggtgtgcatttgt

SEQ ID NO: 9117808 - DNA, 22 bp, Homo sapiens
tatacacaaggtgtgcatttgt

SEQ ID NO: 9117809 - DNA, 22 bp, Homo sapiens
tatacaatgagtacattctggg

SEQ ID NO: 9117810 - DNA, 22 bp, Homo sapiens
tatacaatggctgaatcatcca

SEQ ID NO: 9117811 - DNA, 22 bp, Homo sapiens
tatacaagaggtgagatgagca

SEQ ID NO: 9117812 - DNA, 22 bp, Homo sapiens
tataatttttctgtggccagtt

SEQ ID NO: 9117813 - DNA, 22 bp, Homo sapiens
tatacaagtgagaagaagagtt

SEQ ID NO: 9117814 - DNA, 22 bp, Homo sapiens
tatacaagtaatgctgaatgat

SEQ ID NO: 9117815 - DNA, 22 bp, Homo sapiens
tataattttaagtggtaaatta

SEQ ID NO: 9117816 - DNA, 22 bp, Homo sapiens
tataatttatcatgtcacagtt

SEQ ID NO: 9117817 - DNA, 22 bp, Homo sapiens
tataatttggggaaagtggtgt

SEQ ID NO: 9117818 - DNA, 22 bp, Homo sapiens
tataatttggggaaagtggtgt

SEQ ID NO: 9117819 - DNA, 22 bp, Homo sapiens
tatacacatcctccaaagatag

SEQ ID NO: 9117820 - DNA, 22 bp, Homo sapiens
tatacacatatcttctaggcct

SEQ ID NO: 9117821 - DNA, 22 bp, Homo sapiens
tatacacaggaatctgtgaaaa

SEQ ID NO: 9117822 - DNA, 17 bp, Homo sapiens
tatacacagacagactg

SEQ ID NO: 9117823 - DNA, 22 bp, Homo sapiens
tatacacatttttacctatagt

SEQ ID NO: 9117824 - DNA, 23 bp, Homo sapiens
tatacacatgtggcagtatagtg

SEQ ID NO: 9117825 - DNA, 23 bp, Homo sapiens
tatacacatgtggcagtatagtg

SEQ ID NO: 9117826 - DNA, 22 bp, Homo sapiens
tatacacatgtgtgtattcata

SEQ ID NO: 9117827 - DNA, 22 bp, Homo sapiens
tataaatgccaggactttagat

SEQ ID NO: 9117828 - DNA, 22 bp, Homo sapiens
tataaatgccaggactttagat

SEQ ID NO: 9117829 - DNA, 22 bp, Homo sapiens
tataaattaatgtgcccatgag

SEQ ID NO: 9117830 - DNA, 22 bp, Homo sapiens
tataaattaatgtgcccatgag

SEQ ID NO: 9117831 - DNA, 22 bp, Homo sapiens
tataaatgcacttttgaaatat

SEQ ID NO: 9117832 - DNA, 22 bp, Homo sapiens
tataaagtttcgaaagatgtat

SEQ ID NO: 9117833 - DNA, 20 bp, Homo sapiens
tataaattcagagctttggt

SEQ ID NO: 9117834 - DNA, 22 bp, Homo sapiens
tataaattattaggctgctaaa

SEQ ID NO: 9117835 - DNA, 22 bp, Homo sapiens
taggtgtaccagccataccctg

SEQ ID NO: 9117836 - DNA, 22 bp, Homo sapiens
taggtcagaacaagcagtatcg

SEQ ID NO: 9117837 - DNA, 22 bp, Homo sapiens
taggtctctcttcttgatggga

SEQ ID NO: 9117838 - DNA, 22 bp, Homo sapiens
tatgagaaaataaatatctgtt

SEQ ID NO: 9117839 - DNA, 22 bp, Homo sapiens
tatgagaaaataaatatctgtt

SEQ ID NO: 9117840 - DNA, 21 bp, Homo sapiens
tatgagaaaactgaggtgcat

SEQ ID NO: 9117841 - DNA, 22 bp, Homo sapiens
tatgagaaattatacctaggtt

SEQ ID NO: 9117842 - DNA, 22 bp, Homo sapiens
tatgagaaagtcgtatgtctcc

SEQ ID NO: 9117843 - DNA, 22 bp, Homo sapiens
tatgagaaagtcgtatgtctcc

SEQ ID NO: 9117844 - DNA, 22 bp, Homo sapiens
tatgagaaaggagaatgacttt

SEQ ID NO: 9117845 - DNA, 22 bp, Homo sapiens
tatgagaaaggagaatgacttt

SEQ ID NO: 9117846 - DNA, 22 bp, Homo sapiens
tatgagaaaggagaatgacttt

SEQ ID NO: 9117847 - DNA, 22 bp, Homo sapiens
tatgagaacaagaacaatctcc

SEQ ID NO: 9117848 - DNA, 23 bp, Homo sapiens
tatgagaacccatacgctgtctt

SEQ ID NO: 9117849 - DNA, 22 bp, Homo sapiens
tatgagaacgggggcgtgtggg

SEQ ID NO: 9117850 - DNA, 22 bp, Homo sapiens
tatgagaacaagaacaatctcc

SEQ ID NO: 9117851 - DNA, 22 bp, Homo sapiens
tatgagaaattgctgatatttg

SEQ ID NO: 9117852 - DNA, 22 bp, Homo sapiens
tatgagaaattgctgatatttg

SEQ ID NO: 9117853 - DNA, 22 bp, Homo sapiens
tatgagaacaagaacaatctcc

SEQ ID NO: 9117854 - DNA, 22 bp, Homo sapiens
tatgagaagaacaggtgacttt

SEQ ID NO: 9117855 - DNA, 22 bp, Homo sapiens
tatgagaactgacagagtgcca

SEQ ID NO: 9117856 - DNA, 22 bp, Homo sapiens
tatgagaactgacagagtgcca

SEQ ID NO: 9117857 - DNA, 18 bp, Homo sapiens
tatgagaagattagcaat

SEQ ID NO: 9117858 - DNA, 22 bp, Homo sapiens
tatgagaaggtatggtgacttg

SEQ ID NO: 9117859 - DNA, 18 bp, Homo sapiens
tatgagaagattagcaat

SEQ ID NO: 9117860 - DNA, 22 bp, Homo sapiens
tatgacattttcccagatttat

SEQ ID NO: 9117861 - DNA, 22 bp, Homo sapiens
tatctacagttaatatgtcatc

SEQ ID NO: 9117862 - DNA, 22 bp, Homo sapiens
tatctacatgtaggtatgtatg

SEQ ID NO: 9117863 - DNA, 19 bp, Homo sapiens
tatgacaagtactagttct

SEQ ID NO: 9117864 - DNA, 19 bp, Homo sapiens
tatgacaagtactagttct

SEQ ID NO: 9117865 - DNA, 22 bp, Homo sapiens
tatctagaactccagaatgtag

SEQ ID NO: 9117866 - DNA, 20 bp, Homo sapiens
tatctaaatgcttacattac

SEQ ID NO: 9117867 - DNA, 22 bp, Homo sapiens
tatctaagaattccagagaaag

SEQ ID NO: 9117868 - DNA, 22 bp, Homo sapiens
tatctaaatggaatattccaga

SEQ ID NO: 9117869 - DNA, 22 bp, Homo sapiens
tatctaataaatctgataagta

SEQ ID NO: 9117870 - DNA, 22 bp, Homo sapiens
tatctaagagagtcaatattta

SEQ ID NO: 9117871 - DNA, 22 bp, Homo sapiens
tatcctaaatgttgaactgtga

SEQ ID NO: 9117872 - DNA, 22 bp, Homo sapiens
tatcctaagatgagcatgtcat

SEQ ID NO: 9117873 - DNA, 22 bp, Homo sapiens
tatccaaagtttctcagaaact

SEQ ID NO: 9117874 - DNA, 22 bp, Homo sapiens
tatccaattcaccattgatggg

SEQ ID NO: 9117875 - DNA, 22 bp, Homo sapiens
tatccaaagtggcatattatag

SEQ ID NO: 9117876 - DNA, 22 bp, Homo sapiens
tatccaaagtggcatattatag

SEQ ID NO: 9117877 - DNA, 22 bp, Homo sapiens
tatccatattaagatgcctctg

SEQ ID NO: 9117878 - DNA, 22 bp, Homo sapiens
tatccatttattttctaggcaa

SEQ ID NO: 9117879 - DNA, 22 bp, Homo sapiens
tatccattatgttggctagtct

SEQ ID NO: 9117880 - DNA, 22 bp, Homo sapiens
tatccattaggtctatggtcaa

SEQ ID NO: 9117881 - DNA, 22 bp, Homo sapiens
tatatatgggggaagctggatg

SEQ ID NO: 9117882 - DNA, 22 bp, Homo sapiens
tatatatgagcatgtgaggaca

SEQ ID NO: 9117883 - DNA, 22 bp, Homo sapiens
tatatattcttaagtagtgtag

SEQ ID NO: 9117884 - DNA, 22 bp, Homo sapiens
tatatattcttaagtagtgtag

SEQ ID NO: 9117885 - DNA, 19 bp, Homo sapiens
tatatattttggggttgtg

SEQ ID NO: 9117886 - DNA, 22 bp, Homo sapiens
tatatcatggagattaacattc

SEQ ID NO: 9117887 - DNA, 22 bp, Homo sapiens
tatatcatggagattaacattc

SEQ ID NO: 9117888 - DNA, 22 bp, Homo sapiens
tatagtaaaattttcatttatg

SEQ ID NO: 9117889 - DNA, 22 bp, Homo sapiens
tatagtacacttaggtacttca

SEQ ID NO: 9117890 - DNA, 21 bp, Homo sapiens
tatagtgtggatatgctgatg

SEQ ID NO: 9117891 - DNA, 22 bp, Homo sapiens
tatagttagtttcataatcatg

SEQ ID NO: 9117892 - DNA, 22 bp, Homo sapiens
tatagcacacagtttataaaag

SEQ ID NO: 9117893 - DNA, 22 bp, Homo sapiens
tataggaaacatacgtgactag

SEQ ID NO: 9117894 - DNA, 22 bp, Homo sapiens
tataggaataaagtggggtata

SEQ ID NO: 9117895 - DNA, 19 bp, Homo sapiens
tataggaagtgtggttaag

SEQ ID NO: 9117896 - DNA, 22 bp, Homo sapiens
tataggaagtgtagtgcttgga

SEQ ID NO: 9117897 - DNA, 22 bp, Homo sapiens
tataggaagtattcaaagactg

SEQ ID NO: 9117898 - DNA, 22 bp, Homo sapiens
tataggaaatttatctcctggg

SEQ ID NO: 9117899 - DNA, 22 bp, Homo sapiens
tataggaaatttatctcctggg

SEQ ID NO: 9117900 - DNA, 22 bp, Homo sapiens
tataggaaggcagattttagct

SEQ ID NO: 9117901 - DNA, 22 bp, Homo sapiens
tataggaaataggtcttctgtg

SEQ ID NO: 9117902 - DNA, 22 bp, Homo sapiens
tataggaaataggtcttctgtg

SEQ ID NO: 9117903 - DNA, 22 bp, Homo sapiens
tatgtacataacatgaaatgca

SEQ ID NO: 9117904 - DNA, 22 bp, Homo sapiens
tatgtacagggatagaacttga

SEQ ID NO: 9117905 - DNA, 22 bp, Homo sapiens
tatgtacagggatagaacttga

SEQ ID NO: 9117906 - DNA, 22 bp, Homo sapiens
tatgtacagtccttaacttaaa

SEQ ID NO: 9117907 - DNA, 22 bp, Homo sapiens
tatgtacataacatgaaatgca

SEQ ID NO: 9117908 - DNA, 22 bp, Homo sapiens
tatgtacataacatgaaatgca

SEQ ID NO: 9117909 - DNA, 22 bp, Homo sapiens
tatgtacacatacacttgtaat

SEQ ID NO: 9117910 - DNA, 22 bp, Homo sapiens
tatgtacaccaaggattgaaaa

SEQ ID NO: 9117911 - DNA, 22 bp, Homo sapiens
tatgtacacttaagtttgagaa

SEQ ID NO: 9117912 - DNA, 22 bp, Homo sapiens
tatgtacagggatagaacttga

SEQ ID NO: 9117913 - DNA, 22 bp, Homo sapiens
tatgtacaccggggaaggtggg

SEQ ID NO: 9117914 - DNA, 22 bp, Homo sapiens
tatgtacaccggggaaggtggg

SEQ ID NO: 9117915 - DNA, 22 bp, Homo sapiens
tatgtacaccggggaaggtggg

SEQ ID NO: 9117916 - DNA, 22 bp, Homo sapiens
tatgtacaccggggaaggtggg

SEQ ID NO: 9117917 - DNA, 22 bp, Homo sapiens
tatgtacaatttgttgtatgtc

SEQ ID NO: 9117918 - DNA, 22 bp, Homo sapiens
tatgtacaatttgttgtatgtc

SEQ ID NO: 9117919 - DNA, 22 bp, Homo sapiens
tatgtacacacacatgcatgta

SEQ ID NO: 9117920 - DNA, 22 bp, Homo sapiens
tatgtacacacacatgcatgta

SEQ ID NO: 9117921 - DNA, 22 bp, Homo sapiens
tatgtacacacacatgcatgta

SEQ ID NO: 9117922 - DNA, 22 bp, Homo sapiens
tatgtacacacacatgcatgta

SEQ ID NO: 9117923 - DNA, 22 bp, Homo sapiens
tatgtacaatcagcagttcata

SEQ ID NO: 9117924 - DNA, 22 bp, Homo sapiens
tatgtacaatcagcagttcata

SEQ ID NO: 9117925 - DNA, 22 bp, Homo sapiens
tatgtacaagcacacatgtgac

SEQ ID NO: 9117926 - DNA, 22 bp, Homo sapiens
tatgtacaagcacacatgtgac

SEQ ID NO: 9117927 - DNA, 22 bp, Homo sapiens
tatgagaatctgcagtatgctt

SEQ ID NO: 9117928 - DNA, 23 bp, Homo sapiens
tatgagaattaagtgcgagtgcc

SEQ ID NO: 9117929 - DNA, 22 bp, Homo sapiens
tatgagaataatctggtaaata

SEQ ID NO: 9117930 - DNA, 22 bp, Homo sapiens
tatgagaatctgcagtatgctt

SEQ ID NO: 9117931 - DNA, 18 bp, Homo sapiens
tatgagaagattagcaat

SEQ ID NO: 9117932 - DNA, 22 bp, Homo sapiens
tatgagaataatctggtaaata

SEQ ID NO: 9117933 - DNA, 22 bp, Homo sapiens
tatgagaatttgctaattggct

SEQ ID NO: 9117934 - DNA, 22 bp, Homo sapiens
tatgagcagacagtggttttac

SEQ ID NO: 9117935 - DNA, 20 bp, Homo sapiens
tatgagatttgacctcaaca

SEQ ID NO: 9117936 - DNA, 22 bp, Homo sapiens
tatgagatttggattcagtgaa

SEQ ID NO: 9117937 - DNA, 22 bp, Homo sapiens
tatgagatcccttttcctagag

SEQ ID NO: 9117938 - DNA, 22 bp, Homo sapiens
tatgagatattcccagcgtcta

SEQ ID NO: 9117939 - DNA, 22 bp, Homo sapiens
tatgtgcacattagagagatgg

SEQ ID NO: 9117940 - DNA, 22 bp, Homo sapiens
tatgtgcaaattaattgctaga

SEQ ID NO: 9117941 - DNA, 22 bp, Homo sapiens
tatgtgcaaaatgctagactag

SEQ ID NO: 9117942 - DNA, 22 bp, Homo sapiens
tatgtgaagagattaaaaaata

SEQ ID NO: 9117943 - DNA, 22 bp, Homo sapiens
tatgtgaatacagcagtggatg

SEQ ID NO: 9117944 - DNA, 22 bp, Homo sapiens
tatgtcttttgcttgcaaatag

SEQ ID NO: 9117945 - DNA, 22 bp, Homo sapiens
tattagcagcatgagaatgggc

SEQ ID NO: 9117946 - DNA, 22 bp, Homo sapiens
tattagcacaaagcaaggtatt

SEQ ID NO: 9117947 - DNA, 23 bp, Homo sapiens
tattagcaattcccacagagcag

SEQ ID NO: 9117948 - DNA, 22 bp, Homo sapiens
tattagaaagcttaatatcgtg

SEQ ID NO: 9117949 - DNA, 22 bp, Homo sapiens
tattagaggaaccaaggtggag

SEQ ID NO: 9117950 - DNA, 22 bp, Homo sapiens
tattacatccacttttattgca

SEQ ID NO: 9117951 - DNA, 22 bp, Homo sapiens
tattagaaagcttaatatcgtg

SEQ ID NO: 9117952 - DNA, 22 bp, Homo sapiens
tattacagttcgagtttctagg

SEQ ID NO: 9117953 - DNA, 22 bp, Homo sapiens
tattacagggctagttatgagt

SEQ ID NO: 9117954 - DNA, 22 bp, Homo sapiens
tattacagggctagttatgagt

SEQ ID NO: 9117955 - DNA, 22 bp, Homo sapiens
tattacaatttacattgcactt

SEQ ID NO: 9117956 - DNA, 19 bp, Homo sapiens
tatgtgtgcatttgtgcat

SEQ ID NO: 9117957 - DNA, 21 bp, Homo sapiens
tatttattaatttgtaaggct

SEQ ID NO: 9117958 - DNA, 22 bp, Homo sapiens
tatttatcgagtgtctactatg

SEQ ID NO: 9117959 - DNA, 22 bp, Homo sapiens
tatttatcaaggtaggagaata

SEQ ID NO: 9117960 - DNA, 22 bp, Homo sapiens
tatttatcaaggtaggagaata

SEQ ID NO: 9117961 - DNA, 22 bp, Homo sapiens
tatttatattctgccttctgct

SEQ ID NO: 9117962 - DNA, 22 bp, Homo sapiens
tatttatcaaggtaggagaata

SEQ ID NO: 9117963 - DNA, 22 bp, Homo sapiens
tatttatattctgccttctgct

SEQ ID NO: 9117964 - DNA, 22 bp, Homo sapiens
tatttataccaggtgatcggag

SEQ ID NO: 9117965 - DNA, 22 bp, Homo sapiens
tatttaatttgctcattgtgat

SEQ ID NO: 9117966 - DNA, 20 bp, Homo sapiens
tatttacaacttagagcctc

SEQ ID NO: 9117967 - DNA, 20 bp, Homo sapiens
tatttacaacttagagcctc

SEQ ID NO: 9117968 - DNA, 22 bp, Homo sapiens
tatttataatctgccaaagaga

SEQ ID NO: 9117969 - DNA, 22 bp, Homo sapiens
tatttataatctgccaaagaga

SEQ ID NO: 9117970 - DNA, 22 bp, Homo sapiens
tattgacaggtgcctgcagaca

SEQ ID NO: 9117971 - DNA, 22 bp, Homo sapiens
tatttctcagcattttacatcc

SEQ ID NO: 9117972 - DNA, 22 bp, Homo sapiens
tatttctattccccaggcaagt

SEQ ID NO: 9117973 - DNA, 22 bp, Homo sapiens
tatttctcttcaaaattgatgt

SEQ ID NO: 9117974 - DNA, 22 bp, Homo sapiens
tatttctattccccaggcaagt

SEQ ID NO: 9117975 - DNA, 22 bp, Homo sapiens
tatttctattccccaggcaagt

SEQ ID NO: 9117976 - DNA, 22 bp, Homo sapiens
tatttctattccccaggcaagt

SEQ ID NO: 9117977 - DNA, 22 bp, Homo sapiens
tatttctaagctgtaagtctga

SEQ ID NO: 9117978 - DNA, 22 bp, Homo sapiens
tatttctaagctgtaagtctga

SEQ ID NO: 9117979 - DNA, 22 bp, Homo sapiens
tatttattcattcagcaagcat

SEQ ID NO: 9117980 - DNA, 22 bp, Homo sapiens
tatttattctttgtactgcctt

SEQ ID NO: 9117981 - DNA, 22 bp, Homo sapiens
tattgaagattttgtggttgct

SEQ ID NO: 9117982 - DNA, 22 bp, Homo sapiens
tattgaagagataagtgacaga

SEQ ID NO: 9117983 - DNA, 22 bp, Homo sapiens
tattgacaataggcaactgagg

SEQ ID NO: 9117984 - DNA, 22 bp, Homo sapiens
tattgaattagaccctaaaatg

SEQ ID NO: 9117985 - DNA, 22 bp, Homo sapiens
tattgaattagaccctaaaatg

SEQ ID NO: 9117986 - DNA, 22 bp, Homo sapiens
tattgacaataggcaactgagg

SEQ ID NO: 9117987 - DNA, 22 bp, Homo sapiens
tattcttactctcgactgcatt

SEQ ID NO: 9117988 - DNA, 22 bp, Homo sapiens
tattctcagtgctataagtaga

SEQ ID NO: 9117989 - DNA, 22 bp, Homo sapiens
tattctcattagtctgtattcc

SEQ ID NO: 9117990 - DNA, 22 bp, Homo sapiens
tattctacgagtttggtaattt

SEQ ID NO: 9117991 - DNA, 22 bp, Homo sapiens
tattctgtgtgatatgtaaatg

SEQ ID NO: 9117992 - DNA, 19 bp, Homo sapiens
tattctgttaacctttgtc

SEQ ID NO: 9117993 - DNA, 22 bp, Homo sapiens
tattattatattggatgagact

SEQ ID NO: 9117994 - DNA, 22 bp, Homo sapiens
tattattatattggatgagact

SEQ ID NO: 9117995 - DNA, 22 bp, Homo sapiens
tattattgcaagtatataaagt

SEQ ID NO: 9117996 - DNA, 22 bp, Homo sapiens
tattattgactattcagaatgt

SEQ ID NO: 9117997 - DNA, 22 bp, Homo sapiens
tattcattatgaccaaatctag

SEQ ID NO: 9117998 - DNA, 22 bp, Homo sapiens
tattccaaaatcccaaactgcc

SEQ ID NO: 9117999 - DNA, 22 bp, Homo sapiens
tattatttttattcgagggaaa

SEQ ID NO: 9118000 - DNA, 22 bp, Homo sapiens
tattattttagcactgaggatt

SEQ ID NO: 9118001 - DNA, 19 bp, Homo sapiens
tattatttgtagcaaggcc

SEQ ID NO: 9118002 - DNA, 22 bp, Homo sapiens
tattattttagcactgaggatt

SEQ ID NO: 9118003 - DNA, 22 bp, Homo sapiens
tattcaaagtaccttcattgcc

SEQ ID NO: 9118004 - DNA, 22 bp, Homo sapiens
tccccacatctctgcatcaggc

SEQ ID NO: 9118005 - DNA, 19 bp, Homo sapiens
tccccaagagttctagctc

SEQ ID NO: 9118006 - DNA, 22 bp, Homo sapiens
tccccaaagctttgtggtcagg

SEQ ID NO: 9118007 - DNA, 22 bp, Homo sapiens
tccccaggaaattctgattctt

SEQ ID NO: 9118008 - DNA, 22 bp, Homo sapiens
tccccaggaaggcccttcctgg

SEQ ID NO: 9118009 - DNA, 22 bp, Homo sapiens
tccccaggaaattctgattctt

SEQ ID NO: 9118010 - DNA, 22 bp, Homo sapiens
tccccaggagcaatgattcagt

SEQ ID NO: 9118011 - DNA, 22 bp, Homo sapiens
tccccaggaatcaggtggttgc

SEQ ID NO: 9118012 - DNA, 22 bp, Homo sapiens
tccccaccccagaactactagg

SEQ ID NO: 9118013 - DNA, 22 bp, Homo sapiens
tccccacctaagatacccatct

SEQ ID NO: 9118014 - DNA, 22 bp, Homo sapiens
tccccacctaagatacccatct

SEQ ID NO: 9118015 - DNA, 22 bp, Homo sapiens
tccccacctacacactgctcct

SEQ ID NO: 9118016 - DNA, 22 bp, Homo sapiens
tccccacctacacactgctcct

SEQ ID NO: 9118017 - DNA, 22 bp, Homo sapiens
tccccaggggcatctctctgct

SEQ ID NO: 9118018 - DNA, 22 bp, Homo sapiens
tccccaggggcatctctctgct

SEQ ID NO: 9118019 - DNA, 22 bp, Homo sapiens
tccccagggtccctgcttccat

SEQ ID NO: 9118020 - DNA, 22 bp, Homo sapiens
tccccagggtccctgcttccat

SEQ ID NO: 9118021 - DNA, 22 bp, Homo sapiens
tccccaggggcctgggcacagt

SEQ ID NO: 9118022 - DNA, 22 bp, Homo sapiens
tccccaggagttttactttgca

SEQ ID NO: 9118023 - DNA, 22 bp, Homo sapiens
tccccaggagcaatgattcagt

SEQ ID NO: 9118024 - DNA, 22 bp, Homo sapiens
tcccacaggaaagtagacattg

SEQ ID NO: 9118025 - DNA, 22 bp, Homo sapiens
tcccagggactggatgatgcag

SEQ ID NO: 9118026 - DNA, 22 bp, Homo sapiens
tcccacaggtggagcttgcagt

SEQ ID NO: 9118027 - DNA, 22 bp, Homo sapiens
tcccagggactgggctaggctt

SEQ ID NO: 9118028 - DNA, 22 bp, Homo sapiens
tcccagggttacagccagggca

SEQ ID NO: 9118029 - DNA, 22 bp, Homo sapiens
tcccagggttacagccagggca

SEQ ID NO: 9118030 - DNA, 22 bp, Homo sapiens
tcccagggtgcgcctgccctcg

SEQ ID NO: 9118031 - DNA, 21 bp, Homo sapiens
tcccagggtcttatgggatgt

SEQ ID NO: 9118032 - DNA, 22 bp, Homo sapiens
tcccagggtgaaatgcagtagg

SEQ ID NO: 9118033 - DNA, 22 bp, Homo sapiens
tcccagggatcctccgggtcgc

SEQ ID NO: 9118034 - DNA, 22 bp, Homo sapiens
tcccagggattaggacatggat

SEQ ID NO: 9118035 - DNA, 22 bp, Homo sapiens
tcccagggattaggacatggat

SEQ ID NO: 9118036 - DNA, 22 bp, Homo sapiens
tcccagtgtggcaggccatgga

SEQ ID NO: 9118037 - DNA, 22 bp, Homo sapiens
tcccagtggtcttgaaacaggg

SEQ ID NO: 9118038 - DNA, 22 bp, Homo sapiens
tcccagtggtgggtgcacattt

SEQ ID NO: 9118039 - DNA, 22 bp, Homo sapiens
tcccagtgggtgactggaggct

SEQ ID NO: 9118040 - DNA, 22 bp, Homo sapiens
tcccagtgaggtcctggctgtc

SEQ ID NO: 9118041 - DNA, 22 bp, Homo sapiens
tcccagtgaggtcctggctgtc

SEQ ID NO: 9118042 - DNA, 22 bp, Homo sapiens
tcccagtgaggtcctggctgtc

SEQ ID NO: 9118043 - DNA, 22 bp, Homo sapiens
tcccagtgggaagcagcacgct

SEQ ID NO: 9118044 - DNA, 22 bp, Homo sapiens
tcccagtctagagccggattgg

SEQ ID NO: 9118045 - DNA, 22 bp, Homo sapiens
tcccagtgagatgaaacaggta

SEQ ID NO: 9118046 - DNA, 22 bp, Homo sapiens
tcccaggttccaccatccaggg

SEQ ID NO: 9118047 - DNA, 20 bp, Homo sapiens
tcccagtcagccagagtgag

SEQ ID NO: 9118048 - DNA, 22 bp, Homo sapiens
tcccatggtctatatagaggca

SEQ ID NO: 9118049 - DNA, 22 bp, Homo sapiens
tcccattgccatagataggaca

SEQ ID NO: 9118050 - DNA, 22 bp, Homo sapiens
tcccatctccaacatttttctt

SEQ ID NO: 9118051 - DNA, 22 bp, Homo sapiens
tcccatcagtcattggttgagg

SEQ ID NO: 9118052 - DNA, 22 bp, Homo sapiens
tcattgaatttggttcaatatg

SEQ ID NO: 9118053 - DNA, 22 bp, Homo sapiens
tcattgaggaaaggtagtggct

SEQ ID NO: 9118054 - DNA, 22 bp, Homo sapiens
tcattgaagcccttgacaagcc

SEQ ID NO: 9118055 - DNA, 22 bp, Homo sapiens
tcattgaatgagatgcaataga

SEQ ID NO: 9118056 - DNA, 22 bp, Homo sapiens
tcattgaagtgactgaaagatt

SEQ ID NO: 9118057 - DNA, 19 bp, Homo sapiens
tccagaagtccctgagcgg

SEQ ID NO: 9118058 - DNA, 22 bp, Homo sapiens
tcattgcagtagggagagaccc

SEQ ID NO: 9118059 - DNA, 22 bp, Homo sapiens
tcattgcatttattcactggca

SEQ ID NO: 9118060 - DNA, 22 bp, Homo sapiens
tccagagaggtttctccatgct

SEQ ID NO: 9118061 - DNA, 20 bp, Homo sapiens
tccagagagtggcaaagctc

SEQ ID NO: 9118062 - DNA, 18 bp, Homo sapiens
tccagagagggagaagtg

SEQ ID NO: 9118063 - DNA, 20 bp, Homo sapiens
tccagacatctagctcagtt

SEQ ID NO: 9118064 - DNA, 22 bp, Homo sapiens
tccagagctaattcagcagctg

SEQ ID NO: 9118065 - DNA, 22 bp, Homo sapiens
tccagagcctatatgttcaact

SEQ ID NO: 9118066 - DNA, 22 bp, Homo sapiens
tccagagcctgcgcactggctg

SEQ ID NO: 9118067 - DNA, 22 bp, Homo sapiens
tccagagcaggtggtcagaagg

SEQ ID NO: 9118068 - DNA, 17 bp, Homo sapiens
tccagagcacagagctc

SEQ ID NO: 9118069 - DNA, 22 bp, Homo sapiens
tccagagatctctcttccctgt

SEQ ID NO: 9118070 - DNA, 22 bp, Homo sapiens
tccagagatcacactgggcagg

SEQ ID NO: 9118071 - DNA, 22 bp, Homo sapiens
tccagagatcacactgggcagg

SEQ ID NO: 9118072 - DNA, 20 bp, Homo sapiens
tccagagagtggcaaagctc

SEQ ID NO: 9118073 - DNA, 22 bp, Homo sapiens
tccagcagaccatcaaggctca

SEQ ID NO: 9118074 - DNA, 23 bp, Homo sapiens
tccagcagagccttccaggaggg

SEQ ID NO: 9118075 - DNA, 23 bp, Homo sapiens
tccagcagagccttccaggaggg

SEQ ID NO: 9118076 - DNA, 22 bp, Homo sapiens
tccagcagactcatcagcaagg

SEQ ID NO: 9118077 - DNA, 23 bp, Homo sapiens
tccagcagagccttccaggaggg

SEQ ID NO: 9118078 - DNA, 23 bp, Homo sapiens
tccagcagccaagaagggtagaa

SEQ ID NO: 9118079 - DNA, 23 bp, Homo sapiens
tccagcagccaagaagggtagaa

SEQ ID NO: 9118080 - DNA, 22 bp, Homo sapiens
tccagcaggtgtttgccaactt

SEQ ID NO: 9118081 - DNA, 18 bp, Homo sapiens
tccagcaggtctgaggtg

SEQ ID NO: 9118082 - DNA, 22 bp, Homo sapiens
tccagcaggtccgagacaagtt

SEQ ID NO: 9118083 - DNA, 22 bp, Homo sapiens
tccagcaggtccgagacaagtt

SEQ ID NO: 9118084 - DNA, 22 bp, Homo sapiens
tccagcagccacacctctggac

SEQ ID NO: 9118085 - DNA, 22 bp, Homo sapiens
tccagcagccacacctctggac

SEQ ID NO: 9118086 - DNA, 22 bp, Homo sapiens
tccagcagcccgaaggcccatc

SEQ ID NO: 9118087 - DNA, 22 bp, Homo sapiens
tccagcagggaattagtagtct

SEQ ID NO: 9118088 - DNA, 22 bp, Homo sapiens
tccagcagcctgacttccctct

SEQ ID NO: 9118089 - DNA, 22 bp, Homo sapiens
tccagaggcagctgcggtcagg

SEQ ID NO: 9118090 - DNA, 21 bp, Homo sapiens
tccagaggaggacagactcag

SEQ ID NO: 9118091 - DNA, 21 bp, Homo sapiens
tccagaggaggacagactcag

SEQ ID NO: 9118092 - DNA, 22 bp, Homo sapiens
tccagagctgagggtcagtaga

SEQ ID NO: 9118093 - DNA, 22 bp, Homo sapiens
tccagaggggcagccctgtgct

SEQ ID NO: 9118094 - DNA, 22 bp, Homo sapiens
tccagaggcagctgcggtcagg

SEQ ID NO: 9118095 - DNA, 20 bp, Homo sapiens
tccagaggccacatccagtg

SEQ ID NO: 9118096 - DNA, 22 bp, Homo sapiens
tccagaggcagctgcggtcagg

SEQ ID NO: 9118097 - DNA, 20 bp, Homo sapiens
tccagaggccacatccagtg

SEQ ID NO: 9118098 - DNA, 20 bp, Homo sapiens
tccagctgtctttcagagac

SEQ ID NO: 9118099 - DNA, 22 bp, Homo sapiens
tccagctctggcttggctagct

SEQ ID NO: 9118100 - DNA, 22 bp, Homo sapiens
tccagctctggcttggctagct

SEQ ID NO: 9118101 - DNA, 22 bp, Homo sapiens
tccagctctaaggctgatagcc

SEQ ID NO: 9118102 - DNA, 22 bp, Homo sapiens
tccagctctaacatgctgggcc

SEQ ID NO: 9118103 - DNA, 22 bp, Homo sapiens
tccaggaggcctcatttcctgt

SEQ ID NO: 9118104 - DNA, 22 bp, Homo sapiens
tccaggaggctctggttgacgt

SEQ ID NO: 9118105 - DNA, 22 bp, Homo sapiens
tccagcttcttgacttggtggt

SEQ ID NO: 9118106 - DNA, 22 bp, Homo sapiens
tccagcttccagtggctggctg

SEQ ID NO: 9118107 - DNA, 22 bp, Homo sapiens
tccagcaggttggtcaggtgca

SEQ ID NO: 9118108 - DNA, 22 bp, Homo sapiens
tccagcagtccatgtgagacac

SEQ ID NO: 9118109 - DNA, 22 bp, Homo sapiens
tccagcagtccatgtgagacac

SEQ ID NO: 9118110 - DNA, 22 bp, Homo sapiens
tccagcagtgctctagagcgtg

SEQ ID NO: 9118111 - DNA, 20 bp, Homo sapiens
tccagcatataaactcctct

SEQ ID NO: 9118112 - DNA, 22 bp, Homo sapiens
tccagcagtgctcaggactcac

SEQ ID NO: 9118113 - DNA, 22 bp, Homo sapiens
tccagccaagggaggttactag

SEQ ID NO: 9118114 - DNA, 22 bp, Homo sapiens
tccagccaactgcctagggagc

SEQ ID NO: 9118115 - DNA, 22 bp, Homo sapiens
tccagccaagccttggtagctg

SEQ ID NO: 9118116 - DNA, 22 bp, Homo sapiens
tccagcctttctactcactgag

SEQ ID NO: 9118117 - DNA, 22 bp, Homo sapiens
tccagccaactgcctagggagc

SEQ ID NO: 9118118 - DNA, 22 bp, Homo sapiens
tccagcatgactagttccccat

SEQ ID NO: 9118119 - DNA, 22 bp, Homo sapiens
tccagcattcttagacctctat

SEQ ID NO: 9118120 - DNA, 22 bp, Homo sapiens
tccagctcagatgcagggatca

SEQ ID NO: 9118121 - DNA, 22 bp, Homo sapiens
tccagctcagggttggctcaag

SEQ ID NO: 9118122 - DNA, 22 bp, Homo sapiens
tccagctcagggttggctcaag

SEQ ID NO: 9118123 - DNA, 22 bp, Homo sapiens
tccagctcagggttggctcaag

SEQ ID NO: 9118124 - DNA, 18 bp, Homo sapiens
tccagctcacagatgggc

SEQ ID NO: 9118125 - DNA, 22 bp, Homo sapiens
tccagctcaaagtgctcctgtc

SEQ ID NO: 9118126 - DNA, 22 bp, Homo sapiens
tccagctcaaagtgctcctgtc

SEQ ID NO: 9118127 - DNA, 22 bp, Homo sapiens
tccagcctttctactcactgag

SEQ ID NO: 9118128 - DNA, 18 bp, Homo sapiens
tccagcgtgctccagggc

SEQ ID NO: 9118129 - DNA, 23 bp, Homo sapiens
tccagctcccttcaatggcactg

SEQ ID NO: 9118130 - DNA, 23 bp, Homo sapiens
tccagctcccttcaatggcactg

SEQ ID NO: 9118131 - DNA, 23 bp, Homo sapiens
tccagctcccttcaatggcactg

SEQ ID NO: 9118132 - DNA, 17 bp, Homo sapiens
tccagctcctcattgtt

SEQ ID NO: 9118133 - DNA, 22 bp, Homo sapiens
tccaggctcagcacttgctact

SEQ ID NO: 9118134 - DNA, 23 bp, Homo sapiens
tccaggctgaaggagcagatttt

SEQ ID NO: 9118135 - DNA, 22 bp, Homo sapiens
tccaggcatcccccaggacaga

SEQ ID NO: 9118136 - DNA, 22 bp, Homo sapiens
tccaggcatgtggccagtactc

SEQ ID NO: 9118137 - DNA, 22 bp, Homo sapiens
tccaggcatgtctgagtccttc

SEQ ID NO: 9118138 - DNA, 22 bp, Homo sapiens
tccaggccaatgtagcaggccc

SEQ ID NO: 9118139 - DNA, 22 bp, Homo sapiens
tccaggccaatgtagcaggccc

SEQ ID NO: 9118140 - DNA, 22 bp, Homo sapiens
tccaggccaatgtagcaggccc

SEQ ID NO: 9118141 - DNA, 22 bp, Homo sapiens
tccaggagtgtgtgctaatggg

SEQ ID NO: 9118142 - DNA, 22 bp, Homo sapiens
tccaggagtggggcagaggtct

SEQ ID NO: 9118143 - DNA, 22 bp, Homo sapiens
tccaggattgtcagccagaagg

SEQ ID NO: 9118144 - DNA, 22 bp, Homo sapiens
tccaggattgcaggtgcacaac

SEQ ID NO: 9118145 - DNA, 22 bp, Homo sapiens
tccaggagtttgagactgcagt

SEQ ID NO: 9118146 - DNA, 22 bp, Homo sapiens
tccaggatgcccgcttttgctt

SEQ ID NO: 9118147 - DNA, 22 bp, Homo sapiens
tccaggatggtgacggtggcca

SEQ ID NO: 9118148 - DNA, 22 bp, Homo sapiens
tccaggcagtcattaatctcta

SEQ ID NO: 9118149 - DNA, 22 bp, Homo sapiens
tccaggagtcctgggtggcccc

SEQ ID NO: 9118150 - DNA, 22 bp, Homo sapiens
tccaggagtctagcctcaggcc

SEQ ID NO: 9118151 - DNA, 22 bp, Homo sapiens
tccaggagtcctgggagtgatt

SEQ ID NO: 9118152 - DNA, 22 bp, Homo sapiens
tccaggagtcagacagatggtg

SEQ ID NO: 9118153 - DNA, 22 bp, Homo sapiens
tccaggaggttgagtgagttcc

SEQ ID NO: 9118154 - DNA, 22 bp, Homo sapiens
tccaggaggtttggaggaagca

SEQ ID NO: 9118155 - DNA, 22 bp, Homo sapiens
tccaggaggtgaggggaccaaa

SEQ ID NO: 9118156 - DNA, 22 bp, Homo sapiens
tccaggaggttgagactgcagt

SEQ ID NO: 9118157 - DNA, 22 bp, Homo sapiens
tccaggagggttttctgccttc

SEQ ID NO: 9118158 - DNA, 22 bp, Homo sapiens
tccatccctgactcctcctgga

SEQ ID NO: 9118159 - DNA, 22 bp, Homo sapiens
tccatctacggctataccaccc

SEQ ID NO: 9118160 - DNA, 22 bp, Homo sapiens
tccatctcacctgcactctgcg

SEQ ID NO: 9118161 - DNA, 22 bp, Homo sapiens
tccatctgtctttcccatccac

SEQ ID NO: 9118162 - DNA, 22 bp, Homo sapiens
tccatctggtggcttccttttg

SEQ ID NO: 9118163 - DNA, 23 bp, Homo sapiens
tccatctgtgagcatgccctgga

SEQ ID NO: 9118164 - DNA, 20 bp, Homo sapiens
tccatcttgggcagaagcag

SEQ ID NO: 9118165 - DNA, 20 bp, Homo sapiens
tccatctggtataagctgat

SEQ ID NO: 9118166 - DNA, 22 bp, Homo sapiens
tcccaagcaatgagtcagggcc

SEQ ID NO: 9118167 - DNA, 19 bp, Homo sapiens
tcccaagatttctgtatca

SEQ ID NO: 9118168 - DNA, 20 bp, Homo sapiens
tcccaaggatgcctgggtgt

SEQ ID NO: 9118169 - DNA, 22 bp, Homo sapiens
tcccaaggataagagagtctga

SEQ ID NO: 9118170 - DNA, 22 bp, Homo sapiens
tcccaaggcacagggcagggac

SEQ ID NO: 9118171 - DNA, 22 bp, Homo sapiens
tcccaaggtgctcggcaacagg

SEQ ID NO: 9118172 - DNA, 22 bp, Homo sapiens
tcccaagtgtcttggaccaggg

SEQ ID NO: 9118173 - DNA, 22 bp, Homo sapiens
tcccaagtgtcttggaccaggg

SEQ ID NO: 9118174 - DNA, 22 bp, Homo sapiens
tcccacagatgctgtccagagt

SEQ ID NO: 9118175 - DNA, 20 bp, Homo sapiens
tccagggccctggctcctct

SEQ ID NO: 9118176 - DNA, 20 bp, Homo sapiens
tccagggctagggagctcat

SEQ ID NO: 9118177 - DNA, 22 bp, Homo sapiens
tccagttgcccatctctcttct

SEQ ID NO: 9118178 - DNA, 22 bp, Homo sapiens
tccagggctccccaacatccag

SEQ ID NO: 9118179 - DNA, 22 bp, Homo sapiens
tccatcatgttcacagctatat

SEQ ID NO: 9118180 - DNA, 22 bp, Homo sapiens
tccatcatggcagcagcagtga

SEQ ID NO: 9118181 - DNA, 22 bp, Homo sapiens
tccatcaggctcgtgggctctc

SEQ ID NO: 9118182 - DNA, 22 bp, Homo sapiens
tccagtttccaatcactgcacg

SEQ ID NO: 9118183 - DNA, 22 bp, Homo sapiens
tcagagcccctccgctgtccca

SEQ ID NO: 9118184 - DNA, 22 bp, Homo sapiens
tcagagccctgctcctccccaa

SEQ ID NO: 9118185 - DNA, 22 bp, Homo sapiens
tcagagctaaggggagagcaaa

SEQ ID NO: 9118186 - DNA, 22 bp, Homo sapiens
tcagagctcatgagcagagcca

SEQ ID NO: 9118187 - DNA, 22 bp, Homo sapiens
tcagagctaaggggagagcaaa

SEQ ID NO: 9118188 - DNA, 22 bp, Homo sapiens
tcagagcttatctcttgctgga

SEQ ID NO: 9118189 - DNA, 22 bp, Homo sapiens
tcagagctttggagaccaggaa

SEQ ID NO: 9118190 - DNA, 22 bp, Homo sapiens
tcagagctgcccatgcaagggg

SEQ ID NO: 9118191 - DNA, 23 bp, Homo sapiens
tcagagaggccccctgcagagat

SEQ ID NO: 9118192 - DNA, 23 bp, Homo sapiens
tcagagaggccccctgcagagat

SEQ ID NO: 9118193 - DNA, 22 bp, Homo sapiens
tcagagaggcaatactgtttaa

SEQ ID NO: 9118194 - DNA, 23 bp, Homo sapiens
tcagagaggccccctgcagagat

SEQ ID NO: 9118195 - DNA, 22 bp, Homo sapiens
tcagagaggttggtgataagaa

SEQ ID NO: 9118196 - DNA, 22 bp, Homo sapiens
tcagagccaatcatggtgcatt

SEQ ID NO: 9118197 - DNA, 22 bp, Homo sapiens
tcagagccaatcatggtgcatt

SEQ ID NO: 9118198 - DNA, 22 bp, Homo sapiens
tcagagccaatcatggtgcatt

SEQ ID NO: 9118199 - DNA, 22 bp, Homo sapiens
tcagagcattcgggtgacaaat

SEQ ID NO: 9118200 - DNA, 22 bp, Homo sapiens
tcagagcatgtgggctgcagtt

SEQ ID NO: 9118201 - DNA, 22 bp, Homo sapiens
tcagagcacttggctcatggca

SEQ ID NO: 9118202 - DNA, 22 bp, Homo sapiens
tcagcaaggctgcattctcatc

SEQ ID NO: 9118203 - DNA, 22 bp, Homo sapiens
tcagcaagcagggggatgttca

SEQ ID NO: 9118204 - DNA, 22 bp, Homo sapiens
tcagaggaagcatcaagttctc

SEQ ID NO: 9118205 - DNA, 22 bp, Homo sapiens
tcagaggaactggactaaagcc

SEQ ID NO: 9118206 - DNA, 22 bp, Homo sapiens
tcagaggaacactgtttcatgc

SEQ ID NO: 9118207 - DNA, 22 bp, Homo sapiens
tcagaggaaaggtcagatggct

SEQ ID NO: 9118208 - DNA, 22 bp, Homo sapiens
tcagaggaaaggtcagatggct

SEQ ID NO: 9118209 - DNA, 22 bp, Homo sapiens
tcagaggaaagggaacatagtc

SEQ ID NO: 9118210 - DNA, 22 bp, Homo sapiens
tcagaggaaagggaacatagtc

SEQ ID NO: 9118211 - DNA, 22 bp, Homo sapiens
tcagaggaaacaatctttagta

SEQ ID NO: 9118212 - DNA, 22 bp, Homo sapiens
tcagaggaaagggaacatagtc

SEQ ID NO: 9118213 - DNA, 22 bp, Homo sapiens
tcagcactgtcttttatttgaa

SEQ ID NO: 9118214 - DNA, 22 bp, Homo sapiens
tcagcactgatgtttcagaaga

SEQ ID NO: 9118215 - DNA, 22 bp, Homo sapiens
tcagcactgtgtccagtctccc

SEQ ID NO: 9118216 - DNA, 22 bp, Homo sapiens
tcagcactgatagaagtcaata

SEQ ID NO: 9118217 - DNA, 22 bp, Homo sapiens
tcagcacaggtcttgcaaaaca

SEQ ID NO: 9118218 - DNA, 22 bp, Homo sapiens
tcagcaatgtgatactgtgcaa

SEQ ID NO: 9118219 - DNA, 22 bp, Homo sapiens
tcagacaggcctctccagcctc

SEQ ID NO: 9118220 - DNA, 22 bp, Homo sapiens
tcagacagcttgcagggaggtg

SEQ ID NO: 9118221 - DNA, 22 bp, Homo sapiens
tcagacagattttgacacttgc

SEQ ID NO: 9118222 - DNA, 22 bp, Homo sapiens
tcagacaggcttctttctccct

SEQ ID NO: 9118223 - DNA, 22 bp, Homo sapiens
tcagacagtgtgatcagtctct

SEQ ID NO: 9118224 - DNA, 22 bp, Homo sapiens
tcagacagggcttctcaaactt

SEQ ID NO: 9118225 - DNA, 22 bp, Homo sapiens
tcagacagggcttctcaaactt

SEQ ID NO: 9118226 - DNA, 22 bp, Homo sapiens
tcactttggattatgtaatttc

SEQ ID NO: 9118227 - DNA, 22 bp, Homo sapiens
tcacttttgatccctatgcagt

SEQ ID NO: 9118228 - DNA, 22 bp, Homo sapiens
tcagaaaagagaaaatcttata

SEQ ID NO: 9118229 - DNA, 22 bp, Homo sapiens
tcagaaaaggtagctgtgacaa

SEQ ID NO: 9118230 - DNA, 22 bp, Homo sapiens
tcagaaaaggtagctgtgacaa

SEQ ID NO: 9118231 - DNA, 22 bp, Homo sapiens
tcagaaaagaccacattattct

SEQ ID NO: 9118232 - DNA, 22 bp, Homo sapiens
tcagaaaagagaaaatcttata

SEQ ID NO: 9118233 - DNA, 23 bp, Homo sapiens
tcagagaactcgggcagatgacc

SEQ ID NO: 9118234 - DNA, 22 bp, Homo sapiens
tcagagaactgcagcccttcct

SEQ ID NO: 9118235 - DNA, 20 bp, Homo sapiens
tcagagaaggagctttcctg

SEQ ID NO: 9118236 - DNA, 20 bp, Homo sapiens
tcagagaaggagctttcctg

SEQ ID NO: 9118237 - DNA, 22 bp, Homo sapiens
tcagagaaggctgagtcacggc

SEQ ID NO: 9118238 - DNA, 22 bp, Homo sapiens
tcagagaactccacaccttagg

SEQ ID NO: 9118239 - DNA, 22 bp, Homo sapiens
tcagaccatcctgctgttagtg

SEQ ID NO: 9118240 - DNA, 22 bp, Homo sapiens
tcagacatgggatatgaagctc

SEQ ID NO: 9118241 - DNA, 22 bp, Homo sapiens
tcagacagtttgcagtgtgcct

SEQ ID NO: 9118242 - DNA, 22 bp, Homo sapiens
tcagacagtttgcagtgtgcct

SEQ ID NO: 9118243 - DNA, 22 bp, Homo sapiens
tcagacagtttgcagtgtgcct

SEQ ID NO: 9118244 - DNA, 22 bp, Homo sapiens
tcactctgcaggaaggagcagc

SEQ ID NO: 9118245 - DNA, 22 bp, Homo sapiens
tcactctgcctccatattacta

SEQ ID NO: 9118246 - DNA, 22 bp, Homo sapiens
tcactctggagtccgctaccag

SEQ ID NO: 9118247 - DNA, 15 bp, Homo sapiens
tcactctggaaggga

SEQ ID NO: 9118248 - DNA, 22 bp, Homo sapiens
tcactctgctgcccgagggctg

SEQ ID NO: 9118249 - DNA, 22 bp, Homo sapiens
tcactctggagtccgctaccag

SEQ ID NO: 9118250 - DNA, 22 bp, Homo sapiens
tcactctgatagataagctaac

SEQ ID NO: 9118251 - DNA, 21 bp, Homo sapiens
tcactctgattaggtgtctct

SEQ ID NO: 9118252 - DNA, 20 bp, Homo sapiens
tcactctgatgctagggtgg

SEQ ID NO: 9118253 - DNA, 22 bp, Homo sapiens
tcactctgagaggtcactggaa

SEQ ID NO: 9118254 - DNA, 22 bp, Homo sapiens
tcactctgagaggtcactggaa

SEQ ID NO: 9118255 - DNA, 22 bp, Homo sapiens
tcactacagtgtagagattagg

SEQ ID NO: 9118256 - DNA, 22 bp, Homo sapiens
tcactacacaatatatttcaga

SEQ ID NO: 9118257 - DNA, 22 bp, Homo sapiens
tcactacaacctccgcctcctg

SEQ ID NO: 9118258 - DNA, 21 bp, Homo sapiens
tcactacaatgttctcttata

SEQ ID NO: 9118259 - DNA, 22 bp, Homo sapiens
tcactacaacctccgcctcctg

SEQ ID NO: 9118260 - DNA, 22 bp, Homo sapiens
tcactctgacttggcctccaac

SEQ ID NO: 9118261 - DNA, 22 bp, Homo sapiens
tcacccaggatattgaagtcag

SEQ ID NO: 9118262 - DNA, 22 bp, Homo sapiens
tcacccagccttggcgggtttg

SEQ ID NO: 9118263 - DNA, 22 bp, Homo sapiens
tcacccaggctggtatgcagtg

SEQ ID NO: 9118264 - DNA, 22 bp, Homo sapiens
tcacattttgttcaaggctagt

SEQ ID NO: 9118265 - DNA, 22 bp, Homo sapiens
tcacattttctactactgtacg

SEQ ID NO: 9118266 - DNA, 22 bp, Homo sapiens
tcacagtagacttctcaagagc

SEQ ID NO: 9118267 - DNA, 22 bp, Homo sapiens
tcacagtagccatttcatgagt

SEQ ID NO: 9118268 - DNA, 22 bp, Homo sapiens
tcacagtagttgttctctgttt

SEQ ID NO: 9118269 - DNA, 22 bp, Homo sapiens
tcacagtataacctcatatagg

SEQ ID NO: 9118270 - DNA, 19 bp, Homo sapiens
tcacttgtgccaggcactg

SEQ ID NO: 9118271 - DNA, 22 bp, Homo sapiens
tcactttgatgacattgtagct

SEQ ID NO: 9118272 - DNA, 22 bp, Homo sapiens
tcactttgacggccaacttcta

SEQ ID NO: 9118273 - DNA, 22 bp, Homo sapiens
tcactttgacagagaaatgaat

SEQ ID NO: 9118274 - DNA, 22 bp, Homo sapiens
tcactttgaattccttgatttt

SEQ ID NO: 9118275 - DNA, 23 bp, Homo sapiens
tcactttgatgtaattgaaaagc

SEQ ID NO: 9118276 - DNA, 23 bp, Homo sapiens
tcactttgatgtaattgaaaagc

SEQ ID NO: 9118277 - DNA, 22 bp, Homo sapiens
tcactttgatgacattgtagct

SEQ ID NO: 9118278 - DNA, 22 bp, Homo sapiens
tcactttggattatgtaatttc

SEQ ID NO: 9118279 - DNA, 22 bp, Homo sapiens
tcactttggaagatagcacatc

SEQ ID NO: 9118280 - DNA, 22 bp, Homo sapiens
tcactttggattatgtaatttc

SEQ ID NO: 9118281 - DNA, 22 bp, Homo sapiens
tcactgttaataaatagcaaag

SEQ ID NO: 9118282 - DNA, 22 bp, Homo sapiens
tcactgttagagcaaacgtatg

SEQ ID NO: 9118283 - DNA, 22 bp, Homo sapiens
tcacttcttcagctttccttga

SEQ ID NO: 9118284 - DNA, 22 bp, Homo sapiens
tcactctgttttactcactgtt

SEQ ID NO: 9118285 - DNA, 22 bp, Homo sapiens
tcactctgttttactcactgtt

SEQ ID NO: 9118286 - DNA, 22 bp, Homo sapiens
tcactctgttttactcactgtt

SEQ ID NO: 9118287 - DNA, 22 bp, Homo sapiens
tcactctgtggcccaggcagtg

SEQ ID NO: 9118288 - DNA, 22 bp, Homo sapiens
tcactctgtgtttccctgggac

SEQ ID NO: 9118289 - DNA, 22 bp, Homo sapiens
tcactctgtgtttgaactcaag

SEQ ID NO: 9118290 - DNA, 22 bp, Homo sapiens
tcactctgtgtttgaactcaag

SEQ ID NO: 9118291 - DNA, 22 bp, Homo sapiens
tcactctgttagaggaaagtgc

SEQ ID NO: 9118292 - DNA, 22 bp, Homo sapiens
tcactctgggccagcgcaggta

SEQ ID NO: 9118293 - DNA, 22 bp, Homo sapiens
tcactctggcctctgcagcagt

SEQ ID NO: 9118294 - DNA, 22 bp, Homo sapiens
tcactctggcctctgcagcagt

SEQ ID NO: 9118295 - DNA, 22 bp, Homo sapiens
tcactctgtcccccattgagat

SEQ ID NO: 9118296 - DNA, 22 bp, Homo sapiens
tcactctggtccatccgagagc

SEQ ID NO: 9118297 - DNA, 22 bp, Homo sapiens
tcactctgggccctactgggct

SEQ ID NO: 9118298 - DNA, 22 bp, Homo sapiens
tcactgaagactgggctctaaa

SEQ ID NO: 9118299 - DNA, 22 bp, Homo sapiens
tcactgaatacttgtctcatcc

SEQ ID NO: 9118300 - DNA, 22 bp, Homo sapiens
tcacagtactgtgactattgac

SEQ ID NO: 9118301 - DNA, 22 bp, Homo sapiens
tcacagtactccccaaagtttc

SEQ ID NO: 9118302 - DNA, 22 bp, Homo sapiens
tcacagtaactttgttgctttt

SEQ ID NO: 9118303 - DNA, 22 bp, Homo sapiens
tcacagtacatgattcagtggt

SEQ ID NO: 9118304 - DNA, 22 bp, Homo sapiens
tcacaggctccagggcctggat

SEQ ID NO: 9118305 - DNA, 22 bp, Homo sapiens
tcacaggctccagggcctggat

SEQ ID NO: 9118306 - DNA, 21 bp, Homo sapiens
tcacaggctcagggagagagt

SEQ ID NO: 9118307 - DNA, 21 bp, Homo sapiens
tcacaggctcagggagagagt

SEQ ID NO: 9118308 - DNA, 22 bp, Homo sapiens
tcacaggcccaaaccacgctta

SEQ ID NO: 9118309 - DNA, 22 bp, Homo sapiens
tcacaggctaaatttatgcagg

SEQ ID NO: 9118310 - DNA, 22 bp, Homo sapiens
tcacaggcctggggcagagggc

SEQ ID NO: 9118311 - DNA, 22 bp, Homo sapiens
tcacaggcctggggcagagggc

SEQ ID NO: 9118312 - DNA, 22 bp, Homo sapiens
tcacaggctggtctccgaggac

SEQ ID NO: 9118313 - DNA, 22 bp, Homo sapiens
tcacaggctaaatttatgcagg

SEQ ID NO: 9118314 - DNA, 22 bp, Homo sapiens
tcacaggctggtctccgaggac

SEQ ID NO: 9118315 - DNA, 22 bp, Homo sapiens
tcacaggctctccaccatgagg

SEQ ID NO: 9118316 - DNA, 22 bp, Homo sapiens
tcacaggctctagggattaaga

SEQ ID NO: 9118317 - DNA, 22 bp, Homo sapiens
tcacagctccagactgcaactc

SEQ ID NO: 9118318 - DNA, 22 bp, Homo sapiens
tcacagaataaatgtactggcc

SEQ ID NO: 9118319 - DNA, 22 bp, Homo sapiens
tcacaggagtcataattacagt

SEQ ID NO: 9118320 - DNA, 22 bp, Homo sapiens
tcacaggagtcataattacagt

SEQ ID NO: 9118321 - DNA, 22 bp, Homo sapiens
tcacaggataaggtggcatcac

SEQ ID NO: 9118322 - DNA, 22 bp, Homo sapiens
tcacaggagtcaaggaatagta

SEQ ID NO: 9118323 - DNA, 19 bp, Homo sapiens
tcacaggcatctccccaga

SEQ ID NO: 9118324 - DNA, 19 bp, Homo sapiens
tcacaggcatctccccaga

SEQ ID NO: 9118325 - DNA, 22 bp, Homo sapiens
tcacaggcaaagaagattggtg

SEQ ID NO: 9118326 - DNA, 19 bp, Homo sapiens
tcacaggcatctccccaga

SEQ ID NO: 9118327 - DNA, 22 bp, Homo sapiens
tcacagaaggcatcacagaaga

SEQ ID NO: 9118328 - DNA, 22 bp, Homo sapiens
tcacagaagggaaagatgccaa

SEQ ID NO: 9118329 - DNA, 22 bp, Homo sapiens
tcacagaaggtggccatagctg

SEQ ID NO: 9118330 - DNA, 22 bp, Homo sapiens
tcacagaagttgaatttgcatg

SEQ ID NO: 9118331 - DNA, 22 bp, Homo sapiens
tcacagaagtgtgtttcaggag

SEQ ID NO: 9118332 - DNA, 22 bp, Homo sapiens
tcacagaagtgtagtgaggaaa

SEQ ID NO: 9118333 - DNA, 22 bp, Homo sapiens
tcacagaagatgctggatgttg

SEQ ID NO: 9118334 - DNA, 22 bp, Homo sapiens
tcacagaagcatcatacccgga

SEQ ID NO: 9118335 - DNA, 22 bp, Homo sapiens
tcacagaagagcattaagatga

SEQ ID NO: 9118336 - DNA, 22 bp, Homo sapiens
tcacagaagccctcgcaaacta

SEQ ID NO: 9118337 - DNA, 22 bp, Homo sapiens
tcacagaagcttgaagattttc

SEQ ID NO: 9118338 - DNA, 22 bp, Homo sapiens
tcacagaaggagggaagctagt

SEQ ID NO: 9118339 - DNA, 22 bp, Homo sapiens
tcacagaaggaccttgtttcat

SEQ ID NO: 9118340 - DNA, 22 bp, Homo sapiens
tcacacatgctaagccagagat

SEQ ID NO: 9118341 - DNA, 20 bp, Homo sapiens
tcacacatggtaagctatga

SEQ ID NO: 9118342 - DNA, 20 bp, Homo sapiens
tcacagaaacaaatagagaa

SEQ ID NO: 9118343 - DNA, 22 bp, Homo sapiens
tcacagaaaagctgagcatcag

SEQ ID NO: 9118344 - DNA, 22 bp, Homo sapiens
tcacagaaaagtggagagccta

SEQ ID NO: 9118345 - DNA, 22 bp, Homo sapiens
tcacaatgaaaaacactacata

SEQ ID NO: 9118346 - DNA, 22 bp, Homo sapiens
tcacaatggcatagtataaaat

SEQ ID NO: 9118347 - DNA, 20 bp, Homo sapiens
tcacaatatgagctcataca

SEQ ID NO: 9118348 - DNA, 22 bp, Homo sapiens
tcacaatatttatcttccaatt

SEQ ID NO: 9118349 - DNA, 22 bp, Homo sapiens
tcacagaagaagtagattgcat

SEQ ID NO: 9118350 - DNA, 22 bp, Homo sapiens
tcacagaagagatattgacaga

SEQ ID NO: 9118351 - DNA, 22 bp, Homo sapiens
tcacagaacacaaatgccactt

SEQ ID NO: 9118352 - DNA, 22 bp, Homo sapiens
tcacagaacaatgtttagttct

SEQ ID NO: 9118353 - DNA, 22 bp, Homo sapiens
tcacagaaagctgtgtcctgac

SEQ ID NO: 9118354 - DNA, 22 bp, Homo sapiens
tcacagaaacagaatggcacag

SEQ ID NO: 9118355 - DNA, 22 bp, Homo sapiens
tcacagaacaagcctggtggag

SEQ ID NO: 9118356 - DNA, 22 bp, Homo sapiens
tcacagaaatctgttttttcta

SEQ ID NO: 9118357 - DNA, 22 bp, Homo sapiens
tcacagaaataagatagttatt

SEQ ID NO: 9118358 - DNA, 22 bp, Homo sapiens
tcacaaagctttgataagcaga

SEQ ID NO: 9118359 - DNA, 22 bp, Homo sapiens
tcacaaagctttgataagcaga

SEQ ID NO: 9118360 - DNA, 22 bp, Homo sapiens
tcacaaagagaattgtgggtgt

SEQ ID NO: 9118361 - DNA, 22 bp, Homo sapiens
tcacaaagtgaagtgtgtcatg

SEQ ID NO: 9118362 - DNA, 22 bp, Homo sapiens
tcacaaagtgaagtgtgtcatg

SEQ ID NO: 9118363 - DNA, 22 bp, Homo sapiens
tcacaaatagctatattaagga

SEQ ID NO: 9118364 - DNA, 22 bp, Homo sapiens
tcacaaagggagggatagctgg

SEQ ID NO: 9118365 - DNA, 22 bp, Homo sapiens
tcacaaagggagggatagctgg

SEQ ID NO: 9118366 - DNA, 22 bp, Homo sapiens
tcacaaagggagggatagctgg

SEQ ID NO: 9118367 - DNA, 22 bp, Homo sapiens
tatttcttcgggattcaagcta

SEQ ID NO: 9118368 - DNA, 22 bp, Homo sapiens
tatttcttgagactcgtcttcc

SEQ ID NO: 9118369 - DNA, 22 bp, Homo sapiens
tatttcttgagtggtcagtttc

SEQ ID NO: 9118370 - DNA, 20 bp, Homo sapiens
tcaagacagacatggagttt

SEQ ID NO: 9118371 - DNA, 22 bp, Homo sapiens
tcaaggaaggtctgttgctcca

SEQ ID NO: 9118372 - DNA, 22 bp, Homo sapiens
tcaaggaatgactatatgagga

SEQ ID NO: 9118373 - DNA, 22 bp, Homo sapiens
tcaaggaatgactatatgagga

SEQ ID NO: 9118374 - DNA, 22 bp, Homo sapiens
tcaaggaagtcttattgcacag

SEQ ID NO: 9118375 - DNA, 22 bp, Homo sapiens
tcaaggaatttagtttagtaaa

SEQ ID NO: 9118376 - DNA, 22 bp, Homo sapiens
tcaagctggctgttgctatttc

SEQ ID NO: 9118377 - DNA, 22 bp, Homo sapiens
tcaaggaagggatattcttgaa

SEQ ID NO: 9118378 - DNA, 22 bp, Homo sapiens
tcaaggaagatagctattatga

SEQ ID NO: 9118379 - DNA, 22 bp, Homo sapiens
tcaagataccaccattatatgt

SEQ ID NO: 9118380 - DNA, 18 bp, Homo sapiens
tcaagacatcatgaaata

SEQ ID NO: 9118381 - DNA, 18 bp, Homo sapiens
tcaagacatcatgaaata

SEQ ID NO: 9118382 - DNA, 22 bp, Homo sapiens
tcaagagaaggggaaatagact

SEQ ID NO: 9118383 - DNA, 22 bp, Homo sapiens
tcaagagacaggacgtgtttca

SEQ ID NO: 9118384 - DNA, 22 bp, Homo sapiens
tcaagagaagtgctccacagta

SEQ ID NO: 9118385 - DNA, 22 bp, Homo sapiens
tcaagagattgaataataactg

SEQ ID NO: 9118386 - DNA, 22 bp, Homo sapiens
tcaagagagtgctgcttggggt

SEQ ID NO: 9118387 - DNA, 22 bp, Homo sapiens
tcaagacagatgggtaacttgg

SEQ ID NO: 9118388 - DNA, 22 bp, Homo sapiens
tcaagacagggtttaaggttga

SEQ ID NO: 9118389 - DNA, 21 bp, Homo sapiens
tcaagacagcatatttaagaa

SEQ ID NO: 9118390 - DNA, 22 bp, Homo sapiens
tcaagacatcactgtgcatttt

SEQ ID NO: 9118391 - DNA, 22 bp, Homo sapiens
tcaagacatattaaatgtgcga

SEQ ID NO: 9118392 - DNA, 22 bp, Homo sapiens
tcaagacagtgtgatactggcc

SEQ ID NO: 9118393 - DNA, 22 bp, Homo sapiens
tcaagtattatattctcatttt

SEQ ID NO: 9118394 - DNA, 22 bp, Homo sapiens
tcaagtattattacagatgtag

SEQ ID NO: 9118395 - DNA, 22 bp, Homo sapiens
tcaagtatttatttctgctggc

SEQ ID NO: 9118396 - DNA, 22 bp, Homo sapiens
tcaagtatttatttctgctggc

SEQ ID NO: 9118397 - DNA, 22 bp, Homo sapiens
tcaagtcatttgactgtgtgtt

SEQ ID NO: 9118398 - DNA, 22 bp, Homo sapiens
tcaagtatatctagtcattagg

SEQ ID NO: 9118399 - DNA, 22 bp, Homo sapiens
tcaagtatgacatcaagtttct

SEQ ID NO: 9118400 - DNA, 22 bp, Homo sapiens
tcaaggtgctgtgctgtgctag

SEQ ID NO: 9118401 - DNA, 22 bp, Homo sapiens
tcaaggttgccaggaaggaaga

SEQ ID NO: 9118402 - DNA, 22 bp, Homo sapiens
tcaaggcacttcatgtctcagt

SEQ ID NO: 9118403 - DNA, 22 bp, Homo sapiens
tcaaggagcccacagtctaatg

SEQ ID NO: 9118404 - DNA, 22 bp, Homo sapiens
tcaaggcaaagtaaatattcaa

SEQ ID NO: 9118405 - DNA, 22 bp, Homo sapiens
tcaagggaggagacacagccct

SEQ ID NO: 9118406 - DNA, 19 bp, Homo sapiens
tcaaggctgcctctccttt

SEQ ID NO: 9118407 - DNA, 22 bp, Homo sapiens
tcaaggcttttggttttccata

SEQ ID NO: 9118408 - DNA, 19 bp, Homo sapiens
tcaaggctccctgagggat

SEQ ID NO: 9118409 - DNA, 19 bp, Homo sapiens
tcaaggctccctgagggat

SEQ ID NO: 9118410 - DNA, 22 bp, Homo sapiens
tcaaggctattaattctgtgag

SEQ ID NO: 9118411 - DNA, 22 bp, Homo sapiens
tcaaggctaaactttcagagta

SEQ ID NO: 9118412 - DNA, 22 bp, Homo sapiens
tcaaggctaaactttcagagta

SEQ ID NO: 9118413 - DNA, 22 bp, Homo sapiens
tcaataactttgtttagcattg

SEQ ID NO: 9118414 - DNA, 22 bp, Homo sapiens
tcaagtgtagtggtgtcaggtc

SEQ ID NO: 9118415 - DNA, 22 bp, Homo sapiens
tcaatttcttggtttgataata

SEQ ID NO: 9118416 - DNA, 22 bp, Homo sapiens
tcaattttatgaaacaaagtga

SEQ ID NO: 9118417 - DNA, 17 bp, Homo sapiens
tcaatacactgctttta

SEQ ID NO: 9118418 - DNA, 22 bp, Homo sapiens
tcaataactttgtttagcattg

SEQ ID NO: 9118419 - DNA, 21 bp, Homo sapiens
tcagcaggcaccagaaggctg

SEQ ID NO: 9118420 - DNA, 22 bp, Homo sapiens
tcagcaggcaccggaagtgttt

SEQ ID NO: 9118421 - DNA, 22 bp, Homo sapiens
tcagcaggcacggacaggctgc

SEQ ID NO: 9118422 - DNA, 22 bp, Homo sapiens
tcagcctgctccaagtgctgcc

SEQ ID NO: 9118423 - DNA, 22 bp, Homo sapiens
tcagcctgctccaagtgctgcc

SEQ ID NO: 9118424 - DNA, 22 bp, Homo sapiens
tcagcacttttactctctttgc

SEQ ID NO: 9118425 - DNA, 22 bp, Homo sapiens
tcagcactttgaagcagaagga

SEQ ID NO: 9118426 - DNA, 22 bp, Homo sapiens
tcagcactttttaaagcagcat

SEQ ID NO: 9118427 - DNA, 21 bp, Homo sapiens
tcagcagaaagcaaggtcagt

SEQ ID NO: 9118428 - DNA, 22 bp, Homo sapiens
tcagcactttttaaagcagcat

SEQ ID NO: 9118429 - DNA, 21 bp, Homo sapiens
tcagcagcttttgcagtccct

SEQ ID NO: 9118430 - DNA, 22 bp, Homo sapiens
tcagcctttgaagggctgcagg

SEQ ID NO: 9118431 - DNA, 22 bp, Homo sapiens
tcagcctttgaagggctgcagg

SEQ ID NO: 9118432 - DNA, 22 bp, Homo sapiens
tcagcctggcaggatggcctgg

SEQ ID NO: 9118433 - DNA, 22 bp, Homo sapiens
tcagcctggtgattcctctgtc

SEQ ID NO: 9118434 - DNA, 22 bp, Homo sapiens
tcagcctggtgattcctctgtc

SEQ ID NO: 9118435 - DNA, 20 bp, Homo sapiens
tcagccttgaatgcttgaaa

SEQ ID NO: 9118436 - DNA, 22 bp, Homo sapiens
tcagccttctgaggacctggga

SEQ ID NO: 9118437 - DNA, 22 bp, Homo sapiens
tcagccttgcttctggactggt

SEQ ID NO: 9118438 - DNA, 22 bp, Homo sapiens
tcagccttgcttctggactggt

SEQ ID NO: 9118439 - DNA, 20 bp, Homo sapiens
tcagccttctcatcctgggg

SEQ ID NO: 9118440 - DNA, 20 bp, Homo sapiens
tcagccttctcatcctgggg

SEQ ID NO: 9118441 - DNA, 22 bp, Homo sapiens
tcagctcctcatgcaggggata

SEQ ID NO: 9118442 - DNA, 22 bp, Homo sapiens
tcagctcctcatgcaggggata

SEQ ID NO: 9118443 - DNA, 22 bp, Homo sapiens
tcagctccagagttgcacagtg

SEQ ID NO: 9118444 - DNA, 22 bp, Homo sapiens
tcagctctacacacacctgtgt

SEQ ID NO: 9118445 - DNA, 22 bp, Homo sapiens
tcaggaaggcaaattgcatgat

SEQ ID NO: 9118446 - DNA, 22 bp, Homo sapiens
tcaggaaggagctggcctgcca

SEQ ID NO: 9118447 - DNA, 22 bp, Homo sapiens
tcaggaagctgctctgggtggt

SEQ ID NO: 9118448 - DNA, 22 bp, Homo sapiens
tcaggaagctgctctgggtggt

SEQ ID NO: 9118449 - DNA, 22 bp, Homo sapiens
tcaggaaggcttcacacgagtg

SEQ ID NO: 9118450 - DNA, 22 bp, Homo sapiens
tcaggaaggcgccccatcagga

SEQ ID NO: 9118451 - DNA, 22 bp, Homo sapiens
tcaggaagggctcagtctgtgc

SEQ ID NO: 9118452 - DNA, 22 bp, Homo sapiens
tcaggaaggcacttggtgtgtt

SEQ ID NO: 9118453 - DNA, 22 bp, Homo sapiens
tcaggaaggcaaattgcatgat

SEQ ID NO: 9118454 - DNA, 22 bp, Homo sapiens
tcaggaaggcacttggtgtgtt

SEQ ID NO: 9118455 - DNA, 22 bp, Homo sapiens
tcaggaagggctcagtctgtgc

SEQ ID NO: 9118456 - DNA, 22 bp, Homo sapiens
tcaggaggttgaccacggggca

SEQ ID NO: 9118457 - DNA, 22 bp, Homo sapiens
tcaggagtaaagaagacttgac

SEQ ID NO: 9118458 - DNA, 22 bp, Homo sapiens
tcagctctgcaaggtcacctcc

SEQ ID NO: 9118459 - DNA, 22 bp, Homo sapiens
tcaggaacataatgtgagtcag

SEQ ID NO: 9118460 - DNA, 22 bp, Homo sapiens
tcaggaaccctggtctcctgct

SEQ ID NO: 9118461 - DNA, 22 bp, Homo sapiens
tcaggaagacaatctttggctc

SEQ ID NO: 9118462 - DNA, 22 bp, Homo sapiens
tcaggaagccactccacagaga

SEQ ID NO: 9118463 - DNA, 22 bp, Homo sapiens
tcaggaagccggttaaatagat

SEQ ID NO: 9118464 - DNA, 22 bp, Homo sapiens
tcaggaagctcttgctgattct

SEQ ID NO: 9118465 - DNA, 22 bp, Homo sapiens
tcaggaagctactgccagcagc

SEQ ID NO: 9118466 - DNA, 21 bp, Homo sapiens
tcaggaagagccagttcatgc

SEQ ID NO: 9118467 - DNA, 21 bp, Homo sapiens
tcaggaagagcttctcccact

SEQ ID NO: 9118468 - DNA, 22 bp, Homo sapiens
tcaggaagcatcctgaggtgtc

SEQ ID NO: 9118469 - DNA, 22 bp, Homo sapiens
tcaggatccatagactcccaaa

SEQ ID NO: 9118470 - DNA, 22 bp, Homo sapiens
tcaggatcaggggcctttcctt

SEQ ID NO: 9118471 - DNA, 22 bp, Homo sapiens
tcaggagtttggcctacagagg

SEQ ID NO: 9118472 - DNA, 22 bp, Homo sapiens
tcaggagtgataccatttgtca

SEQ ID NO: 9118473 - DNA, 22 bp, Homo sapiens
tcaggcagtctgactccggagg

SEQ ID NO: 9118474 - DNA, 22 bp, Homo sapiens
tcaggcagtctgactccggagg

SEQ ID NO: 9118475 - DNA, 22 bp, Homo sapiens
tcaggcagtagaattgcttgaa

SEQ ID NO: 9118476 - DNA, 20 bp, Homo sapiens
tcaggcagtggggaaaggca

SEQ ID NO: 9118477 - DNA, 20 bp, Homo sapiens
tcaggcagtggggaaaggca

SEQ ID NO: 9118478 - DNA, 20 bp, Homo sapiens
tcaggcagtggggaaaggca

SEQ ID NO: 9118479 - DNA, 20 bp, Homo sapiens
tcaggcagtggggaaaggca

SEQ ID NO: 9118480 - DNA, 22 bp, Homo sapiens
tcaggcagtggtaaatgagtta

SEQ ID NO: 9118481 - DNA, 19 bp, Homo sapiens
tcaggcagttattcacaaa

SEQ ID NO: 9118482 - DNA, 22 bp, Homo sapiens
tcaggcattgtgcagagccttg

SEQ ID NO: 9118483 - DNA, 22 bp, Homo sapiens
tcaggcatgtgtactctttgat

SEQ ID NO: 9118484 - DNA, 22 bp, Homo sapiens
tcaggcatgcattctgcaggtt

SEQ ID NO: 9118485 - DNA, 22 bp, Homo sapiens
tcaggcctgcaggcttcctgga

SEQ ID NO: 9118486 - DNA, 22 bp, Homo sapiens
tcaggcctgcagtgccaaccca

SEQ ID NO: 9118487 - DNA, 22 bp, Homo sapiens
tcaggcctgcagtgccaaccca

SEQ ID NO: 9118488 - DNA, 22 bp, Homo sapiens
tcaggcctgccctgaaagcaca

SEQ ID NO: 9118489 - DNA, 22 bp, Homo sapiens
tcaggcctgctgtatgatggat

SEQ ID NO: 9118490 - DNA, 22 bp, Homo sapiens
tcaggcctgcaaggagagtccc

SEQ ID NO: 9118491 - DNA, 22 bp, Homo sapiens
tcaggcctgcaggcttcctgga

SEQ ID NO: 9118492 - DNA, 22 bp, Homo sapiens
tcaggcctgcaggcttcctgga

SEQ ID NO: 9118493 - DNA, 22 bp, Homo sapiens
tcaggcctgcaaatgaatggta

SEQ ID NO: 9118494 - DNA, 22 bp, Homo sapiens
tcaggcctgagaaaaatccttt

SEQ ID NO: 9118495 - DNA, 22 bp, Homo sapiens
tcaggccacggctcactgagac

SEQ ID NO: 9118496 - DNA, 22 bp, Homo sapiens
tcaggccttcagacctggcccg

SEQ ID NO: 9118497 - DNA, 22 bp, Homo sapiens
tcaggccttcagacctggcccg

SEQ ID NO: 9118498 - DNA, 22 bp, Homo sapiens
tcaggccttcagacctggcccg

SEQ ID NO: 9118499 - DNA, 22 bp, Homo sapiens
tcaggctgaggtcatctgcatc

SEQ ID NO: 9118500 - DNA, 22 bp, Homo sapiens
tcaggcctgtgctggaggagat

SEQ ID NO: 9118501 - DNA, 22 bp, Homo sapiens
tcaggcctggagaaaggaatga

SEQ ID NO: 9118502 - DNA, 16 bp, Homo sapiens
tcaggcctggacgagc

SEQ ID NO: 9118503 - DNA, 21 bp, Homo sapiens
tcaggctgatgtcgatgttag

SEQ ID NO: 9118504 - DNA, 22 bp, Homo sapiens
tcaggctgataggaggaactga

SEQ ID NO: 9118505 - DNA, 22 bp, Homo sapiens
tcaggctgctggccagcaggct

SEQ ID NO: 9118506 - DNA, 22 bp, Homo sapiens
tcaggctggagtgcagtggcgc

SEQ ID NO: 9118507 - DNA, 22 bp, Homo sapiens
tcaggctggaatgcagtggggc

SEQ ID NO: 9118508 - DNA, 22 bp, Homo sapiens
tcaggctggaatgcagtggggc

SEQ ID NO: 9118509 - DNA, 22 bp, Homo sapiens
tcaggctgctttcatgcttaga

SEQ ID NO: 9118510 - DNA, 22 bp, Homo sapiens
tcaggctgctgtactgtgaatg

SEQ ID NO: 9118511 - DNA, 18 bp, Homo sapiens
tcaggctggaagtttgcc

SEQ ID NO: 9118512 - DNA, 22 bp, Homo sapiens
tcagggaaatagcagggctgaa

SEQ ID NO: 9118513 - DNA, 22 bp, Homo sapiens
tcagggaaaagtcacactgggt

SEQ ID NO: 9118514 - DNA, 22 bp, Homo sapiens
tcagggaaaagtcacactgggt

SEQ ID NO: 9118515 - DNA, 18 bp, Homo sapiens
tcaggctgggcctccttc

SEQ ID NO: 9118516 - DNA, 22 bp, Homo sapiens
tcaggctgggagacaatcactg

SEQ ID NO: 9118517 - DNA, 22 bp, Homo sapiens
tcaggctggggtgctaaggtgt

SEQ ID NO: 9118518 - DNA, 22 bp, Homo sapiens
tcaggctgggctcctctcccca

SEQ ID NO: 9118519 - DNA, 22 bp, Homo sapiens
tcatatttaggcctttaattca

SEQ ID NO: 9118520 - DNA, 22 bp, Homo sapiens
tcatattagggtaatgataaga

SEQ ID NO: 9118521 - DNA, 22 bp, Homo sapiens
tcatattagggtaatgataaga

SEQ ID NO: 9118522 - DNA, 22 bp, Homo sapiens
tcatatttatatgttggcacag

SEQ ID NO: 9118523 - DNA, 21 bp, Homo sapiens
tcatatttctcttgctattgt

SEQ ID NO: 9118524 - DNA, 21 bp, Homo sapiens
tcatatttctcttgctattgt

SEQ ID NO: 9118525 - DNA, 22 bp, Homo sapiens
tcatgccaatttctgcatggct

SEQ ID NO: 9118526 - DNA, 22 bp, Homo sapiens
tcatgccacttacaaaataatg

SEQ ID NO: 9118527 - DNA, 22 bp, Homo sapiens
tcatgccagttaaaggctgtga

SEQ ID NO: 9118528 - DNA, 22 bp, Homo sapiens
tcatgccagctttgcttgtccc

SEQ ID NO: 9118529 - DNA, 22 bp, Homo sapiens
tcatgccaaaatccagtggctt

SEQ ID NO: 9118530 - DNA, 22 bp, Homo sapiens
tcatgccaaactgaacacagtt

SEQ ID NO: 9118531 - DNA, 22 bp, Homo sapiens
tcatgccaaactgaacacagtt

SEQ ID NO: 9118532 - DNA, 22 bp, Homo sapiens
tcatgccaaaatccagtggctt

SEQ ID NO: 9118533 - DNA, 22 bp, Homo sapiens
tcatgcctgattatgttactca

SEQ ID NO: 9118534 - DNA, 22 bp, Homo sapiens
tcatgccatccacatctgtttc

SEQ ID NO: 9118535 - DNA, 22 bp, Homo sapiens
tcagtgttagacaagtttggaa

SEQ ID NO: 9118536 - DNA, 22 bp, Homo sapiens
tcagtgttacattatatagaac

SEQ ID NO: 9118537 - DNA, 22 bp, Homo sapiens
tcataggagtagcagtgagagg

SEQ ID NO: 9118538 - DNA, 22 bp, Homo sapiens
tcatataagagctttagagtca

SEQ ID NO: 9118539 - DNA, 22 bp, Homo sapiens
tcatatatctgcaaagcagtat

SEQ ID NO: 9118540 - DNA, 22 bp, Homo sapiens
tcatatatttagttgtgcaaca

SEQ ID NO: 9118541 - DNA, 22 bp, Homo sapiens
tcatggaaacagcaatgctaat

SEQ ID NO: 9118542 - DNA, 22 bp, Homo sapiens
tcatgcttagtttaatgctctg

SEQ ID NO: 9118543 - DNA, 22 bp, Homo sapiens
tcatggcacttagtgtctcaaa

SEQ ID NO: 9118544 - DNA, 20 bp, Homo sapiens
tcatggcagccacccacagg

SEQ ID NO: 9118545 - DNA, 22 bp, Homo sapiens
tcatggctaatgcagtatattc

SEQ ID NO: 9118546 - DNA, 22 bp, Homo sapiens
tcatggctctaaagacatagat

SEQ ID NO: 9118547 - DNA, 22 bp, Homo sapiens
tcatggcacttagcacagtcct

SEQ ID NO: 9118548 - DNA, 22 bp, Homo sapiens
tcattattctctttaatgttct

SEQ ID NO: 9118549 - DNA, 22 bp, Homo sapiens
tcattattctctttaatgttct

SEQ ID NO: 9118550 - DNA, 22 bp, Homo sapiens
tcattatcttggctcatttctg

SEQ ID NO: 9118551 - DNA, 22 bp, Homo sapiens
tcattattctctttaatgttct

SEQ ID NO: 9118552 - DNA, 22 bp, Homo sapiens
tcattacagtgtttatatgtct

SEQ ID NO: 9118553 - DNA, 22 bp, Homo sapiens
tcattacatcttggccaaaact

SEQ ID NO: 9118554 - DNA, 22 bp, Homo sapiens
tcattacatcttggccaaaact

SEQ ID NO: 9118555 - DNA, 20 bp, Homo sapiens
tcattacagtgctaagatgt

SEQ ID NO: 9118556 - DNA, 20 bp, Homo sapiens
tcattacagtgctaagatgt

SEQ ID NO: 9118557 - DNA, 22 bp, Homo sapiens
tcattacagagatataatctac

SEQ ID NO: 9118558 - DNA, 22 bp, Homo sapiens
tcattatttgctttagttatgt

SEQ ID NO: 9118559 - DNA, 22 bp, Homo sapiens
tcattatttgctttagttatgt

SEQ ID NO: 9118560 - DNA, 18 bp, Homo sapiens
tcattcaaagtctactga

SEQ ID NO: 9118561 - DNA, 22 bp, Homo sapiens
tcattcaagatttcaatagatt

SEQ ID NO: 9118562 - DNA, 22 bp, Homo sapiens
tcattcaatgtaagcatatata

SEQ ID NO: 9118563 - DNA, 23 bp, Homo sapiens
tcattcaaggctggtatctttca

SEQ ID NO: 9118564 - DNA, 22 bp, Homo sapiens
tcattcaggttgggcaagtgtc

SEQ ID NO: 9118565 - DNA, 22 bp, Homo sapiens
tcattcaggttgggcaagtgtc

SEQ ID NO: 9118566 - DNA, 18 bp, Homo sapiens
tcagggaagagaatatga

SEQ ID NO: 9118567 - DNA, 22 bp, Homo sapiens
tcagggaagacttcttagagga

SEQ ID NO: 9118568 - DNA, 19 bp, Homo sapiens
tcagggaagttcaaagctc

SEQ ID NO: 9118569 - DNA, 21 bp, Homo sapiens
tcagggaagtgtgcagaaggg

SEQ ID NO: 9118570 - DNA, 22 bp, Homo sapiens
tcagggaatgtgatacaggaag

SEQ ID NO: 9118571 - DNA, 22 bp, Homo sapiens
tcagggacccctctgagtggag

SEQ ID NO: 9118572 - DNA, 22 bp, Homo sapiens
tcaggtgttctccactcagttt

SEQ ID NO: 9118573 - DNA, 22 bp, Homo sapiens
tcaggtgttagaagaaatttca

SEQ ID NO: 9118574 - DNA, 22 bp, Homo sapiens
tcagtcttttaactttctgcca

SEQ ID NO: 9118575 - DNA, 22 bp, Homo sapiens
tcagtctttccctccctcagtt

SEQ ID NO: 9118576 - DNA, 22 bp, Homo sapiens
tcagtcttgtttgattcctcac

SEQ ID NO: 9118577 - DNA, 22 bp, Homo sapiens
tcagtcttgtttttctggtcca

SEQ ID NO: 9118578 - DNA, 22 bp, Homo sapiens
tcagtgatttctggggtgaggg

SEQ ID NO: 9118579 - DNA, 22 bp, Homo sapiens
tcagtgcaggaatctctagcca

SEQ ID NO: 9118580 - DNA, 22 bp, Homo sapiens
tcagtgcaggaatttccttaga

SEQ ID NO: 9118581 - DNA, 20 bp, Homo sapiens
tcagtgcagattgtccaagt

SEQ ID NO: 9118582 - DNA, 22 bp, Homo sapiens
tcagtgcagcggcagcagctct

SEQ ID NO: 9118583 - DNA, 20 bp, Homo sapiens
tcagtgcagattgtccaagt

SEQ ID NO: 9118584 - DNA, 22 bp, Homo sapiens
tcagtgcagactgtaagttgga

SEQ ID NO: 9118585 - DNA, 22 bp, Homo sapiens
tcagtgcagaatagtgatgcat

SEQ ID NO: 9118586 - DNA, 22 bp, Homo sapiens
tcagtgcacccaattctctcca

SEQ ID NO: 9118587 - DNA, 22 bp, Homo sapiens
tcagtgcagaatagtgatgcat

SEQ ID NO: 9118588 - DNA, 22 bp, Homo sapiens
tcagtgcacaatgacggtggct

SEQ ID NO: 9118589 - DNA, 21 bp, Homo sapiens
tcagtgcaattctatggggaa

SEQ ID NO: 9118590 - DNA, 22 bp, Homo sapiens
tcagtgcacccaattctctcca

SEQ ID NO: 9118591 - DNA, 22 bp, Homo sapiens
tcagtgcacagagatttttgtt

SEQ ID NO: 9118592 - DNA, 22 bp, Homo sapiens
tcagtgcaaaaaatgggctaga

SEQ ID NO: 9118593 - DNA, 22 bp, Homo sapiens
tcagtgcaatcaaggtatgttt

SEQ ID NO: 9118594 - DNA, 23 bp, Homo sapiens
tcagtgcaaaaataggattttgg

SEQ ID NO: 9118595 - DNA, 22 bp, Homo sapiens
tcagtgcagggtgggagagaga

SEQ ID NO: 9118596 - DNA, 22 bp, Homo sapiens
tcagtgcagggtgggagagaga

SEQ ID NO: 9118597 - DNA, 22 bp, Homo sapiens
tcagtgcagtagaactttagtt

SEQ ID NO: 9118598 - DNA, 22 bp, Homo sapiens
tcagtgtaagttatgtagatgt

SEQ ID NO: 9118599 - DNA, 22 bp, Homo sapiens
tcagtgtagcagacttgtagcc

SEQ ID NO: 9118600 - DNA, 19 bp, Homo sapiens
tcagtgtgtgggaggtggt

SEQ ID NO: 9118601 - DNA, 22 bp, Homo sapiens
tcagtgtgttactttctcctat

SEQ ID NO: 9118602 - DNA, 22 bp, Homo sapiens
tcagtgtgttattctactttca

SEQ ID NO: 9118603 - DNA, 22 bp, Homo sapiens
tcagtgtgttcaattggatagg

SEQ ID NO: 9118604 - DNA, 22 bp, Homo sapiens
tcagtgtgttcaattggatagg

SEQ ID NO: 9118605 - DNA, 22 bp, Homo sapiens
tcagtgtccggagcctgagtgc

SEQ ID NO: 9118606 - DNA, 23 bp, Homo sapiens
ttcatcagttgctgttgcagaac

SEQ ID NO: 9118607 - DNA, 22 bp, Homo sapiens
ttcagtgtacagtgaagggatt

SEQ ID NO: 9118608 - DNA, 22 bp, Homo sapiens
ttcagtggtttgatgatgtata

SEQ ID NO: 9118609 - DNA, 22 bp, Homo sapiens
ttcagtgtatattttttgagta

SEQ ID NO: 9118610 - DNA, 22 bp, Homo sapiens
ttcagtgtcaatttttaaatat

SEQ ID NO: 9118611 - DNA, 23 bp, Homo sapiens
ttcatgttccctccttctggtga

SEQ ID NO: 9118612 - DNA, 22 bp, Homo sapiens
ttcatgttggcatgtttttagg

SEQ ID NO: 9118613 - DNA, 22 bp, Homo sapiens
ttcatgttcatatgtgtatatc

SEQ ID NO: 9118614 - DNA, 22 bp, Homo sapiens
ttcatgttgtagtatgtatcag

SEQ ID NO: 9118615 - DNA, 22 bp, Homo sapiens
ttcatgtttcatttgttactat

SEQ ID NO: 9118616 - DNA, 22 bp, Homo sapiens
ttcatgtttcctcttgtgctgc

SEQ ID NO: 9118617 - DNA, 22 bp, Homo sapiens
ttccaatttgtggtgagttaat

SEQ ID NO: 9118618 - DNA, 22 bp, Homo sapiens
ttccaatttgtggtgagttaat

SEQ ID NO: 9118619 - DNA, 20 bp, Homo sapiens
ttcatgggagcaaagaggcc

SEQ ID NO: 9118620 - DNA, 20 bp, Homo sapiens
ttcatgggagcaaagaggcc

SEQ ID NO: 9118621 - DNA, 20 bp, Homo sapiens
ttcatggtgtatttctttct

SEQ ID NO: 9118622 - DNA, 22 bp, Homo sapiens
ttcatgggtccagagccctggg

SEQ ID NO: 9118623 - DNA, 22 bp, Homo sapiens
ttcacagtggctaagttctgca

SEQ ID NO: 9118624 - DNA, 22 bp, Homo sapiens
ttcacagtggctgtgccatttg

SEQ ID NO: 9118625 - DNA, 22 bp, Homo sapiens
ttcacattacaaggccatattt

SEQ ID NO: 9118626 - DNA, 22 bp, Homo sapiens
ttcacagtggccctctctgagt

SEQ ID NO: 9118627 - DNA, 22 bp, Homo sapiens
ttcacagtggccctctctgagt

SEQ ID NO: 9118628 - DNA, 22 bp, Homo sapiens
ttcacagtggctaagttctgca

SEQ ID NO: 9118629 - DNA, 22 bp, Homo sapiens
ttcacagtggctaagttctgca

SEQ ID NO: 9118630 - DNA, 22 bp, Homo sapiens
ttcacagtggctaagttctgca

SEQ ID NO: 9118631 - DNA, 22 bp, Homo sapiens
ttcacagtggccctctctgagt

SEQ ID NO: 9118632 - DNA, 22 bp, Homo sapiens
ttcacattataatcagttctgc

SEQ ID NO: 9118633 - DNA, 22 bp, Homo sapiens
ttcacattccgcggctattttc

SEQ ID NO: 9118634 - DNA, 19 bp, Homo sapiens
ttcacattggaagaagtag

SEQ ID NO: 9118635 - DNA, 19 bp, Homo sapiens
ttcacattggaagaagtag

SEQ ID NO: 9118636 - DNA, 22 bp, Homo sapiens
ttcacattgaaggtgctttctt

SEQ ID NO: 9118637 - DNA, 22 bp, Homo sapiens
ttcagtataaaatcaaagtgat

SEQ ID NO: 9118638 - DNA, 22 bp, Homo sapiens
ttcagtagggccctcacacagt

SEQ ID NO: 9118639 - DNA, 22 bp, Homo sapiens
ttcaggagaaagttcagtactt

SEQ ID NO: 9118640 - DNA, 22 bp, Homo sapiens
ttcagggtctagagtatctacc

SEQ ID NO: 9118641 - DNA, 21 bp, Homo sapiens
ttcaggtgagatcatgttgac

SEQ ID NO: 9118642 - DNA, 20 bp, Homo sapiens
ttcagggtgagagttctagg

SEQ ID NO: 9118643 - DNA, 22 bp, Homo sapiens
ttcagggttacagttggctctg

SEQ ID NO: 9118644 - DNA, 22 bp, Homo sapiens
ttcagtaaaacactgcaatgtc

SEQ ID NO: 9118645 - DNA, 22 bp, Homo sapiens
ttcagtaaaacactgcaatgtc

SEQ ID NO: 9118646 - DNA, 22 bp, Homo sapiens
ttcagtaaggataataaacaga

SEQ ID NO: 9118647 - DNA, 22 bp, Homo sapiens
ttcacaaaatggtttgttgatg

SEQ ID NO: 9118648 - DNA, 22 bp, Homo sapiens
ttcacaaaaatgctgaacagtt

SEQ ID NO: 9118649 - DNA, 22 bp, Homo sapiens
ttcaatgtttcttatcaagttg

SEQ ID NO: 9118650 - DNA, 22 bp, Homo sapiens
ttcaatgtttcttatcaagttg

SEQ ID NO: 9118651 - DNA, 22 bp, Homo sapiens
ttcaattcaattctaaatatat

SEQ ID NO: 9118652 - DNA, 22 bp, Homo sapiens
ttcaattctaaactaatattct

SEQ ID NO: 9118653 - DNA, 22 bp, Homo sapiens
ttcaattctgatgaaggcaata

SEQ ID NO: 9118654 - DNA, 22 bp, Homo sapiens
ttcaattctaaactaatattct

SEQ ID NO: 9118655 - DNA, 22 bp, Homo sapiens
ttcaattctgctctgatcttag

SEQ ID NO: 9118656 - DNA, 22 bp, Homo sapiens
ttcaactttggagatttaataa

SEQ ID NO: 9118657 - DNA, 22 bp, Homo sapiens
ttcaagaaagagtggctattcc

SEQ ID NO: 9118658 - DNA, 22 bp, Homo sapiens
ttcaatgcatatagatatagaa

SEQ ID NO: 9118659 - DNA, 22 bp, Homo sapiens
ttcaatgtctatgtacatttta

SEQ ID NO: 9118660 - DNA, 22 bp, Homo sapiens
ttcaatgcctagaacttagcat

SEQ ID NO: 9118661 - DNA, 22 bp, Homo sapiens
ttcacaaagctggagcatttcc

SEQ ID NO: 9118662 - DNA, 21 bp, Homo sapiens
ttcacaacctgctttagtggg

SEQ ID NO: 9118663 - DNA, 20 bp, Homo sapiens
ttcacaactcttagaagctg

SEQ ID NO: 9118664 - DNA, 22 bp, Homo sapiens
ttcacaagtctggaatatgcta

SEQ ID NO: 9118665 - DNA, 22 bp, Homo sapiens
ttcacaagtcattagctgcata

SEQ ID NO: 9118666 - DNA, 18 bp, Homo sapiens
ttcacaagggcttggttt

SEQ ID NO: 9118667 - DNA, 22 bp, Homo sapiens
ttcacaactgccatagccagtg

SEQ ID NO: 9118668 - DNA, 22 bp, Homo sapiens
ttcacagtcacccttctccatg

SEQ ID NO: 9118669 - DNA, 22 bp, Homo sapiens
ttcacagtgagctatgtcttgt

SEQ ID NO: 9118670 - DNA, 22 bp, Homo sapiens
ttcacagtgagctatgtcttgt

SEQ ID NO: 9118671 - DNA, 22 bp, Homo sapiens
ttcacagtgccagggggcaggc

SEQ ID NO: 9118672 - DNA, 22 bp, Homo sapiens
ttcacagtgctcacagttcagt

SEQ ID NO: 9118673 - DNA, 22 bp, Homo sapiens
ttcaactaatgtttattttatg

SEQ ID NO: 9118674 - DNA, 22 bp, Homo sapiens
ttcaacatttttgagtttaggt

SEQ ID NO: 9118675 - DNA, 22 bp, Homo sapiens
ttcaacatttatcagtttatca

SEQ ID NO: 9118676 - DNA, 22 bp, Homo sapiens
ttcaacatttgaaatgaatgaa

SEQ ID NO: 9118677 - DNA, 22 bp, Homo sapiens
ttcaacatgttctacataaggg

SEQ ID NO: 9118678 - DNA, 22 bp, Homo sapiens
ttcaacatgttctacataaggg

SEQ ID NO: 9118679 - DNA, 22 bp, Homo sapiens
ttcaactttggagatttaataa

SEQ ID NO: 9118680 - DNA, 22 bp, Homo sapiens
ttcaactttatgcatatgtatt

SEQ ID NO: 9118681 - DNA, 22 bp, Homo sapiens
ttcaactttaggcaaagaaaac

SEQ ID NO: 9118682 - DNA, 22 bp, Homo sapiens
ttcaactttaggcaaagaaaac

SEQ ID NO: 9118683 - DNA, 22 bp, Homo sapiens
ttcaactattatgaataaaatt

SEQ ID NO: 9118684 - DNA, 19 bp, Homo sapiens
ttcaactgagccagtctgg

SEQ ID NO: 9118685 - DNA, 22 bp, Homo sapiens
ttcaactagatttatacaattc

SEQ ID NO: 9118686 - DNA, 22 bp, Homo sapiens
ttcaacatcaagaatgcatgga

SEQ ID NO: 9118687 - DNA, 22 bp, Homo sapiens
ttcaacatgctttatttctaaa

SEQ ID NO: 9118688 - DNA, 22 bp, Homo sapiens
ttcaacatgctttatttctaaa

SEQ ID NO: 9118689 - DNA, 22 bp, Homo sapiens
ttagataaaagtgttcaataaa

SEQ ID NO: 9118690 - DNA, 22 bp, Homo sapiens
ttagagtttttgtaagtacaat

SEQ ID NO: 9118691 - DNA, 23 bp, Homo sapiens
ttcaaagcttaagctctttccac

SEQ ID NO: 9118692 - DNA, 22 bp, Homo sapiens
ttagataaattgcaacttgatt

SEQ ID NO: 9118693 - DNA, 17 bp, Homo sapiens
ttcaaagcttatcaagg

SEQ ID NO: 9118694 - DNA, 22 bp, Homo sapiens
ttagataaattaagactttaca

SEQ ID NO: 9118695 - DNA, 22 bp, Homo sapiens
ttagataaattaagactttaca

SEQ ID NO: 9118696 - DNA, 22 bp, Homo sapiens
ttagagttttatcattgcctta

SEQ ID NO: 9118697 - DNA, 21 bp, Homo sapiens
ttagagttgccattatatgta

SEQ ID NO: 9118698 - DNA, 22 bp, Homo sapiens
ttcaaaggtgactttgggccag

SEQ ID NO: 9118699 - DNA, 22 bp, Homo sapiens
ttcaacaaactgttcacgaatg

SEQ ID NO: 9118700 - DNA, 22 bp, Homo sapiens
ttcaacaaactgttcacgaatg

SEQ ID NO: 9118701 - DNA, 22 bp, Homo sapiens
ttcaaagtaaaaatgtgttcac

SEQ ID NO: 9118702 - DNA, 21 bp, Homo sapiens
ttcaacaaagggaataagttt

SEQ ID NO: 9118703 - DNA, 21 bp, Homo sapiens
ttcaacaaagggaataagttt

SEQ ID NO: 9118704 - DNA, 22 bp, Homo sapiens
ttcaacaatgaaagctaaggaa

SEQ ID NO: 9118705 - DNA, 22 bp, Homo sapiens
ttcaacaaggctgtcaaaagtt

SEQ ID NO: 9118706 - DNA, 22 bp, Homo sapiens
ttcctagggcagagccgctggg

SEQ ID NO: 9118707 - DNA, 22 bp, Homo sapiens
ttcctagggcagagccgctggg

SEQ ID NO: 9118708 - DNA, 22 bp, Homo sapiens
ttcctacatcaccagggggagt

SEQ ID NO: 9118709 - DNA, 22 bp, Homo sapiens
ttcctacatttgtacaataaga

SEQ ID NO: 9118710 - DNA, 22 bp, Homo sapiens
ttcctcagaccctcattgtgag

SEQ ID NO: 9118711 - DNA, 22 bp, Homo sapiens
ttcctcagaaaatactgtccaa

SEQ ID NO: 9118712 - DNA, 22 bp, Homo sapiens
ttcctcagagggcgctggggaa

SEQ ID NO: 9118713 - DNA, 22 bp, Homo sapiens
ttcctcagccaaggctgggatc

SEQ ID NO: 9118714 - DNA, 22 bp, Homo sapiens
ttcctcagccaaggctgggatc

SEQ ID NO: 9118715 - DNA, 22 bp, Homo sapiens
ttcctcagagggcgctggggaa

SEQ ID NO: 9118716 - DNA, 22 bp, Homo sapiens
ttcctctgtatgctttgctgct

SEQ ID NO: 9118717 - DNA, 22 bp, Homo sapiens
ttcctctgtatgctttgctgct

SEQ ID NO: 9118718 - DNA, 22 bp, Homo sapiens
ttcctctgtatgctttgctgct

SEQ ID NO: 9118719 - DNA, 22 bp, Homo sapiens
ttcctctgtagttgctgatgaa

SEQ ID NO: 9118720 - DNA, 22 bp, Homo sapiens
ttcctctgtagttgctgatgaa

SEQ ID NO: 9118721 - DNA, 22 bp, Homo sapiens
ttcctctgtagttgctgatgaa

SEQ ID NO: 9118722 - DNA, 22 bp, Homo sapiens
ttcctctggggccaggccaaca

SEQ ID NO: 9118723 - DNA, 22 bp, Homo sapiens
ttcctccacgtgacaggagcca

SEQ ID NO: 9118724 - DNA, 22 bp, Homo sapiens
ttcctccagaagctgtagggga

SEQ ID NO: 9118725 - DNA, 22 bp, Homo sapiens
ttcctccacgtgacaggagcca

SEQ ID NO: 9118726 - DNA, 18 bp, Homo sapiens
ttcctccacagagcgctg

SEQ ID NO: 9118727 - DNA, 18 bp, Homo sapiens
ttcctccacagagcgctg

SEQ ID NO: 9118728 - DNA, 22 bp, Homo sapiens
ttcctcagctgtttgggctcat

SEQ ID NO: 9118729 - DNA, 20 bp, Homo sapiens
ttcctcaggagaggatgtta

SEQ ID NO: 9118730 - DNA, 22 bp, Homo sapiens
ttcctcagggcggatgggcagg

SEQ ID NO: 9118731 - DNA, 22 bp, Homo sapiens
ttcctcagggcggatgggcagg

SEQ ID NO: 9118732 - DNA, 20 bp, Homo sapiens
ttccacatctttgcacatgc

SEQ ID NO: 9118733 - DNA, 22 bp, Homo sapiens
ttccagaactcaagaaatgccc

SEQ ID NO: 9118734 - DNA, 22 bp, Homo sapiens
ttccagaacaatgtggacgtat

SEQ ID NO: 9118735 - DNA, 21 bp, Homo sapiens
ttccacagtcctgaggattca

SEQ ID NO: 9118736 - DNA, 22 bp, Homo sapiens
ttccacaacaaccaagcatata

SEQ ID NO: 9118737 - DNA, 22 bp, Homo sapiens
ttccacaatgccaggggcatca

SEQ ID NO: 9118738 - DNA, 22 bp, Homo sapiens
ttccacaatggttaagctcgtt

SEQ ID NO: 9118739 - DNA, 22 bp, Homo sapiens
ttccagagaaaaggtttatttc

SEQ ID NO: 9118740 - DNA, 22 bp, Homo sapiens
ttccagaattgggagccttgag

SEQ ID NO: 9118741 - DNA, 22 bp, Homo sapiens
ttccagaatagatggagctcta

SEQ ID NO: 9118742 - DNA, 22 bp, Homo sapiens
ttccagaagcctccatattact

SEQ ID NO: 9118743 - DNA, 22 bp, Homo sapiens
ttccagaagatggcagcaaagg

SEQ ID NO: 9118744 - DNA, 22 bp, Homo sapiens
ttccagagcagttttcagatca

SEQ ID NO: 9118745 - DNA, 22 bp, Homo sapiens
ttccagagcagttttcagatca

SEQ ID NO: 9118746 - DNA, 22 bp, Homo sapiens
ttccagagcccatgctctaggc

SEQ ID NO: 9118747 - DNA, 22 bp, Homo sapiens
ttccagagaggctcatgttccc

SEQ ID NO: 9118748 - DNA, 22 bp, Homo sapiens
ttccagagaggctcatgttccc

SEQ ID NO: 9118749 - DNA, 22 bp, Homo sapiens
ttccagagaggctcatgttccc

SEQ ID NO: 9118750 - DNA, 22 bp, Homo sapiens
ttccagagagttattcccctgg

SEQ ID NO: 9118751 - DNA, 22 bp, Homo sapiens
ttccagagagttattcccctgg

SEQ ID NO: 9118752 - DNA, 22 bp, Homo sapiens
ttccctggctcttctacatcgt

SEQ ID NO: 9118753 - DNA, 22 bp, Homo sapiens
ttccctggggaaggtgaccttt

SEQ ID NO: 9118754 - DNA, 22 bp, Homo sapiens
ttccctggcatgagtgtaagat

SEQ ID NO: 9118755 - DNA, 22 bp, Homo sapiens
ttccctggccctggcacgctct

SEQ ID NO: 9118756 - DNA, 22 bp, Homo sapiens
ttctacaatatgaataatgaag

SEQ ID NO: 9118757 - DNA, 22 bp, Homo sapiens
ttctacaaatatttactgttcc

SEQ ID NO: 9118758 - DNA, 22 bp, Homo sapiens
ttctacaaatatttactgttcc

SEQ ID NO: 9118759 - DNA, 22 bp, Homo sapiens
ttctacttgccaaatgacacat

SEQ ID NO: 9118760 - DNA, 22 bp, Homo sapiens
ttctagaaacacatgcaaacag

SEQ ID NO: 9118761 - DNA, 20 bp, Homo sapiens
ttctaatttgatggagtagc

SEQ ID NO: 9118762 - DNA, 22 bp, Homo sapiens
ttctaattgcaagttttagtat

SEQ ID NO: 9118763 - DNA, 22 bp, Homo sapiens
ttctaattgtgtttgcatatct

SEQ ID NO: 9118764 - DNA, 22 bp, Homo sapiens
ttctaatgaaatctgtacagta

SEQ ID NO: 9118765 - DNA, 22 bp, Homo sapiens
ttctaattaaatctacgctagg

SEQ ID NO: 9118766 - DNA, 19 bp, Homo sapiens
ttctaagttttgcttgctg

SEQ ID NO: 9118767 - DNA, 22 bp, Homo sapiens
ttctaagtcctacctgaaagca

SEQ ID NO: 9118768 - DNA, 22 bp, Homo sapiens
ttctaagtcactcagattttgg

SEQ ID NO: 9118769 - DNA, 22 bp, Homo sapiens
ttctaagtgttgacaaagtcta

SEQ ID NO: 9118770 - DNA, 22 bp, Homo sapiens
ttctagcacaagatatgaaagt

SEQ ID NO: 9118771 - DNA, 22 bp, Homo sapiens
ttctagactgtgtacagattca

SEQ ID NO: 9118772 - DNA, 22 bp, Homo sapiens
ttctagcatgccttttagcaca

SEQ ID NO: 9118773 - DNA, 20 bp, Homo sapiens
ttctagcatacttacaagga

SEQ ID NO: 9118774 - DNA, 20 bp, Homo sapiens
ttctagcatacttacaagga

SEQ ID NO: 9118775 - DNA, 22 bp, Homo sapiens
ttctagaatccttgtctacttt

SEQ ID NO: 9118776 - DNA, 22 bp, Homo sapiens
ttctagaatgttttgaaaggga

SEQ ID NO: 9118777 - DNA, 22 bp, Homo sapiens
ttctagaagtgtctatgtctgt

SEQ ID NO: 9118778 - DNA, 22 bp, Homo sapiens
ttctagaaactggagcaaacag

SEQ ID NO: 9118779 - DNA, 22 bp, Homo sapiens
ttctagaaatccgtaagtgaat

SEQ ID NO: 9118780 - DNA, 22 bp, Homo sapiens
ttcctgtggccttacatctgtg

SEQ ID NO: 9118781 - DNA, 22 bp, Homo sapiens
ttcctgtgatattagccactgt

SEQ ID NO: 9118782 - DNA, 22 bp, Homo sapiens
ttcctgtgatattagccactgt

SEQ ID NO: 9118783 - DNA, 22 bp, Homo sapiens
ttcctgtggtccagagtcatcc

SEQ ID NO: 9118784 - DNA, 22 bp, Homo sapiens
ttcctgtggctgtcactcctgg

SEQ ID NO: 9118785 - DNA, 22 bp, Homo sapiens
ttcctgtgtgaccgagacagtg

SEQ ID NO: 9118786 - DNA, 22 bp, Homo sapiens
ttcctgaaaatacagggagaga

SEQ ID NO: 9118787 - DNA, 22 bp, Homo sapiens
ttcctgaaaatacagggagacc

SEQ ID NO: 9118788 - DNA, 22 bp, Homo sapiens
ttcctgaacatttctaagttga

SEQ ID NO: 9118789 - DNA, 22 bp, Homo sapiens
ttcctgaagtcaaagatctaaa

SEQ ID NO: 9118790 - DNA, 22 bp, Homo sapiens
ttcctgaagtcaaagatctaaa

SEQ ID NO: 9118791 - DNA, 22 bp, Homo sapiens
ttcctgaagtcaaagatctaaa

SEQ ID NO: 9118792 - DNA, 23 bp, Homo sapiens
ttccttaactgttaagattgtct

SEQ ID NO: 9118793 - DNA, 22 bp, Homo sapiens
ttccttctagagcttgtttagg

SEQ ID NO: 9118794 - DNA, 22 bp, Homo sapiens
ttccttctcagccctcgaggat

SEQ ID NO: 9118795 - DNA, 22 bp, Homo sapiens
ttctaagaatgctttgcaaaat

SEQ ID NO: 9118796 - DNA, 22 bp, Homo sapiens
ttccttctgaagcctttgtgtt

SEQ ID NO: 9118797 - DNA, 22 bp, Homo sapiens
ttctaagagagtacaagcaatt

SEQ ID NO: 9118798 - DNA, 22 bp, Homo sapiens
ttctaagagagtacaagcaatt

SEQ ID NO: 9118799 - DNA, 22 bp, Homo sapiens
ttctaaggggttcacaggcata

SEQ ID NO: 9118800 - DNA, 22 bp, Homo sapiens
ttctaagctctgaaataaatct

SEQ ID NO: 9118801 - DNA, 22 bp, Homo sapiens
ttctaagtcactcagattttgg

SEQ ID NO: 9118802 - DNA, 23 bp, Homo sapiens
ttctaaggtatggtttatacctg

SEQ ID NO: 9118803 - DNA, 20 bp, Homo sapiens
ttctaaggttttggtgcaca

SEQ ID NO: 9118804 - DNA, 22 bp, Homo sapiens
ttctcttttcaccagttgctaa

SEQ ID NO: 9118805 - DNA, 22 bp, Homo sapiens
ttctgaaggtcagcagcttggt

SEQ ID NO: 9118806 - DNA, 22 bp, Homo sapiens
ttctgaagggctaagtgtctat

SEQ ID NO: 9118807 - DNA, 22 bp, Homo sapiens
ttctcttttgtgatgtgagatg

SEQ ID NO: 9118808 - DNA, 22 bp, Homo sapiens
ttctataagactcatatttctt

SEQ ID NO: 9118809 - DNA, 22 bp, Homo sapiens
ttctataagactcatatttctt

SEQ ID NO: 9118810 - DNA, 22 bp, Homo sapiens
ttctataaatgaatgtgtatat

SEQ ID NO: 9118811 - DNA, 22 bp, Homo sapiens
ttctagttttcagtccaccagg

SEQ ID NO: 9118812 - DNA, 22 bp, Homo sapiens
ttctagttgagggagacaaata

SEQ ID NO: 9118813 - DNA, 22 bp, Homo sapiens
ttctagtcctagaaactacatg

SEQ ID NO: 9118814 - DNA, 22 bp, Homo sapiens
ttctagtctatggctagatagt

SEQ ID NO: 9118815 - DNA, 22 bp, Homo sapiens
ttctagtgtccttggacttgct

SEQ ID NO: 9118816 - DNA, 22 bp, Homo sapiens
ttctgaatcctcgaaacatagc

SEQ ID NO: 9118817 - DNA, 22 bp, Homo sapiens
ttctgaattcatgagatttggg

SEQ ID NO: 9118818 - DNA, 22 bp, Homo sapiens
ttctgaatttctgtgtatctta

SEQ ID NO: 9118819 - DNA, 22 bp, Homo sapiens
ttctgagaagggtgggtctggc

SEQ ID NO: 9118820 - DNA, 22 bp, Homo sapiens
ttctgagaagggtgggtctggc

SEQ ID NO: 9118821 - DNA, 22 bp, Homo sapiens
ttctgacatgtgagattttgtt

SEQ ID NO: 9118822 - DNA, 22 bp, Homo sapiens
ttctgagaggcagagcttgtga

SEQ ID NO: 9118823 - DNA, 22 bp, Homo sapiens
ttctgggcacacaggccctggt

SEQ ID NO: 9118824 - DNA, 22 bp, Homo sapiens
ttctgggcaccaccacagactt

SEQ ID NO: 9118825 - DNA, 22 bp, Homo sapiens
ttctgggcaccaccacagactt

SEQ ID NO: 9118826 - DNA, 22 bp, Homo sapiens
ttctggaaaagaaagttaagat

SEQ ID NO: 9118827 - DNA, 19 bp, Homo sapiens
ttctgggcagcacatgaat

SEQ ID NO: 9118828 - DNA, 22 bp, Homo sapiens
ttctgggcagagctggagctgc

SEQ ID NO: 9118829 - DNA, 20 bp, Homo sapiens
ttctgggcagccatgtactt

SEQ ID NO: 9118830 - DNA, 22 bp, Homo sapiens
ttctgggcaggactggggaccc

SEQ ID NO: 9118831 - DNA, 19 bp, Homo sapiens
ttctgggcattcatattta

SEQ ID NO: 9118832 - DNA, 22 bp, Homo sapiens
ttctgggccaatctcttaatct

SEQ ID NO: 9118833 - DNA, 22 bp, Homo sapiens
ttctgggcatgttacattctgt

SEQ ID NO: 9118834 - DNA, 22 bp, Homo sapiens
ttctgggcaggactggggaccc

SEQ ID NO: 9118835 - DNA, 22 bp, Homo sapiens
ttctgggcagttggaaatttca

SEQ ID NO: 9118836 - DNA, 22 bp, Homo sapiens
ttctgcttttattgccagagtt

SEQ ID NO: 9118837 - DNA, 22 bp, Homo sapiens
ttctgcttttctctgtctgagt

SEQ ID NO: 9118838 - DNA, 21 bp, Homo sapiens
ttctgccttcccctagctggg

SEQ ID NO: 9118839 - DNA, 21 bp, Homo sapiens
ttctgccttcccctagctggg

SEQ ID NO: 9118840 - DNA, 22 bp, Homo sapiens
ttctgccttcagtcctctgact

SEQ ID NO: 9118841 - DNA, 22 bp, Homo sapiens
ttctgccttacgatattttcaa

SEQ ID NO: 9118842 - DNA, 22 bp, Homo sapiens
ttctgctccaccacttccagca

SEQ ID NO: 9118843 - DNA, 22 bp, Homo sapiens
ttctgccttggcagggtggtcc

SEQ ID NO: 9118844 - DNA, 21 bp, Homo sapiens
ttctgccttcgaggtctcagg

SEQ ID NO: 9118845 - DNA, 21 bp, Homo sapiens
ttctgccttcgaggtctcagg

SEQ ID NO: 9118846 - DNA, 22 bp, Homo sapiens
ttctgcctgatgtagtcatacc

SEQ ID NO: 9118847 - DNA, 22 bp, Homo sapiens
ttctgagcctcattcatgaggc

SEQ ID NO: 9118848 - DNA, 22 bp, Homo sapiens
ttctgcctgccccagagaggcc

SEQ ID NO: 9118849 - DNA, 22 bp, Homo sapiens
ttctgcctggcaggaggactgt

SEQ ID NO: 9118850 - DNA, 22 bp, Homo sapiens
ttctgagccagagtcagttatg

SEQ ID NO: 9118851 - DNA, 22 bp, Homo sapiens
ttctgagcctcattcatgaggc

SEQ ID NO: 9118852 - DNA, 22 bp, Homo sapiens
ttctgctcttggctttgctggt

SEQ ID NO: 9118853 - DNA, 21 bp, Homo sapiens
ttcttcttggactgttttggc

SEQ ID NO: 9118854 - DNA, 21 bp, Homo sapiens
ttcttcttggactgttttggc

SEQ ID NO: 9118855 - DNA, 22 bp, Homo sapiens
ttcttgaaggggatataaatag

SEQ ID NO: 9118856 - DNA, 22 bp, Homo sapiens
ttcttgatgaatgctaagaact

SEQ ID NO: 9118857 - DNA, 20 bp, Homo sapiens
ttcttgagccaaaaggcata

SEQ ID NO: 9118858 - DNA, 22 bp, Homo sapiens
ttcttctttccaattacatggt

SEQ ID NO: 9118859 - DNA, 22 bp, Homo sapiens
ttcttctttcctataattaatt

SEQ ID NO: 9118860 - DNA, 22 bp, Homo sapiens
ttcttgattcttccttgaagga

SEQ ID NO: 9118861 - DNA, 22 bp, Homo sapiens
ttcttgattagtctcatgccaa

SEQ ID NO: 9118862 - DNA, 22 bp, Homo sapiens
ttcttgatgtaccaacttggga

SEQ ID NO: 9118863 - DNA, 22 bp, Homo sapiens
ttcttgatgcttgtttaaaggt

SEQ ID NO: 9118864 - DNA, 19 bp, Homo sapiens
ttcttgagacctcagtctg

SEQ ID NO: 9118865 - DNA, 22 bp, Homo sapiens
ttcttgagtatctgcacagtgc

SEQ ID NO: 9118866 - DNA, 20 bp, Homo sapiens
ttcttgatttgatcctggtt

SEQ ID NO: 9118867 - DNA, 22 bp, Homo sapiens
ttcttgatttcatgcagttaag

SEQ ID NO: 9118868 - DNA, 22 bp, Homo sapiens
ttctttaaaatagtgagaaaga

SEQ ID NO: 9118869 - DNA, 22 bp, Homo sapiens
ttctttaaaatagtgagaaaga

SEQ ID NO: 9118870 - DNA, 22 bp, Homo sapiens
ttctttaaatgaattctctgta

SEQ ID NO: 9118871 - DNA, 22 bp, Homo sapiens
ttctttaaaatagtgagaaaga

SEQ ID NO: 9118872 - DNA, 22 bp, Homo sapiens
ttctttaaaatagtgagaaaga

SEQ ID NO: 9118873 - DNA, 23 bp, Homo sapiens
ttctttataaatcaatgggatgt

SEQ ID NO: 9118874 - DNA, 22 bp, Homo sapiens
ttctttatagctattggatgag

SEQ ID NO: 9118875 - DNA, 22 bp, Homo sapiens
ttctttatatctgctagtgggt

SEQ ID NO: 9118876 - DNA, 22 bp, Homo sapiens
ttctttatcagttactcatagg

SEQ ID NO: 9118877 - DNA, 18 bp, Homo sapiens
ttctttaattcagtttga

SEQ ID NO: 9118878 - DNA, 18 bp, Homo sapiens
ttctttaattcagtttga

SEQ ID NO: 9118879 - DNA, 22 bp, Homo sapiens
ttcttacactcttaaaaatcat

SEQ ID NO: 9118880 - DNA, 22 bp, Homo sapiens
ttcttacagagtttacagagcc

SEQ ID NO: 9118881 - DNA, 22 bp, Homo sapiens
ttctgttttgcacagacttgaa

SEQ ID NO: 9118882 - DNA, 22 bp, Homo sapiens
ttctgttttagaaataagtagt

SEQ ID NO: 9118883 - DNA, 22 bp, Homo sapiens
ttctgttttagaaataagtagt

SEQ ID NO: 9118884 - DNA, 22 bp, Homo sapiens
ttctgttctgatacttgtttct

SEQ ID NO: 9118885 - DNA, 22 bp, Homo sapiens
ttctgtttactcagaaatacaa

SEQ ID NO: 9118886 - DNA, 22 bp, Homo sapiens
ttctgttagaattttgaaaata

SEQ ID NO: 9118887 - DNA, 22 bp, Homo sapiens
ttctgttacaagtgaaaaaatg

SEQ ID NO: 9118888 - DNA, 22 bp, Homo sapiens
ttctggttacattgttacagct

SEQ ID NO: 9118889 - DNA, 22 bp, Homo sapiens
ttctgggtgccacctaagacat

SEQ ID NO: 9118890 - DNA, 21 bp, Homo sapiens
ttctgggccatgctgcttctc

SEQ ID NO: 9118891 - DNA, 22 bp, Homo sapiens
ttctgggcccaaccctagagtg

SEQ ID NO: 9118892 - DNA, 21 bp, Homo sapiens
ttctgggccggagaaggggcg

SEQ ID NO: 9118893 - DNA, 22 bp, Homo sapiens
ttctgggcccactgtagcatcc

SEQ ID NO: 9118894 - DNA, 22 bp, Homo sapiens
ttctgggcctcctaggacaggc

SEQ ID NO: 9118895 - DNA, 22 bp, Homo sapiens
ttctgggctaccttcccggcag

SEQ ID NO: 9118896 - DNA, 22 bp, Homo sapiens
ttctgggctcacagagcagcag

SEQ ID NO: 9118897 - DNA, 22 bp, Homo sapiens
ttctgggcctcctaggacaggc

SEQ ID NO: 9118898 - DNA, 22 bp, Homo sapiens
ttctggggccaattgccactgc

SEQ ID NO: 9118899 - DNA, 22 bp, Homo sapiens
ttctgggcttgaaagtttaata

SEQ ID NO: 9118900 - DNA, 22 bp, Homo sapiens
ttctgggcttggctgtttccat

SEQ ID NO: 9118901 - DNA, 22 bp, Homo sapiens
ttctgggctctctttctgtgtg

SEQ ID NO: 9118902 - DNA, 22 bp, Homo sapiens
ttctgggctcccacatatttca

SEQ ID NO: 9118903 - DNA, 23 bp, Homo sapiens
ttctgggctgtggaagcctcggg

SEQ ID NO: 9118904 - DNA, 22 bp, Homo sapiens
ttctgggctgtccagagggtga

SEQ ID NO: 9118905 - DNA, 22 bp, Homo sapiens
ttgagcaatgtcactgaggctt

SEQ ID NO: 9118906 - DNA, 21 bp, Homo sapiens
ttgagcagaaatgtgtatgcc

SEQ ID NO: 9118907 - DNA, 20 bp, Homo sapiens
ttgagcagcagtgctgtgtc

SEQ ID NO: 9118908 - DNA, 22 bp, Homo sapiens
ttgagcaagcctgcggcgggaa

SEQ ID NO: 9118909 - DNA, 22 bp, Homo sapiens
ttgagcaatgctgcaaagagat

SEQ ID NO: 9118910 - DNA, 22 bp, Homo sapiens
ttgagcaaagcagccattcatt

SEQ ID NO: 9118911 - DNA, 22 bp, Homo sapiens
ttgagatgtcttttggcattat

SEQ ID NO: 9118912 - DNA, 22 bp, Homo sapiens
ttgagatgggctttatgttcag

SEQ ID NO: 9118913 - DNA, 22 bp, Homo sapiens
ttgagatggagtcttgctctct

SEQ ID NO: 9118914 - DNA, 22 bp, Homo sapiens
ttgagatggagtctcactctgt

SEQ ID NO: 9118915 - DNA, 22 bp, Homo sapiens
ttgagatggagtctcgcactgt

SEQ ID NO: 9118916 - DNA, 22 bp, Homo sapiens
ttgagcccaggaggcctgggtg

SEQ ID NO: 9118917 - DNA, 22 bp, Homo sapiens
ttgagcccaggaggcctgggtg

SEQ ID NO: 9118918 - DNA, 22 bp, Homo sapiens
ttgagcccaggaggcctgggtg

SEQ ID NO: 9118919 - DNA, 22 bp, Homo sapiens
ttgaggcaaaatcaacgggaag

SEQ ID NO: 9118920 - DNA, 22 bp, Homo sapiens
ttgaggattcatgtcagaattc

SEQ ID NO: 9118921 - DNA, 23 bp, Homo sapiens
ttgaggcaaactcttttctgaaa

SEQ ID NO: 9118922 - DNA, 22 bp, Homo sapiens
ttgaagcccttcttgatagtca

SEQ ID NO: 9118923 - DNA, 22 bp, Homo sapiens
ttgaagctccggtgtataggaa

SEQ ID NO: 9118924 - DNA, 22 bp, Homo sapiens
ttgaagctaggctgtgcatatg

SEQ ID NO: 9118925 - DNA, 22 bp, Homo sapiens
ttgaaggacatcctatttctag

SEQ ID NO: 9118926 - DNA, 22 bp, Homo sapiens
ttgaagctgtctttcagaatca

SEQ ID NO: 9118927 - DNA, 22 bp, Homo sapiens
ttgaatgaatggtccatataga

SEQ ID NO: 9118928 - DNA, 22 bp, Homo sapiens
ttgaatgaattctacttccaga

SEQ ID NO: 9118929 - DNA, 22 bp, Homo sapiens
ttgaagcaaattctgtgcagta

SEQ ID NO: 9118930 - DNA, 22 bp, Homo sapiens
ttgaagcacaatgtcttttatc

SEQ ID NO: 9118931 - DNA, 22 bp, Homo sapiens
ttgaagcatggtacttgttcaa

SEQ ID NO: 9118932 - DNA, 22 bp, Homo sapiens
ttgaagcatttgctatagcatt

SEQ ID NO: 9118933 - DNA, 22 bp, Homo sapiens
ttgaagcaggaaaatttctatt

SEQ ID NO: 9118934 - DNA, 22 bp, Homo sapiens
ttgagatgaggtagaagccaat

SEQ ID NO: 9118935 - DNA, 22 bp, Homo sapiens
ttgagatgacttaaatttggga

SEQ ID NO: 9118936 - DNA, 22 bp, Homo sapiens
ttgagatggagcttcactcttg

SEQ ID NO: 9118937 - DNA, 22 bp, Homo sapiens
ttgagatggagcctcagtcttg

SEQ ID NO: 9118938 - DNA, 22 bp, Homo sapiens
ttgaatgatcctatctagcaca

SEQ ID NO: 9118939 - DNA, 22 bp, Homo sapiens
ttgaagaagtaattttaagtct

SEQ ID NO: 9118940 - DNA, 22 bp, Homo sapiens
ttgaagaaccatctgtgccact

SEQ ID NO: 9118941 - DNA, 22 bp, Homo sapiens
ttgaagacacagacatatagag

SEQ ID NO: 9118942 - DNA, 22 bp, Homo sapiens
ttgaagacctttagtgctatgt

SEQ ID NO: 9118943 - DNA, 22 bp, Homo sapiens
ttgaagaattaacagctgtgga

SEQ ID NO: 9118944 - DNA, 22 bp, Homo sapiens
ttgaagaattaacagctgtgga

SEQ ID NO: 9118945 - DNA, 22 bp, Homo sapiens
ttgaagaattaggacgtgagta

SEQ ID NO: 9118946 - DNA, 22 bp, Homo sapiens
ttgaagaattaacagctgtgga

SEQ ID NO: 9118947 - DNA, 22 bp, Homo sapiens
ttctttcccagaagatatgttt

SEQ ID NO: 9118948 - DNA, 22 bp, Homo sapiens
ttgaagattattctattaaaag

SEQ ID NO: 9118949 - DNA, 22 bp, Homo sapiens
ttgaagagtttgatagagttga

SEQ ID NO: 9118950 - DNA, 22 bp, Homo sapiens
ttgaagagcaccagcattttga

SEQ ID NO: 9118951 - DNA, 22 bp, Homo sapiens
ttgaagagaatcagaaggttga

SEQ ID NO: 9118952 - DNA, 22 bp, Homo sapiens
ttctttatcagttactcatagg

SEQ ID NO: 9118953 - DNA, 22 bp, Homo sapiens
ttctttatcctatttgtaggtg

SEQ ID NO: 9118954 - DNA, 22 bp, Homo sapiens
ttctttatggaatggtgatagt

SEQ ID NO: 9118955 - DNA, 22 bp, Homo sapiens
ttctttatgcttctgtttaggc

SEQ ID NO: 9118956 - DNA, 22 bp, Homo sapiens
ttctttatgcttctgtttaggc

SEQ ID NO: 9118957 - DNA, 22 bp, Homo sapiens
ttctttatgcttctgtttaggc

SEQ ID NO: 9118958 - DNA, 22 bp, Homo sapiens
ttctttatgttaatgaatctat

SEQ ID NO: 9118959 - DNA, 22 bp, Homo sapiens
ttctttatgttaatgaatctat

SEQ ID NO: 9118960 - DNA, 22 bp, Homo sapiens
ttctttatgttaatgaatctat

SEQ ID NO: 9118961 - DNA, 22 bp, Homo sapiens
ttctttattagtttagtgagct

SEQ ID NO: 9118962 - DNA, 22 bp, Homo sapiens
ttctttattgagacttcattgt

SEQ ID NO: 9118963 - DNA, 22 bp, Homo sapiens
ttctttattgagacttcattgt

SEQ ID NO: 9118964 - DNA, 22 bp, Homo sapiens
ttctttcagaacacaagtgatt

SEQ ID NO: 9118965 - DNA, 22 bp, Homo sapiens
ttctttccaaccagatattggt

SEQ ID NO: 9118966 - DNA, 22 bp, Homo sapiens
ttgatttcttactcttccaagg

SEQ ID NO: 9118967 - DNA, 22 bp, Homo sapiens
ttgattttaaaatagtgacact

SEQ ID NO: 9118968 - DNA, 22 bp, Homo sapiens
ttgatttatagaatgttcaagc

SEQ ID NO: 9118969 - DNA, 22 bp, Homo sapiens
ttgattttgcctgatctgagag

SEQ ID NO: 9118970 - DNA, 21 bp, Homo sapiens
ttgattttaggaagtttgtca

SEQ ID NO: 9118971 - DNA, 22 bp, Homo sapiens
ttgattttcaattcattgacaa

SEQ ID NO: 9118972 - DNA, 22 bp, Homo sapiens
ttgattttaaaatagtgacact

SEQ ID NO: 9118973 - DNA, 22 bp, Homo sapiens
ttgcaaagagataatcctaggc

SEQ ID NO: 9118974 - DNA, 22 bp, Homo sapiens
ttgcaaagactggcttaacagt

SEQ ID NO: 9118975 - DNA, 20 bp, Homo sapiens
ttgcaaagtgaatagcaatt

SEQ ID NO: 9118976 - DNA, 22 bp, Homo sapiens
ttgcaaagtgtcatgcaaagta

SEQ ID NO: 9118977 - DNA, 22 bp, Homo sapiens
ttgcaaatgaccattgccacat

SEQ ID NO: 9118978 - DNA, 22 bp, Homo sapiens
ttgcaaatgaccattgccacat

SEQ ID NO: 9118979 - DNA, 22 bp, Homo sapiens
ttgcaaatgaccattgccacat

SEQ ID NO: 9118980 - DNA, 22 bp, Homo sapiens
ttgcaaatggaggcctggcagc

SEQ ID NO: 9118981 - DNA, 22 bp, Homo sapiens
ttgcaaatgggcaaagcagatc

SEQ ID NO: 9118982 - DNA, 22 bp, Homo sapiens
ttgcaaatgggcaaagcagatc

SEQ ID NO: 9118983 - DNA, 22 bp, Homo sapiens
ttgcaaatgtgaataattacac

SEQ ID NO: 9118984 - DNA, 22 bp, Homo sapiens
ttgcaaatgtgaataattacac

SEQ ID NO: 9118985 - DNA, 22 bp, Homo sapiens
ttgcaaatgtgaataattacac

SEQ ID NO: 9118986 - DNA, 22 bp, Homo sapiens
ttgcaaatgtgaataattacac

SEQ ID NO: 9118987 - DNA, 22 bp, Homo sapiens
ttgcaaatggtaccaagggtct

SEQ ID NO: 9118988 - DNA, 22 bp, Homo sapiens
ttgcaaatgtggttagggcttt

SEQ ID NO: 9118989 - DNA, 22 bp, Homo sapiens
ttgcaaatgtggttagggcttt

SEQ ID NO: 9118990 - DNA, 22 bp, Homo sapiens
ttgcaaatgtgagtttagactg

SEQ ID NO: 9118991 - DNA, 22 bp, Homo sapiens
ttgcaaatgtgagtttagactg

SEQ ID NO: 9118992 - DNA, 22 bp, Homo sapiens
ttgcaaatgttatactgccagt

SEQ ID NO: 9118993 - DNA, 22 bp, Homo sapiens
ttgcaaatgttatactgccagt

SEQ ID NO: 9118994 - DNA, 22 bp, Homo sapiens
ttgcaaattaaagaggatagca

SEQ ID NO: 9118995 - DNA, 22 bp, Homo sapiens
ttgcaaattaaagaggatagca

SEQ ID NO: 9118996 - DNA, 22 bp, Homo sapiens
ttgcaaattatataagggatgc

SEQ ID NO: 9118997 - DNA, 22 bp, Homo sapiens
ttgcaaatgtttcataacagta

SEQ ID NO: 9118998 - DNA, 22 bp, Homo sapiens
ttgcaaatgtttcataacagta

SEQ ID NO: 9118999 - DNA, 20 bp, Homo sapiens
ttgcaaatatctattgattg

SEQ ID NO: 9119000 - DNA, 20 bp, Homo sapiens
ttgcaaatatctattgattg

SEQ ID NO: 9119001 - DNA, 22 bp, Homo sapiens
ttgcaaatatgttctcctattc

SEQ ID NO: 9119002 - DNA, 20 bp, Homo sapiens
ttgcaaatatcgtgggtcag

SEQ ID NO: 9119003 - DNA, 22 bp, Homo sapiens
ttgcaaataatagcctgaaact

SEQ ID NO: 9119004 - DNA, 22 bp, Homo sapiens
ttgcaaataatagcctgaaact

SEQ ID NO: 9119005 - DNA, 22 bp, Homo sapiens
ttgcaaataaacaagtatacat

SEQ ID NO: 9119006 - DNA, 22 bp, Homo sapiens
ttgcaaataaacaagtatacat

SEQ ID NO: 9119007 - DNA, 22 bp, Homo sapiens
ttgcaaataaacaagtatacat

SEQ ID NO: 9119008 - DNA, 22 bp, Homo sapiens
ttgcaaataaacaagtatacat

SEQ ID NO: 9119009 - DNA, 22 bp, Homo sapiens
ttgcaaatcagaagtatagatt

SEQ ID NO: 9119010 - DNA, 22 bp, Homo sapiens
ttgcaaatcagaagtatagatt

SEQ ID NO: 9119011 - DNA, 22 bp, Homo sapiens
ttgcaaatctcttgtgtttggt

SEQ ID NO: 9119012 - DNA, 22 bp, Homo sapiens
ttgcaaatctttgccagaaggc

SEQ ID NO: 9119013 - DNA, 22 bp, Homo sapiens
ttgcaaatctttgccagaaggc

SEQ ID NO: 9119014 - DNA, 22 bp, Homo sapiens
ttgcaaatattgtttacctttc

SEQ ID NO: 9119015 - DNA, 22 bp, Homo sapiens
ttgcaaatattgtttacctttc

SEQ ID NO: 9119016 - DNA, 22 bp, Homo sapiens
ttgcaaatattcccctaggtct

SEQ ID NO: 9119017 - DNA, 22 bp, Homo sapiens
ttgcaaatcacaagagcagagc

SEQ ID NO: 9119018 - DNA, 22 bp, Homo sapiens
ttgcaaatattgtttacctttc

SEQ ID NO: 9119019 - DNA, 22 bp, Homo sapiens
ttgaggcattactgtaatgaga

SEQ ID NO: 9119020 - DNA, 20 bp, Homo sapiens
ttgaggcatgtctagaagta

SEQ ID NO: 9119021 - DNA, 22 bp, Homo sapiens
ttgagtggttcctcagttgact

SEQ ID NO: 9119022 - DNA, 22 bp, Homo sapiens
ttgagtgtaaggaatgtggggc

SEQ ID NO: 9119023 - DNA, 22 bp, Homo sapiens
ttgatccctggaaattgaaatg

SEQ ID NO: 9119024 - DNA, 22 bp, Homo sapiens
ttgatccagttgaaagtgatga

SEQ ID NO: 9119025 - DNA, 22 bp, Homo sapiens
ttgatccagttgaaagtgatga

SEQ ID NO: 9119026 - DNA, 22 bp, Homo sapiens
ttgatgatcttacggcagagga

SEQ ID NO: 9119027 - DNA, 22 bp, Homo sapiens
ttgatgatgtttctgccttgcc

SEQ ID NO: 9119028 - DNA, 22 bp, Homo sapiens
ttgatgatgcacatttataatt

SEQ ID NO: 9119029 - DNA, 22 bp, Homo sapiens
ttgattaaacaggcatattcaa

SEQ ID NO: 9119030 - DNA, 22 bp, Homo sapiens
ttgattaaaatgagacatcatt

SEQ ID NO: 9119031 - DNA, 22 bp, Homo sapiens
ttgattaaaatgagacatcatt

SEQ ID NO: 9119032 - DNA, 22 bp, Homo sapiens
ttgattaatcccatgtgagtag

SEQ ID NO: 9119033 - DNA, 23 bp, Homo sapiens
tgtgtctgtttagggaggatgtg

SEQ ID NO: 9119034 - DNA, 22 bp, Homo sapiens
tgtgtctgttttgctcaccatt

SEQ ID NO: 9119035 - DNA, 22 bp, Homo sapiens
tgtgtctgttttgctcaccatt

SEQ ID NO: 9119036 - DNA, 22 bp, Homo sapiens
tgtgtcttaagttccaagacat

SEQ ID NO: 9119037 - DNA, 22 bp, Homo sapiens
tgtgtctttggcgatgtctgga

SEQ ID NO: 9119038 - DNA, 20 bp, Homo sapiens
tgtgtcttcctttctttatg

SEQ ID NO: 9119039 - DNA, 22 bp, Homo sapiens
tgtgtcttggccaccttgggaa

SEQ ID NO: 9119040 - DNA, 22 bp, Homo sapiens
tgtgtgaaggagccactgttca

SEQ ID NO: 9119041 - DNA, 22 bp, Homo sapiens
tgtgtgaatggattattctatt

SEQ ID NO: 9119042 - DNA, 22 bp, Homo sapiens
tgtgtgaaggagccactgttca

SEQ ID NO: 9119043 - DNA, 22 bp, Homo sapiens
tgtgtgaaggaatatatactca

SEQ ID NO: 9119044 - DNA, 22 bp, Homo sapiens
tgtgtgaactctctgatgtaca

SEQ ID NO: 9119045 - DNA, 22 bp, Homo sapiens
tgtgtgaacatgttttcatttc

SEQ ID NO: 9119046 - DNA, 22 bp, Homo sapiens
tgtgtgaagcacatgttcaagg

SEQ ID NO: 9119047 - DNA, 22 bp, Homo sapiens
tgtgtgaactctctgatgtaca

SEQ ID NO: 9119048 - DNA, 22 bp, Homo sapiens
tgtgtgattgcaggagatgtgg

SEQ ID NO: 9119049 - DNA, 22 bp, Homo sapiens
tgtgtgacctggggtgagatag

SEQ ID NO: 9119050 - DNA, 22 bp, Homo sapiens
tgtgtgacccccagtgaagcct

SEQ ID NO: 9119051 - DNA, 22 bp, Homo sapiens
tgtgtgacacattgatatgtgc

SEQ ID NO: 9119052 - DNA, 22 bp, Homo sapiens
tgtgtcccttggaacctcagct

SEQ ID NO: 9119053 - DNA, 19 bp, Homo sapiens
tgtgtcctagcagccagtc

SEQ ID NO: 9119054 - DNA, 22 bp, Homo sapiens
tgtgtcccttggaacctcagct

SEQ ID NO: 9119055 - DNA, 23 bp, Homo sapiens
tgtgtcatggggaaagactcacc

SEQ ID NO: 9119056 - DNA, 22 bp, Homo sapiens
tgtgtcatgtgtgaggctccct

SEQ ID NO: 9119057 - DNA, 22 bp, Homo sapiens
tgtgtccacgcactggcatgat

SEQ ID NO: 9119058 - DNA, 22 bp, Homo sapiens
tgtgtcctgcagacagactcag

SEQ ID NO: 9119059 - DNA, 22 bp, Homo sapiens
tgtgtcctgtccccttgctgct

SEQ ID NO: 9119060 - DNA, 22 bp, Homo sapiens
tgtgtccttctgggagtcccag

SEQ ID NO: 9119061 - DNA, 22 bp, Homo sapiens
tgtgtcctttggaggatcagcg

SEQ ID NO: 9119062 - DNA, 22 bp, Homo sapiens
tgtgtctaatgactatttcttc

SEQ ID NO: 9119063 - DNA, 22 bp, Homo sapiens
tgtggcctcctgttcctgggta

SEQ ID NO: 9119064 - DNA, 18 bp, Homo sapiens
tgtggtggagctgccttc

SEQ ID NO: 9119065 - DNA, 18 bp, Homo sapiens
tgtggtggagctgccttc

SEQ ID NO: 9119066 - DNA, 22 bp, Homo sapiens
tgtgggtttaagaggcagcatg

SEQ ID NO: 9119067 - DNA, 22 bp, Homo sapiens
tgtgtaatgaatagctttactg

SEQ ID NO: 9119068 - DNA, 22 bp, Homo sapiens
tgtgtaaatttatttacataaa

SEQ ID NO: 9119069 - DNA, 22 bp, Homo sapiens
tgtgtacaaactaacaacatat

SEQ ID NO: 9119070 - DNA, 22 bp, Homo sapiens
tgtggtggtaatgagccagatg

SEQ ID NO: 9119071 - DNA, 22 bp, Homo sapiens
tgtggtggggtctggtattcca

SEQ ID NO: 9119072 - DNA, 22 bp, Homo sapiens
tgtggaggattctgatgccagc

SEQ ID NO: 9119073 - DNA, 22 bp, Homo sapiens
tgtggaggtttaagtaatggga

SEQ ID NO: 9119074 - DNA, 22 bp, Homo sapiens
tgtggaggattctgatgccagc

SEQ ID NO: 9119075 - DNA, 20 bp, Homo sapiens
tgtggatgaggtaaggatag

SEQ ID NO: 9119076 - DNA, 22 bp, Homo sapiens
tgtggcagaactgggactcaaa

SEQ ID NO: 9119077 - DNA, 22 bp, Homo sapiens
tgtggcagaactgggactcaaa

SEQ ID NO: 9119078 - DNA, 22 bp, Homo sapiens
tgtggcagaaccagaattcaaa

SEQ ID NO: 9119079 - DNA, 22 bp, Homo sapiens
tgtggcagaaccagaattcaaa

SEQ ID NO: 9119080 - DNA, 22 bp, Homo sapiens
tgtggcagagtaaggacccagt

SEQ ID NO: 9119081 - DNA, 22 bp, Homo sapiens
tgtggcagattttataaattgc

SEQ ID NO: 9119082 - DNA, 22 bp, Homo sapiens
tgtggcagattttataaattgc

SEQ ID NO: 9119083 - DNA, 21 bp, Homo sapiens
tgtggcagatgttgggaggca

SEQ ID NO: 9119084 - DNA, 22 bp, Homo sapiens
tgtggcagagagagcttccttg

SEQ ID NO: 9119085 - DNA, 22 bp, Homo sapiens
tgtggcagagagagcttccttg

SEQ ID NO: 9119086 - DNA, 21 bp, Homo sapiens
tgtggcagagacaatgctagt

SEQ ID NO: 9119087 - DNA, 22 bp, Homo sapiens
tgtggcagacaagattctatgt

SEQ ID NO: 9119088 - DNA, 21 bp, Homo sapiens
tgtggcagagacaatgctagt

SEQ ID NO: 9119089 - DNA, 22 bp, Homo sapiens
tgtggcagtctcactggagggc

SEQ ID NO: 9119090 - DNA, 22 bp, Homo sapiens
tgtggccaccagagctgctatt

SEQ ID NO: 9119091 - DNA, 22 bp, Homo sapiens
tgtggccaaaataaaatgaggt

SEQ ID NO: 9119092 - DNA, 22 bp, Homo sapiens
tgtggccaccagagctgctatt

SEQ ID NO: 9119093 - DNA, 22 bp, Homo sapiens
tgtggcagtataagagctagaa

SEQ ID NO: 9119094 - DNA, 22 bp, Homo sapiens
tgtggcagtaaaattgggcaac

SEQ ID NO: 9119095 - DNA, 22 bp, Homo sapiens
tgtggcccagatgagtgtgcta

SEQ ID NO: 9119096 - DNA, 19 bp, Homo sapiens
tgtggccatggttcagctg

SEQ ID NO: 9119097 - DNA, 19 bp, Homo sapiens
tgtggccatggttcagctg

SEQ ID NO: 9119098 - DNA, 22 bp, Homo sapiens
tgtggccaggaaaaggagatgg

SEQ ID NO: 9119099 - DNA, 22 bp, Homo sapiens
tgtggccagcaggtggctgtgt

SEQ ID NO: 9119100 - DNA, 22 bp, Homo sapiens
tgtggccagccacaggcatggt

SEQ ID NO: 9119101 - DNA, 22 bp, Homo sapiens
tgtggccaggaaaaggagatgg

SEQ ID NO: 9119102 - DNA, 22 bp, Homo sapiens
tgtggccagggggccatgtccc

SEQ ID NO: 9119103 - DNA, 22 bp, Homo sapiens
tgtggccaggcccctgatggtg

SEQ ID NO: 9119104 - DNA, 22 bp, Homo sapiens
tgtggccaggcccctgatggtg

SEQ ID NO: 9119105 - DNA, 22 bp, Homo sapiens
tcccccaggctggagtgcagtg

SEQ ID NO: 9119106 - DNA, 22 bp, Homo sapiens
tcccccaaatgaatgaggaata

SEQ ID NO: 9119107 - DNA, 22 bp, Homo sapiens
tcccccactctaaaggagcctt

SEQ ID NO: 9119108 - DNA, 22 bp, Homo sapiens
tccccaggtcctgtcggctcct

SEQ ID NO: 9119109 - DNA, 22 bp, Homo sapiens
tccccaggtcctgtcggctcct

SEQ ID NO: 9119110 - DNA, 22 bp, Homo sapiens
tccccagtcccggcggtgggtg

SEQ ID NO: 9119111 - DNA, 22 bp, Homo sapiens
tccccagtaagcctgcactgtg

SEQ ID NO: 9119112 - DNA, 22 bp, Homo sapiens
tccccctcattacctcattcaa

SEQ ID NO: 9119113 - DNA, 22 bp, Homo sapiens
tccccctccaattgccatgtta

SEQ ID NO: 9119114 - DNA, 22 bp, Homo sapiens
tccccctccaattgccatgtta

SEQ ID NO: 9119115 - DNA, 23 bp, Homo sapiens
tcccctcaggcagccagtgccct

SEQ ID NO: 9119116 - DNA, 22 bp, Homo sapiens
tcccctccaactccaactatgg

SEQ ID NO: 9119117 - DNA, 22 bp, Homo sapiens
tcccctccaactccaactatgg

SEQ ID NO: 9119118 - DNA, 22 bp, Homo sapiens
tcccctccaactccaactatgg

SEQ ID NO: 9119119 - DNA, 18 bp, Homo sapiens
tcccctgctctggtgctc

SEQ ID NO: 9119120 - DNA, 22 bp, Homo sapiens
tgtggacgtcattaaagcagtg

SEQ ID NO: 9119121 - DNA, 22 bp, Homo sapiens
tgtggagatgtgagcaagggga

SEQ ID NO: 9119122 - DNA, 22 bp, Homo sapiens
tgtggagaagaaggccactgca

SEQ ID NO: 9119123 - DNA, 22 bp, Homo sapiens
tgtggagaagaaggccactgca

SEQ ID NO: 9119124 - DNA, 22 bp, Homo sapiens
tgtggagctcagaagtagcagt

SEQ ID NO: 9119125 - DNA, 22 bp, Homo sapiens
tgtggagcagcgtcacagcctt

SEQ ID NO: 9119126 - DNA, 22 bp, Homo sapiens
tcccctgcagatgagggcagtg

SEQ ID NO: 9119127 - DNA, 22 bp, Homo sapiens
tcccctctggttgacccaggag

SEQ ID NO: 9119128 - DNA, 22 bp, Homo sapiens
tcccctctggttgacccaggag

SEQ ID NO: 9119129 - DNA, 22 bp, Homo sapiens
tcccctctggaggctgcagggg

SEQ ID NO: 9119130 - DNA, 22 bp, Homo sapiens
tcccctctggaggctgcagggg

SEQ ID NO: 9119131 - DNA, 21 bp, Homo sapiens
tgttcctgttctctaggatcc

SEQ ID NO: 9119132 - DNA, 22 bp, Homo sapiens
tgttcctgtttaatgtgctcat

SEQ ID NO: 9119133 - DNA, 22 bp, Homo sapiens
tgttccttcacagcagtggaca

SEQ ID NO: 9119134 - DNA, 22 bp, Homo sapiens
tgttccttgaatatatcagacg

SEQ ID NO: 9119135 - DNA, 22 bp, Homo sapiens
tgttccttgaatatatcagacg

SEQ ID NO: 9119136 - DNA, 22 bp, Homo sapiens
tgttccttctggcttttacatc

SEQ ID NO: 9119137 - DNA, 22 bp, Homo sapiens
tgttctaagctgccaaaatgct

SEQ ID NO: 9119138 - DNA, 22 bp, Homo sapiens
tgttctatgctctttaaggtga

SEQ ID NO: 9119139 - DNA, 21 bp, Homo sapiens
tgttctatcagctcaggtgtc

SEQ ID NO: 9119140 - DNA, 22 bp, Homo sapiens
tgttctcagtaattctatttta

SEQ ID NO: 9119141 - DNA, 22 bp, Homo sapiens
tgttctcagtaattctatttta

SEQ ID NO: 9119142 - DNA, 22 bp, Homo sapiens
tgttctgtacctgtcctggggc

SEQ ID NO: 9119143 - DNA, 22 bp, Homo sapiens
tgttctctctggctgccagtac

SEQ ID NO: 9119144 - DNA, 22 bp, Homo sapiens
tgttctctaagccacccatttt

SEQ ID NO: 9119145 - DNA, 22 bp, Homo sapiens
tgtttaatttcacaaagttgac

SEQ ID NO: 9119146 - DNA, 22 bp, Homo sapiens
tgtttaattcaccatcatgttc

SEQ ID NO: 9119147 - DNA, 22 bp, Homo sapiens
tgtttaatgaagatggtttttc

SEQ ID NO: 9119148 - DNA, 22 bp, Homo sapiens
tgtttaataattctatgatagt

SEQ ID NO: 9119149 - DNA, 21 bp, Homo sapiens
tgtttaatacatatttgtgga

SEQ ID NO: 9119150 - DNA, 22 bp, Homo sapiens
tgtttacacttcaaggttaagg

SEQ ID NO: 9119151 - DNA, 22 bp, Homo sapiens
tgtttacagtttttagtaccct

SEQ ID NO: 9119152 - DNA, 22 bp, Homo sapiens
tgtttacaaaaccgtggtactg

SEQ ID NO: 9119153 - DNA, 22 bp, Homo sapiens
tgtttcttgataaagcagaaaa

SEQ ID NO: 9119154 - DNA, 22 bp, Homo sapiens
tgtttcttgggtgctcacatca

SEQ ID NO: 9119155 - DNA, 22 bp, Homo sapiens
tgtttgaaaagtggagatttat

SEQ ID NO: 9119156 - DNA, 22 bp, Homo sapiens
tgtttctttgtagatattcttt

SEQ ID NO: 9119157 - DNA, 22 bp, Homo sapiens
tgtttcctaagtgtctctgaag

SEQ ID NO: 9119158 - DNA, 18 bp, Homo sapiens
tgtttcctcctggaggct

SEQ ID NO: 9119159 - DNA, 22 bp, Homo sapiens
tgtttcttgagagtattaccct

SEQ ID NO: 9119160 - DNA, 22 bp, Homo sapiens
tgttttcacaatgatgtcagat

SEQ ID NO: 9119161 - DNA, 19 bp, Homo sapiens
tgttttcaagtgggattat

SEQ ID NO: 9119162 - DNA, 22 bp, Homo sapiens
tgtttgagttctagcgcattta

SEQ ID NO: 9119163 - DNA, 22 bp, Homo sapiens
tgtttgcaacaactagatggag

SEQ ID NO: 9119164 - DNA, 22 bp, Homo sapiens
tgtttgcaacaactagatggag

SEQ ID NO: 9119165 - DNA, 22 bp, Homo sapiens
tgtttgaaaagtggagatttat

SEQ ID NO: 9119166 - DNA, 22 bp, Homo sapiens
tgtttcactgaaagccttacta

SEQ ID NO: 9119167 - DNA, 22 bp, Homo sapiens
tgtttcaggcttctgggatttt

SEQ ID NO: 9119168 - DNA, 22 bp, Homo sapiens
tgtttcaggacctatcttttag

SEQ ID NO: 9119169 - DNA, 22 bp, Homo sapiens
tgtttcagagcactgggcttat

SEQ ID NO: 9119170 - DNA, 17 bp, Homo sapiens
tgtttcacttggggaaa

SEQ ID NO: 9119171 - DNA, 22 bp, Homo sapiens
tgtttacatgcataagcttaag

SEQ ID NO: 9119172 - DNA, 22 bp, Homo sapiens
tgtttactagccaacatggaga

SEQ ID NO: 9119173 - DNA, 22 bp, Homo sapiens
tgtttcagtccctgtgttcaat

SEQ ID NO: 9119174 - DNA, 22 bp, Homo sapiens
tgtttcagtccctgtgttcaat

SEQ ID NO: 9119175 - DNA, 22 bp, Homo sapiens
tgtttcagtccacttaggcagc

SEQ ID NO: 9119176 - DNA, 22 bp, Homo sapiens
tgtttcatgattgctgtcattt

SEQ ID NO: 9119177 - DNA, 22 bp, Homo sapiens
tgttcagaacaaaggtaaatga

SEQ ID NO: 9119178 - DNA, 22 bp, Homo sapiens
tgttcagaacaaaggtaaatga

SEQ ID NO: 9119179 - DNA, 22 bp, Homo sapiens
tgttcctgacggccaaagaggt

SEQ ID NO: 9119180 - DNA, 22 bp, Homo sapiens
tgttcacaggggagccatttat

SEQ ID NO: 9119181 - DNA, 20 bp, Homo sapiens
tgttcacagtagttgctgct

SEQ ID NO: 9119182 - DNA, 21 bp, Homo sapiens
tgttcacatggagcagaatgt

SEQ ID NO: 9119183 - DNA, 21 bp, Homo sapiens
tgttcacatggagcagaatgt

SEQ ID NO: 9119184 - DNA, 22 bp, Homo sapiens
tgttcacatgtacatgaatatt

SEQ ID NO: 9119185 - DNA, 22 bp, Homo sapiens
tgttcacacacggaggccacag

SEQ ID NO: 9119186 - DNA, 22 bp, Homo sapiens
tgttatttctttgccatatctt

SEQ ID NO: 9119187 - DNA, 22 bp, Homo sapiens
tgttatttgggaaagttgtaca

SEQ ID NO: 9119188 - DNA, 22 bp, Homo sapiens
tgttatttatctgagcatttat

SEQ ID NO: 9119189 - DNA, 22 bp, Homo sapiens
tgttattatctgttaggtgttc

SEQ ID NO: 9119190 - DNA, 20 bp, Homo sapiens
tgttattagcaagcttcttt

SEQ ID NO: 9119191 - DNA, 19 bp, Homo sapiens
tgttatgactttgcctttt

SEQ ID NO: 9119192 - DNA, 22 bp, Homo sapiens
tgttaaaaatgcagattcctat

SEQ ID NO: 9119193 - DNA, 22 bp, Homo sapiens
tgttaaaaatgcagattcctat

SEQ ID NO: 9119194 - DNA, 22 bp, Homo sapiens
tgttatcacttgtaaaagcaat

SEQ ID NO: 9119195 - DNA, 22 bp, Homo sapiens
tgttatcacttagacatgctag

SEQ ID NO: 9119196 - DNA, 22 bp, Homo sapiens
tgttatcctcagctcacctcta

SEQ ID NO: 9119197 - DNA, 22 bp, Homo sapiens
tgttatcctcagctcacctcta

SEQ ID NO: 9119198 - DNA, 22 bp, Homo sapiens
tgtgttctggaaagctcactga

SEQ ID NO: 9119199 - DNA, 22 bp, Homo sapiens
tgtgttaattttccctttctct

SEQ ID NO: 9119200 - DNA, 21 bp, Homo sapiens
tgtgttcttctaggtcagcta

SEQ ID NO: 9119201 - DNA, 22 bp, Homo sapiens
tgtgttcttaaaagcagtgata

SEQ ID NO: 9119202 - DNA, 22 bp, Homo sapiens
tgtgttcttaaaagcagtgata

SEQ ID NO: 9119203 - DNA, 21 bp, Homo sapiens
tgtgtttgagactatgtttcc

SEQ ID NO: 9119204 - DNA, 22 bp, Homo sapiens
tgtgttttatctattgtatctt

SEQ ID NO: 9119205 - DNA, 22 bp, Homo sapiens
tgtgttttggaaggaacatgca

SEQ ID NO: 9119206 - DNA, 22 bp, Homo sapiens
ttacacatgctcacttatttgt

SEQ ID NO: 9119207 - DNA, 22 bp, Homo sapiens
ttacacatgctcacttatttgt

SEQ ID NO: 9119208 - DNA, 22 bp, Homo sapiens
ttacacatgctttgtgtgtatg

SEQ ID NO: 9119209 - DNA, 22 bp, Homo sapiens
ttacacatgaaggtccaatgtt

SEQ ID NO: 9119210 - DNA, 22 bp, Homo sapiens
ttacacatctagacccattttt

SEQ ID NO: 9119211 - DNA, 22 bp, Homo sapiens
ttacacagtgcacaagcagagt

SEQ ID NO: 9119212 - DNA, 22 bp, Homo sapiens
ttacacagttggtaggggcaga

SEQ ID NO: 9119213 - DNA, 22 bp, Homo sapiens
ttacactatgaatgagaatata

SEQ ID NO: 9119214 - DNA, 18 bp, Homo sapiens
ttacactagccttggttc

SEQ ID NO: 9119215 - DNA, 22 bp, Homo sapiens
ttacacatgtctcagtggaaat

SEQ ID NO: 9119216 - DNA, 22 bp, Homo sapiens
ttacacattgcagatcaaaatg

SEQ ID NO: 9119217 - DNA, 22 bp, Homo sapiens
ttacacattaacaggcagctaa

SEQ ID NO: 9119218 - DNA, 22 bp, Homo sapiens
ttacacactctgccctgctgtt

SEQ ID NO: 9119219 - DNA, 22 bp, Homo sapiens
ttacacaattttattgacctaa

SEQ ID NO: 9119220 - DNA, 22 bp, Homo sapiens
ttacacaattactcactcctgg

SEQ ID NO: 9119221 - DNA, 22 bp, Homo sapiens
ttacacacaattagcatagtaa

SEQ ID NO: 9119222 - DNA, 22 bp, Homo sapiens
ttacacagtatccaaggttctt

SEQ ID NO: 9119223 - DNA, 22 bp, Homo sapiens
ttacacaggcacttaaaatgca

SEQ ID NO: 9119224 - DNA, 17 bp, Homo sapiens
ttacacaggagagctct

SEQ ID NO: 9119225 - DNA, 22 bp, Homo sapiens
ttacaaacaacagacatttatt

SEQ ID NO: 9119226 - DNA, 22 bp, Homo sapiens
ttaatttttatgtatagtgtgt

SEQ ID NO: 9119227 - DNA, 22 bp, Homo sapiens
ttaatttttatgtatagtgtgt

SEQ ID NO: 9119228 - DNA, 21 bp, Homo sapiens
ttaatttattcatgatagcta

SEQ ID NO: 9119229 - DNA, 22 bp, Homo sapiens
ttaattttctcatctgtgaaat

SEQ ID NO: 9119230 - DNA, 22 bp, Homo sapiens
ttacaaacaacagacatttatt

SEQ ID NO: 9119231 - DNA, 22 bp, Homo sapiens
ttacaaactgtcatatagtatt

SEQ ID NO: 9119232 - DNA, 22 bp, Homo sapiens
ttacaaactgtcatatagtatt

SEQ ID NO: 9119233 - DNA, 22 bp, Homo sapiens
ttacacaaagctccccaaatag

SEQ ID NO: 9119234 - DNA, 22 bp, Homo sapiens
ttacacaacagtgcatcagcag

SEQ ID NO: 9119235 - DNA, 22 bp, Homo sapiens
ttacacaagttctttaacctat

SEQ ID NO: 9119236 - DNA, 22 bp, Homo sapiens
ttacagtattgttaaactcttt

SEQ ID NO: 9119237 - DNA, 22 bp, Homo sapiens
ttacagtattgttaaactcttt

SEQ ID NO: 9119238 - DNA, 22 bp, Homo sapiens
ttacagtattggtcacgtttgt

SEQ ID NO: 9119239 - DNA, 22 bp, Homo sapiens
ttacagtagctttatttggagt

SEQ ID NO: 9119240 - DNA, 23 bp, Homo sapiens
ttacagtaggagttggaaaacca

SEQ ID NO: 9119241 - DNA, 22 bp, Homo sapiens
ttacagtatgatcaacttttca

SEQ ID NO: 9119242 - DNA, 22 bp, Homo sapiens
ttacatagttaaatagtacagc

SEQ ID NO: 9119243 - DNA, 22 bp, Homo sapiens
ttacatattatccaaaactgct

SEQ ID NO: 9119244 - DNA, 22 bp, Homo sapiens
ttacatattatccaaaactgct

SEQ ID NO: 9119245 - DNA, 22 bp, Homo sapiens
ttacatattatccaaaactgct

SEQ ID NO: 9119246 - DNA, 22 bp, Homo sapiens
ttacatattgtctattgttcaa

SEQ ID NO: 9119247 - DNA, 22 bp, Homo sapiens
ttacatcatgcttatccctttc

SEQ ID NO: 9119248 - DNA, 22 bp, Homo sapiens
ttacatcagaaggaaacagcgt

SEQ ID NO: 9119249 - DNA, 22 bp, Homo sapiens
ttacatcatgtaactggatata

SEQ ID NO: 9119250 - DNA, 19 bp, Homo sapiens
ttacatctgcaacactggt

SEQ ID NO: 9119251 - DNA, 22 bp, Homo sapiens
ttacagtacagaaaataacaga

SEQ ID NO: 9119252 - DNA, 22 bp, Homo sapiens
ttacagtaatgtattatttaac

SEQ ID NO: 9119253 - DNA, 22 bp, Homo sapiens
ttacagtacagaaaataacaga

SEQ ID NO: 9119254 - DNA, 22 bp, Homo sapiens
ttacagtaacattttcagtctg

SEQ ID NO: 9119255 - DNA, 22 bp, Homo sapiens
ttacagtaatcgagtgttgtgg

SEQ ID NO: 9119256 - DNA, 22 bp, Homo sapiens
ttacagtaatcgagtgttgtgg

SEQ ID NO: 9119257 - DNA, 22 bp, Homo sapiens
ttacagtagattttgaatgtgg

SEQ ID NO: 9119258 - DNA, 22 bp, Homo sapiens
ttacagtagattttgaatgtgg

SEQ ID NO: 9119259 - DNA, 22 bp, Homo sapiens
ttacagtagctttatttggagt

SEQ ID NO: 9119260 - DNA, 22 bp, Homo sapiens
ttacagtagatacaatgagtaa

SEQ ID NO: 9119261 - DNA, 22 bp, Homo sapiens
ttacagtacctgtatggccact

SEQ ID NO: 9119262 - DNA, 22 bp, Homo sapiens
ttacagtagattttgaatgtgg

SEQ ID NO: 9119263 - DNA, 22 bp, Homo sapiens
ttacagtagatacaatgagtaa

SEQ ID NO: 9119264 - DNA, 22 bp, Homo sapiens
ttacacttctaaaaaaagcagg

SEQ ID NO: 9119265 - DNA, 22 bp, Homo sapiens
ttacacttctaaaaaaagcagg

SEQ ID NO: 9119266 - DNA, 22 bp, Homo sapiens
ttacacttgtaattatataacg

SEQ ID NO: 9119267 - DNA, 22 bp, Homo sapiens
ttagacatcaagaagccaatgt

SEQ ID NO: 9119268 - DNA, 22 bp, Homo sapiens
ttagacatgtttgctaaaatga

SEQ ID NO: 9119269 - DNA, 22 bp, Homo sapiens
ttagacattaaatgccatttaa

SEQ ID NO: 9119270 - DNA, 22 bp, Homo sapiens
ttagaaagctttccatagtcaa

SEQ ID NO: 9119271 - DNA, 21 bp, Homo sapiens
ttagaaagctcactacagtta

SEQ ID NO: 9119272 - DNA, 22 bp, Homo sapiens
ttagaaagctttccatagtcaa

SEQ ID NO: 9119273 - DNA, 22 bp, Homo sapiens
ttagaggactgtaggtgggaat

SEQ ID NO: 9119274 - DNA, 22 bp, Homo sapiens
ttagaggggctgctgaatggga

SEQ ID NO: 9119275 - DNA, 22 bp, Homo sapiens
ttagagagaaccatcaggatct

SEQ ID NO: 9119276 - DNA, 22 bp, Homo sapiens
ttagagacaggcttcccaagga

SEQ ID NO: 9119277 - DNA, 22 bp, Homo sapiens
ttagagaattccaaatgactac

SEQ ID NO: 9119278 - DNA, 22 bp, Homo sapiens
ttactttcaaaaactacgtggg

SEQ ID NO: 9119279 - DNA, 22 bp, Homo sapiens
ttactttatctcctagattcca

SEQ ID NO: 9119280 - DNA, 22 bp, Homo sapiens
ttactttatctcctagattcca

SEQ ID NO: 9119281 - DNA, 22 bp, Homo sapiens
ttactttatctcctagattcca

SEQ ID NO: 9119282 - DNA, 22 bp, Homo sapiens
ttactttggatggtcaagaaag

SEQ ID NO: 9119283 - DNA, 22 bp, Homo sapiens
ttagaaagagtataccagaaac

SEQ ID NO: 9119284 - DNA, 20 bp, Homo sapiens
ttagaaagagcgtgataaga

SEQ ID NO: 9119285 - DNA, 22 bp, Homo sapiens
ttagaaagaactttagatatca

SEQ ID NO: 9119286 - DNA, 22 bp, Homo sapiens
ttagaaagaactttagatatca

SEQ ID NO: 9119287 - DNA, 22 bp, Homo sapiens
ttacttttctattcgatatgtg

SEQ ID NO: 9119288 - DNA, 19 bp, Homo sapiens
ttagaaactgttgacactg

SEQ ID NO: 9119289 - DNA, 22 bp, Homo sapiens
ttactgttttggtacctcattg

SEQ ID NO: 9119290 - DNA, 22 bp, Homo sapiens
ttactgttcatgttgtacactt

SEQ ID NO: 9119291 - DNA, 22 bp, Homo sapiens
ttactgtttgaaaaatgaatgt

SEQ ID NO: 9119292 - DNA, 22 bp, Homo sapiens
ttactgttggtgtatccatagc

SEQ ID NO: 9119293 - DNA, 22 bp, Homo sapiens
ttaccaaatgaaatagagattt

SEQ ID NO: 9119294 - DNA, 22 bp, Homo sapiens
ttaccaaatcccgtgcacattc

SEQ ID NO: 9119295 - DNA, 22 bp, Homo sapiens
ttaccaaatcccgtgcacattc

SEQ ID NO: 9119296 - DNA, 22 bp, Homo sapiens
ttactagtatatgtcaagcaac

SEQ ID NO: 9119297 - DNA, 22 bp, Homo sapiens
ttactaggccagttttcacttt

SEQ ID NO: 9119298 - DNA, 22 bp, Homo sapiens
ttactatagtccagcccttttt

SEQ ID NO: 9119299 - DNA, 22 bp, Homo sapiens
ttactagtggagaaactgaggc

SEQ ID NO: 9119300 - DNA, 22 bp, Homo sapiens
ttactatatgcgtggcaggtgc

SEQ ID NO: 9119301 - DNA, 22 bp, Homo sapiens
ttaagtcaatatcaatctcagc

SEQ ID NO: 9119302 - DNA, 22 bp, Homo sapiens
ttaagtacttccctgttggaca

SEQ ID NO: 9119303 - DNA, 22 bp, Homo sapiens
ttaagtaagaccttatgtcttg

SEQ ID NO: 9119304 - DNA, 22 bp, Homo sapiens
ttaagtacagggttagtgacgg

SEQ ID NO: 9119305 - DNA, 22 bp, Homo sapiens
ttaagtgtcataatttccaaga

SEQ ID NO: 9119306 - DNA, 22 bp, Homo sapiens
ttaagtgtagtgctaagggcag

SEQ ID NO: 9119307 - DNA, 22 bp, Homo sapiens
ttaagggccattatggatgggt

SEQ ID NO: 9119308 - DNA, 22 bp, Homo sapiens
ttaagggccattatggatgggt

SEQ ID NO: 9119309 - DNA, 18 bp, Homo sapiens
ttaaggataagcagacta

SEQ ID NO: 9119310 - DNA, 22 bp, Homo sapiens
ttaaggcatagcttgtgttgac

SEQ ID NO: 9119311 - DNA, 22 bp, Homo sapiens
ttaaggcattgatatggtgcta

SEQ ID NO: 9119312 - DNA, 22 bp, Homo sapiens
ttaaggaatgtgcagtttatat

SEQ ID NO: 9119313 - DNA, 22 bp, Homo sapiens
ttaaggaacaattctacacacc

SEQ ID NO: 9119314 - DNA, 22 bp, Homo sapiens
ttaatttatacataatcacagg

SEQ ID NO: 9119315 - DNA, 22 bp, Homo sapiens
ttaatttatacataatcacagg

SEQ ID NO: 9119316 - DNA, 22 bp, Homo sapiens
ttaatttatgtccaaaccagat

SEQ ID NO: 9119317 - DNA, 22 bp, Homo sapiens
ttaataaacaggtgcagctgaa

SEQ ID NO: 9119318 - DNA, 22 bp, Homo sapiens
ttaataaacaggtgcagctgaa

SEQ ID NO: 9119319 - DNA, 22 bp, Homo sapiens
ttaataaacaggtgcagctgaa

SEQ ID NO: 9119320 - DNA, 22 bp, Homo sapiens
ttaattactaagcacaatgcaa

SEQ ID NO: 9119321 - DNA, 22 bp, Homo sapiens
ttaattaattagttaagcatgt

SEQ ID NO: 9119322 - DNA, 22 bp, Homo sapiens
ttaattacaaaacacataggtt

SEQ ID NO: 9119323 - DNA, 22 bp, Homo sapiens
ttaacatttgtgaagcatttag

SEQ ID NO: 9119324 - DNA, 22 bp, Homo sapiens
ttaacattgtccttagcagatt

SEQ ID NO: 9119325 - DNA, 22 bp, Homo sapiens
ttaacattgtccttagcagatt

SEQ ID NO: 9119326 - DNA, 22 bp, Homo sapiens
ttaacattaaaagcagcatttt

SEQ ID NO: 9119327 - DNA, 22 bp, Homo sapiens
ttaacattgtccttagcagatt

SEQ ID NO: 9119328 - DNA, 22 bp, Homo sapiens
ttaacatgtcttgacttcatct

SEQ ID NO: 9119329 - DNA, 22 bp, Homo sapiens
ttaacatcctgtttaaatttgg

SEQ ID NO: 9119330 - DNA, 22 bp, Homo sapiens
ttaacatacatcatgaacaatg

SEQ ID NO: 9119331 - DNA, 22 bp, Homo sapiens
ttaacagttaaacaattggcta

SEQ ID NO: 9119332 - DNA, 22 bp, Homo sapiens
ttaacatacatcatgaacaatg

SEQ ID NO: 9119333 - DNA, 22 bp, Homo sapiens
ttaacactgattgtagagacac

SEQ ID NO: 9119334 - DNA, 22 bp, Homo sapiens
ttaacacttgaactctacatgt

SEQ ID NO: 9119335 - DNA, 22 bp, Homo sapiens
ttaacactatctgtcataatta

SEQ ID NO: 9119336 - DNA, 22 bp, Homo sapiens
ttaacactcctaactacagtct

SEQ ID NO: 9119337 - DNA, 22 bp, Homo sapiens
ttaacagacatatatatttgta

SEQ ID NO: 9119338 - DNA, 22 bp, Homo sapiens
ttaacacttgaactctacatgt

SEQ ID NO: 9119339 - DNA, 22 bp, Homo sapiens
ttaacagagaacatagaagtag

SEQ ID NO: 9119340 - DNA, 22 bp, Homo sapiens
ttaagacattcagatatttcta

SEQ ID NO: 9119341 - DNA, 22 bp, Homo sapiens
ttaagacatttttggagattat

SEQ ID NO: 9119342 - DNA, 21 bp, Homo sapiens
ttaagacacacagattaagga

SEQ ID NO: 9119343 - DNA, 22 bp, Homo sapiens
ttaagacagtgtatttgttttc

SEQ ID NO: 9119344 - DNA, 22 bp, Homo sapiens
ttaagaatggaatgaggaattt

SEQ ID NO: 9119345 - DNA, 22 bp, Homo sapiens
ttaagaatggaatgaggaattt

SEQ ID NO: 9119346 - DNA, 22 bp, Homo sapiens
ttaagaagtgagtagaagtaat

SEQ ID NO: 9119347 - DNA, 22 bp, Homo sapiens
ttaagaagtgattttcctcatt

SEQ ID NO: 9119348 - DNA, 20 bp, Homo sapiens
ttaagaaaagcacatcctgc

SEQ ID NO: 9119349 - DNA, 20 bp, Homo sapiens
ttaagaaaagcacatcctgc

SEQ ID NO: 9119350 - DNA, 22 bp, Homo sapiens
ttaagaagccacacacctcttt

SEQ ID NO: 9119351 - DNA, 20 bp, Homo sapiens
ttaagaaaagcacatcctgc

SEQ ID NO: 9119352 - DNA, 22 bp, Homo sapiens
ttaacttgtcagaaaatacagt

SEQ ID NO: 9119353 - DNA, 22 bp, Homo sapiens
ttaacttgtcagaaaatacagt

SEQ ID NO: 9119354 - DNA, 22 bp, Homo sapiens
ttaacttttatttctgctcgcc

SEQ ID NO: 9119355 - DNA, 22 bp, Homo sapiens
tgttttgtttatgagagcacag

SEQ ID NO: 9119356 - DNA, 19 bp, Homo sapiens
tgttttgttaaagcagtcc

SEQ ID NO: 9119357 - DNA, 22 bp, Homo sapiens
tgttttgtgcatttacaacatg

SEQ ID NO: 9119358 - DNA, 22 bp, Homo sapiens
tgttttctgatggttaatgagt

SEQ ID NO: 9119359 - DNA, 22 bp, Homo sapiens
tgttttctgatggttaatgagt

SEQ ID NO: 9119360 - DNA, 23 bp, Homo sapiens
tgttttcttgtcctggtataatt

SEQ ID NO: 9119361 - DNA, 23 bp, Homo sapiens
tgtttttcattcacatgggctgt

SEQ ID NO: 9119362 - DNA, 22 bp, Homo sapiens
ttaaagcatcacactattaatt

SEQ ID NO: 9119363 - DNA, 22 bp, Homo sapiens
tgtttttatctctgtgtacaac

SEQ ID NO: 9119364 - DNA, 22 bp, Homo sapiens
ttaaagcatgttgcttaacagg

SEQ ID NO: 9119365 - DNA, 22 bp, Homo sapiens
ttaaagcatcctgtcagtctgt

SEQ ID NO: 9119366 - DNA, 22 bp, Homo sapiens
ttaaagcccagcatatactagg

SEQ ID NO: 9119367 - DNA, 22 bp, Homo sapiens
ttaaatattatgttgtctgcaa

SEQ ID NO: 9119368 - DNA, 22 bp, Homo sapiens
ttaaatattatgttgtctgcaa

SEQ ID NO: 9119369 - DNA, 22 bp, Homo sapiens
ttaaatattatgttgtctgcaa

SEQ ID NO: 9119370 - DNA, 22 bp, Homo sapiens
ttaaatattttcagcagggtca

SEQ ID NO: 9119371 - DNA, 22 bp, Homo sapiens
ttaaatattttcagcagggtca

SEQ ID NO: 9119372 - DNA, 22 bp, Homo sapiens
ttaaatgatgcatatcatttag

SEQ ID NO: 9119373 - DNA, 22 bp, Homo sapiens
ttaaatgaggctgatgtagatt

SEQ ID NO: 9119374 - DNA, 22 bp, Homo sapiens
ttaaatgatgcatatcatttag

SEQ ID NO: 9119375 - DNA, 22 bp, Homo sapiens
ttaaatgagatgttcagatatt

SEQ ID NO: 9119376 - DNA, 22 bp, Homo sapiens
ttaaatgagatgttcagatatt

SEQ ID NO: 9119377 - DNA, 22 bp, Homo sapiens
ttaaatgagatgttcagatatt

SEQ ID NO: 9119378 - DNA, 22 bp, Homo sapiens
ttaaatgaggctgatgtagatt

SEQ ID NO: 9119379 - DNA, 22 bp, Homo sapiens
ttaaatgaggctgatgtagatt

SEQ ID NO: 9119380 - DNA, 22 bp, Homo sapiens
ttaaatgacttttattattctc

SEQ ID NO: 9119381 - DNA, 22 bp, Homo sapiens
ttaaatgacttttattattctc

SEQ ID NO: 9119382 - DNA, 22 bp, Homo sapiens
ttaaatgacttttattattctc

SEQ ID NO: 9119383 - DNA, 22 bp, Homo sapiens
ttaaatgagatgttcagatatt

SEQ ID NO: 9119384 - DNA, 22 bp, Homo sapiens
ttaaatgaacgagatatgcaac

SEQ ID NO: 9119385 - DNA, 22 bp, Homo sapiens
ttaaatgaacgagatatgcaac

SEQ ID NO: 9119386 - DNA, 22 bp, Homo sapiens
ttaaatcagtaggctactcctt

SEQ ID NO: 9119387 - DNA, 22 bp, Homo sapiens
ttaaatgaacgagatatgcaac

SEQ ID NO: 9119388 - DNA, 22 bp, Homo sapiens
ttaaatcaggcatcatttcagt

SEQ ID NO: 9119389 - DNA, 22 bp, Homo sapiens
ttaaatcaggcatcatttcagt

SEQ ID NO: 9119390 - DNA, 22 bp, Homo sapiens
ttaaattaggactctagttctg

SEQ ID NO: 9119391 - DNA, 22 bp, Homo sapiens
ttaaattagtcaagcttctctg

SEQ ID NO: 9119392 - DNA, 22 bp, Homo sapiens
ttaacaaaaatatcaggcatca

SEQ ID NO: 9119393 - DNA, 22 bp, Homo sapiens
ttaacacatatttatcaattgc

SEQ ID NO: 9119394 - DNA, 22 bp, Homo sapiens
ttaacacatatttatcaattgc

SEQ ID NO: 9119395 - DNA, 22 bp, Homo sapiens
ttaacaatcataggaccattta

SEQ ID NO: 9119396 - DNA, 22 bp, Homo sapiens
ttaacaatagagtttcttcagg

SEQ ID NO: 9119397 - DNA, 22 bp, Homo sapiens
ttaacacagggggagacaaagt

SEQ ID NO: 9119398 - DNA, 22 bp, Homo sapiens
ttaacacagggggagacaaagt

SEQ ID NO: 9119399 - DNA, 22 bp, Homo sapiens
ttaacaaagtaacgggaaaaga

SEQ ID NO: 9119400 - DNA, 22 bp, Homo sapiens
ttaacaatagagtttcttcagg

SEQ ID NO: 9119401 - DNA, 22 bp, Homo sapiens
tttgcagcttctggtggcctct

SEQ ID NO: 9119402 - DNA, 22 bp, Homo sapiens
tttgcagccacagtgccttgta

SEQ ID NO: 9119403 - DNA, 22 bp, Homo sapiens
tttgcagctaagcacagtaatt

SEQ ID NO: 9119404 - DNA, 22 bp, Homo sapiens
tttgcagcctccctggcagaag

SEQ ID NO: 9119405 - DNA, 22 bp, Homo sapiens
tttgcagaagaaaacatgaaca

SEQ ID NO: 9119406 - DNA, 22 bp, Homo sapiens
tttgcagcaaggagagagcatt

SEQ ID NO: 9119407 - DNA, 22 bp, Homo sapiens
tttgcagatgagaaaactgtgg

SEQ ID NO: 9119408 - DNA, 22 bp, Homo sapiens
tttgcagagtacctgaagagga

SEQ ID NO: 9119409 - DNA, 22 bp, Homo sapiens
tttgcagcaattcgttatacag

SEQ ID NO: 9119410 - DNA, 22 bp, Homo sapiens
tttgcagcaaggagagagcatt

SEQ ID NO: 9119411 - DNA, 22 bp, Homo sapiens
tttgcagaagaaaacatgaaca

SEQ ID NO: 9119412 - DNA, 22 bp, Homo sapiens
tttgcagaagaaaacatgaaca

SEQ ID NO: 9119413 - DNA, 22 bp, Homo sapiens
tttgcaaatgaagctctgagga

SEQ ID NO: 9119414 - DNA, 22 bp, Homo sapiens
tttgcaaatgaagctctgagga

SEQ ID NO: 9119415 - DNA, 22 bp, Homo sapiens
tttgcaaattagccaccctgtt

SEQ ID NO: 9119416 - DNA, 22 bp, Homo sapiens
tttgcaaattagccaccctgtt

SEQ ID NO: 9119417 - DNA, 22 bp, Homo sapiens
tttgcaaatgctctgcagagct

SEQ ID NO: 9119418 - DNA, 22 bp, Homo sapiens
tttgcaaatgctctgcagagct

SEQ ID NO: 9119419 - DNA, 23 bp, Homo sapiens
tttgcaaattggacacaaccaca

SEQ ID NO: 9119420 - DNA, 23 bp, Homo sapiens
tttgcaaattggacacaaccaca

SEQ ID NO: 9119421 - DNA, 22 bp, Homo sapiens
tttgcaaattcttgtctagcct

SEQ ID NO: 9119422 - DNA, 22 bp, Homo sapiens
tttgcaaattagccaccctgtt

SEQ ID NO: 9119423 - DNA, 22 bp, Homo sapiens
tttgcaaattcttgtctagcct

SEQ ID NO: 9119424 - DNA, 22 bp, Homo sapiens
tttgcaaatttcgtctcctcag

SEQ ID NO: 9119425 - DNA, 22 bp, Homo sapiens
tttgcaaatttcgtctcctcag

SEQ ID NO: 9119426 - DNA, 22 bp, Homo sapiens
tttgcaaatttcgtctcctcag

SEQ ID NO: 9119427 - DNA, 23 bp, Homo sapiens
tttgcaaattttcctgactactc

SEQ ID NO: 9119428 - DNA, 22 bp, Homo sapiens
tttgcaagaagaatggcacaaa

SEQ ID NO: 9119429 - DNA, 23 bp, Homo sapiens
tttgcaaattttcctgactactc

SEQ ID NO: 9119430 - DNA, 22 bp, Homo sapiens
tttgcaacagactcatcattga

SEQ ID NO: 9119431 - DNA, 22 bp, Homo sapiens
tttgcaagtatcaaacatgtca

SEQ ID NO: 9119432 - DNA, 22 bp, Homo sapiens
tttctttctcgtaaacttagtt

SEQ ID NO: 9119433 - DNA, 22 bp, Homo sapiens
tttgcaaataccatgaaacttg

SEQ ID NO: 9119434 - DNA, 22 bp, Homo sapiens
tttgcaaatatgtgtttctatt

SEQ ID NO: 9119435 - DNA, 22 bp, Homo sapiens
tttgcaaatatgtgtttctatt

SEQ ID NO: 9119436 - DNA, 22 bp, Homo sapiens
tttgcaaatacagaggtcttgc

SEQ ID NO: 9119437 - DNA, 22 bp, Homo sapiens
tttgcaaatacagaggtcttgc

SEQ ID NO: 9119438 - DNA, 22 bp, Homo sapiens
tttgcaaataccatgaaacttg

SEQ ID NO: 9119439 - DNA, 22 bp, Homo sapiens
tttgcaaataaataagtgctcg

SEQ ID NO: 9119440 - DNA, 22 bp, Homo sapiens
tttgcaaataaataagtgctcg

SEQ ID NO: 9119441 - DNA, 22 bp, Homo sapiens
tttgcaaataaataagtgctcg

SEQ ID NO: 9119442 - DNA, 22 bp, Homo sapiens
tttggcacattctgtcacattc

SEQ ID NO: 9119443 - DNA, 22 bp, Homo sapiens
tttggcaatttgactgtatagg

SEQ ID NO: 9119444 - DNA, 22 bp, Homo sapiens
tttggcactcacttatcattgg

SEQ ID NO: 9119445 - DNA, 22 bp, Homo sapiens
tttggcagagtcatttcagaaa

SEQ ID NO: 9119446 - DNA, 22 bp, Homo sapiens
tttggcagaggaagaaggcaca

SEQ ID NO: 9119447 - DNA, 22 bp, Homo sapiens
tttgtaatgataatgttaaatt

SEQ ID NO: 9119448 - DNA, 17 bp, Homo sapiens
tttgtacaacattttaa

SEQ ID NO: 9119449 - DNA, 17 bp, Homo sapiens
tttgtacaacattttaa

SEQ ID NO: 9119450 - DNA, 22 bp, Homo sapiens
tttgtacatcctaattctgagt

SEQ ID NO: 9119451 - DNA, 22 bp, Homo sapiens
tttgtacacaacctgtggtagt

SEQ ID NO: 9119452 - DNA, 22 bp, Homo sapiens
tttggcaaagatcaacatgtta

SEQ ID NO: 9119453 - DNA, 22 bp, Homo sapiens
tttggagttggagtggtttcta

SEQ ID NO: 9119454 - DNA, 22 bp, Homo sapiens
tttggagttgttatggttatat

SEQ ID NO: 9119455 - DNA, 22 bp, Homo sapiens
tttggatatgtttctgtcttct

SEQ ID NO: 9119456 - DNA, 20 bp, Homo sapiens
tttggagagaaagaagtagt

SEQ ID NO: 9119457 - DNA, 22 bp, Homo sapiens
tttggagaaatggctgatcaaa

SEQ ID NO: 9119458 - DNA, 22 bp, Homo sapiens
tttggagagatgaagttctgtg

SEQ ID NO: 9119459 - DNA, 22 bp, Homo sapiens
tttggagatagggcctagcaat

SEQ ID NO: 9119460 - DNA, 22 bp, Homo sapiens
tttggagtatggaggtgacaca

SEQ ID NO: 9119461 - DNA, 22 bp, Homo sapiens
tttggaagatagttcggcagtt

SEQ ID NO: 9119462 - DNA, 22 bp, Homo sapiens
tttggaagggaaagaaagtact

SEQ ID NO: 9119463 - DNA, 22 bp, Homo sapiens
tttggaagacagggcaggaaag

SEQ ID NO: 9119464 - DNA, 22 bp, Homo sapiens
tttggacaaatgtctgactttc

SEQ ID NO: 9119465 - DNA, 22 bp, Homo sapiens
tttggacaaatgtctgactttc

SEQ ID NO: 9119466 - DNA, 19 bp, Homo sapiens
tttggacagagtgtccagg

SEQ ID NO: 9119467 - DNA, 22 bp, Homo sapiens
tttggacatgttgagtctgata

SEQ ID NO: 9119468 - DNA, 22 bp, Homo sapiens
tttggacttagcctgcagaatt

SEQ ID NO: 9119469 - DNA, 22 bp, Homo sapiens
tttggactgcatgatgatctgg

SEQ ID NO: 9119470 - DNA, 22 bp, Homo sapiens
ttttatattgagtgagagttcc

SEQ ID NO: 9119471 - DNA, 20 bp, Homo sapiens
ttttatatgtagggtatatg

SEQ ID NO: 9119472 - DNA, 22 bp, Homo sapiens
ttttatatggcacattggttgg

SEQ ID NO: 9119473 - DNA, 22 bp, Homo sapiens
ttttatcaatcattaagacatt

SEQ ID NO: 9119474 - DNA, 22 bp, Homo sapiens
ttttatcaatcattaagacatt

SEQ ID NO: 9119475 - DNA, 22 bp, Homo sapiens
ttttatcaatcattaagacatt

SEQ ID NO: 9119476 - DNA, 22 bp, Homo sapiens
ttttagtttggatttctaaagc

SEQ ID NO: 9119477 - DNA, 22 bp, Homo sapiens
ttttagtttggatttctaaagc

SEQ ID NO: 9119478 - DNA, 22 bp, Homo sapiens
ttttagtttggatttctaaagc

SEQ ID NO: 9119479 - DNA, 22 bp, Homo sapiens
ttttatacttaagacagagttt

SEQ ID NO: 9119480 - DNA, 22 bp, Homo sapiens
ttttatacttaagacagagttt

SEQ ID NO: 9119481 - DNA, 22 bp, Homo sapiens
ttttatagctgaatagtattcc

SEQ ID NO: 9119482 - DNA, 22 bp, Homo sapiens
ttttatacacatgaacatgcag

SEQ ID NO: 9119483 - DNA, 22 bp, Homo sapiens
ttttatacacatgaacatgcag

SEQ ID NO: 9119484 - DNA, 22 bp, Homo sapiens
ttttataagcaagaaagggaaa

SEQ ID NO: 9119485 - DNA, 22 bp, Homo sapiens
ttttataagcaagaaagggaaa

SEQ ID NO: 9119486 - DNA, 22 bp, Homo sapiens
tttgtttgaaagtctctacagc

SEQ ID NO: 9119487 - DNA, 22 bp, Homo sapiens
tttgtttggcaacttggtaaag

SEQ ID NO: 9119488 - DNA, 22 bp, Homo sapiens
tttgttttcaatgtgtcattca

SEQ ID NO: 9119489 - DNA, 22 bp, Homo sapiens
tttgttttcaatgtgtcattca

SEQ ID NO: 9119490 - DNA, 22 bp, Homo sapiens
tttgtttagatggtaaatcagt

SEQ ID NO: 9119491 - DNA, 22 bp, Homo sapiens
tttgtttagatggtaaatcagt

SEQ ID NO: 9119492 - DNA, 22 bp, Homo sapiens
tttgtttagatggtaaatcagt

SEQ ID NO: 9119493 - DNA, 22 bp, Homo sapiens
tttgttttgaactagctcagaa

SEQ ID NO: 9119494 - DNA, 22 bp, Homo sapiens
tttgttttgaactagctcagaa

SEQ ID NO: 9119495 - DNA, 22 bp, Homo sapiens
tttgttttgaactagctcagaa

SEQ ID NO: 9119496 - DNA, 22 bp, Homo sapiens
tttgttttcaatgtgtcattca

SEQ ID NO: 9119497 - DNA, 22 bp, Homo sapiens
tttgttttcaatgtgtcattca

SEQ ID NO: 9119498 - DNA, 22 bp, Homo sapiens
tttgttttcaatgtgtcattca

SEQ ID NO: 9119499 - DNA, 22 bp, Homo sapiens
tttgtagattcattgaactttt

SEQ ID NO: 9119500 - DNA, 22 bp, Homo sapiens
tttgtataagaacattctagca

SEQ ID NO: 9119501 - DNA, 22 bp, Homo sapiens
tttgtactatggtttttcacta

SEQ ID NO: 9119502 - DNA, 18 bp, Homo sapiens
tttgtacccttttcctag

SEQ ID NO: 9119503 - DNA, 22 bp, Homo sapiens
tttgtactggaagaacatgcaa

SEQ ID NO: 9119504 - DNA, 22 bp, Homo sapiens
tttgtagaataatatctttctg

SEQ ID NO: 9119505 - DNA, 22 bp, Homo sapiens
tttgtttactcattcattgatg

SEQ ID NO: 9119506 - DNA, 22 bp, Homo sapiens
tttgttgtgaacagaataatat

SEQ ID NO: 9119507 - DNA, 22 bp, Homo sapiens
tttgttctgaagcaagtaggga

SEQ ID NO: 9119508 - DNA, 22 bp, Homo sapiens
tttgttgagttacagagatgaa

SEQ ID NO: 9119509 - DNA, 22 bp, Homo sapiens
tttgttgggagaaacattattt

SEQ ID NO: 9119510 - DNA, 18 bp, Homo sapiens
tttgttgggttgccttta

SEQ ID NO: 9119511 - DNA, 22 bp, Homo sapiens
tttgttcactgagcaatgatta

SEQ ID NO: 9119512 - DNA, 22 bp, Homo sapiens
tttgtatttttcccagctagct

SEQ ID NO: 9119513 - DNA, 22 bp, Homo sapiens
tttgtcaaagatcagatgcttt

SEQ ID NO: 9119514 - DNA, 20 bp, Homo sapiens
tttgtcaactgcatccagca

SEQ ID NO: 9119515 - DNA, 22 bp, Homo sapiens
tttgtcaagtttgcaaatacgt

SEQ ID NO: 9119516 - DNA, 22 bp, Homo sapiens
tttgtcaagtttgcaaatacgt

SEQ ID NO: 9119517 - DNA, 22 bp, Homo sapiens
tttgtcaatcccttgaaaacct

SEQ ID NO: 9119518 - DNA, 20 bp, Homo sapiens
ttttccttctgagtatgttg

SEQ ID NO: 9119519 - DNA, 19 bp, Homo sapiens
ttttccttctcctcttaat

SEQ ID NO: 9119520 - DNA, 22 bp, Homo sapiens
ttttatgagaatgcgccacttg

SEQ ID NO: 9119521 - DNA, 22 bp, Homo sapiens
ttttatgaagataattttctga

SEQ ID NO: 9119522 - DNA, 22 bp, Homo sapiens
ttttatctacctatgctcattt

SEQ ID NO: 9119523 - DNA, 22 bp, Homo sapiens
ttttccttctgatactccattt

SEQ ID NO: 9119524 - DNA, 20 bp, Homo sapiens
ttttccttctgagtatgttg

SEQ ID NO: 9119525 - DNA, 20 bp, Homo sapiens
ttttccttgttgccgctgct

SEQ ID NO: 9119526 - DNA, 22 bp, Homo sapiens
ttttccttctgatactccattt

SEQ ID NO: 9119527 - DNA, 22 bp, Homo sapiens
ttttcctttgattcccagatgt

SEQ ID NO: 9119528 - DNA, 22 bp, Homo sapiens
ttttcctttggaagatgcatat

SEQ ID NO: 9119529 - DNA, 22 bp, Homo sapiens
ttttcctttcatcaggacaaag

SEQ ID NO: 9119530 - DNA, 22 bp, Homo sapiens
ttttcctttgaaaggtgagggc

SEQ ID NO: 9119531 - DNA, 23 bp, Homo sapiens
ttttcctttggacaggctgtatt

SEQ ID NO: 9119532 - DNA, 22 bp, Homo sapiens
ttttcctttggaagatgcatat

SEQ ID NO: 9119533 - DNA, 22 bp, Homo sapiens
ttttctaaaagaagtcactgat

SEQ ID NO: 9119534 - DNA, 22 bp, Homo sapiens
ttttctaaaagaagtcactgat

SEQ ID NO: 9119535 - DNA, 22 bp, Homo sapiens
ttttctaacatctagtaatttg

SEQ ID NO: 9119536 - DNA, 22 bp, Homo sapiens
ttttctaactttacactcgaaa

SEQ ID NO: 9119537 - DNA, 22 bp, Homo sapiens
ttttctaacatctagtaatttg

SEQ ID NO: 9119538 - DNA, 22 bp, Homo sapiens
ttttctaacatctagtaatttg

SEQ ID NO: 9119539 - DNA, 22 bp, Homo sapiens
ttttctaacatctagtaatttg

SEQ ID NO: 9119540 - DNA, 22 bp, Homo sapiens
ttttctaacatctagtaatttg

SEQ ID NO: 9119541 - DNA, 22 bp, Homo sapiens
ttttctaaaatatccaggacag

SEQ ID NO: 9119542 - DNA, 22 bp, Homo sapiens
ttttctaaaatatccaggacag

SEQ ID NO: 9119543 - DNA, 22 bp, Homo sapiens
ttttctaaaagaagtcactgat

SEQ ID NO: 9119544 - DNA, 22 bp, Homo sapiens
ttttcttctacctgctgtccaa

SEQ ID NO: 9119545 - DNA, 22 bp, Homo sapiens
ttttgaaagagtcctgctacag

SEQ ID NO: 9119546 - DNA, 22 bp, Homo sapiens
ttttctaactttacactcgaaa

SEQ ID NO: 9119547 - DNA, 22 bp, Homo sapiens
ttttctaactttacactcgaaa

SEQ ID NO: 9119548 - DNA, 22 bp, Homo sapiens
ttttctaatttagttaccctcc

SEQ ID NO: 9119549 - DNA, 22 bp, Homo sapiens
ttttctaagggaaacgtcctcc

SEQ ID NO: 9119550 - DNA, 22 bp, Homo sapiens
ttttctaatttagttaccctcc

SEQ ID NO: 9119551 - DNA, 22 bp, Homo sapiens
ttttctattaactcattttgca

SEQ ID NO: 9119552 - DNA, 22 bp, Homo sapiens
ttttgcagaatgggaaggtagt

SEQ ID NO: 9119553 - DNA, 20 bp, Homo sapiens
ttttgcagagaaggcgactg

SEQ ID NO: 9119554 - DNA, 22 bp, Homo sapiens
ttttgcaatgagatgcttgtca

SEQ ID NO: 9119555 - DNA, 22 bp, Homo sapiens
ttttgcaatatgttcctgaata

SEQ ID NO: 9119556 - DNA, 23 bp, Homo sapiens
ttttgcaataagtcactggaata

SEQ ID NO: 9119557 - DNA, 22 bp, Homo sapiens
ttttgcaaagtacattatcagg

SEQ ID NO: 9119558 - DNA, 22 bp, Homo sapiens
ttttggatgagcccagatttct

SEQ ID NO: 9119559 - DNA, 22 bp, Homo sapiens
ttttggaatctgggaaaacagt

SEQ ID NO: 9119560 - DNA, 22 bp, Homo sapiens
ttttggcaaagagatagcatga

SEQ ID NO: 9119561 - DNA, 22 bp, Homo sapiens
ttttgatatcatgatgaacaga

SEQ ID NO: 9119562 - DNA, 22 bp, Homo sapiens
ttttgacaatgctaatctcaat

SEQ ID NO: 9119563 - DNA, 22 bp, Homo sapiens
ttttgacaatgctaatctcaat

SEQ ID NO: 9119564 - DNA, 22 bp, Homo sapiens
ttttgaaagggtgatttggctt

SEQ ID NO: 9119565 - DNA, 22 bp, Homo sapiens
ttttgaaagccaggtttgtatg

SEQ ID NO: 9119566 - DNA, 22 bp, Homo sapiens
ttttggcagattacttaatatg

SEQ ID NO: 9119567 - DNA, 22 bp, Homo sapiens
ttttggcagattacttaatatg

SEQ ID NO: 9119568 - DNA, 22 bp, Homo sapiens
ttttggcactgcgtctacatgg

SEQ ID NO: 9119569 - DNA, 22 bp, Homo sapiens
ttttggcactgcgtctacatgg

SEQ ID NO: 9119570 - DNA, 22 bp, Homo sapiens
ttttggcagccacatgcacttg

SEQ ID NO: 9119571 - DNA, 22 bp, Homo sapiens
ttttggctctgcaggtttgcac

SEQ ID NO: 9119572 - DNA, 22 bp, Homo sapiens
ttttggctacaaagagcctagt

SEQ ID NO: 9119573 - DNA, 22 bp, Homo sapiens
ttttggctccagtggtttgtgc

SEQ ID NO: 9119574 - DNA, 22 bp, Homo sapiens
tttttcctagcgatttgtcagc

SEQ ID NO: 9119575 - DNA, 22 bp, Homo sapiens
tttttcctagtgctttctggta

SEQ ID NO: 9119576 - DNA, 22 bp, Homo sapiens
tttttcctagcgatttgtcagc

SEQ ID NO: 9119577 - DNA, 22 bp, Homo sapiens
tttttccttaggggttactcac

SEQ ID NO: 9119578 - DNA, 22 bp, Homo sapiens
tttttcctagtgctttctggta

SEQ ID NO: 9119579 - DNA, 22 bp, Homo sapiens
tttttcctaagcagtggagctg

SEQ ID NO: 9119580 - DNA, 22 bp, Homo sapiens
tttttgaaggctgatgtgatta

SEQ ID NO: 9119581 - DNA, 22 bp, Homo sapiens
tttttgaaggctgatgtgatta

SEQ ID NO: 9119582 - DNA, 22 bp, Homo sapiens
tttttccttggatgtgtctctc

SEQ ID NO: 9119583 - DNA, 20 bp, Homo sapiens
tttttccttctctacaggca

SEQ ID NO: 9119584 - DNA, 22 bp, Homo sapiens
tttttctaatggcttaggatgt

SEQ ID NO: 9119585 - DNA, 22 bp, Homo sapiens
tttttctactgcccacattgta

SEQ ID NO: 9119586 - DNA, 22 bp, Homo sapiens
tttttggcagctcagaaacttc

SEQ ID NO: 9119587 - DNA, 22 bp, Homo sapiens
tttttggcccttagctctgtat

SEQ ID NO: 9119588 - DNA, 22 bp, Homo sapiens
tttttgggtccaggctgtatct

SEQ ID NO: 9119589 - DNA, 22 bp, Homo sapiens
ttttttgtcttgaagaaatggt

SEQ ID NO: 9119590 - DNA, 22 bp, Homo sapiens
ttttttgtcttgaagaaatggt

SEQ ID NO: 9119591 - DNA, 22 bp, Homo sapiens
ttttttgtcttgaagaaatggt

SEQ ID NO: 9119592 - DNA, 22 bp, Homo sapiens
tttttgtagtcattagaagagg

SEQ ID NO: 9119593 - DNA, 22 bp, Homo sapiens
ttttttgtcccagagagcctgg

SEQ ID NO: 9119594 - DNA, 23 bp, Homo sapiens
ttttttgtcttgctaggctgccc

SEQ ID NO: 9119595 - DNA, 21 bp, Homo sapiens
ttgtgtttccccagtcacttt

SEQ ID NO: 9119596 - DNA, 22 bp, Homo sapiens
ttgtgtttctggccaagatgga

SEQ ID NO: 9119597 - DNA, 22 bp, Homo sapiens
ttgtgtttctggccaagatgga

SEQ ID NO: 9119598 - DNA, 22 bp, Homo sapiens
ttgtgtgtgtaactttatgaga

SEQ ID NO: 9119599 - DNA, 22 bp, Homo sapiens
ttgtgtgtgtaactttatgaga

SEQ ID NO: 9119600 - DNA, 22 bp, Homo sapiens
ttgtgtgtttgtagaaaatcca

SEQ ID NO: 9119601 - DNA, 22 bp, Homo sapiens
ttgtgtgtttgtagaaaatcca

SEQ ID NO: 9119602 - DNA, 22 bp, Homo sapiens
ttgtgttaaggtgcatctagtg

SEQ ID NO: 9119603 - DNA, 19 bp, Homo sapiens
ttgtgtgtcagtcagagtt

SEQ ID NO: 9119604 - DNA, 19 bp, Homo sapiens
ttgtgtgtcagtcagagtt

SEQ ID NO: 9119605 - DNA, 22 bp, Homo sapiens
ttgtgaatggtgccgcaataaa

SEQ ID NO: 9119606 - DNA, 22 bp, Homo sapiens
ttgtgaatggtgccgcaataaa

SEQ ID NO: 9119607 - DNA, 22 bp, Homo sapiens
ttgtgtgtgagccttcaccaca

SEQ ID NO: 9119608 - DNA, 22 bp, Homo sapiens
ttgtgtgtgagccttcaccaca

SEQ ID NO: 9119609 - DNA, 22 bp, Homo sapiens
ttgtgtgtcttcttcactgccc

SEQ ID NO: 9119610 - DNA, 22 bp, Homo sapiens
ttgtgtgtcttcttcactgccc

SEQ ID NO: 9119611 - DNA, 22 bp, Homo sapiens
ttgttacagcagcaatagaaaa

SEQ ID NO: 9119612 - DNA, 22 bp, Homo sapiens
ttgttacagcagcaatagaaaa

SEQ ID NO: 9119613 - DNA, 22 bp, Homo sapiens
ttgttacagcagtgatttcaga

SEQ ID NO: 9119614 - DNA, 20 bp, Homo sapiens
ttgttagaggaatgccatag

SEQ ID NO: 9119615 - DNA, 20 bp, Homo sapiens
ttgttagaggaatgccatag

SEQ ID NO: 9119616 - DNA, 22 bp, Homo sapiens
ttgttacatacagcagaacata

SEQ ID NO: 9119617 - DNA, 20 bp, Homo sapiens
ttgtttaaaggtgaagaggc

SEQ ID NO: 9119618 - DNA, 22 bp, Homo sapiens
ttgtttccattgcagactgtgt

SEQ ID NO: 9119619 - DNA, 21 bp, Homo sapiens
ttgtttcccagagctcgctcc

SEQ ID NO: 9119620 - DNA, 22 bp, Homo sapiens
ttgtttccattgcagactgtgt

SEQ ID NO: 9119621 - DNA, 22 bp, Homo sapiens
ttgtttaaaatgtagcaagaaa

SEQ ID NO: 9119622 - DNA, 22 bp, Homo sapiens
ttgtttaaaatgtagcaagaaa

SEQ ID NO: 9119623 - DNA, 22 bp, Homo sapiens
ttgttttatctttctacagact

SEQ ID NO: 9119624 - DNA, 18 bp, Homo sapiens
ttgttttaagactctgtc

SEQ ID NO: 9119625 - DNA, 22 bp, Homo sapiens
ttgttttaacgactcagcttgt

SEQ ID NO: 9119626 - DNA, 22 bp, Homo sapiens
ttgttttaacctagtgtttatg

SEQ ID NO: 9119627 - DNA, 22 bp, Homo sapiens
ttgtttttaaacatgtgactga

SEQ ID NO: 9119628 - DNA, 22 bp, Homo sapiens
ttgtttttaaacatgtgactga

SEQ ID NO: 9119629 - DNA, 22 bp, Homo sapiens
ttgttttggagatgagctaaaa

SEQ ID NO: 9119630 - DNA, 22 bp, Homo sapiens
ttgttttggaagaacttactct

SEQ ID NO: 9119631 - DNA, 22 bp, Homo sapiens
ttgttttgctaaagggtcatca

SEQ ID NO: 9119632 - DNA, 22 bp, Homo sapiens
ttgttttctccactgcatctta

SEQ ID NO: 9119633 - DNA, 22 bp, Homo sapiens
ttgtttgtatgctgagaagaat

SEQ ID NO: 9119634 - DNA, 22 bp, Homo sapiens
ttgtttgtaaggctcttagaat

SEQ ID NO: 9119635 - DNA, 22 bp, Homo sapiens
ttgtttggaacttggtgccacc

SEQ ID NO: 9119636 - DNA, 22 bp, Homo sapiens
ttgtttgaggtcactgatattt

SEQ ID NO: 9119637 - DNA, 23 bp, Homo sapiens
ttgtttctttgtattgtctctat

SEQ ID NO: 9119638 - DNA, 23 bp, Homo sapiens
ttgtttctttgtattgtctctat

SEQ ID NO: 9119639 - DNA, 17 bp, Homo sapiens
ttgtttcttctctgtgg

SEQ ID NO: 9119640 - DNA, 22 bp, Homo sapiens
ttgtttcttcatttagaagctt

SEQ ID NO: 9119641 - DNA, 22 bp, Homo sapiens
ttgtttctctggtcttgagtga

SEQ ID NO: 9119642 - DNA, 22 bp, Homo sapiens
ttgtttctgagttttcatgtat

SEQ ID NO: 9119643 - DNA, 20 bp, Homo sapiens
ttgtttctgctattttctaa

SEQ ID NO: 9119644 - DNA, 21 bp, Homo sapiens
ttgtttcctcccaaaatgcca

SEQ ID NO: 9119645 - DNA, 22 bp, Homo sapiens
ttgtttcctttctatacaggat

SEQ ID NO: 9119646 - DNA, 22 bp, Homo sapiens
ttgtttctcctggtgcctgata

SEQ ID NO: 9119647 - DNA, 22 bp, Homo sapiens
ttgcaaggagccactctgcctg

SEQ ID NO: 9119648 - DNA, 22 bp, Homo sapiens
ttgcaactcttgaaaagcattg

SEQ ID NO: 9119649 - DNA, 22 bp, Homo sapiens
ttgcaattaacatatgtcaact

SEQ ID NO: 9119650 - DNA, 22 bp, Homo sapiens
ttgcaagttaaaaattattagt

SEQ ID NO: 9119651 - DNA, 22 bp, Homo sapiens
ttgcaagttccttatgagaatc

SEQ ID NO: 9119652 - DNA, 20 bp, Homo sapiens
ttgcaataaatgaaagacca

SEQ ID NO: 9119653 - DNA, 22 bp, Homo sapiens
ttgcaatagccttatttccaaa

SEQ ID NO: 9119654 - DNA, 22 bp, Homo sapiens
ttgcaagttccttatgagaatc

SEQ ID NO: 9119655 - DNA, 22 bp, Homo sapiens
ttgcaaggtttctctctgccta

SEQ ID NO: 9119656 - DNA, 22 bp, Homo sapiens
ttgcaacattgtaagtttatat

SEQ ID NO: 9119657 - DNA, 22 bp, Homo sapiens
ttgcaactaaaagaacttgaca

SEQ ID NO: 9119658 - DNA, 22 bp, Homo sapiens
ttgcaacattgtaagtttatat

SEQ ID NO: 9119659 - DNA, 22 bp, Homo sapiens
ttgcaacacaaagtttgattcc

SEQ ID NO: 9119660 - DNA, 21 bp, Homo sapiens
ttgcaacaacctatatatttt

SEQ ID NO: 9119661 - DNA, 23 bp, Homo sapiens
ttgcaaatttcagttagttcatg

SEQ ID NO: 9119662 - DNA, 23 bp, Homo sapiens
ttgcaaatttcagttagttcatg

SEQ ID NO: 9119663 - DNA, 23 bp, Homo sapiens
ttgcaaatttcagttagttcatg

SEQ ID NO: 9119664 - DNA, 22 bp, Homo sapiens
ttgcaaattgcaagagttggat

SEQ ID NO: 9119665 - DNA, 22 bp, Homo sapiens
ttgcaaattccaatccaatatt

SEQ ID NO: 9119666 - DNA, 22 bp, Homo sapiens
ttgcaaattccaatccaatatt

SEQ ID NO: 9119667 - DNA, 22 bp, Homo sapiens
ttgcaaattcgtcactgttaaa

SEQ ID NO: 9119668 - DNA, 18 bp, Homo sapiens
ttgcaaattcttccctgt

SEQ ID NO: 9119669 - DNA, 22 bp, Homo sapiens
ttgcaaattgcaagagttggat

SEQ ID NO: 9119670 - DNA, 18 bp, Homo sapiens
ttgcaaattcttccctgt

SEQ ID NO: 9119671 - DNA, 22 bp, Homo sapiens
ttgcaaattcatggatctgaat

SEQ ID NO: 9119672 - DNA, 22 bp, Homo sapiens
ttgcaaattcatggatctgaat

SEQ ID NO: 9119673 - DNA, 22 bp, Homo sapiens
ttgcaaattattttagtccctt

SEQ ID NO: 9119674 - DNA, 22 bp, Homo sapiens
ttgcaaattattttagtccctt

SEQ ID NO: 9119675 - DNA, 22 bp, Homo sapiens
ttgcaaattatataagggatgc

SEQ ID NO: 9119676 - DNA, 22 bp, Homo sapiens
ttggtggagtcattggcatatg

SEQ ID NO: 9119677 - DNA, 22 bp, Homo sapiens
ttggtggacctcatcagaaccg

SEQ ID NO: 9119678 - DNA, 22 bp, Homo sapiens
ttggtgagtatggacacagaga

SEQ ID NO: 9119679 - DNA, 22 bp, Homo sapiens
ttggtgcaaattcctgtaagag

SEQ ID NO: 9119680 - DNA, 19 bp, Homo sapiens
ttggttacaactgagcttc

SEQ ID NO: 9119681 - DNA, 22 bp, Homo sapiens
ttggttaaaatcaaattaatca

SEQ ID NO: 9119682 - DNA, 22 bp, Homo sapiens
ttggttacacagactggtgctt

SEQ ID NO: 9119683 - DNA, 22 bp, Homo sapiens
ttggttacagactcttctctaa

SEQ ID NO: 9119684 - DNA, 22 bp, Homo sapiens
ttggttacaagtttgctctgcc

SEQ ID NO: 9119685 - DNA, 22 bp, Homo sapiens
ttggtcatattaattcaatcgg

SEQ ID NO: 9119686 - DNA, 22 bp, Homo sapiens
ttggtcatgcataatgtatctg

SEQ ID NO: 9119687 - DNA, 22 bp, Homo sapiens
ttggtcatatgttactccaggg

SEQ ID NO: 9119688 - DNA, 22 bp, Homo sapiens
ttggtttgttcaccatcaagca

SEQ ID NO: 9119689 - DNA, 22 bp, Homo sapiens
ttggttttatcttaagattctt

SEQ ID NO: 9119690 - DNA, 22 bp, Homo sapiens
ttggtttagagagtgtggttac

SEQ ID NO: 9119691 - DNA, 22 bp, Homo sapiens
ttggtttactaggattcaaatt

SEQ ID NO: 9119692 - DNA, 22 bp, Homo sapiens
ttggttccttctgaaagtattg

SEQ ID NO: 9119693 - DNA, 22 bp, Homo sapiens
ttggttatgcaatttctttgct

SEQ ID NO: 9119694 - DNA, 22 bp, Homo sapiens
ttggttacttttaaacttgtct

SEQ ID NO: 9119695 - DNA, 22 bp, Homo sapiens
ttggttacttcagtggagaaag

SEQ ID NO: 9119696 - DNA, 22 bp, Homo sapiens
ttggttactaaaaactgtttgg

SEQ ID NO: 9119697 - DNA, 22 bp, Homo sapiens
ttggttacttaagttggtgcga

SEQ ID NO: 9119698 - DNA, 23 bp, Homo sapiens
ttggttactggatttgaggggcc

SEQ ID NO: 9119699 - DNA, 22 bp, Homo sapiens
ttggttaccttcagaaatgagt

SEQ ID NO: 9119700 - DNA, 22 bp, Homo sapiens
ttggttacacttaatttttcca

SEQ ID NO: 9119701 - DNA, 22 bp, Homo sapiens
ttgtccttgtgatagtttgctg

SEQ ID NO: 9119702 - DNA, 22 bp, Homo sapiens
ttggttttgaaatagcttattg

SEQ ID NO: 9119703 - DNA, 22 bp, Homo sapiens
ttggttttgggatgtacaaagg

SEQ ID NO: 9119704 - DNA, 23 bp, Homo sapiens
ttgtccttctgaaatatatctgg

SEQ ID NO: 9119705 - DNA, 22 bp, Homo sapiens
ttgtgaatagtgctgcaataaa

SEQ ID NO: 9119706 - DNA, 22 bp, Homo sapiens
ttgtgaatagtgccgctataaa

SEQ ID NO: 9119707 - DNA, 22 bp, Homo sapiens
ttgtgaatagtgccgctataaa

SEQ ID NO: 9119708 - DNA, 22 bp, Homo sapiens
ttgtgaatagtgccgcaataaa

SEQ ID NO: 9119709 - DNA, 22 bp, Homo sapiens
ttgtgaatagtgccgcaataaa

SEQ ID NO: 9119710 - DNA, 22 bp, Homo sapiens
ttgtgaagtgttctgagacagg

SEQ ID NO: 9119711 - DNA, 22 bp, Homo sapiens
ttgtgaagtgttctgagacagg

SEQ ID NO: 9119712 - DNA, 22 bp, Homo sapiens
ttgtgaaatgtttcaaaatagt

SEQ ID NO: 9119713 - DNA, 22 bp, Homo sapiens
ttgtgaaatgtttcaaaatagt

SEQ ID NO: 9119714 - DNA, 22 bp, Homo sapiens
ttgtgaaatgtttcaaaatagt

SEQ ID NO: 9119715 - DNA, 22 bp, Homo sapiens
ttgtgaaatcgtgtttggaagc

SEQ ID NO: 9119716 - DNA, 22 bp, Homo sapiens
ttgtctgctcctcccagcctca

SEQ ID NO: 9119717 - DNA, 22 bp, Homo sapiens
ttgtctgctcctcccagcctca

SEQ ID NO: 9119718 - DNA, 22 bp, Homo sapiens
ttgtctgcattgtttctatggg

SEQ ID NO: 9119719 - DNA, 22 bp, Homo sapiens
ttgtctgcttgttcagatggaa

SEQ ID NO: 9119720 - DNA, 22 bp, Homo sapiens
ttgtctgcttgatgccaagcat

SEQ ID NO: 9119721 - DNA, 22 bp, Homo sapiens
ttgtctgcttgttcagatggaa

SEQ ID NO: 9119722 - DNA, 22 bp, Homo sapiens
ttgtctgaatctggagctctct

SEQ ID NO: 9119723 - DNA, 22 bp, Homo sapiens
ttgtctgaatatgtatgtatcc

SEQ ID NO: 9119724 - DNA, 22 bp, Homo sapiens
ttgtctgaattcttctaggcag

SEQ ID NO: 9119725 - DNA, 22 bp, Homo sapiens
ttgtctgacttctttagttact

SEQ ID NO: 9119726 - DNA, 22 bp, Homo sapiens
ttgtctgaatctggagctctct

SEQ ID NO: 9119727 - DNA, 22 bp, Homo sapiens
ttgtctgatgttccctcatgat

SEQ ID NO: 9119728 - DNA, 22 bp, Homo sapiens
ttgtctgcatgattctaggcag

SEQ ID NO: 9119729 - DNA, 22 bp, Homo sapiens
ttgtctgagaaagtgagttgct

SEQ ID NO: 9119730 - DNA, 22 bp, Homo sapiens
ttgtctgacttctttagttact

SEQ ID NO: 9119731 - DNA, 22 bp, Homo sapiens
ttgtctgagggtttgagagaat

SEQ ID NO: 9119732 - DNA, 22 bp, Homo sapiens
ttgtctgagagatggcagaggt

SEQ ID NO: 9119733 - DNA, 22 bp, Homo sapiens
ttgtctgaagtcacacagatgc

SEQ ID NO: 9119734 - DNA, 22 bp, Homo sapiens
ttgtctgaaccatctccctggc

SEQ ID NO: 9119735 - DNA, 22 bp, Homo sapiens
ttgtctctggaaggaaaaagca

SEQ ID NO: 9119736 - DNA, 22 bp, Homo sapiens
ttgtctctgggacatggtatta

SEQ ID NO: 9119737 - DNA, 22 bp, Homo sapiens
ttgtctctaagtgtgatcttca

SEQ ID NO: 9119738 - DNA, 21 bp, Homo sapiens
tttattaacaactgtggacgt

SEQ ID NO: 9119739 - DNA, 22 bp, Homo sapiens
tttatgtttgcattttcaaaga

SEQ ID NO: 9119740 - DNA, 22 bp, Homo sapiens
tttattaatgtagcatccatgg

SEQ ID NO: 9119741 - DNA, 22 bp, Homo sapiens
tttattaatgtagcatccatgg

SEQ ID NO: 9119742 - DNA, 22 bp, Homo sapiens
tttattaagatgcgaatgctga

SEQ ID NO: 9119743 - DNA, 22 bp, Homo sapiens
tttattaagatgcgaatgctga

SEQ ID NO: 9119744 - DNA, 22 bp, Homo sapiens
tttatagggtagctaggattga

SEQ ID NO: 9119745 - DNA, 22 bp, Homo sapiens
tttatagtagcatgatttataa

SEQ ID NO: 9119746 - DNA, 22 bp, Homo sapiens
tttatagtagcatgatttatag

SEQ ID NO: 9119747 - DNA, 23 bp, Homo sapiens
tttatagcagcatgatttataat

SEQ ID NO: 9119748 - DNA, 23 bp, Homo sapiens
tttatagcagcatgatttatagt

SEQ ID NO: 9119749 - DNA, 22 bp, Homo sapiens
tttatataacagagactgctat

SEQ ID NO: 9119750 - DNA, 22 bp, Homo sapiens
tttatataacagagactgctat

SEQ ID NO: 9119751 - DNA, 20 bp, Homo sapiens
tttatagtgatcaatttata

SEQ ID NO: 9119752 - DNA, 22 bp, Homo sapiens
tttatagttatatacagatgtt

SEQ ID NO: 9119753 - DNA, 20 bp, Homo sapiens
tttatagtgatcaatttata

SEQ ID NO: 9119754 - DNA, 22 bp, Homo sapiens
tttatagttatatacagatgtt

SEQ ID NO: 9119755 - DNA, 22 bp, Homo sapiens
tttataattatctctactctta

SEQ ID NO: 9119756 - DNA, 17 bp, Homo sapiens
tttataattggcctctt

SEQ ID NO: 9119757 - DNA, 23 bp, Homo sapiens
tttatacaagaaaccgctggcct

SEQ ID NO: 9119758 - DNA, 22 bp, Homo sapiens
tttataattatctctactctta

SEQ ID NO: 9119759 - DNA, 22 bp, Homo sapiens
tttatacatggagaatttttgc

SEQ ID NO: 9119760 - DNA, 22 bp, Homo sapiens
tttatacatggagaatttttgc

SEQ ID NO: 9119761 - DNA, 22 bp, Homo sapiens
tttatacctcattcttagcaaa

SEQ ID NO: 9119762 - DNA, 22 bp, Homo sapiens
tttatagatgtctgtattataa

SEQ ID NO: 9119763 - DNA, 22 bp, Homo sapiens
tttatacttcataatgtctatt

SEQ ID NO: 9119764 - DNA, 22 bp, Homo sapiens
tttatacttcataatgtctatt

SEQ ID NO: 9119765 - DNA, 22 bp, Homo sapiens
tttatacttcataatgtctatt

SEQ ID NO: 9119766 - DNA, 22 bp, Homo sapiens
tttataaaatagactgggtcta

SEQ ID NO: 9119767 - DNA, 22 bp, Homo sapiens
tttataaacagtaccacggtgc

SEQ ID NO: 9119768 - DNA, 22 bp, Homo sapiens
tttagttttaactgaaagctat

SEQ ID NO: 9119769 - DNA, 22 bp, Homo sapiens
tttattaatgtagcatccatgg

SEQ ID NO: 9119770 - DNA, 22 bp, Homo sapiens
tttattagattatcaaagaggt

SEQ ID NO: 9119771 - DNA, 22 bp, Homo sapiens
tttattagattatcaaagaggt

SEQ ID NO: 9119772 - DNA, 22 bp, Homo sapiens
tttattagtgcttgtatcactg

SEQ ID NO: 9119773 - DNA, 22 bp, Homo sapiens
tttattatccagtgttgtcatg

SEQ ID NO: 9119774 - DNA, 22 bp, Homo sapiens
tttattatgatggacaccttcg

SEQ ID NO: 9119775 - DNA, 22 bp, Homo sapiens
tttcaaaattttgcagtggtaa

SEQ ID NO: 9119776 - DNA, 22 bp, Homo sapiens
tttcaaacatagatctgaatat

SEQ ID NO: 9119777 - DNA, 22 bp, Homo sapiens
tttcaaaattttgcagtggtaa

SEQ ID NO: 9119778 - DNA, 22 bp, Homo sapiens
tttcaaactgtactttccccta

SEQ ID NO: 9119779 - DNA, 22 bp, Homo sapiens
tttcaaactgggagtgagggga

SEQ ID NO: 9119780 - DNA, 22 bp, Homo sapiens
tttcaaactgcccagcacacct

SEQ ID NO: 9119781 - DNA, 22 bp, Homo sapiens
tttcaaacttaaatacctttcc

SEQ ID NO: 9119782 - DNA, 20 bp, Homo sapiens
tttcaaactgcacctttgct

SEQ ID NO: 9119783 - DNA, 22 bp, Homo sapiens
tttcaaactccagctcaccaat

SEQ ID NO: 9119784 - DNA, 22 bp, Homo sapiens
tttcaaaccactgaggttctga

SEQ ID NO: 9119785 - DNA, 22 bp, Homo sapiens
tttcaaacattcctgggagact

SEQ ID NO: 9119786 - DNA, 22 bp, Homo sapiens
tttcaaacatatcttcattact

SEQ ID NO: 9119787 - DNA, 22 bp, Homo sapiens
tttcaaacatatcttcattact

SEQ ID NO: 9119788 - DNA, 22 bp, Homo sapiens
tttcaaactatgtgtcaggcag

SEQ ID NO: 9119789 - DNA, 22 bp, Homo sapiens
tttcaaacctacttgtatgttt

SEQ ID NO: 9119790 - DNA, 22 bp, Homo sapiens
tttatttggcatccagggagaa

SEQ ID NO: 9119791 - DNA, 22 bp, Homo sapiens
tttatttggcatctctgccaag

SEQ ID NO: 9119792 - DNA, 19 bp, Homo sapiens
tttatttgagacatgcctt

SEQ ID NO: 9119793 - DNA, 22 bp, Homo sapiens
tttattattctgttctctctac

SEQ ID NO: 9119794 - DNA, 22 bp, Homo sapiens
tttaattagcaagccagagagc

SEQ ID NO: 9119795 - DNA, 22 bp, Homo sapiens
tttaatttgaaatgagtaaccc

SEQ ID NO: 9119796 - DNA, 22 bp, Homo sapiens
tttaatttgaaatgagtaaccc

SEQ ID NO: 9119797 - DNA, 22 bp, Homo sapiens
tttaatttgaaatgagtaaccc

SEQ ID NO: 9119798 - DNA, 22 bp, Homo sapiens
tttaattgcatttaaagatgga

SEQ ID NO: 9119799 - DNA, 22 bp, Homo sapiens
tttaattttcctcttcctggag

SEQ ID NO: 9119800 - DNA, 22 bp, Homo sapiens
tttaattttctgggcccagcag

SEQ ID NO: 9119801 - DNA, 22 bp, Homo sapiens
tttacaacccaagtccagagag

SEQ ID NO: 9119802 - DNA, 22 bp, Homo sapiens
tttacaacccaagtccagagag

SEQ ID NO: 9119803 - DNA, 22 bp, Homo sapiens
tttacaacataggccccaagaa

SEQ ID NO: 9119804 - DNA, 22 bp, Homo sapiens
tttaattttcctggtaggcctg

SEQ ID NO: 9119805 - DNA, 22 bp, Homo sapiens
tttaatttgtatttctagaggg

SEQ ID NO: 9119806 - DNA, 21 bp, Homo sapiens
tttaatttgcatgtatgacgc

SEQ ID NO: 9119807 - DNA, 21 bp, Homo sapiens
tttaatttgcatgtatgacgc

SEQ ID NO: 9119808 - DNA, 23 bp, Homo sapiens
ttgtttttagaggtggcatgaga

SEQ ID NO: 9119809 - DNA, 23 bp, Homo sapiens
ttgtttttagaggtggcatgaga

SEQ ID NO: 9119810 - DNA, 22 bp, Homo sapiens
ttgtttttatgaacatccagga

SEQ ID NO: 9119811 - DNA, 22 bp, Homo sapiens
tttaaaagttatcatctgtcca

SEQ ID NO: 9119812 - DNA, 23 bp, Homo sapiens
tttaaaagttgtaatgtaggctt

SEQ ID NO: 9119813 - DNA, 22 bp, Homo sapiens
tttaaacaaataggattgccta

SEQ ID NO: 9119814 - DNA, 22 bp, Homo sapiens
tttaccatataagaaaggcatg

SEQ ID NO: 9119815 - DNA, 22 bp, Homo sapiens
tttaccatctgccacagatatg

SEQ ID NO: 9119816 - DNA, 22 bp, Homo sapiens
tttacgactgctaaatgcctgc

SEQ ID NO: 9119817 - DNA, 22 bp, Homo sapiens
tttactaagcccagttatatgc

SEQ ID NO: 9119818 - DNA, 22 bp, Homo sapiens
tttactacttcattgacttacg

SEQ ID NO: 9119819 - DNA, 22 bp, Homo sapiens
tttactacttgtgataactgaa

SEQ ID NO: 9119820 - DNA, 22 bp, Homo sapiens
tttactaagtacttgtatccct

SEQ ID NO: 9119821 - DNA, 22 bp, Homo sapiens
tttactaagtacttgtatccct

SEQ ID NO: 9119822 - DNA, 22 bp, Homo sapiens
tttacaaggcagttattttcct

SEQ ID NO: 9119823 - DNA, 22 bp, Homo sapiens
tttacaaggcagaactgattaa

SEQ ID NO: 9119824 - DNA, 22 bp, Homo sapiens
tttacaagtacacctaacagct

SEQ ID NO: 9119825 - DNA, 22 bp, Homo sapiens
tttacaagtacacctaacagct

SEQ ID NO: 9119826 - DNA, 22 bp, Homo sapiens
tttacaacctcatattctgatg

SEQ ID NO: 9119827 - DNA, 22 bp, Homo sapiens
tttacaacgttcctggtgctaa

SEQ ID NO: 9119828 - DNA, 22 bp, Homo sapiens
tttacaaggatcaagggatctc

SEQ ID NO: 9119829 - DNA, 22 bp, Homo sapiens
tttacaaggatcaagggatctc

SEQ ID NO: 9119830 - DNA, 22 bp, Homo sapiens
tttacaaggatcaagggatctc

SEQ ID NO: 9119831 - DNA, 22 bp, Homo sapiens
tttacaagaaatcatgatgcta

SEQ ID NO: 9119832 - DNA, 22 bp, Homo sapiens
tttacaactttctgttctgtat

SEQ ID NO: 9119833 - DNA, 22 bp, Homo sapiens
tttacaagaaatcatgatgcta

SEQ ID NO: 9119834 - DNA, 22 bp, Homo sapiens
tttactttctcaagtatatagg

SEQ ID NO: 9119835 - DNA, 22 bp, Homo sapiens
tttactttgtgtcaagtcaaga

SEQ ID NO: 9119836 - DNA, 22 bp, Homo sapiens
tttagaaattcatctatggcct

SEQ ID NO: 9119837 - DNA, 22 bp, Homo sapiens
tttactacttgtgataactgaa

SEQ ID NO: 9119838 - DNA, 22 bp, Homo sapiens
tttactgaactgctagtacagg

SEQ ID NO: 9119839 - DNA, 22 bp, Homo sapiens
tttactgacctccaatcccact

SEQ ID NO: 9119840 - DNA, 22 bp, Homo sapiens
tttactaccattctgatcagtg

SEQ ID NO: 9119841 - DNA, 21 bp, Homo sapiens
tttactgagcacttactatgt

SEQ ID NO: 9119842 - DNA, 22 bp, Homo sapiens
tttactgttcaacttgcaagta

SEQ ID NO: 9119843 - DNA, 21 bp, Homo sapiens
tttctccaagtgactgattcc

SEQ ID NO: 9119844 - DNA, 21 bp, Homo sapiens
tttctccaagtgactgattcc

SEQ ID NO: 9119845 - DNA, 22 bp, Homo sapiens
tttctcatctggaaacagtgct

SEQ ID NO: 9119846 - DNA, 22 bp, Homo sapiens
tttctcatctggaaacagtgct

SEQ ID NO: 9119847 - DNA, 22 bp, Homo sapiens
tttctcctccagagagacacag

SEQ ID NO: 9119848 - DNA, 22 bp, Homo sapiens
tttctcctaactcaaatttaag

SEQ ID NO: 9119849 - DNA, 22 bp, Homo sapiens
tttctcctcatgactggttgtg

SEQ ID NO: 9119850 - DNA, 22 bp, Homo sapiens
tttctcccaactctggaagcca

SEQ ID NO: 9119851 - DNA, 20 bp, Homo sapiens
tttctcccaagtgcaagggt

SEQ ID NO: 9119852 - DNA, 22 bp, Homo sapiens
tttctcccagtctcctgagaca

SEQ ID NO: 9119853 - DNA, 22 bp, Homo sapiens
tttctcccaaagtgcaaccaca

SEQ ID NO: 9119854 - DNA, 22 bp, Homo sapiens
tttctcccccatgataatttct

SEQ ID NO: 9119855 - DNA, 22 bp, Homo sapiens
tttctcccagtctcctgagaca

SEQ ID NO: 9119856 - DNA, 22 bp, Homo sapiens
tttctccccagtctaatctgga

SEQ ID NO: 9119857 - DNA, 22 bp, Homo sapiens
tttctccctttataagactgta

SEQ ID NO: 9119858 - DNA, 22 bp, Homo sapiens
tttctccctccactacaggctc

SEQ ID NO: 9119859 - DNA, 22 bp, Homo sapiens
tttctcagttctctgcaaggag

SEQ ID NO: 9119860 - DNA, 22 bp, Homo sapiens
tttctcagtaatgtcctggaat

SEQ ID NO: 9119861 - DNA, 22 bp, Homo sapiens
tttctattgtaagtctcctata

SEQ ID NO: 9119862 - DNA, 22 bp, Homo sapiens
tttctagacatttctatgtaca

SEQ ID NO: 9119863 - DNA, 22 bp, Homo sapiens
tttctactgttatgacactggg

SEQ ID NO: 9119864 - DNA, 22 bp, Homo sapiens
tttctactttggaatgcactga

SEQ ID NO: 9119865 - DNA, 22 bp, Homo sapiens
tttctagaaatagagatagagt

SEQ ID NO: 9119866 - DNA, 22 bp, Homo sapiens
tttctagaaatagagatagagt

SEQ ID NO: 9119867 - DNA, 22 bp, Homo sapiens
tttctactcatcctttggagaa

SEQ ID NO: 9119868 - DNA, 22 bp, Homo sapiens
tttctacatttgtaaccagatt

SEQ ID NO: 9119869 - DNA, 22 bp, Homo sapiens
tttctacatgttttctattgaa

SEQ ID NO: 9119870 - DNA, 19 bp, Homo sapiens
tttctaatgtgtttttctt

SEQ ID NO: 9119871 - DNA, 22 bp, Homo sapiens
tttctaagtatcttgcagtttt

SEQ ID NO: 9119872 - DNA, 22 bp, Homo sapiens
tttctaagtatcttgcagtttt

SEQ ID NO: 9119873 - DNA, 22 bp, Homo sapiens
tttctaagtatcttgcagtttt

SEQ ID NO: 9119874 - DNA, 22 bp, Homo sapiens
tttctaagtatcttgcagtttt

SEQ ID NO: 9119875 - DNA, 22 bp, Homo sapiens
tttctaagtgaacattcaagtt

SEQ ID NO: 9119876 - DNA, 21 bp, Homo sapiens
tttctaagtgcttggtttggg

SEQ ID NO: 9119877 - DNA, 22 bp, Homo sapiens
tttctaagtgaacattcaagtt

SEQ ID NO: 9119878 - DNA, 22 bp, Homo sapiens
tttctaagtgaacattcaagtt

SEQ ID NO: 9119879 - DNA, 22 bp, Homo sapiens
tttctaagtaaacacagcatac

SEQ ID NO: 9119880 - DNA, 22 bp, Homo sapiens
tttctaagtaaacacagcatac

SEQ ID NO: 9119881 - DNA, 22 bp, Homo sapiens
tttctaagtatcttgcagtttt

SEQ ID NO: 9119882 - DNA, 22 bp, Homo sapiens
tttctaagtaagattaacttct

SEQ ID NO: 9119883 - DNA, 21 bp, Homo sapiens
tttctaagtaactggcagcat

SEQ ID NO: 9119884 - DNA, 22 bp, Homo sapiens
tttctaatatcacttccagctg

SEQ ID NO: 9119885 - DNA, 22 bp, Homo sapiens
tttctaagtgtgtttcatagga

SEQ ID NO: 9119886 - DNA, 22 bp, Homo sapiens
tttctaagtgtgtttcatagga

SEQ ID NO: 9119887 - DNA, 22 bp, Homo sapiens
tttctaagtgtgtttcatagga

SEQ ID NO: 9119888 - DNA, 22 bp, Homo sapiens
tttctaagtgtgattttagatt

SEQ ID NO: 9119889 - DNA, 22 bp, Homo sapiens
tttctaagtgtgtttcatagga

SEQ ID NO: 9119890 - DNA, 22 bp, Homo sapiens
tttctaagtgtgattttagatt

SEQ ID NO: 9119891 - DNA, 22 bp, Homo sapiens
tttctaagtgtattgagcttgg

SEQ ID NO: 9119892 - DNA, 21 bp, Homo sapiens
tttctaagtgcttggtttggg

SEQ ID NO: 9119893 - DNA, 22 bp, Homo sapiens
tttctaagtgtattgagcttgg

SEQ ID NO: 9119894 - DNA, 22 bp, Homo sapiens
tttcctctttgtaccttgacta

SEQ ID NO: 9119895 - DNA, 22 bp, Homo sapiens
tttcctctttgtaccttgacta

SEQ ID NO: 9119896 - DNA, 22 bp, Homo sapiens
tttcctctttgtgacacagctg

SEQ ID NO: 9119897 - DNA, 22 bp, Homo sapiens
tttcctctttgtgacacagctg

SEQ ID NO: 9119898 - DNA, 22 bp, Homo sapiens
tttcctgtgcttaacaaatatt

SEQ ID NO: 9119899 - DNA, 22 bp, Homo sapiens
tttctaaggtgatcctttctta

SEQ ID NO: 9119900 - DNA, 22 bp, Homo sapiens
tttctaaggtgaggtagaaaat

SEQ ID NO: 9119901 - DNA, 22 bp, Homo sapiens
tttccttccaggttcctaaggc

SEQ ID NO: 9119902 - DNA, 22 bp, Homo sapiens
tttcagagttgtcttcttgacc

SEQ ID NO: 9119903 - DNA, 22 bp, Homo sapiens
tttcagagttatgtaagaaaat

SEQ ID NO: 9119904 - DNA, 22 bp, Homo sapiens
tttcagagttggggaaaagcag

SEQ ID NO: 9119905 - DNA, 22 bp, Homo sapiens
tttcaggaatacacacacatct

SEQ ID NO: 9119906 - DNA, 22 bp, Homo sapiens
tttcaggagagaccagaaatga

SEQ ID NO: 9119907 - DNA, 22 bp, Homo sapiens
tttcagctttaccattccatga

SEQ ID NO: 9119908 - DNA, 22 bp, Homo sapiens
tttcaggcaggtggaatgagta

SEQ ID NO: 9119909 - DNA, 22 bp, Homo sapiens
tttcaggccatagcacagggaa

SEQ ID NO: 9119910 - DNA, 22 bp, Homo sapiens
tttcagggtcagcctgtatgtg

SEQ ID NO: 9119911 - DNA, 22 bp, Homo sapiens
tttcagtcatggattcactgag

SEQ ID NO: 9119912 - DNA, 22 bp, Homo sapiens
tttcagtcatgagttgttttca

SEQ ID NO: 9119913 - DNA, 20 bp, Homo sapiens
tttcagagtgtctttccatt

SEQ ID NO: 9119914 - DNA, 22 bp, Homo sapiens
tttcagagtctggctgcagcct

SEQ ID NO: 9119915 - DNA, 22 bp, Homo sapiens
tttcagagtctggctgcagcct

SEQ ID NO: 9119916 - DNA, 20 bp, Homo sapiens
tttcagagtgtctttccatt

SEQ ID NO: 9119917 - DNA, 22 bp, Homo sapiens
tttcagagttagtagagcatgt

SEQ ID NO: 9119918 - DNA, 22 bp, Homo sapiens
tttcagagttagtagagcatgt

SEQ ID NO: 9119919 - DNA, 22 bp, Homo sapiens
tttcagagttagtagagcatgt

SEQ ID NO: 9119920 - DNA, 22 bp, Homo sapiens
tttcagaggtgcttggaatgct

SEQ ID NO: 9119921 - DNA, 22 bp, Homo sapiens
tttcagagtcagctcctctcta

SEQ ID NO: 9119922 - DNA, 22 bp, Homo sapiens
tttcagagtcagctcctctcta

SEQ ID NO: 9119923 - DNA, 22 bp, Homo sapiens
tttcagagggcagatctggggc

SEQ ID NO: 9119924 - DNA, 22 bp, Homo sapiens
tttcagaggtgcttggaatgct

SEQ ID NO: 9119925 - DNA, 20 bp, Homo sapiens
tttcaaaggcacctatgaag

SEQ ID NO: 9119926 - DNA, 20 bp, Homo sapiens
tttcaaaggcacctatgaag

SEQ ID NO: 9119927 - DNA, 22 bp, Homo sapiens
tttcagaggaaatctcattgag

SEQ ID NO: 9119928 - DNA, 22 bp, Homo sapiens
tttcagaggaaatctcattgag

SEQ ID NO: 9119929 - DNA, 22 bp, Homo sapiens
tttcagaggaggaaggcagtta

SEQ ID NO: 9119930 - DNA, 22 bp, Homo sapiens
tttcagaggaggaaggcagtta

SEQ ID NO: 9119931 - DNA, 22 bp, Homo sapiens
tttcagaggagagctggaccaa

SEQ ID NO: 9119932 - DNA, 22 bp, Homo sapiens
tttcagaggtatgctgcttatc

SEQ ID NO: 9119933 - DNA, 22 bp, Homo sapiens
tttcagaggtatgctgcttatc

SEQ ID NO: 9119934 - DNA, 22 bp, Homo sapiens
tttcagaggaggaaggcagtta

SEQ ID NO: 9119935 - DNA, 22 bp, Homo sapiens
tttcaaactttactcttgaatc

SEQ ID NO: 9119936 - DNA, 22 bp, Homo sapiens
tttcaaagcaactgaaaaggaa

SEQ ID NO: 9119937 - DNA, 17 bp, Homo sapiens
tttcaaagcagtcagga

SEQ ID NO: 9119938 - DNA, 22 bp, Homo sapiens
tttcaaaggaggctgagaggat

SEQ ID NO: 9119939 - DNA, 22 bp, Homo sapiens
tttcattttggttatgccataa

SEQ ID NO: 9119940 - DNA, 22 bp, Homo sapiens
tttcattgtctacatatgacat

SEQ ID NO: 9119941 - DNA, 22 bp, Homo sapiens
tttcagtggagtgacatgatct

SEQ ID NO: 9119942 - DNA, 22 bp, Homo sapiens
tttcctctgctgccattgcccc

SEQ ID NO: 9119943 - DNA, 22 bp, Homo sapiens
tttcctctgctgccattgcccc

SEQ ID NO: 9119944 - DNA, 22 bp, Homo sapiens
tttcctctgtcatgacagctga

SEQ ID NO: 9119945 - DNA, 22 bp, Homo sapiens
tttcctctgtcatgacagctga

SEQ ID NO: 9119946 - DNA, 22 bp, Homo sapiens
tttcctcttatacagtgtttat

SEQ ID NO: 9119947 - DNA, 22 bp, Homo sapiens
tttcctctgggccctgccaccc

SEQ ID NO: 9119948 - DNA, 22 bp, Homo sapiens
tttcctctgggccctgccaccc

SEQ ID NO: 9119949 - DNA, 22 bp, Homo sapiens
tttcctcttcgattaagtttgg

SEQ ID NO: 9119950 - DNA, 22 bp, Homo sapiens
tttcctcttctggcaggcaggg

SEQ ID NO: 9119951 - DNA, 22 bp, Homo sapiens
tttcctcttcttcccatgtcat

SEQ ID NO: 9119952 - DNA, 22 bp, Homo sapiens
tttccaaaggtggcaggaacaa

SEQ ID NO: 9119953 - DNA, 22 bp, Homo sapiens
tttccaaaggtggcaggaacaa

SEQ ID NO: 9119954 - DNA, 22 bp, Homo sapiens
tttcttatgtgcagagtgagta

SEQ ID NO: 9119955 - DNA, 22 bp, Homo sapiens
tttcttcaattgctaacaagga

SEQ ID NO: 9119956 - DNA, 22 bp, Homo sapiens
tttcttatggggtagtccttta

SEQ ID NO: 9119957 - DNA, 22 bp, Homo sapiens
tttcttatgagcaagactctat

SEQ ID NO: 9119958 - DNA, 22 bp, Homo sapiens
tttcttcagagagagctttccc

SEQ ID NO: 9119959 - DNA, 22 bp, Homo sapiens
tttcttcagagagagctttccc

SEQ ID NO: 9119960 - DNA, 22 bp, Homo sapiens
tttcttcaattgctaacaagga

SEQ ID NO: 9119961 - DNA, 22 bp, Homo sapiens
tttcttcaattgctaacaagga

SEQ ID NO: 9119962 - DNA, 22 bp, Homo sapiens
tttcttcagtaacacaaaccat

SEQ ID NO: 9119963 - DNA, 22 bp, Homo sapiens
tttcttcagccactccaaactg

SEQ ID NO: 9119964 - DNA, 22 bp, Homo sapiens
tttcttcattgacaaggaaaaa

SEQ ID NO: 9119965 - DNA, 22 bp, Homo sapiens
tttcttcattgacaaggaaaaa

SEQ ID NO: 9119966 - DNA, 22 bp, Homo sapiens
tttcttcattcaccttcacccc

SEQ ID NO: 9119967 - DNA, 22 bp, Homo sapiens
tttcttcatagaccttgtcttg

SEQ ID NO: 9119968 - DNA, 22 bp, Homo sapiens
tttcttcattgatgtcaggtgg

SEQ ID NO: 9119969 - DNA, 22 bp, Homo sapiens
tttcttccaaaggcacgttctc

SEQ ID NO: 9119970 - DNA, 22 bp, Homo sapiens
tttcttccccaagtgaatttta

SEQ ID NO: 9119971 - DNA, 21 bp, Homo sapiens
tttctgtcctttccatcagct

SEQ ID NO: 9119972 - DNA, 21 bp, Homo sapiens
tttctgtctctgccactagtt

SEQ ID NO: 9119973 - DNA, 22 bp, Homo sapiens
tttctgtggattttccattcaa

SEQ ID NO: 9119974 - DNA, 20 bp, Homo sapiens
tttctgtgcccaggtctgtt

SEQ ID NO: 9119975 - DNA, 20 bp, Homo sapiens
tttctgtgatagagaggtgt

SEQ ID NO: 9119976 - DNA, 21 bp, Homo sapiens
tttcttatctgtaaagtggga

SEQ ID NO: 9119977 - DNA, 22 bp, Homo sapiens
tttctgtggtgggtagttcaga

SEQ ID NO: 9119978 - DNA, 19 bp, Homo sapiens
tttctgttagaaggataca

SEQ ID NO: 9119979 - DNA, 19 bp, Homo sapiens
tttctgttagaaggataca

SEQ ID NO: 9119980 - DNA, 22 bp, Homo sapiens
tttctgttaggcatcattttaa

SEQ ID NO: 9119981 - DNA, 22 bp, Homo sapiens
tttctgttaggcatcattttaa

SEQ ID NO: 9119982 - DNA, 22 bp, Homo sapiens
tttcttctcacccaggacagag

SEQ ID NO: 9119983 - DNA, 22 bp, Homo sapiens
tttcttctaggactaataagag

SEQ ID NO: 9119984 - DNA, 22 bp, Homo sapiens
tttcttctaagatttcaaacta

SEQ ID NO: 9119985 - DNA, 22 bp, Homo sapiens
tttcttcctatgtatcttgctg

SEQ ID NO: 9119986 - DNA, 22 bp, Homo sapiens
tttcttcctaaatatgatttcc

SEQ ID NO: 9119987 - DNA, 22 bp, Homo sapiens
tttcttccttaccttactagag

SEQ ID NO: 9119988 - DNA, 22 bp, Homo sapiens
tttctttaggctgtgttgccaa

SEQ ID NO: 9119989 - DNA, 22 bp, Homo sapiens
tttcttgtgcctaattttgggc

SEQ ID NO: 9119990 - DNA, 22 bp, Homo sapiens
tttcttctgagatcagggagaa

SEQ ID NO: 9119991 - DNA, 20 bp, Homo sapiens
tttcttgtacttggagaagg

SEQ ID NO: 9119992 - DNA, 22 bp, Homo sapiens
tttctctgggctgttggcagcc

SEQ ID NO: 9119993 - DNA, 18 bp, Homo sapiens
tttctctgtcgtcttctg

SEQ ID NO: 9119994 - DNA, 19 bp, Homo sapiens
tttctctgtgcaccttttc

SEQ ID NO: 9119995 - DNA, 22 bp, Homo sapiens
tttctctaaatagggaggctta

SEQ ID NO: 9119996 - DNA, 22 bp, Homo sapiens
tttctctagctattcattaaat

SEQ ID NO: 9119997 - DNA, 22 bp, Homo sapiens
tttctcttaatgtctctgtgct

SEQ ID NO: 9119998 - DNA, 22 bp, Homo sapiens
tttctcttaatgtctctgtgct

SEQ ID NO: 9119999 - DNA, 22 bp, Homo sapiens
tttctctgtgccatttccataa

SEQ ID NO: 9120000 - DNA, 22 bp, Homo sapiens
tttctcctgcccagatgcctgg

SEQ ID NO: 9120001 - DNA, 22 bp, Homo sapiens
tttctcctctccagagtgcagt

SEQ ID NO: 9120002 - DNA, 22 bp, Homo sapiens
tttctctttcaatctgcagtac

SEQ ID NO: 9120003 - DNA, 22 bp, Homo sapiens
tttctcttgcgatatgctacac

SEQ ID NO: 9120004 - DNA, 22 bp, Homo sapiens
tttctcttcactgtgtgcctca

SEQ ID NO: 9120005 - DNA, 22 bp, Homo sapiens
tttctctttcaatctgcagtac

SEQ ID NO: 9120006 - DNA, 22 bp, Homo sapiens
tttctctttcaatctgcagtac

SEQ ID NO: 9120007 - DNA, 22 bp, Homo sapiens
tttctctttgacaggaatcaga

SEQ ID NO: 9120008 - DNA, 22 bp, Homo sapiens
tttctctttgacaggaatcaga

SEQ ID NO: 9120009 - DNA, 22 bp, Homo sapiens
tttctgaagatacagctttgct

SEQ ID NO: 9120010 - DNA, 21 bp, Homo sapiens
tttctgaaggcaacatctatc

SEQ ID NO: 9120011 - DNA, 22 bp, Homo sapiens
tttctgccaaccatttaaactc

SEQ ID NO: 9120012 - DNA, 22 bp, Homo sapiens
tttctgccaggtttctggatga

SEQ ID NO: 9120013 - DNA, 22 bp, Homo sapiens
tttctgcccccgagggcggtgc

SEQ ID NO: 9120014 - DNA, 22 bp, Homo sapiens
tttctgccagtcactgctctag

SEQ ID NO: 9120015 - DNA, 22 bp, Homo sapiens
tttctgcatttacaaaatgagg

SEQ ID NO: 9120016 - DNA, 22 bp, Homo sapiens
tttctgccttgtagactagaat

SEQ ID NO: 9120017 - DNA, 22 bp, Homo sapiens
tttctgccttatctttgctgag

SEQ ID NO: 9120018 - DNA, 22 bp, Homo sapiens
tttctgccgttccctgctctgt

SEQ ID NO: 9120019 - DNA, 22 bp, Homo sapiens
tttctgaagggcagcagactct

SEQ ID NO: 9120020 - DNA, 22 bp, Homo sapiens
tttctgaagtcttctaacagat

SEQ ID NO: 9120021 - DNA, 22 bp, Homo sapiens
tttctgaattcctaggatgttg

SEQ ID NO: 9120022 - DNA, 22 bp, Homo sapiens
tttctgactccagagaggaata

SEQ ID NO: 9120023 - DNA, 22 bp, Homo sapiens
tttctggaaagcaagatacatt

SEQ ID NO: 9120024 - DNA, 20 bp, Homo sapiens
tttctgtagctcagtattca

SEQ ID NO: 9120025 - DNA, 22 bp, Homo sapiens
tttctgtaaggacttaatgcaa

SEQ ID NO: 9120026 - DNA, 22 bp, Homo sapiens
tttctggcagcgggacaggggt

SEQ ID NO: 9120027 - DNA, 22 bp, Homo sapiens
aggcaatcctcttacagatggg

SEQ ID NO: 9120028 - DNA, 22 bp, Homo sapiens
aggcaatcagtgtagagtaaca

SEQ ID NO: 9120029 - DNA, 22 bp, Homo sapiens
cattggaagacatatcatgcta

SEQ ID NO: 9120030 - DNA, 22 bp, Homo sapiens
catttcacaaatggccacatca

SEQ ID NO: 9120031 - DNA, 22 bp, Homo sapiens
ccaccattcaaggtcttcacag

SEQ ID NO: 9120032 - DNA, 20 bp, Homo sapiens
ccacctggccaaggctgtgc

SEQ ID NO: 9120033 - DNA, 22 bp, Homo sapiens
cagtccagagtatatccgcttt

SEQ ID NO: 9120034 - DNA, 22 bp, Homo sapiens
cagtccagcaaagaactttcac

SEQ ID NO: 9120035 - DNA, 22 bp, Homo sapiens
cataacatgtacatataaatgc

SEQ ID NO: 9120036 - DNA, 22 bp, Homo sapiens
catcttgggtaagcagttgctt

SEQ ID NO: 9120037 - DNA, 22 bp, Homo sapiens
aggaatattactttgcttttat

SEQ ID NO: 9120038 - DNA, 23 bp, Homo sapiens
aggaagttaaggcagacagacag

SEQ ID NO: 9120039 - DNA, 22 bp, Homo sapiens
cagtaaatgcagatatagatac

SEQ ID NO: 9120040 - DNA, 22 bp, Homo sapiens
cagtaaatggtacgtatatttt

SEQ ID NO: 9120041 - DNA, 22 bp, Homo sapiens
agctgtcaccaggagccggacc

SEQ ID NO: 9120042 - DNA, 22 bp, Homo sapiens
agctgtctctggtattatgtga

SEQ ID NO: 9120043 - DNA, 22 bp, Homo sapiens
agcttctcagcttcagaactgt

SEQ ID NO: 9120044 - DNA, 21 bp, Homo sapiens
aggctcagagatcaaacagta

SEQ ID NO: 9120045 - DNA, 22 bp, Homo sapiens
aggctcagaggtgagcatctgc

SEQ ID NO: 9120046 - DNA, 22 bp, Homo sapiens
ccactccccacgtgctgtcaga

SEQ ID NO: 9120047 - DNA, 20 bp, Homo sapiens
cccagaggttgcggcaggag

SEQ ID NO: 9120048 - DNA, 22 bp, Homo sapiens
cccagaggtgcttcagaggtgc

SEQ ID NO: 9120049 - DNA, 22 bp, Homo sapiens
aggctgtggtgctgaaggaggg

SEQ ID NO: 9120050 - DNA, 22 bp, Homo sapiens
aggctgtgggagttgagagtct

SEQ ID NO: 9120051 - DNA, 22 bp, Homo sapiens
aggctgtgggaatggctgcttg

SEQ ID NO: 9120052 - DNA, 22 bp, Homo sapiens
aggctgtgctcagccaatggga

SEQ ID NO: 9120053 - DNA, 22 bp, Homo sapiens
aggctgtgcgaggtctcagagt

SEQ ID NO: 9120054 - DNA, 22 bp, Homo sapiens
aggctgtggccctggtctagca

SEQ ID NO: 9120055 - DNA, 22 bp, Homo sapiens
cccactcctggagctagggctc

SEQ ID NO: 9120056 - DNA, 18 bp, Homo sapiens
cccaccctggctcttagt

SEQ ID NO: 9120057 - DNA, 22 bp, Homo sapiens
ccagtgtgaccatctgttagct

SEQ ID NO: 9120058 - DNA, 18 bp, Homo sapiens
cccacacagcagtagctc

SEQ ID NO: 9120059 - DNA, 22 bp, Homo sapiens
cccacacatttttcacttaccg

SEQ ID NO: 9120060 - DNA, 22 bp, Homo sapiens
cccacacactggctgctgccaa

SEQ ID NO: 9120061 - DNA, 22 bp, Homo sapiens
ccctggccagctcatgtctgag

SEQ ID NO: 9120062 - DNA, 22 bp, Homo sapiens
agggggagacatgtgtgtgttt

SEQ ID NO: 9120063 - DNA, 22 bp, Homo sapiens
ccctgaggcacaggccacgtat

SEQ ID NO: 9120064 - DNA, 22 bp, Homo sapiens
ccctgaggggagtggtgaggtg

SEQ ID NO: 9120065 - DNA, 22 bp, Homo sapiens
ccccttcagagtagccacatta

SEQ ID NO: 9120066 - DNA, 22 bp, Homo sapiens
ccctgaggagagcgcttcccga

SEQ ID NO: 9120067 - DNA, 22 bp, Homo sapiens
ccctgaggatagggcaggaccc

SEQ ID NO: 9120068 - DNA, 22 bp, Homo sapiens
aggcttggctgcacgcctcgct

SEQ ID NO: 9120069 - DNA, 22 bp, Homo sapiens
aggcttggctctcctatgagaa

SEQ ID NO: 9120070 - DNA, 19 bp, Homo sapiens
aggcttggctagatttact

SEQ ID NO: 9120071 - DNA, 22 bp, Homo sapiens
aggcttggctggcagccctggg

SEQ ID NO: 9120072 - DNA, 18 bp, Homo sapiens
aggttttcaggatatgtg

SEQ ID NO: 9120073 - DNA, 15 bp, Homo sapiens
aggttttcagagtaa

SEQ ID NO: 9120074 - DNA, 22 bp, Homo sapiens
aggttttcacaggaagtatgtt

SEQ ID NO: 9120075 - DNA, 22 bp, Homo sapiens
aggttttcagctgtatcctgag

SEQ ID NO: 9120076 - DNA, 18 bp, Homo sapiens
aggttttcagagtttcca

SEQ ID NO: 9120077 - DNA, 21 bp, Homo sapiens
cgggctggccgggccctcacc

SEQ ID NO: 9120078 - DNA, 22 bp, Homo sapiens
agtccagtcggcctggagaaat

SEQ ID NO: 9120079 - DNA, 22 bp, Homo sapiens
agtccagaaagtgaacagtgtt

SEQ ID NO: 9120080 - DNA, 22 bp, Homo sapiens
ctagggtcaggggcctgcgtcg

SEQ ID NO: 9120081 - DNA, 22 bp, Homo sapiens
ctacagaatctacctcaagcca

SEQ ID NO: 9120082 - DNA, 23 bp, Homo sapiens
cctggcacacaaggggtgctgca

SEQ ID NO: 9120083 - DNA, 19 bp, Homo sapiens
aggtcctcaggatgaccct

SEQ ID NO: 9120084 - DNA, 22 bp, Homo sapiens
cctgggcttggttgttgagaac

SEQ ID NO: 9120085 - DNA, 22 bp, Homo sapiens
cctgggctttcaaaaccagcct

SEQ ID NO: 9120086 - DNA, 22 bp, Homo sapiens
cctgggctcacagccaaggctc

SEQ ID NO: 9120087 - DNA, 22 bp, Homo sapiens
cctgtgccaaaatctaggcagt

SEQ ID NO: 9120088 - DNA, 23 bp, Homo sapiens
ctgaaattcagatgctaaagata

SEQ ID NO: 9120089 - DNA, 22 bp, Homo sapiens
agttaagagtgtgaaaatgtta

SEQ ID NO: 9120090 - DNA, 22 bp, Homo sapiens
agttagtatacaaagtaacagc

SEQ ID NO: 9120091 - DNA, 23 bp, Homo sapiens
ctctggatcctgtagctcctggc

SEQ ID NO: 9120092 - DNA, 22 bp, Homo sapiens
ctctggcttctaccttgcagtt

SEQ ID NO: 9120093 - DNA, 22 bp, Homo sapiens
ctctgcctgtgtcgccaccaca

SEQ ID NO: 9120094 - DNA, 22 bp, Homo sapiens
ctctggctttcccagggaggag

SEQ ID NO: 9120095 - DNA, 22 bp, Homo sapiens
ctctgggaagggctgagcactg

SEQ ID NO: 9120096 - DNA, 22 bp, Homo sapiens
ctctgggaaagattgtgcaggc

SEQ ID NO: 9120097 - DNA, 22 bp, Homo sapiens
ctcatggaagacactccttcac

SEQ ID NO: 9120098 - DNA, 22 bp, Homo sapiens
ctcattgcagctgcattactgt

SEQ ID NO: 9120099 - DNA, 22 bp, Homo sapiens
ctcattgcagctgcattactgt

SEQ ID NO: 9120100 - DNA, 22 bp, Homo sapiens
agtcccctggcaggagggacgt

SEQ ID NO: 9120101 - DNA, 22 bp, Homo sapiens
ctcctggctcgcccccagctga

SEQ ID NO: 9120102 - DNA, 22 bp, Homo sapiens
ctccctccaaataagactcggg

SEQ ID NO: 9120103 - DNA, 22 bp, Homo sapiens
ctccctctcaccggagccctgg

SEQ ID NO: 9120104 - DNA, 22 bp, Homo sapiens
ctccctcctcaaatatctttgt

SEQ ID NO: 9120105 - DNA, 22 bp, Homo sapiens
ctccctccctacgtgagctcac

SEQ ID NO: 9120106 - DNA, 22 bp, Homo sapiens
ctccctccctacgtgagctcac

SEQ ID NO: 9120107 - DNA, 22 bp, Homo sapiens
ctccctcaccatgacccgctgt

SEQ ID NO: 9120108 - DNA, 18 bp, Homo sapiens
ctccagggaactcagtca

SEQ ID NO: 9120109 - DNA, 22 bp, Homo sapiens
ctcctggctttcccagaccagg

SEQ ID NO: 9120110 - DNA, 22 bp, Homo sapiens
ctggaataaacgatcttcagca

SEQ ID NO: 9120111 - DNA, 23 bp, Homo sapiens
ctgcaattgcctgatctcattgg

SEQ ID NO: 9120112 - DNA, 22 bp, Homo sapiens
ctgcctctcagcctgaccgcca

SEQ ID NO: 9120113 - DNA, 22 bp, Homo sapiens
ctgcctctgcgtcccacagagt

SEQ ID NO: 9120114 - DNA, 22 bp, Homo sapiens
ataaatgtgaattagagctttg

SEQ ID NO: 9120115 - DNA, 22 bp, Homo sapiens
ataacccattggccaggcttca

SEQ ID NO: 9120116 - DNA, 22 bp, Homo sapiens
atattttggcaaatgtctagat

SEQ ID NO: 9120117 - DNA, 22 bp, Homo sapiens
atattgcagtgtgtttatgtga

SEQ ID NO: 9120118 - DNA, 22 bp, Homo sapiens
atattgcaatagatgcatcatt

SEQ ID NO: 9120119 - DNA, 22 bp, Homo sapiens
atcaacatgtgagagcaccagt

SEQ ID NO: 9120120 - DNA, 19 bp, Homo sapiens
ctgggctgaggtctgcctt

SEQ ID NO: 9120121 - DNA, 22 bp, Homo sapiens
cttcctcaggcattagctggac

SEQ ID NO: 9120122 - DNA, 21 bp, Homo sapiens
atcctgtgagtctcagtcccc

SEQ ID NO: 9120123 - DNA, 22 bp, Homo sapiens
cttagaaattgttactcattca

SEQ ID NO: 9120124 - DNA, 22 bp, Homo sapiens
ctgtggctcagcacggggtcag

SEQ ID NO: 9120125 - DNA, 22 bp, Homo sapiens
ctgtggcttttccggggagcct

SEQ ID NO: 9120126 - DNA, 19 bp, Homo sapiens
ctgtggcctccaggaggga

SEQ ID NO: 9120127 - DNA, 22 bp, Homo sapiens
ctgtggagtggggagtactggt

SEQ ID NO: 9120128 - DNA, 22 bp, Homo sapiens
ctgtgtggcctcaagccagcct

SEQ ID NO: 9120129 - DNA, 22 bp, Homo sapiens
ctgtgtgctgttagggagctgc

SEQ ID NO: 9120130 - DNA, 22 bp, Homo sapiens
atccaccctgtggtggctttct

SEQ ID NO: 9120131 - DNA, 22 bp, Homo sapiens
atccagttctcagtgcttacag

SEQ ID NO: 9120132 - DNA, 21 bp, Homo sapiens
cacctgtgagactctcagacc

SEQ ID NO: 9120133 - DNA, 20 bp, Homo sapiens
caccttcaaatttcctggca

SEQ ID NO: 9120134 - DNA, 22 bp, Homo sapiens
caccttactccctctggatgcc

SEQ ID NO: 9120135 - DNA, 22 bp, Homo sapiens
cacctttgttctcggccagagt

SEQ ID NO: 9120136 - DNA, 22 bp, Homo sapiens
ggcatcaggagcttcttcaggt

SEQ ID NO: 9120137 - DNA, 22 bp, Homo sapiens
cacaggcttttttggctgatgt

SEQ ID NO: 9120138 - DNA, 22 bp, Homo sapiens
ggctctggtgggaaggttagat

SEQ ID NO: 9120139 - DNA, 22 bp, Homo sapiens
ggctctggtgccctggctccca

SEQ ID NO: 9120140 - DNA, 22 bp, Homo sapiens
ggctgagcgtggctgccgtggg

SEQ ID NO: 9120141 - DNA, 22 bp, Homo sapiens
cagaaagccaactccaactgtc

SEQ ID NO: 9120142 - DNA, 22 bp, Homo sapiens
cagaaatacccagcatttggag

SEQ ID NO: 9120143 - DNA, 22 bp, Homo sapiens
cagaaataaacttctcacatcg

SEQ ID NO: 9120144 - DNA, 21 bp, Homo sapiens
ggctggtgtttagctgtgata

SEQ ID NO: 9120145 - DNA, 22 bp, Homo sapiens
cacagagaaaatgttggtgctt

SEQ ID NO: 9120146 - DNA, 22 bp, Homo sapiens
cacacaggaaaattggaattaa

SEQ ID NO: 9120147 - DNA, 22 bp, Homo sapiens
cacaggctgggaagcctaggcc

SEQ ID NO: 9120148 - DNA, 22 bp, Homo sapiens
ggagccctccatcccttgcggc

SEQ ID NO: 9120149 - DNA, 22 bp, Homo sapiens
ggagcccttctattccatggag

SEQ ID NO: 9120150 - DNA, 22 bp, Homo sapiens
ggagccctgctgacatgggtgt

SEQ ID NO: 9120151 - DNA, 22 bp, Homo sapiens
caagccagtcagctcagtagat

SEQ ID NO: 9120152 - DNA, 22 bp, Homo sapiens
caagccagagagcaactgttct

SEQ ID NO: 9120153 - DNA, 22 bp, Homo sapiens
caaatgtatgttttcctatgta

SEQ ID NO: 9120154 - DNA, 22 bp, Homo sapiens
gctggctggctgtgcaaaggca

SEQ ID NO: 9120155 - DNA, 22 bp, Homo sapiens
gctggctgggtccctgagaggc

SEQ ID NO: 9120156 - DNA, 22 bp, Homo sapiens
gctggctggtccagcaggggct

SEQ ID NO: 9120157 - DNA, 22 bp, Homo sapiens
caagggtggtattgggagcata

SEQ ID NO: 9120158 - DNA, 21 bp, Homo sapiens
gctggctgtcccagggaagca

SEQ ID NO: 9120159 - DNA, 22 bp, Homo sapiens
gctttctgtggtgatgtaaagg

SEQ ID NO: 9120160 - DNA, 22 bp, Homo sapiens
gctgtggcgattggtatcgatt

SEQ ID NO: 9120161 - DNA, 22 bp, Homo sapiens
cagagacaggatctcgaagact

SEQ ID NO: 9120162 - DNA, 22 bp, Homo sapiens
cagacctctttttagcactccc

SEQ ID NO: 9120163 - DNA, 22 bp, Homo sapiens
cagacctctttttagcactccc

SEQ ID NO: 9120164 - DNA, 22 bp, Homo sapiens
ggcttaggtgtctctctgcacc

SEQ ID NO: 9120165 - DNA, 22 bp, Homo sapiens
ggtgaccagggtcagtagcttt

SEQ ID NO: 9120166 - DNA, 19 bp, Homo sapiens
ggtgaccacctggtcagtg

SEQ ID NO: 9120167 - DNA, 22 bp, Homo sapiens
ggtgctgaataaatactagtta

SEQ ID NO: 9120168 - DNA, 22 bp, Homo sapiens
ggtgctgacattcagagtctgg

SEQ ID NO: 9120169 - DNA, 22 bp, Homo sapiens
ggtgctgacttcacagtcttac

SEQ ID NO: 9120170 - DNA, 22 bp, Homo sapiens
ggtgctgatgttattgatgctg

SEQ ID NO: 9120171 - DNA, 22 bp, Homo sapiens
ggtgctgattcactgacttctg

SEQ ID NO: 9120172 - DNA, 21 bp, Homo sapiens
gtgcccgtcccaggagccgac

SEQ ID NO: 9120173 - DNA, 22 bp, Homo sapiens
gtcagcattttacatgtgtcat

SEQ ID NO: 9120174 - DNA, 22 bp, Homo sapiens
gtcatggtgctagcgggaatgt

SEQ ID NO: 9120175 - DNA, 22 bp, Homo sapiens
gtcatggtgctcatcattggtg

SEQ ID NO: 9120176 - DNA, 22 bp, Homo sapiens
cagcccctggcgcacgccgagc

SEQ ID NO: 9120177 - DNA, 22 bp, Homo sapiens
cagccctcaaaccacttccagg

SEQ ID NO: 9120178 - DNA, 22 bp, Homo sapiens
gtccctgggtctaaggcagtaa

SEQ ID NO: 9120179 - DNA, 22 bp, Homo sapiens
gtccctggcgctttcgagcctt

SEQ ID NO: 9120180 - DNA, 22 bp, Homo sapiens
gactggaatcccaggctctgtg

SEQ ID NO: 9120181 - DNA, 22 bp, Homo sapiens
gactgggacaggacagacatct

SEQ ID NO: 9120182 - DNA, 22 bp, Homo sapiens
gaaatttattatctacatcatt

SEQ ID NO: 9120183 - DNA, 22 bp, Homo sapiens
atgacagctctagcacacagta

SEQ ID NO: 9120184 - DNA, 22 bp, Homo sapiens
atgacatgattctttctttcat

SEQ ID NO: 9120185 - DNA, 22 bp, Homo sapiens
ctttctgatgtaaggaactagg

SEQ ID NO: 9120186 - DNA, 22 bp, Homo sapiens
atgtctctgccccagagagctt

SEQ ID NO: 9120187 - DNA, 22 bp, Homo sapiens
gataatgtgccgataatttcta

SEQ ID NO: 9120188 - DNA, 19 bp, Homo sapiens
atgttctgaattactgtaa

SEQ ID NO: 9120189 - DNA, 22 bp, Homo sapiens
atgttctgaataatgtgcatta

SEQ ID NO: 9120190 - DNA, 22 bp, Homo sapiens
atgttctgcctccattttgagt

SEQ ID NO: 9120191 - DNA, 22 bp, Homo sapiens
atgttctgtttcttaatcttga

SEQ ID NO: 9120192 - DNA, 22 bp, Homo sapiens
atggaggatgtgcagcatgggc

SEQ ID NO: 9120193 - DNA, 22 bp, Homo sapiens
atggctgttggcaggaggcctc

SEQ ID NO: 9120194 - DNA, 22 bp, Homo sapiens
atggcttgcttttagagagatc

SEQ ID NO: 9120195 - DNA, 22 bp, Homo sapiens
atggcttgatagaaagctagtt

SEQ ID NO: 9120196 - DNA, 22 bp, Homo sapiens
atggcttgtctatgagtgctct

SEQ ID NO: 9120197 - DNA, 22 bp, Homo sapiens
atggcttgttcattggtacctg

SEQ ID NO: 9120198 - DNA, 22 bp, Homo sapiens
atgggacacgttttaaggaaaa

SEQ ID NO: 9120199 - DNA, 22 bp, Homo sapiens
atgggacacagtccgccctcta

SEQ ID NO: 9120200 - DNA, 22 bp, Homo sapiens
atgggacaatttgaacacagtg

SEQ ID NO: 9120201 - DNA, 22 bp, Homo sapiens
atgggacacacaaggaagtaaa

SEQ ID NO: 9120202 - DNA, 22 bp, Homo sapiens
atgggacaaacctttgatttga

SEQ ID NO: 9120203 - DNA, 22 bp, Homo sapiens
atgggacaggtactagaaaggg

SEQ ID NO: 9120204 - DNA, 22 bp, Homo sapiens
atgggacagcatcttggtatta

SEQ ID NO: 9120205 - DNA, 22 bp, Homo sapiens
atgggacatagatccttgaggt

SEQ ID NO: 9120206 - DNA, 22 bp, Homo sapiens
atgggacagggctggctggtcc

SEQ ID NO: 9120207 - DNA, 22 bp, Homo sapiens
atgggacaggcatgggacttag

SEQ ID NO: 9120208 - DNA, 18 bp, Homo sapiens
atggtctcatactgggag

SEQ ID NO: 9120209 - DNA, 22 bp, Homo sapiens
attacaatcgagagaaacaaat

SEQ ID NO: 9120210 - DNA, 22 bp, Homo sapiens
attacatcagttgacatgtgag

SEQ ID NO: 9120211 - DNA, 22 bp, Homo sapiens
attcacatgttgaagccctaac

SEQ ID NO: 9120212 - DNA, 20 bp, Homo sapiens
attcaccaaatcatcccagg

SEQ ID NO: 9120213 - DNA, 20 bp, Homo sapiens
attcaccaaatcatcccagg

SEQ ID NO: 9120214 - DNA, 22 bp, Homo sapiens
attgtcttacatactgtggagg

SEQ ID NO: 9120215 - DNA, 23 bp, Homo sapiens
attgtgagattactatcacactg

SEQ ID NO: 9120216 - DNA, 22 bp, Homo sapiens
gccaaattccttgaaaggtggg

SEQ ID NO: 9120217 - DNA, 22 bp, Homo sapiens
attctttcaaggaatagttatt

SEQ ID NO: 9120218 - DNA, 22 bp, Homo sapiens
attctttcatataaaggctcag

SEQ ID NO: 9120219 - DNA, 22 bp, Homo sapiens
gcagggctgactcagccaccct

SEQ ID NO: 9120220 - DNA, 22 bp, Homo sapiens
attgatttgaacaaagatatta

SEQ ID NO: 9120221 - DNA, 22 bp, Homo sapiens
attgatttaggcttgttatgac

SEQ ID NO: 9120222 - DNA, 22 bp, Homo sapiens
caaagcccagaggcctcacttt

SEQ ID NO: 9120223 - DNA, 22 bp, Homo sapiens
caaaatgttctggcacctttaa

SEQ ID NO: 9120224 - DNA, 22 bp, Homo sapiens
atttttcctgggtgctttagtt

SEQ ID NO: 9120225 - DNA, 22 bp, Homo sapiens
atttttctctttccactgagat

SEQ ID NO: 9120226 - DNA, 22 bp, Homo sapiens
atttttgccctgcagtacataa

SEQ ID NO: 9120227 - DNA, 22 bp, Homo sapiens
gctcttttcacagtccaaaatg

SEQ ID NO: 9120228 - DNA, 22 bp, Homo sapiens
gctgacagttactgctgtaaca

SEQ ID NO: 9120229 - DNA, 22 bp, Homo sapiens
gctcttgtcaaaaattagttga

SEQ ID NO: 9120230 - DNA, 22 bp, Homo sapiens
caaagctcatgctcttagccat

SEQ ID NO: 9120231 - DNA, 18 bp, Homo sapiens
caaagctcacgttccatc

SEQ ID NO: 9120232 - DNA, 22 bp, Homo sapiens
caaagctcagccctccaatgaa

SEQ ID NO: 9120233 - DNA, 22 bp, Homo sapiens
caaagctcgccacctctgaggg

SEQ ID NO: 9120234 - DNA, 21 bp, Homo sapiens
caaagctcattctttggtcat

SEQ ID NO: 9120235 - DNA, 22 bp, Homo sapiens
caaagccctggaaagatgaaga

SEQ ID NO: 9120236 - DNA, 22 bp, Homo sapiens
caaaggaagctccttgatggcg

SEQ ID NO: 9120237 - DNA, 22 bp, Homo sapiens
caaatactgggtaagttaattt

SEQ ID NO: 9120238 - DNA, 22 bp, Homo sapiens
caaatactgtactgaacactgt

SEQ ID NO: 9120239 - DNA, 21 bp, Homo sapiens
caaatacttagaaacttaaga

SEQ ID NO: 9120240 - DNA, 22 bp, Homo sapiens
gcctgagagttgaagttcagtg

SEQ ID NO: 9120241 - DNA, 22 bp, Homo sapiens
gccccctctttggagccagcca

SEQ ID NO: 9120242 - DNA, 22 bp, Homo sapiens
atttcatgttaactgaacagaa

SEQ ID NO: 9120243 - DNA, 22 bp, Homo sapiens
gcccacctaacctgctcacctt

SEQ ID NO: 9120244 - DNA, 22 bp, Homo sapiens
atttctgtggcttcattctcct

SEQ ID NO: 9120245 - DNA, 22 bp, Homo sapiens
atacacatttgctagagatggg

SEQ ID NO: 9120246 - DNA, 22 bp, Homo sapiens
agttcagaaatgtctttgcaaa

SEQ ID NO: 9120247 - DNA, 22 bp, Homo sapiens
agttcagagtaaatgttgaagg

SEQ ID NO: 9120248 - DNA, 19 bp, Homo sapiens
ataaataaaaagtgggaga

SEQ ID NO: 9120249 - DNA, 22 bp, Homo sapiens
agttgcagacgcagagatgttg

SEQ ID NO: 9120250 - DNA, 22 bp, Homo sapiens
actttacatttgatctctctaa

SEQ ID NO: 9120251 - DNA, 22 bp, Homo sapiens
agaaaacttgtcacagctctca

SEQ ID NO: 9120252 - DNA, 23 bp, Homo sapiens
atagttctgcttagaaatcagtg

SEQ ID NO: 9120253 - DNA, 20 bp, Homo sapiens
agaaatattgagttcagagg

SEQ ID NO: 9120254 - DNA, 22 bp, Homo sapiens
agaagcccagcatggaaccagc

SEQ ID NO: 9120255 - DNA, 18 bp, Homo sapiens
agaagcaggttctcccag

SEQ ID NO: 9120256 - DNA, 22 bp, Homo sapiens
agaagcattggaccaggggccc

SEQ ID NO: 9120257 - DNA, 22 bp, Homo sapiens
agaaatgtatagtgaatttttc

SEQ ID NO: 9120258 - DNA, 22 bp, Homo sapiens
agaaatgtattctgtatgtttt

SEQ ID NO: 9120259 - DNA, 19 bp, Homo sapiens
agttatttctaaatttacc

SEQ ID NO: 9120260 - DNA, 21 bp, Homo sapiens
agttacaagtttattcagagg

SEQ ID NO: 9120261 - DNA, 22 bp, Homo sapiens
actggtaacaatggaagcttct

SEQ ID NO: 9120262 - DNA, 22 bp, Homo sapiens
actggtaaattatgcgactttg

SEQ ID NO: 9120263 - DNA, 22 bp, Homo sapiens
actggggctgatgcgttcgtgt

SEQ ID NO: 9120264 - DNA, 23 bp, Homo sapiens
actgggtctatctccagagaaga

SEQ ID NO: 9120265 - DNA, 22 bp, Homo sapiens
actgggtctgaaggacagagca

SEQ ID NO: 9120266 - DNA, 22 bp, Homo sapiens
agtgtggggtcaccggcccagg

SEQ ID NO: 9120267 - DNA, 22 bp, Homo sapiens
agtgattttaacttccagcaat

SEQ ID NO: 9120268 - DNA, 20 bp, Homo sapiens
agtgatttgttagtacattg

SEQ ID NO: 9120269 - DNA, 22 bp, Homo sapiens
agtgatttgggtgtcagaaagt

SEQ ID NO: 9120270 - DNA, 22 bp, Homo sapiens
agtgattttggccgtgccatta

SEQ ID NO: 9120271 - DNA, 22 bp, Homo sapiens
agtggctggaattgcaggtgcg

SEQ ID NO: 9120272 - DNA, 22 bp, Homo sapiens
aggtgccacctctggtgctgtc

SEQ ID NO: 9120273 - DNA, 22 bp, Homo sapiens
aggtgccactctcatgggctac

SEQ ID NO: 9120274 - DNA, 22 bp, Homo sapiens
agggtgcagggacaggtgtgca

SEQ ID NO: 9120275 - DNA, 22 bp, Homo sapiens
agggtgcaggtgtggagtctag

SEQ ID NO: 9120276 - DNA, 22 bp, Homo sapiens
agggtgcaggggaagctgccct

SEQ ID NO: 9120277 - DNA, 22 bp, Homo sapiens
agggtccatcaaggactgcaca

SEQ ID NO: 9120278 - DNA, 19 bp, Homo sapiens
agggtccagggagcggctc

SEQ ID NO: 9120279 - DNA, 22 bp, Homo sapiens
actcacatttcatcaggccaag

SEQ ID NO: 9120280 - DNA, 23 bp, Homo sapiens
agtcagtcatggtaaccatttga

SEQ ID NO: 9120281 - DNA, 22 bp, Homo sapiens
agtaagatcttgaaatttaaga

SEQ ID NO: 9120282 - DNA, 22 bp, Homo sapiens
actcagcacagcactgggaacc

SEQ ID NO: 9120283 - DNA, 20 bp, Homo sapiens
actcagatgctcacaacagg

SEQ ID NO: 9120284 - DNA, 22 bp, Homo sapiens
actcagcatatggggccgcttg

SEQ ID NO: 9120285 - DNA, 22 bp, Homo sapiens
agtccagaccccggcagctggt

SEQ ID NO: 9120286 - DNA, 19 bp, Homo sapiens
aggaggccatgccactaga

SEQ ID NO: 9120287 - DNA, 22 bp, Homo sapiens
acagggccattatctgttctag

SEQ ID NO: 9120288 - DNA, 22 bp, Homo sapiens
acagggccaggtgagaggtgct

SEQ ID NO: 9120289 - DNA, 22 bp, Homo sapiens
acagggcccttagatcctttta

SEQ ID NO: 9120290 - DNA, 22 bp, Homo sapiens
acagggccttatatccagaagg

SEQ ID NO: 9120291 - DNA, 19 bp, Homo sapiens
aggaaaggtggccttagca

SEQ ID NO: 9120292 - DNA, 22 bp, Homo sapiens
acaggcaagaggaaagcaagta

SEQ ID NO: 9120293 - DNA, 22 bp, Homo sapiens
acaggatggagataatagaaaa

SEQ ID NO: 9120294 - DNA, 22 bp, Homo sapiens
acaggatgggcgcacagagcta

SEQ ID NO: 9120295 - DNA, 22 bp, Homo sapiens
acaggaagtttggaaagcctca

SEQ ID NO: 9120296 - DNA, 22 bp, Homo sapiens
acaggaagtgggaagaaacagg

SEQ ID NO: 9120297 - DNA, 22 bp, Homo sapiens
acagcttcgaggatctcatccc

SEQ ID NO: 9120298 - DNA, 22 bp, Homo sapiens
acagcttctatttctctgtact

SEQ ID NO: 9120299 - DNA, 22 bp, Homo sapiens
acagcttctctgaaattcatgt

SEQ ID NO: 9120300 - DNA, 22 bp, Homo sapiens
aggctgtgagaggtggctccca

SEQ ID NO: 9120301 - DNA, 22 bp, Homo sapiens
aggctgtgagttttgtctcaga

SEQ ID NO: 9120302 - DNA, 22 bp, Homo sapiens
acatggcgggagtttcagatac

SEQ ID NO: 9120303 - DNA, 22 bp, Homo sapiens
aggctctctagaaactgtgcct

SEQ ID NO: 9120304 - DNA, 21 bp, Homo sapiens
aggctctcatccagggaccca

SEQ ID NO: 9120305 - DNA, 22 bp, Homo sapiens
aggggagcttgaggcatggcct

SEQ ID NO: 9120306 - DNA, 22 bp, Homo sapiens
aggggcaggtgctgcacttaga

SEQ ID NO: 9120307 - DNA, 22 bp, Homo sapiens
acctcccagaaagttttgcagg

SEQ ID NO: 9120308 - DNA, 22 bp, Homo sapiens
agggtcagtgatgagggagccc

SEQ ID NO: 9120309 - DNA, 21 bp, Homo sapiens
aggggcccttgccaggacgcc

SEQ ID NO: 9120310 - DNA, 22 bp, Homo sapiens
atggacaggcttataacagcaa

SEQ ID NO: 9120311 - DNA, 22 bp, Homo sapiens
agagctctgcagctggcctcag

SEQ ID NO: 9120312 - DNA, 22 bp, Homo sapiens
agagccagcatttgggccctgc

SEQ ID NO: 9120313 - DNA, 22 bp, Homo sapiens
atgattcttttggatagatgat

SEQ ID NO: 9120314 - DNA, 18 bp, Homo sapiens
atgcttctgatagaagca

SEQ ID NO: 9120315 - DNA, 22 bp, Homo sapiens
agataaattcctaagatttcag

SEQ ID NO: 9120316 - DNA, 22 bp, Homo sapiens
attgaaaccctggattgtccta

SEQ ID NO: 9120317 - DNA, 22 bp, Homo sapiens
attgaaacctgctcaggctctc

SEQ ID NO: 9120318 - DNA, 22 bp, Homo sapiens
attgaaagataggctactgtgg

SEQ ID NO: 9120319 - DNA, 22 bp, Homo sapiens
attgaaagatatactgttctca

SEQ ID NO: 9120320 - DNA, 22 bp, Homo sapiens
attatttctcactcacataata

SEQ ID NO: 9120321 - DNA, 22 bp, Homo sapiens
attcgacaaccttgttttgtac

SEQ ID NO: 9120322 - DNA, 22 bp, Homo sapiens
attcgacaaccttgttttgtac

SEQ ID NO: 9120323 - DNA, 22 bp, Homo sapiens
agatttatgtggtcacactcag

SEQ ID NO: 9120324 - DNA, 22 bp, Homo sapiens
attttctgtaactatttctata

SEQ ID NO: 9120325 - DNA, 21 bp, Homo sapiens
attttctgtgatagctgtctc

SEQ ID NO: 9120326 - DNA, 23 bp, Homo sapiens
agcaatctgtgtttcagcaagcc

SEQ ID NO: 9120327 - DNA, 22 bp, Homo sapiens
caagggctcaaacggtggttgc

SEQ ID NO: 9120328 - DNA, 22 bp, Homo sapiens
caagggcttcaagtggccaaga

SEQ ID NO: 9120329 - DNA, 22 bp, Homo sapiens
caagggctctaagtcacaagat

SEQ ID NO: 9120330 - DNA, 22 bp, Homo sapiens
caaggaaaacagatgatcaaca

SEQ ID NO: 9120331 - DNA, 22 bp, Homo sapiens
caaggaagttttaggagaggaa

SEQ ID NO: 9120332 - DNA, 22 bp, Homo sapiens
caaggaaggagagatgatgggt

SEQ ID NO: 9120333 - DNA, 22 bp, Homo sapiens
cacacatggttccgcaggatgc

SEQ ID NO: 9120334 - DNA, 22 bp, Homo sapiens
cacacttgcttcagagtcaagt

SEQ ID NO: 9120335 - DNA, 22 bp, Homo sapiens
cacacttttctggctcaggctc

SEQ ID NO: 9120336 - DNA, 22 bp, Homo sapiens
cacactttcaggtcctctttgc

SEQ ID NO: 9120337 - DNA, 22 bp, Homo sapiens
cacagcagcatcatttatctgg

SEQ ID NO: 9120338 - DNA, 22 bp, Homo sapiens
cacagcagcgttcctccgtgtg

SEQ ID NO: 9120339 - DNA, 22 bp, Homo sapiens
cagaaacttttgatgagtgtat

SEQ ID NO: 9120340 - DNA, 22 bp, Homo sapiens
cagaaactttggccctcaagcc

SEQ ID NO: 9120341 - DNA, 22 bp, Homo sapiens
cagaaacttctggtgtcaaata

SEQ ID NO: 9120342 - DNA, 22 bp, Homo sapiens
cagaaactgcttgtggtcatct

SEQ ID NO: 9120343 - DNA, 22 bp, Homo sapiens
cagaaactatgtaagaaagtga

SEQ ID NO: 9120344 - DNA, 22 bp, Homo sapiens
cacaggctccggccttgcagcc

SEQ ID NO: 9120345 - DNA, 22 bp, Homo sapiens
cacatgaagacctaattggatt

SEQ ID NO: 9120346 - DNA, 22 bp, Homo sapiens
cacattgcaggttgagaaggtg

SEQ ID NO: 9120347 - DNA, 21 bp, Homo sapiens
cacattgaatacagagatgga

SEQ ID NO: 9120348 - DNA, 22 bp, Homo sapiens
cagagtgatttgatgagttgca

SEQ ID NO: 9120349 - DNA, 22 bp, Homo sapiens
cagagtgattatggaggattgc

SEQ ID NO: 9120350 - DNA, 22 bp, Homo sapiens
cagagtggcatgaatgaagcct

SEQ ID NO: 9120351 - DNA, 22 bp, Homo sapiens
agccctcctggggccacgctgg

SEQ ID NO: 9120352 - DNA, 18 bp, Homo sapiens
cagagtgggccaagagac

SEQ ID NO: 9120353 - DNA, 22 bp, Homo sapiens
agccctcctttgttcatgctgc

SEQ ID NO: 9120354 - DNA, 22 bp, Homo sapiens
agcccttcaagagctctgtcct

SEQ ID NO: 9120355 - DNA, 22 bp, Homo sapiens
agcccttcaacctgcctactcc

SEQ ID NO: 9120356 - DNA, 20 bp, Homo sapiens
agccaagaacaggcagaacc

SEQ ID NO: 9120357 - DNA, 22 bp, Homo sapiens
agccaagaggagcctaaagcga

SEQ ID NO: 9120358 - DNA, 22 bp, Homo sapiens
agcgagggaggtctgaggacag

SEQ ID NO: 9120359 - DNA, 22 bp, Homo sapiens
cagcactttagcggaggcatca

SEQ ID NO: 9120360 - DNA, 22 bp, Homo sapiens
cagctgccagcttctctccatc

SEQ ID NO: 9120361 - DNA, 22 bp, Homo sapiens
cagccttctgaatgaacgtact

SEQ ID NO: 9120362 - DNA, 22 bp, Homo sapiens
cagccttcgacagttggagtag

SEQ ID NO: 9120363 - DNA, 22 bp, Homo sapiens
cagcctttcttgactgtgtgtt

SEQ ID NO: 9120364 - DNA, 22 bp, Homo sapiens
aaagttctttctcttatttggt

SEQ ID NO: 9120365 - DNA, 23 bp, Homo sapiens
aaatattcttttttagtaagtgc

SEQ ID NO: 9120366 - DNA, 22 bp, Homo sapiens
aaagttcttcatttttattgga

SEQ ID NO: 9120367 - DNA, 22 bp, Homo sapiens
aacttctgcttttacaggcagt

SEQ ID NO: 9120368 - DNA, 22 bp, Homo sapiens
aacttctctgaagtgacctgtt

SEQ ID NO: 9120369 - DNA, 22 bp, Homo sapiens
aaagtcctgactgcaggggatg

SEQ ID NO: 9120370 - DNA, 22 bp, Homo sapiens
aaagtcctagcgatccacagaa

SEQ ID NO: 9120371 - DNA, 22 bp, Homo sapiens
aaagggaactctaattatcttc

SEQ ID NO: 9120372 - DNA, 22 bp, Homo sapiens
aaagggaagttgcacatgttcc

SEQ ID NO: 9120373 - DNA, 22 bp, Homo sapiens
aaagggaaaatatttagacata

SEQ ID NO: 9120374 - DNA, 22 bp, Homo sapiens
aaagggaatgtgtaggacatgt

SEQ ID NO: 9120375 - DNA, 22 bp, Homo sapiens
aaaggctctattgttttcatat

SEQ ID NO: 9120376 - DNA, 22 bp, Homo sapiens
aaaggctatgatagtccagtgg

SEQ ID NO: 9120377 - DNA, 22 bp, Homo sapiens
aaattcatttttcttagtgtgc

SEQ ID NO: 9120378 - DNA, 22 bp, Homo sapiens
aaaatgtaaagcttgagtgtag

SEQ ID NO: 9120379 - DNA, 22 bp, Homo sapiens
aaaagttacctctgtaatataa

SEQ ID NO: 9120380 - DNA, 22 bp, Homo sapiens
aaaagctctttctgctgtagat

SEQ ID NO: 9120381 - DNA, 22 bp, Homo sapiens
aaaagctcattgataaaaagtc

SEQ ID NO: 9120382 - DNA, 22 bp, Homo sapiens
aaaagcaggtactcagcttggg

SEQ ID NO: 9120383 - DNA, 22 bp, Homo sapiens
aaaaatttatggttcttctctg

SEQ ID NO: 9120384 - DNA, 22 bp, Homo sapiens
aaacttcagggaataaaagagt

SEQ ID NO: 9120385 - DNA, 22 bp, Homo sapiens
aaacttcatggataatataaag

SEQ ID NO: 9120386 - DNA, 22 bp, Homo sapiens
aaactgttgtggtttatcatta

SEQ ID NO: 9120387 - DNA, 19 bp, Homo sapiens
aaagttttattctcatttg

SEQ ID NO: 9120388 - DNA, 22 bp, Homo sapiens
aaagctctcccactgtatgaag

SEQ ID NO: 9120389 - DNA, 22 bp, Homo sapiens
aaagctctaagagaggtaggta

SEQ ID NO: 9120390 - DNA, 22 bp, Homo sapiens
aaagctctgagaagcactgcaa

SEQ ID NO: 9120391 - DNA, 22 bp, Homo sapiens
aaagctctctgaacaccagacc

SEQ ID NO: 9120392 - DNA, 22 bp, Homo sapiens
aaagctctgggaatgcttatct

SEQ ID NO: 9120393 - DNA, 22 bp, Homo sapiens
aaagctctggtttggagcattt

SEQ ID NO: 9120394 - DNA, 22 bp, Homo sapiens
aaagctctggaagattaggtaa

SEQ ID NO: 9120395 - DNA, 23 bp, Homo sapiens
aaagctctgctgcatgtagaata

SEQ ID NO: 9120396 - DNA, 22 bp, Homo sapiens
aaagctcttaatgagattatcc

SEQ ID NO: 9120397 - DNA, 22 bp, Homo sapiens
aaagctcttaaattgacctgct

SEQ ID NO: 9120398 - DNA, 22 bp, Homo sapiens
aaagctatgaggcatgcatttc

SEQ ID NO: 9120399 - DNA, 22 bp, Homo sapiens
aataatgtaggatgataaatga

SEQ ID NO: 9120400 - DNA, 22 bp, Homo sapiens
aatattgagaaccagcatgttt

SEQ ID NO: 9120401 - DNA, 22 bp, Homo sapiens
aatgcacatatatgtgtataca

SEQ ID NO: 9120402 - DNA, 20 bp, Homo sapiens
aacttgtcttcctgtttggc

SEQ ID NO: 9120403 - DNA, 22 bp, Homo sapiens
aactttacttgaaagaacatgt

SEQ ID NO: 9120404 - DNA, 22 bp, Homo sapiens
aagtgcttaaaagggtggtcta

SEQ ID NO: 9120405 - DNA, 22 bp, Homo sapiens
aagggcaggcagagatcatata

SEQ ID NO: 9120406 - DNA, 22 bp, Homo sapiens
aagggcaggaaaagatggatgt

SEQ ID NO: 9120407 - DNA, 22 bp, Homo sapiens
aaatggaagctatttatgattc

SEQ ID NO: 9120408 - DNA, 20 bp, Homo sapiens
aaatggcacatgggaagtcc

SEQ ID NO: 9120409 - DNA, 22 bp, Homo sapiens
aaatggcaacagaagggagttc

SEQ ID NO: 9120410 - DNA, 22 bp, Homo sapiens
acacttgaggaatgtggtgatt

SEQ ID NO: 9120411 - DNA, 22 bp, Homo sapiens
acacttggagcaacacttatgg

SEQ ID NO: 9120412 - DNA, 22 bp, Homo sapiens
acagacatttaataaatgctga

SEQ ID NO: 9120413 - DNA, 22 bp, Homo sapiens
aagccctcattagccatagccc

SEQ ID NO: 9120414 - DNA, 22 bp, Homo sapiens
acagctgctgcttctcactggg

SEQ ID NO: 9120415 - DNA, 22 bp, Homo sapiens
acaatgttctacatatacataa

SEQ ID NO: 9120416 - DNA, 22 bp, Homo sapiens
acaacaaaatcactagtcttcc

SEQ ID NO: 9120417 - DNA, 22 bp, Homo sapiens
acctctggacactgcatccttc

SEQ ID NO: 9120418 - DNA, 22 bp, Homo sapiens
aagtccctggtgctggctgcgc

SEQ ID NO: 9120419 - DNA, 22 bp, Homo sapiens
acctctggccaagactcgtgtt

SEQ ID NO: 9120420 - DNA, 22 bp, Homo sapiens
aagggtgctgctatcaggaagc

SEQ ID NO: 9120421 - DNA, 22 bp, Homo sapiens
aagggtggatttctgagctcta

SEQ ID NO: 9120422 - DNA, 22 bp, Homo sapiens
aagggtgggcaccgccaggtca

SEQ ID NO: 9120423 - DNA, 22 bp, Homo sapiens
aagggtgcccaggagatggact

SEQ ID NO: 9120424 - DNA, 22 bp, Homo sapiens
aagggtgcattgcgcggggctg

SEQ ID NO: 9120425 - DNA, 22 bp, Homo sapiens
aagggtgcgacctaggagtgag

SEQ ID NO: 9120426 - DNA, 22 bp, Homo sapiens
aaggggtgagcagaggcttcgc

SEQ ID NO: 9120427 - DNA, 20 bp, Homo sapiens
aagggcagagggaacagact

SEQ ID NO: 9120428 - DNA, 22 bp, Homo sapiens
aagggctggagaggaaaggttg

SEQ ID NO: 9120429 - DNA, 22 bp, Homo sapiens
aaggaagggaaatagtgatgtc

SEQ ID NO: 9120430 - DNA, 22 bp, Homo sapiens
aagcttcttagaatgcatgtgc

SEQ ID NO: 9120431 - DNA, 22 bp, Homo sapiens
acatgaatatatgaagttcaac

SEQ ID NO: 9120432 - DNA, 22 bp, Homo sapiens
acatgaaattctagctgaaccc

SEQ ID NO: 9120433 - DNA, 22 bp, Homo sapiens
acatgaaatgcagcctgtaacc

SEQ ID NO: 9120434 - DNA, 22 bp, Homo sapiens
aatagctcacggttagtgtagg

SEQ ID NO: 9120435 - DNA, 22 bp, Homo sapiens
acttttatgataatcaatgttc

SEQ ID NO: 9120436 - DNA, 22 bp, Homo sapiens
acttttatcaaggaagtgatct

SEQ ID NO: 9120437 - DNA, 22 bp, Homo sapiens
actcttttataaagcatcttga

SEQ ID NO: 9120438 - DNA, 22 bp, Homo sapiens
actcttttatgcattccttcag

SEQ ID NO: 9120439 - DNA, 19 bp, Homo sapiens
actcttttccttttgaatc

SEQ ID NO: 9120440 - DNA, 22 bp, Homo sapiens
aagtgtgacactgtgttaatta

SEQ ID NO: 9120441 - DNA, 22 bp, Homo sapiens
aagtgtgatttgtagaatgcct

SEQ ID NO: 9120442 - DNA, 22 bp, Homo sapiens
aagtgtgaattttagagtcagg

SEQ ID NO: 9120443 - DNA, 22 bp, Homo sapiens
actggctgagttgcttcagcaa

SEQ ID NO: 9120444 - DNA, 20 bp, Homo sapiens
agatctttgggttgtcatat

SEQ ID NO: 9120445 - DNA, 22 bp, Homo sapiens
agatgctgcctctcctcacaag

SEQ ID NO: 9120446 - DNA, 22 bp, Homo sapiens
agatgcagagtttgctgtggac

SEQ ID NO: 9120447 - DNA, 22 bp, Homo sapiens
agatgcagaaaaactaagtgat

SEQ ID NO: 9120448 - DNA, 21 bp, Homo sapiens
agatgcagtttgcaggtgggt

SEQ ID NO: 9120449 - DNA, 22 bp, Homo sapiens
aatttgacagcaatagaagatt

SEQ ID NO: 9120450 - DNA, 22 bp, Homo sapiens
aatttgattcagcaaatgttca

SEQ ID NO: 9120451 - DNA, 19 bp, Homo sapiens
acaatagaaaagtcttttg

SEQ ID NO: 9120452 - DNA, 22 bp, Homo sapiens
agcaaagtagctgctgttctta

SEQ ID NO: 9120453 - DNA, 22 bp, Homo sapiens
aatgtattatacataatttgtg

SEQ ID NO: 9120454 - DNA, 22 bp, Homo sapiens
agaggacaaaatgagaagtgct

SEQ ID NO: 9120455 - DNA, 22 bp, Homo sapiens
agaggcaaaaatctatggcaac

SEQ ID NO: 9120456 - DNA, 22 bp, Homo sapiens
aatttccagatcagatgactca

SEQ ID NO: 9120457 - DNA, 19 bp, Homo sapiens
acacaatgacacatatata

SEQ ID NO: 9120458 - DNA, 22 bp, Homo sapiens
acacaatgattcacaagcagca

SEQ ID NO: 9120459 - DNA, 22 bp, Homo sapiens
acagaagcagcgcggctcttct

SEQ ID NO: 9120460 - DNA, 23 bp, Homo sapiens
acagaagccaggagccgctgggc

SEQ ID NO: 9120461 - DNA, 22 bp, Homo sapiens
acagaagcctttggccatttga

SEQ ID NO: 9120462 - DNA, 21 bp, Homo sapiens
acagaagcggcgagtggcccc

SEQ ID NO: 9120463 - DNA, 22 bp, Homo sapiens
acagaggtcatggagagttctc

SEQ ID NO: 9120464 - DNA, 21 bp, Homo sapiens
acagcagcaatctgtctttcc

SEQ ID NO: 9120465 - DNA, 22 bp, Homo sapiens
acagcagagtgtgagatagcca

SEQ ID NO: 9120466 - DNA, 22 bp, Homo sapiens
acagcagagtggagatgagcac

SEQ ID NO: 9120467 - DNA, 22 bp, Homo sapiens
tcattgaacgaagagctccatt

SEQ ID NO: 9120468 - DNA, 16 bp, Homo sapiens
tcattgaagacagtac

SEQ ID NO: 9120469 - DNA, 22 bp, Homo sapiens
tcattacagagatataatctac

SEQ ID NO: 9120470 - DNA, 22 bp, Homo sapiens
tcatatgattgtaatgagaata

SEQ ID NO: 9120471 - DNA, 22 bp, Homo sapiens
tcagctcactctgcttcctggg

SEQ ID NO: 9120472 - DNA, 21 bp, Homo sapiens
tcagctcaaatgtcgcttcct

SEQ ID NO: 9120473 - DNA, 17 bp, Homo sapiens
tcagctcagagcacctg

SEQ ID NO: 9120474 - DNA, 22 bp, Homo sapiens
tcagcactttttaaagcagcat

SEQ ID NO: 9120475 - DNA, 22 bp, Homo sapiens
tcagcactgtgtccagtctccc

SEQ ID NO: 9120476 - DNA, 22 bp, Homo sapiens
tcagcactttgaagcagaagga

SEQ ID NO: 9120477 - DNA, 22 bp, Homo sapiens
tcagcacttggatttcagagat

SEQ ID NO: 9120478 - DNA, 22 bp, Homo sapiens
tcaataaatccctctgaccctg

SEQ ID NO: 9120479 - DNA, 22 bp, Homo sapiens
tcaataaatagcttggctcagc

SEQ ID NO: 9120480 - DNA, 22 bp, Homo sapiens
tcaataaaattgttttcctatc

SEQ ID NO: 9120481 - DNA, 22 bp, Homo sapiens
tcaaggtgctgtgctgtgctag

SEQ ID NO: 9120482 - DNA, 22 bp, Homo sapiens
tcaagtattattacagatgtag

SEQ ID NO: 9120483 - DNA, 22 bp, Homo sapiens
tcacaagagctggactgtcttt

SEQ ID NO: 9120484 - DNA, 22 bp, Homo sapiens
tcacaaaggatgatgaattctg

SEQ ID NO: 9120485 - DNA, 20 bp, Homo sapiens
tcacacatggtaagctatga

SEQ ID NO: 9120486 - DNA, 22 bp, Homo sapiens
tcacagaagcttgaagattttc

SEQ ID NO: 9120487 - DNA, 22 bp, Homo sapiens
tcacaggataaggtggcatcac

SEQ ID NO: 9120488 - DNA, 18 bp, Homo sapiens
tcactgagccgcctctct

SEQ ID NO: 9120489 - DNA, 23 bp, Homo sapiens
tcactgatgttacagcagccagt

SEQ ID NO: 9120490 - DNA, 22 bp, Homo sapiens
tcactttagatcttcatctctt

SEQ ID NO: 9120491 - DNA, 22 bp, Homo sapiens
tcacattttcaaaagctggtgc

SEQ ID NO: 9120492 - DNA, 22 bp, Homo sapiens
tcacattttccttggtatctgt

SEQ ID NO: 9120493 - DNA, 22 bp, Homo sapiens
tcacattttcatattctctgag

SEQ ID NO: 9120494 - DNA, 22 bp, Homo sapiens
tcacattttctactactgtacg

SEQ ID NO: 9120495 - DNA, 22 bp, Homo sapiens
tcacattttttactggacttaa

SEQ ID NO: 9120496 - DNA, 22 bp, Homo sapiens
tcaccaggactgagaccttggg

SEQ ID NO: 9120497 - DNA, 22 bp, Homo sapiens
tcaccagacagttactgcatgt

SEQ ID NO: 9120498 - DNA, 22 bp, Homo sapiens
tcaccaggattcctatcagtag

SEQ ID NO: 9120499 - DNA, 22 bp, Homo sapiens
tcacccaggctggagtgcagtg

SEQ ID NO: 9120500 - DNA, 22 bp, Homo sapiens
tcacccaggctggtgcgcagtg

SEQ ID NO: 9120501 - DNA, 22 bp, Homo sapiens
tcagaaaagagaaaatcttata

SEQ ID NO: 9120502 - DNA, 22 bp, Homo sapiens
tcacttttgatccctatgcagt

SEQ ID NO: 9120503 - DNA, 22 bp, Homo sapiens
tcactttttgatatcattctgc

SEQ ID NO: 9120504 - DNA, 22 bp, Homo sapiens
tcagcactggcgctgggcaggt

SEQ ID NO: 9120505 - DNA, 22 bp, Homo sapiens
tcagcacttactagtggccttt

SEQ ID NO: 9120506 - DNA, 22 bp, Homo sapiens
tcagagcactggtgctaccttg

SEQ ID NO: 9120507 - DNA, 22 bp, Homo sapiens
tccaggctggaaatgtcaaact

SEQ ID NO: 9120508 - DNA, 22 bp, Homo sapiens
tcccacacttgaaacaaggctg

SEQ ID NO: 9120509 - DNA, 22 bp, Homo sapiens
tcccaaggtgctcggcaacagg

SEQ ID NO: 9120510 - DNA, 20 bp, Homo sapiens
tcccaagggctgagaggatc

SEQ ID NO: 9120511 - DNA, 20 bp, Homo sapiens
tcccaaggatgcctgggtgt

SEQ ID NO: 9120512 - DNA, 22 bp, Homo sapiens
tcccaaggcacagggcagggac

SEQ ID NO: 9120513 - DNA, 22 bp, Homo sapiens
tcccaaggataagagagtctga

SEQ ID NO: 9120514 - DNA, 22 bp, Homo sapiens
tcccaagccctggatgcctcag

SEQ ID NO: 9120515 - DNA, 22 bp, Homo sapiens
tccagaggtatgtagagagtat

SEQ ID NO: 9120516 - DNA, 22 bp, Homo sapiens
tccagagggcgatggctggggg

SEQ ID NO: 9120517 - DNA, 22 bp, Homo sapiens
tcattgaatatggggccataca

SEQ ID NO: 9120518 - DNA, 22 bp, Homo sapiens
tcattgaatgagatgcaataga

SEQ ID NO: 9120519 - DNA, 22 bp, Homo sapiens
tcattgaatgctctgcaggttg

SEQ ID NO: 9120520 - DNA, 22 bp, Homo sapiens
tcattgaattctgggggttgag

SEQ ID NO: 9120521 - DNA, 22 bp, Homo sapiens
tcattgaagcattttgtgtatt

SEQ ID NO: 9120522 - DNA, 22 bp, Homo sapiens
tcattgaagacttactggcttc

SEQ ID NO: 9120523 - DNA, 22 bp, Homo sapiens
tcattgaatacatatttgggat

SEQ ID NO: 9120524 - DNA, 22 bp, Homo sapiens
tcattgaagtgactgaaagatt

SEQ ID NO: 9120525 - DNA, 22 bp, Homo sapiens
tcattgaagcccttgacaagcc

SEQ ID NO: 9120526 - DNA, 22 bp, Homo sapiens
tcattgaatttggttcaatatg

SEQ ID NO: 9120527 - DNA, 22 bp, Homo sapiens
tcattgaatttcacagctttat

SEQ ID NO: 9120528 - DNA, 23 bp, Homo sapiens
tcccatgggctcactgccctgca

SEQ ID NO: 9120529 - DNA, 22 bp, Homo sapiens
tcccagggattaggacatggat

SEQ ID NO: 9120530 - DNA, 22 bp, Homo sapiens
tcccagggatcctccgggtcgc

SEQ ID NO: 9120531 - DNA, 22 bp, Homo sapiens
tcccagggttacagccagggca

SEQ ID NO: 9120532 - DNA, 22 bp, Homo sapiens
tcccacaggtggagcttgcagt

SEQ ID NO: 9120533 - DNA, 22 bp, Homo sapiens
tcccacagtctcacaatgcata

SEQ ID NO: 9120534 - DNA, 22 bp, Homo sapiens
tccccaggggcctgggcacagt

SEQ ID NO: 9120535 - DNA, 22 bp, Homo sapiens
tccccaaagctttgtggtcagg

SEQ ID NO: 9120536 - DNA, 22 bp, Homo sapiens
tattcattatgaccaaatctag

SEQ ID NO: 9120537 - DNA, 22 bp, Homo sapiens
tatttattggacagtgttgctg

SEQ ID NO: 9120538 - DNA, 22 bp, Homo sapiens
tattacatccacttttattgca

SEQ ID NO: 9120539 - DNA, 22 bp, Homo sapiens
tatagtgtgaggtaagggtcca

SEQ ID NO: 9120540 - DNA, 22 bp, Homo sapiens
tagaatgtagtgcttcaagatt

SEQ ID NO: 9120541 - DNA, 22 bp, Homo sapiens
tagaaactcacgttatcattgc

SEQ ID NO: 9120542 - DNA, 22 bp, Homo sapiens
tagggagaggaagcaggccgct

SEQ ID NO: 9120543 - DNA, 22 bp, Homo sapiens
tagctcttcacctctaggcact

SEQ ID NO: 9120544 - DNA, 22 bp, Homo sapiens
tagctcttcaatcactgtctcc

SEQ ID NO: 9120545 - DNA, 22 bp, Homo sapiens
tagctcttaagtctgtgataga

SEQ ID NO: 9120546 - DNA, 22 bp, Homo sapiens
tagctcttaccaggtggccatg

SEQ ID NO: 9120547 - DNA, 22 bp, Homo sapiens
tagctcttaggtgcgtggctct

SEQ ID NO: 9120548 - DNA, 22 bp, Homo sapiens
tagctttaatgagttggtaaga

SEQ ID NO: 9120549 - DNA, 22 bp, Homo sapiens
tagctcttttataggaactctg

SEQ ID NO: 9120550 - DNA, 22 bp, Homo sapiens
tagctcttttaatccttaggac

SEQ ID NO: 9120551 - DNA, 22 bp, Homo sapiens
tagctctttgtacaagtagatg

SEQ ID NO: 9120552 - DNA, 22 bp, Homo sapiens
tagctctttgagattggttctt

SEQ ID NO: 9120553 - DNA, 22 bp, Homo sapiens
tagctcttgatgctggcaggac

SEQ ID NO: 9120554 - DNA, 22 bp, Homo sapiens
tagctcttctaatggtaaagag

SEQ ID NO: 9120555 - DNA, 22 bp, Homo sapiens
tagctcttcatttcatctgatt

SEQ ID NO: 9120556 - DNA, 22 bp, Homo sapiens
tagctcttcaggtgcctttcac

SEQ ID NO: 9120557 - DNA, 22 bp, Homo sapiens
tagctctttattaaggcccaga

SEQ ID NO: 9120558 - DNA, 18 bp, Homo sapiens
tagctcttgttggtccat

SEQ ID NO: 9120559 - DNA, 22 bp, Homo sapiens
tagctcttgtgttttacatata

SEQ ID NO: 9120560 - DNA, 22 bp, Homo sapiens
tagctcttggaacgtgttaatt

SEQ ID NO: 9120561 - DNA, 22 bp, Homo sapiens
tagctcttgccatctgtcttat

SEQ ID NO: 9120562 - DNA, 22 bp, Homo sapiens
tagctcttgccagatcctcgat

SEQ ID NO: 9120563 - DNA, 22 bp, Homo sapiens
tacattgaaagtcatttaatcc

SEQ ID NO: 9120564 - DNA, 22 bp, Homo sapiens
tacagaaagggatgattgatct

SEQ ID NO: 9120565 - DNA, 20 bp, Homo sapiens
tacagaaacaggacttttgg

SEQ ID NO: 9120566 - DNA, 22 bp, Homo sapiens
taatgtttgagatgttggattt

SEQ ID NO: 9120567 - DNA, 22 bp, Homo sapiens
taatgtttccagtctatgatgg

SEQ ID NO: 9120568 - DNA, 22 bp, Homo sapiens
gttgggagcagcagaccaagag

SEQ ID NO: 9120569 - DNA, 22 bp, Homo sapiens
gttcattctgaaaagcagcttg

SEQ ID NO: 9120570 - DNA, 22 bp, Homo sapiens
gtgtgccagacatgatgctatg

SEQ ID NO: 9120571 - DNA, 18 bp, Homo sapiens
gtgtggctgagatgaggc

SEQ ID NO: 9120572 - DNA, 22 bp, Homo sapiens
gtgtggctgattgacatggtca

SEQ ID NO: 9120573 - DNA, 21 bp, Homo sapiens
gttttgctggtatctggggat

SEQ ID NO: 9120574 - DNA, 21 bp, Homo sapiens
gttttctttgatagagggaag

SEQ ID NO: 9120575 - DNA, 22 bp, Homo sapiens
taaaatgtagcttctaggctgg

SEQ ID NO: 9120576 - DNA, 22 bp, Homo sapiens
taaacaagctggactgataagt

SEQ ID NO: 9120577 - DNA, 22 bp, Homo sapiens
taaaatgtttgcaagagaccag

SEQ ID NO: 9120578 - DNA, 22 bp, Homo sapiens
taaaatttgtccctgagtgttg

SEQ ID NO: 9120579 - DNA, 22 bp, Homo sapiens
taaatttacccaaggaacatgt

SEQ ID NO: 9120580 - DNA, 18 bp, Homo sapiens
taacccagagggtgactt

SEQ ID NO: 9120581 - DNA, 22 bp, Homo sapiens
gcctcccttggtgtctcccggg

SEQ ID NO: 9120582 - DNA, 22 bp, Homo sapiens
gcctctgggctctgcccctggc

SEQ ID NO: 9120583 - DNA, 22 bp, Homo sapiens
gcctctggcttctgcatcagtg

SEQ ID NO: 9120584 - DNA, 22 bp, Homo sapiens
gcctctggagttgcttgtaaat

SEQ ID NO: 9120585 - DNA, 22 bp, Homo sapiens
gcagtggcccagcttgcaggct

SEQ ID NO: 9120586 - DNA, 22 bp, Homo sapiens
gccaccaggagcccagtccaaa

SEQ ID NO: 9120587 - DNA, 22 bp, Homo sapiens
gccaccagtgggggcctgggca

SEQ ID NO: 9120588 - DNA, 21 bp, Homo sapiens
gccagcctgtttacctgtggt

SEQ ID NO: 9120589 - DNA, 22 bp, Homo sapiens
gcagggcttgcagcagctagac

SEQ ID NO: 9120590 - DNA, 22 bp, Homo sapiens
gcagccctgcaggcagctccag

SEQ ID NO: 9120591 - DNA, 22 bp, Homo sapiens
gcagccctcgggtactcacgtg

SEQ ID NO: 9120592 - DNA, 22 bp, Homo sapiens
gcagccctcttggtcactaggc

SEQ ID NO: 9120593 - DNA, 22 bp, Homo sapiens
gcagccctgcagctccacaccg

SEQ ID NO: 9120594 - DNA, 22 bp, Homo sapiens
gcagccctcgctagctctcccc

SEQ ID NO: 9120595 - DNA, 22 bp, Homo sapiens
gaggccattcagctgggcagca

SEQ ID NO: 9120596 - DNA, 22 bp, Homo sapiens
gctgagagcaaagcatgtctag

SEQ ID NO: 9120597 - DNA, 22 bp, Homo sapiens
gctgagagcagtgtggccttaa

SEQ ID NO: 9120598 - DNA, 22 bp, Homo sapiens
gctgagagaaaagtgaggttct

SEQ ID NO: 9120599 - DNA, 18 bp, Homo sapiens
gctctggctcacctccag

SEQ ID NO: 9120600 - DNA, 22 bp, Homo sapiens
gctgcgccggatcccacgttcc

SEQ ID NO: 9120601 - DNA, 22 bp, Homo sapiens
gctcagcactttctccaaccac

SEQ ID NO: 9120602 - DNA, 22 bp, Homo sapiens
gctccagtgaccatcgttttag

SEQ ID NO: 9120603 - DNA, 22 bp, Homo sapiens
gctacagactgagcatggctct

SEQ ID NO: 9120604 - DNA, 22 bp, Homo sapiens
gcgggttttgtgaatgtaggtt

SEQ ID NO: 9120605 - DNA, 22 bp, Homo sapiens
gcctttggagaatccagtcatg

SEQ ID NO: 9120606 - DNA, 22 bp, Homo sapiens
gcgggtttgatgtgctaatgag

SEQ ID NO: 9120607 - DNA, 22 bp, Homo sapiens
gccttgctttgcttctggacag

SEQ ID NO: 9120608 - DNA, 22 bp, Homo sapiens
gcctctggtccctcatgctgtg

SEQ ID NO: 9120609 - DNA, 22 bp, Homo sapiens
gcctctgggttggtgacaggct

SEQ ID NO: 9120610 - DNA, 22 bp, Homo sapiens
gcctctggggttaatagagttt

SEQ ID NO: 9120611 - DNA, 22 bp, Homo sapiens
gcctctgggtgacgaaaggtga

SEQ ID NO: 9120612 - DNA, 22 bp, Homo sapiens
gcctctggggcagctgagtcat

SEQ ID NO: 9120613 - DNA, 22 bp, Homo sapiens
gcctctgggggctcagacctgt

SEQ ID NO: 9120614 - DNA, 22 bp, Homo sapiens
gctggctggaggtgaggaagaa

SEQ ID NO: 9120615 - DNA, 22 bp, Homo sapiens
gctggctggagtaaggagggag

SEQ ID NO: 9120616 - DNA, 23 bp, Homo sapiens
gctggctggcagtaaaggttgtt

SEQ ID NO: 9120617 - DNA, 22 bp, Homo sapiens
gctggctggaggagggaggttg

SEQ ID NO: 9120618 - DNA, 19 bp, Homo sapiens
gctggctggaggagggaca

SEQ ID NO: 9120619 - DNA, 22 bp, Homo sapiens
gctggctggaatgggagaagaa

SEQ ID NO: 9120620 - DNA, 22 bp, Homo sapiens
gctggctggaactagcagttgg

SEQ ID NO: 9120621 - DNA, 22 bp, Homo sapiens
gctggctgctaggacagctaca

SEQ ID NO: 9120622 - DNA, 22 bp, Homo sapiens
gctggctgctgttgagacttgt

SEQ ID NO: 9120623 - DNA, 22 bp, Homo sapiens
gctggctgccttactttgtgga

SEQ ID NO: 9120624 - DNA, 22 bp, Homo sapiens
gctggcttgacagaggcctggg

SEQ ID NO: 9120625 - DNA, 21 bp, Homo sapiens
gctggctggctgaccggcctt

SEQ ID NO: 9120626 - DNA, 22 bp, Homo sapiens
gctgtggctgtacagagaccat

SEQ ID NO: 9120627 - DNA, 22 bp, Homo sapiens
gctgtggcttgcagctggggct

SEQ ID NO: 9120628 - DNA, 22 bp, Homo sapiens
gctgtggctttctgtttctgtt

SEQ ID NO: 9120629 - DNA, 22 bp, Homo sapiens
gctgtggctccaatggtgagcc

SEQ ID NO: 9120630 - DNA, 22 bp, Homo sapiens
gctgtggctctcacaagcaaat

SEQ ID NO: 9120631 - DNA, 22 bp, Homo sapiens
gctgtggctgaagatgcaggga

SEQ ID NO: 9120632 - DNA, 22 bp, Homo sapiens
gctgtggctgaccaccaggggg

SEQ ID NO: 9120633 - DNA, 22 bp, Homo sapiens
gctgtggctgacattgcagaca

SEQ ID NO: 9120634 - DNA, 19 bp, Homo sapiens
gctgtgcctctctcctgct

SEQ ID NO: 9120635 - DNA, 22 bp, Homo sapiens
gctgtggcggcagcagctggtg

SEQ ID NO: 9120636 - DNA, 22 bp, Homo sapiens
ggacaaaacttcttgcatttct

SEQ ID NO: 9120637 - DNA, 22 bp, Homo sapiens
ggacaaaaatcagccatctcta

SEQ ID NO: 9120638 - DNA, 22 bp, Homo sapiens
ggacaaaatccaaacttcttag

SEQ ID NO: 9120639 - DNA, 19 bp, Homo sapiens
ggcaagcacaaaagctttg

SEQ ID NO: 9120640 - DNA, 22 bp, Homo sapiens
ggcaacctgagcttgtggagaa

SEQ ID NO: 9120641 - DNA, 22 bp, Homo sapiens
ggagtccatgcagcttgagaca

SEQ ID NO: 9120642 - DNA, 22 bp, Homo sapiens
ggagtccataggttcttatggg

SEQ ID NO: 9120643 - DNA, 22 bp, Homo sapiens
ggagtccaaattttttgaatca

SEQ ID NO: 9120644 - DNA, 22 bp, Homo sapiens
ggagtccaccaagtatttcagg

SEQ ID NO: 9120645 - DNA, 23 bp, Homo sapiens
ggcaccaacctctgctccctctt

SEQ ID NO: 9120646 - DNA, 22 bp, Homo sapiens
ggccttggtgccatggccagtt

SEQ ID NO: 9120647 - DNA, 22 bp, Homo sapiens
ggcttgggagcaggcatgtgac

SEQ ID NO: 9120648 - DNA, 22 bp, Homo sapiens
gggacagcagaaagaaggcaag

SEQ ID NO: 9120649 - DNA, 22 bp, Homo sapiens
gggacagccatgtgcagatgcc

SEQ ID NO: 9120650 - DNA, 22 bp, Homo sapiens
gggacagctggtctacctggta

SEQ ID NO: 9120651 - DNA, 22 bp, Homo sapiens
gggacatttgctatcggagttc

SEQ ID NO: 9120652 - DNA, 22 bp, Homo sapiens
gggagaggttacccgagcaact

SEQ ID NO: 9120653 - DNA, 22 bp, Homo sapiens
gggagagtagctggaaggttct

SEQ ID NO: 9120654 - DNA, 22 bp, Homo sapiens
gggcaacagagcgagggcctgt

SEQ ID NO: 9120655 - DNA, 22 bp, Homo sapiens
gggaggacggtccagggcaaag

SEQ ID NO: 9120656 - DNA, 22 bp, Homo sapiens
ggctctgggaaatggtcttcct

SEQ ID NO: 9120657 - DNA, 22 bp, Homo sapiens
ggctctttggcgggccttgaac

SEQ ID NO: 9120658 - DNA, 22 bp, Homo sapiens
ggctctttaacttgtctaaatt

SEQ ID NO: 9120659 - DNA, 22 bp, Homo sapiens
ggctgctgaagtgtggcaatct

SEQ ID NO: 9120660 - DNA, 22 bp, Homo sapiens
gggtggcacaggtgcagagggt

SEQ ID NO: 9120661 - DNA, 22 bp, Homo sapiens
gggtggccttcatagctcaggg

SEQ ID NO: 9120662 - DNA, 22 bp, Homo sapiens
ggtctcagatctttattaaggc

SEQ ID NO: 9120663 - DNA, 22 bp, Homo sapiens
ggtccctggggaactaggctgt

SEQ ID NO: 9120664 - DNA, 22 bp, Homo sapiens
ggtcgccagccctagtctgctg

SEQ ID NO: 9120665 - DNA, 22 bp, Homo sapiens
ggtggctctcttaagggcagcg

SEQ ID NO: 9120666 - DNA, 22 bp, Homo sapiens
ggtggctctctgtcagtgacag

SEQ ID NO: 9120667 - DNA, 22 bp, Homo sapiens
ggtggctcggccagtgcaggcc

SEQ ID NO: 9120668 - DNA, 22 bp, Homo sapiens
ggtgtgggcagatgccctactt

SEQ ID NO: 9120669 - DNA, 21 bp, Homo sapiens
ggtgtgggatggactgaacca

SEQ ID NO: 9120670 - DNA, 22 bp, Homo sapiens
ggtgtgggagagattctttcct

SEQ ID NO: 9120671 - DNA, 22 bp, Homo sapiens
ggtgtgggaactacaggttttt

SEQ ID NO: 9120672 - DNA, 22 bp, Homo sapiens
ggtgtgggggcagctctgatat

SEQ ID NO: 9120673 - DNA, 22 bp, Homo sapiens
ggtgtgggtcagctttattaat

SEQ ID NO: 9120674 - DNA, 22 bp, Homo sapiens
ggtgtgggtccttgtgcttgct

SEQ ID NO: 9120675 - DNA, 22 bp, Homo sapiens
ggtgtgggggcaagtttgagat

SEQ ID NO: 9120676 - DNA, 22 bp, Homo sapiens
ggtgtggggaggttctgcttct

SEQ ID NO: 9120677 - DNA, 22 bp, Homo sapiens
ggtgtgggccctgatgtcagca

SEQ ID NO: 9120678 - DNA, 22 bp, Homo sapiens
ggtggcctgcaagtgcagatgg

SEQ ID NO: 9120679 - DNA, 22 bp, Homo sapiens
ggtggctcaaagagagcacaga

SEQ ID NO: 9120680 - DNA, 21 bp, Homo sapiens
ggtggctcacctgattggata

SEQ ID NO: 9120681 - DNA, 22 bp, Homo sapiens
ggtggcctttcagtggatcagg

SEQ ID NO: 9120682 - DNA, 22 bp, Homo sapiens
ggtggctcagggctccaagcat

SEQ ID NO: 9120683 - DNA, 22 bp, Homo sapiens
ggtggctcccacccagctttga

SEQ ID NO: 9120684 - DNA, 22 bp, Homo sapiens
ggtggctcatttgatcttcata

SEQ ID NO: 9120685 - DNA, 21 bp, Homo sapiens
ggtggctagaaagcagtgaga

SEQ ID NO: 9120686 - DNA, 18 bp, Homo sapiens
ggtggctcagtcatgggg

SEQ ID NO: 9120687 - DNA, 22 bp, Homo sapiens
ggggctggtggtggtttctcca

SEQ ID NO: 9120688 - DNA, 22 bp, Homo sapiens
ggggctgggatttgaacccagg

SEQ ID NO: 9120689 - DNA, 22 bp, Homo sapiens
ggggctggctcactaagagact

SEQ ID NO: 9120690 - DNA, 22 bp, Homo sapiens
gggcttggtggagagaatgctg

SEQ ID NO: 9120691 - DNA, 22 bp, Homo sapiens
gggcttgggtattgtgagaggt

SEQ ID NO: 9120692 - DNA, 22 bp, Homo sapiens
gggctgctgtgttcctgaggca

SEQ ID NO: 9120693 - DNA, 22 bp, Homo sapiens
gggcttggctggggccaccaga

SEQ ID NO: 9120694 - DNA, 19 bp, Homo sapiens
gggcttggggctgaagcct

SEQ ID NO: 9120695 - DNA, 22 bp, Homo sapiens
gggcttggctcataagtggatg

SEQ ID NO: 9120696 - DNA, 22 bp, Homo sapiens
gggcttggccccagaagagcta

SEQ ID NO: 9120697 - DNA, 22 bp, Homo sapiens
gggcttggagtaggctgatgaa

SEQ ID NO: 9120698 - DNA, 22 bp, Homo sapiens
gggcttggcacatgggctcagc

SEQ ID NO: 9120699 - DNA, 20 bp, Homo sapiens
gggcttggaggactcgaggg

SEQ ID NO: 9120700 - DNA, 22 bp, Homo sapiens
gggctgccaagcctgcctgcct

SEQ ID NO: 9120701 - DNA, 22 bp, Homo sapiens
gggccaagggtgcgtggcagga

SEQ ID NO: 9120702 - DNA, 22 bp, Homo sapiens
gtgagactcgcctttgtgtagc

SEQ ID NO: 9120703 - DNA, 22 bp, Homo sapiens
gtctggagggaagagatgtcag

SEQ ID NO: 9120704 - DNA, 22 bp, Homo sapiens
gtccctggaaaagagctggtga

SEQ ID NO: 9120705 - DNA, 22 bp, Homo sapiens
gtcccctcattttagagaaaga

SEQ ID NO: 9120706 - DNA, 22 bp, Homo sapiens
gtcccctcagccacccatgggg

SEQ ID NO: 9120707 - DNA, 22 bp, Homo sapiens
gtcccctcaaaattcatatgtt

SEQ ID NO: 9120708 - DNA, 23 bp, Homo sapiens
gtccagaacccaggctggggtgg

SEQ ID NO: 9120709 - DNA, 22 bp, Homo sapiens
gtccacccatgacacctgcctg

SEQ ID NO: 9120710 - DNA, 22 bp, Homo sapiens
gtccacagagggctgggcaggc

SEQ ID NO: 9120711 - DNA, 22 bp, Homo sapiens
gtattgcatagacctgggatga

SEQ ID NO: 9120712 - DNA, 22 bp, Homo sapiens
ggtttcacaatttagagcagtg

SEQ ID NO: 9120713 - DNA, 22 bp, Homo sapiens
ggttttctccccctcttctcag

SEQ ID NO: 9120714 - DNA, 22 bp, Homo sapiens
ggttttctgctgaagatttcac

SEQ ID NO: 9120715 - DNA, 22 bp, Homo sapiens
cttcagctaggatccctgcagc

SEQ ID NO: 9120716 - DNA, 23 bp, Homo sapiens
ctgtgcccggggctccacctgat

SEQ ID NO: 9120717 - DNA, 22 bp, Homo sapiens
ctgtgccctctttgctggcctt

SEQ ID NO: 9120718 - DNA, 22 bp, Homo sapiens
ctgtgcccggcccagggccctg

SEQ ID NO: 9120719 - DNA, 22 bp, Homo sapiens
ctgtgccccacagagctccaca

SEQ ID NO: 9120720 - DNA, 22 bp, Homo sapiens
ctgtgcccacctggctctgagg

SEQ ID NO: 9120721 - DNA, 22 bp, Homo sapiens
ctgtgcccaggcccctggggat

SEQ ID NO: 9120722 - DNA, 22 bp, Homo sapiens
ctgtgcccagctccctgactgc

SEQ ID NO: 9120723 - DNA, 22 bp, Homo sapiens
ctgtcctgtctgcttttaattt

SEQ ID NO: 9120724 - DNA, 22 bp, Homo sapiens
ctgtcctgtgcattgtcagatg

SEQ ID NO: 9120725 - DNA, 22 bp, Homo sapiens
ctgtcctgaaagggagattggg

SEQ ID NO: 9120726 - DNA, 22 bp, Homo sapiens
ctgtcctgtagctccatcagtc

SEQ ID NO: 9120727 - DNA, 20 bp, Homo sapiens
ctgtcctgatcttttcagaa

SEQ ID NO: 9120728 - DNA, 22 bp, Homo sapiens
ctgtggctgcgccctgggggag

SEQ ID NO: 9120729 - DNA, 23 bp, Homo sapiens
ctgtggctgagtcctgttggagt

SEQ ID NO: 9120730 - DNA, 20 bp, Homo sapiens
ctgtggctcatgcatctgcc

SEQ ID NO: 9120731 - DNA, 22 bp, Homo sapiens
ctgtggctcattcttggtggca

SEQ ID NO: 9120732 - DNA, 22 bp, Homo sapiens
ctgtggctctccaatggaggga

SEQ ID NO: 9120733 - DNA, 22 bp, Homo sapiens
ctgtggctggctcatcataggt

SEQ ID NO: 9120734 - DNA, 19 bp, Homo sapiens
ctgggccagaatcagctca

SEQ ID NO: 9120735 - DNA, 22 bp, Homo sapiens
ctgggctgcatcaaagaggcat

SEQ ID NO: 9120736 - DNA, 20 bp, Homo sapiens
ctgggctgcccagctatggg

SEQ ID NO: 9120737 - DNA, 22 bp, Homo sapiens
ctggggccctgggtctgccctc

SEQ ID NO: 9120738 - DNA, 22 bp, Homo sapiens
ctgggccacaagcctgtgtgat

SEQ ID NO: 9120739 - DNA, 22 bp, Homo sapiens
ctggctcttgcgactcagcttg

SEQ ID NO: 9120740 - DNA, 23 bp, Homo sapiens
ctggctcatcctggttgcagtgg

SEQ ID NO: 9120741 - DNA, 22 bp, Homo sapiens
ctggctcatgtgatgagggcaa

SEQ ID NO: 9120742 - DNA, 22 bp, Homo sapiens
ctggctcagtgccttcagaagt

SEQ ID NO: 9120743 - DNA, 22 bp, Homo sapiens
ctggctcagggtggtctgggtc

SEQ ID NO: 9120744 - DNA, 21 bp, Homo sapiens
ctgccacctgctccatcagca

SEQ ID NO: 9120745 - DNA, 22 bp, Homo sapiens
ctgccaccatgccccagcagag

SEQ ID NO: 9120746 - DNA, 22 bp, Homo sapiens
ctgccagccaggccaggtaggc

SEQ ID NO: 9120747 - DNA, 22 bp, Homo sapiens
gagacaaagcttcctgtgggta

SEQ ID NO: 9120748 - DNA, 22 bp, Homo sapiens
gagccagcagccggcaccacca

SEQ ID NO: 9120749 - DNA, 22 bp, Homo sapiens
gagatgttaactacatagctac

SEQ ID NO: 9120750 - DNA, 22 bp, Homo sapiens
gagatgttctgattaggtttcc

SEQ ID NO: 9120751 - DNA, 22 bp, Homo sapiens
gagatgttgtgggtagttttgg

SEQ ID NO: 9120752 - DNA, 22 bp, Homo sapiens
gagatgttgttcaaagatttta

SEQ ID NO: 9120753 - DNA, 22 bp, Homo sapiens
gagctctttcctgcccatactg

SEQ ID NO: 9120754 - DNA, 22 bp, Homo sapiens
gagctctttcatggttctgtga

SEQ ID NO: 9120755 - DNA, 22 bp, Homo sapiens
gagctctttcagttgactccta

SEQ ID NO: 9120756 - DNA, 22 bp, Homo sapiens
gagctctttgaacctgggcagt

SEQ ID NO: 9120757 - DNA, 22 bp, Homo sapiens
gagctctttcggttgttttcga

SEQ ID NO: 9120758 - DNA, 22 bp, Homo sapiens
gagctcttttgatgaaggtagt

SEQ ID NO: 9120759 - DNA, 22 bp, Homo sapiens
gagctcttttgccagtcactgc

SEQ ID NO: 9120760 - DNA, 22 bp, Homo sapiens
gagctcttccccatcttacatc

SEQ ID NO: 9120761 - DNA, 22 bp, Homo sapiens
gagctcttatagttctagcagt

SEQ ID NO: 9120762 - DNA, 18 bp, Homo sapiens
gagctcttcccttttctc

SEQ ID NO: 9120763 - DNA, 22 bp, Homo sapiens
gagctcttcgcctgtcgctgag

SEQ ID NO: 9120764 - DNA, 22 bp, Homo sapiens
gagctcttcctttcaggaggcc

SEQ ID NO: 9120765 - DNA, 22 bp, Homo sapiens
gagctcttgcttctagtccagg

SEQ ID NO: 9120766 - DNA, 22 bp, Homo sapiens
gagctctttaccaggtcaggac

SEQ ID NO: 9120767 - DNA, 22 bp, Homo sapiens
gagctcttgtagtatgcggtaa

SEQ ID NO: 9120768 - DNA, 22 bp, Homo sapiens
gagctcttctggttagatgttg

SEQ ID NO: 9120769 - DNA, 22 bp, Homo sapiens
gagctcttctaaagatggcaat

SEQ ID NO: 9120770 - DNA, 22 bp, Homo sapiens
gagctcttctggggtaagggac

SEQ ID NO: 9120771 - DNA, 22 bp, Homo sapiens
gagcttcatatgttgcagagaa

SEQ ID NO: 9120772 - DNA, 22 bp, Homo sapiens
gagcttcacgggggacagcatt

SEQ ID NO: 9120773 - DNA, 22 bp, Homo sapiens
gagcctgcccagccctgtccac

SEQ ID NO: 9120774 - DNA, 22 bp, Homo sapiens
gagcctgcaggcctcggcctca

SEQ ID NO: 9120775 - DNA, 22 bp, Homo sapiens
gagctcttagatagggcaggaa

SEQ ID NO: 9120776 - DNA, 22 bp, Homo sapiens
gaggaaaatgcaacaggaatgc

SEQ ID NO: 9120777 - DNA, 22 bp, Homo sapiens
gaggccagcccctcttgaaggc

SEQ ID NO: 9120778 - DNA, 22 bp, Homo sapiens
gaggccagatgtcatgtcttat

SEQ ID NO: 9120779 - DNA, 22 bp, Homo sapiens
gacaaggaaattactagctgga

SEQ ID NO: 9120780 - DNA, 22 bp, Homo sapiens
gacaataaaatgatcttacagt

SEQ ID NO: 9120781 - DNA, 22 bp, Homo sapiens
gacaggcccgagtagctgatga

SEQ ID NO: 9120782 - DNA, 22 bp, Homo sapiens
gacaggccaggggctgaggtgg

SEQ ID NO: 9120783 - DNA, 23 bp, Homo sapiens
gaagccctcattggttctccaga

SEQ ID NO: 9120784 - DNA, 19 bp, Homo sapiens
gaagccctgcattctccgc

SEQ ID NO: 9120785 - DNA, 22 bp, Homo sapiens
gaagacaattctgggtggagga

SEQ ID NO: 9120786 - DNA, 22 bp, Homo sapiens
ctttcataaggggttttataat

SEQ ID NO: 9120787 - DNA, 22 bp, Homo sapiens
cggtggtcataagtggctggcg

SEQ ID NO: 9120788 - DNA, 22 bp, Homo sapiens
cggtgcccggtgccaggcgcgg

SEQ ID NO: 9120789 - DNA, 22 bp, Homo sapiens
cggtctcccgtgtgtgtgcgct

SEQ ID NO: 9120790 - DNA, 22 bp, Homo sapiens
ctaaaattacctaccagtttag

SEQ ID NO: 9120791 - DNA, 22 bp, Homo sapiens
ttcatgaaagtgtatcttgtgg

SEQ ID NO: 9120792 - DNA, 22 bp, Homo sapiens
ttcatgaataccccttctgtaa

SEQ ID NO: 9120793 - DNA, 22 bp, Homo sapiens
ttcagaaagtgaatcttgttat

SEQ ID NO: 9120794 - DNA, 22 bp, Homo sapiens
cgccctccacacagcccctggc

SEQ ID NO: 9120795 - DNA, 22 bp, Homo sapiens
cgccccctcggccacctgcggg

SEQ ID NO: 9120796 - DNA, 22 bp, Homo sapiens
cgccctccacacagcccctggc

SEQ ID NO: 9120797 - DNA, 22 bp, Homo sapiens
ctcacaggtcatgtggtggctt

SEQ ID NO: 9120798 - DNA, 22 bp, Homo sapiens
ctcacagggttctatcgaagag

SEQ ID NO: 9120799 - DNA, 22 bp, Homo sapiens
ctcaaggccagttcttctgact

SEQ ID NO: 9120800 - DNA, 22 bp, Homo sapiens
ctcaagaggatatgtccagaaa

SEQ ID NO: 9120801 - DNA, 22 bp, Homo sapiens
ctatgagaagaaaacaagatta

SEQ ID NO: 9120802 - DNA, 22 bp, Homo sapiens
ctactagatcagtatgcctcaa

SEQ ID NO: 9120803 - DNA, 20 bp, Homo sapiens
ctactttaggcactgagaat

SEQ ID NO: 9120804 - DNA, 22 bp, Homo sapiens
ttctctggactatttgcactcc

SEQ ID NO: 9120805 - DNA, 22 bp, Homo sapiens
ctactttaattttctgcagaga

SEQ ID NO: 9120806 - DNA, 22 bp, Homo sapiens
ctacaggtcaagcagtagctct

SEQ ID NO: 9120807 - DNA, 22 bp, Homo sapiens
ctacagataatggcccagaaca

SEQ ID NO: 9120808 - DNA, 22 bp, Homo sapiens
ccttcccaggctagaccaacat

SEQ ID NO: 9120809 - DNA, 19 bp, Homo sapiens
ccttccccttcagcctctg

SEQ ID NO: 9120810 - DNA, 22 bp, Homo sapiens
ccttccccagtgattctctcag

SEQ ID NO: 9120811 - DNA, 22 bp, Homo sapiens
ccttccccagtgattctctcag

SEQ ID NO: 9120812 - DNA, 20 bp, Homo sapiens
ccttccccacccgctgaggt

SEQ ID NO: 9120813 - DNA, 22 bp, Homo sapiens
ccttccccaggtgctcactgtc

SEQ ID NO: 9120814 - DNA, 22 bp, Homo sapiens
ccttccccaggtgctcactgtc

SEQ ID NO: 9120815 - DNA, 19 bp, Homo sapiens
ccttccccttcagcctctg

SEQ ID NO: 9120816 - DNA, 22 bp, Homo sapiens
ttagaatttctgctcactttga

SEQ ID NO: 9120817 - DNA, 22 bp, Homo sapiens
ccttctagcaaatcaacataaa

SEQ ID NO: 9120818 - DNA, 22 bp, Homo sapiens
ttaaagctgctgaatcctattt

SEQ ID NO: 9120819 - DNA, 22 bp, Homo sapiens
cctgtgccctcagcctggctct

SEQ ID NO: 9120820 - DNA, 22 bp, Homo sapiens
cctgtggcttccacgacctaat

SEQ ID NO: 9120821 - DNA, 22 bp, Homo sapiens
cctgtgggaaaggtctgctctc

SEQ ID NO: 9120822 - DNA, 22 bp, Homo sapiens
cctgtggctggtcaggccagca

SEQ ID NO: 9120823 - DNA, 22 bp, Homo sapiens
cctgtggcttccacgacctaat

SEQ ID NO: 9120824 - DNA, 22 bp, Homo sapiens
cctgggcttacgacctctgact

SEQ ID NO: 9120825 - DNA, 22 bp, Homo sapiens
tggggcagttaataaacattct

SEQ ID NO: 9120826 - DNA, 22 bp, Homo sapiens
tggggcagtggcttttcaccct

SEQ ID NO: 9120827 - DNA, 22 bp, Homo sapiens
tggggcagggatgggaaactat

SEQ ID NO: 9120828 - DNA, 22 bp, Homo sapiens
tggggcagctccatctattcca

SEQ ID NO: 9120829 - DNA, 22 bp, Homo sapiens
tggggcagccacatagacaaca

SEQ ID NO: 9120830 - DNA, 22 bp, Homo sapiens
ctctgcccagtgcccacaggag

SEQ ID NO: 9120831 - DNA, 22 bp, Homo sapiens
tttgcaaagttatttagactca

SEQ ID NO: 9120832 - DNA, 22 bp, Homo sapiens
ctctgcccacgtcttgcccaga

SEQ ID NO: 9120833 - DNA, 22 bp, Homo sapiens
tttgggaactctatcatggaaa

SEQ ID NO: 9120834 - DNA, 22 bp, Homo sapiens
tttgggaacaatgaggatctga

SEQ ID NO: 9120835 - DNA, 22 bp, Homo sapiens
tttgggaaatagtagaaaatgt

SEQ ID NO: 9120836 - DNA, 22 bp, Homo sapiens
tttgctagtacacagctgtttc

SEQ ID NO: 9120837 - DNA, 22 bp, Homo sapiens
ctctttaagctcctaacagcca

SEQ ID NO: 9120838 - DNA, 22 bp, Homo sapiens
ttttcagttatagaatggtaga

SEQ ID NO: 9120839 - DNA, 22 bp, Homo sapiens
ctcttattttatggcatttgtg

SEQ ID NO: 9120840 - DNA, 22 bp, Homo sapiens
ctgcacagtcatttcctctcaa

SEQ ID NO: 9120841 - DNA, 22 bp, Homo sapiens
ctgcaccctgcaggtacccctg

SEQ ID NO: 9120842 - DNA, 22 bp, Homo sapiens
ctgcacccaggcctggtcccag

SEQ ID NO: 9120843 - DNA, 22 bp, Homo sapiens
ctgagccatgagcctgcgccca

SEQ ID NO: 9120844 - DNA, 22 bp, Homo sapiens
ctgagccagtagtcagggacaa

SEQ ID NO: 9120845 - DNA, 22 bp, Homo sapiens
ctgagccaaccacagcaggagc

SEQ ID NO: 9120846 - DNA, 22 bp, Homo sapiens
ctctttccagggtaccccaggt

SEQ ID NO: 9120847 - DNA, 22 bp, Homo sapiens
ctctttgcctaactgttttcaa

SEQ ID NO: 9120848 - DNA, 22 bp, Homo sapiens
ttgtattttgttatgctactgc

SEQ ID NO: 9120849 - DNA, 22 bp, Homo sapiens
ctcccactcctggctcaccaca

SEQ ID NO: 9120850 - DNA, 22 bp, Homo sapiens
ttgaaagttatctagattctga

SEQ ID NO: 9120851 - DNA, 22 bp, Homo sapiens
ttcttttcctgtggctcatcca

SEQ ID NO: 9120852 - DNA, 22 bp, Homo sapiens
ttcttttaattgtgggggagtg

SEQ ID NO: 9120853 - DNA, 22 bp, Homo sapiens
ttcttttaatttctgtctgcag

SEQ ID NO: 9120854 - DNA, 22 bp, Homo sapiens
ctcacaggttagttgtgtggat

SEQ ID NO: 9120855 - DNA, 22 bp, Homo sapiens
ttcttttagtcattcagggaag

SEQ ID NO: 9120856 - DNA, 22 bp, Homo sapiens
ttcttttagaatttcctaaggt

SEQ ID NO: 9120857 - DNA, 22 bp, Homo sapiens
ttcttttacattaagatttcag

SEQ ID NO: 9120858 - DNA, 22 bp, Homo sapiens
ctccaaggctctggtgctgagg

SEQ ID NO: 9120859 - DNA, 22 bp, Homo sapiens
ctccaagggctcccagacgtct

SEQ ID NO: 9120860 - DNA, 22 bp, Homo sapiens
ctccaagggtcttccaccagga

SEQ ID NO: 9120861 - DNA, 22 bp, Homo sapiens
tttcctcactcatgtcatcagt

SEQ ID NO: 9120862 - DNA, 22 bp, Homo sapiens
tttcctcacacagaagatcttg

SEQ ID NO: 9120863 - DNA, 22 bp, Homo sapiens
tttcaaatggagtcgtgaaatg

SEQ ID NO: 9120864 - DNA, 22 bp, Homo sapiens
ctcctggccctgagctcccagg

SEQ ID NO: 9120865 - DNA, 22 bp, Homo sapiens
tttattgtttagaagggggctg

SEQ ID NO: 9120866 - DNA, 22 bp, Homo sapiens
tttattgtgttgaaactgaatt

SEQ ID NO: 9120867 - DNA, 17 bp, Homo sapiens
ctcctggcagcctcagg

SEQ ID NO: 9120868 - DNA, 17 bp, Homo sapiens
ctcctggccacccctct

SEQ ID NO: 9120869 - DNA, 20 bp, Homo sapiens
ctcccctctacagagggctg

SEQ ID NO: 9120870 - DNA, 22 bp, Homo sapiens
ctcccgaggcggccccggctcg

SEQ ID NO: 9120871 - DNA, 22 bp, Homo sapiens
ctcccgaggagcctcagcgctc

SEQ ID NO: 9120872 - DNA, 22 bp, Homo sapiens
ctccccattgtgacctcatcca

SEQ ID NO: 9120873 - DNA, 22 bp, Homo sapiens
ctcccccttagctcttgtcttt

SEQ ID NO: 9120874 - DNA, 22 bp, Homo sapiens
tttagtaagttcactgcaaagc

SEQ ID NO: 9120875 - DNA, 22 bp, Homo sapiens
tttagggatgtcagaacaggga

SEQ ID NO: 9120876 - DNA, 22 bp, Homo sapiens
tttagggaaattgagggttaag

SEQ ID NO: 9120877 - DNA, 21 bp, Homo sapiens
tttagggaccaggtcataggc

SEQ ID NO: 9120878 - DNA, 22 bp, Homo sapiens
tttagggaagaagcccatggcc

SEQ ID NO: 9120879 - DNA, 22 bp, Homo sapiens
tgagacagttctgcagctgggt

SEQ ID NO: 9120880 - DNA, 23 bp, Homo sapiens
tgaagttcattctcactgatgta

SEQ ID NO: 9120881 - DNA, 22 bp, Homo sapiens
tgacaagatagattgagtttta

SEQ ID NO: 9120882 - DNA, 23 bp, Homo sapiens
tgattttaaaaagtaagttatca

SEQ ID NO: 9120883 - DNA, 22 bp, Homo sapiens
ccattgaacccctctaggccac

SEQ ID NO: 9120884 - DNA, 22 bp, Homo sapiens
ccattgaaggcacttgagcaga

SEQ ID NO: 9120885 - DNA, 22 bp, Homo sapiens
ccattgaatcctcagctgctag

SEQ ID NO: 9120886 - DNA, 22 bp, Homo sapiens
ccattgaattagaaggggaagg

SEQ ID NO: 9120887 - DNA, 22 bp, Homo sapiens
ccattctgtttaatgaatgaaa

SEQ ID NO: 9120888 - DNA, 22 bp, Homo sapiens
tgcaaaggggacagagtccact

SEQ ID NO: 9120889 - DNA, 20 bp, Homo sapiens
cccagaagtcacctccactc

SEQ ID NO: 9120890 - DNA, 22 bp, Homo sapiens
tctcagactctttagtgaaggt

SEQ ID NO: 9120891 - DNA, 22 bp, Homo sapiens
tctggctcaggtcagacaggga

SEQ ID NO: 9120892 - DNA, 22 bp, Homo sapiens
tctggctcagggctctgaggga

SEQ ID NO: 9120893 - DNA, 22 bp, Homo sapiens
tctggtaactcagaagaaagga

SEQ ID NO: 9120894 - DNA, 22 bp, Homo sapiens
tctggtaataggcaatagcttg

SEQ ID NO: 9120895 - DNA, 22 bp, Homo sapiens
tcttcccagaggaggtgccagc

SEQ ID NO: 9120896 - DNA, 22 bp, Homo sapiens
ccctgaggaaagggtggagggc

SEQ ID NO: 9120897 - DNA, 22 bp, Homo sapiens
ccctctccctgcagaatgtggc

SEQ ID NO: 9120898 - DNA, 22 bp, Homo sapiens
ccctctctcaggctgacagcct

SEQ ID NO: 9120899 - DNA, 22 bp, Homo sapiens
ccctcggggcctcagtttccct

SEQ ID NO: 9120900 - DNA, 22 bp, Homo sapiens
ccctcgctctaggcagccctgt

SEQ ID NO: 9120901 - DNA, 22 bp, Homo sapiens
ccctcctttctaggcttccagc

SEQ ID NO: 9120902 - DNA, 22 bp, Homo sapiens
ccccaaggtgctcactgtctgg

SEQ ID NO: 9120903 - DNA, 22 bp, Homo sapiens
tgctggctacattattgctgtc

SEQ ID NO: 9120904 - DNA, 22 bp, Homo sapiens
tgctggctttgcgagatgcatt

SEQ ID NO: 9120905 - DNA, 22 bp, Homo sapiens
cccctcttggcattgagtgcca

SEQ ID NO: 9120906 - DNA, 23 bp, Homo sapiens
cccctctggtggctcagctcctg

SEQ ID NO: 9120907 - DNA, 22 bp, Homo sapiens
ccccttccttcctcagacagcc

SEQ ID NO: 9120908 - DNA, 22 bp, Homo sapiens
ccccttctctgcaagcctgctc

SEQ ID NO: 9120909 - DNA, 22 bp, Homo sapiens
cccagggttgcctgcctctgct

SEQ ID NO: 9120910 - DNA, 22 bp, Homo sapiens
cccagggtggatgcaagcagca

SEQ ID NO: 9120911 - DNA, 22 bp, Homo sapiens
cccagggtgcggccctggctgg

SEQ ID NO: 9120912 - DNA, 22 bp, Homo sapiens
cccagggtagctgagctggcag

SEQ ID NO: 9120913 - DNA, 22 bp, Homo sapiens
tgccttcctgctttgagttctg

SEQ ID NO: 9120914 - DNA, 22 bp, Homo sapiens
cccttcctcaaggagctgtgtt

SEQ ID NO: 9120915 - DNA, 22 bp, Homo sapiens
cccttcccttctgggagatcca

SEQ ID NO: 9120916 - DNA, 22 bp, Homo sapiens
cccttcctcctcgcctgtcaga

SEQ ID NO: 9120917 - DNA, 22 bp, Homo sapiens
cccttccttgtgactggtgggg

SEQ ID NO: 9120918 - DNA, 22 bp, Homo sapiens
cccttctgtaaatgctgactgg

SEQ ID NO: 9120919 - DNA, 22 bp, Homo sapiens
ccctgcaggggacctgcagcct

SEQ ID NO: 9120920 - DNA, 22 bp, Homo sapiens
cctcatggtacttactgtagct

SEQ ID NO: 9120921 - DNA, 22 bp, Homo sapiens
cctcatgaggcaggcagggtag

SEQ ID NO: 9120922 - DNA, 22 bp, Homo sapiens
cctcatgatttttagcccattg

SEQ ID NO: 9120923 - DNA, 22 bp, Homo sapiens
cctcatgagttcttctgcccat

SEQ ID NO: 9120924 - DNA, 23 bp, Homo sapiens
cctcatgaaggtctgcttcctgg

SEQ ID NO: 9120925 - DNA, 22 bp, Homo sapiens
cctcatgagaactgggctcctg

SEQ ID NO: 9120926 - DNA, 22 bp, Homo sapiens
tggcctggggaagaccatgggc

SEQ ID NO: 9120927 - DNA, 22 bp, Homo sapiens
tggcctgggcatgaagcatcgt

SEQ ID NO: 9120928 - DNA, 19 bp, Homo sapiens
cctcttcctctgacactat

SEQ ID NO: 9120929 - DNA, 22 bp, Homo sapiens
tgggccatttttggaagactgg

SEQ ID NO: 9120930 - DNA, 22 bp, Homo sapiens
tgggcccatcattgctgtgggc

SEQ ID NO: 9120931 - DNA, 21 bp, Homo sapiens
tgggcccagctctgtctgttt

SEQ ID NO: 9120932 - DNA, 22 bp, Homo sapiens
tggctgagaccatcagggtgta

SEQ ID NO: 9120933 - DNA, 22 bp, Homo sapiens
tggctggctgtccagctgggca

SEQ ID NO: 9120934 - DNA, 22 bp, Homo sapiens
cctctgcgtctctccacactga

SEQ ID NO: 9120935 - DNA, 22 bp, Homo sapiens
cctctgctctggtccatgtgct

SEQ ID NO: 9120936 - DNA, 22 bp, Homo sapiens
cctctgcgcccttgatcagcca

SEQ ID NO: 9120937 - DNA, 22 bp, Homo sapiens
cctctggagtcagaccagcttg

SEQ ID NO: 9120938 - DNA, 22 bp, Homo sapiens
cctctggacttgggacagtgag

SEQ ID NO: 9120939 - DNA, 18 bp, Homo sapiens
caggcctcttgatcttcc

SEQ ID NO: 9120940 - DNA, 22 bp, Homo sapiens
tactttaaagaggtgtaatgag

SEQ ID NO: 9120941 - DNA, 22 bp, Homo sapiens
tactttaatatatgtgaagttc

SEQ ID NO: 9120942 - DNA, 22 bp, Homo sapiens
caggcttgggagcagagccact

SEQ ID NO: 9120943 - DNA, 22 bp, Homo sapiens
caggcttgtgtctcagctgcag

SEQ ID NO: 9120944 - DNA, 22 bp, Homo sapiens
caggcttggagggcagtggcat

SEQ ID NO: 9120945 - DNA, 22 bp, Homo sapiens
cagggaaactaggaaataagct

SEQ ID NO: 9120946 - DNA, 22 bp, Homo sapiens
cagggaaagttcttgtccactc

SEQ ID NO: 9120947 - DNA, 22 bp, Homo sapiens
tagattcagatatttaggacaa

SEQ ID NO: 9120948 - DNA, 21 bp, Homo sapiens
taataattccactacagagta

SEQ ID NO: 9120949 - DNA, 22 bp, Homo sapiens
caggcattagagaattgtgata

SEQ ID NO: 9120950 - DNA, 20 bp, Homo sapiens
taatcacttataagacaatg

SEQ ID NO: 9120951 - DNA, 19 bp, Homo sapiens
tcaaaacacaaatggttga

SEQ ID NO: 9120952 - DNA, 22 bp, Homo sapiens
tcaaaacaatcattggatgtgc

SEQ ID NO: 9120953 - DNA, 22 bp, Homo sapiens
tcaaaacaacactcaggtgtaa

SEQ ID NO: 9120954 - DNA, 22 bp, Homo sapiens
caggtaggcagccggtctctgg

SEQ ID NO: 9120955 - DNA, 22 bp, Homo sapiens
tagatttaagaccctgaatttg

SEQ ID NO: 9120956 - DNA, 22 bp, Homo sapiens
tagcttctcttttcaacatctt

SEQ ID NO: 9120957 - DNA, 22 bp, Homo sapiens
cagggcccaggccactgggttg

SEQ ID NO: 9120958 - DNA, 23 bp, Homo sapiens
cagggccctgctcaatttctcca

SEQ ID NO: 9120959 - DNA, 20 bp, Homo sapiens
cagggcctatgattgagctt

SEQ ID NO: 9120960 - DNA, 22 bp, Homo sapiens
taggcttgcttctcctccacag

SEQ ID NO: 9120961 - DNA, 23 bp, Homo sapiens
tcagagcaaagggtgcctccgtt

SEQ ID NO: 9120962 - DNA, 22 bp, Homo sapiens
tcagagcaacttttcctgcttt

SEQ ID NO: 9120963 - DNA, 22 bp, Homo sapiens
tcaatcatagtccttctctaga

SEQ ID NO: 9120964 - DNA, 22 bp, Homo sapiens
cataattactgatatgctgatt

SEQ ID NO: 9120965 - DNA, 22 bp, Homo sapiens
catctgctgttccttggactca

SEQ ID NO: 9120966 - DNA, 22 bp, Homo sapiens
catgaaattgctcctttggtgc

SEQ ID NO: 9120967 - DNA, 22 bp, Homo sapiens
catgaaatttgaagtacagcaa

SEQ ID NO: 9120968 - DNA, 22 bp, Homo sapiens
tcagtccaggggctgtgatgtc

SEQ ID NO: 9120969 - DNA, 22 bp, Homo sapiens
catctcacttccctgcagcatc

SEQ ID NO: 9120970 - DNA, 22 bp, Homo sapiens
tcagtcacactcactgaggtag

SEQ ID NO: 9120971 - DNA, 22 bp, Homo sapiens
tcagtcaccttgactatagctg

SEQ ID NO: 9120972 - DNA, 22 bp, Homo sapiens
tcagtcaacataaatccaaggt

SEQ ID NO: 9120973 - DNA, 22 bp, Homo sapiens
catggccagattctttcttctc

SEQ ID NO: 9120974 - DNA, 22 bp, Homo sapiens
tccttccccctcaagagaactt

SEQ ID NO: 9120975 - DNA, 21 bp, Homo sapiens
tccttcccccttggcctggga

SEQ ID NO: 9120976 - DNA, 20 bp, Homo sapiens
tccttccctctctttttgca

SEQ ID NO: 9120977 - DNA, 22 bp, Homo sapiens
tccttggggtaactccagcctg

SEQ ID NO: 9120978 - DNA, 22 bp, Homo sapiens
tccttcccaggtgtcgccgcct

SEQ ID NO: 9120979 - DNA, 22 bp, Homo sapiens
ccaaggctcctcagctggtctt

SEQ ID NO: 9120980 - DNA, 22 bp, Homo sapiens
ccaaggctgaggtttccagttg

SEQ ID NO: 9120981 - DNA, 22 bp, Homo sapiens
ccaaggctgtggggctgtgcag

SEQ ID NO: 9120982 - DNA, 22 bp, Homo sapiens
ccaaggctgtggggctgtgcag

SEQ ID NO: 9120983 - DNA, 22 bp, Homo sapiens
ccaaggctgtcattcagtagct

SEQ ID NO: 9120984 - DNA, 22 bp, Homo sapiens
ccaaggctggagtgcagtggcg

SEQ ID NO: 9120985 - DNA, 22 bp, Homo sapiens
ccaaggcttcccagagatgctc

SEQ ID NO: 9120986 - DNA, 22 bp, Homo sapiens
ccaaggagctgcaggcacttgt

SEQ ID NO: 9120987 - DNA, 22 bp, Homo sapiens
tccctctccctattgcctggag

SEQ ID NO: 9120988 - DNA, 22 bp, Homo sapiens
tccctggggttcctccagccac

SEQ ID NO: 9120989 - DNA, 18 bp, Homo sapiens
tccctggggctgccaccc

SEQ ID NO: 9120990 - DNA, 22 bp, Homo sapiens
tccctcctggtgatgatgcaaa

SEQ ID NO: 9120991 - DNA, 22 bp, Homo sapiens
tccctcctggccgtcaccgctg

SEQ ID NO: 9120992 - DNA, 22 bp, Homo sapiens
tccctcctgcatgaggctcggc

SEQ ID NO: 9120993 - DNA, 22 bp, Homo sapiens
tcccactcactgtctctgacac

SEQ ID NO: 9120994 - DNA, 22 bp, Homo sapiens
tcccactcccaggcaggcctct

SEQ ID NO: 9120995 - DNA, 22 bp, Homo sapiens
tttctggcagcgggacaggggt

SEQ ID NO: 9120996 - DNA, 22 bp, Homo sapiens
tttctgtaaggacttaatgcaa

SEQ ID NO: 9120997 - DNA, 22 bp, Homo sapiens
tttctggattcatacagatgta

SEQ ID NO: 9120998 - DNA, 22 bp, Homo sapiens
tttctgaattcctaggatgttg

SEQ ID NO: 9120999 - DNA, 23 bp, Homo sapiens
tttctgaagttgagatggacttt

SEQ ID NO: 9121000 - DNA, 21 bp, Homo sapiens
tttctgaaggcaacatctatc

SEQ ID NO: 9121001 - DNA, 22 bp, Homo sapiens
tttctgaagggcagcagactct

SEQ ID NO: 9121002 - DNA, 22 bp, Homo sapiens
tttctgctcatcctagtggagc

SEQ ID NO: 9121003 - DNA, 22 bp, Homo sapiens
tttctgaacaaagccattatca

SEQ ID NO: 9121004 - DNA, 22 bp, Homo sapiens
tttctgaaaactgaagtagtgc

SEQ ID NO: 9121005 - DNA, 20 bp, Homo sapiens
tttcttgtacttggagaagg

SEQ ID NO: 9121006 - DNA, 22 bp, Homo sapiens
tttcttgtctttagtatctggc

SEQ ID NO: 9121007 - DNA, 23 bp, Homo sapiens
tttctgttcctctagctttgcat

SEQ ID NO: 9121008 - DNA, 23 bp, Homo sapiens
tttctgttgggtatatatccaag

SEQ ID NO: 9121009 - DNA, 22 bp, Homo sapiens
tttctgtgaattataaaatttg

SEQ ID NO: 9121010 - DNA, 22 bp, Homo sapiens
tttctgtagggatttcacagtt

SEQ ID NO: 9121011 - DNA, 22 bp, Homo sapiens
tttcagtggagtgacatgatct

SEQ ID NO: 9121012 - DNA, 22 bp, Homo sapiens
tttcattgtcagagctttgaat

SEQ ID NO: 9121013 - DNA, 22 bp, Homo sapiens
tttcatttcatagaattgtgtt

SEQ ID NO: 9121014 - DNA, 22 bp, Homo sapiens
tttcaaagaccattaactatca

SEQ ID NO: 9121015 - DNA, 22 bp, Homo sapiens
tttcaaagggaagttatgaagt

SEQ ID NO: 9121016 - DNA, 22 bp, Homo sapiens
tttcagctggtaaaggagtagc

SEQ ID NO: 9121017 - DNA, 22 bp, Homo sapiens
tttctaatctttagttacaaaa

SEQ ID NO: 9121018 - DNA, 22 bp, Homo sapiens
tttctattgtaagtctcctata

SEQ ID NO: 9121019 - DNA, 22 bp, Homo sapiens
tttctcatggaacatcgtttag

SEQ ID NO: 9121020 - DNA, 22 bp, Homo sapiens
tttaaaatttagacctctccac

SEQ ID NO: 9121021 - DNA, 22 bp, Homo sapiens
tttaaaatcagatgggagttgg

SEQ ID NO: 9121022 - DNA, 22 bp, Homo sapiens
tttaatgtttgagtcagtatat

SEQ ID NO: 9121023 - DNA, 22 bp, Homo sapiens
ttgtgaaatgtttcaaaatagt

SEQ ID NO: 9121024 - DNA, 23 bp, Homo sapiens
ttgcaaatttcagttagttcatg

SEQ ID NO: 9121025 - DNA, 20 bp, Homo sapiens
ttgtttctgctattttctaa

SEQ ID NO: 9121026 - DNA, 22 bp, Homo sapiens
ttgtttccatgcatgcatttat

SEQ ID NO: 9121027 - DNA, 22 bp, Homo sapiens
tttttcatgagactagaagtca

SEQ ID NO: 9121028 - DNA, 22 bp, Homo sapiens
ttttgaaagccaggtttgtatg

SEQ ID NO: 9121029 - DNA, 22 bp, Homo sapiens
ttttctaacatctagtaatttg

SEQ ID NO: 9121030 - DNA, 22 bp, Homo sapiens
tttctttctcgtaaacttagtt

SEQ ID NO: 9121031 - DNA, 22 bp, Homo sapiens
tttctttccatgagcctatgta

SEQ ID NO: 9121032 - DNA, 18 bp, Homo sapiens
tttctttctgcctggggc

SEQ ID NO: 9121033 - DNA, 22 bp, Homo sapiens
tttctttccatacatattgcta

SEQ ID NO: 9121034 - DNA, 22 bp, Homo sapiens
tttctttcaattctcctaatgc

SEQ ID NO: 9121035 - DNA, 22 bp, Homo sapiens
tttctttccagagtgattggca

SEQ ID NO: 9121036 - DNA, 22 bp, Homo sapiens
tttgcacacattcttagaaatg

SEQ ID NO: 9121037 - DNA, 22 bp, Homo sapiens
ttaaatgtttaatctaacttga

SEQ ID NO: 9121038 - DNA, 23 bp, Homo sapiens
tgttttcttgtcctggtataatt

SEQ ID NO: 9121039 - DNA, 22 bp, Homo sapiens
tgttttcttcctaattgctcat

SEQ ID NO: 9121040 - DNA, 22 bp, Homo sapiens
tgttttcttctgtaccgtgcca

SEQ ID NO: 9121041 - DNA, 22 bp, Homo sapiens
tgttttctgggtggaaggtact

SEQ ID NO: 9121042 - DNA, 22 bp, Homo sapiens
tgttttctgtgtagagatcaca

SEQ ID NO: 9121043 - DNA, 22 bp, Homo sapiens
tgttttctgatggttaatgagt

SEQ ID NO: 9121044 - DNA, 22 bp, Homo sapiens
tgttttctgattctcgtgtggt

SEQ ID NO: 9121045 - DNA, 17 bp, Homo sapiens
tgttttctgctaccttt

SEQ ID NO: 9121046 - DNA, 22 bp, Homo sapiens
ttaagtgtcataatttccaaga

SEQ ID NO: 9121047 - DNA, 21 bp, Homo sapiens
ttactttagaaattgcctttt

SEQ ID NO: 9121048 - DNA, 22 bp, Homo sapiens
ttagaaagaactttagatatca

SEQ ID NO: 9121049 - DNA, 22 bp, Homo sapiens
ttactttatctcctagattcca

SEQ ID NO: 9121050 - DNA, 22 bp, Homo sapiens
ttacagcttcgacagaggcagt

SEQ ID NO: 9121051 - DNA, 22 bp, Homo sapiens
ttacatcagcaagagtgtatgt

SEQ ID NO: 9121052 - DNA, 22 bp, Homo sapiens
ttaatttttatgtatagtgtgt

SEQ ID NO: 9121053 - DNA, 22 bp, Homo sapiens
ttacacacaattagcatagtaa

SEQ ID NO: 9121054 - DNA, 22 bp, Homo sapiens
ttacacactctgccctgctgtt

SEQ ID NO: 9121055 - DNA, 22 bp, Homo sapiens
ttacacattgcagatcaaaatg

SEQ ID NO: 9121056 - DNA, 22 bp, Homo sapiens
ttacacatgctttgtgtgtatg

SEQ ID NO: 9121057 - DNA, 22 bp, Homo sapiens
ttacacatgctcacttatttgt

SEQ ID NO: 9121058 - DNA, 22 bp, Homo sapiens
tgttatttgggaaagttgtaca

SEQ ID NO: 9121059 - DNA, 21 bp, Homo sapiens
tgtttcatgctattttcttgt

SEQ ID NO: 9121060 - DNA, 22 bp, Homo sapiens
tgtttccaactgtgatcttact

SEQ ID NO: 9121061 - DNA, 22 bp, Homo sapiens
tgtttccagaaggacaaagaaa

SEQ ID NO: 9121062 - DNA, 22 bp, Homo sapiens
tgttttctcttgaaaagcagtc

SEQ ID NO: 9121063 - DNA, 22 bp, Homo sapiens
tcccctctctgcgctcccaggt

SEQ ID NO: 9121064 - DNA, 22 bp, Homo sapiens
tcccctcctgcctttgcggtgg

SEQ ID NO: 9121065 - DNA, 22 bp, Homo sapiens
tcccctctggaggctgcagggg

SEQ ID NO: 9121066 - DNA, 22 bp, Homo sapiens
tcccctctggttgacccaggag

SEQ ID NO: 9121067 - DNA, 22 bp, Homo sapiens
tcccctgcagatgagggcagtg

SEQ ID NO: 9121068 - DNA, 18 bp, Homo sapiens
tcccctgctctggtgctc

SEQ ID NO: 9121069 - DNA, 22 bp, Homo sapiens
tgtggacagctctttgagtgct

SEQ ID NO: 9121070 - DNA, 22 bp, Homo sapiens
tcccctccaactccaactatgg

SEQ ID NO: 9121071 - DNA, 22 bp, Homo sapiens
tcccctcctctcctgatatggg

SEQ ID NO: 9121072 - DNA, 22 bp, Homo sapiens
tcccctcccttccaacagagct

SEQ ID NO: 9121073 - DNA, 21 bp, Homo sapiens
tcccctcacttgtcttctgag

SEQ ID NO: 9121074 - DNA, 22 bp, Homo sapiens
tccccctccaattgccatgtta

SEQ ID NO: 9121075 - DNA, 22 bp, Homo sapiens
tgtggccagcaggtggctgtgt

SEQ ID NO: 9121076 - DNA, 22 bp, Homo sapiens
tgtggccatatactttgttgtg

SEQ ID NO: 9121077 - DNA, 22 bp, Homo sapiens
tgtgtaaagcttgttccagaaa

SEQ ID NO: 9121078 - DNA, 21 bp, Homo sapiens
tgtgtaaagttgaaatcctgt

SEQ ID NO: 9121079 - DNA, 22 bp, Homo sapiens
tgtggtcttggaagaagttgct

SEQ ID NO: 9121080 - DNA, 22 bp, Homo sapiens
tgtgtgaattacgcgtgtcctg

SEQ ID NO: 9121081 - DNA, 22 bp, Homo sapiens
ttgcaaatgtgaataattacac

SEQ ID NO: 9121082 - DNA, 22 bp, Homo sapiens
ttgatttgattgatgaactaag

SEQ ID NO: 9121083 - DNA, 22 bp, Homo sapiens
ttgatttctattcagatgtaga

SEQ ID NO: 9121084 - DNA, 22 bp, Homo sapiens
ttctttccaaccagatattggt

SEQ ID NO: 9121085 - DNA, 19 bp, Homo sapiens
ttctttccacatcttctct

SEQ ID NO: 9121086 - DNA, 22 bp, Homo sapiens
ttctttatcagttactcatagg

SEQ ID NO: 9121087 - DNA, 22 bp, Homo sapiens
ttctttcccagaagatatgttt

SEQ ID NO: 9121088 - DNA, 22 bp, Homo sapiens
ttctttcccagtagatgtgaaa

SEQ ID NO: 9121089 - DNA, 21 bp, Homo sapiens
ttctttccccagaggactaaa

SEQ ID NO: 9121090 - DNA, 22 bp, Homo sapiens
ttctttccccatggagttcgga

SEQ ID NO: 9121091 - DNA, 22 bp, Homo sapiens
ttctttcccttccagcagctcc

SEQ ID NO: 9121092 - DNA, 22 bp, Homo sapiens
ttctttcctcccagcctttgga

SEQ ID NO: 9121093 - DNA, 22 bp, Homo sapiens
ttctttccttgcctcagtgaag

SEQ ID NO: 9121094 - DNA, 19 bp, Homo sapiens
ttctggtctggaatcaagg

SEQ ID NO: 9121095 - DNA, 22 bp, Homo sapiens
ttctggtaccgtgtcagaaacc

SEQ ID NO: 9121096 - DNA, 22 bp, Homo sapiens
ttctgacatgtgagattttgtt

SEQ ID NO: 9121097 - DNA, 22 bp, Homo sapiens
ttctagtgtccttggacttgct

SEQ ID NO: 9121098 - DNA, 22 bp, Homo sapiens
ttcctgtggtccagagtcatcc

SEQ ID NO: 9121099 - DNA, 17 bp, Homo sapiens
ttcctgtggtttgatct

SEQ ID NO: 9121100 - DNA, 19 bp, Homo sapiens
ttcctgtgctgctgtgtcc

SEQ ID NO: 9121101 - DNA, 22 bp, Homo sapiens
ttcctgtggccttacatctgtg

SEQ ID NO: 9121102 - DNA, 22 bp, Homo sapiens
ttccagagcccatgctctaggc

SEQ ID NO: 9121103 - DNA, 22 bp, Homo sapiens
ttcctctgtagttgctgatgaa

SEQ ID NO: 9121104 - DNA, 22 bp, Homo sapiens
ttcaacaagtagtacacacagt

SEQ ID NO: 9121105 - DNA, 22 bp, Homo sapiens
ttcaacatgctttatttctaaa

SEQ ID NO: 9121106 - DNA, 22 bp, Homo sapiens
ttcaacaattaagtatcagcct

SEQ ID NO: 9121107 - DNA, 22 bp, Homo sapiens
ttcaacatttgatacaagtcag

SEQ ID NO: 9121108 - DNA, 22 bp, Homo sapiens
ttcacattgaaggtgctttctt

SEQ ID NO: 9121109 - DNA, 22 bp, Homo sapiens
ttcacattccgcggctattttc

SEQ ID NO: 9121110 - DNA, 22 bp, Homo sapiens
ttcacattagtggttctatata

SEQ ID NO: 9121111 - DNA, 22 bp, Homo sapiens
ttcacattatcaggattgtttc

SEQ ID NO: 9121112 - DNA, 22 bp, Homo sapiens
ttcatgtttcatttgttactat

SEQ ID NO: 9121113 - DNA, 22 bp, Homo sapiens
ttcatgtttcaattgttaatgt

SEQ ID NO: 9121114 - DNA, 22 bp, Homo sapiens
ttcatgttggcatgtttttagg

SEQ ID NO: 9121115 - DNA, 22 bp, Homo sapiens
ttcatgttcatgcttaggaaaa

SEQ ID NO: 9121116 - DNA, 22 bp, Homo sapiens
ccctttggaagaggctcactga

SEQ ID NO: 9121117 - DNA, 22 bp, Homo sapiens
ccgcagggaaagccccaggaag

SEQ ID NO: 9121118 - DNA, 22 bp, Homo sapiens
cctcctctgtgcagctgtgggt

SEQ ID NO: 9121119 - DNA, 22 bp, Homo sapiens
cctctggcttactgttgggttt

SEQ ID NO: 9121120 - DNA, 22 bp, Homo sapiens
agggctgcaccggggcttcgcg

SEQ ID NO: 9121121 - DNA, 19 bp, Homo sapiens
cctctgccagcccgcctct

SEQ ID NO: 9121122 - DNA, 22 bp, Homo sapiens
agggagaagagaacaaagccct

SEQ ID NO: 9121123 - DNA, 22 bp, Homo sapiens
ccctctctgacttctgaacttg

SEQ ID NO: 9121124 - DNA, 22 bp, Homo sapiens
ccctctctcggttgctgtggtt

SEQ ID NO: 9121125 - DNA, 22 bp, Homo sapiens
ccctcccaggagtggccagaga

SEQ ID NO: 9121126 - DNA, 22 bp, Homo sapiens
ccctctgcctgggaccaagtcc

SEQ ID NO: 9121127 - DNA, 22 bp, Homo sapiens
ccctctggctgtgtgttcttag

SEQ ID NO: 9121128 - DNA, 22 bp, Homo sapiens
ccctctggctgtgtgttcttag

SEQ ID NO: 9121129 - DNA, 22 bp, Homo sapiens
ccctctggctcttctcaggccg

SEQ ID NO: 9121130 - DNA, 22 bp, Homo sapiens
aggcttctggaatccagtttct

SEQ ID NO: 9121131 - DNA, 22 bp, Homo sapiens
aggcttctccacataaagttac

SEQ ID NO: 9121132 - DNA, 21 bp, Homo sapiens
aggcttggatctagacaggcc

SEQ ID NO: 9121133 - DNA, 21 bp, Homo sapiens
aggcttggataggttatgtga

SEQ ID NO: 9121134 - DNA, 22 bp, Homo sapiens
aggcttggaagtggcagaactg

SEQ ID NO: 9121135 - DNA, 19 bp, Homo sapiens
aggcttggaacagccttat

SEQ ID NO: 9121136 - DNA, 22 bp, Homo sapiens
aggcttggaggttctgtagcca

SEQ ID NO: 9121137 - DNA, 21 bp, Homo sapiens
aggcttggatagatattcata

SEQ ID NO: 9121138 - DNA, 19 bp, Homo sapiens
aggcttggattgtggccaa

SEQ ID NO: 9121139 - DNA, 22 bp, Homo sapiens
aggcttggaaaatttacagtgt

SEQ ID NO: 9121140 - DNA, 22 bp, Homo sapiens
aggcttcttcttcctatttagt

SEQ ID NO: 9121141 - DNA, 22 bp, Homo sapiens
ccagagagtaaacattttccgg

SEQ ID NO: 9121142 - DNA, 22 bp, Homo sapiens
ccagggtgagaaaaggctggat

SEQ ID NO: 9121143 - DNA, 22 bp, Homo sapiens
ccagggagcctggtgtgtcagc

SEQ ID NO: 9121144 - DNA, 22 bp, Homo sapiens
aggctcagcctgggcctagagc

SEQ ID NO: 9121145 - DNA, 22 bp, Homo sapiens
cccactgtctgttcccagggcc

SEQ ID NO: 9121146 - DNA, 22 bp, Homo sapiens
catagacattcagcactcacta

SEQ ID NO: 9121147 - DNA, 21 bp, Homo sapiens
catattaaatcggtgccttta

SEQ ID NO: 9121148 - DNA, 20 bp, Homo sapiens
cagtgcccgtggaaaagatg

SEQ ID NO: 9121149 - DNA, 22 bp, Homo sapiens
cagtgcccgccgccgttcctgg

SEQ ID NO: 9121150 - DNA, 22 bp, Homo sapiens
cagtgcctggcatagaggcggc

SEQ ID NO: 9121151 - DNA, 22 bp, Homo sapiens
cagtgcctcttaagtgtcaccc

SEQ ID NO: 9121152 - DNA, 22 bp, Homo sapiens
cagtggcctctggctttgctgt

SEQ ID NO: 9121153 - DNA, 22 bp, Homo sapiens
aggaccaacatagcagcagtgg

SEQ ID NO: 9121154 - DNA, 22 bp, Homo sapiens
ccaagcctagtcgtgcacacag

SEQ ID NO: 9121155 - DNA, 22 bp, Homo sapiens
ccaagcagagcagcctctctgg

SEQ ID NO: 9121156 - DNA, 22 bp, Homo sapiens
ccaagagtaaattcatgatgcc

SEQ ID NO: 9121157 - DNA, 22 bp, Homo sapiens
ccaaggttgcaggcctcagaga

SEQ ID NO: 9121158 - DNA, 22 bp, Homo sapiens
ccaaggttagaaaaggtacttt

SEQ ID NO: 9121159 - DNA, 22 bp, Homo sapiens
ccaagggctctggacagagtgg

SEQ ID NO: 9121160 - DNA, 22 bp, Homo sapiens
ccaagggctgctgaggtgtcca

SEQ ID NO: 9121161 - DNA, 20 bp, Homo sapiens
aggaggggatagaatcaaag

SEQ ID NO: 9121162 - DNA, 22 bp, Homo sapiens
aggagggctaggaaaaccagga

SEQ ID NO: 9121163 - DNA, 22 bp, Homo sapiens
aggatgttcgggtcacatagcc

SEQ ID NO: 9121164 - DNA, 22 bp, Homo sapiens
catggctgaacactcagtgact

SEQ ID NO: 9121165 - DNA, 22 bp, Homo sapiens
agctgtggagtagggggttgga

SEQ ID NO: 9121166 - DNA, 22 bp, Homo sapiens
agctgtggcagcactttggagt

SEQ ID NO: 9121167 - DNA, 22 bp, Homo sapiens
caggctcactttctcagtcaca

SEQ ID NO: 9121168 - DNA, 22 bp, Homo sapiens
cagggtgcctctgctcccacca

SEQ ID NO: 9121169 - DNA, 22 bp, Homo sapiens
cagggtgcctgtcctcagcaaa

SEQ ID NO: 9121170 - DNA, 22 bp, Homo sapiens
cagggtgcagagctagggtagt

SEQ ID NO: 9121171 - DNA, 22 bp, Homo sapiens
cagggtgcagtgtcgctgctag

SEQ ID NO: 9121172 - DNA, 22 bp, Homo sapiens
ctaaaattatcaagataattcc

SEQ ID NO: 9121173 - DNA, 22 bp, Homo sapiens
cgtggaatattataatggcaca

SEQ ID NO: 9121174 - DNA, 22 bp, Homo sapiens
cctggactcagaggtgctggtg

SEQ ID NO: 9121175 - DNA, 22 bp, Homo sapiens
agggtgctgccggacaggtggg

SEQ ID NO: 9121176 - DNA, 22 bp, Homo sapiens
ctgagaaaggacctcaaacagg

SEQ ID NO: 9121177 - DNA, 22 bp, Homo sapiens
agtgcactgagctaggagtgga

SEQ ID NO: 9121178 - DNA, 22 bp, Homo sapiens
ctccagtgggggtgagcctaga

SEQ ID NO: 9121179 - DNA, 22 bp, Homo sapiens
ctccagtggcacaaatgggtgc

SEQ ID NO: 9121180 - DNA, 22 bp, Homo sapiens
ctcctcctggacacaggctgtg

SEQ ID NO: 9121181 - DNA, 22 bp, Homo sapiens
ctcctcccacggtctcaggaag

SEQ ID NO: 9121182 - DNA, 18 bp, Homo sapiens
ctcctccctaagggctca

SEQ ID NO: 9121183 - DNA, 22 bp, Homo sapiens
ctcctccccttgagtctgggat

SEQ ID NO: 9121184 - DNA, 22 bp, Homo sapiens
ctcctccccttgagtctgggat

SEQ ID NO: 9121185 - DNA, 22 bp, Homo sapiens
ctcctccctgcgattgctctgc

SEQ ID NO: 9121186 - DNA, 22 bp, Homo sapiens
ctcctccctctttgccacacat

SEQ ID NO: 9121187 - DNA, 22 bp, Homo sapiens
ctcctccctgggaggctggcat

SEQ ID NO: 9121188 - DNA, 22 bp, Homo sapiens
ctcctccctgggaggctggcat

SEQ ID NO: 9121189 - DNA, 22 bp, Homo sapiens
ctcctcctcaaattagcttttg

SEQ ID NO: 9121190 - DNA, 19 bp, Homo sapiens
agtcatctcactgtgccca

SEQ ID NO: 9121191 - DNA, 22 bp, Homo sapiens
atatcaaacgaagttattttaa

SEQ ID NO: 9121192 - DNA, 19 bp, Homo sapiens
atatatgtatacaatgtgg

SEQ ID NO: 9121193 - DNA, 22 bp, Homo sapiens
ctgggccatggaagtctctgcc

SEQ ID NO: 9121194 - DNA, 22 bp, Homo sapiens
ctgggccagggaggtgtctgta

SEQ ID NO: 9121195 - DNA, 22 bp, Homo sapiens
atattttgaagttaataatgtg

SEQ ID NO: 9121196 - DNA, 22 bp, Homo sapiens
ctggtgctgtagcctgattgag

SEQ ID NO: 9121197 - DNA, 22 bp, Homo sapiens
ctggtgctggcaacagagtagg

SEQ ID NO: 9121198 - DNA, 22 bp, Homo sapiens
ctgggctgtggtgtggcccaaa

SEQ ID NO: 9121199 - DNA, 22 bp, Homo sapiens
cttcagagaacttgatcgctgc

SEQ ID NO: 9121200 - DNA, 22 bp, Homo sapiens
cttcagaattcctcagcctcag

SEQ ID NO: 9121201 - DNA, 22 bp, Homo sapiens
cttcataattaccttgtctgcc

SEQ ID NO: 9121202 - DNA, 22 bp, Homo sapiens
cttcataatctgaaatttgtaa

SEQ ID NO: 9121203 - DNA, 22 bp, Homo sapiens
ctgtgccctttcgctgcactgt

SEQ ID NO: 9121204 - DNA, 22 bp, Homo sapiens
ctgtgccctttgtcctcgtctc

SEQ ID NO: 9121205 - DNA, 22 bp, Homo sapiens
ctgtgcctttgtagctgtgcct

SEQ ID NO: 9121206 - DNA, 22 bp, Homo sapiens
ctgtgccttggcgctgtgccac

SEQ ID NO: 9121207 - DNA, 22 bp, Homo sapiens
agtgttctcagctactagagag

SEQ ID NO: 9121208 - DNA, 22 bp, Homo sapiens
agtttgtatgccaacagcaaag

SEQ ID NO: 9121209 - DNA, 18 bp, Homo sapiens
ctgccccttctctgagat

SEQ ID NO: 9121210 - DNA, 22 bp, Homo sapiens
ctgccctcgggccctcccatag

SEQ ID NO: 9121211 - DNA, 22 bp, Homo sapiens
ctgccctcccagttggtccgtg

SEQ ID NO: 9121212 - DNA, 22 bp, Homo sapiens
agttttctctgtgttctgctta

SEQ ID NO: 9121213 - DNA, 22 bp, Homo sapiens
agttttctcacatcaaaaatga

SEQ ID NO: 9121214 - DNA, 22 bp, Homo sapiens
agttttctgacccctgctctat

SEQ ID NO: 9121215 - DNA, 22 bp, Homo sapiens
agttttcttcattttgtggcca

SEQ ID NO: 9121216 - DNA, 22 bp, Homo sapiens
agttttctgttctacaatttga

SEQ ID NO: 9121217 - DNA, 22 bp, Homo sapiens
agttttctttcgcaaaggtaca

SEQ ID NO: 9121218 - DNA, 22 bp, Homo sapiens
agttttctttcatctatcagca

SEQ ID NO: 9121219 - DNA, 22 bp, Homo sapiens
agttttctgatgtgtagtgaga

SEQ ID NO: 9121220 - DNA, 22 bp, Homo sapiens
agttttctgcctctggatgcgt

SEQ ID NO: 9121221 - DNA, 21 bp, Homo sapiens
agttttctgagttataaaata

SEQ ID NO: 9121222 - DNA, 22 bp, Homo sapiens
agttttctgctaaaccagctaa

SEQ ID NO: 9121223 - DNA, 19 bp, Homo sapiens
agttttctgtgatccattt

SEQ ID NO: 9121224 - DNA, 22 bp, Homo sapiens
agttttctgggatcactggaat

SEQ ID NO: 9121225 - DNA, 22 bp, Homo sapiens
ataatgtttttgtataagcatg

SEQ ID NO: 9121226 - DNA, 22 bp, Homo sapiens
ataattacattatactgttaga

SEQ ID NO: 9121227 - DNA, 22 bp, Homo sapiens
caatagtgtctgcttgtttcta

SEQ ID NO: 9121228 - DNA, 22 bp, Homo sapiens
cacacaggatgaagcagcagaa

SEQ ID NO: 9121229 - DNA, 22 bp, Homo sapiens
cacaaatgtgcagaaatgtgag

SEQ ID NO: 9121230 - DNA, 22 bp, Homo sapiens
gctgctttggaaagcatggaaa

SEQ ID NO: 9121231 - DNA, 22 bp, Homo sapiens
gctggctgacagatttggggtg

SEQ ID NO: 9121232 - DNA, 20 bp, Homo sapiens
gctggctgaactgaaagcaa

SEQ ID NO: 9121233 - DNA, 22 bp, Homo sapiens
gctggctgaggtctagctcttt

SEQ ID NO: 9121234 - DNA, 22 bp, Homo sapiens
caagctctttaaacttatgtca

SEQ ID NO: 9121235 - DNA, 22 bp, Homo sapiens
caagctctgggatgcagacatc

SEQ ID NO: 9121236 - DNA, 22 bp, Homo sapiens
caagctctgggatagcagagag

SEQ ID NO: 9121237 - DNA, 22 bp, Homo sapiens
caagctctgcgggctccaagat

SEQ ID NO: 9121238 - DNA, 22 bp, Homo sapiens
caacacattgaagctatgatga

SEQ ID NO: 9121239 - DNA, 22 bp, Homo sapiens
cacatgaattcacatgtatttt

SEQ ID NO: 9121240 - DNA, 22 bp, Homo sapiens
cacatgaattgatgccaagtgc

SEQ ID NO: 9121241 - DNA, 22 bp, Homo sapiens
cacatgaaggctggggtcgtga

SEQ ID NO: 9121242 - DNA, 22 bp, Homo sapiens
cacttgttggtggtgaaatcac

SEQ ID NO: 9121243 - DNA, 22 bp, Homo sapiens
cacttcattgggaccagggctg

SEQ ID NO: 9121244 - DNA, 20 bp, Homo sapiens
ggctctggaatctggtgggc

SEQ ID NO: 9121245 - DNA, 22 bp, Homo sapiens
cactccaggtcccagttcctgg

SEQ ID NO: 9121246 - DNA, 22 bp, Homo sapiens
cagccctcatctcagcttcttt

SEQ ID NO: 9121247 - DNA, 22 bp, Homo sapiens
cagccctctgaagaggcgcttg

SEQ ID NO: 9121248 - DNA, 22 bp, Homo sapiens
cagccctctctgggccccaagg

SEQ ID NO: 9121249 - DNA, 20 bp, Homo sapiens
cagccctccagtggaggcag

SEQ ID NO: 9121250 - DNA, 22 bp, Homo sapiens
cagccctcctttcactcccagg

SEQ ID NO: 9121251 - DNA, 22 bp, Homo sapiens
gtgaatttctgactaaaagtgc

SEQ ID NO: 9121252 - DNA, 22 bp, Homo sapiens
gtcacaaatcccctcagcaact

SEQ ID NO: 9121253 - DNA, 22 bp, Homo sapiens
cagcatctctttttgcattcct

SEQ ID NO: 9121254 - DNA, 22 bp, Homo sapiens
cagcatctgttggatggataag

SEQ ID NO: 9121255 - DNA, 22 bp, Homo sapiens
cagcatctgttcccaacgagat

SEQ ID NO: 9121256 - DNA, 22 bp, Homo sapiens
gtccagagaggcaggaggctac

SEQ ID NO: 9121257 - DNA, 22 bp, Homo sapiens
cagcagccactagagggctcac

SEQ ID NO: 9121258 - DNA, 22 bp, Homo sapiens
cagcagcctacaatgcacagaa

SEQ ID NO: 9121259 - DNA, 22 bp, Homo sapiens
cagcagcctacaatgcacagaa

SEQ ID NO: 9121260 - DNA, 22 bp, Homo sapiens
gtacacactatgtattgtacac

SEQ ID NO: 9121261 - DNA, 22 bp, Homo sapiens
cagcagcctagaagctctacca

SEQ ID NO: 9121262 - DNA, 22 bp, Homo sapiens
gtacacattgtctgtttacttc

SEQ ID NO: 9121263 - DNA, 22 bp, Homo sapiens
gtacacattatgcttctctaaa

SEQ ID NO: 9121264 - DNA, 20 bp, Homo sapiens
gggtaaaaggcagtgttgca

SEQ ID NO: 9121265 - DNA, 22 bp, Homo sapiens
gggttcagtccctcttgctact

SEQ ID NO: 9121266 - DNA, 20 bp, Homo sapiens
gggtgtgggcccggccaggc

SEQ ID NO: 9121267 - DNA, 21 bp, Homo sapiens
gggtgtggaaattacatcctg

SEQ ID NO: 9121268 - DNA, 20 bp, Homo sapiens
gggtgtggcctgggaatttg

SEQ ID NO: 9121269 - DNA, 22 bp, Homo sapiens
gggtgtggctgcgtgccaataa

SEQ ID NO: 9121270 - DNA, 22 bp, Homo sapiens
gggtcccctcatcatggagact

SEQ ID NO: 9121271 - DNA, 18 bp, Homo sapiens
gggtccccagctgcaggg

SEQ ID NO: 9121272 - DNA, 19 bp, Homo sapiens
gggtcccaaaagatgtgct

SEQ ID NO: 9121273 - DNA, 22 bp, Homo sapiens
ggtcacaccccaagtacattcg

SEQ ID NO: 9121274 - DNA, 21 bp, Homo sapiens
ggtcacacagctggtaaatag

SEQ ID NO: 9121275 - DNA, 22 bp, Homo sapiens
cagagacaacctggtagagaaa

SEQ ID NO: 9121276 - DNA, 22 bp, Homo sapiens
cagagacaccccagaaaataag

SEQ ID NO: 9121277 - DNA, 22 bp, Homo sapiens
cagaaaataaagtttctacgca

SEQ ID NO: 9121278 - DNA, 22 bp, Homo sapiens
ggctggcacaaagctccaaatc

SEQ ID NO: 9121279 - DNA, 22 bp, Homo sapiens
ggctggcacgaagccctgctgg

SEQ ID NO: 9121280 - DNA, 22 bp, Homo sapiens
ggctggcacctgccctccgctg

SEQ ID NO: 9121281 - DNA, 22 bp, Homo sapiens
cagaatttagcacaatgtatgg

SEQ ID NO: 9121282 - DNA, 22 bp, Homo sapiens
cagaatttgaagtaatattcca

SEQ ID NO: 9121283 - DNA, 22 bp, Homo sapiens
cagaatttttcgaatgtactgt

SEQ ID NO: 9121284 - DNA, 22 bp, Homo sapiens
cagacacttattgagcaagtac

SEQ ID NO: 9121285 - DNA, 22 bp, Homo sapiens
gggaggagggtgctggctaaac

SEQ ID NO: 9121286 - DNA, 22 bp, Homo sapiens
ctttgggatttcatgagagcta

SEQ ID NO: 9121287 - DNA, 22 bp, Homo sapiens
ctttattgtccttcttaggtgg

SEQ ID NO: 9121288 - DNA, 22 bp, Homo sapiens
atcttgggacatgtgctctggg

SEQ ID NO: 9121289 - DNA, 22 bp, Homo sapiens
gaagctctcaacaatggggagt

SEQ ID NO: 9121290 - DNA, 22 bp, Homo sapiens
gaagctctaaggtcattgcatt

SEQ ID NO: 9121291 - DNA, 22 bp, Homo sapiens
gaagctctcaaactctcccctt

SEQ ID NO: 9121292 - DNA, 22 bp, Homo sapiens
gaagctctggacagtgaagaag

SEQ ID NO: 9121293 - DNA, 22 bp, Homo sapiens
gaagcctgtcatgtgacgctga

SEQ ID NO: 9121294 - DNA, 22 bp, Homo sapiens
atgctgggacgtacttgttcat

SEQ ID NO: 9121295 - DNA, 19 bp, Homo sapiens
gagccctctccatggccac

SEQ ID NO: 9121296 - DNA, 22 bp, Homo sapiens
gagccctccatggagccaggca

SEQ ID NO: 9121297 - DNA, 22 bp, Homo sapiens
gagccctcgggcgagcccgcgc

SEQ ID NO: 9121298 - DNA, 22 bp, Homo sapiens
gagccctccatggagccaggca

SEQ ID NO: 9121299 - DNA, 22 bp, Homo sapiens
gagccctcaccgcctgaccagg

SEQ ID NO: 9121300 - DNA, 22 bp, Homo sapiens
gagccctcaccgcctgaccagg

SEQ ID NO: 9121301 - DNA, 19 bp, Homo sapiens
gagccctctccatggccac

SEQ ID NO: 9121302 - DNA, 22 bp, Homo sapiens
gagccctctctgtaggcaagta

SEQ ID NO: 9121303 - DNA, 22 bp, Homo sapiens
atgtgccagtgccaggtctcta

SEQ ID NO: 9121304 - DNA, 22 bp, Homo sapiens
atgttactgtgatcatgatact

SEQ ID NO: 9121305 - DNA, 22 bp, Homo sapiens
atgttacagttgagtaaattaa

SEQ ID NO: 9121306 - DNA, 23 bp, Homo sapiens
atttcccattgtgtcagcagagc

SEQ ID NO: 9121307 - DNA, 19 bp, Homo sapiens
atttattgtatgattccat

SEQ ID NO: 9121308 - DNA, 22 bp, Homo sapiens
atttattggtttgcatggtgaa

SEQ ID NO: 9121309 - DNA, 22 bp, Homo sapiens
atttgtcaataagatgaacata

SEQ ID NO: 9121310 - DNA, 22 bp, Homo sapiens
atttgtcagtggaagtgattca

SEQ ID NO: 9121311 - DNA, 22 bp, Homo sapiens
atttgtactcaggaattctgct

SEQ ID NO: 9121312 - DNA, 22 bp, Homo sapiens
atttgtcaacaggcatttaggt

SEQ ID NO: 9121313 - DNA, 22 bp, Homo sapiens
gccttcccaagacgcctgagtt

SEQ ID NO: 9121314 - DNA, 19 bp, Homo sapiens
gccttcccaccacccgtcc

SEQ ID NO: 9121315 - DNA, 22 bp, Homo sapiens
gccttccctctcatcctgctgg

SEQ ID NO: 9121316 - DNA, 22 bp, Homo sapiens
gccttccctggctaggcaagca

SEQ ID NO: 9121317 - DNA, 21 bp, Homo sapiens
attttcattaattcagtgtgg

SEQ ID NO: 9121318 - DNA, 22 bp, Homo sapiens
attttcatgactaccttaaata

SEQ ID NO: 9121319 - DNA, 22 bp, Homo sapiens
attttcatggcttctgctcagt

SEQ ID NO: 9121320 - DNA, 22 bp, Homo sapiens
attccacagtgtgtggtgagga

SEQ ID NO: 9121321 - DNA, 22 bp, Homo sapiens
attccacagaggactccgattg

SEQ ID NO: 9121322 - DNA, 22 bp, Homo sapiens
attccacaggactaccaatgtg

SEQ ID NO: 9121323 - DNA, 22 bp, Homo sapiens
attccacagctcagcctctctt

SEQ ID NO: 9121324 - DNA, 22 bp, Homo sapiens
attccacagctacgttttgagc

SEQ ID NO: 9121325 - DNA, 22 bp, Homo sapiens
attccacagctcagcctctctt

SEQ ID NO: 9121326 - DNA, 22 bp, Homo sapiens
attcaatgggggtttctagttg

SEQ ID NO: 9121327 - DNA, 19 bp, Homo sapiens
attcatttttgccttctaa

SEQ ID NO: 9121328 - DNA, 22 bp, Homo sapiens
gcagcttcctgagtgtggacag

SEQ ID NO: 9121329 - DNA, 22 bp, Homo sapiens
gcagcttcaagatactttttct

SEQ ID NO: 9121330 - DNA, 22 bp, Homo sapiens
attctgacctgaatagacttgg

SEQ ID NO: 9121331 - DNA, 22 bp, Homo sapiens
attctttccagacactgattgc

SEQ ID NO: 9121332 - DNA, 22 bp, Homo sapiens
gatggccaaggaccacgcatcg

SEQ ID NO: 9121333 - DNA, 22 bp, Homo sapiens
gatgtgacaaaccaagaggact

SEQ ID NO: 9121334 - DNA, 22 bp, Homo sapiens
attatcaagtttactgtgtgga

SEQ ID NO: 9121335 - DNA, 22 bp, Homo sapiens
aaaatcttgtgacttaggaagg

SEQ ID NO: 9121336 - DNA, 23 bp, Homo sapiens
aaaatcttctgcctatgaagaaa

SEQ ID NO: 9121337 - DNA, 22 bp, Homo sapiens
aaaaaatcagatctttggttaa

SEQ ID NO: 9121338 - DNA, 22 bp, Homo sapiens
aaaaatcacttttataggcagc

SEQ ID NO: 9121339 - DNA, 20 bp, Homo sapiens
aaaatctcccagaaacttat

SEQ ID NO: 9121340 - DNA, 22 bp, Homo sapiens
aaaatccttagccgagtgaggt

SEQ ID NO: 9121341 - DNA, 22 bp, Homo sapiens
aaactcctgggctcaagcagtt

SEQ ID NO: 9121342 - DNA, 21 bp, Homo sapiens
aaagttcatgctttaatattc

SEQ ID NO: 9121343 - DNA, 22 bp, Homo sapiens
aaaccttaaaccaagctcttga

SEQ ID NO: 9121344 - DNA, 22 bp, Homo sapiens
aaagtgtttacattgctataag

SEQ ID NO: 9121345 - DNA, 22 bp, Homo sapiens
aaatctcaaaggcttagcatct

SEQ ID NO: 9121346 - DNA, 22 bp, Homo sapiens
aagctcttttctgcctcaccca

SEQ ID NO: 9121347 - DNA, 22 bp, Homo sapiens
aagctctttccactaaaccact

SEQ ID NO: 9121348 - DNA, 22 bp, Homo sapiens
aagctctttccctcttcagaac

SEQ ID NO: 9121349 - DNA, 22 bp, Homo sapiens
aagctcttttacaatcctaggc

SEQ ID NO: 9121350 - DNA, 22 bp, Homo sapiens
aagctctttgacctgggcctgg

SEQ ID NO: 9121351 - DNA, 22 bp, Homo sapiens
aagctcttttcaccattaaagt

SEQ ID NO: 9121352 - DNA, 22 bp, Homo sapiens
aagctcttttcataagagcaaa

SEQ ID NO: 9121353 - DNA, 22 bp, Homo sapiens
aagctctttaatagtctaaaaa

SEQ ID NO: 9121354 - DNA, 22 bp, Homo sapiens
aagctcttgttgaatcttgtca

SEQ ID NO: 9121355 - DNA, 22 bp, Homo sapiens
aagctcttgaatgggatcaagg

SEQ ID NO: 9121356 - DNA, 22 bp, Homo sapiens
aagctcttgagtaaactagttt

SEQ ID NO: 9121357 - DNA, 22 bp, Homo sapiens
aagcatctcattcttgcctgtc

SEQ ID NO: 9121358 - DNA, 20 bp, Homo sapiens
aagcatctggatgtagcaat

SEQ ID NO: 9121359 - DNA, 20 bp, Homo sapiens
aagcatctggatgtagcaat

SEQ ID NO: 9121360 - DNA, 19 bp, Homo sapiens
aagcatctttgaaactggg

SEQ ID NO: 9121361 - DNA, 22 bp, Homo sapiens
aaagctcttatgtaaacagaaa

SEQ ID NO: 9121362 - DNA, 22 bp, Homo sapiens
aaagctcttggattttagactc

SEQ ID NO: 9121363 - DNA, 22 bp, Homo sapiens
aaagctcttatagcagagtgtg

SEQ ID NO: 9121364 - DNA, 22 bp, Homo sapiens
aaagctcttactgtactagtga

SEQ ID NO: 9121365 - DNA, 22 bp, Homo sapiens
aaagctcttttccaagtattga

SEQ ID NO: 9121366 - DNA, 22 bp, Homo sapiens
aaagctcttgggagggttaatt

SEQ ID NO: 9121367 - DNA, 22 bp, Homo sapiens
aaagctctttcacttccgttct

SEQ ID NO: 9121368 - DNA, 22 bp, Homo sapiens
aaagctctttcttctttggcat

SEQ ID NO: 9121369 - DNA, 22 bp, Homo sapiens
aaagctctttgtatagtggaat

SEQ ID NO: 9121370 - DNA, 22 bp, Homo sapiens
aaattttctctctaagacttaa

SEQ ID NO: 9121371 - DNA, 22 bp, Homo sapiens
aaattttcctggtaaagatgga

SEQ ID NO: 9121372 - DNA, 22 bp, Homo sapiens
aaattttcagagcactagagaa

SEQ ID NO: 9121373 - DNA, 22 bp, Homo sapiens
aacaaaagccgaagtaggtgtc

SEQ ID NO: 9121374 - DNA, 22 bp, Homo sapiens
aaagtatatttacttactgtga

SEQ ID NO: 9121375 - DNA, 22 bp, Homo sapiens
aacaaagaagactggttatttt

SEQ ID NO: 9121376 - DNA, 22 bp, Homo sapiens
aaattctatgtcaatgtttatt

SEQ ID NO: 9121377 - DNA, 22 bp, Homo sapiens
aaattgaatgattaagtggtga

SEQ ID NO: 9121378 - DNA, 22 bp, Homo sapiens
aaatgtgttcctttgctacaga

SEQ ID NO: 9121379 - DNA, 22 bp, Homo sapiens
aaatgttcctttggattaaact

SEQ ID NO: 9121380 - DNA, 22 bp, Homo sapiens
aaatgttctactttgataatta

SEQ ID NO: 9121381 - DNA, 22 bp, Homo sapiens
aaatgttctaaattacatgtga

SEQ ID NO: 9121382 - DNA, 22 bp, Homo sapiens
aaatgttaggttgtactgagtc

SEQ ID NO: 9121383 - DNA, 22 bp, Homo sapiens
aaatgttcatttctcactcaca

SEQ ID NO: 9121384 - DNA, 22 bp, Homo sapiens
aaatgttccattattgtgtaat

SEQ ID NO: 9121385 - DNA, 22 bp, Homo sapiens
aaatgtttctacttgtgagcat

SEQ ID NO: 9121386 - DNA, 22 bp, Homo sapiens
aaggtctctgttgagaacattt

SEQ ID NO: 9121387 - DNA, 22 bp, Homo sapiens
aacagcaggcaccaaggctatg

SEQ ID NO: 9121388 - DNA, 22 bp, Homo sapiens
aacagcagggatgacatggcca

SEQ ID NO: 9121389 - DNA, 22 bp, Homo sapiens
aacacatagacgtttgatatca

SEQ ID NO: 9121390 - DNA, 22 bp, Homo sapiens
aaggtcagagcaggaaggagtc

SEQ ID NO: 9121391 - DNA, 22 bp, Homo sapiens
aacttaatgatttcatgcatgt

SEQ ID NO: 9121392 - DNA, 22 bp, Homo sapiens
aactgcatttaacaaatactct

SEQ ID NO: 9121393 - DNA, 22 bp, Homo sapiens
aatcatcacgaacacaacagcg

SEQ ID NO: 9121394 - DNA, 22 bp, Homo sapiens
aactgcattgtactaaacttgt

SEQ ID NO: 9121395 - DNA, 22 bp, Homo sapiens
aacatgctgcctttctacgagt

SEQ ID NO: 9121396 - DNA, 20 bp, Homo sapiens
aaccaacagaatcatgtctc

SEQ ID NO: 9121397 - DNA, 22 bp, Homo sapiens
aacatggctcatgagagatttg

SEQ ID NO: 9121398 - DNA, 22 bp, Homo sapiens
acagcagctgggttcccaccat

SEQ ID NO: 9121399 - DNA, 22 bp, Homo sapiens
aagattctgtatttctaacaat

SEQ ID NO: 9121400 - DNA, 22 bp, Homo sapiens
aagatttaccactttattcaag

SEQ ID NO: 9121401 - DNA, 22 bp, Homo sapiens
acactgctaaacagtaaagatg

SEQ ID NO: 9121402 - DNA, 22 bp, Homo sapiens
acactggatgaagcaagctaaa

SEQ ID NO: 9121403 - DNA, 22 bp, Homo sapiens
acactggataccactgttatta

SEQ ID NO: 9121404 - DNA, 22 bp, Homo sapiens
acactggattcttgtagtgaag

SEQ ID NO: 9121405 - DNA, 22 bp, Homo sapiens
acactggagggtccagggatgt

SEQ ID NO: 9121406 - DNA, 22 bp, Homo sapiens
acactggaggagagctgttgct

SEQ ID NO: 9121407 - DNA, 22 bp, Homo sapiens
acactggaccatttaaacttga

SEQ ID NO: 9121408 - DNA, 22 bp, Homo sapiens
acactggagcttctagcccacg

SEQ ID NO: 9121409 - DNA, 22 bp, Homo sapiens
acactggaaatagggaggtttt

SEQ ID NO: 9121410 - DNA, 22 bp, Homo sapiens
acactggacactgaactccctg

SEQ ID NO: 9121411 - DNA, 22 bp, Homo sapiens
acactggactcagaggccagaa

SEQ ID NO: 9121412 - DNA, 22 bp, Homo sapiens
acactggagatggacctcacaa

SEQ ID NO: 9121413 - DNA, 22 bp, Homo sapiens
aagatttattagatgcttacct

SEQ ID NO: 9121414 - DNA, 22 bp, Homo sapiens
aagatttactagcataatagct

SEQ ID NO: 9121415 - DNA, 22 bp, Homo sapiens
aagatttagggccagtttacat

SEQ ID NO: 9121416 - DNA, 22 bp, Homo sapiens
aagatttactttctttgtaata

SEQ ID NO: 9121417 - DNA, 22 bp, Homo sapiens
aacttcatgtaatttaaaacag

SEQ ID NO: 9121418 - DNA, 22 bp, Homo sapiens
acaaagattcatttgcattatt

SEQ ID NO: 9121419 - DNA, 22 bp, Homo sapiens
acaaaattgtgttaaactttat

SEQ ID NO: 9121420 - DNA, 22 bp, Homo sapiens
aattttctgatgatgaagcacg

SEQ ID NO: 9121421 - DNA, 22 bp, Homo sapiens
acaaatgtgtctaattgtgcct

SEQ ID NO: 9121422 - DNA, 22 bp, Homo sapiens
agcaagattgaggcttcctcag

SEQ ID NO: 9121423 - DNA, 22 bp, Homo sapiens
acaattcattaatgtgaggtag

SEQ ID NO: 9121424 - DNA, 22 bp, Homo sapiens
agacagcacttttgtatggggg

SEQ ID NO: 9121425 - DNA, 22 bp, Homo sapiens
aatgttgccccaggacaaagga

SEQ ID NO: 9121426 - DNA, 22 bp, Homo sapiens
aatgttctgtgctggttctggg

SEQ ID NO: 9121427 - DNA, 22 bp, Homo sapiens
aatgttctcaacaaaaggaagc

SEQ ID NO: 9121428 - DNA, 22 bp, Homo sapiens
aatgttcattgattaaatgaat

SEQ ID NO: 9121429 - DNA, 22 bp, Homo sapiens
aatgttattgtcctttccaaaa

SEQ ID NO: 9121430 - DNA, 22 bp, Homo sapiens
aatgtttcgtaaattgtctatg

SEQ ID NO: 9121431 - DNA, 22 bp, Homo sapiens
aatgtttcatttagttgtctcc

SEQ ID NO: 9121432 - DNA, 22 bp, Homo sapiens
aatgtttcaattaagtctttta

SEQ ID NO: 9121433 - DNA, 20 bp, Homo sapiens
aatgtttctgaacaggtagt

SEQ ID NO: 9121434 - DNA, 22 bp, Homo sapiens
aatgtttctggatattgtgggt

SEQ ID NO: 9121435 - DNA, 22 bp, Homo sapiens
aatgtttgaactttgcatattt

SEQ ID NO: 9121436 - DNA, 22 bp, Homo sapiens
aattatattgtggtgtgaatgt

SEQ ID NO: 9121437 - DNA, 20 bp, Homo sapiens
aatttactcacagaatgaat

SEQ ID NO: 9121438 - DNA, 22 bp, Homo sapiens
aatttatatgtaattaggcaca

SEQ ID NO: 9121439 - DNA, 19 bp, Homo sapiens
acagagtgatgaggataga

SEQ ID NO: 9121440 - DNA, 22 bp, Homo sapiens
agcccctctgtggctctgcctc

SEQ ID NO: 9121441 - DNA, 22 bp, Homo sapiens
acagagtggagttcagtaaata

SEQ ID NO: 9121442 - DNA, 22 bp, Homo sapiens
acagagtgtttttaagtatatt

SEQ ID NO: 9121443 - DNA, 23 bp, Homo sapiens
agcccctcatggtgtctagacag

SEQ ID NO: 9121444 - DNA, 22 bp, Homo sapiens
agccccccaagggccttctctt

SEQ ID NO: 9121445 - DNA, 22 bp, Homo sapiens
agcccagcttccttctgtctct

SEQ ID NO: 9121446 - DNA, 22 bp, Homo sapiens
agccatcgccgcaggcatctgc

SEQ ID NO: 9121447 - DNA, 22 bp, Homo sapiens
agctatctgcatgttttgctag

SEQ ID NO: 9121448 - DNA, 22 bp, Homo sapiens
acagcaatctgagagacatagt

SEQ ID NO: 9121449 - DNA, 22 bp, Homo sapiens
acagaaattgctaatagctcat

SEQ ID NO: 9121450 - DNA, 22 bp, Homo sapiens
agcaccctcccaccctctcaga

SEQ ID NO: 9121451 - DNA, 22 bp, Homo sapiens
agcacccttcagcccagcctgg

SEQ ID NO: 9121452 - DNA, 22 bp, Homo sapiens
acacaggacggccctgtggctt

SEQ ID NO: 9121453 - DNA, 22 bp, Homo sapiens
acacagatgggtagaaaacaga

SEQ ID NO: 9121454 - DNA, 22 bp, Homo sapiens
aagttactggcaagggctgcag

SEQ ID NO: 9121455 - DNA, 22 bp, Homo sapiens
actccagttctcttgtttataa

SEQ ID NO: 9121456 - DNA, 22 bp, Homo sapiens
aagtgcatagtaatggagtcaa

SEQ ID NO: 9121457 - DNA, 22 bp, Homo sapiens
aagtttatgttggtaagatatc

SEQ ID NO: 9121458 - DNA, 21 bp, Homo sapiens
aataattcagacattgttgtt

SEQ ID NO: 9121459 - DNA, 22 bp, Homo sapiens
aataatgtttatttgtattctc

SEQ ID NO: 9121460 - DNA, 22 bp, Homo sapiens
aatgagaaccttgaaaggaact

SEQ ID NO: 9121461 - DNA, 22 bp, Homo sapiens
aatgagaaaacacagaggaggt

SEQ ID NO: 9121462 - DNA, 22 bp, Homo sapiens
aatcaaaacctacagaggtaat

SEQ ID NO: 9121463 - DNA, 22 bp, Homo sapiens
acagtagagcatttgttttgat

SEQ ID NO: 9121464 - DNA, 22 bp, Homo sapiens
acagtagattggtatgatgtca

SEQ ID NO: 9121465 - DNA, 22 bp, Homo sapiens
aaggcagcttcaccacagcatt

SEQ ID NO: 9121466 - DNA, 22 bp, Homo sapiens
aaggcagtcaaagcagacttct

SEQ ID NO: 9121467 - DNA, 22 bp, Homo sapiens
aaggcagtactttatgtccata

SEQ ID NO: 9121468 - DNA, 22 bp, Homo sapiens
aagctcttcctgcagggacctt

SEQ ID NO: 9121469 - DNA, 22 bp, Homo sapiens
aagctcttcttgccaccattca

SEQ ID NO: 9121470 - DNA, 22 bp, Homo sapiens
aagctcttctgtggatttgagt

SEQ ID NO: 9121471 - DNA, 21 bp, Homo sapiens
aagctcttctcagggtcacct

SEQ ID NO: 9121472 - DNA, 22 bp, Homo sapiens
aagctcttcctggagcgcccac

SEQ ID NO: 9121473 - DNA, 22 bp, Homo sapiens
aagctcttgaagaccaccagga

SEQ ID NO: 9121474 - DNA, 22 bp, Homo sapiens
aagggaagtttgcatcctcact

SEQ ID NO: 9121475 - DNA, 22 bp, Homo sapiens
aagggaaggttccattatactt

SEQ ID NO: 9121476 - DNA, 22 bp, Homo sapiens
aaggctcttggagtgaatgcag

SEQ ID NO: 9121477 - DNA, 22 bp, Homo sapiens
aaggcttctttagtgtcctaat

SEQ ID NO: 9121478 - DNA, 22 bp, Homo sapiens
aaggtgctgtggacttgggagc

SEQ ID NO: 9121479 - DNA, 22 bp, Homo sapiens
aggctgagctggtagtgagtac

SEQ ID NO: 9121480 - DNA, 18 bp, Homo sapiens
acatttctatgcttctgg

SEQ ID NO: 9121481 - DNA, 22 bp, Homo sapiens
acatcagacaattaattattaa

SEQ ID NO: 9121482 - DNA, 22 bp, Homo sapiens
acatcagagggctcacatgatc

SEQ ID NO: 9121483 - DNA, 22 bp, Homo sapiens
acatgtttgataaatatttggg

SEQ ID NO: 9121484 - DNA, 22 bp, Homo sapiens
agggctgcccagtgtgagagct

SEQ ID NO: 9121485 - DNA, 20 bp, Homo sapiens
acccagctctgtgccctggg

SEQ ID NO: 9121486 - DNA, 22 bp, Homo sapiens
acccagctgtttcccgtgtcat

SEQ ID NO: 9121487 - DNA, 22 bp, Homo sapiens
agggggcatcaggtcctggctc

SEQ ID NO: 9121488 - DNA, 22 bp, Homo sapiens
agggcagcaatgcagctgctgc

SEQ ID NO: 9121489 - DNA, 20 bp, Homo sapiens
aggcttggcttggcaggaac

SEQ ID NO: 9121490 - DNA, 22 bp, Homo sapiens
aggcttgggactgcttaggagc

SEQ ID NO: 9121491 - DNA, 18 bp, Homo sapiens
aggcttgggcccagcagc

SEQ ID NO: 9121492 - DNA, 21 bp, Homo sapiens
aggcttgggtaaaaaggtcat

SEQ ID NO: 9121493 - DNA, 22 bp, Homo sapiens
aggcttgggtcagaaggcttgt

SEQ ID NO: 9121494 - DNA, 19 bp, Homo sapiens
aggcttggtgttgaatggg

SEQ ID NO: 9121495 - DNA, 22 bp, Homo sapiens
aggcttggtgccaaggagcctg

SEQ ID NO: 9121496 - DNA, 22 bp, Homo sapiens
aggcttggtttatagaagtaat

SEQ ID NO: 9121497 - DNA, 19 bp, Homo sapiens
aggcttggttgcagcaagc

SEQ ID NO: 9121498 - DNA, 22 bp, Homo sapiens
aggcttggttaattctgtgtga

SEQ ID NO: 9121499 - DNA, 19 bp, Homo sapiens
agggagaattccaagagga

SEQ ID NO: 9121500 - DNA, 22 bp, Homo sapiens
aggcagctgaccacagtatgat

SEQ ID NO: 9121501 - DNA, 22 bp, Homo sapiens
acatattggcttagctctgtga

SEQ ID NO: 9121502 - DNA, 22 bp, Homo sapiens
acatattgaggctttgatttaa

SEQ ID NO: 9121503 - DNA, 17 bp, Homo sapiens
aggcagctcagaacatc

SEQ ID NO: 9121504 - DNA, 17 bp, Homo sapiens
acaggcagatcacctga

SEQ ID NO: 9121505 - DNA, 22 bp, Homo sapiens
atactgaaagggtgttacctaa

SEQ ID NO: 9121506 - DNA, 20 bp, Homo sapiens
atacacttgcccagcttgtg

SEQ ID NO: 9121507 - DNA, 22 bp, Homo sapiens
acttctgaagcagagatttggg

SEQ ID NO: 9121508 - DNA, 22 bp, Homo sapiens
acttctgataaagagcatgtgc

SEQ ID NO: 9121509 - DNA, 22 bp, Homo sapiens
atacagggacatccagtttttc

SEQ ID NO: 9121510 - DNA, 22 bp, Homo sapiens
ataaaatttgctactgttaaat

SEQ ID NO: 9121511 - DNA, 22 bp, Homo sapiens
atatttcacgtaggttgttttc

SEQ ID NO: 9121512 - DNA, 22 bp, Homo sapiens
atattcttatccttttctctgt

SEQ ID NO: 9121513 - DNA, 22 bp, Homo sapiens
atattctgcctcactacagttg

SEQ ID NO: 9121514 - DNA, 22 bp, Homo sapiens
atattcttccaaaacatcattt

SEQ ID NO: 9121515 - DNA, 22 bp, Homo sapiens
actttcatggatctctgttcag

SEQ ID NO: 9121516 - DNA, 22 bp, Homo sapiens
actttcatttgtaataaacttc

SEQ ID NO: 9121517 - DNA, 22 bp, Homo sapiens
agaaagttcactggtatatttt

SEQ ID NO: 9121518 - DNA, 22 bp, Homo sapiens
atctaaaaggagctctttatct

SEQ ID NO: 9121519 - DNA, 22 bp, Homo sapiens
atctcacagaggcccaccagga

SEQ ID NO: 9121520 - DNA, 22 bp, Homo sapiens
acgcccagactcccatactttg

SEQ ID NO: 9121521 - DNA, 20 bp, Homo sapiens
aggtggctcctgctgggggt

SEQ ID NO: 9121522 - DNA, 22 bp, Homo sapiens
aggtggctcctcccatggctgg

SEQ ID NO: 9121523 - DNA, 22 bp, Homo sapiens
agtaaaatcaccatctctttgt

SEQ ID NO: 9121524 - DNA, 22 bp, Homo sapiens
acctctgggcagcacctttgta

SEQ ID NO: 9121525 - DNA, 19 bp, Homo sapiens
accctctccccactgggtc

SEQ ID NO: 9121526 - DNA, 19 bp, Homo sapiens
accctctctgtagaaagat

SEQ ID NO: 9121527 - DNA, 22 bp, Homo sapiens
acctcccttgctaaagactgtg

SEQ ID NO: 9121528 - DNA, 22 bp, Homo sapiens
accctccccaagaggtcgtgcc

SEQ ID NO: 9121529 - DNA, 22 bp, Homo sapiens
accctcccatttccatgtagca

SEQ ID NO: 9121530 - DNA, 22 bp, Homo sapiens
aggtggctatgaggatgcagtc

SEQ ID NO: 9121531 - DNA, 22 bp, Homo sapiens
aggtctcaagttgagaaggcag

SEQ ID NO: 9121532 - DNA, 22 bp, Homo sapiens
actggaatgaagttaatctgat

SEQ ID NO: 9121533 - DNA, 22 bp, Homo sapiens
actggaaattgagaggtcactg

SEQ ID NO: 9121534 - DNA, 22 bp, Homo sapiens
actggaaaaccactgaaatgag

SEQ ID NO: 9121535 - DNA, 22 bp, Homo sapiens
actggaaaattcaaatggggtc

SEQ ID NO: 9121536 - DNA, 22 bp, Homo sapiens
actggaaaacactactacatgc

SEQ ID NO: 9121537 - DNA, 22 bp, Homo sapiens
actggaaaggctctgaatggga

SEQ ID NO: 9121538 - DNA, 22 bp, Homo sapiens
actggaaactacagcctatcct

SEQ ID NO: 9121539 - DNA, 22 bp, Homo sapiens
actggaaagttgattatgtcca

SEQ ID NO: 9121540 - DNA, 22 bp, Homo sapiens
actggaaagtattctttcactg

SEQ ID NO: 9121541 - DNA, 22 bp, Homo sapiens
actggaaataaattttgaatgt

SEQ ID NO: 9121542 - DNA, 22 bp, Homo sapiens
actggaaatgagatgatatcag

SEQ ID NO: 9121543 - DNA, 22 bp, Homo sapiens
actctaaaagtgaagtgtggtc

SEQ ID NO: 9121544 - DNA, 23 bp, Homo sapiens
agcccaccttgttagtcctgtgg

SEQ ID NO: 9121545 - DNA, 22 bp, Homo sapiens
cagaatgtattctcataaagcc

SEQ ID NO: 9121546 - DNA, 22 bp, Homo sapiens
cagaaatatttattgagtgaca

SEQ ID NO: 9121547 - DNA, 21 bp, Homo sapiens
cagaaatatgaatgatggtga

SEQ ID NO: 9121548 - DNA, 22 bp, Homo sapiens
cagcagctcaggctgcttccca

SEQ ID NO: 9121549 - DNA, 22 bp, Homo sapiens
agcctccctatgcaccttcagg

SEQ ID NO: 9121550 - DNA, 22 bp, Homo sapiens
agcaggcaagcgtgagttctct

SEQ ID NO: 9121551 - DNA, 22 bp, Homo sapiens
cacccaggctggagagcagtgg

SEQ ID NO: 9121552 - DNA, 22 bp, Homo sapiens
caccgatgatgtgggagacact

SEQ ID NO: 9121553 - DNA, 22 bp, Homo sapiens
caagatttatattttcacacaa

SEQ ID NO: 9121554 - DNA, 22 bp, Homo sapiens
cacaaggacatgtatatttatg

SEQ ID NO: 9121555 - DNA, 22 bp, Homo sapiens
cacaaggaggtcctgaggaagc

SEQ ID NO: 9121556 - DNA, 22 bp, Homo sapiens
caaattaatgtgtctcaaaata

SEQ ID NO: 9121557 - DNA, 22 bp, Homo sapiens
agcaccaagcctagagtgatgt

SEQ ID NO: 9121558 - DNA, 21 bp, Homo sapiens
agcaccaaatgcaggctctgg

SEQ ID NO: 9121559 - DNA, 22 bp, Homo sapiens
agagccaaggctgagagctatt

SEQ ID NO: 9121560 - DNA, 22 bp, Homo sapiens
agagccaatcttcagagcagag

SEQ ID NO: 9121561 - DNA, 22 bp, Homo sapiens
atgggtccctggccgccctcgg

SEQ ID NO: 9121562 - DNA, 17 bp, Homo sapiens
atggctcacctgtgggc

SEQ ID NO: 9121563 - DNA, 22 bp, Homo sapiens
atctcagaaacatatctaatcc

SEQ ID NO: 9121564 - DNA, 22 bp, Homo sapiens
atctcagaaacatatctaatcc

SEQ ID NO: 9121565 - DNA, 22 bp, Homo sapiens
atctcagatctacagatctaca

SEQ ID NO: 9121566 - DNA, 22 bp, Homo sapiens
agacagcaggggagtctggttt

SEQ ID NO: 9121567 - DNA, 22 bp, Homo sapiens
agacagcagggagcaggattca

SEQ ID NO: 9121568 - DNA, 22 bp, Homo sapiens
agacagcagcagaggggctccc

SEQ ID NO: 9121569 - DNA, 22 bp, Homo sapiens
agacagcatttctagcaccagg

SEQ ID NO: 9121570 - DNA, 22 bp, Homo sapiens
agacagcatgatacatgatgct

SEQ ID NO: 9121571 - DNA, 22 bp, Homo sapiens
agaggacaggttttccatgggc

SEQ ID NO: 9121572 - DNA, 22 bp, Homo sapiens
agaggacagacggaaagtgcca

SEQ ID NO: 9121573 - DNA, 22 bp, Homo sapiens
agaggacacatctttcctcaaa

SEQ ID NO: 9121574 - DNA, 22 bp, Homo sapiens
attcatttgctattgtgtatgg

SEQ ID NO: 9121575 - DNA, 22 bp, Homo sapiens
attcatttaggtattcacttac

SEQ ID NO: 9121576 - DNA, 22 bp, Homo sapiens
agagttttatggctttaattct

SEQ ID NO: 9121577 - DNA, 22 bp, Homo sapiens
agataaaatggttcaaaggcta

SEQ ID NO: 9121578 - DNA, 22 bp, Homo sapiens
atttattgaagcttattacgtt

SEQ ID NO: 9121579 - DNA, 22 bp, Homo sapiens
agatacatatagaaaacatcaa

SEQ ID NO: 9121580 - DNA, 22 bp, Homo sapiens
atttcacagctgctgttcaggt

SEQ ID NO: 9121581 - DNA, 22 bp, Homo sapiens
agaggtcagaacaggaaagtgt

SEQ ID NO: 9121582 - DNA, 22 bp, Homo sapiens
agaggtcagagcaggaaaggca

SEQ ID NO: 9121583 - DNA, 22 bp, Homo sapiens
agaggtcatatctcagaagaga

SEQ ID NO: 9121584 - DNA, 22 bp, Homo sapiens
attgctaggaacaggttgcacc

SEQ ID NO: 9121585 - DNA, 22 bp, Homo sapiens
atttctctgcagtgttcggaat

SEQ ID NO: 9121586 - DNA, 22 bp, Homo sapiens
gccaccctgcaaatgcccagga

SEQ ID NO: 9121587 - DNA, 22 bp, Homo sapiens
gcattgaatcctatcaggcaaa

SEQ ID NO: 9121588 - DNA, 22 bp, Homo sapiens
gcattgaaggacttccattata

SEQ ID NO: 9121589 - DNA, 22 bp, Homo sapiens
gcattgaagatcttagactagg

SEQ ID NO: 9121590 - DNA, 22 bp, Homo sapiens
gcattgaaggcattttatctac

SEQ ID NO: 9121591 - DNA, 22 bp, Homo sapiens
gcattgaaccatctagatttct

SEQ ID NO: 9121592 - DNA, 23 bp, Homo sapiens
gcattgaacaaaagaggggagta

SEQ ID NO: 9121593 - DNA, 22 bp, Homo sapiens
gcattgaaatggcaaaaagaga

SEQ ID NO: 9121594 - DNA, 22 bp, Homo sapiens
gcccaaggtcacacacaggaag

SEQ ID NO: 9121595 - DNA, 22 bp, Homo sapiens
gcccaaggtatatcagagacag

SEQ ID NO: 9121596 - DNA, 22 bp, Homo sapiens
gcccaagggcatcaagttctac

SEQ ID NO: 9121597 - DNA, 22 bp, Homo sapiens
gccagctggtaggcacctagcc

SEQ ID NO: 9121598 - DNA, 22 bp, Homo sapiens
gcctgcagcccctctgcagtag

SEQ ID NO: 9121599 - DNA, 22 bp, Homo sapiens
gcctgcagctgcttccacacac

SEQ ID NO: 9121600 - DNA, 22 bp, Homo sapiens
gcctccccaggggtgtcatgag

SEQ ID NO: 9121601 - DNA, 22 bp, Homo sapiens
gcctccctgagtcacccaagca

SEQ ID NO: 9121602 - DNA, 22 bp, Homo sapiens
gcctccctggcccacagcagcg

SEQ ID NO: 9121603 - DNA, 22 bp, Homo sapiens
gcctccctccaccactgcaggt

SEQ ID NO: 9121604 - DNA, 22 bp, Homo sapiens
gcctcccctgcaattgtccttg

SEQ ID NO: 9121605 - DNA, 22 bp, Homo sapiens
gcctccctgttcttccacaata

SEQ ID NO: 9121606 - DNA, 22 bp, Homo sapiens
gcctccctgtttcctgctccaa

SEQ ID NO: 9121607 - DNA, 18 bp, Homo sapiens
gcctccctggctacactt

SEQ ID NO: 9121608 - DNA, 22 bp, Homo sapiens
gcctccctgtagaggccagcct

SEQ ID NO: 9121609 - DNA, 20 bp, Homo sapiens
gcccaaggtccagaaggggg

SEQ ID NO: 9121610 - DNA, 22 bp, Homo sapiens
gcccctctccttgtgcacctgc

SEQ ID NO: 9121611 - DNA, 22 bp, Homo sapiens
gcccctccgggcgcgtcatagc

SEQ ID NO: 9121612 - DNA, 22 bp, Homo sapiens
gcccctctcccttgaggcaggc

SEQ ID NO: 9121613 - DNA, 22 bp, Homo sapiens
gcccctcccagtcaggagcact

SEQ ID NO: 9121614 - DNA, 22 bp, Homo sapiens
gcccctccatccatcaccgggg

SEQ ID NO: 9121615 - DNA, 22 bp, Homo sapiens
gccccttcgtggaagtgcattc

SEQ ID NO: 9121616 - DNA, 22 bp, Homo sapiens
gccccttgtctccaggccccaa

SEQ ID NO: 9121617 - DNA, 22 bp, Homo sapiens
gccccttctctgaggaacctgc

SEQ ID NO: 9121618 - DNA, 22 bp, Homo sapiens
gccccttcttctggagattcaa

SEQ ID NO: 9121619 - DNA, 22 bp, Homo sapiens
gccccttgggaattcctccact

SEQ ID NO: 9121620 - DNA, 17 bp, Homo sapiens
gccctgcctgctgccct

SEQ ID NO: 9121621 - DNA, 19 bp, Homo sapiens
gcaggcccagtcgggctgg

SEQ ID NO: 9121622 - DNA, 22 bp, Homo sapiens
gcagccaggaagcccaggacac

SEQ ID NO: 9121623 - DNA, 22 bp, Homo sapiens
gcacatttctcaaagaattgtc

SEQ ID NO: 9121624 - DNA, 22 bp, Homo sapiens
gctctctgtcgttatgcttcat

SEQ ID NO: 9121625 - DNA, 22 bp, Homo sapiens
gctccctccatgaggcagaccg

SEQ ID NO: 9121626 - DNA, 22 bp, Homo sapiens
gctccctcccaccagcctgcag

SEQ ID NO: 9121627 - DNA, 22 bp, Homo sapiens
gctccctcatctgtgctgtttt

SEQ ID NO: 9121628 - DNA, 22 bp, Homo sapiens
gctccctctgctcaggcacttg

SEQ ID NO: 9121629 - DNA, 22 bp, Homo sapiens
ggagaaagaaatttttgattgg

SEQ ID NO: 9121630 - DNA, 22 bp, Homo sapiens
gcttggggtcatgaggctgctg

SEQ ID NO: 9121631 - DNA, 22 bp, Homo sapiens
gcttttatttcttcacaaaagt

SEQ ID NO: 9121632 - DNA, 22 bp, Homo sapiens
gcttttatgcacataagggtca

SEQ ID NO: 9121633 - DNA, 22 bp, Homo sapiens
gcttttattgtctttacgacga

SEQ ID NO: 9121634 - DNA, 19 bp, Homo sapiens
gcttttattgctcaggtgc

SEQ ID NO: 9121635 - DNA, 22 bp, Homo sapiens
gctgtaggttcagtctccatgc

SEQ ID NO: 9121636 - DNA, 22 bp, Homo sapiens
ggtaaaaatcacaaatacttta

SEQ ID NO: 9121637 - DNA, 22 bp, Homo sapiens
gggttttcttcaaaagtctaga

SEQ ID NO: 9121638 - DNA, 22 bp, Homo sapiens
gggttttccttctgcattggag

SEQ ID NO: 9121639 - DNA, 22 bp, Homo sapiens
gggtgtcctgtgccaagctggg

SEQ ID NO: 9121640 - DNA, 22 bp, Homo sapiens
ggtccctgaagatgcctgagga

SEQ ID NO: 9121641 - DNA, 20 bp, Homo sapiens
ggtccctgccctctgtcatc

SEQ ID NO: 9121642 - DNA, 22 bp, Homo sapiens
ggtccctgcctgaggctggcct

SEQ ID NO: 9121643 - DNA, 22 bp, Homo sapiens
ggtccctgaagaggcctggggt

SEQ ID NO: 9121644 - DNA, 22 bp, Homo sapiens
ggtcccagttgcccaggtcagg

SEQ ID NO: 9121645 - DNA, 22 bp, Homo sapiens
ggtgagggagtggaacgaggtg

SEQ ID NO: 9121646 - DNA, 19 bp, Homo sapiens
ggtgagccctcgcctgcct

SEQ ID NO: 9121647 - DNA, 22 bp, Homo sapiens
ggtggtggagccagctgggagt

SEQ ID NO: 9121648 - DNA, 22 bp, Homo sapiens
ggtgggtgagccctgggagctg

SEQ ID NO: 9121649 - DNA, 22 bp, Homo sapiens
ggtggcaccttaccctgcgcag

SEQ ID NO: 9121650 - DNA, 22 bp, Homo sapiens
ggggcccctgtggcttgatgcc

SEQ ID NO: 9121651 - DNA, 22 bp, Homo sapiens
ggggcccctcggacacgtgcgg

SEQ ID NO: 9121652 - DNA, 16 bp, Homo sapiens
gggctgggggattctg

SEQ ID NO: 9121653 - DNA, 22 bp, Homo sapiens
ggggaggacctttccaaggctt

SEQ ID NO: 9121654 - DNA, 21 bp, Homo sapiens
gtcttttaagtgaagagaggc

SEQ ID NO: 9121655 - DNA, 22 bp, Homo sapiens
gtgagccattctactcctaacc

SEQ ID NO: 9121656 - DNA, 22 bp, Homo sapiens
gtctaaagtctatacttttgtg

SEQ ID NO: 9121657 - DNA, 22 bp, Homo sapiens
gtctacagtgaatgggtcctaa

SEQ ID NO: 9121658 - DNA, 22 bp, Homo sapiens
gtctccagtgttcaggtgactg

SEQ ID NO: 9121659 - DNA, 22 bp, Homo sapiens
gtgccagcctggtgcgcctggg

SEQ ID NO: 9121660 - DNA, 22 bp, Homo sapiens
gtgcccaccggtgccctgagct

SEQ ID NO: 9121661 - DNA, 22 bp, Homo sapiens
gtcaacaaagaaaattgttaat

SEQ ID NO: 9121662 - DNA, 22 bp, Homo sapiens
gtcactcatctcatggaggggt

SEQ ID NO: 9121663 - DNA, 22 bp, Homo sapiens
gtcacctctcatcacatgctac

SEQ ID NO: 9121664 - DNA, 21 bp, Homo sapiens
ggccagcagcgtccactgtgg

SEQ ID NO: 9121665 - DNA, 22 bp, Homo sapiens
ggccaccaaagtcctgtggctt

SEQ ID NO: 9121666 - DNA, 17 bp, Homo sapiens
ggaggcaacagacaggg

SEQ ID NO: 9121667 - DNA, 19 bp, Homo sapiens
ggcacctttctgctgtgtc

SEQ ID NO: 9121668 - DNA, 22 bp, Homo sapiens
ggcagcactgcagcttgttggg

SEQ ID NO: 9121669 - DNA, 22 bp, Homo sapiens
gggaggttgaggctgcagtgag

SEQ ID NO: 9121670 - DNA, 22 bp, Homo sapiens
gggccccttgctgctctgctgg

SEQ ID NO: 9121671 - DNA, 22 bp, Homo sapiens
gggctctgagctctgggaatta

SEQ ID NO: 9121672 - DNA, 22 bp, Homo sapiens
ggctgtggccagcggggctgag

SEQ ID NO: 9121673 - DNA, 22 bp, Homo sapiens
ggctgtgggccagctagaccct

SEQ ID NO: 9121674 - DNA, 22 bp, Homo sapiens
ggctgtgggatgcataggagct

SEQ ID NO: 9121675 - DNA, 22 bp, Homo sapiens
ggctgtggggggagcctgcccg

SEQ ID NO: 9121676 - DNA, 22 bp, Homo sapiens
ggctgtggggccgggtacagtg

SEQ ID NO: 9121677 - DNA, 22 bp, Homo sapiens
ggctgtggtctcatctagcctt

SEQ ID NO: 9121678 - DNA, 22 bp, Homo sapiens
ggctgtggtcattaggaggttg

SEQ ID NO: 9121679 - DNA, 22 bp, Homo sapiens
ggctgtgggtgtgacaggcctc

SEQ ID NO: 9121680 - DNA, 22 bp, Homo sapiens
ggctgtgcgtcatccggctgca

SEQ ID NO: 9121681 - DNA, 22 bp, Homo sapiens
ggctgtggacactgagctcaga

SEQ ID NO: 9121682 - DNA, 21 bp, Homo sapiens
ggctgtggagccatgactcac

SEQ ID NO: 9121683 - DNA, 22 bp, Homo sapiens
ggctgtggcagctggaagtggt

SEQ ID NO: 9121684 - DNA, 22 bp, Homo sapiens
ggctgtggcattaggtgaggcc

SEQ ID NO: 9121685 - DNA, 22 bp, Homo sapiens
tattacaatttacattgcactt

SEQ ID NO: 9121686 - DNA, 22 bp, Homo sapiens
tcaaagagctattcagttgtgg

SEQ ID NO: 9121687 - DNA, 20 bp, Homo sapiens
tcaaagacaagctctcatcc

SEQ ID NO: 9121688 - DNA, 22 bp, Homo sapiens
tattaacacgtataaagtgttt

SEQ ID NO: 9121689 - DNA, 22 bp, Homo sapiens
tatgtttcctgagcttacacca

SEQ ID NO: 9121690 - DNA, 22 bp, Homo sapiens
tagtttcatctccaccctgccc

SEQ ID NO: 9121691 - DNA, 22 bp, Homo sapiens
tagcaaatacatgatgtaattt

SEQ ID NO: 9121692 - DNA, 22 bp, Homo sapiens
tagcaaatgtgttatgctatgc

SEQ ID NO: 9121693 - DNA, 22 bp, Homo sapiens
tagaacttgagatcaggtcttc

SEQ ID NO: 9121694 - DNA, 22 bp, Homo sapiens
taaggaaagtgccatgatttct

SEQ ID NO: 9121695 - DNA, 22 bp, Homo sapiens
taagctctgttatccagagccc

SEQ ID NO: 9121696 - DNA, 22 bp, Homo sapiens
taagctctccaggtgatcatga

SEQ ID NO: 9121697 - DNA, 21 bp, Homo sapiens
taatttattcagcacagtgtt

SEQ ID NO: 9121698 - DNA, 22 bp, Homo sapiens
tacaacataacgggcattcagt

SEQ ID NO: 9121699 - DNA, 22 bp, Homo sapiens
taatttatttcaactgccaagg

SEQ ID NO: 9121700 - DNA, 22 bp, Homo sapiens
tacacatacaccaatgtggtca

SEQ ID NO: 9121701 - DNA, 22 bp, Homo sapiens
tacacaatgacttaagatgtca

SEQ ID NO: 9121702 - DNA, 22 bp, Homo sapiens
tacacatacattgcttacaagg

SEQ ID NO: 9121703 - DNA, 22 bp, Homo sapiens
tacacataggagggtaataaaa

SEQ ID NO: 9121704 - DNA, 22 bp, Homo sapiens
tactacattaataaaacattca

SEQ ID NO: 9121705 - DNA, 22 bp, Homo sapiens
tactacatacagaatttagaga

SEQ ID NO: 9121706 - DNA, 21 bp, Homo sapiens
tacatgaagctggtgtttgtc

SEQ ID NO: 9121707 - DNA, 22 bp, Homo sapiens
tacatgagggcactctgcatct

SEQ ID NO: 9121708 - DNA, 22 bp, Homo sapiens
taacatgatttgctatttagat

SEQ ID NO: 9121709 - DNA, 22 bp, Homo sapiens
taaatgttatgcccatcatcca

SEQ ID NO: 9121710 - DNA, 22 bp, Homo sapiens
taacagccctccctccatcctg

SEQ ID NO: 9121711 - DNA, 22 bp, Homo sapiens
taaatgttttgtgggttgagtt

SEQ ID NO: 9121712 - DNA, 22 bp, Homo sapiens
taaatgtttagtcttatttggg

SEQ ID NO: 9121713 - DNA, 22 bp, Homo sapiens
taaatgttggcattggaggccg

SEQ ID NO: 9121714 - DNA, 22 bp, Homo sapiens
taaatgttgtaagtacatctaa

SEQ ID NO: 9121715 - DNA, 22 bp, Homo sapiens
taaatgttactttcctttcaca

SEQ ID NO: 9121716 - DNA, 22 bp, Homo sapiens
taacatgagagctaagacatta

SEQ ID NO: 9121717 - DNA, 22 bp, Homo sapiens
taacatcttgcagtagcagaac

SEQ ID NO: 9121718 - DNA, 22 bp, Homo sapiens
taacatctaagggagagaaagt

SEQ ID NO: 9121719 - DNA, 22 bp, Homo sapiens
taaagacataggatcagggaga

SEQ ID NO: 9121720 - DNA, 22 bp, Homo sapiens
taaaacttaactatccagatta

SEQ ID NO: 9121721 - DNA, 19 bp, Homo sapiens
gttctttcatagtaagagc

SEQ ID NO: 9121722 - DNA, 22 bp, Homo sapiens
gttcttctcttgtaatggaatc

SEQ ID NO: 9121723 - DNA, 22 bp, Homo sapiens
gtttctttctattgactgaaca

SEQ ID NO: 9121724 - DNA, 22 bp, Homo sapiens
gtttgcaaagatcattttctcc

SEQ ID NO: 9121725 - DNA, 22 bp, Homo sapiens
gttataaatgactgcaaaagtt

SEQ ID NO: 9121726 - DNA, 22 bp, Homo sapiens
tcaacagacatttttaagcact

SEQ ID NO: 9121727 - DNA, 22 bp, Homo sapiens
tcaacactctttggcacagtta

SEQ ID NO: 9121728 - DNA, 22 bp, Homo sapiens
tcaacactggctacagttatgc

SEQ ID NO: 9121729 - DNA, 22 bp, Homo sapiens
tcacatttcgcatcagtccgat

SEQ ID NO: 9121730 - DNA, 22 bp, Homo sapiens
tcacatttctttatgtagtctt

SEQ ID NO: 9121731 - DNA, 22 bp, Homo sapiens
tcacattgccattagttcagtt

SEQ ID NO: 9121732 - DNA, 22 bp, Homo sapiens
tcacatttatactccatttgca

SEQ ID NO: 9121733 - DNA, 22 bp, Homo sapiens
tcacatttatactccatttgca

SEQ ID NO: 9121734 - DNA, 22 bp, Homo sapiens
tcagaacagcagggtgtggctg

SEQ ID NO: 9121735 - DNA, 22 bp, Homo sapiens
tcagaatctaaataggctccag

SEQ ID NO: 9121736 - DNA, 22 bp, Homo sapiens
tcagaatctgaaaagcgcttgg

SEQ ID NO: 9121737 - DNA, 21 bp, Homo sapiens
tcagaatctgtgagctatctc

SEQ ID NO: 9121738 - DNA, 22 bp, Homo sapiens
tcagaacagaagaaggaacacg

SEQ ID NO: 9121739 - DNA, 22 bp, Homo sapiens
tcagaacactttctctactgac

SEQ ID NO: 9121740 - DNA, 22 bp, Homo sapiens
tcacattttatatctctggttt

SEQ ID NO: 9121741 - DNA, 22 bp, Homo sapiens
tcacatttgcaattgcattgtt

SEQ ID NO: 9121742 - DNA, 22 bp, Homo sapiens
tcacatttgctatcccactcct

SEQ ID NO: 9121743 - DNA, 22 bp, Homo sapiens
tcacattttagtaccatgattt

SEQ ID NO: 9121744 - DNA, 22 bp, Homo sapiens
tcacatttgttcttgaatctaa

SEQ ID NO: 9121745 - DNA, 22 bp, Homo sapiens
tcagcaactatttatcaaattc

SEQ ID NO: 9121746 - DNA, 22 bp, Homo sapiens
tcagagtggtggttttgccttc

SEQ ID NO: 9121747 - DNA, 22 bp, Homo sapiens
tcaggagaaaatatcaggaagt

SEQ ID NO: 9121748 - DNA, 22 bp, Homo sapiens
tcagccaagcagccatcatctg

SEQ ID NO: 9121749 - DNA, 22 bp, Homo sapiens
tcataaatcatactccatttgc

SEQ ID NO: 9121750 - DNA, 22 bp, Homo sapiens
tcataaatagttgtgcctgaat

SEQ ID NO: 9121751 - DNA, 22 bp, Homo sapiens
tcagtcctatccaaactatata

SEQ ID NO: 9121752 - DNA, 22 bp, Homo sapiens
tcatgaaaatagatcagaaatt

SEQ ID NO: 9121753 - DNA, 22 bp, Homo sapiens
tcataaatgcagtgtcataaat

SEQ ID NO: 9121754 - DNA, 22 bp, Homo sapiens
tcataaattctggtgctgtgag

SEQ ID NO: 9121755 - DNA, 22 bp, Homo sapiens
tcataaattgattatgtgcttt

SEQ ID NO: 9121756 - DNA, 22 bp, Homo sapiens
tcatacatcttgtatatctatc

SEQ ID NO: 9121757 - DNA, 21 bp, Homo sapiens
tcagtaaacctaaagattgta

SEQ ID NO: 9121758 - DNA, 22 bp, Homo sapiens
tcatttataaggatgcaattaa

SEQ ID NO: 9121759 - DNA, 22 bp, Homo sapiens
tcattgccatggcatttgcaga

SEQ ID NO: 9121760 - DNA, 18 bp, Homo sapiens
tccaaaatcatgtatttt

SEQ ID NO: 9121761 - DNA, 22 bp, Homo sapiens
tcccaaagtcaagctgtgtctt

SEQ ID NO: 9121762 - DNA, 22 bp, Homo sapiens
tccaggctggagtgcagtggca

SEQ ID NO: 9121763 - DNA, 22 bp, Homo sapiens
tccaggctggagtgcagtggcg

SEQ ID NO: 9121764 - DNA, 21 bp, Homo sapiens
tccaggctggaaggggcgttg

SEQ ID NO: 9121765 - DNA, 22 bp, Homo sapiens
tccaggctagcctggtagagaa

SEQ ID NO: 9121766 - DNA, 22 bp, Homo sapiens
tccaggctagagtgcagtggcc

SEQ ID NO: 9121767 - DNA, 22 bp, Homo sapiens
tccaggctagaagtcacaggcc

SEQ ID NO: 9121768 - DNA, 22 bp, Homo sapiens
tccaggtgccggggactgaggc

SEQ ID NO: 9121769 - DNA, 22 bp, Homo sapiens
tccaggtgtatttactgaagta

SEQ ID NO: 9121770 - DNA, 23 bp, Homo sapiens
tccagtagggagtctgcttactt

SEQ ID NO: 9121771 - DNA, 22 bp, Homo sapiens
tccagtatgactgatgtccttc

SEQ ID NO: 9121772 - DNA, 22 bp, Homo sapiens
tccctcagatgagctcctagca

SEQ ID NO: 9121773 - DNA, 22 bp, Homo sapiens
tccctcagattggcaattagat

SEQ ID NO: 9121774 - DNA, 20 bp, Homo sapiens
tccctcagcacttctacctc

SEQ ID NO: 9121775 - DNA, 22 bp, Homo sapiens
tccccttggcttggtcaagagg

SEQ ID NO: 9121776 - DNA, 21 bp, Homo sapiens
tccctcagaaggtagccaagc

SEQ ID NO: 9121777 - DNA, 22 bp, Homo sapiens
tcccctggtgccacgatctgct

SEQ ID NO: 9121778 - DNA, 22 bp, Homo sapiens
tcccaggctcttcaaggaagac

SEQ ID NO: 9121779 - DNA, 23 bp, Homo sapiens
tcccagggaaggtgagcgaggct

SEQ ID NO: 9121780 - DNA, 22 bp, Homo sapiens
tccctccccacttctgagcttt

SEQ ID NO: 9121781 - DNA, 20 bp, Homo sapiens
tccctcagtttccagccctg

SEQ ID NO: 9121782 - DNA, 22 bp, Homo sapiens
tccctcaggacccaacttgtaa

SEQ ID NO: 9121783 - DNA, 22 bp, Homo sapiens
tccctctggtctggacgccata

SEQ ID NO: 9121784 - DNA, 19 bp, Homo sapiens
tccctccctgtaatctcac

SEQ ID NO: 9121785 - DNA, 22 bp, Homo sapiens
tccctctcttgggcgtggctca

SEQ ID NO: 9121786 - DNA, 22 bp, Homo sapiens
tccctctggaggctctagggga

SEQ ID NO: 9121787 - DNA, 22 bp, Homo sapiens
tccctctggaggctctagggga

SEQ ID NO: 9121788 - DNA, 20 bp, Homo sapiens
tccctccctccagctctggg

SEQ ID NO: 9121789 - DNA, 18 bp, Homo sapiens
tccctccctgctgtggcc

SEQ ID NO: 9121790 - DNA, 18 bp, Homo sapiens
tccctccctgctgtggcc

SEQ ID NO: 9121791 - DNA, 22 bp, Homo sapiens
tccctctgtggttggttctgtc

SEQ ID NO: 9121792 - DNA, 22 bp, Homo sapiens
tccctgagaaagcccaggaggt

SEQ ID NO: 9121793 - DNA, 22 bp, Homo sapiens
tcctctggtacttaaagtgctt

SEQ ID NO: 9121794 - DNA, 19 bp, Homo sapiens
tcctctggtaccacccttg

SEQ ID NO: 9121795 - DNA, 22 bp, Homo sapiens
gagtaaaagttggattacaaag

SEQ ID NO: 9121796 - DNA, 22 bp, Homo sapiens
gagtaaaataggtgagaatcaa

SEQ ID NO: 9121797 - DNA, 22 bp, Homo sapiens
gagggtggggaatagactgcta

SEQ ID NO: 9121798 - DNA, 22 bp, Homo sapiens
gagggtgcagctgggccccacg

SEQ ID NO: 9121799 - DNA, 22 bp, Homo sapiens
gagggagaaggactatcaggct

SEQ ID NO: 9121800 - DNA, 22 bp, Homo sapiens
gagctcagggcattgagcaaga

SEQ ID NO: 9121801 - DNA, 22 bp, Homo sapiens
gagctcattcattcattgcctg

SEQ ID NO: 9121802 - DNA, 22 bp, Homo sapiens
gagctggttctgtccagggaat

SEQ ID NO: 9121803 - DNA, 22 bp, Homo sapiens
gagctgtgaaaagtgcctgggg

SEQ ID NO: 9121804 - DNA, 22 bp, Homo sapiens
gagctgtgtatgcatcattctg

SEQ ID NO: 9121805 - DNA, 22 bp, Homo sapiens
gaggactaacttggcagacgca

SEQ ID NO: 9121806 - DNA, 22 bp, Homo sapiens
gaggagtgccagccgtggagtc

SEQ ID NO: 9121807 - DNA, 22 bp, Homo sapiens
gaggcaacacatttggaaagca

SEQ ID NO: 9121808 - DNA, 22 bp, Homo sapiens
gaggccagaagtctgagatcag

SEQ ID NO: 9121809 - DNA, 22 bp, Homo sapiens
gagaggagtagacactttggtt

SEQ ID NO: 9121810 - DNA, 22 bp, Homo sapiens
gagaacaggctctggagtcaga

SEQ ID NO: 9121811 - DNA, 22 bp, Homo sapiens
gagaactcagacgcaggtcatg

SEQ ID NO: 9121812 - DNA, 22 bp, Homo sapiens
gagaagaaatagaatcacattt

SEQ ID NO: 9121813 - DNA, 22 bp, Homo sapiens
gaagacaagctgagtgttgtcc

SEQ ID NO: 9121814 - DNA, 22 bp, Homo sapiens
gacatgttgaagaatatttgga

SEQ ID NO: 9121815 - DNA, 22 bp, Homo sapiens
gacatgaatgttatactttatt

SEQ ID NO: 9121816 - DNA, 22 bp, Homo sapiens
cttcttcagcacaatattgatg

SEQ ID NO: 9121817 - DNA, 22 bp, Homo sapiens
cttcccagaccttagagtgcag

SEQ ID NO: 9121818 - DNA, 22 bp, Homo sapiens
ctttcctccactccctaggctt

SEQ ID NO: 9121819 - DNA, 22 bp, Homo sapiens
gaaatattgggactcagagctt

SEQ ID NO: 9121820 - DNA, 22 bp, Homo sapiens
gaaatgttttacaaggcatact

SEQ ID NO: 9121821 - DNA, 22 bp, Homo sapiens
gaaatgtttgggaggagtcaac

SEQ ID NO: 9121822 - DNA, 23 bp, Homo sapiens
gaaatgtttcttgattaatccta

SEQ ID NO: 9121823 - DNA, 22 bp, Homo sapiens
gaaatgttatgagatatgtact

SEQ ID NO: 9121824 - DNA, 22 bp, Homo sapiens
gaaatgttcctgatccctgatt

SEQ ID NO: 9121825 - DNA, 22 bp, Homo sapiens
gaaatgttgtctctgcagcaat

SEQ ID NO: 9121826 - DNA, 22 bp, Homo sapiens
gaaatgtttccttttgtatgct

SEQ ID NO: 9121827 - DNA, 22 bp, Homo sapiens
gaaatgttgtcctgtctcttga

SEQ ID NO: 9121828 - DNA, 22 bp, Homo sapiens
gaaatgttggacacttgaaatt

SEQ ID NO: 9121829 - DNA, 22 bp, Homo sapiens
gaaattgtcagtgatatgatac

SEQ ID NO: 9121830 - DNA, 22 bp, Homo sapiens
gaagaagggagtgacaaatgca

SEQ ID NO: 9121831 - DNA, 22 bp, Homo sapiens
ctgggcccacgagggctctggg

SEQ ID NO: 9121832 - DNA, 22 bp, Homo sapiens
ctggagctaataatccatctga

SEQ ID NO: 9121833 - DNA, 22 bp, Homo sapiens
ctgggccctatggaagaaaggg

SEQ ID NO: 9121834 - DNA, 22 bp, Homo sapiens
ctgggcccaggcggctctcgga

SEQ ID NO: 9121835 - DNA, 22 bp, Homo sapiens
ctgggctcagtgtctcactcct

SEQ ID NO: 9121836 - DNA, 22 bp, Homo sapiens
ctggtgggtagagggcatcagg

SEQ ID NO: 9121837 - DNA, 23 bp, Homo sapiens
ctggtaaatcactaaaattacaa

SEQ ID NO: 9121838 - DNA, 22 bp, Homo sapiens
ctggtaaagaagacaaacaggg

SEQ ID NO: 9121839 - DNA, 22 bp, Homo sapiens
ctggtaaatgatgagaagcacc

SEQ ID NO: 9121840 - DNA, 21 bp, Homo sapiens
ctgtggacaggctggggcatg

SEQ ID NO: 9121841 - DNA, 22 bp, Homo sapiens
ctgtccccgcgagtccagagct

SEQ ID NO: 9121842 - DNA, 21 bp, Homo sapiens
ctgtcatgcaaccattctcca

SEQ ID NO: 9121843 - DNA, 22 bp, Homo sapiens
ctgtcatggtttgaatgctcgc

SEQ ID NO: 9121844 - DNA, 22 bp, Homo sapiens
ctgtggtcactgttggggaatg

SEQ ID NO: 9121845 - DNA, 18 bp, Homo sapiens
ctgtgggctggtgcatga

SEQ ID NO: 9121846 - DNA, 22 bp, Homo sapiens
ctgtggctttctctgcctcctt

SEQ ID NO: 9121847 - DNA, 22 bp, Homo sapiens
tttgaaagacagaatatttttg

SEQ ID NO: 9121848 - DNA, 22 bp, Homo sapiens
tttgcaaacggccctgagtccc

SEQ ID NO: 9121849 - DNA, 22 bp, Homo sapiens
tttgttcatgcctatattctca

SEQ ID NO: 9121850 - DNA, 22 bp, Homo sapiens
ctcctgtgttcaagcgattctc

SEQ ID NO: 9121851 - DNA, 22 bp, Homo sapiens
ctccttcctgcagatctgagat

SEQ ID NO: 9121852 - DNA, 22 bp, Homo sapiens
tttatgcacaattagtcttata

SEQ ID NO: 9121853 - DNA, 22 bp, Homo sapiens
tttcatgttacatttaaaatgt

SEQ ID NO: 9121854 - DNA, 22 bp, Homo sapiens
tttcatgtttatggaaaatgag

SEQ ID NO: 9121855 - DNA, 22 bp, Homo sapiens
ctgcccctgccaggcagctgtc

SEQ ID NO: 9121856 - DNA, 22 bp, Homo sapiens
ctgcccccaggctgcatggctg

SEQ ID NO: 9121857 - DNA, 22 bp, Homo sapiens
ctgcccctcgaccaagcgcgtc

SEQ ID NO: 9121858 - DNA, 22 bp, Homo sapiens
ctcagtcagggagccttgaggg

SEQ ID NO: 9121859 - DNA, 22 bp, Homo sapiens
ctcagtcagttattatgccagt

SEQ ID NO: 9121860 - DNA, 22 bp, Homo sapiens
ctcagtcatgacgctcaggacc

SEQ ID NO: 9121861 - DNA, 22 bp, Homo sapiens
ctcagtcagtttttgtgagaga

SEQ ID NO: 9121862 - DNA, 22 bp, Homo sapiens
ctccaggacagattcagggcca

SEQ ID NO: 9121863 - DNA, 22 bp, Homo sapiens
ctcaggagcttcctcagcccat

SEQ ID NO: 9121864 - DNA, 22 bp, Homo sapiens
ctcaggagtagttcagcagctg

SEQ ID NO: 9121865 - DNA, 22 bp, Homo sapiens
ctcactgaaacctccgcctccc

SEQ ID NO: 9121866 - DNA, 22 bp, Homo sapiens
ctcactgactgcaagtcaagtt

SEQ ID NO: 9121867 - DNA, 19 bp, Homo sapiens
ctcacctctgtgcgccccc

SEQ ID NO: 9121868 - DNA, 22 bp, Homo sapiens
ttctggctccgcggggcggccc

SEQ ID NO: 9121869 - DNA, 22 bp, Homo sapiens
ttctggctctcccctgctgggt

SEQ ID NO: 9121870 - DNA, 22 bp, Homo sapiens
ttctttctgtccataatgagac

SEQ ID NO: 9121871 - DNA, 22 bp, Homo sapiens
ttctttctctactagcagagct

SEQ ID NO: 9121872 - DNA, 22 bp, Homo sapiens
ttctttctctgtaaaaggaaaa

SEQ ID NO: 9121873 - DNA, 21 bp, Homo sapiens
ttctttctgaatctgaagtat

SEQ ID NO: 9121874 - DNA, 22 bp, Homo sapiens
ttctttctgaatacagttgagt

SEQ ID NO: 9121875 - DNA, 22 bp, Homo sapiens
ttctggaacatagcaagaagtt

SEQ ID NO: 9121876 - DNA, 22 bp, Homo sapiens
cgttttcttcactttgcaagtt

SEQ ID NO: 9121877 - DNA, 22 bp, Homo sapiens
cgtttattttgaagattccact

SEQ ID NO: 9121878 - DNA, 22 bp, Homo sapiens
ccttaaaagaactatctcttct

SEQ ID NO: 9121879 - DNA, 22 bp, Homo sapiens
ccttaggggtgacagaaatacc

SEQ ID NO: 9121880 - DNA, 22 bp, Homo sapiens
tgtcaatatgtaataactgaat

SEQ ID NO: 9121881 - DNA, 16 bp, Homo sapiens
tgtcaatagcttgcct

SEQ ID NO: 9121882 - DNA, 22 bp, Homo sapiens
ccttgcccgctgcctctgagtt

SEQ ID NO: 9121883 - DNA, 22 bp, Homo sapiens
ttcaaatgcaagttactacttt

SEQ ID NO: 9121884 - DNA, 22 bp, Homo sapiens
cggggctgctcgtcctcctgtg

SEQ ID NO: 9121885 - DNA, 22 bp, Homo sapiens
cggggctggcacaggtgaccac

SEQ ID NO: 9121886 - DNA, 22 bp, Homo sapiens
cggggccctggggctgaaggtc

SEQ ID NO: 9121887 - DNA, 22 bp, Homo sapiens
ttattgcactattgattttcta

SEQ ID NO: 9121888 - DNA, 23 bp, Homo sapiens
ttattgcatccaaatgcattcct

SEQ ID NO: 9121889 - DNA, 22 bp, Homo sapiens
cgctggcttcctcctggggcca

SEQ ID NO: 9121890 - DNA, 16 bp, Homo sapiens
cgcctccctccctcgc

SEQ ID NO: 9121891 - DNA, 22 bp, Homo sapiens
ttatttcatataatgttatcaa

SEQ ID NO: 9121892 - DNA, 22 bp, Homo sapiens
cgacagcagaagaagcaagcca

SEQ ID NO: 9121893 - DNA, 22 bp, Homo sapiens
cgagagtggacagggcgcagct

SEQ ID NO: 9121894 - DNA, 22 bp, Homo sapiens
ccagtgttagagactgatacag

SEQ ID NO: 9121895 - DNA, 22 bp, Homo sapiens
cccaagaggtggaggttgcagt

SEQ ID NO: 9121896 - DNA, 22 bp, Homo sapiens
cccaagagcttctaggacgctg

SEQ ID NO: 9121897 - DNA, 22 bp, Homo sapiens
cccagaggtgaaggaggtggga

SEQ ID NO: 9121898 - DNA, 22 bp, Homo sapiens
cccacaggtggaagcctcggaa

SEQ ID NO: 9121899 - DNA, 22 bp, Homo sapiens
cccaggaggcctgcctggccgg

SEQ ID NO: 9121900 - DNA, 20 bp, Homo sapiens
cccaggagtgagcagcttta

SEQ ID NO: 9121901 - DNA, 22 bp, Homo sapiens
tgccctctcaagttgagtcaga

SEQ ID NO: 9121902 - DNA, 22 bp, Homo sapiens
tgccctcctcctgagcccatgt

SEQ ID NO: 9121903 - DNA, 22 bp, Homo sapiens
tgccctccctgtactgtcagga

SEQ ID NO: 9121904 - DNA, 22 bp, Homo sapiens
tgccctctgcctcctctgcaga

SEQ ID NO: 9121905 - DNA, 22 bp, Homo sapiens
tgccctcccacattatggctgt

SEQ ID NO: 9121906 - DNA, 23 bp, Homo sapiens
tgccctcccaatgcttcggtcac

SEQ ID NO: 9121907 - DNA, 22 bp, Homo sapiens
tgccctccacagtggctccacc

SEQ ID NO: 9121908 - DNA, 22 bp, Homo sapiens
ccagggtgggaggctgaaggcg

SEQ ID NO: 9121909 - DNA, 21 bp, Homo sapiens
ccaggtacatggagaatgtgg

SEQ ID NO: 9121910 - DNA, 22 bp, Homo sapiens
ccaggcttggtgtgtggtcagg

SEQ ID NO: 9121911 - DNA, 22 bp, Homo sapiens
tgacagagctgggatttgaagc

SEQ ID NO: 9121912 - DNA, 22 bp, Homo sapiens
tctttcaaagctgtagtagatt

SEQ ID NO: 9121913 - DNA, 22 bp, Homo sapiens
tgtaatttgcatggctgaatgc

SEQ ID NO: 9121914 - DNA, 22 bp, Homo sapiens
tgtattcagtgatttcacaata

SEQ ID NO: 9121915 - DNA, 20 bp, Homo sapiens
cctgctgggaaccctctgaa

SEQ ID NO: 9121916 - DNA, 22 bp, Homo sapiens
cctgctggccactgctccacct

SEQ ID NO: 9121917 - DNA, 22 bp, Homo sapiens
cctccctctttcagtcccacag

SEQ ID NO: 9121918 - DNA, 22 bp, Homo sapiens
cctccctgccggctggactagt

SEQ ID NO: 9121919 - DNA, 22 bp, Homo sapiens
cctccctctttcagtcccacag

SEQ ID NO: 9121920 - DNA, 22 bp, Homo sapiens
cctctggatctttctccacact

SEQ ID NO: 9121921 - DNA, 22 bp, Homo sapiens
cctctggccacatgggacatag

SEQ ID NO: 9121922 - DNA, 22 bp, Homo sapiens
cctctggcctaggccgggagag

SEQ ID NO: 9121923 - DNA, 22 bp, Homo sapiens
tgggccactaccttctctggat

SEQ ID NO: 9121924 - DNA, 22 bp, Homo sapiens
cctgcagaagagtccagctcat

SEQ ID NO: 9121925 - DNA, 22 bp, Homo sapiens
cctgagggctcagcccccagcc

SEQ ID NO: 9121926 - DNA, 22 bp, Homo sapiens
cctgaggggctgcaggccagct

SEQ ID NO: 9121927 - DNA, 22 bp, Homo sapiens
cctcccctcagacagagactgg

SEQ ID NO: 9121928 - DNA, 22 bp, Homo sapiens
cctccccatgacccggtgctgg

SEQ ID NO: 9121929 - DNA, 19 bp, Homo sapiens
cctccccttggaccagcaa

SEQ ID NO: 9121930 - DNA, 23 bp, Homo sapiens
cctccccttcccacagctgggtg

SEQ ID NO: 9121931 - DNA, 22 bp, Homo sapiens
cctcccctgctcagaactctgg

SEQ ID NO: 9121932 - DNA, 18 bp, Homo sapiens
cctccctcattttcccag

SEQ ID NO: 9121933 - DNA, 22 bp, Homo sapiens
cctccctcagaatgaagaaagg

SEQ ID NO: 9121934 - DNA, 22 bp, Homo sapiens
cctccctctgttagagctgtct

SEQ ID NO: 9121935 - DNA, 22 bp, Homo sapiens
cctccctccctgcagaagccac

SEQ ID NO: 9121936 - DNA, 18 bp, Homo sapiens
cctccctcattttcccag

SEQ ID NO: 9121937 - DNA, 22 bp, Homo sapiens
cctccctccattgccatcgtct

SEQ ID NO: 9121938 - DNA, 22 bp, Homo sapiens
tggctaggaatccatgactctc

SEQ ID NO: 9121939 - DNA, 22 bp, Homo sapiens
tggctaagctggggaggcctgg

SEQ ID NO: 9121940 - DNA, 22 bp, Homo sapiens
tggcctcggcatccagcaagag

SEQ ID NO: 9121941 - DNA, 22 bp, Homo sapiens
cctcagcatcctggtgaagtag

SEQ ID NO: 9121942 - DNA, 22 bp, Homo sapiens
cctcactgtcatcagtagttat

SEQ ID NO: 9121943 - DNA, 22 bp, Homo sapiens
cctcactcttgtcctggcaggt

SEQ ID NO: 9121944 - DNA, 22 bp, Homo sapiens
ccgtggcttcccaggcggatgt

SEQ ID NO: 9121945 - DNA, 22 bp, Homo sapiens
ccgtcccctctgaccttgctga

SEQ ID NO: 9121946 - DNA, 22 bp, Homo sapiens
ccgtccccagccacctgctgat

SEQ ID NO: 9121947 - DNA, 22 bp, Homo sapiens
ccctgtcctgctaggccctggt

SEQ ID NO: 9121948 - DNA, 22 bp, Homo sapiens
ccctgtggatttcagtttgtgt

SEQ ID NO: 9121949 - DNA, 22 bp, Homo sapiens
ccctgccttgtctgggctaggt

SEQ ID NO: 9121950 - DNA, 22 bp, Homo sapiens
ccctgccttgtctgggctaggt

SEQ ID NO: 9121951 - DNA, 22 bp, Homo sapiens
tggaggccagaggtactgggac

SEQ ID NO: 9121952 - DNA, 22 bp, Homo sapiens
ccctgcctctgaagctgctcag

SEQ ID NO: 9121953 - DNA, 22 bp, Homo sapiens
ccctgcagtgtgacctcaccta

SEQ ID NO: 9121954 - DNA, 19 bp, Homo sapiens
ccctgccctggtgactggg

SEQ ID NO: 9121955 - DNA, 22 bp, Homo sapiens
ccctgcagagccagccctgacc

SEQ ID NO: 9121956 - DNA, 22 bp, Homo sapiens
ccctgaggaccaggaaggaggg

SEQ ID NO: 9121957 - DNA, 22 bp, Homo sapiens
ccctgcagaaccacagacaaac

SEQ ID NO: 9121958 - DNA, 22 bp, Homo sapiens
ccctaaggcagcccagtctgtg

SEQ ID NO: 9121959 - DNA, 17 bp, Homo sapiens
cccgttctcttcgctgg

SEQ ID NO: 9121960 - DNA, 22 bp, Homo sapiens
cccgtcccttttgcccgctggt

SEQ ID NO: 9121961 - DNA, 22 bp, Homo sapiens
cccgtccctgtgcgtcgcgagc

SEQ ID NO: 9121962 - DNA, 21 bp, Homo sapiens
cccgtcagcagggcccctcct

SEQ ID NO: 9121963 - DNA, 22 bp, Homo sapiens
cccgggaggaggaagttgcagt

SEQ ID NO: 9121964 - DNA, 22 bp, Homo sapiens
cagtggctggttagggacagga

SEQ ID NO: 9121965 - DNA, 22 bp, Homo sapiens
cagtgcccaaaggaacagaaag

SEQ ID NO: 9121966 - DNA, 22 bp, Homo sapiens
tcacagctttgagcagagacca

SEQ ID NO: 9121967 - DNA, 22 bp, Homo sapiens
tcacaggagattatgtgtgcta

SEQ ID NO: 9121968 - DNA, 22 bp, Homo sapiens
tcacaggagcccaggggagctg

SEQ ID NO: 9121969 - DNA, 22 bp, Homo sapiens
tcacaggaaccatcagagaaat

SEQ ID NO: 9121970 - DNA, 22 bp, Homo sapiens
tcacagttcaactagttcagat

SEQ ID NO: 9121971 - DNA, 20 bp, Homo sapiens
tcacaggagggaaggcaggt

SEQ ID NO: 9121972 - DNA, 22 bp, Homo sapiens
tcacaaatattttaacagtagg

SEQ ID NO: 9121973 - DNA, 22 bp, Homo sapiens
tcacaaatcattttatctgtgt

SEQ ID NO: 9121974 - DNA, 22 bp, Homo sapiens
tcacaagacagaaaacatttag

SEQ ID NO: 9121975 - DNA, 22 bp, Homo sapiens
tcacacttcaaagggttagatc

SEQ ID NO: 9121976 - DNA, 21 bp, Homo sapiens
tcacacttgattggcttagac

SEQ ID NO: 9121977 - DNA, 22 bp, Homo sapiens
tcacactttatttatttcatgc

SEQ ID NO: 9121978 - DNA, 22 bp, Homo sapiens
tcacagacgcctcccctcgcct

SEQ ID NO: 9121979 - DNA, 22 bp, Homo sapiens
tatttcattctttatcaggagc

SEQ ID NO: 9121980 - DNA, 22 bp, Homo sapiens
tatttccacctattattttctg

SEQ ID NO: 9121981 - DNA, 22 bp, Homo sapiens
tatttccagaggagtatagaag

SEQ ID NO: 9121982 - DNA, 22 bp, Homo sapiens
tatttccacaccttttgaatct

SEQ ID NO: 9121983 - DNA, 18 bp, Homo sapiens
tagagttaatgttccctg

SEQ ID NO: 9121984 - DNA, 22 bp, Homo sapiens
tagaataagttgatgatatatg

SEQ ID NO: 9121985 - DNA, 23 bp, Homo sapiens
tagggtgttaagtcagtgattga

SEQ ID NO: 9121986 - DNA, 18 bp, Homo sapiens
taggaggatactgagatg

SEQ ID NO: 9121987 - DNA, 22 bp, Homo sapiens
cagggcaggaatttgacattgc

SEQ ID NO: 9121988 - DNA, 22 bp, Homo sapiens
tctctgatctttaattcagata

SEQ ID NO: 9121989 - DNA, 22 bp, Homo sapiens
ccagcagccaccttctcgaaat

SEQ ID NO: 9121990 - DNA, 22 bp, Homo sapiens
ccagcagctgacaccagtccca

SEQ ID NO: 9121991 - DNA, 22 bp, Homo sapiens
ccagcagctccctcagggtccg

SEQ ID NO: 9121992 - DNA, 22 bp, Homo sapiens
ccagcagctcagctactggtca

SEQ ID NO: 9121993 - DNA, 22 bp, Homo sapiens
ccagcagctttattggctctcc

SEQ ID NO: 9121994 - DNA, 22 bp, Homo sapiens
tctgaaatgaactcttgaactt

SEQ ID NO: 9121995 - DNA, 19 bp, Homo sapiens
tctgaattatttatgtacc

SEQ ID NO: 9121996 - DNA, 22 bp, Homo sapiens
tctgagagtccatctccaagcc

SEQ ID NO: 9121997 - DNA, 22 bp, Homo sapiens
tctccacaccagaaggagctga

SEQ ID NO: 9121998 - DNA, 22 bp, Homo sapiens
tctccctctttgtctgctttgg

SEQ ID NO: 9121999 - DNA, 22 bp, Homo sapiens
tctccctcattcctgcttccat

SEQ ID NO: 9122000 - DNA, 22 bp, Homo sapiens
tctccctctgtaagatcagggg

SEQ ID NO: 9122001 - DNA, 22 bp, Homo sapiens
tctccctctcagatttattcac

SEQ ID NO: 9122002 - DNA, 18 bp, Homo sapiens
tcctctctttccccaggg

SEQ ID NO: 9122003 - DNA, 22 bp, Homo sapiens
tcctctctgcactggccctgcc

SEQ ID NO: 9122004 - DNA, 22 bp, Homo sapiens
tcctctccatgtctcacgccac

SEQ ID NO: 9122005 - DNA, 21 bp, Homo sapiens
tcctctccatgatctgtttgt

SEQ ID NO: 9122006 - DNA, 22 bp, Homo sapiens
cattgaataatgtccttgcaaa

SEQ ID NO: 9122007 - DNA, 22 bp, Homo sapiens
cattgaaacctaacataggctg

SEQ ID NO: 9122008 - DNA, 17 bp, Homo sapiens
tcctccccgcagttgca

SEQ ID NO: 9122009 - DNA, 22 bp, Homo sapiens
tcctcccctcagggcaacggat

SEQ ID NO: 9122010 - DNA, 22 bp, Homo sapiens
cattcacattcttcttactgtt

SEQ ID NO: 9122011 - DNA, 21 bp, Homo sapiens
cattcacagtctggctcttga

SEQ ID NO: 9122012 - DNA, 22 bp, Homo sapiens
tccaggctcccctgcgtgctcc

SEQ ID NO: 9122013 - DNA, 22 bp, Homo sapiens
tccaggctccctcaggatgcac

SEQ ID NO: 9122014 - DNA, 22 bp, Homo sapiens
tcattccttatccgtatctttt

SEQ ID NO: 9122015 - DNA, 22 bp, Homo sapiens
tcattgaaagtgcctcctcgga

SEQ ID NO: 9122016 - DNA, 22 bp, Homo sapiens
tcattgaaaactcagcatctac

SEQ ID NO: 9122017 - DNA, 19 bp, Homo sapiens
tcattgaacataattactt

SEQ ID NO: 9122018 - DNA, 22 bp, Homo sapiens
catgaaaaatttactgttaaca

SEQ ID NO: 9122019 - DNA, 22 bp, Homo sapiens
tttatattgtaaaaatggttct

SEQ ID NO: 9122020 - DNA, 22 bp, Homo sapiens
tttagcaaggagaaataatcct

SEQ ID NO: 9122021 - DNA, 20 bp, Homo sapiens
tttacattttgaaacagtga

SEQ ID NO: 9122022 - DNA, 21 bp, Homo sapiens
tttaaagaataggaagggagg

SEQ ID NO: 9122023 - DNA, 22 bp, Homo sapiens
tttcatgtgcaattagcaatat

SEQ ID NO: 9122024 - DNA, 22 bp, Homo sapiens
tttcaccaaggtaacctttgat

SEQ ID NO: 9122025 - DNA, 19 bp, Homo sapiens
tttcaaagggcataagcct

SEQ ID NO: 9122026 - DNA, 22 bp, Homo sapiens
tttattgaacacttgcactggc

SEQ ID NO: 9122027 - DNA, 22 bp, Homo sapiens
tttattcaagatgaggttcatg

SEQ ID NO: 9122028 - DNA, 22 bp, Homo sapiens
ttggacagcacagacatagaat

SEQ ID NO: 9122029 - DNA, 23 bp, Homo sapiens
ttgcttagagacctcctcatcag

SEQ ID NO: 9122030 - DNA, 22 bp, Homo sapiens
ttgacaagtggagatatttaag

SEQ ID NO: 9122031 - DNA, 22 bp, Homo sapiens
ttgacaaagatatattcatgct

SEQ ID NO: 9122032 - DNA, 22 bp, Homo sapiens
ttgggacaaagactccttgaat

SEQ ID NO: 9122033 - DNA, 22 bp, Homo sapiens
ttgggacaagagatagctctga

SEQ ID NO: 9122034 - DNA, 20 bp, Homo sapiens
ttgggacacttgctttgcta

SEQ ID NO: 9122035 - DNA, 22 bp, Homo sapiens
ttgggacagagctggggctgga

SEQ ID NO: 9122036 - DNA, 22 bp, Homo sapiens
ttgggacagaaaaggagaagat

SEQ ID NO: 9122037 - DNA, 22 bp, Homo sapiens
ttgggacagcaaccatctgcta

SEQ ID NO: 9122038 - DNA, 22 bp, Homo sapiens
ttgggacagcaacggttctgtt

SEQ ID NO: 9122039 - DNA, 22 bp, Homo sapiens
ttgggacagcactgctacccct

SEQ ID NO: 9122040 - DNA, 22 bp, Homo sapiens
ttgggacagctgtggtagtgag

SEQ ID NO: 9122041 - DNA, 22 bp, Homo sapiens
ttgggacatctggcatacagtt

SEQ ID NO: 9122042 - DNA, 22 bp, Homo sapiens
ttgggacattatcagtctgcag

SEQ ID NO: 9122043 - DNA, 22 bp, Homo sapiens
ttgggacatgtaagctggaagt

SEQ ID NO: 9122044 - DNA, 22 bp, Homo sapiens
ttggagagatttaggtctcagt

SEQ ID NO: 9122045 - DNA, 22 bp, Homo sapiens
ttggagagttaattgacagtta

SEQ ID NO: 9122046 - DNA, 22 bp, Homo sapiens
ttggacagtactttaaagcaga

SEQ ID NO: 9122047 - DNA, 22 bp, Homo sapiens
ttgtacaagtattatgtgaaca

SEQ ID NO: 9122048 - DNA, 22 bp, Homo sapiens
ttgtaaagctgattagaaagcc

SEQ ID NO: 9122049 - DNA, 22 bp, Homo sapiens
ttgtaacaatctgtcataaatg

SEQ ID NO: 9122050 - DNA, 22 bp, Homo sapiens
ttgtaacatcaccatcaaaatc

SEQ ID NO: 9122051 - DNA, 20 bp, Homo sapiens
ttgtcacagctttccatcag

SEQ ID NO: 9122052 - DNA, 22 bp, Homo sapiens
ttattgtaggcctattgtagaa

SEQ ID NO: 9122053 - DNA, 22 bp, Homo sapiens
ttattgtagcactttggcagtg

SEQ ID NO: 9122054 - DNA, 22 bp, Homo sapiens
ttattggagctggaggctgttt

SEQ ID NO: 9122055 - DNA, 22 bp, Homo sapiens
ttatactttatactacatcatt

SEQ ID NO: 9122056 - DNA, 22 bp, Homo sapiens
ttcctggaaattatgctcacct

SEQ ID NO: 9122057 - DNA, 22 bp, Homo sapiens
ttccttggagttaagaccctgg

SEQ ID NO: 9122058 - DNA, 19 bp, Homo sapiens
ttgaaattgtttgatatgg

SEQ ID NO: 9122059 - DNA, 22 bp, Homo sapiens
ttgaaatgatctatttcagtag

SEQ ID NO: 9122060 - DNA, 22 bp, Homo sapiens
ttcttttaatgttctgaagttt

SEQ ID NO: 9122061 - DNA, 22 bp, Homo sapiens
ttcttttaatagagatcctgtg

SEQ ID NO: 9122062 - DNA, 22 bp, Homo sapiens
ttcttttaaaagagagcagaaa

SEQ ID NO: 9122063 - DNA, 22 bp, Homo sapiens
ttcttttaatgtctggctttca

SEQ ID NO: 9122064 - DNA, 19 bp, Homo sapiens
ttctgtaaggacattaatc

SEQ ID NO: 9122065 - DNA, 22 bp, Homo sapiens
tttgacaaatccttcagcaatg

SEQ ID NO: 9122066 - DNA, 22 bp, Homo sapiens
tttgacaaatgtatctgcatta

SEQ ID NO: 9122067 - DNA, 22 bp, Homo sapiens
tttgacaattaggtagaaaaag

SEQ ID NO: 9122068 - DNA, 22 bp, Homo sapiens
tttgacaagagggcatcttcag

SEQ ID NO: 9122069 - DNA, 22 bp, Homo sapiens
tttgacaaccaggcaggtaaga

SEQ ID NO: 9122070 - DNA, 22 bp, Homo sapiens
tttgacaacagcaaatgtcaca

SEQ ID NO: 9122071 - DNA, 22 bp, Homo sapiens
tttgacaacgttgttgtgagga

SEQ ID NO: 9122072 - DNA, 22 bp, Homo sapiens
tttgacaataattgcatttata

SEQ ID NO: 9122073 - DNA, 21 bp, Homo sapiens
tttgaaagctacatctatagc

SEQ ID NO: 9122074 - DNA, 22 bp, Homo sapiens
tttgaaagggaaataaactcct

SEQ ID NO: 9122075 - DNA, 22 bp, Homo sapiens
tttgaaaggaagttaatacttt

SEQ ID NO: 9122076 - DNA, 21 bp, Homo sapiens
tttctttctggctctcacagt

SEQ ID NO: 9122077 - DNA, 22 bp, Homo sapiens
tttggtttttacctgctgagag

SEQ ID NO: 9122078 - DNA, 22 bp, Homo sapiens
tttggtttgcctgagtaccctc

SEQ ID NO: 9122079 - DNA, 22 bp, Homo sapiens
tttgtaagcaagttaacatttt

SEQ ID NO: 9122080 - DNA, 22 bp, Homo sapiens
tttgtaacatcccaacaaattt

SEQ ID NO: 9122081 - DNA, 22 bp, Homo sapiens
tttgttaattcttatgttagag

SEQ ID NO: 9122082 - DNA, 22 bp, Homo sapiens
ttttaattgcaattatggtccc

SEQ ID NO: 9122083 - DNA, 22 bp, Homo sapiens
ttttaatgtgctctgcaatgat

SEQ ID NO: 9122084 - DNA, 22 bp, Homo sapiens
ttttcatgtgatgtgacatttc

SEQ ID NO: 9122085 - DNA, 22 bp, Homo sapiens
ttttattgcaataaagtgtgta

SEQ ID NO: 9122086 - DNA, 22 bp, Homo sapiens
ttttattggagtgataccaagc

SEQ ID NO: 9122087 - DNA, 21 bp, Homo sapiens
ttttattgatgaatggccact

SEQ ID NO: 9122088 - DNA, 22 bp, Homo sapiens
ttttctgtattattgtgcttca

SEQ ID NO: 9122089 - DNA, 22 bp, Homo sapiens
ttttctgtattattgtgcttca

SEQ ID NO: 9122090 - DNA, 22 bp, Homo sapiens
ttttctgtaagaggactttaat

SEQ ID NO: 9122091 - DNA, 22 bp, Homo sapiens
ttttctgttacaaagtacagcg

SEQ ID NO: 9122092 - DNA, 22 bp, Homo sapiens
ttttctgtttacagagggacct

SEQ ID NO: 9122093 - DNA, 22 bp, Homo sapiens
ttttctgtgtatccaggcttcc

SEQ ID NO: 9122094 - DNA, 22 bp, Homo sapiens
ttttctgtgtgtccctcgacag

SEQ ID NO: 9122095 - DNA, 20 bp, Homo sapiens
ttttctgtgccaagaaaact

SEQ ID NO: 9122096 - DNA, 22 bp, Homo sapiens
ttttctgtgccctgctagctgg

SEQ ID NO: 9122097 - DNA, 22 bp, Homo sapiens
ttttctgtggtcagagcttgag

SEQ ID NO: 9122098 - DNA, 22 bp, Homo sapiens
ttttctgtgattctgaggttgg

SEQ ID NO: 9122099 - DNA, 22 bp, Homo sapiens
ttttctgtttgcttcaagacat

SEQ ID NO: 9122100 - DNA, 22 bp, Homo sapiens
cagaagatgcagtgtctgagaa

SEQ ID NO: 9122101 - DNA, 22 bp, Homo sapiens
gggggaggtgaatgcaataagg

SEQ ID NO: 9122102 - DNA, 22 bp, Homo sapiens
cagagtgtatctgtgtaagcat

SEQ ID NO: 9122103 - DNA, 22 bp, Homo sapiens
ggggtccctgcaccagcatgtc

SEQ ID NO: 9122104 - DNA, 22 bp, Homo sapiens
cagaggctgatggctgtagcca

SEQ ID NO: 9122105 - DNA, 22 bp, Homo sapiens
gtaagcagaggttaatgttaac

SEQ ID NO: 9122106 - DNA, 20 bp, Homo sapiens
gtgcagccaagctgagccgc

SEQ ID NO: 9122107 - DNA, 22 bp, Homo sapiens
gtctcagtgcccaatgccataa

SEQ ID NO: 9122108 - DNA, 22 bp, Homo sapiens
gtctcagtaagaaaggctcctg

SEQ ID NO: 9122109 - DNA, 22 bp, Homo sapiens
gtctccagaagcctagacagcc

SEQ ID NO: 9122110 - DNA, 22 bp, Homo sapiens
cagcatcttcatgtgcatctcc

SEQ ID NO: 9122111 - DNA, 22 bp, Homo sapiens
gtgctgagattacaggtgtgag

SEQ ID NO: 9122112 - DNA, 19 bp, Homo sapiens
cagcctcaatccctcgggc

SEQ ID NO: 9122113 - DNA, 23 bp, Homo sapiens
cagcccttcctgcatgtttttgt

SEQ ID NO: 9122114 - DNA, 22 bp, Homo sapiens
gcttccacctactaaatgccac

SEQ ID NO: 9122115 - DNA, 22 bp, Homo sapiens
caatgcccctgagggctgcacc

SEQ ID NO: 9122116 - DNA, 22 bp, Homo sapiens
caatgctatcatgtcagagata

SEQ ID NO: 9122117 - DNA, 22 bp, Homo sapiens
caaatttaagtgaggtctttgt

SEQ ID NO: 9122118 - DNA, 22 bp, Homo sapiens
caaattctcaaggtttatccca

SEQ ID NO: 9122119 - DNA, 22 bp, Homo sapiens
caaatttaggtaacagtctgta

SEQ ID NO: 9122120 - DNA, 22 bp, Homo sapiens
caaatttaagttagaaagcaat

SEQ ID NO: 9122121 - DNA, 22 bp, Homo sapiens
gctgggccccttgaaaggcgtc

SEQ ID NO: 9122122 - DNA, 21 bp, Homo sapiens
gctggctgtctcttacacggt

SEQ ID NO: 9122123 - DNA, 22 bp, Homo sapiens
cacagagacatgatgtcattgc

SEQ ID NO: 9122124 - DNA, 22 bp, Homo sapiens
ggagagtcttctgcttggttta

SEQ ID NO: 9122125 - DNA, 22 bp, Homo sapiens
ggagagttcatgtggagtgggg

SEQ ID NO: 9122126 - DNA, 22 bp, Homo sapiens
ggacagcatatcagcagggcag

SEQ ID NO: 9122127 - DNA, 22 bp, Homo sapiens
cacagcaggcagaacgtgggca

SEQ ID NO: 9122128 - DNA, 22 bp, Homo sapiens
ggaggggatttagtagatgcta

SEQ ID NO: 9122129 - DNA, 22 bp, Homo sapiens
ggagtgaataagtagggggaaa

SEQ ID NO: 9122130 - DNA, 22 bp, Homo sapiens
ggatccagtccagggctgtgtg

SEQ ID NO: 9122131 - DNA, 22 bp, Homo sapiens
ggatccagaggtgaagatggga

SEQ ID NO: 9122132 - DNA, 21 bp, Homo sapiens
cacatgcatgcacaggttgta

SEQ ID NO: 9122133 - DNA, 22 bp, Homo sapiens
cacatttgggacaggagataaa

SEQ ID NO: 9122134 - DNA, 22 bp, Homo sapiens
cacccagcttttgcatcctccg

SEQ ID NO: 9122135 - DNA, 22 bp, Homo sapiens
cagaaatggtctgttcagctta

SEQ ID NO: 9122136 - DNA, 22 bp, Homo sapiens
cagaaatgtttgttaatattgt

SEQ ID NO: 9122137 - DNA, 22 bp, Homo sapiens
cagaaatgttctaatgattcag

SEQ ID NO: 9122138 - DNA, 22 bp, Homo sapiens
ggcttgatcacataggtctccc

SEQ ID NO: 9122139 - DNA, 22 bp, Homo sapiens
cactgcccttacatgccctgca

SEQ ID NO: 9122140 - DNA, 22 bp, Homo sapiens
atgtttccttatagataaaagc

SEQ ID NO: 9122141 - DNA, 22 bp, Homo sapiens
atgtttcccagagcaaatctgg

SEQ ID NO: 9122142 - DNA, 22 bp, Homo sapiens
gagtccaggctgttgctcatct

SEQ ID NO: 9122143 - DNA, 20 bp, Homo sapiens
gagtccaggggcctgtagca

SEQ ID NO: 9122144 - DNA, 23 bp, Homo sapiens
gagtgcagaatagacatgcagtg

SEQ ID NO: 9122145 - DNA, 22 bp, Homo sapiens
gagggcagaaaattatgcggtg

SEQ ID NO: 9122146 - DNA, 22 bp, Homo sapiens
gagtccagcagaatgagccaag

SEQ ID NO: 9122147 - DNA, 22 bp, Homo sapiens
gagtccagccctgttctagtaa

SEQ ID NO: 9122148 - DNA, 18 bp, Homo sapiens
gagtccaggctcttcacc

SEQ ID NO: 9122149 - DNA, 22 bp, Homo sapiens
gagtccagctctgcctcttact

SEQ ID NO: 9122150 - DNA, 22 bp, Homo sapiens
gagggcaaaacagagaagatgt

SEQ ID NO: 9122151 - DNA, 22 bp, Homo sapiens
gagggcaagagttggaaacggt

SEQ ID NO: 9122152 - DNA, 22 bp, Homo sapiens
gaggccaactttggagaacagg

SEQ ID NO: 9122153 - DNA, 22 bp, Homo sapiens
gaggccaagttggagaccaggt

SEQ ID NO: 9122154 - DNA, 22 bp, Homo sapiens
gagccctcttccctagtgatcg

SEQ ID NO: 9122155 - DNA, 22 bp, Homo sapiens
atcttcccaggctggggagagg

SEQ ID NO: 9122156 - DNA, 22 bp, Homo sapiens
gaaaatgtgcctttgggtattg

SEQ ID NO: 9122157 - DNA, 22 bp, Homo sapiens
gacagtgctatggtaggacatt

SEQ ID NO: 9122158 - DNA, 22 bp, Homo sapiens
atgctttctcttagttcattga

SEQ ID NO: 9122159 - DNA, 22 bp, Homo sapiens
gaccctccactcactgctgtgt

SEQ ID NO: 9122160 - DNA, 22 bp, Homo sapiens
gcaaaatttacactccttcttc

SEQ ID NO: 9122161 - DNA, 22 bp, Homo sapiens
gatttctgtaacacttcagata

SEQ ID NO: 9122162 - DNA, 22 bp, Homo sapiens
gcaacatgaagaaaacagaacc

SEQ ID NO: 9122163 - DNA, 22 bp, Homo sapiens
gcagccaggtttgaggaccact

SEQ ID NO: 9122164 - DNA, 20 bp, Homo sapiens
attgtttcatttaatgtaca

SEQ ID NO: 9122165 - DNA, 22 bp, Homo sapiens
attgtttccccggaattattca

SEQ ID NO: 9122166 - DNA, 22 bp, Homo sapiens
attgtttctgctttatttaggg

SEQ ID NO: 9122167 - DNA, 22 bp, Homo sapiens
gcagtgccgaccatccttccca

SEQ ID NO: 9122168 - DNA, 22 bp, Homo sapiens
gcagtgccttgcttctctgtct

SEQ ID NO: 9122169 - DNA, 18 bp, Homo sapiens
gcagtgccagcctctcct

SEQ ID NO: 9122170 - DNA, 22 bp, Homo sapiens
gcagtgccacaagatgggagga

SEQ ID NO: 9122171 - DNA, 22 bp, Homo sapiens
gccctccaccagagcccttctc

SEQ ID NO: 9122172 - DNA, 22 bp, Homo sapiens
gccctgccctctcggcactcgc

SEQ ID NO: 9122173 - DNA, 22 bp, Homo sapiens
gccctccctacagcctatttct

SEQ ID NO: 9122174 - DNA, 22 bp, Homo sapiens
gccctcccctctgggtggtgag

SEQ ID NO: 9122175 - DNA, 22 bp, Homo sapiens
gccctcctgcaggggcttctgg

SEQ ID NO: 9122176 - DNA, 19 bp, Homo sapiens
gccctcctcactgagctct

SEQ ID NO: 9122177 - DNA, 23 bp, Homo sapiens
gccctccctcccaggtgggtgtt

SEQ ID NO: 9122178 - DNA, 22 bp, Homo sapiens
atttacatttatttgagaaggt

SEQ ID NO: 9122179 - DNA, 23 bp, Homo sapiens
atttgacagagcatagcatttct

SEQ ID NO: 9122180 - DNA, 22 bp, Homo sapiens
atttgacattgacacacctatg

SEQ ID NO: 9122181 - DNA, 22 bp, Homo sapiens
atttgacattattctctcagtc

SEQ ID NO: 9122182 - DNA, 22 bp, Homo sapiens
atttgcaaagtcgtatctgtga

SEQ ID NO: 9122183 - DNA, 22 bp, Homo sapiens
atttgcaattactcatgtcatt

SEQ ID NO: 9122184 - DNA, 22 bp, Homo sapiens
atttgcaagagtaagaatttct

SEQ ID NO: 9122185 - DNA, 22 bp, Homo sapiens
atttgcaatgatttcagtgctt

SEQ ID NO: 9122186 - DNA, 22 bp, Homo sapiens
atttgcaaaggttaacagcagt

SEQ ID NO: 9122187 - DNA, 23 bp, Homo sapiens
gcctgccgcctggctgagaactg

SEQ ID NO: 9122188 - DNA, 23 bp, Homo sapiens
attttacaggtcagttccttgaa

SEQ ID NO: 9122189 - DNA, 22 bp, Homo sapiens
attttactaagtggatatctgt

SEQ ID NO: 9122190 - DNA, 22 bp, Homo sapiens
attttctgtgtgcagataaata

SEQ ID NO: 9122191 - DNA, 22 bp, Homo sapiens
gctcagtctaaagacatgctcc

SEQ ID NO: 9122192 - DNA, 19 bp, Homo sapiens
gctcagtctcctgattgct

SEQ ID NO: 9122193 - DNA, 22 bp, Homo sapiens
gctctaggaggtgtgcttagaa

SEQ ID NO: 9122194 - DNA, 22 bp, Homo sapiens
caaattcacatgattgcttctg

SEQ ID NO: 9122195 - DNA, 22 bp, Homo sapiens
gctgagctgggacagtcctggg

SEQ ID NO: 9122196 - DNA, 22 bp, Homo sapiens
caaatattccaggtacatccct

SEQ ID NO: 9122197 - DNA, 19 bp, Homo sapiens
agtgttctgagtactcctc

SEQ ID NO: 9122198 - DNA, 22 bp, Homo sapiens
ctgagccaccggcagggacatc

SEQ ID NO: 9122199 - DNA, 22 bp, Homo sapiens
ctgagccagagggagtcgggtc

SEQ ID NO: 9122200 - DNA, 22 bp, Homo sapiens
agtgtcccctccaagggcctgg

SEQ ID NO: 9122201 - DNA, 22 bp, Homo sapiens
agtgtgagaacggactaataaa

SEQ ID NO: 9122202 - DNA, 22 bp, Homo sapiens
ctctggagttcccttgatctga

SEQ ID NO: 9122203 - DNA, 22 bp, Homo sapiens
agtggccccacagtagggctta

SEQ ID NO: 9122204 - DNA, 22 bp, Homo sapiens
agtgatccacccgcctcaacct

SEQ ID NO: 9122205 - DNA, 22 bp, Homo sapiens
agtgaaatgatagtgtaaatac

SEQ ID NO: 9122206 - DNA, 22 bp, Homo sapiens
ctcacattcacaggacagaagg

SEQ ID NO: 9122207 - DNA, 22 bp, Homo sapiens
agtctcagaaaagaagcatgga

SEQ ID NO: 9122208 - DNA, 22 bp, Homo sapiens
agtggcaaagtcttcagaagtt

SEQ ID NO: 9122209 - DNA, 22 bp, Homo sapiens
agtggcaaaagcaggcttaggc

SEQ ID NO: 9122210 - DNA, 22 bp, Homo sapiens
agtggagaccccacttctacat

SEQ ID NO: 9122211 - DNA, 22 bp, Homo sapiens
agtgccctcgtgcccagggcct

SEQ ID NO: 9122212 - DNA, 22 bp, Homo sapiens
agtgcctctgcaggtccgagtt

SEQ ID NO: 9122213 - DNA, 22 bp, Homo sapiens
agtgccctggttataggtgtgg

SEQ ID NO: 9122214 - DNA, 22 bp, Homo sapiens
agggttttgtttcttgaagcac

SEQ ID NO: 9122215 - DNA, 22 bp, Homo sapiens
agggttttgtgaggctcaaact

SEQ ID NO: 9122216 - DNA, 22 bp, Homo sapiens
aggtaaaatagatagtatttct

SEQ ID NO: 9122217 - DNA, 22 bp, Homo sapiens
aggtaaaatgagtctccattat

SEQ ID NO: 9122218 - DNA, 21 bp, Homo sapiens
agggttttatagatctcttcc

SEQ ID NO: 9122219 - DNA, 22 bp, Homo sapiens
agggttttggctgaagttcagc

SEQ ID NO: 9122220 - DNA, 22 bp, Homo sapiens
agggttttcatttctgagcatt

SEQ ID NO: 9122221 - DNA, 22 bp, Homo sapiens
aggtcagccctctctgggcagg

SEQ ID NO: 9122222 - DNA, 22 bp, Homo sapiens
aggtcagctagacagctctctg

SEQ ID NO: 9122223 - DNA, 22 bp, Homo sapiens
aggtcagcaggccaggggcgaa

SEQ ID NO: 9122224 - DNA, 22 bp, Homo sapiens
ccttccagccccatctcatcgt

SEQ ID NO: 9122225 - DNA, 22 bp, Homo sapiens
cctgtgccagctgggccctgcc

SEQ ID NO: 9122226 - DNA, 22 bp, Homo sapiens
agtcacatgagtttctctttat

SEQ ID NO: 9122227 - DNA, 22 bp, Homo sapiens
agtcaatatttcaataacccat

SEQ ID NO: 9122228 - DNA, 21 bp, Homo sapiens
ataaagacaaacactatttgg

SEQ ID NO: 9122229 - DNA, 22 bp, Homo sapiens
ataaagctaagacttacatgaa

SEQ ID NO: 9122230 - DNA, 22 bp, Homo sapiens
ataaagctattcctctcttttt

SEQ ID NO: 9122231 - DNA, 22 bp, Homo sapiens
agttctggtggtttggagatct

SEQ ID NO: 9122232 - DNA, 22 bp, Homo sapiens
ataaaaggaaagcctgttgtga

SEQ ID NO: 9122233 - DNA, 22 bp, Homo sapiens
agttctcattgcatgagacaga

SEQ ID NO: 9122234 - DNA, 22 bp, Homo sapiens
agttctcatcatgaagcataag

SEQ ID NO: 9122235 - DNA, 22 bp, Homo sapiens
ataaagctcttagtagcagcct

SEQ ID NO: 9122236 - DNA, 22 bp, Homo sapiens
ataaagcttctgagtctagatc

SEQ ID NO: 9122237 - DNA, 22 bp, Homo sapiens
ataaagctttgaaatggagata

SEQ ID NO: 9122238 - DNA, 22 bp, Homo sapiens
ctgctaaacctctctgagagct

SEQ ID NO: 9122239 - DNA, 22 bp, Homo sapiens
ctggccctatgagcctcctgat

SEQ ID NO: 9122240 - DNA, 22 bp, Homo sapiens
ctggctcttggctagggagagt

SEQ ID NO: 9122241 - DNA, 22 bp, Homo sapiens
cttcaagagaatgcagggatgt

SEQ ID NO: 9122242 - DNA, 22 bp, Homo sapiens
cttaataaatggtagctgttat

SEQ ID NO: 9122243 - DNA, 22 bp, Homo sapiens
atcatacactcacataaacaga

SEQ ID NO: 9122244 - DNA, 22 bp, Homo sapiens
ctgtaaatggaactatgtagta

SEQ ID NO: 9122245 - DNA, 22 bp, Homo sapiens
caggcttgctagaggagccaaa

SEQ ID NO: 9122246 - DNA, 22 bp, Homo sapiens
caggcttgctgctagagcactt

SEQ ID NO: 9122247 - DNA, 22 bp, Homo sapiens
caggcttgattattcagacaat

SEQ ID NO: 9122248 - DNA, 22 bp, Homo sapiens
caggcttgaagcttcagagtat

SEQ ID NO: 9122249 - DNA, 21 bp, Homo sapiens
caggcttgaggaatgtgcctg

SEQ ID NO: 9122250 - DNA, 22 bp, Homo sapiens
caggcttgagggcaggcccagt

SEQ ID NO: 9122251 - DNA, 20 bp, Homo sapiens
agcttctgctgcctttcggc

SEQ ID NO: 9122252 - DNA, 22 bp, Homo sapiens
agctgggtggcctctcctcggg

SEQ ID NO: 9122253 - DNA, 22 bp, Homo sapiens
agctgggtggagggcccacggt

SEQ ID NO: 9122254 - DNA, 20 bp, Homo sapiens
caggcagaggatgctgacca

SEQ ID NO: 9122255 - DNA, 20 bp, Homo sapiens
agctctttttagctaaggta

SEQ ID NO: 9122256 - DNA, 22 bp, Homo sapiens
agctcttttatcatgaggagag

SEQ ID NO: 9122257 - DNA, 22 bp, Homo sapiens
agctcttttgattctccctgtc

SEQ ID NO: 9122258 - DNA, 22 bp, Homo sapiens
agctcttttgctctccaagttt

SEQ ID NO: 9122259 - DNA, 22 bp, Homo sapiens
agctcttttgtgagcatttggc

SEQ ID NO: 9122260 - DNA, 22 bp, Homo sapiens
agctgccctggcggagctgctc

SEQ ID NO: 9122261 - DNA, 22 bp, Homo sapiens
agctgccctttatgatgctgaa

SEQ ID NO: 9122262 - DNA, 22 bp, Homo sapiens
catcagaagaaagacaaatgat

SEQ ID NO: 9122263 - DNA, 22 bp, Homo sapiens
cagttcagactacccacattgt

SEQ ID NO: 9122264 - DNA, 22 bp, Homo sapiens
aggacaaaggaccagatctgga

SEQ ID NO: 9122265 - DNA, 20 bp, Homo sapiens
aggcagctggccaggcaggt

SEQ ID NO: 9122266 - DNA, 23 bp, Homo sapiens
aggataaactaaactcattttgg

SEQ ID NO: 9122267 - DNA, 22 bp, Homo sapiens
aggataaaggtcattattccca

SEQ ID NO: 9122268 - DNA, 22 bp, Homo sapiens
ccagaaatcctctctttcttgc

SEQ ID NO: 9122269 - DNA, 22 bp, Homo sapiens
ccagaccagactgacttgagcc

SEQ ID NO: 9122270 - DNA, 19 bp, Homo sapiens
ccagcagctttgattctct

SEQ ID NO: 9122271 - DNA, 22 bp, Homo sapiens
ccagggctggtggctgcagagg

SEQ ID NO: 9122272 - DNA, 22 bp, Homo sapiens
aggctgggctccgcccaactcc

SEQ ID NO: 9122273 - DNA, 22 bp, Homo sapiens
agggctgcatctgcctggtgaa

SEQ ID NO: 9122274 - DNA, 22 bp, Homo sapiens
cctgagaggccctctcactgtc

SEQ ID NO: 9122275 - DNA, 22 bp, Homo sapiens
cctgaactctaaatagagcagt

SEQ ID NO: 9122276 - DNA, 22 bp, Homo sapiens
cctgaaatccatagtttacact

SEQ ID NO: 9122277 - DNA, 22 bp, Homo sapiens
aggggcagcctcacaatcctct

SEQ ID NO: 9122278 - DNA, 22 bp, Homo sapiens
aggggagagttaatgtgaatgt

SEQ ID NO: 9122279 - DNA, 22 bp, Homo sapiens
aggggaggtgtccccaaatctc

SEQ ID NO: 9122280 - DNA, 22 bp, Homo sapiens
cccatcaggaacccaggagccc

SEQ ID NO: 9122281 - DNA, 22 bp, Homo sapiens
cccaggagcttctctctgcctc

SEQ ID NO: 9122282 - DNA, 22 bp, Homo sapiens
cccaggagccatctgtcttggc

SEQ ID NO: 9122283 - DNA, 22 bp, Homo sapiens
aggctggtgcttcctagggcag

SEQ ID NO: 9122284 - DNA, 22 bp, Homo sapiens
aggctgtgacagggtcatggag

SEQ ID NO: 9122285 - DNA, 22 bp, Homo sapiens
aggctgtgaaatgtggcaagga

SEQ ID NO: 9122286 - DNA, 22 bp, Homo sapiens
cccatgagtgctgctcagaggc

SEQ ID NO: 9122287 - DNA, 17 bp, Homo sapiens
cccatgagcccactccc

SEQ ID NO: 9122288 - DNA, 19 bp, Homo sapiens
ccctaggggctcctgaggg

SEQ ID NO: 9122289 - DNA, 22 bp, Homo sapiens
ccctagggtttggccagagccc

SEQ ID NO: 9122290 - DNA, 22 bp, Homo sapiens
ccctcacttcacgctctgcaga

SEQ ID NO: 9122291 - DNA, 22 bp, Homo sapiens
ccccttccaggaagcagaatcg

SEQ ID NO: 9122292 - DNA, 20 bp, Homo sapiens
ccccttcatctacagcctga

SEQ ID NO: 9122293 - DNA, 22 bp, Homo sapiens
ccccttccacagtgcttcctaa

SEQ ID NO: 9122294 - DNA, 22 bp, Homo sapiens
ccctgccctgggcagaagtggg

SEQ ID NO: 9122295 - DNA, 22 bp, Homo sapiens
ccctgctgtgcctgactgccat

SEQ ID NO: 9122296 - DNA, 22 bp, Homo sapiens
ccctgcccaccacatgctggga

SEQ ID NO: 9122297 - DNA, 22 bp, Homo sapiens
ccctgcccatcggggcggcctg

SEQ ID NO: 9122298 - DNA, 21 bp, Homo sapiens
ccctgccctcaaggacagtgc

SEQ ID NO: 9122299 - DNA, 22 bp, Homo sapiens
ccctgccccaggcggcttcact

SEQ ID NO: 9122300 - DNA, 23 bp, Homo sapiens
ccctgcccattgagcaggacgtc

SEQ ID NO: 9122301 - DNA, 22 bp, Homo sapiens
ccctccatgacgtcttcagccg

SEQ ID NO: 9122302 - DNA, 22 bp, Homo sapiens
ccctccatgagtgtgctgctgg

SEQ ID NO: 9122303 - DNA, 22 bp, Homo sapiens
ccctcccaagcactctgacata

SEQ ID NO: 9122304 - DNA, 20 bp, Homo sapiens
ccctcccagatgcttcccaa

SEQ ID NO: 9122305 - DNA, 20 bp, Homo sapiens
ccctcccagatgcttcccaa

SEQ ID NO: 9122306 - DNA, 22 bp, Homo sapiens
aggcttcccagctgagctcagc

SEQ ID NO: 9122307 - DNA, 22 bp, Homo sapiens
aggctgtgcaattagggtaaga

SEQ ID NO: 9122308 - DNA, 19 bp, Homo sapiens
acattgaattttcttcttt

SEQ ID NO: 9122309 - DNA, 22 bp, Homo sapiens
acattgaacatggcaggacatt

SEQ ID NO: 9122310 - DNA, 22 bp, Homo sapiens
acattgaacagtacaaatgatc

SEQ ID NO: 9122311 - DNA, 22 bp, Homo sapiens
acattgaaagcatattatctcc

SEQ ID NO: 9122312 - DNA, 22 bp, Homo sapiens
acattgaaagcatattatctcc

SEQ ID NO: 9122313 - DNA, 22 bp, Homo sapiens
acattgaactacttgtaatgag

SEQ ID NO: 9122314 - DNA, 22 bp, Homo sapiens
acattgaaccagtagacacaaa

SEQ ID NO: 9122315 - DNA, 22 bp, Homo sapiens
acattgaagggaatgcaaagat

SEQ ID NO: 9122316 - DNA, 22 bp, Homo sapiens
acattgaagctgtgaaatcaaa

SEQ ID NO: 9122317 - DNA, 22 bp, Homo sapiens
acattgaagggctatccaatag

SEQ ID NO: 9122318 - DNA, 22 bp, Homo sapiens
acattgaagtgtctggcctcct

SEQ ID NO: 9122319 - DNA, 22 bp, Homo sapiens
acattgaatgtatgtgatgaaa

SEQ ID NO: 9122320 - DNA, 22 bp, Homo sapiens
acattgaatttcacttttgtac

SEQ ID NO: 9122321 - DNA, 22 bp, Homo sapiens
acattgaattcaaaattactga

SEQ ID NO: 9122322 - DNA, 20 bp, Homo sapiens
acatgaaaggaaacaggaaa

SEQ ID NO: 9122323 - DNA, 22 bp, Homo sapiens
acatgaaacctgagtctaactc

SEQ ID NO: 9122324 - DNA, 22 bp, Homo sapiens
aggccagcattctctctccagg

SEQ ID NO: 9122325 - DNA, 22 bp, Homo sapiens
acatgaaaagactatctgatta

SEQ ID NO: 9122326 - DNA, 21 bp, Homo sapiens
aggaggggtctttcccactga

SEQ ID NO: 9122327 - DNA, 22 bp, Homo sapiens
aggcaacataacacgaaagtct

SEQ ID NO: 9122328 - DNA, 22 bp, Homo sapiens
aggaagcatgttggatccactt

SEQ ID NO: 9122329 - DNA, 21 bp, Homo sapiens
agctgtggcgaggggaacatg

SEQ ID NO: 9122330 - DNA, 22 bp, Homo sapiens
agctgtgggagaatctctgggt

SEQ ID NO: 9122331 - DNA, 22 bp, Homo sapiens
agctgtgggatttgggtgtgcc

SEQ ID NO: 9122332 - DNA, 22 bp, Homo sapiens
agctgtggttctgggcagcgac

SEQ ID NO: 9122333 - DNA, 22 bp, Homo sapiens
agctgtggggcaggcagcgagg

SEQ ID NO: 9122334 - DNA, 22 bp, Homo sapiens
agctgtgggcctgggagagctg

SEQ ID NO: 9122335 - DNA, 22 bp, Homo sapiens
agctgtggggaggaggctagca

SEQ ID NO: 9122336 - DNA, 22 bp, Homo sapiens
agtactcaggaaatgctgagta

SEQ ID NO: 9122337 - DNA, 22 bp, Homo sapiens
agtcaccagggtttgctgggtt

SEQ ID NO: 9122338 - DNA, 22 bp, Homo sapiens
agtcaccatctgtggcagcctg

SEQ ID NO: 9122339 - DNA, 22 bp, Homo sapiens
actccctctctagtccttgcaa

SEQ ID NO: 9122340 - DNA, 22 bp, Homo sapiens
actccctccaaatctgcacagt

SEQ ID NO: 9122341 - DNA, 22 bp, Homo sapiens
actacattatgaggaaagagtg

SEQ ID NO: 9122342 - DNA, 22 bp, Homo sapiens
acccttccaaatgagcttatta

SEQ ID NO: 9122343 - DNA, 22 bp, Homo sapiens
accttcgtttcccactttgtaa

SEQ ID NO: 9122344 - DNA, 22 bp, Homo sapiens
actctgcctgaacctcctgcaa

SEQ ID NO: 9122345 - DNA, 21 bp, Homo sapiens
actctgccagtctcctgcact

SEQ ID NO: 9122346 - DNA, 22 bp, Homo sapiens
actggctgtgtaacctcaggca

SEQ ID NO: 9122347 - DNA, 22 bp, Homo sapiens
actggctgtggccacggctgct

SEQ ID NO: 9122348 - DNA, 22 bp, Homo sapiens
actggctgtgcccatagagctc

SEQ ID NO: 9122349 - DNA, 22 bp, Homo sapiens
actggctggccgcgctcttcgc

SEQ ID NO: 9122350 - DNA, 22 bp, Homo sapiens
actggctggccacaccctggta

SEQ ID NO: 9122351 - DNA, 21 bp, Homo sapiens
actggctggctgagtttcctg

SEQ ID NO: 9122352 - DNA, 21 bp, Homo sapiens
actggctgtcttcctactggt

SEQ ID NO: 9122353 - DNA, 22 bp, Homo sapiens
actggctgtgcagagggcagta

SEQ ID NO: 9122354 - DNA, 22 bp, Homo sapiens
agtgtccttgttattactgctc

SEQ ID NO: 9122355 - DNA, 22 bp, Homo sapiens
agtgtccttgaggttcctagga

SEQ ID NO: 9122356 - DNA, 21 bp, Homo sapiens
agtgtccttgatcttgccttg

SEQ ID NO: 9122357 - DNA, 22 bp, Homo sapiens
actggctgatatggctaggaag

SEQ ID NO: 9122358 - DNA, 21 bp, Homo sapiens
actggctgccatgatccaggg

SEQ ID NO: 9122359 - DNA, 22 bp, Homo sapiens
actggctgatcacctgcctcag

SEQ ID NO: 9122360 - DNA, 22 bp, Homo sapiens
actggctggagttgccaaggct

SEQ ID NO: 9122361 - DNA, 22 bp, Homo sapiens
actggctggactctgacctctt

SEQ ID NO: 9122362 - DNA, 22 bp, Homo sapiens
actggctgcgttcctgtgagac

SEQ ID NO: 9122363 - DNA, 22 bp, Homo sapiens
actggctgcggggtggaagaag

SEQ ID NO: 9122364 - DNA, 20 bp, Homo sapiens
actggctgcctggaatgcgc

SEQ ID NO: 9122365 - DNA, 18 bp, Homo sapiens
acttctcatttctctgca

SEQ ID NO: 9122366 - DNA, 22 bp, Homo sapiens
ataatttttgtttgatgtccaa

SEQ ID NO: 9122367 - DNA, 21 bp, Homo sapiens
actgttattcccattttcacc

SEQ ID NO: 9122368 - DNA, 22 bp, Homo sapiens
atcaaaacttctttagagttta

SEQ ID NO: 9122369 - DNA, 22 bp, Homo sapiens
agaaagcctcaatcttcaggcc

SEQ ID NO: 9122370 - DNA, 20 bp, Homo sapiens
agaaggcaggagacaaaagg

SEQ ID NO: 9122371 - DNA, 22 bp, Homo sapiens
agaatattcatctgtattctta

SEQ ID NO: 9122372 - DNA, 22 bp, Homo sapiens
agacacttggcagagagctgtt

SEQ ID NO: 9122373 - DNA, 21 bp, Homo sapiens
agacaactgtgactattccct

SEQ ID NO: 9122374 - DNA, 22 bp, Homo sapiens
atgcctttcttagccctgaagg

SEQ ID NO: 9122375 - DNA, 22 bp, Homo sapiens
atgcctttgttgaccactataa

SEQ ID NO: 9122376 - DNA, 22 bp, Homo sapiens
agagaaaactcattgaggtgtc

SEQ ID NO: 9122377 - DNA, 22 bp, Homo sapiens
agactttcatctcttctgggca

SEQ ID NO: 9122378 - DNA, 22 bp, Homo sapiens
agagccctctgcaatgcctcag

SEQ ID NO: 9122379 - DNA, 22 bp, Homo sapiens
agagccctctcattggcttatt

SEQ ID NO: 9122380 - DNA, 22 bp, Homo sapiens
agagccctaaaccctgccttgg

SEQ ID NO: 9122381 - DNA, 22 bp, Homo sapiens
agagcccctggtggagtgagaa

SEQ ID NO: 9122382 - DNA, 22 bp, Homo sapiens
agagtggcagtaaaatagagca

SEQ ID NO: 9122383 - DNA, 22 bp, Homo sapiens
agatattaggaggattcataat

SEQ ID NO: 9122384 - DNA, 22 bp, Homo sapiens
agatattaggaggattcataat

SEQ ID NO: 9122385 - DNA, 22 bp, Homo sapiens
agatggctctttgaaggggaat

SEQ ID NO: 9122386 - DNA, 22 bp, Homo sapiens
agatggcttagcctggctccca

SEQ ID NO: 9122387 - DNA, 22 bp, Homo sapiens
agcaacatatatcaatgcctga

SEQ ID NO: 9122388 - DNA, 19 bp, Homo sapiens
agaggcaagggtggaagta

SEQ ID NO: 9122389 - DNA, 22 bp, Homo sapiens
agaggcaagggacctttctggg

SEQ ID NO: 9122390 - DNA, 22 bp, Homo sapiens
agaggcaagattatcagggcat

SEQ ID NO: 9122391 - DNA, 22 bp, Homo sapiens
agagtgcttagtagtgacatgg

SEQ ID NO: 9122392 - DNA, 22 bp, Homo sapiens
agagtgcagataagagaatgtt

SEQ ID NO: 9122393 - DNA, 22 bp, Homo sapiens
agagtgcaaccgaaacaagcag

SEQ ID NO: 9122394 - DNA, 22 bp, Homo sapiens
caaaggcttccactgcatcctt

SEQ ID NO: 9122395 - DNA, 23 bp, Homo sapiens
agcagcccagatgccttccatcc

SEQ ID NO: 9122396 - DNA, 19 bp, Homo sapiens
cactgtggtccttcactgc

SEQ ID NO: 9122397 - DNA, 22 bp, Homo sapiens
agcaggttgtgatacactcaga

SEQ ID NO: 9122398 - DNA, 22 bp, Homo sapiens
agcagtcctccagtgtgtttta

SEQ ID NO: 9122399 - DNA, 22 bp, Homo sapiens
agcagtgctatggccaggctaa

SEQ ID NO: 9122400 - DNA, 22 bp, Homo sapiens
agctctttcccctccctatggc

SEQ ID NO: 9122401 - DNA, 22 bp, Homo sapiens
agctctttctacaagcaggcag

SEQ ID NO: 9122402 - DNA, 22 bp, Homo sapiens
agctctttgagaaggcagtgtg

SEQ ID NO: 9122403 - DNA, 22 bp, Homo sapiens
agctctttgactaatcttgctt

SEQ ID NO: 9122404 - DNA, 22 bp, Homo sapiens
agctctttgagcaaggcagctc

SEQ ID NO: 9122405 - DNA, 22 bp, Homo sapiens
agctctttggcactgagcagca

SEQ ID NO: 9122406 - DNA, 22 bp, Homo sapiens
agctctttggaaggtgtgcact

SEQ ID NO: 9122407 - DNA, 22 bp, Homo sapiens
agctctttgctggcagtaggct

SEQ ID NO: 9122408 - DNA, 19 bp, Homo sapiens
agctctttgctgcattcca

SEQ ID NO: 9122409 - DNA, 22 bp, Homo sapiens
agctctttatgggtaaatgcca

SEQ ID NO: 9122410 - DNA, 15 bp, Homo sapiens
agctctttcagctac

SEQ ID NO: 9122411 - DNA, 22 bp, Homo sapiens
agctctttatgtggaagaggca

SEQ ID NO: 9122412 - DNA, 22 bp, Homo sapiens
agctctttaatcttagccccag

SEQ ID NO: 9122413 - DNA, 22 bp, Homo sapiens
agctctttagagtctcccttct

SEQ ID NO: 9122414 - DNA, 22 bp, Homo sapiens
agctctttacacagagtccctc

SEQ ID NO: 9122415 - DNA, 22 bp, Homo sapiens
agctcttccacctcatgatggg

SEQ ID NO: 9122416 - DNA, 22 bp, Homo sapiens
cagatgtagtagctttattgca

SEQ ID NO: 9122417 - DNA, 22 bp, Homo sapiens
cagatgtgcatgatgggaaggg

SEQ ID NO: 9122418 - DNA, 23 bp, Homo sapiens
agccctgctgagacccagctccc

SEQ ID NO: 9122419 - DNA, 22 bp, Homo sapiens
agccagcaggtgcagaattcca

SEQ ID NO: 9122420 - DNA, 22 bp, Homo sapiens
agccagcatcccttcagtctcc

SEQ ID NO: 9122421 - DNA, 22 bp, Homo sapiens
agccagcacggcgccatggagt

SEQ ID NO: 9122422 - DNA, 21 bp, Homo sapiens
agccagcaacacagcatctcc

SEQ ID NO: 9122423 - DNA, 22 bp, Homo sapiens
cagagcctggcgatgtcatgga

SEQ ID NO: 9122424 - DNA, 22 bp, Homo sapiens
cagagcctggcgatgtcatgga

SEQ ID NO: 9122425 - DNA, 19 bp, Homo sapiens
cagagccttcagtgactcc

SEQ ID NO: 9122426 - DNA, 22 bp, Homo sapiens
cagagacccttctcagtggcca

SEQ ID NO: 9122427 - DNA, 22 bp, Homo sapiens
aaatggcatagaggtgaaggta

SEQ ID NO: 9122428 - DNA, 22 bp, Homo sapiens
aaaggaggaatggagagatgct

SEQ ID NO: 9122429 - DNA, 22 bp, Homo sapiens
aaacatctactgtaggctggag

SEQ ID NO: 9122430 - DNA, 22 bp, Homo sapiens
aaacatcaccattttacctaat

SEQ ID NO: 9122431 - DNA, 22 bp, Homo sapiens
aaaagtcttgtcaaggttccca

SEQ ID NO: 9122432 - DNA, 22 bp, Homo sapiens
aaaagtgtccagattatgaaga

SEQ ID NO: 9122433 - DNA, 22 bp, Homo sapiens
aaacttctggctacaagcaata

SEQ ID NO: 9122434 - DNA, 22 bp, Homo sapiens
aaacttcttgctgcattttctg

SEQ ID NO: 9122435 - DNA, 22 bp, Homo sapiens
aaacttggggctttcttacatt

SEQ ID NO: 9122436 - DNA, 22 bp, Homo sapiens
aaacatctttctattgcaagtt

SEQ ID NO: 9122437 - DNA, 22 bp, Homo sapiens
aaacatcttgctctgattggta

SEQ ID NO: 9122438 - DNA, 22 bp, Homo sapiens
aaacatcttctcttgattcttt

SEQ ID NO: 9122439 - DNA, 22 bp, Homo sapiens
aaactggtattcaaatgtttgg

SEQ ID NO: 9122440 - DNA, 22 bp, Homo sapiens
aagaatgttagtttctgataca

SEQ ID NO: 9122441 - DNA, 22 bp, Homo sapiens
aaatatcatttataacttttaa

SEQ ID NO: 9122442 - DNA, 22 bp, Homo sapiens
aaatatcattctggtgcacaga

SEQ ID NO: 9122443 - DNA, 22 bp, Homo sapiens
aactgacagcaggaaccattcc

SEQ ID NO: 9122444 - DNA, 22 bp, Homo sapiens
aacatgcaatgtctgaaaatcc

SEQ ID NO: 9122445 - DNA, 22 bp, Homo sapiens
aacattctactgtactgcattg

SEQ ID NO: 9122446 - DNA, 22 bp, Homo sapiens
aacacattgccagagatcagca

SEQ ID NO: 9122447 - DNA, 22 bp, Homo sapiens
aaattattacaagctagttggc

SEQ ID NO: 9122448 - DNA, 22 bp, Homo sapiens
aaattgttgatctacagtaagg

SEQ ID NO: 9122449 - DNA, 22 bp, Homo sapiens
aaggggagatgtcatgggccct

SEQ ID NO: 9122450 - DNA, 22 bp, Homo sapiens
aacaagcagatgcaatgcactt

SEQ ID NO: 9122451 - DNA, 22 bp, Homo sapiens
aagatataataactgttgtcat

SEQ ID NO: 9122452 - DNA, 22 bp, Homo sapiens
aagattttctcaactgtatttg

SEQ ID NO: 9122453 - DNA, 22 bp, Homo sapiens
aagatttttttccacagactca

SEQ ID NO: 9122454 - DNA, 22 bp, Homo sapiens
acagaagagcacatttagtatg

SEQ ID NO: 9122455 - DNA, 22 bp, Homo sapiens
acagaagcagccgtcacagata

SEQ ID NO: 9122456 - DNA, 22 bp, Homo sapiens
acagaagcaaaagcaggatctt

SEQ ID NO: 9122457 - DNA, 22 bp, Homo sapiens
aagagttatacctatttctaac

SEQ ID NO: 9122458 - DNA, 22 bp, Homo sapiens
aagagtgagtatttcctgatta

SEQ ID NO: 9122459 - DNA, 20 bp, Homo sapiens
acacacagagacatgcgcat

SEQ ID NO: 9122460 - DNA, 22 bp, Homo sapiens
aattagaagggagttattgata

SEQ ID NO: 9122461 - DNA, 22 bp, Homo sapiens
aagaattttccagcatgtcagt

SEQ ID NO: 9122462 - DNA, 22 bp, Homo sapiens
aagaattattgcaatactagat

SEQ ID NO: 9122463 - DNA, 22 bp, Homo sapiens
aactctcattttaggtgtaagg

SEQ ID NO: 9122464 - DNA, 22 bp, Homo sapiens
aatgtcaaagtgctttgcaaac

SEQ ID NO: 9122465 - DNA, 22 bp, Homo sapiens
aatgttacgatcaacaacacat

SEQ ID NO: 9122466 - DNA, 22 bp, Homo sapiens
aatgttacaggacctaagatga

SEQ ID NO: 9122467 - DNA, 22 bp, Homo sapiens
aatgttacaggacaaagatgga

SEQ ID NO: 9122468 - DNA, 22 bp, Homo sapiens
agcatgaaaacatgaaacagca

SEQ ID NO: 9122469 - DNA, 21 bp, Homo sapiens
agcattctgcttctttcctgg

SEQ ID NO: 9122470 - DNA, 22 bp, Homo sapiens
agcatctctaaatccagtaagt

SEQ ID NO: 9122471 - DNA, 22 bp, Homo sapiens
agcatctctccattcctccttt

SEQ ID NO: 9122472 - DNA, 22 bp, Homo sapiens
agcattgatttgtgaccaacaa

SEQ ID NO: 9122473 - DNA, 23 bp, Homo sapiens
agcattgatgcaaggtgcccctg

SEQ ID NO: 9122474 - DNA, 22 bp, Homo sapiens
acagacatcatcaacatcttcc

SEQ ID NO: 9122475 - DNA, 22 bp, Homo sapiens
agcccagctttcacccctctgg

SEQ ID NO: 9122476 - DNA, 22 bp, Homo sapiens
agccttacataaacagccttat

SEQ ID NO: 9122477 - DNA, 22 bp, Homo sapiens
acacactgctcatgaggagcat

SEQ ID NO: 9122478 - DNA, 22 bp, Homo sapiens
acacactggaggtaaatggggt

SEQ ID NO: 9122479 - DNA, 22 bp, Homo sapiens
acacactgctcgctcagattaa

SEQ ID NO: 9122480 - DNA, 21 bp, Homo sapiens
acacactgagttttccactgt

SEQ ID NO: 9122481 - DNA, 22 bp, Homo sapiens
acacactgagtgccataggacc

SEQ ID NO: 9122482 - DNA, 22 bp, Homo sapiens
acacactgaattttgtggaaac

SEQ ID NO: 9122483 - DNA, 22 bp, Homo sapiens
agattttatagataatttccca

SEQ ID NO: 9122484 - DNA, 22 bp, Homo sapiens
acacacagaaggaagccccact

SEQ ID NO: 9122485 - DNA, 22 bp, Homo sapiens
acacactggcaggagctataaa

SEQ ID NO: 9122486 - DNA, 22 bp, Homo sapiens
acacactggcccccagtactga

SEQ ID NO: 9122487 - DNA, 22 bp, Homo sapiens
acacactgggcatggtttatgc

SEQ ID NO: 9122488 - DNA, 20 bp, Homo sapiens
acacactttgatcttgagcc

SEQ ID NO: 9122489 - DNA, 22 bp, Homo sapiens
acacactgttgctcatccaggc

SEQ ID NO: 9122490 - DNA, 22 bp, Homo sapiens
acacactgtaaggactatcact

SEQ ID NO: 9122491 - DNA, 19 bp, Homo sapiens
agcagcagctaccacttgt

SEQ ID NO: 9122492 - DNA, 22 bp, Homo sapiens
agagggcataaaatagagcacg

SEQ ID NO: 9122493 - DNA, 22 bp, Homo sapiens
aattttctggtgtgtaatgaag

SEQ ID NO: 9122494 - DNA, 22 bp, Homo sapiens
aattcacatgttgaagtcctaa

SEQ ID NO: 9122495 - DNA, 22 bp, Homo sapiens
agacctctgctcccttcatggt

SEQ ID NO: 9122496 - DNA, 22 bp, Homo sapiens
agagagcagtctggaagaaaca

SEQ ID NO: 9122497 - DNA, 22 bp, Homo sapiens
agaatttttgattatctactcg

SEQ ID NO: 9122498 - DNA, 22 bp, Homo sapiens
acatacttgaagcaagtgatca

SEQ ID NO: 9122499 - DNA, 22 bp, Homo sapiens
acataagttatggataaaatgt

SEQ ID NO: 9122500 - DNA, 22 bp, Homo sapiens
acagattttattattcaggtat

SEQ ID NO: 9122501 - DNA, 22 bp, Homo sapiens
acagatttttcagctcctgtgt

SEQ ID NO: 9122502 - DNA, 22 bp, Homo sapiens
acagcttttgaaaaattactgg

SEQ ID NO: 9122503 - DNA, 22 bp, Homo sapiens
actcatgtaagcggaatgtagt

SEQ ID NO: 9122504 - DNA, 22 bp, Homo sapiens
aagtaacagagggggtgttgct

SEQ ID NO: 9122505 - DNA, 22 bp, Homo sapiens
aagtaaatatctgtagtcttta

SEQ ID NO: 9122506 - DNA, 22 bp, Homo sapiens
aagtaaatatctgtttatagca

SEQ ID NO: 9122507 - DNA, 22 bp, Homo sapiens
aatcttcattttgacaagattc

SEQ ID NO: 9122508 - DNA, 22 bp, Homo sapiens
aatcttctttcttaacagtaca

SEQ ID NO: 9122509 - DNA, 22 bp, Homo sapiens
aatcttcacagagaaaattagg

SEQ ID NO: 9122510 - DNA, 22 bp, Homo sapiens
aatcttcaaaatgttctgcttg

SEQ ID NO: 9122511 - DNA, 22 bp, Homo sapiens
aatattatcaaaagctttttca

SEQ ID NO: 9122512 - DNA, 22 bp, Homo sapiens
aatatgtttataagatatcttc

SEQ ID NO: 9122513 - DNA, 22 bp, Homo sapiens
agaaaatgtgaacttgtgaatt

SEQ ID NO: 9122514 - DNA, 22 bp, Homo sapiens
aatattcaagttattctttctt

SEQ ID NO: 9122515 - DNA, 22 bp, Homo sapiens
actgtggctaattcatttggtc

SEQ ID NO: 9122516 - DNA, 18 bp, Homo sapiens
actgtggctcagagttgc

SEQ ID NO: 9122517 - DNA, 22 bp, Homo sapiens
actgtggctcagggaatgcatg

SEQ ID NO: 9122518 - DNA, 22 bp, Homo sapiens
actgtggctcatcaggctggtg

SEQ ID NO: 9122519 - DNA, 22 bp, Homo sapiens
actgtggcctgctgtatgggct

SEQ ID NO: 9122520 - DNA, 22 bp, Homo sapiens
actgtggcgtcaggaagaaatt

SEQ ID NO: 9122521 - DNA, 22 bp, Homo sapiens
actgtggccttgtgggttcagg

SEQ ID NO: 9122522 - DNA, 22 bp, Homo sapiens
actgtggccggaacagtgggac

SEQ ID NO: 9122523 - DNA, 22 bp, Homo sapiens
actgtggcaaaagaacattgga

SEQ ID NO: 9122524 - DNA, 22 bp, Homo sapiens
actgtggcactaggcaccttac

SEQ ID NO: 9122525 - DNA, 22 bp, Homo sapiens
actgtggccaaagcctctggga

SEQ ID NO: 9122526 - DNA, 22 bp, Homo sapiens
actgtggcaaagaagcaggctc

SEQ ID NO: 9122527 - DNA, 17 bp, Homo sapiens
acttcccacccctccag

SEQ ID NO: 9122528 - DNA, 22 bp, Homo sapiens
aatatgaattattgttacaagt

SEQ ID NO: 9122529 - DNA, 22 bp, Homo sapiens
acttatttcatggatcataatg

SEQ ID NO: 9122530 - DNA, 22 bp, Homo sapiens
gcccatccatggggtcatggcc

SEQ ID NO: 9122531 - DNA, 18 bp, Homo sapiens
gccagtcagtctttggta

SEQ ID NO: 9122532 - DNA, 22 bp, Homo sapiens
gccagcagtatgtcctggcagt

SEQ ID NO: 9122533 - DNA, 22 bp, Homo sapiens
gccagcagggcccaaatgctgg

SEQ ID NO: 9122534 - DNA, 22 bp, Homo sapiens
gcataaatgtgcacacacatgt

SEQ ID NO: 9122535 - DNA, 22 bp, Homo sapiens
gcagtcctgggattctgtcctt

SEQ ID NO: 9122536 - DNA, 22 bp, Homo sapiens
gcagcatcaatccatgcttctc

SEQ ID NO: 9122537 - DNA, 17 bp, Homo sapiens
gcactcccccacctcct

SEQ ID NO: 9122538 - DNA, 22 bp, Homo sapiens
gcaagagttttttctctcttga

SEQ ID NO: 9122539 - DNA, 22 bp, Homo sapiens
gagggtcagaagggcctggttc

SEQ ID NO: 9122540 - DNA, 22 bp, Homo sapiens
ggaaatattttgtctaatttgt

SEQ ID NO: 9122541 - DNA, 22 bp, Homo sapiens
gctggctgccaatttcagagct

SEQ ID NO: 9122542 - DNA, 22 bp, Homo sapiens
gctggctgcagattttagaggt

SEQ ID NO: 9122543 - DNA, 22 bp, Homo sapiens
gctggctgcacaggggctcact

SEQ ID NO: 9122544 - DNA, 18 bp, Homo sapiens
gctggctgcacttctgct

SEQ ID NO: 9122545 - DNA, 22 bp, Homo sapiens
gctggcacctatttggacctgg

SEQ ID NO: 9122546 - DNA, 22 bp, Homo sapiens
gctggcacctgcaccaagcagg

SEQ ID NO: 9122547 - DNA, 22 bp, Homo sapiens
gctggcacacagtacacgcctt

SEQ ID NO: 9122548 - DNA, 22 bp, Homo sapiens
gctgtgcccagctccagctctg

SEQ ID NO: 9122549 - DNA, 22 bp, Homo sapiens
gctgtgcagccaagtgcctctg

SEQ ID NO: 9122550 - DNA, 22 bp, Homo sapiens
gctgggtctggatgctcaggtg

SEQ ID NO: 9122551 - DNA, 22 bp, Homo sapiens
gctgggtctggctgtgagccgg

SEQ ID NO: 9122552 - DNA, 22 bp, Homo sapiens
gctgggtctctccctggtcctg

SEQ ID NO: 9122553 - DNA, 22 bp, Homo sapiens
gctgggtctctgggtgtaacaa

SEQ ID NO: 9122554 - DNA, 22 bp, Homo sapiens
gctgggtcctatgctggtagag

SEQ ID NO: 9122555 - DNA, 22 bp, Homo sapiens
gctgggtcccaagcctggggag

SEQ ID NO: 9122556 - DNA, 22 bp, Homo sapiens
gctgggtccatggtcctcgggt

SEQ ID NO: 9122557 - DNA, 21 bp, Homo sapiens
gctgggtcagcaggtcctctg

SEQ ID NO: 9122558 - DNA, 22 bp, Homo sapiens
gctgggtcagaatctccctgtg

SEQ ID NO: 9122559 - DNA, 20 bp, Homo sapiens
gctgggggtgtgctgagtga

SEQ ID NO: 9122560 - DNA, 22 bp, Homo sapiens
gctgatggcttgctggctgaca

SEQ ID NO: 9122561 - DNA, 22 bp, Homo sapiens
gccttaggggtcagacagagct

SEQ ID NO: 9122562 - DNA, 22 bp, Homo sapiens
gcgctggggctcaaacctcaca

SEQ ID NO: 9122563 - DNA, 22 bp, Homo sapiens
gccttctgcgctcgtgtctccg

SEQ ID NO: 9122564 - DNA, 18 bp, Homo sapiens
gctatctctaagatcttt

SEQ ID NO: 9122565 - DNA, 22 bp, Homo sapiens
gctcacaggcagtgttgggaga

SEQ ID NO: 9122566 - DNA, 19 bp, Homo sapiens
gggcagtggcactagggag

SEQ ID NO: 9122567 - DNA, 22 bp, Homo sapiens
gggcagtgttgctctcaaagtc

SEQ ID NO: 9122568 - DNA, 22 bp, Homo sapiens
gggcagtgaatattggtgggaa

SEQ ID NO: 9122569 - DNA, 22 bp, Homo sapiens
gggagggatctgctaggcaatg

SEQ ID NO: 9122570 - DNA, 22 bp, Homo sapiens
gggaggtgatggcaagcagcgg

SEQ ID NO: 9122571 - DNA, 22 bp, Homo sapiens
gggaggttctgttcgcacttga

SEQ ID NO: 9122572 - DNA, 22 bp, Homo sapiens
ggctctggttgaccatgatggc

SEQ ID NO: 9122573 - DNA, 22 bp, Homo sapiens
ggctctgggtctgtggggagcg

SEQ ID NO: 9122574 - DNA, 22 bp, Homo sapiens
ggctctgggcctccaaggtctg

SEQ ID NO: 9122575 - DNA, 22 bp, Homo sapiens
ggctggtcacaccactgcaggg

SEQ ID NO: 9122576 - DNA, 22 bp, Homo sapiens
ggctggtcctttctctgtccta

SEQ ID NO: 9122577 - DNA, 22 bp, Homo sapiens
ggctgggttatttatggccaag

SEQ ID NO: 9122578 - DNA, 17 bp, Homo sapiens
ggctgtgccaggtgaga

SEQ ID NO: 9122579 - DNA, 22 bp, Homo sapiens
ggctgtgcaccatccacctccc

SEQ ID NO: 9122580 - DNA, 22 bp, Homo sapiens
ggctgggtaccctgtttcccct

SEQ ID NO: 9122581 - DNA, 21 bp, Homo sapiens
ggctgggtcatgcagctggcc

SEQ ID NO: 9122582 - DNA, 22 bp, Homo sapiens
ggctgggtcccagctgggagga

SEQ ID NO: 9122583 - DNA, 22 bp, Homo sapiens
ggatctggggctctgctgctca

SEQ ID NO: 9122584 - DNA, 22 bp, Homo sapiens
gggctgggaatggctaagtatg

SEQ ID NO: 9122585 - DNA, 22 bp, Homo sapiens
gggctgggatggcttgaagatt

SEQ ID NO: 9122586 - DNA, 22 bp, Homo sapiens
gggctgggattgcttgctgtga

SEQ ID NO: 9122587 - DNA, 22 bp, Homo sapiens
gggctgggcatggtgttccctc

SEQ ID NO: 9122588 - DNA, 22 bp, Homo sapiens
gggctggggctcaataatttgt

SEQ ID NO: 9122589 - DNA, 22 bp, Homo sapiens
ggtctgggtttccccaccacac

SEQ ID NO: 9122590 - DNA, 22 bp, Homo sapiens
ggtctttctttgatagtggaga

SEQ ID NO: 9122591 - DNA, 22 bp, Homo sapiens
ggtgcctgtatttggggcacag

SEQ ID NO: 9122592 - DNA, 22 bp, Homo sapiens
ggtgccctggaagctgctgcat

SEQ ID NO: 9122593 - DNA, 22 bp, Homo sapiens
ggtgcccgccggcaaccctcgg

SEQ ID NO: 9122594 - DNA, 22 bp, Homo sapiens
ggtgcccaaggaaggttgccgt

SEQ ID NO: 9122595 - DNA, 22 bp, Homo sapiens
ggtaacaaggccgatagaaaca

SEQ ID NO: 9122596 - DNA, 22 bp, Homo sapiens
gtcttcagtggcaaatggatct

SEQ ID NO: 9122597 - DNA, 22 bp, Homo sapiens
gtgctgggattacaggtgtgag

SEQ ID NO: 9122598 - DNA, 22 bp, Homo sapiens
gtgctgggctccaccccagagg

SEQ ID NO: 9122599 - DNA, 22 bp, Homo sapiens
gtgcctcagcaccgcctgcagc

SEQ ID NO: 9122600 - DNA, 22 bp, Homo sapiens
gtgcctcccggggctcttcctt

SEQ ID NO: 9122601 - DNA, 22 bp, Homo sapiens
gtccctggagctgagcagtgct

SEQ ID NO: 9122602 - DNA, 22 bp, Homo sapiens
gtcaataattgatagatattgg

SEQ ID NO: 9122603 - DNA, 22 bp, Homo sapiens
gtcagttttgctacagttgctg

SEQ ID NO: 9122604 - DNA, 18 bp, Homo sapiens
gtcagttttgaagccaga

SEQ ID NO: 9122605 - DNA, 22 bp, Homo sapiens
gtcaataagtttgtaactggat

SEQ ID NO: 9122606 - DNA, 19 bp, Homo sapiens
gtcaataaaagttaggggt

SEQ ID NO: 9122607 - DNA, 22 bp, Homo sapiens
gtcaataattttatggagagaa

SEQ ID NO: 9122608 - DNA, 22 bp, Homo sapiens
ggtgggcagctcttggcaggca

SEQ ID NO: 9122609 - DNA, 22 bp, Homo sapiens
gtaaatgtttgctgatgattct

SEQ ID NO: 9122610 - DNA, 22 bp, Homo sapiens
gtaaatgtgactccacctgagt

SEQ ID NO: 9122611 - DNA, 22 bp, Homo sapiens
tcataaaacacaccaggtagtt

SEQ ID NO: 9122612 - DNA, 22 bp, Homo sapiens
tcatccagcctcatcaggagct

SEQ ID NO: 9122613 - DNA, 22 bp, Homo sapiens
tcatccagaaaaatgtcttagc

SEQ ID NO: 9122614 - DNA, 21 bp, Homo sapiens
tcatccaggtcctgcttcttc

SEQ ID NO: 9122615 - DNA, 22 bp, Homo sapiens
tcatcaaaagccttctgggtta

SEQ ID NO: 9122616 - DNA, 22 bp, Homo sapiens
tcagcctcaggtgttcagattt

SEQ ID NO: 9122617 - DNA, 22 bp, Homo sapiens
tcagcttctccaagtgacatgg

SEQ ID NO: 9122618 - DNA, 23 bp, Homo sapiens
tcagcctcttaggacttctcacc

SEQ ID NO: 9122619 - DNA, 22 bp, Homo sapiens
tcagcttcaaatttggtgaagt

SEQ ID NO: 9122620 - DNA, 21 bp, Homo sapiens
tcagaggctgggggaatgccc

SEQ ID NO: 9122621 - DNA, 22 bp, Homo sapiens
tcagaggcttccttcctcggag

SEQ ID NO: 9122622 - DNA, 22 bp, Homo sapiens
tcagaggcttgaagcccaagcc

SEQ ID NO: 9122623 - DNA, 22 bp, Homo sapiens
tcagagtctaaatagaagaata

SEQ ID NO: 9122624 - DNA, 23 bp, Homo sapiens
tcagaacagttcttggtgcatag

SEQ ID NO: 9122625 - DNA, 20 bp, Homo sapiens
tcagaacagtagaggagcta

SEQ ID NO: 9122626 - DNA, 22 bp, Homo sapiens
tcaccgaggctggagtgcagtg

SEQ ID NO: 9122627 - DNA, 22 bp, Homo sapiens
tcacatcttggattacaatttt

SEQ ID NO: 9122628 - DNA, 20 bp, Homo sapiens
tcacatctggcagctgatga

SEQ ID NO: 9122629 - DNA, 22 bp, Homo sapiens
tcacatctgcctccatagcacc

SEQ ID NO: 9122630 - DNA, 22 bp, Homo sapiens
tcagagacctagcaagaaattg

SEQ ID NO: 9122631 - DNA, 22 bp, Homo sapiens
tcagaggccttggttatggtat

SEQ ID NO: 9122632 - DNA, 22 bp, Homo sapiens
tcagaggctacagtctgggagt

SEQ ID NO: 9122633 - DNA, 22 bp, Homo sapiens
tcagaggccaaactgagcaggg

SEQ ID NO: 9122634 - DNA, 22 bp, Homo sapiens
tcagaggcctatgtctacaact

SEQ ID NO: 9122635 - DNA, 22 bp, Homo sapiens
tcagaacattctcattgactgc

SEQ ID NO: 9122636 - DNA, 22 bp, Homo sapiens
tcagaacatgtttgagtaagac

SEQ ID NO: 9122637 - DNA, 22 bp, Homo sapiens
tcacatctaattccatttctgc

SEQ ID NO: 9122638 - DNA, 22 bp, Homo sapiens
tattttcattctgtgtgactgt

SEQ ID NO: 9122639 - DNA, 22 bp, Homo sapiens
tcacacacatttgctgtctgat

SEQ ID NO: 9122640 - DNA, 22 bp, Homo sapiens
tcccagcagagccagcaagccg

SEQ ID NO: 9122641 - DNA, 22 bp, Homo sapiens
tcccagcagggccgaccagcct

SEQ ID NO: 9122642 - DNA, 22 bp, Homo sapiens
tcccagaagtccagccatgggc

SEQ ID NO: 9122643 - DNA, 22 bp, Homo sapiens
tccagtgtggacccctgcagtc

SEQ ID NO: 9122644 - DNA, 20 bp, Homo sapiens
tccagtgtctctctggtgga

SEQ ID NO: 9122645 - DNA, 22 bp, Homo sapiens
tccagtgtggtcaaaggggaat

SEQ ID NO: 9122646 - DNA, 20 bp, Homo sapiens
tccagtgtggggactggggc

SEQ ID NO: 9122647 - DNA, 22 bp, Homo sapiens
tccagtgtggaggtgaccaact

SEQ ID NO: 9122648 - DNA, 22 bp, Homo sapiens
tccagtgttataatatgcgtct

SEQ ID NO: 9122649 - DNA, 22 bp, Homo sapiens
tccagtgtgtgtccagctgctg

SEQ ID NO: 9122650 - DNA, 22 bp, Homo sapiens
tcatgttattgactcataatat

SEQ ID NO: 9122651 - DNA, 20 bp, Homo sapiens
tcatggctgctgagaggttc

SEQ ID NO: 9122652 - DNA, 22 bp, Homo sapiens
tccacgtttccccgagtccatc

SEQ ID NO: 9122653 - DNA, 22 bp, Homo sapiens
tccaccatgtaacaagctctgt

SEQ ID NO: 9122654 - DNA, 22 bp, Homo sapiens
tccaccaagccggggccacttc

SEQ ID NO: 9122655 - DNA, 19 bp, Homo sapiens
tcccttcctgtcgggctcc

SEQ ID NO: 9122656 - DNA, 21 bp, Homo sapiens
tcccttgggaaactttcttga

SEQ ID NO: 9122657 - DNA, 22 bp, Homo sapiens
tcccttggaaagtagcctcaca

SEQ ID NO: 9122658 - DNA, 23 bp, Homo sapiens
tccctgtgtacagcctgcatgag

SEQ ID NO: 9122659 - DNA, 19 bp, Homo sapiens
tccctgagttccagcccag

SEQ ID NO: 9122660 - DNA, 21 bp, Homo sapiens
tccctgagttctctgagcatc

SEQ ID NO: 9122661 - DNA, 22 bp, Homo sapiens
tcctccctaaatcctagactgt

SEQ ID NO: 9122662 - DNA, 22 bp, Homo sapiens
tcctccctaactcatgatgagt

SEQ ID NO: 9122663 - DNA, 23 bp, Homo sapiens
tcctccctgacttctacagcaca

SEQ ID NO: 9122664 - DNA, 22 bp, Homo sapiens
tcctccctgagtggggacagct

SEQ ID NO: 9122665 - DNA, 21 bp, Homo sapiens
tcctccctgagctgtggggga

SEQ ID NO: 9122666 - DNA, 21 bp, Homo sapiens
tcctccctgagctgtggggga

SEQ ID NO: 9122667 - DNA, 22 bp, Homo sapiens
tcctcccttctcactgggaagg

SEQ ID NO: 9122668 - DNA, 22 bp, Homo sapiens
tcctccctgtaccattcctctg

SEQ ID NO: 9122669 - DNA, 22 bp, Homo sapiens
tcctccctgggagcttctgagt

SEQ ID NO: 9122670 - DNA, 22 bp, Homo sapiens
tcctccctgcactcagtgaagt

SEQ ID NO: 9122671 - DNA, 22 bp, Homo sapiens
tcctcccctgcccatgaggagg

SEQ ID NO: 9122672 - DNA, 19 bp, Homo sapiens
tcctccctttggtgtcctg

SEQ ID NO: 9122673 - DNA, 19 bp, Homo sapiens
tcctccctttggtgtcctg

SEQ ID NO: 9122674 - DNA, 22 bp, Homo sapiens
tcctcccttggggtttcgttat

SEQ ID NO: 9122675 - DNA, 22 bp, Homo sapiens
tcctcccttgactcctgctttt

SEQ ID NO: 9122676 - DNA, 21 bp, Homo sapiens
tcctcctccactaggctagcc

SEQ ID NO: 9122677 - DNA, 22 bp, Homo sapiens
tcctcctcctcacagtcacctg

SEQ ID NO: 9122678 - DNA, 22 bp, Homo sapiens
tccgggaggcagaggttgcagt

SEQ ID NO: 9122679 - DNA, 22 bp, Homo sapiens
tccgaacactcaggaagccaga

SEQ ID NO: 9122680 - DNA, 22 bp, Homo sapiens
tcctcatgccgggtctcacgct

SEQ ID NO: 9122681 - DNA, 22 bp, Homo sapiens
tacttcaaccttctctattaga

SEQ ID NO: 9122682 - DNA, 22 bp, Homo sapiens
tacttcattcctttgtaaaatg

SEQ ID NO: 9122683 - DNA, 22 bp, Homo sapiens
tacttcatgagttaatatgcag

SEQ ID NO: 9122684 - DNA, 22 bp, Homo sapiens
tacttcatacctgctagaatgg

SEQ ID NO: 9122685 - DNA, 22 bp, Homo sapiens
tacttcattattctagttttga

SEQ ID NO: 9122686 - DNA, 22 bp, Homo sapiens
tacatgtatgtttatcttgaga

SEQ ID NO: 9122687 - DNA, 22 bp, Homo sapiens
tacacattttgcgggtacatgt

SEQ ID NO: 9122688 - DNA, 22 bp, Homo sapiens
tacaccattttctgcagtgttt

SEQ ID NO: 9122689 - DNA, 22 bp, Homo sapiens
tacacatatgtccattaatcag

SEQ ID NO: 9122690 - DNA, 22 bp, Homo sapiens
tacacatatgtgtgtatatgtg

SEQ ID NO: 9122691 - DNA, 22 bp, Homo sapiens
tacacataggtctgaataaaaa

SEQ ID NO: 9122692 - DNA, 22 bp, Homo sapiens
taagtttaccactttcagaatt

SEQ ID NO: 9122693 - DNA, 22 bp, Homo sapiens
taagtttaccactttcagaatt

SEQ ID NO: 9122694 - DNA, 22 bp, Homo sapiens
taatttctaattcattttcagt

SEQ ID NO: 9122695 - DNA, 22 bp, Homo sapiens
gttttatttccatgagagaccg

SEQ ID NO: 9122696 - DNA, 22 bp, Homo sapiens
gttttattggaacacagccatg

SEQ ID NO: 9122697 - DNA, 21 bp, Homo sapiens
taaacataaccttgtatggct

SEQ ID NO: 9122698 - DNA, 22 bp, Homo sapiens
taacttctctgagcctcattcc

SEQ ID NO: 9122699 - DNA, 22 bp, Homo sapiens
taacttctggaaatgcatctgc

SEQ ID NO: 9122700 - DNA, 22 bp, Homo sapiens
taacttctgcacagaaaatttg

SEQ ID NO: 9122701 - DNA, 16 bp, Homo sapiens
taacttcttccttcaa

SEQ ID NO: 9122702 - DNA, 22 bp, Homo sapiens
taagatggtccagaagggaggc

SEQ ID NO: 9122703 - DNA, 22 bp, Homo sapiens
taacacatggttagtacacaat

SEQ ID NO: 9122704 - DNA, 22 bp, Homo sapiens
gtttctgtaagactgaattgac

SEQ ID NO: 9122705 - DNA, 22 bp, Homo sapiens
gtttctgttgctcagataatgc

SEQ ID NO: 9122706 - DNA, 22 bp, Homo sapiens
gttccagacttgccagtggaag

SEQ ID NO: 9122707 - DNA, 22 bp, Homo sapiens
gttcattttactgtaaatagca

SEQ ID NO: 9122708 - DNA, 22 bp, Homo sapiens
gttcatttttccctaatgagta

SEQ ID NO: 9122709 - DNA, 22 bp, Homo sapiens
gttactcttccccggggtctgg

SEQ ID NO: 9122710 - DNA, 22 bp, Homo sapiens
tactttattgtaaatgctgatg

SEQ ID NO: 9122711 - DNA, 22 bp, Homo sapiens
tacttgtctcttctgacaaagt

SEQ ID NO: 9122712 - DNA, 22 bp, Homo sapiens
tagattttaggagattttactg

SEQ ID NO: 9122713 - DNA, 22 bp, Homo sapiens
tagattttacttctgtcattac

SEQ ID NO: 9122714 - DNA, 22 bp, Homo sapiens
taggtttcagaggtgccgggaa

SEQ ID NO: 9122715 - DNA, 22 bp, Homo sapiens
taggctctagatgtggtctttg

SEQ ID NO: 9122716 - DNA, 22 bp, Homo sapiens
tataccttccacaaaacagctt

SEQ ID NO: 9122717 - DNA, 22 bp, Homo sapiens
tatcttcagcacagatcctgtg

SEQ ID NO: 9122718 - DNA, 22 bp, Homo sapiens
tatctttctgtcctagattctg

SEQ ID NO: 9122719 - DNA, 22 bp, Homo sapiens
tatttccagcagtaagaagaca

SEQ ID NO: 9122720 - DNA, 22 bp, Homo sapiens
tattttcaccttctctggatat

SEQ ID NO: 9122721 - DNA, 22 bp, Homo sapiens
tattgcaagcaattccaaaagg

SEQ ID NO: 9122722 - DNA, 22 bp, Homo sapiens
tattgcatattgtacttgaatg

SEQ ID NO: 9122723 - DNA, 21 bp, Homo sapiens
ttcttcatgatgattaatggc

SEQ ID NO: 9122724 - DNA, 22 bp, Homo sapiens
ttcttcatctgtaagataagca

SEQ ID NO: 9122725 - DNA, 22 bp, Homo sapiens
ttgaaatatcaagttattagtg

SEQ ID NO: 9122726 - DNA, 22 bp, Homo sapiens
ttcttaaagaggcaaaacacag

SEQ ID NO: 9122727 - DNA, 22 bp, Homo sapiens
ttctgaaataggagatagctgt

SEQ ID NO: 9122728 - DNA, 22 bp, Homo sapiens
ttctgaaaattgggtcatactt

SEQ ID NO: 9122729 - DNA, 23 bp, Homo sapiens
ttctgaaaatagatagtggctcc

SEQ ID NO: 9122730 - DNA, 22 bp, Homo sapiens
ttgcaaagaattttacattcta

SEQ ID NO: 9122731 - DNA, 22 bp, Homo sapiens
ctcagcatggagggagaacaag

SEQ ID NO: 9122732 - DNA, 22 bp, Homo sapiens
ctcagcattcaatgtccagtcc

SEQ ID NO: 9122733 - DNA, 22 bp, Homo sapiens
ttgctgggctcttcaacacaca

SEQ ID NO: 9122734 - DNA, 22 bp, Homo sapiens
ttgcaccaaatgagttaaaatt

SEQ ID NO: 9122735 - DNA, 22 bp, Homo sapiens
ttctcagtagttagcatttgtg

SEQ ID NO: 9122736 - DNA, 22 bp, Homo sapiens
ctaaatgtcatggagttgtaga

SEQ ID NO: 9122737 - DNA, 22 bp, Homo sapiens
ctaacttcccctctggcagaaa

SEQ ID NO: 9122738 - DNA, 22 bp, Homo sapiens
cgtcccctcgttcccactttgg

SEQ ID NO: 9122739 - DNA, 20 bp, Homo sapiens
cgtccccttgagcaggtccc

SEQ ID NO: 9122740 - DNA, 19 bp, Homo sapiens
ttccaccatcactctgttt

SEQ ID NO: 9122741 - DNA, 22 bp, Homo sapiens
ttccaaattaaaatgtacaatg

SEQ ID NO: 9122742 - DNA, 22 bp, Homo sapiens
tgttttctattacctgagattg

SEQ ID NO: 9122743 - DNA, 22 bp, Homo sapiens
tgttttctagaaacaatgccta

SEQ ID NO: 9122744 - DNA, 22 bp, Homo sapiens
ttacaataccacatcacctcat

SEQ ID NO: 9122745 - DNA, 22 bp, Homo sapiens
ttacaatagttccttcttttgt

SEQ ID NO: 9122746 - DNA, 18 bp, Homo sapiens
cctgtggctcagcccaca

SEQ ID NO: 9122747 - DNA, 22 bp, Homo sapiens
cctgtggctctctttggaggtc

SEQ ID NO: 9122748 - DNA, 20 bp, Homo sapiens
cctgtggctcttgtaattca

SEQ ID NO: 9122749 - DNA, 22 bp, Homo sapiens
cctgtggctgccacttgggtga

SEQ ID NO: 9122750 - DNA, 22 bp, Homo sapiens
cctgtggcgggggccagtgcct

SEQ ID NO: 9122751 - DNA, 22 bp, Homo sapiens
cctgtggcgggggccagtgcct

SEQ ID NO: 9122752 - DNA, 22 bp, Homo sapiens
cctgtggcctgaatttggtaaa

SEQ ID NO: 9122753 - DNA, 22 bp, Homo sapiens
cctgtggctgccccgctgttgg

SEQ ID NO: 9122754 - DNA, 22 bp, Homo sapiens
cctgtggctggtagtatcgttt

SEQ ID NO: 9122755 - DNA, 23 bp, Homo sapiens
cctgtggcaagtagatgagatga

SEQ ID NO: 9122756 - DNA, 19 bp, Homo sapiens
cctgtggcagagtggaaac

SEQ ID NO: 9122757 - DNA, 22 bp, Homo sapiens
cctgtggccgcgtcgggcggcg

SEQ ID NO: 9122758 - DNA, 22 bp, Homo sapiens
cctgtggcacatgcagggattc

SEQ ID NO: 9122759 - DNA, 21 bp, Homo sapiens
tgttttctaaagggcggatca

SEQ ID NO: 9122760 - DNA, 22 bp, Homo sapiens
tgttttcatggttatgtgtcta

SEQ ID NO: 9122761 - DNA, 22 bp, Homo sapiens
tgtttctatctggatcaataga

SEQ ID NO: 9122762 - DNA, 22 bp, Homo sapiens
ttattattgtggttgcattatc

SEQ ID NO: 9122763 - DNA, 20 bp, Homo sapiens
cctttctggagtgctgttca

SEQ ID NO: 9122764 - DNA, 22 bp, Homo sapiens
ccttggtccctccccagaccaa

SEQ ID NO: 9122765 - DNA, 22 bp, Homo sapiens
ccttgggaccctgctggaggtt

SEQ ID NO: 9122766 - DNA, 22 bp, Homo sapiens
ccttgggacagccagcttcaga

SEQ ID NO: 9122767 - DNA, 21 bp, Homo sapiens
ccttctccacagggtctccgg

SEQ ID NO: 9122768 - DNA, 20 bp, Homo sapiens
ttacagaaatgatgttattt

SEQ ID NO: 9122769 - DNA, 22 bp, Homo sapiens
tttctgttgttggtgtctggct

SEQ ID NO: 9122770 - DNA, 22 bp, Homo sapiens
tttctgttgtacttaaactagg

SEQ ID NO: 9122771 - DNA, 22 bp, Homo sapiens
tttctgttgtatggcttctgca

SEQ ID NO: 9122772 - DNA, 20 bp, Homo sapiens
tttctcagaacagtggctgc

SEQ ID NO: 9122773 - DNA, 19 bp, Homo sapiens
ctctagggtctaagggcag

SEQ ID NO: 9122774 - DNA, 22 bp, Homo sapiens
ctctaggggctggtcagcgtct

SEQ ID NO: 9122775 - DNA, 22 bp, Homo sapiens
ctctagggctctgtgaggttgg

SEQ ID NO: 9122776 - DNA, 22 bp, Homo sapiens
ctctaggggctggtcagcgtct

SEQ ID NO: 9122777 - DNA, 22 bp, Homo sapiens
ctctagggaagaatgagagccc

SEQ ID NO: 9122778 - DNA, 22 bp, Homo sapiens
ctctagctgaggtcactgctat

SEQ ID NO: 9122779 - DNA, 22 bp, Homo sapiens
tttctctccccaagtggaattg

SEQ ID NO: 9122780 - DNA, 21 bp, Homo sapiens
ctctggagtcaagagcttcca

SEQ ID NO: 9122781 - DNA, 19 bp, Homo sapiens
ctctgcctctggctgtggc

SEQ ID NO: 9122782 - DNA, 19 bp, Homo sapiens
tttctgtttgcttctggtt

SEQ ID NO: 9122783 - DNA, 22 bp, Homo sapiens
ctcgggttgtaagtatctatta

SEQ ID NO: 9122784 - DNA, 22 bp, Homo sapiens
tttcaaataccataaacctaat

SEQ ID NO: 9122785 - DNA, 22 bp, Homo sapiens
tttcaaatgcatgtctttcctc

SEQ ID NO: 9122786 - DNA, 22 bp, Homo sapiens
tttcaaatagaatctttccaaa

SEQ ID NO: 9122787 - DNA, 22 bp, Homo sapiens
tttcaaagtcaatatcattacc

SEQ ID NO: 9122788 - DNA, 22 bp, Homo sapiens
tttcaaagtggagaattagaca

SEQ ID NO: 9122789 - DNA, 22 bp, Homo sapiens
ctcctgagctctgaggaagctt

SEQ ID NO: 9122790 - DNA, 22 bp, Homo sapiens
tttacacataaatgtgtagaca

SEQ ID NO: 9122791 - DNA, 22 bp, Homo sapiens
tttacaattggttttctctaat

SEQ ID NO: 9122792 - DNA, 22 bp, Homo sapiens
ctcaggctcatatcccatcagc

SEQ ID NO: 9122793 - DNA, 22 bp, Homo sapiens
ctcaggctctggccatccaagg

SEQ ID NO: 9122794 - DNA, 22 bp, Homo sapiens
ctcaggctgccctgacagcccc

SEQ ID NO: 9122795 - DNA, 22 bp, Homo sapiens
ctccccaccttcgcggtccctg

SEQ ID NO: 9122796 - DNA, 22 bp, Homo sapiens
ctccccacatttctccctgtct

SEQ ID NO: 9122797 - DNA, 22 bp, Homo sapiens
ttgtttcaaggaagaattagga

SEQ ID NO: 9122798 - DNA, 22 bp, Homo sapiens
ttgtttcagcccagatctttac

SEQ ID NO: 9122799 - DNA, 22 bp, Homo sapiens
ctccctggaggcccagacctgg

SEQ ID NO: 9122800 - DNA, 22 bp, Homo sapiens
ctccctctgtcttgtccagaaa

SEQ ID NO: 9122801 - DNA, 22 bp, Homo sapiens
ctccctcacacccttgcccaga

SEQ ID NO: 9122802 - DNA, 22 bp, Homo sapiens
ctgcctctgttgggcatggtct

SEQ ID NO: 9122803 - DNA, 17 bp, Homo sapiens
ctgctggctggggcttg

SEQ ID NO: 9122804 - DNA, 22 bp, Homo sapiens
ctgctgccggcgagcctccctt

SEQ ID NO: 9122805 - DNA, 22 bp, Homo sapiens
ctgctgccctagacccagtcct

SEQ ID NO: 9122806 - DNA, 22 bp, Homo sapiens
ctgcagtctgacatacgaggac

SEQ ID NO: 9122807 - DNA, 22 bp, Homo sapiens
ctgcagtctacctggattttta

SEQ ID NO: 9122808 - DNA, 22 bp, Homo sapiens
ctgcccctgctcatggctgtcc

SEQ ID NO: 9122809 - DNA, 22 bp, Homo sapiens
ctgcccctggtgatggacgcca

SEQ ID NO: 9122810 - DNA, 22 bp, Homo sapiens
ctgcccctggctggtgaagcag

SEQ ID NO: 9122811 - DNA, 22 bp, Homo sapiens
ctgcctctggttttggtccctg

SEQ ID NO: 9122812 - DNA, 22 bp, Homo sapiens
ctgcctctggcctcaggcccag

SEQ ID NO: 9122813 - DNA, 22 bp, Homo sapiens
ctgcctctataggagtccacca

SEQ ID NO: 9122814 - DNA, 22 bp, Homo sapiens
ttttcctctgttattagtgtga

SEQ ID NO: 9122815 - DNA, 22 bp, Homo sapiens
ttttcctctgtatttgaaatgc

SEQ ID NO: 9122816 - DNA, 21 bp, Homo sapiens
ttttctccagctgtgatttta

SEQ ID NO: 9122817 - DNA, 22 bp, Homo sapiens
ctgagctggtggaagcatgcag

SEQ ID NO: 9122818 - DNA, 22 bp, Homo sapiens
gaaggggaaagttgagcaaata

SEQ ID NO: 9122819 - DNA, 22 bp, Homo sapiens
gaagggtgtgatttgcctgaga

SEQ ID NO: 9122820 - DNA, 22 bp, Homo sapiens
gaagggtgcatggagggaagtc

SEQ ID NO: 9122821 - DNA, 22 bp, Homo sapiens
gaagggtgtgtgtgagggacac

SEQ ID NO: 9122822 - DNA, 22 bp, Homo sapiens
gaaagctctgcttcagcctgca

SEQ ID NO: 9122823 - DNA, 22 bp, Homo sapiens
gagaaactgaatatttaacggg

SEQ ID NO: 9122824 - DNA, 22 bp, Homo sapiens
gagagaaaggcttgcaggctgt

SEQ ID NO: 9122825 - DNA, 22 bp, Homo sapiens
gactccagtgattgtcctgtct

SEQ ID NO: 9122826 - DNA, 22 bp, Homo sapiens
gacagcagacagaactacctgc

SEQ ID NO: 9122827 - DNA, 22 bp, Homo sapiens
gacagcagacagcctggcccct

SEQ ID NO: 9122828 - DNA, 22 bp, Homo sapiens
gacagcaagagacagagcatcc

SEQ ID NO: 9122829 - DNA, 21 bp, Homo sapiens
gacagcaactgtagtcctctt

SEQ ID NO: 9122830 - DNA, 22 bp, Homo sapiens
gacagcagatgaagcctgcaga

SEQ ID NO: 9122831 - DNA, 22 bp, Homo sapiens
gacattgaaaataatgtgtaga

SEQ ID NO: 9122832 - DNA, 22 bp, Homo sapiens
gaggagcacatgaggctgaggg

SEQ ID NO: 9122833 - DNA, 22 bp, Homo sapiens
gagggctgtgaaggagcgggtt

SEQ ID NO: 9122834 - DNA, 22 bp, Homo sapiens
gagggctgctggaaaaatgcag

SEQ ID NO: 9122835 - DNA, 22 bp, Homo sapiens
ctgggacatgatagaaacagat

SEQ ID NO: 9122836 - DNA, 22 bp, Homo sapiens
ctgggacatattgctagtgttg

SEQ ID NO: 9122837 - DNA, 23 bp, Homo sapiens
ctgggacatggtaggggcacaac

SEQ ID NO: 9122838 - DNA, 22 bp, Homo sapiens
ctgggacattataagaaacatt

SEQ ID NO: 9122839 - DNA, 22 bp, Homo sapiens
ctgggacatggtgctgtcttta

SEQ ID NO: 9122840 - DNA, 22 bp, Homo sapiens
ctgggacagctgagacaggaga

SEQ ID NO: 9122841 - DNA, 22 bp, Homo sapiens
ctgggacatagatcagcctttt

SEQ ID NO: 9122842 - DNA, 22 bp, Homo sapiens
ctgggacagttcaggtagggca

SEQ ID NO: 9122843 - DNA, 22 bp, Homo sapiens
ctgggagattgaggccatggtg

SEQ ID NO: 9122844 - DNA, 22 bp, Homo sapiens
ctgggagattcaggtgaagttt

SEQ ID NO: 9122845 - DNA, 22 bp, Homo sapiens
ctgggagaggtggtgggaagta

SEQ ID NO: 9122846 - DNA, 22 bp, Homo sapiens
ctgggagaggctgctccgctct

SEQ ID NO: 9122847 - DNA, 22 bp, Homo sapiens
ctgggactcagaccagttctgt

SEQ ID NO: 9122848 - DNA, 22 bp, Homo sapiens
ctgggacacccaaggaaagagc

SEQ ID NO: 9122849 - DNA, 22 bp, Homo sapiens
ctgggacacccagagctgcaga

SEQ ID NO: 9122850 - DNA, 22 bp, Homo sapiens
ctgggacacgttctattccaaa

SEQ ID NO: 9122851 - DNA, 22 bp, Homo sapiens
ctgggacacgttgtgctttaac

SEQ ID NO: 9122852 - DNA, 22 bp, Homo sapiens
ctgggacagagcagcagtgggg

SEQ ID NO: 9122853 - DNA, 22 bp, Homo sapiens
ctgtgccctgtggctggcacct

SEQ ID NO: 9122854 - DNA, 17 bp, Homo sapiens
ctgtgctcgagtgatgg

SEQ ID NO: 9122855 - DNA, 22 bp, Homo sapiens
ctgtctgaatcctaagcttcct

SEQ ID NO: 9122856 - DNA, 22 bp, Homo sapiens
cttaaaatctggcagttagcta

SEQ ID NO: 9122857 - DNA, 22 bp, Homo sapiens
cttaatttcaaactgctagtga

SEQ ID NO: 9122858 - DNA, 22 bp, Homo sapiens
cttctcagaggccagaagctat

SEQ ID NO: 9122859 - DNA, 22 bp, Homo sapiens
cttctaacatcctacaatgcaa

SEQ ID NO: 9122860 - DNA, 22 bp, Homo sapiens
cttaggcaagcagagcccatcc

SEQ ID NO: 9122861 - DNA, 18 bp, Homo sapiens
cttcatttgtagagttcc

SEQ ID NO: 9122862 - DNA, 22 bp, Homo sapiens
cttcatttcaggctgaagaata

SEQ ID NO: 9122863 - DNA, 22 bp, Homo sapiens
ctttgaaaacttaaataacagc

SEQ ID NO: 9122864 - DNA, 23 bp, Homo sapiens
cttgtgagtttgctagggctgcc

SEQ ID NO: 9122865 - DNA, 22 bp, Homo sapiens
cttttcttctcacggctgtcag

SEQ ID NO: 9122866 - DNA, 22 bp, Homo sapiens
cttttcttatgtggacgtacct

SEQ ID NO: 9122867 - DNA, 22 bp, Homo sapiens
cttttcttactcccgcaaggca

SEQ ID NO: 9122868 - DNA, 22 bp, Homo sapiens
gaaaatgtttcctgttatttgc

SEQ ID NO: 9122869 - DNA, 22 bp, Homo sapiens
gaaaatttaattctcttctgtg

SEQ ID NO: 9122870 - DNA, 22 bp, Homo sapiens
gaaaatttagaactgaacttct

SEQ ID NO: 9122871 - DNA, 22 bp, Homo sapiens
gaaaatttctgccacatgtgtg

SEQ ID NO: 9122872 - DNA, 23 bp, Homo sapiens
gaaagctctctcctcaggacctt

SEQ ID NO: 9122873 - DNA, 22 bp, Homo sapiens
gaaagcccattgacaaagaagt

SEQ ID NO: 9122874 - DNA, 17 bp, Homo sapiens
tgaagttaggctgcaga

SEQ ID NO: 9122875 - DNA, 19 bp, Homo sapiens
tgaaggtgtatgtgctggg

SEQ ID NO: 9122876 - DNA, 22 bp, Homo sapiens
ccaggcttctgattccaggcac

SEQ ID NO: 9122877 - DNA, 22 bp, Homo sapiens
ccaggcttcctaatgtgtgcag

SEQ ID NO: 9122878 - DNA, 22 bp, Homo sapiens
ccaggcttccctgagaggctgc

SEQ ID NO: 9122879 - DNA, 22 bp, Homo sapiens
tcttttcttgcattattgcact

SEQ ID NO: 9122880 - DNA, 22 bp, Homo sapiens
tcttaccagctgagaagagggt

SEQ ID NO: 9122881 - DNA, 20 bp, Homo sapiens
tctgttattgcatgtacata

SEQ ID NO: 9122882 - DNA, 22 bp, Homo sapiens
tctgtggctatcatactgaagg

SEQ ID NO: 9122883 - DNA, 18 bp, Homo sapiens
cccagaggaatgcctgga

SEQ ID NO: 9122884 - DNA, 19 bp, Homo sapiens
cccagaggaatgcctggaa

SEQ ID NO: 9122885 - DNA, 22 bp, Homo sapiens
cccaagggtgcccagcagagga

SEQ ID NO: 9122886 - DNA, 22 bp, Homo sapiens
cccaagggagtgcctggtcaac

SEQ ID NO: 9122887 - DNA, 22 bp, Homo sapiens
cccagaggaggcaaagctctgt

SEQ ID NO: 9122888 - DNA, 22 bp, Homo sapiens
cccagaggggtcgtctgagggg

SEQ ID NO: 9122889 - DNA, 22 bp, Homo sapiens
tgagtccaccttagtatatggg

SEQ ID NO: 9122890 - DNA, 20 bp, Homo sapiens
tgagtccagattttgcttta

SEQ ID NO: 9122891 - DNA, 22 bp, Homo sapiens
tgagtccaggtgcttacctgga

SEQ ID NO: 9122892 - DNA, 22 bp, Homo sapiens
tgagtccaggtgcttacctgga

SEQ ID NO: 9122893 - DNA, 22 bp, Homo sapiens
tgagtccaacttccatttgacc

SEQ ID NO: 9122894 - DNA, 22 bp, Homo sapiens
tgagtccaaatcccttctctga

SEQ ID NO: 9122895 - DNA, 22 bp, Homo sapiens
tgagtccaaattctaccacctc

SEQ ID NO: 9122896 - DNA, 22 bp, Homo sapiens
tgagtccattctgttttcctgg

SEQ ID NO: 9122897 - DNA, 22 bp, Homo sapiens
tgagtccatagtggatccttca

SEQ ID NO: 9122898 - DNA, 23 bp, Homo sapiens
ccatcaggcctccgtgtccagcc

SEQ ID NO: 9122899 - DNA, 22 bp, Homo sapiens
tgagccagtggaagatggcagt

SEQ ID NO: 9122900 - DNA, 22 bp, Homo sapiens
ccagtgcctgtgggcatggtgc

SEQ ID NO: 9122901 - DNA, 17 bp, Homo sapiens
ccagtgcctgtggcaac

SEQ ID NO: 9122902 - DNA, 22 bp, Homo sapiens
ccagtgcctatccttctcctgt

SEQ ID NO: 9122903 - DNA, 19 bp, Homo sapiens
ccagtgccggcgctgggga

SEQ ID NO: 9122904 - DNA, 18 bp, Homo sapiens
ccagtgccaagagtggca

SEQ ID NO: 9122905 - DNA, 22 bp, Homo sapiens
ccagtgcccagctgcccaggca

SEQ ID NO: 9122906 - DNA, 22 bp, Homo sapiens
cctgcagacacttgtccagcaa

SEQ ID NO: 9122907 - DNA, 22 bp, Homo sapiens
cctgcagaccacactcagtcct

SEQ ID NO: 9122908 - DNA, 22 bp, Homo sapiens
tgggctcatggcccagcactgg

SEQ ID NO: 9122909 - DNA, 22 bp, Homo sapiens
tgggctcatgtttctttgagga

SEQ ID NO: 9122910 - DNA, 19 bp, Homo sapiens
tggtacaaaccaagagaga

SEQ ID NO: 9122911 - DNA, 23 bp, Homo sapiens
tggtaatagggagcagaaggtag

SEQ ID NO: 9122912 - DNA, 22 bp, Homo sapiens
tggtaatatatgccagataaaa

SEQ ID NO: 9122913 - DNA, 22 bp, Homo sapiens
cctgcctcatcaacttgtcgtg

SEQ ID NO: 9122914 - DNA, 21 bp, Homo sapiens
tggtacaccttgcctgtcaga

SEQ ID NO: 9122915 - DNA, 22 bp, Homo sapiens
cctgccctgtcactggctaggg

SEQ ID NO: 9122916 - DNA, 22 bp, Homo sapiens
cctcccacttcttgctgaggtc

SEQ ID NO: 9122917 - DNA, 22 bp, Homo sapiens
cctcctctggtgctgccaaccc

SEQ ID NO: 9122918 - DNA, 22 bp, Homo sapiens
cctcctggcttttcccattgaa

SEQ ID NO: 9122919 - DNA, 22 bp, Homo sapiens
cctcctgggacaggctggcaca

SEQ ID NO: 9122920 - DNA, 22 bp, Homo sapiens
cctcccaccgtatctcagtggc

SEQ ID NO: 9122921 - DNA, 22 bp, Homo sapiens
cctcccaccatttagagagagc

SEQ ID NO: 9122922 - DNA, 22 bp, Homo sapiens
tgggagagagaattcccagtgg

SEQ ID NO: 9122923 - DNA, 22 bp, Homo sapiens
tggcttggtcctggcccttccc

SEQ ID NO: 9122924 - DNA, 22 bp, Homo sapiens
tggcttggtgagcagagtgtag

SEQ ID NO: 9122925 - DNA, 16 bp, Homo sapiens
tggcttgggtttcatg

SEQ ID NO: 9122926 - DNA, 22 bp, Homo sapiens
tggcttggtaaggaccagcagg

SEQ ID NO: 9122927 - DNA, 22 bp, Homo sapiens
tggcttgggtgtctcagctctt

SEQ ID NO: 9122928 - DNA, 22 bp, Homo sapiens
tggcttgggagattctcgaact

SEQ ID NO: 9122929 - DNA, 19 bp, Homo sapiens
tggcttggctgcagatgct

SEQ ID NO: 9122930 - DNA, 22 bp, Homo sapiens
tggcttggctaagatctaagct

SEQ ID NO: 9122931 - DNA, 22 bp, Homo sapiens
tggcttggactaaatggaccgt

SEQ ID NO: 9122932 - DNA, 22 bp, Homo sapiens
cctctcccgggtgccgctgggc

SEQ ID NO: 9122933 - DNA, 22 bp, Homo sapiens
tgggacacggaggccccagcac

SEQ ID NO: 9122934 - DNA, 22 bp, Homo sapiens
cctctcccaggcgcggcggcag

SEQ ID NO: 9122935 - DNA, 22 bp, Homo sapiens
cctctcccacgtggcagaggct

SEQ ID NO: 9122936 - DNA, 22 bp, Homo sapiens
cccagtgtgcccctcctgcagc

SEQ ID NO: 9122937 - DNA, 22 bp, Homo sapiens
ccctccccacaaagcttcacac

SEQ ID NO: 9122938 - DNA, 22 bp, Homo sapiens
ccctccccagggtcatattgaa

SEQ ID NO: 9122939 - DNA, 22 bp, Homo sapiens
ccctcccggcgtgctgggctcg

SEQ ID NO: 9122940 - DNA, 22 bp, Homo sapiens
ccctccctctgctgggtgtaga

SEQ ID NO: 9122941 - DNA, 22 bp, Homo sapiens
ccctccctatgtagatgatgtt

SEQ ID NO: 9122942 - DNA, 22 bp, Homo sapiens
tgctgcctttctgaatggtgga

SEQ ID NO: 9122943 - DNA, 22 bp, Homo sapiens
tggaggccaaggcaggcggatc

SEQ ID NO: 9122944 - DNA, 22 bp, Homo sapiens
tggaggcataggcctgggccct

SEQ ID NO: 9122945 - DNA, 22 bp, Homo sapiens
ccctcctcaactctggcttcca

SEQ ID NO: 9122946 - DNA, 22 bp, Homo sapiens
ccctccctttgcagcagtgcat

SEQ ID NO: 9122947 - DNA, 22 bp, Homo sapiens
ccctccctttgtctttatgaac

SEQ ID NO: 9122948 - DNA, 22 bp, Homo sapiens
ccctccctgaagaagttactct

SEQ ID NO: 9122949 - DNA, 22 bp, Homo sapiens
ccctcccttccaagttgaggac

SEQ ID NO: 9122950 - DNA, 22 bp, Homo sapiens
ccctccctgtgtgcctcatttg

SEQ ID NO: 9122951 - DNA, 22 bp, Homo sapiens
tggagaattctatgttgagggg

SEQ ID NO: 9122952 - DNA, 22 bp, Homo sapiens
ccctggcttggcactctccact

SEQ ID NO: 9122953 - DNA, 22 bp, Homo sapiens
cccttgggcttcagccctaccg

SEQ ID NO: 9122954 - DNA, 22 bp, Homo sapiens
ccctggctgctaccaggtagct

SEQ ID NO: 9122955 - DNA, 22 bp, Homo sapiens
tatattcatattgttgtctctc

SEQ ID NO: 9122956 - DNA, 22 bp, Homo sapiens
tagtgtggtatcttctatggaa

SEQ ID NO: 9122957 - DNA, 22 bp, Homo sapiens
cagtactggctcattgtgctgt

SEQ ID NO: 9122958 - DNA, 22 bp, Homo sapiens
tatattctgattccatctgtgt

SEQ ID NO: 9122959 - DNA, 22 bp, Homo sapiens
tatattgtagctgatgacaaat

SEQ ID NO: 9122960 - DNA, 22 bp, Homo sapiens
tatgaacattttggtatatatg

SEQ ID NO: 9122961 - DNA, 22 bp, Homo sapiens
tcaaaactcattttggaagtaa

SEQ ID NO: 9122962 - DNA, 22 bp, Homo sapiens
tcaaagcacacttagtggtaga

SEQ ID NO: 9122963 - DNA, 22 bp, Homo sapiens
tcaaagcactggggaaagcctg

SEQ ID NO: 9122964 - DNA, 22 bp, Homo sapiens
tcacacatttctcaagtgtagg

SEQ ID NO: 9122965 - DNA, 22 bp, Homo sapiens
tagcataacaggtaagagtgag

SEQ ID NO: 9122966 - DNA, 22 bp, Homo sapiens
tacagcattgcattttcctttg

SEQ ID NO: 9122967 - DNA, 23 bp, Homo sapiens
gtggagccacatcacaggctcct

SEQ ID NO: 9122968 - DNA, 22 bp, Homo sapiens
catcaggataagttccaggtgg

SEQ ID NO: 9122969 - DNA, 22 bp, Homo sapiens
catgcttcatgcaaaattctga

SEQ ID NO: 9122970 - DNA, 22 bp, Homo sapiens
tccagagtgacaaatgactgat

SEQ ID NO: 9122971 - DNA, 22 bp, Homo sapiens
tccaggctgggctgaagggtgc

SEQ ID NO: 9122972 - DNA, 22 bp, Homo sapiens
tccaggcttgagaccaggctct

SEQ ID NO: 9122973 - DNA, 22 bp, Homo sapiens
cattacaaacatgttaagattt

SEQ ID NO: 9122974 - DNA, 22 bp, Homo sapiens
cattacaaagttataaacagtt

SEQ ID NO: 9122975 - DNA, 22 bp, Homo sapiens
cattacaacaatctgccatggc

SEQ ID NO: 9122976 - DNA, 19 bp, Homo sapiens
cattacaaatttgtaggga

SEQ ID NO: 9122977 - DNA, 22 bp, Homo sapiens
cattacaaccccaaattacaaa

SEQ ID NO: 9122978 - DNA, 21 bp, Homo sapiens
cattacaagatttccaatttg

SEQ ID NO: 9122979 - DNA, 17 bp, Homo sapiens
ccagatgtgtaggtcgt

SEQ ID NO: 9122980 - DNA, 22 bp, Homo sapiens
ccagaggggctgagcaggtcac

SEQ ID NO: 9122981 - DNA, 22 bp, Homo sapiens
ccagagggcaaaatgaagctta

SEQ ID NO: 9122982 - DNA, 22 bp, Homo sapiens
tctcaggaaaaatccctagctt

SEQ ID NO: 9122983 - DNA, 22 bp, Homo sapiens
tcctgtgtgtcagatgcacagt

SEQ ID NO: 9122984 - DNA, 22 bp, Homo sapiens
tcctgtgtaaatagatctggtt

SEQ ID NO: 9122985 - DNA, 19 bp, Homo sapiens
ccacccctttgctgggccc

SEQ ID NO: 9122986 - DNA, 19 bp, Homo sapiens
tcctgttatggagcttagg

SEQ ID NO: 9122987 - DNA, 22 bp, Homo sapiens
tcctgttagtgttagacttccc

SEQ ID NO: 9122988 - DNA, 22 bp, Homo sapiens
tccagttttgaatcctgcttct

SEQ ID NO: 9122989 - DNA, 22 bp, Homo sapiens
tcctgagggactggttcctcgc

SEQ ID NO: 9122990 - DNA, 22 bp, Homo sapiens
tcctgagggactggttcctcgc

SEQ ID NO: 9122991 - DNA, 22 bp, Homo sapiens
ttctcacaattcttgtatttgc

SEQ ID NO: 9122992 - DNA, 22 bp, Homo sapiens
ttctcagaaaatgtagagaaaa

SEQ ID NO: 9122993 - DNA, 22 bp, Homo sapiens
ttccctcccccagcctggcagg

SEQ ID NO: 9122994 - DNA, 22 bp, Homo sapiens
ttccctccgaacctcagtgctg

SEQ ID NO: 9122995 - DNA, 22 bp, Homo sapiens
ttccctctccaggagccctgag

SEQ ID NO: 9122996 - DNA, 22 bp, Homo sapiens
ttccctgatggccccaaggata

SEQ ID NO: 9122997 - DNA, 22 bp, Homo sapiens
ttccctgagtctccctgagtct

SEQ ID NO: 9122998 - DNA, 22 bp, Homo sapiens
ttctgattgctgatgaggccca

SEQ ID NO: 9122999 - DNA, 22 bp, Homo sapiens
ttgaaagaggcaaagtttgatc

SEQ ID NO: 9123000 - DNA, 22 bp, Homo sapiens
ttctgggaacaaagtggagtgg

SEQ ID NO: 9123001 - DNA, 22 bp, Homo sapiens
ttctttctcactctttaggaag

SEQ ID NO: 9123002 - DNA, 22 bp, Homo sapiens
ttctttcttctcaggctgggta

SEQ ID NO: 9123003 - DNA, 22 bp, Homo sapiens
ttcaatcatttttacatagtcc

SEQ ID NO: 9123004 - DNA, 22 bp, Homo sapiens
ttcaagtagaaagtattgatga

SEQ ID NO: 9123005 - DNA, 22 bp, Homo sapiens
ttcaagtagctaaattagctgc

SEQ ID NO: 9123006 - DNA, 22 bp, Homo sapiens
ttcaagtatatttaacatcgta

SEQ ID NO: 9123007 - DNA, 22 bp, Homo sapiens
ttcaagtagtcacacatgatat

SEQ ID NO: 9123008 - DNA, 22 bp, Homo sapiens
ttccaaggcccagcagagagga

SEQ ID NO: 9123009 - DNA, 22 bp, Homo sapiens
ttccccagtagtgacaatcaaa

SEQ ID NO: 9123010 - DNA, 19 bp, Homo sapiens
ttcccctccccagggatag

SEQ ID NO: 9123011 - DNA, 22 bp, Homo sapiens
ttccccaggctggagtgcagtg

SEQ ID NO: 9123012 - DNA, 22 bp, Homo sapiens
ttcccagagaaggatgaaaaag

SEQ ID NO: 9123013 - DNA, 22 bp, Homo sapiens
ttcccagaggagatttgcttat

SEQ ID NO: 9123014 - DNA, 22 bp, Homo sapiens
tcctctccagcaaactggctat

SEQ ID NO: 9123015 - DNA, 22 bp, Homo sapiens
tcctctggctctttccctagga

SEQ ID NO: 9123016 - DNA, 22 bp, Homo sapiens
tcctctggatataagcctcacc

SEQ ID NO: 9123017 - DNA, 22 bp, Homo sapiens
ttcaaaagactcagatgtagcg

SEQ ID NO: 9123018 - DNA, 22 bp, Homo sapiens
ttgtgcccgggcccgggcctct

SEQ ID NO: 9123019 - DNA, 22 bp, Homo sapiens
ttgtatttcctataacctttct

SEQ ID NO: 9123020 - DNA, 22 bp, Homo sapiens
ttgttcatcgtccttgctctgt

SEQ ID NO: 9123021 - DNA, 22 bp, Homo sapiens
ttggctcaaaacttagattcca

SEQ ID NO: 9123022 - DNA, 22 bp, Homo sapiens
ttggctcattaaagatgataat

SEQ ID NO: 9123023 - DNA, 22 bp, Homo sapiens
ttggctcagtgtgagggagatg

SEQ ID NO: 9123024 - DNA, 22 bp, Homo sapiens
ttgcctttcccatgtctaggag

SEQ ID NO: 9123025 - DNA, 22 bp, Homo sapiens
ttgcctttcccctctggaagca

SEQ ID NO: 9123026 - DNA, 22 bp, Homo sapiens
tttcaagtcattctataatatc

SEQ ID NO: 9123027 - DNA, 20 bp, Homo sapiens
tttcaagtcggtagagtcta

SEQ ID NO: 9123028 - DNA, 22 bp, Homo sapiens
tttcaagtcattctataatatc

SEQ ID NO: 9123029 - DNA, 22 bp, Homo sapiens
tttcaagtactgtaaacatgct

SEQ ID NO: 9123030 - DNA, 22 bp, Homo sapiens
tttcaagtagagggatcgctag

SEQ ID NO: 9123031 - DNA, 22 bp, Homo sapiens
tttcaagttgttgcattaaatg

SEQ ID NO: 9123032 - DNA, 22 bp, Homo sapiens
tttcaagtgtcctgattaatgg

SEQ ID NO: 9123033 - DNA, 22 bp, Homo sapiens
tttcaagttcccagttttgtgg

SEQ ID NO: 9123034 - DNA, 22 bp, Homo sapiens
tttcacaactgcttatttgaga

SEQ ID NO: 9123035 - DNA, 22 bp, Homo sapiens
tttcacattagatatgtcattt

SEQ ID NO: 9123036 - DNA, 23 bp, Homo sapiens
tttcacatttactgttagatggc

SEQ ID NO: 9123037 - DNA, 22 bp, Homo sapiens
tttcataacctcaagctacagt

SEQ ID NO: 9123038 - DNA, 22 bp, Homo sapiens
tttcataatactgtacatgaaa

SEQ ID NO: 9123039 - DNA, 22 bp, Homo sapiens
tttacacattattttcagtgtg

SEQ ID NO: 9123040 - DNA, 22 bp, Homo sapiens
ttttggtttcccttcttatggt

SEQ ID NO: 9123041 - DNA, 22 bp, Homo sapiens
ttttggttctgggatacagaga

SEQ ID NO: 9123042 - DNA, 22 bp, Homo sapiens
ttttggttgttgggtaagagta

SEQ ID NO: 9123043 - DNA, 22 bp, Homo sapiens
tttttgtctagcgtctctagtt

SEQ ID NO: 9123044 - DNA, 22 bp, Homo sapiens
ttttattgggagtcctctactg

SEQ ID NO: 9123045 - DNA, 22 bp, Homo sapiens
ttttattggtaatgataaaagt

SEQ ID NO: 9123046 - DNA, 22 bp, Homo sapiens
ttttattgtcaatgaagacaga

SEQ ID NO: 9123047 - DNA, 22 bp, Homo sapiens
ttttattgtctcccagttctgg

SEQ ID NO: 9123048 - DNA, 16 bp, Homo sapiens
ttttattgtgacagcc

SEQ ID NO: 9123049 - DNA, 22 bp, Homo sapiens
ttttattgtctgtattgcctat

SEQ ID NO: 9123050 - DNA, 22 bp, Homo sapiens
tttgaaattggctcattggttt

SEQ ID NO: 9123051 - DNA, 22 bp, Homo sapiens
tttgaacatgctgcatgataat

SEQ ID NO: 9123052 - DNA, 22 bp, Homo sapiens
tttgaagactactgggagtgaa

SEQ ID NO: 9123053 - DNA, 22 bp, Homo sapiens
tttctagtaatcaatataaagt

SEQ ID NO: 9123054 - DNA, 22 bp, Homo sapiens
tttctagtcctcatgcatcatt

SEQ ID NO: 9123055 - DNA, 22 bp, Homo sapiens
tttctagtctcgatctcttaat

SEQ ID NO: 9123056 - DNA, 22 bp, Homo sapiens
tttgaaattaagatattgtcca

SEQ ID NO: 9123057 - DNA, 22 bp, Homo sapiens
tttgaaatgtatcagtataggt

SEQ ID NO: 9123058 - DNA, 22 bp, Homo sapiens
tttgaaatatgaggcattatga

SEQ ID NO: 9123059 - DNA, 22 bp, Homo sapiens
tttgtcatatagactattgtga

SEQ ID NO: 9123060 - DNA, 22 bp, Homo sapiens
ctgggacacagccttacctggg

SEQ ID NO: 9123061 - DNA, 22 bp, Homo sapiens
ctgggacaagctctgtctagct

SEQ ID NO: 9123062 - DNA, 19 bp, Homo sapiens
ctgggacaatgaaagcatc

SEQ ID NO: 9123063 - DNA, 22 bp, Homo sapiens
ctgggagagacacttctgatta

SEQ ID NO: 9123064 - DNA, 22 bp, Homo sapiens
ctgggactttaccctgtggccc

SEQ ID NO: 9123065 - DNA, 22 bp, Homo sapiens
atatgggggggcgtgcagagga

SEQ ID NO: 9123066 - DNA, 22 bp, Homo sapiens
atcatcatcattgctaacatct

SEQ ID NO: 9123067 - DNA, 22 bp, Homo sapiens
ctgggtcccaatagcttttgtt

SEQ ID NO: 9123068 - DNA, 22 bp, Homo sapiens
ctgggtcccaaattctattttc

SEQ ID NO: 9123069 - DNA, 22 bp, Homo sapiens
ctgggtcctgctctccctaaga

SEQ ID NO: 9123070 - DNA, 22 bp, Homo sapiens
ctgggtcctggtgctgagttct

SEQ ID NO: 9123071 - DNA, 22 bp, Homo sapiens
ctgggtcctggtgctgagttct

SEQ ID NO: 9123072 - DNA, 19 bp, Homo sapiens
ctgggtcctgttcttttac

SEQ ID NO: 9123073 - DNA, 22 bp, Homo sapiens
ctgggtcccctcagtgacactg

SEQ ID NO: 9123074 - DNA, 22 bp, Homo sapiens
ctgggtcctgcaaatattatta

SEQ ID NO: 9123075 - DNA, 22 bp, Homo sapiens
ctgggtcccggcttctatccac

SEQ ID NO: 9123076 - DNA, 22 bp, Homo sapiens
ctgggtcccacagcctgctggg

SEQ ID NO: 9123077 - DNA, 22 bp, Homo sapiens
ctgaggctggggaagggaagtg

SEQ ID NO: 9123078 - DNA, 22 bp, Homo sapiens
ataaatatcactgttgtccctc

SEQ ID NO: 9123079 - DNA, 22 bp, Homo sapiens
agtctcagcaagcatggctagt

SEQ ID NO: 9123080 - DNA, 23 bp, Homo sapiens
agtctcagctggaaacatgtgtc

SEQ ID NO: 9123081 - DNA, 19 bp, Homo sapiens
ctccagaatacatgttcct

SEQ ID NO: 9123082 - DNA, 23 bp, Homo sapiens
agtgacaatgggccagaggtggc

SEQ ID NO: 9123083 - DNA, 22 bp, Homo sapiens
agtgaattctaaatgctaaaga

SEQ ID NO: 9123084 - DNA, 20 bp, Homo sapiens
agtgaatttaaataatattc

SEQ ID NO: 9123085 - DNA, 22 bp, Homo sapiens
ctcagaggggatgcttggagaa

SEQ ID NO: 9123086 - DNA, 22 bp, Homo sapiens
ctcagagggtctcctccagaat

SEQ ID NO: 9123087 - DNA, 22 bp, Homo sapiens
ctcagaagctctgctcctttgc

SEQ ID NO: 9123088 - DNA, 22 bp, Homo sapiens
agtcccaacagcttacaaggaa

SEQ ID NO: 9123089 - DNA, 22 bp, Homo sapiens
cgggttttccacaggagtcttt

SEQ ID NO: 9123090 - DNA, 22 bp, Homo sapiens
ctctccccacaccctctgcatg

SEQ ID NO: 9123091 - DNA, 22 bp, Homo sapiens
ctctcccagtcaggctcaggat

SEQ ID NO: 9123092 - DNA, 23 bp, Homo sapiens
ctccttggtatgccatgcccagc

SEQ ID NO: 9123093 - DNA, 22 bp, Homo sapiens
ctcggagtggtgtttacagtaa

SEQ ID NO: 9123094 - DNA, 22 bp, Homo sapiens
agtggctgttccaggtgaggac

SEQ ID NO: 9123095 - DNA, 22 bp, Homo sapiens
agtggcttatctgggacagcta

SEQ ID NO: 9123096 - DNA, 22 bp, Homo sapiens
agtggcttgctctgcctcagcc

SEQ ID NO: 9123097 - DNA, 22 bp, Homo sapiens
ctctggacctcagctacagact

SEQ ID NO: 9123098 - DNA, 22 bp, Homo sapiens
ctctggagaacgctatggatct

SEQ ID NO: 9123099 - DNA, 19 bp, Homo sapiens
cctggctgctgtgggatgc

SEQ ID NO: 9123100 - DNA, 22 bp, Homo sapiens
cctggctggactggaccgtggc

SEQ ID NO: 9123101 - DNA, 22 bp, Homo sapiens
cctggctggcaagatcgtgaag

SEQ ID NO: 9123102 - DNA, 17 bp, Homo sapiens
cctggctgggaatctga

SEQ ID NO: 9123103 - DNA, 20 bp, Homo sapiens
cctggctggtggaggaaagg

SEQ ID NO: 9123104 - DNA, 21 bp, Homo sapiens
agggtcaggaaccagggtacc

SEQ ID NO: 9123105 - DNA, 22 bp, Homo sapiens
cctgccctgctcactgtcggta

SEQ ID NO: 9123106 - DNA, 22 bp, Homo sapiens
cctgcccagcttcccgagtgca

SEQ ID NO: 9123107 - DNA, 22 bp, Homo sapiens
cctctgccacctcccacgaggc

SEQ ID NO: 9123108 - DNA, 22 bp, Homo sapiens
cctgccctagagatgacacaat

SEQ ID NO: 9123109 - DNA, 22 bp, Homo sapiens
cctgcccagggtcaccacagag

SEQ ID NO: 9123110 - DNA, 22 bp, Homo sapiens
cctgcccctcaaggcctggtgc

SEQ ID NO: 9123111 - DNA, 22 bp, Homo sapiens
cctctctccaattttcacctca

SEQ ID NO: 9123112 - DNA, 22 bp, Homo sapiens
cctctctctcctgcacacacac

SEQ ID NO: 9123113 - DNA, 22 bp, Homo sapiens
aggtggctggtccaggctgcag

SEQ ID NO: 9123114 - DNA, 22 bp, Homo sapiens
aggtggctgtattcagctgtaa

SEQ ID NO: 9123115 - DNA, 17 bp, Homo sapiens
aggtggctgctgcgcct

SEQ ID NO: 9123116 - DNA, 22 bp, Homo sapiens
aggtgcccatgagctccatggc

SEQ ID NO: 9123117 - DNA, 23 bp, Homo sapiens
aggtgcccagaccccaccctctt

SEQ ID NO: 9123118 - DNA, 22 bp, Homo sapiens
aggtgccctgctgtgcccttct

SEQ ID NO: 9123119 - DNA, 22 bp, Homo sapiens
aggtggctctgacagctctggt

SEQ ID NO: 9123120 - DNA, 22 bp, Homo sapiens
ccttttatgaacttgagcaggt

SEQ ID NO: 9123121 - DNA, 22 bp, Homo sapiens
ccttttataaagttgtattgaa

SEQ ID NO: 9123122 - DNA, 22 bp, Homo sapiens
ccttttatactcagtgatatca

SEQ ID NO: 9123123 - DNA, 22 bp, Homo sapiens
ccttttatactctgtcctctgg

SEQ ID NO: 9123124 - DNA, 22 bp, Homo sapiens
ccttttatatggctcatcacag

SEQ ID NO: 9123125 - DNA, 22 bp, Homo sapiens
ccttttatagatcagtgtgtta

SEQ ID NO: 9123126 - DNA, 22 bp, Homo sapiens
agtatatttgttaagattattc

SEQ ID NO: 9123127 - DNA, 22 bp, Homo sapiens
catggccaggccaagagagtac

SEQ ID NO: 9123128 - DNA, 22 bp, Homo sapiens
catgaaatctgagtatgtttcc

SEQ ID NO: 9123129 - DNA, 22 bp, Homo sapiens
cagtcctctgcaacaccccttc

SEQ ID NO: 9123130 - DNA, 18 bp, Homo sapiens
aggagaaagggaccaggg

SEQ ID NO: 9123131 - DNA, 20 bp, Homo sapiens
aggaggcaatgtagataagc

SEQ ID NO: 9123132 - DNA, 22 bp, Homo sapiens
agctctctgataaattgataaa

SEQ ID NO: 9123133 - DNA, 22 bp, Homo sapiens
cagctctcacaccctcctccca

SEQ ID NO: 9123134 - DNA, 22 bp, Homo sapiens
aggaaagcaatggctgagaaca

SEQ ID NO: 9123135 - DNA, 21 bp, Homo sapiens
caggccccaggcctggggtgc

SEQ ID NO: 9123136 - DNA, 22 bp, Homo sapiens
agctgtggccagatgtgagcgg

SEQ ID NO: 9123137 - DNA, 22 bp, Homo sapiens
aggcctcctggctccaggcctt

SEQ ID NO: 9123138 - DNA, 22 bp, Homo sapiens
aggcctccagccacatgccagt

SEQ ID NO: 9123139 - DNA, 22 bp, Homo sapiens
aggctgagcctgggcgtggtgg

SEQ ID NO: 9123140 - DNA, 22 bp, Homo sapiens
ccactggcaaccccgcctcata

SEQ ID NO: 9123141 - DNA, 22 bp, Homo sapiens
ccactggagactggtctctgtg

SEQ ID NO: 9123142 - DNA, 22 bp, Homo sapiens
aggccagcttctaccctctgtt

SEQ ID NO: 9123143 - DNA, 22 bp, Homo sapiens
aggccagctgccacccggtccg

SEQ ID NO: 9123144 - DNA, 22 bp, Homo sapiens
aggccagctctacccttggact

SEQ ID NO: 9123145 - DNA, 22 bp, Homo sapiens
aggccagctcaccctggctcct

SEQ ID NO: 9123146 - DNA, 21 bp, Homo sapiens
cctccaggagcagagccctga

SEQ ID NO: 9123147 - DNA, 22 bp, Homo sapiens
cctcccatccctgcaagagagc

SEQ ID NO: 9123148 - DNA, 22 bp, Homo sapiens
cctccccacaggccaaataggc

SEQ ID NO: 9123149 - DNA, 22 bp, Homo sapiens
cctcccatggagctctgtccat

SEQ ID NO: 9123150 - DNA, 22 bp, Homo sapiens
cctccccacagcccaggagact

SEQ ID NO: 9123151 - DNA, 22 bp, Homo sapiens
cctctcggcagcccatcttgtc

SEQ ID NO: 9123152 - DNA, 22 bp, Homo sapiens
cctctccttgcacccgtcccgc

SEQ ID NO: 9123153 - DNA, 19 bp, Homo sapiens
ccctgggggtttctggtac

SEQ ID NO: 9123154 - DNA, 22 bp, Homo sapiens
agggcagctggaaggtggcttc

SEQ ID NO: 9123155 - DNA, 22 bp, Homo sapiens
agggcagctctcacctctggcc

SEQ ID NO: 9123156 - DNA, 22 bp, Homo sapiens
agggcagctaaggtgctgactg

SEQ ID NO: 9123157 - DNA, 22 bp, Homo sapiens
agggcagcctctcagcctaggt

SEQ ID NO: 9123158 - DNA, 22 bp, Homo sapiens
agggcagcccttctgggagggc

SEQ ID NO: 9123159 - DNA, 22 bp, Homo sapiens
agggcagccatgagccttcagg

SEQ ID NO: 9123160 - DNA, 22 bp, Homo sapiens
agggcagcagctcctcctagct

SEQ ID NO: 9123161 - DNA, 22 bp, Homo sapiens
aggctgtgtttaagtggtaatg

SEQ ID NO: 9123162 - DNA, 22 bp, Homo sapiens
aggctgtgttctggttcttagc

SEQ ID NO: 9123163 - DNA, 22 bp, Homo sapiens
aggctgtgtggtcatggtggct

SEQ ID NO: 9123164 - DNA, 22 bp, Homo sapiens
agggagccaggggccagctatt

SEQ ID NO: 9123165 - DNA, 19 bp, Homo sapiens
ccccagggtaggctagggg

SEQ ID NO: 9123166 - DNA, 22 bp, Homo sapiens
ccccatcccacctgagtgtcac

SEQ ID NO: 9123167 - DNA, 22 bp, Homo sapiens
aggcttagaaattcagctgagt

SEQ ID NO: 9123168 - DNA, 22 bp, Homo sapiens
aggcttagactacctggtctgt

SEQ ID NO: 9123169 - DNA, 22 bp, Homo sapiens
aggcttagaaagggtaagtgac

SEQ ID NO: 9123170 - DNA, 22 bp, Homo sapiens
agggaagtccatgggggcggtg

SEQ ID NO: 9123171 - DNA, 22 bp, Homo sapiens
agggaagtggtctgggaacttg

SEQ ID NO: 9123172 - DNA, 20 bp, Homo sapiens
agggaagtgcgccatcaggg

SEQ ID NO: 9123173 - DNA, 22 bp, Homo sapiens
agggaagtgaatgacagatatc

SEQ ID NO: 9123174 - DNA, 22 bp, Homo sapiens
agggaagtgatggagttcgatc

SEQ ID NO: 9123175 - DNA, 22 bp, Homo sapiens
agggaagtgataggacgtctct

SEQ ID NO: 9123176 - DNA, 22 bp, Homo sapiens
cagcatttggtgatcatcttaa

SEQ ID NO: 9123177 - DNA, 22 bp, Homo sapiens
cagcatttaatgcagtgcttcc

SEQ ID NO: 9123178 - DNA, 22 bp, Homo sapiens
cagcattctactttgtgaactg

SEQ ID NO: 9123179 - DNA, 22 bp, Homo sapiens
cagcattgagcacagaaggaaa

SEQ ID NO: 9123180 - DNA, 22 bp, Homo sapiens
cagccactgtggtctagctgca

SEQ ID NO: 9123181 - DNA, 22 bp, Homo sapiens
cagccacttcgagcttcctgat

SEQ ID NO: 9123182 - DNA, 22 bp, Homo sapiens
cagcccagcagactgttaccac

SEQ ID NO: 9123183 - DNA, 22 bp, Homo sapiens
gtaaaattgcaattacttttgc

SEQ ID NO: 9123184 - DNA, 22 bp, Homo sapiens
gtaaaattctagcatctgaaag

SEQ ID NO: 9123185 - DNA, 22 bp, Homo sapiens
cagcagcactctgcgggtcccc

SEQ ID NO: 9123186 - DNA, 22 bp, Homo sapiens
cagcagcctggcccctcctcgg

SEQ ID NO: 9123187 - DNA, 22 bp, Homo sapiens
cagcagcctagggttccatcat

SEQ ID NO: 9123188 - DNA, 22 bp, Homo sapiens
cagagcccagggcctacgtccc

SEQ ID NO: 9123189 - DNA, 22 bp, Homo sapiens
cagagccctagtcctgatggcc

SEQ ID NO: 9123190 - DNA, 22 bp, Homo sapiens
cagagccctcaaggccgatgca

SEQ ID NO: 9123191 - DNA, 22 bp, Homo sapiens
cagagccctccgctccccggct

SEQ ID NO: 9123192 - DNA, 22 bp, Homo sapiens
gggcgagggcgaaagcgagagc

SEQ ID NO: 9123193 - DNA, 22 bp, Homo sapiens
gggtgcctgagttagggcagaa

SEQ ID NO: 9123194 - DNA, 22 bp, Homo sapiens
cagaagggcagcactgggaagg

SEQ ID NO: 9123195 - DNA, 22 bp, Homo sapiens
cagaaggcatagatgaaggcct

SEQ ID NO: 9123196 - DNA, 21 bp, Homo sapiens
cagaagtaagggtaacttctc

SEQ ID NO: 9123197 - DNA, 22 bp, Homo sapiens
gggacactcaatgagacctgca

SEQ ID NO: 9123198 - DNA, 22 bp, Homo sapiens
cagacaggaattctggcgtggt

SEQ ID NO: 9123199 - DNA, 22 bp, Homo sapiens
gggagggtctgagagctgcacc

SEQ ID NO: 9123200 - DNA, 22 bp, Homo sapiens
caaagtatgaaccagtttctct

SEQ ID NO: 9123201 - DNA, 22 bp, Homo sapiens
gctgcagtgagccaagatcgtg

SEQ ID NO: 9123202 - DNA, 22 bp, Homo sapiens
caacattatatagccacatgcc

SEQ ID NO: 9123203 - DNA, 22 bp, Homo sapiens
cacaataaatgtttgctgatga

SEQ ID NO: 9123204 - DNA, 22 bp, Homo sapiens
cacaagggctttgtaggctttg

SEQ ID NO: 9123205 - DNA, 22 bp, Homo sapiens
cacaccctcgtgctccctcccg

SEQ ID NO: 9123206 - DNA, 23 bp, Homo sapiens
cacacccatcactaagagctcct

SEQ ID NO: 9123207 - DNA, 22 bp, Homo sapiens
cacaatttgtattttgcatcca

SEQ ID NO: 9123208 - DNA, 22 bp, Homo sapiens
gctgtggcctggcgcagagctg

SEQ ID NO: 9123209 - DNA, 22 bp, Homo sapiens
gctgtggccgtcagggaaatgg

SEQ ID NO: 9123210 - DNA, 22 bp, Homo sapiens
gctgtggccgggcccaggccgc

SEQ ID NO: 9123211 - DNA, 22 bp, Homo sapiens
gctgtggcccttggcatctgcg

SEQ ID NO: 9123212 - DNA, 22 bp, Homo sapiens
gctgtggcctccagcactcccc

SEQ ID NO: 9123213 - DNA, 22 bp, Homo sapiens
gctgtggcctagtttgttatat

SEQ ID NO: 9123214 - DNA, 20 bp, Homo sapiens
gctgtggccgtgccagactc

SEQ ID NO: 9123215 - DNA, 22 bp, Homo sapiens
gcttggctggaaataggttgag

SEQ ID NO: 9123216 - DNA, 22 bp, Homo sapiens
gcttggctcctggctcacaggt

SEQ ID NO: 9123217 - DNA, 22 bp, Homo sapiens
gcttggctgtgttcaagggcgg

SEQ ID NO: 9123218 - DNA, 22 bp, Homo sapiens
gcttggcttgggctcagaggcc

SEQ ID NO: 9123219 - DNA, 22 bp, Homo sapiens
gcttggctttactagggggaca

SEQ ID NO: 9123220 - DNA, 22 bp, Homo sapiens
gcttgggaaactggggaaacca

SEQ ID NO: 9123221 - DNA, 22 bp, Homo sapiens
gcttgggaaacgtagttcctag

SEQ ID NO: 9123222 - DNA, 22 bp, Homo sapiens
gcttgggacaggcttaggtgac

SEQ ID NO: 9123223 - DNA, 22 bp, Homo sapiens
gctgtggcaatgtttataatta

SEQ ID NO: 9123224 - DNA, 20 bp, Homo sapiens
gctgtggcaagtgctcactg

SEQ ID NO: 9123225 - DNA, 22 bp, Homo sapiens
gctgtggccaacaaaccacttt

SEQ ID NO: 9123226 - DNA, 20 bp, Homo sapiens
gctgtggcaaagctttgtgt

SEQ ID NO: 9123227 - DNA, 22 bp, Homo sapiens
cacagtgtgactgaccttcagc

SEQ ID NO: 9123228 - DNA, 22 bp, Homo sapiens
cacagcttagaaaagaagccat

SEQ ID NO: 9123229 - DNA, 22 bp, Homo sapiens
cacagcttctccttgatatcgc

SEQ ID NO: 9123230 - DNA, 22 bp, Homo sapiens
cacagcttcttccattccactc

SEQ ID NO: 9123231 - DNA, 22 bp, Homo sapiens
cactggaatgttgaggagacaa

SEQ ID NO: 9123232 - DNA, 22 bp, Homo sapiens
cactggaatagcattgattctt

SEQ ID NO: 9123233 - DNA, 21 bp, Homo sapiens
cactggaattttctgtgacat

SEQ ID NO: 9123234 - DNA, 22 bp, Homo sapiens
cactggaattcaagatactgag

SEQ ID NO: 9123235 - DNA, 22 bp, Homo sapiens
cactggaaccatccacatagtg

SEQ ID NO: 9123236 - DNA, 22 bp, Homo sapiens
cactggaaccaagacccagggc

SEQ ID NO: 9123237 - DNA, 18 bp, Homo sapiens
cactggaagattagggtc

SEQ ID NO: 9123238 - DNA, 22 bp, Homo sapiens
cactggaagagcatctgagcca

SEQ ID NO: 9123239 - DNA, 20 bp, Homo sapiens
cactggaaagcaggcgactc

SEQ ID NO: 9123240 - DNA, 22 bp, Homo sapiens
cactggaatatggcgttgaacc

SEQ ID NO: 9123241 - DNA, 22 bp, Homo sapiens
cactggaagttcattctcagaa

SEQ ID NO: 9123242 - DNA, 22 bp, Homo sapiens
cactggaatggatagagcagag

SEQ ID NO: 9123243 - DNA, 22 bp, Homo sapiens
cactggaatggattggccgtgg

SEQ ID NO: 9123244 - DNA, 22 bp, Homo sapiens
caccatcagcagcaggtgtcaa

SEQ ID NO: 9123245 - DNA, 22 bp, Homo sapiens
cacccacatggaaattcacagt

SEQ ID NO: 9123246 - DNA, 22 bp, Homo sapiens
caccccacatcaggcttctcca

SEQ ID NO: 9123247 - DNA, 18 bp, Homo sapiens
caccctccgcggctgccc

SEQ ID NO: 9123248 - DNA, 22 bp, Homo sapiens
caccctcccgtcagcccctggg

SEQ ID NO: 9123249 - DNA, 22 bp, Homo sapiens
attaaaattccaaggtatgcca

SEQ ID NO: 9123250 - DNA, 22 bp, Homo sapiens
attaattttacctttgtaaaca

SEQ ID NO: 9123251 - DNA, 22 bp, Homo sapiens
attagacatcatatgattcagc

SEQ ID NO: 9123252 - DNA, 22 bp, Homo sapiens
attcagtgacctaattacttac

SEQ ID NO: 9123253 - DNA, 22 bp, Homo sapiens
attctacacctctctcatttag

SEQ ID NO: 9123254 - DNA, 22 bp, Homo sapiens
gcgagcctctggagtcctctgg

SEQ ID NO: 9123255 - DNA, 22 bp, Homo sapiens
caaaactgtctagagagagaag

SEQ ID NO: 9123256 - DNA, 22 bp, Homo sapiens
caaaaaacacctgtgtgagtat

SEQ ID NO: 9123257 - DNA, 22 bp, Homo sapiens
atttctcagtgtacattatgtt

SEQ ID NO: 9123258 - DNA, 22 bp, Homo sapiens
gcctccccaaagtgctgacagc

SEQ ID NO: 9123259 - DNA, 22 bp, Homo sapiens
gcctccccaagcagcagggatt

SEQ ID NO: 9123260 - DNA, 22 bp, Homo sapiens
gcctctccgagccactgcctct

SEQ ID NO: 9123261 - DNA, 21 bp, Homo sapiens
gcctctccaaatcctgccttc

SEQ ID NO: 9123262 - DNA, 22 bp, Homo sapiens
atttcatgtgaagaagagataa

SEQ ID NO: 9123263 - DNA, 22 bp, Homo sapiens
atttattgagacttaacaaccc

SEQ ID NO: 9123264 - DNA, 22 bp, Homo sapiens
atttattgagagggaggggaat

SEQ ID NO: 9123265 - DNA, 22 bp, Homo sapiens
atttattggatgcttacttggg

SEQ ID NO: 9123266 - DNA, 22 bp, Homo sapiens
atttattgagcctttcctatgt

SEQ ID NO: 9123267 - DNA, 19 bp, Homo sapiens
gccaggagggctctggctg

SEQ ID NO: 9123268 - DNA, 22 bp, Homo sapiens
atttactactgctatctagaag

SEQ ID NO: 9123269 - DNA, 22 bp, Homo sapiens
atttaattaatcatggtgaatt

SEQ ID NO: 9123270 - DNA, 22 bp, Homo sapiens
atttaatttatagatgtggata

SEQ ID NO: 9123271 - DNA, 22 bp, Homo sapiens
cttggtctataggagagattgt

SEQ ID NO: 9123272 - DNA, 22 bp, Homo sapiens
cttggtctctttaccggagtgt

SEQ ID NO: 9123273 - DNA, 22 bp, Homo sapiens
cttggtctagtgagtgagcata

SEQ ID NO: 9123274 - DNA, 22 bp, Homo sapiens
cttggtcttgggagcagggaca

SEQ ID NO: 9123275 - DNA, 22 bp, Homo sapiens
cttgcctttgtcttcaaaggct

SEQ ID NO: 9123276 - DNA, 22 bp, Homo sapiens
atcttttactacaaatcaggtg

SEQ ID NO: 9123277 - DNA, 22 bp, Homo sapiens
atcttttatgagcgttctgaca

SEQ ID NO: 9123278 - DNA, 22 bp, Homo sapiens
atcttttacattactgcccaga

SEQ ID NO: 9123279 - DNA, 19 bp, Homo sapiens
cttttcaagccatcagttt

SEQ ID NO: 9123280 - DNA, 22 bp, Homo sapiens
cttttattttgaattaagggct

SEQ ID NO: 9123281 - DNA, 22 bp, Homo sapiens
gaggggagcccccatcctccag

SEQ ID NO: 9123282 - DNA, 22 bp, Homo sapiens
atgggttcaagtgattctcctg

SEQ ID NO: 9123283 - DNA, 22 bp, Homo sapiens
atggtaaattttaccttatgta

SEQ ID NO: 9123284 - DNA, 22 bp, Homo sapiens
atggtaaacatttaacaactag

SEQ ID NO: 9123285 - DNA, 22 bp, Homo sapiens
atggtaaaagatatactgtgca

SEQ ID NO: 9123286 - DNA, 22 bp, Homo sapiens
atggctggatttgatccatggg

SEQ ID NO: 9123287 - DNA, 22 bp, Homo sapiens
gaggccaggggagtcagcgtcc

SEQ ID NO: 9123288 - DNA, 22 bp, Homo sapiens
gaggccaggagtgctgtaagtt

SEQ ID NO: 9123289 - DNA, 22 bp, Homo sapiens
gacagcaaagcagagccaaggc

SEQ ID NO: 9123290 - DNA, 20 bp, Homo sapiens
atggaggaagggcaagagaa

SEQ ID NO: 9123291 - DNA, 22 bp, Homo sapiens
atggccatgccagtttacagcc

SEQ ID NO: 9123292 - DNA, 22 bp, Homo sapiens
cagaagctttgtctagtcttga

SEQ ID NO: 9123293 - DNA, 22 bp, Homo sapiens
agccaggcagactctctttctt

SEQ ID NO: 9123294 - DNA, 22 bp, Homo sapiens
cactgaaatattaatatcttat

SEQ ID NO: 9123295 - DNA, 21 bp, Homo sapiens
agccagtctgttttctagtgc

SEQ ID NO: 9123296 - DNA, 19 bp, Homo sapiens
agccagtccaagttctgtc

SEQ ID NO: 9123297 - DNA, 22 bp, Homo sapiens
agcccagccggattcccagttc

SEQ ID NO: 9123298 - DNA, 22 bp, Homo sapiens
agccctcatggaacagctccta

SEQ ID NO: 9123299 - DNA, 18 bp, Homo sapiens
agccctccaggtgattct

SEQ ID NO: 9123300 - DNA, 22 bp, Homo sapiens
agccctccatctgtgctcaggc

SEQ ID NO: 9123301 - DNA, 22 bp, Homo sapiens
agccctccaaaggttgggggag

SEQ ID NO: 9123302 - DNA, 22 bp, Homo sapiens
agccctcctcacatcagcgtcc

SEQ ID NO: 9123303 - DNA, 22 bp, Homo sapiens
cagcagcatgaattcgagccac

SEQ ID NO: 9123304 - DNA, 22 bp, Homo sapiens
agctcccagagtcctctgccca

SEQ ID NO: 9123305 - DNA, 19 bp, Homo sapiens
agctcctcacctctcgcgg

SEQ ID NO: 9123306 - DNA, 20 bp, Homo sapiens
agctcctctgcccattcttc

SEQ ID NO: 9123307 - DNA, 22 bp, Homo sapiens
agctcctctagatctgccactt

SEQ ID NO: 9123308 - DNA, 22 bp, Homo sapiens
agccttcggccagagggtggcc

SEQ ID NO: 9123309 - DNA, 22 bp, Homo sapiens
attttctgagcacgtgacagca

SEQ ID NO: 9123310 - DNA, 22 bp, Homo sapiens
attttctgagtccagaatttac

SEQ ID NO: 9123311 - DNA, 22 bp, Homo sapiens
attttctgtaaaaaggcactaa

SEQ ID NO: 9123312 - DNA, 22 bp, Homo sapiens
attttctggttgaggtttaaca

SEQ ID NO: 9123313 - DNA, 22 bp, Homo sapiens
caaatgttttttagtataagta

SEQ ID NO: 9123314 - DNA, 22 bp, Homo sapiens
caaatgttgactaagagggttt

SEQ ID NO: 9123315 - DNA, 22 bp, Homo sapiens
caaatgtttggtggcattttgt

SEQ ID NO: 9123316 - DNA, 22 bp, Homo sapiens
caaatgtttcttgaacaccaac

SEQ ID NO: 9123317 - DNA, 22 bp, Homo sapiens
caaatgtttgcatcacagggca

SEQ ID NO: 9123318 - DNA, 22 bp, Homo sapiens
caaatgtttttattctacaaca

SEQ ID NO: 9123319 - DNA, 22 bp, Homo sapiens
caaatgttaagacaggatcaag

SEQ ID NO: 9123320 - DNA, 22 bp, Homo sapiens
caaatgttagtgcccatccctc

SEQ ID NO: 9123321 - DNA, 22 bp, Homo sapiens
caaatgttattcattcttgttt

SEQ ID NO: 9123322 - DNA, 22 bp, Homo sapiens
caaatgtttcttatctattgtt

SEQ ID NO: 9123323 - DNA, 22 bp, Homo sapiens
caaatgttgctgtaatgtttgt

SEQ ID NO: 9123324 - DNA, 22 bp, Homo sapiens
caaatgttaaatgtgttaagac

SEQ ID NO: 9123325 - DNA, 22 bp, Homo sapiens
caatgaaaatttaagttgcagc

SEQ ID NO: 9123326 - DNA, 22 bp, Homo sapiens
agcagcacctgtcctcgctgct

SEQ ID NO: 9123327 - DNA, 22 bp, Homo sapiens
cacatctgggttctcttcttca

SEQ ID NO: 9123328 - DNA, 22 bp, Homo sapiens
caccagggcagcagcctagtct

SEQ ID NO: 9123329 - DNA, 22 bp, Homo sapiens
atttattgaacactgactatgt

SEQ ID NO: 9123330 - DNA, 22 bp, Homo sapiens
agagtggcttctttgacatgct

SEQ ID NO: 9123331 - DNA, 22 bp, Homo sapiens
attgttaataactattacattg

SEQ ID NO: 9123332 - DNA, 22 bp, Homo sapiens
atttaagattgcgtattcatgt

SEQ ID NO: 9123333 - DNA, 22 bp, Homo sapiens
attcttcattgttgattcatgt

SEQ ID NO: 9123334 - DNA, 22 bp, Homo sapiens
agatggtagactatggaacgta

SEQ ID NO: 9123335 - DNA, 22 bp, Homo sapiens
agcaaaataaggtaatttattg

SEQ ID NO: 9123336 - DNA, 22 bp, Homo sapiens
agagggatcaccctgtttctgg

SEQ ID NO: 9123337 - DNA, 22 bp, Homo sapiens
agagggtgctggagagacattg

SEQ ID NO: 9123338 - DNA, 22 bp, Homo sapiens
agagggtgagcaggtacacatg

SEQ ID NO: 9123339 - DNA, 22 bp, Homo sapiens
agagggtgaatgagatagaaaa

SEQ ID NO: 9123340 - DNA, 22 bp, Homo sapiens
atgtttgttgaacatctactgc

SEQ ID NO: 9123341 - DNA, 22 bp, Homo sapiens
atgtttgtccctgacatcctct

SEQ ID NO: 9123342 - DNA, 22 bp, Homo sapiens
atgtttctgagtgtatatacat

SEQ ID NO: 9123343 - DNA, 22 bp, Homo sapiens
atgtttctgtcctacgagataa

SEQ ID NO: 9123344 - DNA, 22 bp, Homo sapiens
atgtttctgaagtttacagata

SEQ ID NO: 9123345 - DNA, 17 bp, Homo sapiens
atgttaatttcacattt

SEQ ID NO: 9123346 - DNA, 22 bp, Homo sapiens
agaatactaggcttcagaaagg

SEQ ID NO: 9123347 - DNA, 22 bp, Homo sapiens
atctttacaagaaattctttta

SEQ ID NO: 9123348 - DNA, 22 bp, Homo sapiens
agaatgttttcatgagaatgaa

SEQ ID NO: 9123349 - DNA, 22 bp, Homo sapiens
agaattcagaatgcatttctaa

SEQ ID NO: 9123350 - DNA, 22 bp, Homo sapiens
atggctcagcgcctttctgtgg

SEQ ID NO: 9123351 - DNA, 22 bp, Homo sapiens
accttacccagaggggcatgac

SEQ ID NO: 9123352 - DNA, 22 bp, Homo sapiens
actattagcatatcatgaatgg

SEQ ID NO: 9123353 - DNA, 22 bp, Homo sapiens
actcaaaagaccagagagctga

SEQ ID NO: 9123354 - DNA, 22 bp, Homo sapiens
accctcagctggagattgaatt

SEQ ID NO: 9123355 - DNA, 22 bp, Homo sapiens
accctcagagtaggcactgctg

SEQ ID NO: 9123356 - DNA, 22 bp, Homo sapiens
acctccccacatggtagtgagt

SEQ ID NO: 9123357 - DNA, 18 bp, Homo sapiens
acctccccattttctgaa

SEQ ID NO: 9123358 - DNA, 22 bp, Homo sapiens
acctccccattaggtcacccac

SEQ ID NO: 9123359 - DNA, 22 bp, Homo sapiens
acctccccgggagcagcctcct

SEQ ID NO: 9123360 - DNA, 22 bp, Homo sapiens
acctcccctgactcgaaaccca

SEQ ID NO: 9123361 - DNA, 22 bp, Homo sapiens
acctcccctcaccaatctggtt

SEQ ID NO: 9123362 - DNA, 22 bp, Homo sapiens
acctccctaagggtccagctta

SEQ ID NO: 9123363 - DNA, 22 bp, Homo sapiens
acctccctaacccttttggctc

SEQ ID NO: 9123364 - DNA, 22 bp, Homo sapiens
acctccctcgccgtccactctg

SEQ ID NO: 9123365 - DNA, 22 bp, Homo sapiens
acctccctccatctggacacta

SEQ ID NO: 9123366 - DNA, 21 bp, Homo sapiens
acctccctcgagcaaccagca

SEQ ID NO: 9123367 - DNA, 22 bp, Homo sapiens
agggtgtgttctcctatgagaa

SEQ ID NO: 9123368 - DNA, 22 bp, Homo sapiens
agggtgtgctgttgggtctttc

SEQ ID NO: 9123369 - DNA, 20 bp, Homo sapiens
agggtgtgggccttagccat

SEQ ID NO: 9123370 - DNA, 22 bp, Homo sapiens
acctccctgggttatcggggca

SEQ ID NO: 9123371 - DNA, 20 bp, Homo sapiens
acctccctctgtgggtggga

SEQ ID NO: 9123372 - DNA, 22 bp, Homo sapiens
acctccctgcctcttggcgtca

SEQ ID NO: 9123373 - DNA, 22 bp, Homo sapiens
acctccctggccttctgattcc

SEQ ID NO: 9123374 - DNA, 22 bp, Homo sapiens
actgaaatttatattttgggca

SEQ ID NO: 9123375 - DNA, 22 bp, Homo sapiens
actgaaatgaaatctatcatct

SEQ ID NO: 9123376 - DNA, 22 bp, Homo sapiens
actgaaatactgctcttggatt

SEQ ID NO: 9123377 - DNA, 22 bp, Homo sapiens
agtctcttcctcatgcatatgt

SEQ ID NO: 9123378 - DNA, 22 bp, Homo sapiens
agtctcttgcacattgtattaa

SEQ ID NO: 9123379 - DNA, 22 bp, Homo sapiens
actccaggcatctgcttctgct

SEQ ID NO: 9123380 - DNA, 22 bp, Homo sapiens
agtggctgcttctggttgctcc

SEQ ID NO: 9123381 - DNA, 22 bp, Homo sapiens
actggcaatagcaaatgcttgg

SEQ ID NO: 9123382 - DNA, 22 bp, Homo sapiens
agtggctgatgtaggcagtggg

SEQ ID NO: 9123383 - DNA, 22 bp, Homo sapiens
actgaattcctctttcttatcc

SEQ ID NO: 9123384 - DNA, 22 bp, Homo sapiens
atccagagtggccttctttcca

SEQ ID NO: 9123385 - DNA, 22 bp, Homo sapiens
atcacatttatagtggcacgca

SEQ ID NO: 9123386 - DNA, 22 bp, Homo sapiens
agaaacagaagggaaagctttt

SEQ ID NO: 9123387 - DNA, 18 bp, Homo sapiens
acttgggacttttgcatt

SEQ ID NO: 9123388 - DNA, 22 bp, Homo sapiens
acttgggagggtgtgggcagct

SEQ ID NO: 9123389 - DNA, 22 bp, Homo sapiens
acttggtgaagtcaggtgatta

SEQ ID NO: 9123390 - DNA, 22 bp, Homo sapiens
acttgggatttcagatgctgtg

SEQ ID NO: 9123391 - DNA, 22 bp, Homo sapiens
atatatttgagaatattcatga

SEQ ID NO: 9123392 - DNA, 22 bp, Homo sapiens
agaaaatttattcatgttagtt

SEQ ID NO: 9123393 - DNA, 20 bp, Homo sapiens
actgtgaatgctgaattagc

SEQ ID NO: 9123394 - DNA, 22 bp, Homo sapiens
actgtgaacggactgaagccca

SEQ ID NO: 9123395 - DNA, 22 bp, Homo sapiens
actgtgaaagctaacatcttag

SEQ ID NO: 9123396 - DNA, 22 bp, Homo sapiens
agtttacatcttcaatctcatt

SEQ ID NO: 9123397 - DNA, 22 bp, Homo sapiens
acttcagtgtggtataaaacgt

SEQ ID NO: 9123398 - DNA, 22 bp, Homo sapiens
acttgggaaagaagtttcaccg

SEQ ID NO: 9123399 - DNA, 22 bp, Homo sapiens
actgttatagttcacttttccc

SEQ ID NO: 9123400 - DNA, 22 bp, Homo sapiens
acttcaaaaataagtgagaggt

SEQ ID NO: 9123401 - DNA, 22 bp, Homo sapiens
acttcaaatgtgacaatgtgaa

SEQ ID NO: 9123402 - DNA, 22 bp, Homo sapiens
aggcaggcagggctcactgtct

SEQ ID NO: 9123403 - DNA, 22 bp, Homo sapiens
acatgagactgggtttgtaggg

SEQ ID NO: 9123404 - DNA, 22 bp, Homo sapiens
acatgaaagttattctgagttg

SEQ ID NO: 9123405 - DNA, 22 bp, Homo sapiens
acatgagagaaaagtattctga

SEQ ID NO: 9123406 - DNA, 20 bp, Homo sapiens
agggcagcttgaggagccgg

SEQ ID NO: 9123407 - DNA, 22 bp, Homo sapiens
acatttttgggttgatgtctga

SEQ ID NO: 9123408 - DNA, 22 bp, Homo sapiens
acatttttcacatttgtagggt

SEQ ID NO: 9123409 - DNA, 22 bp, Homo sapiens
acagctctgtgtattgtcatct

SEQ ID NO: 9123410 - DNA, 22 bp, Homo sapiens
acagcgccgattctccggggct

SEQ ID NO: 9123411 - DNA, 22 bp, Homo sapiens
agctgcccaatcctgcagggcg

SEQ ID NO: 9123412 - DNA, 22 bp, Homo sapiens
acagcactggtcccgcaagcct

SEQ ID NO: 9123413 - DNA, 22 bp, Homo sapiens
acagcagacacaggcacgctgt

SEQ ID NO: 9123414 - DNA, 22 bp, Homo sapiens
acagcacttattcagcacagtg

SEQ ID NO: 9123415 - DNA, 23 bp, Homo sapiens
acagcttcctggcatggagaacc

SEQ ID NO: 9123416 - DNA, 22 bp, Homo sapiens
acagcttcacccattatccctg

SEQ ID NO: 9123417 - DNA, 22 bp, Homo sapiens
aggagtgagtgtcctcagcaga

SEQ ID NO: 9123418 - DNA, 22 bp, Homo sapiens
aggcagctggaggcagagacta

SEQ ID NO: 9123419 - DNA, 22 bp, Homo sapiens
acatatgtgttgtacatgcatg

SEQ ID NO: 9123420 - DNA, 22 bp, Homo sapiens
acatatgtatatgtacacagtc

SEQ ID NO: 9123421 - DNA, 22 bp, Homo sapiens
acatatgtgtctgcacatgccc

SEQ ID NO: 9123422 - DNA, 18 bp, Homo sapiens
aagctcttaaatggttca

SEQ ID NO: 9123423 - DNA, 22 bp, Homo sapiens
aagctcttatgatatttattta

SEQ ID NO: 9123424 - DNA, 22 bp, Homo sapiens
aagctattgaatttatagcata

SEQ ID NO: 9123425 - DNA, 22 bp, Homo sapiens
aagctacttttatatgcagtag

SEQ ID NO: 9123426 - DNA, 22 bp, Homo sapiens
acccctccattctgaaggctgc

SEQ ID NO: 9123427 - DNA, 22 bp, Homo sapiens
aaggcctgaacatgaggagatg

SEQ ID NO: 9123428 - DNA, 22 bp, Homo sapiens
aaggcctcttctctctggagat

SEQ ID NO: 9123429 - DNA, 22 bp, Homo sapiens
aaggccttgccgaaggatgcca

SEQ ID NO: 9123430 - DNA, 22 bp, Homo sapiens
aaggcctcaggtgaggctgccc

SEQ ID NO: 9123431 - DNA, 22 bp, Homo sapiens
aaggcctcatgtaatcaggccc

SEQ ID NO: 9123432 - DNA, 22 bp, Homo sapiens
aaggcctcaggtgaggctgccc

SEQ ID NO: 9123433 - DNA, 22 bp, Homo sapiens
aaggcctccctgtgtgcaggtg

SEQ ID NO: 9123434 - DNA, 22 bp, Homo sapiens
aaggcctccctctttcatggga

SEQ ID NO: 9123435 - DNA, 22 bp, Homo sapiens
aaggcctccgccaatggcagag

SEQ ID NO: 9123436 - DNA, 22 bp, Homo sapiens
aaggcctcttctctctggagat

SEQ ID NO: 9123437 - DNA, 22 bp, Homo sapiens
aaggcctccgccaatggcagag

SEQ ID NO: 9123438 - DNA, 23 bp, Homo sapiens
acattgttcaatgaaagttagga

SEQ ID NO: 9123439 - DNA, 22 bp, Homo sapiens
acattgttgtgcaattatagtt

SEQ ID NO: 9123440 - DNA, 22 bp, Homo sapiens
acattgttgtttgcagcacagg

SEQ ID NO: 9123441 - DNA, 22 bp, Homo sapiens
actggccaggcacagctgtggg

SEQ ID NO: 9123442 - DNA, 22 bp, Homo sapiens
actggccatgaacttgggatct

SEQ ID NO: 9123443 - DNA, 22 bp, Homo sapiens
actcagagaacattcccagtct

SEQ ID NO: 9123444 - DNA, 22 bp, Homo sapiens
actccctcaagtcactttagtt

SEQ ID NO: 9123445 - DNA, 22 bp, Homo sapiens
acgtgctggagaagagctcgcc

SEQ ID NO: 9123446 - DNA, 22 bp, Homo sapiens
agaacaaaattagaggagtgca

SEQ ID NO: 9123447 - DNA, 22 bp, Homo sapiens
agaacaaaattagaggagtgca

SEQ ID NO: 9123448 - DNA, 22 bp, Homo sapiens
agagacaggatatctgctcatg

SEQ ID NO: 9123449 - DNA, 22 bp, Homo sapiens
agagccaggcggctgggcacct

SEQ ID NO: 9123450 - DNA, 22 bp, Homo sapiens
aattaaaagataacccatgagt

SEQ ID NO: 9123451 - DNA, 22 bp, Homo sapiens
agagacagatctgagggacctc

SEQ ID NO: 9123452 - DNA, 22 bp, Homo sapiens
agacaatggaccaagcaccttc

SEQ ID NO: 9123453 - DNA, 18 bp, Homo sapiens
aatgtgaatatttacttc

SEQ ID NO: 9123454 - DNA, 22 bp, Homo sapiens
acaatgaacgctttttaactgt

SEQ ID NO: 9123455 - DNA, 22 bp, Homo sapiens
acaatgaaaaaatttactgtgg

SEQ ID NO: 9123456 - DNA, 22 bp, Homo sapiens
acaagagcttatttccctgttt

SEQ ID NO: 9123457 - DNA, 22 bp, Homo sapiens
acaaagggggactgcagagggt

SEQ ID NO: 9123458 - DNA, 22 bp, Homo sapiens
agcctctctttattcccagcta

SEQ ID NO: 9123459 - DNA, 22 bp, Homo sapiens
agcctctctttctggtggctaa

SEQ ID NO: 9123460 - DNA, 22 bp, Homo sapiens
acagagcctccaggagtgctgg

SEQ ID NO: 9123461 - DNA, 22 bp, Homo sapiens
acagagcccttccttgcaccat

SEQ ID NO: 9123462 - DNA, 22 bp, Homo sapiens
agcctctccagagcctggcaga

SEQ ID NO: 9123463 - DNA, 22 bp, Homo sapiens
agcctctctccagcttggcaga

SEQ ID NO: 9123464 - DNA, 22 bp, Homo sapiens
agcctctcatgttctcccccag

SEQ ID NO: 9123465 - DNA, 22 bp, Homo sapiens
agcctctcactgtcaccctccc

SEQ ID NO: 9123466 - DNA, 22 bp, Homo sapiens
acactcttctcacagtcagttt

SEQ ID NO: 9123467 - DNA, 22 bp, Homo sapiens
agcagagccaggtctctctgta

SEQ ID NO: 9123468 - DNA, 22 bp, Homo sapiens
aatagactttctttttagaaca

SEQ ID NO: 9123469 - DNA, 22 bp, Homo sapiens
aacatcatcatgaacaactaat

SEQ ID NO: 9123470 - DNA, 22 bp, Homo sapiens
aacatcattatgtccattaatg

SEQ ID NO: 9123471 - DNA, 22 bp, Homo sapiens
aaatgtcagaggaacatattga

SEQ ID NO: 9123472 - DNA, 22 bp, Homo sapiens
aaatgtcaaggtgatagatgca

SEQ ID NO: 9123473 - DNA, 22 bp, Homo sapiens
aaatgtcaaagacgtgtttttg

SEQ ID NO: 9123474 - DNA, 22 bp, Homo sapiens
aaggcagccctggctcagcctg

SEQ ID NO: 9123475 - DNA, 22 bp, Homo sapiens
aaattttaaggctggaacttaa

SEQ ID NO: 9123476 - DNA, 22 bp, Homo sapiens
aacagagctctgctctcagatt

SEQ ID NO: 9123477 - DNA, 22 bp, Homo sapiens
aatttcagctcaaacttgtgtt

SEQ ID NO: 9123478 - DNA, 22 bp, Homo sapiens
aagagaacagttgctgcccaag

SEQ ID NO: 9123479 - DNA, 22 bp, Homo sapiens
aactggtctttagaatattctg

SEQ ID NO: 9123480 - DNA, 22 bp, Homo sapiens
aactggtcctcaaattttgatg

SEQ ID NO: 9123481 - DNA, 23 bp, Homo sapiens
aactggtccaagatagattgtcc

SEQ ID NO: 9123482 - DNA, 22 bp, Homo sapiens
aagaaaacaatgacttgccagc

SEQ ID NO: 9123483 - DNA, 22 bp, Homo sapiens
aattctcaggaatttcatctgt

SEQ ID NO: 9123484 - DNA, 22 bp, Homo sapiens
acagcagagacactcaggaggc

SEQ ID NO: 9123485 - DNA, 22 bp, Homo sapiens
acacattcctgcagacatgatg

SEQ ID NO: 9123486 - DNA, 22 bp, Homo sapiens
aagatgttagaggtcatgcaga

SEQ ID NO: 9123487 - DNA, 22 bp, Homo sapiens
aacacttatccacatttgaaag

SEQ ID NO: 9123488 - DNA, 21 bp, Homo sapiens
aacacttgggttagtgggaga

SEQ ID NO: 9123489 - DNA, 22 bp, Homo sapiens
aaagcagagatcatggcttgta

SEQ ID NO: 9123490 - DNA, 22 bp, Homo sapiens
aaagcccccctgatctgagatg

SEQ ID NO: 9123491 - DNA, 22 bp, Homo sapiens
aaagccattacaaaatttcata

SEQ ID NO: 9123492 - DNA, 22 bp, Homo sapiens
aaaggcataggatgtggaatcg

SEQ ID NO: 9123493 - DNA, 22 bp, Homo sapiens
aacccaggtctttggcttccag

SEQ ID NO: 9123494 - DNA, 22 bp, Homo sapiens
aaagcctcccaggttatgagta

SEQ ID NO: 9123495 - DNA, 22 bp, Homo sapiens
aaagtttaggctttgaaaccag

SEQ ID NO: 9123496 - DNA, 22 bp, Homo sapiens
aaatctcaggcctctatttact

SEQ ID NO: 9123497 - DNA, 22 bp, Homo sapiens
aaatctcagcccttattttaga

SEQ ID NO: 9123498 - DNA, 22 bp, Homo sapiens
aaatctcaatttgaattgtagc

SEQ ID NO: 9123499 - DNA, 22 bp, Homo sapiens
aagatgtttagatttatacaat

SEQ ID NO: 9123500 - DNA, 22 bp, Homo sapiens
aagatgttgtcgttagtgatga

SEQ ID NO: 9123501 - DNA, 22 bp, Homo sapiens
aagatgttgcattagaatacct

SEQ ID NO: 9123502 - DNA, 22 bp, Homo sapiens
aagatgtttaggtaaaaagttt

SEQ ID NO: 9123503 - DNA, 22 bp, Homo sapiens
aagatattcaaagatttattag

SEQ ID NO: 9123504 - DNA, 22 bp, Homo sapiens
aagatattttagaacattcact

SEQ ID NO: 9123505 - DNA, 22 bp, Homo sapiens
aaaattaagtgtctgggaagcc

SEQ ID NO: 9123506 - DNA, 21 bp, Homo sapiens
aaaatgtttccttgttggtta

SEQ ID NO: 9123507 - DNA, 22 bp, Homo sapiens
aaaatgttcaagcatgctggtt

SEQ ID NO: 9123508 - DNA, 18 bp, Homo sapiens
aaaatgttcccccattaa

SEQ ID NO: 9123509 - DNA, 22 bp, Homo sapiens
aaaatgtgtttatgcatttcgt

SEQ ID NO: 9123510 - DNA, 22 bp, Homo sapiens
aaaactttcagggatacagaaa

SEQ ID NO: 9123511 - DNA, 22 bp, Homo sapiens
aaactggtaataaaatggatta

SEQ ID NO: 9123512 - DNA, 22 bp, Homo sapiens
aaaattcattcctcagactgcc

SEQ ID NO: 9123513 - DNA, 22 bp, Homo sapiens
aaaattctaacatgcagccaag

SEQ ID NO: 9123514 - DNA, 22 bp, Homo sapiens
aaaattgaggctcatgttaaat

SEQ ID NO: 9123515 - DNA, 22 bp, Homo sapiens
aaaattgagagttatagatggt

SEQ ID NO: 9123516 - DNA, 22 bp, Homo sapiens
aaagactttcacctagcaaaga

SEQ ID NO: 9123517 - DNA, 22 bp, Homo sapiens
aaatagttcagcttgtaaaccc

SEQ ID NO: 9123518 - DNA, 22 bp, Homo sapiens
aaatagtttagctctcatttca

SEQ ID NO: 9123519 - DNA, 22 bp, Homo sapiens
aaacttctctccctactttgtg

SEQ ID NO: 9123520 - DNA, 22 bp, Homo sapiens
aaacatctcaaagaggtatttg

SEQ ID NO: 9123521 - DNA, 22 bp, Homo sapiens
aaactgtcattggatgcatttg

SEQ ID NO: 9123522 - DNA, 22 bp, Homo sapiens
aaactgtcacctaatgtatttt

SEQ ID NO: 9123523 - DNA, 22 bp, Homo sapiens
aaacattcaaagcaggatgtgt

SEQ ID NO: 9123524 - DNA, 22 bp, Homo sapiens
ggccttggaaagatacccagct

SEQ ID NO: 9123525 - DNA, 22 bp, Homo sapiens
ggccctccctgagccaggtggg

SEQ ID NO: 9123526 - DNA, 22 bp, Homo sapiens
ggccctcccggtgatgaagagc

SEQ ID NO: 9123527 - DNA, 22 bp, Homo sapiens
ggcccagccggcgagtctcgcg

SEQ ID NO: 9123528 - DNA, 22 bp, Homo sapiens
gggaacactccagggcttggaa

SEQ ID NO: 9123529 - DNA, 22 bp, Homo sapiens
ggctttgggccctcaagtctcc

SEQ ID NO: 9123530 - DNA, 19 bp, Homo sapiens
ggctgtggtggtgccttgc

SEQ ID NO: 9123531 - DNA, 23 bp, Homo sapiens
ggggaagtggcagtgagtgaggc

SEQ ID NO: 9123532 - DNA, 22 bp, Homo sapiens
gggccagtagcacctgtgtgga

SEQ ID NO: 9123533 - DNA, 22 bp, Homo sapiens
gggccataactggctggacagt

SEQ ID NO: 9123534 - DNA, 22 bp, Homo sapiens
gggccagtgggacctgggtctc

SEQ ID NO: 9123535 - DNA, 22 bp, Homo sapiens
gggccagtgagtcgggagagct

SEQ ID NO: 9123536 - DNA, 22 bp, Homo sapiens
gggccagtctgactctgctggt

SEQ ID NO: 9123537 - DNA, 22 bp, Homo sapiens
gggatggggagctggaaagggg

SEQ ID NO: 9123538 - DNA, 22 bp, Homo sapiens
ggaagtaatgtcttaagattct

SEQ ID NO: 9123539 - DNA, 22 bp, Homo sapiens
ggaagtaacattctgtctttcc

SEQ ID NO: 9123540 - DNA, 23 bp, Homo sapiens
ggagacaaggtaccacgttaaca

SEQ ID NO: 9123541 - DNA, 22 bp, Homo sapiens
ggagacaatggaggccaaaaga

SEQ ID NO: 9123542 - DNA, 22 bp, Homo sapiens
ggaggacactggctctgccttc

SEQ ID NO: 9123543 - DNA, 22 bp, Homo sapiens
ggaagaaagcacacaaacttga

SEQ ID NO: 9123544 - DNA, 17 bp, Homo sapiens
ggaaggtcaaggggagg

SEQ ID NO: 9123545 - DNA, 22 bp, Homo sapiens
ggaagaaatgctcttctatgcg

SEQ ID NO: 9123546 - DNA, 22 bp, Homo sapiens
gcttctggtagaattcaataga

SEQ ID NO: 9123547 - DNA, 22 bp, Homo sapiens
gcttcagaaatgaacactgtct

SEQ ID NO: 9123548 - DNA, 22 bp, Homo sapiens
gcttcagactggagcagaggaa

SEQ ID NO: 9123549 - DNA, 22 bp, Homo sapiens
gcttcagagatttcactagttt

SEQ ID NO: 9123550 - DNA, 22 bp, Homo sapiens
gcttcagaaatatcatcattat

SEQ ID NO: 9123551 - DNA, 22 bp, Homo sapiens
ggaggtcaaatggagggctggg

SEQ ID NO: 9123552 - DNA, 22 bp, Homo sapiens
ggagggtggcagcgtcctgggc

SEQ ID NO: 9123553 - DNA, 22 bp, Homo sapiens
ggagggtgcattttaccctgtg

SEQ ID NO: 9123554 - DNA, 22 bp, Homo sapiens
ggagggtgcagaccctttgcaa

SEQ ID NO: 9123555 - DNA, 22 bp, Homo sapiens
ggagggggaattcagccccagc

SEQ ID NO: 9123556 - DNA, 22 bp, Homo sapiens
ggaggctgagaagtccaagatc

SEQ ID NO: 9123557 - DNA, 22 bp, Homo sapiens
ggaggctgctgcctcacgtggg

SEQ ID NO: 9123558 - DNA, 20 bp, Homo sapiens
ggcagacctgctgagagccc

SEQ ID NO: 9123559 - DNA, 22 bp, Homo sapiens
ggtgtcctgggcaggcagctga

SEQ ID NO: 9123560 - DNA, 22 bp, Homo sapiens
ggtgtcctgtcagctagagtga

SEQ ID NO: 9123561 - DNA, 22 bp, Homo sapiens
gtaaagctctcatttaatatca

SEQ ID NO: 9123562 - DNA, 22 bp, Homo sapiens
gtaaagctccttggccagtgcc

SEQ ID NO: 9123563 - DNA, 22 bp, Homo sapiens
gtaaataactggtaattggggt

SEQ ID NO: 9123564 - DNA, 22 bp, Homo sapiens
ggtggccaggagacatttgtca

SEQ ID NO: 9123565 - DNA, 22 bp, Homo sapiens
ggtggccaggccagctctggcc

SEQ ID NO: 9123566 - DNA, 22 bp, Homo sapiens
ggtggccaggccagctctggcc

SEQ ID NO: 9123567 - DNA, 22 bp, Homo sapiens
ggtggccatggtcaggtagcgg

SEQ ID NO: 9123568 - DNA, 22 bp, Homo sapiens
ggtgtccatcaggctgtgcttc

SEQ ID NO: 9123569 - DNA, 22 bp, Homo sapiens
gtccagtgacaagtagctggcc

SEQ ID NO: 9123570 - DNA, 22 bp, Homo sapiens
gtccagtgctaacaggttgagg

SEQ ID NO: 9123571 - DNA, 22 bp, Homo sapiens
gtctgcagagggaaggcttcag

SEQ ID NO: 9123572 - DNA, 22 bp, Homo sapiens
gtccttcatttcctgatctcta

SEQ ID NO: 9123573 - DNA, 22 bp, Homo sapiens
gtccttcatatcatggattata

SEQ ID NO: 9123574 - DNA, 22 bp, Homo sapiens
gtccttggcagcagtccacccc

SEQ ID NO: 9123575 - DNA, 22 bp, Homo sapiens
gtccttggtatgaccaaggttt

SEQ ID NO: 9123576 - DNA, 22 bp, Homo sapiens
gtccttggcttcttgttgactg

SEQ ID NO: 9123577 - DNA, 22 bp, Homo sapiens
gtctgagaactactgaggataa

SEQ ID NO: 9123578 - DNA, 22 bp, Homo sapiens
gtctgagaaagaattctgggga

SEQ ID NO: 9123579 - DNA, 22 bp, Homo sapiens
gtctgagaggagccaagtattg

SEQ ID NO: 9123580 - DNA, 22 bp, Homo sapiens
gtctgagaggaggcagcctcgg

SEQ ID NO: 9123581 - DNA, 22 bp, Homo sapiens
gtctgagattagggaagatttt

SEQ ID NO: 9123582 - DNA, 22 bp, Homo sapiens
gtggccctggagttgtgacact

SEQ ID NO: 9123583 - DNA, 21 bp, Homo sapiens
gtggccctggtgtggctgcac

SEQ ID NO: 9123584 - DNA, 22 bp, Homo sapiens
gtggcccttggagttgtgacct

SEQ ID NO: 9123585 - DNA, 22 bp, Homo sapiens
gtggccaggagagggtgggaca

SEQ ID NO: 9123586 - DNA, 18 bp, Homo sapiens
gtggccagcctggtcttg

SEQ ID NO: 9123587 - DNA, 22 bp, Homo sapiens
gtgacagccttcagtgtctctg

SEQ ID NO: 9123588 - DNA, 22 bp, Homo sapiens
gttcaaattttggctgtactgc

SEQ ID NO: 9123589 - DNA, 22 bp, Homo sapiens
gttctcagcgtgggaggcagag

SEQ ID NO: 9123590 - DNA, 22 bp, Homo sapiens
gttctcactagtgctttgagag

SEQ ID NO: 9123591 - DNA, 22 bp, Homo sapiens
gtgtccactcgtggtctgtcag

SEQ ID NO: 9123592 - DNA, 22 bp, Homo sapiens
gtgtggggtcttctcttggcct

SEQ ID NO: 9123593 - DNA, 22 bp, Homo sapiens
gtgtgggggcagctctgatatg

SEQ ID NO: 9123594 - DNA, 22 bp, Homo sapiens
gtgtggggctcagtgggaatgt

SEQ ID NO: 9123595 - DNA, 22 bp, Homo sapiens
gtgtggggagctgcagccacat

SEQ ID NO: 9123596 - DNA, 22 bp, Homo sapiens
gtgtggggaggagagagccctt

SEQ ID NO: 9123597 - DNA, 22 bp, Homo sapiens
gtgtggggccaggatcagggct

SEQ ID NO: 9123598 - DNA, 22 bp, Homo sapiens
gtgggccaggacccgctgtccg

SEQ ID NO: 9123599 - DNA, 22 bp, Homo sapiens
gtgggccaggcgtctaggccct

SEQ ID NO: 9123600 - DNA, 22 bp, Homo sapiens
gtgtaagtatctttgtatcttt

SEQ ID NO: 9123601 - DNA, 22 bp, Homo sapiens
gtgtcaataaatagcggtgtgg

SEQ ID NO: 9123602 - DNA, 22 bp, Homo sapiens
taaatcagtaaggcatattctc

SEQ ID NO: 9123603 - DNA, 22 bp, Homo sapiens
taaatcagtttctcttattggt

SEQ ID NO: 9123604 - DNA, 22 bp, Homo sapiens
taagaaatttagttatagaatg

SEQ ID NO: 9123605 - DNA, 21 bp, Homo sapiens
taacagcagggaaatacgtgc

SEQ ID NO: 9123606 - DNA, 22 bp, Homo sapiens
taaagctctgggtttctagatc

SEQ ID NO: 9123607 - DNA, 22 bp, Homo sapiens
taaagctctagtgttttggata

SEQ ID NO: 9123608 - DNA, 21 bp, Homo sapiens
taaagctcgttcaggaaagtc

SEQ ID NO: 9123609 - DNA, 22 bp, Homo sapiens
gattttgtcaaattccaaatgt

SEQ ID NO: 9123610 - DNA, 21 bp, Homo sapiens
gatttgcagaaactagacagg

SEQ ID NO: 9123611 - DNA, 22 bp, Homo sapiens
gatttctgtggcttgtacatat

SEQ ID NO: 9123612 - DNA, 22 bp, Homo sapiens
gatttctgttgagaaacatggg

SEQ ID NO: 9123613 - DNA, 22 bp, Homo sapiens
gattttacatgtcatatctatt

SEQ ID NO: 9123614 - DNA, 22 bp, Homo sapiens
gattttcattatagctagtttc

SEQ ID NO: 9123615 - DNA, 22 bp, Homo sapiens
gcagaagcagaggagcctatga

SEQ ID NO: 9123616 - DNA, 22 bp, Homo sapiens
gcagagccaggagcccaggatc

SEQ ID NO: 9123617 - DNA, 22 bp, Homo sapiens
gcacctccaggggccgcccacc

SEQ ID NO: 9123618 - DNA, 22 bp, Homo sapiens
gatggtctgtattaaacagatg

SEQ ID NO: 9123619 - DNA, 22 bp, Homo sapiens
gatggctggctatatcagggga

SEQ ID NO: 9123620 - DNA, 22 bp, Homo sapiens
gatggcttaagagtaaaaggca

SEQ ID NO: 9123621 - DNA, 22 bp, Homo sapiens
gatgctggcctggccatctggg

SEQ ID NO: 9123622 - DNA, 22 bp, Homo sapiens
gatttacaaagctctctagtgt

SEQ ID NO: 9123623 - DNA, 22 bp, Homo sapiens
gatgtttcatgctagcatgtgt

SEQ ID NO: 9123624 - DNA, 22 bp, Homo sapiens
gatgtttcccgttaagagaaaa

SEQ ID NO: 9123625 - DNA, 22 bp, Homo sapiens
gattctttagcccagaaagtta

SEQ ID NO: 9123626 - DNA, 22 bp, Homo sapiens
gcaggggctactctgagcttcc

SEQ ID NO: 9123627 - DNA, 22 bp, Homo sapiens
gcaggggctaaggacacagaga

SEQ ID NO: 9123628 - DNA, 21 bp, Homo sapiens
gcagagccggggcgagaaggc

SEQ ID NO: 9123629 - DNA, 20 bp, Homo sapiens
gcagagcctcactgcaaggg

SEQ ID NO: 9123630 - DNA, 22 bp, Homo sapiens
gcagagcctgtgtctgagcaaa

SEQ ID NO: 9123631 - DNA, 22 bp, Homo sapiens
gcagagccttgcgtcatgtgcc

SEQ ID NO: 9123632 - DNA, 22 bp, Homo sapiens
gccacagccgaacccttgggcc

SEQ ID NO: 9123633 - DNA, 22 bp, Homo sapiens
gcatggtggccttagggtagcc

SEQ ID NO: 9123634 - DNA, 22 bp, Homo sapiens
gcagggtgatagtgaggctcag

SEQ ID NO: 9123635 - DNA, 22 bp, Homo sapiens
gctcagaaaagtgaggctcagt

SEQ ID NO: 9123636 - DNA, 22 bp, Homo sapiens
gctctctttaaactgcatggct

SEQ ID NO: 9123637 - DNA, 22 bp, Homo sapiens
gctgaggattacttgaagtcag

SEQ ID NO: 9123638 - DNA, 23 bp, Homo sapiens
gcctctggagccccagtgctcag

SEQ ID NO: 9123639 - DNA, 20 bp, Homo sapiens
gcctctggagccaaggacca

SEQ ID NO: 9123640 - DNA, 22 bp, Homo sapiens
gcctctggaagtgggaaggggt

SEQ ID NO: 9123641 - DNA, 22 bp, Homo sapiens
gcctctggaagaattacatcca

SEQ ID NO: 9123642 - DNA, 22 bp, Homo sapiens
gcccttccaacccagagggcaa

SEQ ID NO: 9123643 - DNA, 22 bp, Homo sapiens
gcccttccttagacagcaggat

SEQ ID NO: 9123644 - DNA, 22 bp, Homo sapiens
gccctctcttctgcagcctcca

SEQ ID NO: 9123645 - DNA, 22 bp, Homo sapiens
gccctcgcttcttcctaggggt

SEQ ID NO: 9123646 - DNA, 22 bp, Homo sapiens
gccctcctttgcttctcctagt

SEQ ID NO: 9123647 - DNA, 22 bp, Homo sapiens
gccctcctttgcttctcctagt

SEQ ID NO: 9123648 - DNA, 22 bp, Homo sapiens
gataaagcaggtaggagaagat

SEQ ID NO: 9123649 - DNA, 22 bp, Homo sapiens
gataaagcaaggatgactgaag

SEQ ID NO: 9123650 - DNA, 22 bp, Homo sapiens
gagtgattggagttagcattct

SEQ ID NO: 9123651 - DNA, 22 bp, Homo sapiens
gagtggcttttttatggtaatg

SEQ ID NO: 9123652 - DNA, 22 bp, Homo sapiens
gagtggctattgatccgtgatg

SEQ ID NO: 9123653 - DNA, 22 bp, Homo sapiens
gagtggctccaatttggtccta

SEQ ID NO: 9123654 - DNA, 22 bp, Homo sapiens
gagtggctttggagaagtaggg

SEQ ID NO: 9123655 - DNA, 22 bp, Homo sapiens
gagtggctgagtaagaggggag

SEQ ID NO: 9123656 - DNA, 22 bp, Homo sapiens
gagtgcctggggcatctcctgc

SEQ ID NO: 9123657 - DNA, 22 bp, Homo sapiens
gatataggttcatagtgttaca

SEQ ID NO: 9123658 - DNA, 22 bp, Homo sapiens
gatgagaaggctcagatccaaa

SEQ ID NO: 9123659 - DNA, 22 bp, Homo sapiens
gagagtgctgaacggcaagggt

SEQ ID NO: 9123660 - DNA, 22 bp, Homo sapiens
gaggacaagctgtgagtggggt

SEQ ID NO: 9123661 - DNA, 22 bp, Homo sapiens
gaggacaaagcccaggtgctgg

SEQ ID NO: 9123662 - DNA, 22 bp, Homo sapiens
gaggcagctgggatacaaggga

SEQ ID NO: 9123663 - DNA, 22 bp, Homo sapiens
gagtcactagtgaagttggtgc

SEQ ID NO: 9123664 - DNA, 22 bp, Homo sapiens
gagtccctgctgtcaggtgctg

SEQ ID NO: 9123665 - DNA, 22 bp, Homo sapiens
gagtccacttaagtatctgcag

SEQ ID NO: 9123666 - DNA, 22 bp, Homo sapiens
gaggggcaatgagggaaagagt

SEQ ID NO: 9123667 - DNA, 22 bp, Homo sapiens
gaggggcacagtaaagggtccc

SEQ ID NO: 9123668 - DNA, 22 bp, Homo sapiens
gagggccaaagagcaagagcct

SEQ ID NO: 9123669 - DNA, 22 bp, Homo sapiens
gactgtggtctgttctccaggt

SEQ ID NO: 9123670 - DNA, 22 bp, Homo sapiens
gactgtgggctccttgagggca

SEQ ID NO: 9123671 - DNA, 22 bp, Homo sapiens
gactgtgggaagactgtaggtt

SEQ ID NO: 9123672 - DNA, 22 bp, Homo sapiens
gactgtggcaggctcagcactg

SEQ ID NO: 9123673 - DNA, 22 bp, Homo sapiens
gactgtggccttggaccatggg

SEQ ID NO: 9123674 - DNA, 22 bp, Homo sapiens
gactgtcattctagtgcccatg

SEQ ID NO: 9123675 - DNA, 22 bp, Homo sapiens
gagaaaagcgaaggacctggag

SEQ ID NO: 9123676 - DNA, 22 bp, Homo sapiens
gaacctgtcctgagtgaggagt

SEQ ID NO: 9123677 - DNA, 22 bp, Homo sapiens
gaaataacctcatgcaccatga

SEQ ID NO: 9123678 - DNA, 22 bp, Homo sapiens
gaaagttttctcacacagtaat

SEQ ID NO: 9123679 - DNA, 22 bp, Homo sapiens
gaaagttttcatatataccaaa

SEQ ID NO: 9123680 - DNA, 22 bp, Homo sapiens
gaaatttacaactttctcatgg

SEQ ID NO: 9123681 - DNA, 22 bp, Homo sapiens
gaaaggccacgtgccaagatta

SEQ ID NO: 9123682 - DNA, 22 bp, Homo sapiens
gaaagggagtgaagatggtata

SEQ ID NO: 9123683 - DNA, 22 bp, Homo sapiens
gaaagggaatggatttctgttg

SEQ ID NO: 9123684 - DNA, 22 bp, Homo sapiens
gaaagtttctcacacatgcaga

SEQ ID NO: 9123685 - DNA, 22 bp, Homo sapiens
gaaagggataccatgttacttg

SEQ ID NO: 9123686 - DNA, 22 bp, Homo sapiens
cttttaatgggagcagtatttg

SEQ ID NO: 9123687 - DNA, 22 bp, Homo sapiens
cttggggatgcaaagccagtgt

SEQ ID NO: 9123688 - DNA, 22 bp, Homo sapiens
cttggggacacagagcccaggg

SEQ ID NO: 9123689 - DNA, 22 bp, Homo sapiens
cttggctgtaaaatcagaggct

SEQ ID NO: 9123690 - DNA, 22 bp, Homo sapiens
cttggctgtcataaggtcctgg

SEQ ID NO: 9123691 - DNA, 21 bp, Homo sapiens
cttggctgcagtgacaggcat

SEQ ID NO: 9123692 - DNA, 21 bp, Homo sapiens
cttggctgcagtgacaggcat

SEQ ID NO: 9123693 - DNA, 17 bp, Homo sapiens
cttggctgctgtgcgat

SEQ ID NO: 9123694 - DNA, 22 bp, Homo sapiens
cttctcagttgcaagtgtcaga

SEQ ID NO: 9123695 - DNA, 22 bp, Homo sapiens
ctggctctgtgggacctggcct

SEQ ID NO: 9123696 - DNA, 22 bp, Homo sapiens
cttctctctgcataggcatggg

SEQ ID NO: 9123697 - DNA, 22 bp, Homo sapiens
cttctttcttttgatcacaggt

SEQ ID NO: 9123698 - DNA, 22 bp, Homo sapiens
cttctttcccaggcatgtttta

SEQ ID NO: 9123699 - DNA, 22 bp, Homo sapiens
cttctttccttcctccagtggc

SEQ ID NO: 9123700 - DNA, 22 bp, Homo sapiens
cttctttcaagaatggattagg

SEQ ID NO: 9123701 - DNA, 22 bp, Homo sapiens
cttgaaagcactcctttgactg

SEQ ID NO: 9123702 - DNA, 22 bp, Homo sapiens
tgtctcagttcccttctctgga

SEQ ID NO: 9123703 - DNA, 22 bp, Homo sapiens
tgtctcagctgtgcttcattgg

SEQ ID NO: 9123704 - DNA, 22 bp, Homo sapiens
cctggcctctccgagtaacctg

SEQ ID NO: 9123705 - DNA, 22 bp, Homo sapiens
cctggcctgtgaatctgagagc

SEQ ID NO: 9123706 - DNA, 22 bp, Homo sapiens
tggtggcttctgaggatggcga

SEQ ID NO: 9123707 - DNA, 22 bp, Homo sapiens
tggtggctaccaggtcctgggg

SEQ ID NO: 9123708 - DNA, 22 bp, Homo sapiens
tgtaaacagccccatggagagc

SEQ ID NO: 9123709 - DNA, 22 bp, Homo sapiens
cctggactgtgtcctgtggtca

SEQ ID NO: 9123710 - DNA, 22 bp, Homo sapiens
cctgcccacagagagggtgcat

SEQ ID NO: 9123711 - DNA, 22 bp, Homo sapiens
cctgcccactccaggagcaact

SEQ ID NO: 9123712 - DNA, 20 bp, Homo sapiens
tggtccccatccttgcgatt

SEQ ID NO: 9123713 - DNA, 22 bp, Homo sapiens
tgtcatggactggatttctgct

SEQ ID NO: 9123714 - DNA, 22 bp, Homo sapiens
tgtattcagggacatatatgta

SEQ ID NO: 9123715 - DNA, 23 bp, Homo sapiens
cctggctgacctgaaggtgtagt

SEQ ID NO: 9123716 - DNA, 22 bp, Homo sapiens
cctggctgagggacctcgggta

SEQ ID NO: 9123717 - DNA, 22 bp, Homo sapiens
cctggctgaggggccaaggacc

SEQ ID NO: 9123718 - DNA, 21 bp, Homo sapiens
cctggctgcacagttgctggt

SEQ ID NO: 9123719 - DNA, 22 bp, Homo sapiens
tgtgagcttaggacagggctat

SEQ ID NO: 9123720 - DNA, 22 bp, Homo sapiens
cctggctgtggcggtgctctca

SEQ ID NO: 9123721 - DNA, 22 bp, Homo sapiens
cctggctgtgtgaccttggcaa

SEQ ID NO: 9123722 - DNA, 22 bp, Homo sapiens
cctggctgtttgagcggggaat

SEQ ID NO: 9123723 - DNA, 22 bp, Homo sapiens
cctggctgcattttgctggatg

SEQ ID NO: 9123724 - DNA, 22 bp, Homo sapiens
cctggctgccgagtgtgcagcg

SEQ ID NO: 9123725 - DNA, 22 bp, Homo sapiens
cctggctgcccatggaccctct

SEQ ID NO: 9123726 - DNA, 22 bp, Homo sapiens
cctggctgctgtcactgaccat

SEQ ID NO: 9123727 - DNA, 22 bp, Homo sapiens
cctggctgctctgatgagcgcc

SEQ ID NO: 9123728 - DNA, 22 bp, Homo sapiens
cctggctggttgtctgattcta

SEQ ID NO: 9123729 - DNA, 19 bp, Homo sapiens
cctggctgtgaagcctgca

SEQ ID NO: 9123730 - DNA, 22 bp, Homo sapiens
cctggctgtgcattgccggccc

SEQ ID NO: 9123731 - DNA, 23 bp, Homo sapiens
cctggctgtggatttgggcctgc

SEQ ID NO: 9123732 - DNA, 22 bp, Homo sapiens
cctgggcctctcaaagtgctgg

SEQ ID NO: 9123733 - DNA, 22 bp, Homo sapiens
cctgggcctgaaaacatttctc

SEQ ID NO: 9123734 - DNA, 22 bp, Homo sapiens
cctgggccttgacctcgtgggc

SEQ ID NO: 9123735 - DNA, 22 bp, Homo sapiens
cctgggtcctggcagcctcctg

SEQ ID NO: 9123736 - DNA, 19 bp, Homo sapiens
cctgggtccactcagacta

SEQ ID NO: 9123737 - DNA, 22 bp, Homo sapiens
tgtggctgttgaggaccccaag

SEQ ID NO: 9123738 - DNA, 22 bp, Homo sapiens
tgtggctgctcaggtgcagacc

SEQ ID NO: 9123739 - DNA, 22 bp, Homo sapiens
tgtggggccaaagcccagccac

SEQ ID NO: 9123740 - DNA, 21 bp, Homo sapiens
tggctgcctggctctgtggtt

SEQ ID NO: 9123741 - DNA, 22 bp, Homo sapiens
cctctcagccggactgtcaggc

SEQ ID NO: 9123742 - DNA, 22 bp, Homo sapiens
cctctctgtaagggtccctccc

SEQ ID NO: 9123743 - DNA, 22 bp, Homo sapiens
cctctctgtagcagcccccagt

SEQ ID NO: 9123744 - DNA, 22 bp, Homo sapiens
cctctggtatttgcacagatat

SEQ ID NO: 9123745 - DNA, 18 bp, Homo sapiens
cctctgggttttgttccc

SEQ ID NO: 9123746 - DNA, 23 bp, Homo sapiens
cctctgacaatgatgtcacctgc

SEQ ID NO: 9123747 - DNA, 22 bp, Homo sapiens
cctctgacacttgtcccacaca

SEQ ID NO: 9123748 - DNA, 22 bp, Homo sapiens
cctctgaggtgagcccagctgg

SEQ ID NO: 9123749 - DNA, 22 bp, Homo sapiens
cctccactctggcctctcaggt

SEQ ID NO: 9123750 - DNA, 22 bp, Homo sapiens
cctccagactttggccatcctc

SEQ ID NO: 9123751 - DNA, 22 bp, Homo sapiens
cctcgtggtgtcagacctgtgc

SEQ ID NO: 9123752 - DNA, 22 bp, Homo sapiens
cctcctccttatggtggcccag

SEQ ID NO: 9123753 - DNA, 22 bp, Homo sapiens
cctcctggtccagcatctcttt

SEQ ID NO: 9123754 - DNA, 22 bp, Homo sapiens
cctccctggtggctctggtcta

SEQ ID NO: 9123755 - DNA, 22 bp, Homo sapiens
cctcccttcagtagagcccaat

SEQ ID NO: 9123756 - DNA, 22 bp, Homo sapiens
cctcccttccccagtagtcaag

SEQ ID NO: 9123757 - DNA, 22 bp, Homo sapiens
cctcccttggccatagccagcc

SEQ ID NO: 9123758 - DNA, 22 bp, Homo sapiens
cctccctttgttgcaagggaaa

SEQ ID NO: 9123759 - DNA, 22 bp, Homo sapiens
cctcccttttggtgtctgcata

SEQ ID NO: 9123760 - DNA, 22 bp, Homo sapiens
ccctggctcttcaccacctgcc

SEQ ID NO: 9123761 - DNA, 22 bp, Homo sapiens
ccctggctgccagtcaccagac

SEQ ID NO: 9123762 - DNA, 23 bp, Homo sapiens
tggatcagacagatctgggcttc

SEQ ID NO: 9123763 - DNA, 22 bp, Homo sapiens
tggcaagagggatgcaaggttt

SEQ ID NO: 9123764 - DNA, 22 bp, Homo sapiens
ccctgctgcagagagctttcca

SEQ ID NO: 9123765 - DNA, 22 bp, Homo sapiens
ccctccaggcactgccctcttc

SEQ ID NO: 9123766 - DNA, 22 bp, Homo sapiens
ccctccagctcaaagcaaccgg

SEQ ID NO: 9123767 - DNA, 22 bp, Homo sapiens
ccctcatgccagacagcatgca

SEQ ID NO: 9123768 - DNA, 22 bp, Homo sapiens
ccctccagagcttgacctgctg

SEQ ID NO: 9123769 - DNA, 20 bp, Homo sapiens
ccctccagcaaccaggactt

SEQ ID NO: 9123770 - DNA, 19 bp, Homo sapiens
tctgtggccttccctgatg

SEQ ID NO: 9123771 - DNA, 22 bp, Homo sapiens
tctgtggcctgtgtccaagtgc

SEQ ID NO: 9123772 - DNA, 22 bp, Homo sapiens
tctgtggcctgcctcctcattt

SEQ ID NO: 9123773 - DNA, 22 bp, Homo sapiens
tctgtggcgcatagttgtctct

SEQ ID NO: 9123774 - DNA, 21 bp, Homo sapiens
tctgtggcggactctaggccc

SEQ ID NO: 9123775 - DNA, 22 bp, Homo sapiens
tctgtggcatgttgcacttgta

SEQ ID NO: 9123776 - DNA, 22 bp, Homo sapiens
tctgtggcccaagtgatggctg

SEQ ID NO: 9123777 - DNA, 23 bp, Homo sapiens
tctgtggccccttcgccccactc

SEQ ID NO: 9123778 - DNA, 22 bp, Homo sapiens
tctgtggcctccttccacttac

SEQ ID NO: 9123779 - DNA, 22 bp, Homo sapiens
tctgtggcatggtatctggagg

SEQ ID NO: 9123780 - DNA, 22 bp, Homo sapiens
tctgtggcatgaggaaataggc

SEQ ID NO: 9123781 - DNA, 22 bp, Homo sapiens
tctgtggcatagtgcttgggaa

SEQ ID NO: 9123782 - DNA, 22 bp, Homo sapiens
tctgtggcagttctggttcatc

SEQ ID NO: 9123783 - DNA, 22 bp, Homo sapiens
cccagctgaacttgcattccaa

SEQ ID NO: 9123784 - DNA, 19 bp, Homo sapiens
cccagctgttcttccacca

SEQ ID NO: 9123785 - DNA, 22 bp, Homo sapiens
cccaggagggtggcctctgccc

SEQ ID NO: 9123786 - DNA, 22 bp, Homo sapiens
cccctctggtcaaccagtcaca

SEQ ID NO: 9123787 - DNA, 22 bp, Homo sapiens
cccctctccctcacttatcaat

SEQ ID NO: 9123788 - DNA, 22 bp, Homo sapiens
cccctcctggccacactgtcag

SEQ ID NO: 9123789 - DNA, 22 bp, Homo sapiens
cccctccctgacctggttgggc

SEQ ID NO: 9123790 - DNA, 22 bp, Homo sapiens
ctgaagagaaagggagctcttc

SEQ ID NO: 9123791 - DNA, 22 bp, Homo sapiens
ctgaaattctgcctctgcacaa

SEQ ID NO: 9123792 - DNA, 22 bp, Homo sapiens
ctgaaagcaaatacatgaatct

SEQ ID NO: 9123793 - DNA, 23 bp, Homo sapiens
ttttattgatatgtagctgttgt

SEQ ID NO: 9123794 - DNA, 22 bp, Homo sapiens
ctctggtcccctgtcaccagtt

SEQ ID NO: 9123795 - DNA, 21 bp, Homo sapiens
ctctggtcctgtctggcaggc

SEQ ID NO: 9123796 - DNA, 22 bp, Homo sapiens
ctctggtcaagcaaagaggttt

SEQ ID NO: 9123797 - DNA, 22 bp, Homo sapiens
ctctggtcttcaaggccacctc

SEQ ID NO: 9123798 - DNA, 22 bp, Homo sapiens
ctcttttacaccaaaaggccta

SEQ ID NO: 9123799 - DNA, 22 bp, Homo sapiens
ctcttttaattgtcataacaac

SEQ ID NO: 9123800 - DNA, 22 bp, Homo sapiens
ctcttttatgtgacgtgtgtga

SEQ ID NO: 9123801 - DNA, 22 bp, Homo sapiens
ctcttttagagatgaaaattgg

SEQ ID NO: 9123802 - DNA, 22 bp, Homo sapiens
ctctcctctgaagtggtgaccc

SEQ ID NO: 9123803 - DNA, 22 bp, Homo sapiens
ttttattctaagtatgatggga

SEQ ID NO: 9123804 - DNA, 22 bp, Homo sapiens
ctgagagaaacatgactcagga

SEQ ID NO: 9123805 - DNA, 22 bp, Homo sapiens
ctgagagaatcatgctgcaggt

SEQ ID NO: 9123806 - DNA, 21 bp, Homo sapiens
ctgcagagcatgcaaaatgtt

SEQ ID NO: 9123807 - DNA, 22 bp, Homo sapiens
ctggccataggttctcagtgtg

SEQ ID NO: 9123808 - DNA, 22 bp, Homo sapiens
ctggccatatccaccagatgga

SEQ ID NO: 9123809 - DNA, 22 bp, Homo sapiens
ctggccatctcctgccagcggt

SEQ ID NO: 9123810 - DNA, 22 bp, Homo sapiens
ctggccatgttgcctctgagac

SEQ ID NO: 9123811 - DNA, 22 bp, Homo sapiens
ctggctctgggcctcagacact

SEQ ID NO: 9123812 - DNA, 22 bp, Homo sapiens
ctggagtcggcgccccaacaga

SEQ ID NO: 9123813 - DNA, 22 bp, Homo sapiens
ttctgtcagcgtcagaaattct

SEQ ID NO: 9123814 - DNA, 22 bp, Homo sapiens
ttccttcctcctccagttctgg

SEQ ID NO: 9123815 - DNA, 22 bp, Homo sapiens
ttccttcctggggatttatcat

SEQ ID NO: 9123816 - DNA, 22 bp, Homo sapiens
ctaatcttgcctcatcaagtct

SEQ ID NO: 9123817 - DNA, 22 bp, Homo sapiens
ctaatttttgttctgcattgaa

SEQ ID NO: 9123818 - DNA, 22 bp, Homo sapiens
ttcccacacaattaagtcattt

SEQ ID NO: 9123819 - DNA, 22 bp, Homo sapiens
ttcccacactccatataattca

SEQ ID NO: 9123820 - DNA, 22 bp, Homo sapiens
cggctggggctgtccccatgac

SEQ ID NO: 9123821 - DNA, 22 bp, Homo sapiens
ttcacataaatagatcacatca

SEQ ID NO: 9123822 - DNA, 22 bp, Homo sapiens
ttcacattaagcctcctcctac

SEQ ID NO: 9123823 - DNA, 22 bp, Homo sapiens
ctcataaaggcacacttgttgt

SEQ ID NO: 9123824 - DNA, 22 bp, Homo sapiens
ctcataaacaattctttgaggt

SEQ ID NO: 9123825 - DNA, 22 bp, Homo sapiens
ctccagtgcacccagaggattt

SEQ ID NO: 9123826 - DNA, 22 bp, Homo sapiens
ttgtttcaggatggtttgttac

SEQ ID NO: 9123827 - DNA, 22 bp, Homo sapiens
ctccagtgagcgcggggcatgg

SEQ ID NO: 9123828 - DNA, 22 bp, Homo sapiens
ttgttaaaggcaaaacaagcac

SEQ ID NO: 9123829 - DNA, 22 bp, Homo sapiens
ttgttaaaactccattggtttg

SEQ ID NO: 9123830 - DNA, 22 bp, Homo sapiens
ctccagggaggagcacgggttc

SEQ ID NO: 9123831 - DNA, 22 bp, Homo sapiens
ttggtaaattatttcttccaat

SEQ ID NO: 9123832 - DNA, 22 bp, Homo sapiens
ttggtaaaatcatagtggtaac

SEQ ID NO: 9123833 - DNA, 22 bp, Homo sapiens
ttggtaaataacaatcacagtg

SEQ ID NO: 9123834 - DNA, 22 bp, Homo sapiens
ttggtaaacttgacagagaatc

SEQ ID NO: 9123835 - DNA, 22 bp, Homo sapiens
ttggtaaatgttgattgtggct

SEQ ID NO: 9123836 - DNA, 22 bp, Homo sapiens
ttggtaaatactataatcaaat

SEQ ID NO: 9123837 - DNA, 22 bp, Homo sapiens
ttggtaaatactctttggagac

SEQ ID NO: 9123838 - DNA, 22 bp, Homo sapiens
ttggtaaatccccttacacaaa

SEQ ID NO: 9123839 - DNA, 22 bp, Homo sapiens
tttacatggaatattgtcttgt

SEQ ID NO: 9123840 - DNA, 22 bp, Homo sapiens
ctctccagatctgctgagccag

SEQ ID NO: 9123841 - DNA, 22 bp, Homo sapiens
ctctcctccaggaactcacagt

SEQ ID NO: 9123842 - DNA, 22 bp, Homo sapiens
ctctccctggccagctgtgcag

SEQ ID NO: 9123843 - DNA, 22 bp, Homo sapiens
ctctcccttgggtgggctttgg

SEQ ID NO: 9123844 - DNA, 20 bp, Homo sapiens
ctctcctcacccgtgtcagg

SEQ ID NO: 9123845 - DNA, 22 bp, Homo sapiens
ctctccaggactttggcccaat

SEQ ID NO: 9123846 - DNA, 22 bp, Homo sapiens
taaagccctctgatcacactgg

SEQ ID NO: 9123847 - DNA, 22 bp, Homo sapiens
taaatatcacctggaattgtta

SEQ ID NO: 9123848 - DNA, 22 bp, Homo sapiens
taaatatcagtccagctcttcc

SEQ ID NO: 9123849 - DNA, 22 bp, Homo sapiens
caggagcttctgcccatggcca

SEQ ID NO: 9123850 - DNA, 22 bp, Homo sapiens
caggagttttaaatctagcatg

SEQ ID NO: 9123851 - DNA, 22 bp, Homo sapiens
taaaaatcttatgaatggcaag

SEQ ID NO: 9123852 - DNA, 22 bp, Homo sapiens
caggacagctgggccaccacca

SEQ ID NO: 9123853 - DNA, 22 bp, Homo sapiens
caggacaatctcgtcgggtcct

SEQ ID NO: 9123854 - DNA, 22 bp, Homo sapiens
caggacaatggtcatactggat

SEQ ID NO: 9123855 - DNA, 20 bp, Homo sapiens
tacaaattttccatgtttcc

SEQ ID NO: 9123856 - DNA, 22 bp, Homo sapiens
tacaaattaatgggcatgttta

SEQ ID NO: 9123857 - DNA, 22 bp, Homo sapiens
caggcagaaattttgtttcatt

SEQ ID NO: 9123858 - DNA, 22 bp, Homo sapiens
caggcagagaccctctcctaaa

SEQ ID NO: 9123859 - DNA, 22 bp, Homo sapiens
caggcagagaactcatccgtga

SEQ ID NO: 9123860 - DNA, 22 bp, Homo sapiens
taatgttagtatgtaatcttat

SEQ ID NO: 9123861 - DNA, 22 bp, Homo sapiens
taatttaattccatggattcta

SEQ ID NO: 9123862 - DNA, 22 bp, Homo sapiens
taacttgagctctcagtgctat

SEQ ID NO: 9123863 - DNA, 22 bp, Homo sapiens
taacttctttggtttaaagaga

SEQ ID NO: 9123864 - DNA, 20 bp, Homo sapiens
cagcttcaatgtcagcttga

SEQ ID NO: 9123865 - DNA, 22 bp, Homo sapiens
gtttattgataaaagctggaca

SEQ ID NO: 9123866 - DNA, 22 bp, Homo sapiens
gtttattgggtattgtggagcc

SEQ ID NO: 9123867 - DNA, 22 bp, Homo sapiens
gtttcctgatgtgggagatctt

SEQ ID NO: 9123868 - DNA, 22 bp, Homo sapiens
gtgggacagctttccgttgagg

SEQ ID NO: 9123869 - DNA, 22 bp, Homo sapiens
gtgggacagctggagggtccct

SEQ ID NO: 9123870 - DNA, 22 bp, Homo sapiens
gtgggacagtcagaagtgagca

SEQ ID NO: 9123871 - DNA, 22 bp, Homo sapiens
gtgggacaggtcaaatcttaaa

SEQ ID NO: 9123872 - DNA, 22 bp, Homo sapiens
gtgggacagcggggtgggacag

SEQ ID NO: 9123873 - DNA, 22 bp, Homo sapiens
gtggcttgagcaggggcagagg

SEQ ID NO: 9123874 - DNA, 19 bp, Homo sapiens
gtgggacagacattacata

SEQ ID NO: 9123875 - DNA, 22 bp, Homo sapiens
gtgggacacatagaaaaataag

SEQ ID NO: 9123876 - DNA, 22 bp, Homo sapiens
gtgggacaaggatgaagatatt

SEQ ID NO: 9123877 - DNA, 22 bp, Homo sapiens
cagctcttttttgcagcagctg

SEQ ID NO: 9123878 - DNA, 22 bp, Homo sapiens
cagctctttttcacacaacatg

SEQ ID NO: 9123879 - DNA, 22 bp, Homo sapiens
cagctctttgagtattccattt

SEQ ID NO: 9123880 - DNA, 22 bp, Homo sapiens
cagctcttcctcccaccggaca

SEQ ID NO: 9123881 - DNA, 17 bp, Homo sapiens
cagctcttcctccctct

SEQ ID NO: 9123882 - DNA, 22 bp, Homo sapiens
cagctcttcctagccatgccac

SEQ ID NO: 9123883 - DNA, 22 bp, Homo sapiens
cagctcttcctaccctagttgg

SEQ ID NO: 9123884 - DNA, 22 bp, Homo sapiens
cagctctttattgccaatattc

SEQ ID NO: 9123885 - DNA, 22 bp, Homo sapiens
cagctctttattgaaacaaaaa

SEQ ID NO: 9123886 - DNA, 22 bp, Homo sapiens
cagctctttactctgcaatgat

SEQ ID NO: 9123887 - DNA, 22 bp, Homo sapiens
cagctcttggagcctccagtaa

SEQ ID NO: 9123888 - DNA, 22 bp, Homo sapiens
cagctcttggagaaaccagagc

SEQ ID NO: 9123889 - DNA, 18 bp, Homo sapiens
cagctcttctccagtaac

SEQ ID NO: 9123890 - DNA, 22 bp, Homo sapiens
cagctcttccatttccttcagc

SEQ ID NO: 9123891 - DNA, 22 bp, Homo sapiens
cagctcttccctcttcttgtag

SEQ ID NO: 9123892 - DNA, 22 bp, Homo sapiens
cagctcttcagtgcctgagata

SEQ ID NO: 9123893 - DNA, 22 bp, Homo sapiens
cagctcttcagagtgagcaatg

SEQ ID NO: 9123894 - DNA, 22 bp, Homo sapiens
cagctcttattttctctcctaa

SEQ ID NO: 9123895 - DNA, 22 bp, Homo sapiens
cagctcttagagggagacagac

SEQ ID NO: 9123896 - DNA, 22 bp, Homo sapiens
cagctcttaacacagcttgtat

SEQ ID NO: 9123897 - DNA, 18 bp, Homo sapiens
cagctgaggaccaaactg

SEQ ID NO: 9123898 - DNA, 22 bp, Homo sapiens
gtggccataggaggtcagatga

SEQ ID NO: 9123899 - DNA, 22 bp, Homo sapiens
gtggccatacatgtccatatta

SEQ ID NO: 9123900 - DNA, 22 bp, Homo sapiens
gtggccatataattttcttgaa

SEQ ID NO: 9123901 - DNA, 22 bp, Homo sapiens
gtggccaggccgactgccaggc

SEQ ID NO: 9123902 - DNA, 22 bp, Homo sapiens
gtggccatgttgctttcctttg

SEQ ID NO: 9123903 - DNA, 22 bp, Homo sapiens
cagctggcgcctggggaccaga

SEQ ID NO: 9123904 - DNA, 22 bp, Homo sapiens
cagctgctgtaacagaatactt

SEQ ID NO: 9123905 - DNA, 22 bp, Homo sapiens
cagctgcctgtattgtcctcat

SEQ ID NO: 9123906 - DNA, 22 bp, Homo sapiens
cagctgcctatgacctagcctc

SEQ ID NO: 9123907 - DNA, 22 bp, Homo sapiens
cagctgcccctccagggctggg

SEQ ID NO: 9123908 - DNA, 22 bp, Homo sapiens
gtgtgctgttgttcaggtagaa

SEQ ID NO: 9123909 - DNA, 22 bp, Homo sapiens
gtggtaaaatgtgaaatggatt

SEQ ID NO: 9123910 - DNA, 22 bp, Homo sapiens
gtggtaaagctgattgaattga

SEQ ID NO: 9123911 - DNA, 22 bp, Homo sapiens
gtgtatctcatgttcttctctg

SEQ ID NO: 9123912 - DNA, 22 bp, Homo sapiens
ccagcgactgtgacctcagcta

SEQ ID NO: 9123913 - DNA, 22 bp, Homo sapiens
ccagccttcacctgctctggtc

SEQ ID NO: 9123914 - DNA, 22 bp, Homo sapiens
tctgataacaaccatgtctggc

SEQ ID NO: 9123915 - DNA, 22 bp, Homo sapiens
ccagatgtatgtatgagtgcat

SEQ ID NO: 9123916 - DNA, 22 bp, Homo sapiens
tctgaaatctaatgctctgtgg

SEQ ID NO: 9123917 - DNA, 22 bp, Homo sapiens
tctgtggcacgattgcactgca

SEQ ID NO: 9123918 - DNA, 20 bp, Homo sapiens
tctgtggcaggtggcgcttg

SEQ ID NO: 9123919 - DNA, 21 bp, Homo sapiens
tctgtggcagcatgatgaggt

SEQ ID NO: 9123920 - DNA, 18 bp, Homo sapiens
tctgtggcagcagtgcac

SEQ ID NO: 9123921 - DNA, 22 bp, Homo sapiens
tctgtggcaaacacagtgacca

SEQ ID NO: 9123922 - DNA, 19 bp, Homo sapiens
tctgtggcacctgggaggg

SEQ ID NO: 9123923 - DNA, 22 bp, Homo sapiens
tctggctgttttagatgagctc

SEQ ID NO: 9123924 - DNA, 22 bp, Homo sapiens
tctggctgttaggcctgacctt

SEQ ID NO: 9123925 - DNA, 23 bp, Homo sapiens
ccaattcagatattggcttgtgc

SEQ ID NO: 9123926 - DNA, 22 bp, Homo sapiens
ccaattcatcctctggggcttc

SEQ ID NO: 9123927 - DNA, 22 bp, Homo sapiens
ccacaagactctgtcagcataa

SEQ ID NO: 9123928 - DNA, 23 bp, Homo sapiens
tcctcccaaatttcagcctcatt

SEQ ID NO: 9123929 - DNA, 22 bp, Homo sapiens
tcctcccacataggacaatggg

SEQ ID NO: 9123930 - DNA, 22 bp, Homo sapiens
tcctcccaacttttccatctca

SEQ ID NO: 9123931 - DNA, 20 bp, Homo sapiens
tcctcccccacctttgcagc

SEQ ID NO: 9123932 - DNA, 22 bp, Homo sapiens
tcctccccaaagcccagcctgg

SEQ ID NO: 9123933 - DNA, 18 bp, Homo sapiens
ccacagcagagttcttac

SEQ ID NO: 9123934 - DNA, 22 bp, Homo sapiens
ccacagcatgcaggcctgacac

SEQ ID NO: 9123935 - DNA, 22 bp, Homo sapiens
tccctgctgagagtgctctccc

SEQ ID NO: 9123936 - DNA, 19 bp, Homo sapiens
ccaaaagcaattccaagta

SEQ ID NO: 9123937 - DNA, 22 bp, Homo sapiens
ccaaaagcagctgtctgtgaat

SEQ ID NO: 9123938 - DNA, 22 bp, Homo sapiens
catttgaacctggatgttctta

SEQ ID NO: 9123939 - DNA, 22 bp, Homo sapiens
catttacacttctaaccacaag

SEQ ID NO: 9123940 - DNA, 22 bp, Homo sapiens
tcccagggccgcaaacgagttt

SEQ ID NO: 9123941 - DNA, 22 bp, Homo sapiens
tcccagggctctagagtgctgg

SEQ ID NO: 9123942 - DNA, 22 bp, Homo sapiens
tcccagggtcagtggtgaggcc

SEQ ID NO: 9123943 - DNA, 21 bp, Homo sapiens
tctccagtgcttctgcctctt

SEQ ID NO: 9123944 - DNA, 21 bp, Homo sapiens
tctccagtatccttctctgag

SEQ ID NO: 9123945 - DNA, 22 bp, Homo sapiens
tctctagggatctgttttaatt

SEQ ID NO: 9123946 - DNA, 22 bp, Homo sapiens
tctctaggggagccccgtttgt

SEQ ID NO: 9123947 - DNA, 22 bp, Homo sapiens
tcctggggagggttctggctcc

SEQ ID NO: 9123948 - DNA, 16 bp, Homo sapiens
ccacctgcagctctca

SEQ ID NO: 9123949 - DNA, 22 bp, Homo sapiens
ccactctgattggtcacctctg

SEQ ID NO: 9123950 - DNA, 20 bp, Homo sapiens
ccagaagcactcttcatgtt

SEQ ID NO: 9123951 - DNA, 22 bp, Homo sapiens
ccagaagcttctacacaggaga

SEQ ID NO: 9123952 - DNA, 22 bp, Homo sapiens
caggtctccattttgatgagtt

SEQ ID NO: 9123953 - DNA, 22 bp, Homo sapiens
caggtctccattttgatgagtt

SEQ ID NO: 9123954 - DNA, 22 bp, Homo sapiens
cagtctccgccagctcctcaca

SEQ ID NO: 9123955 - DNA, 22 bp, Homo sapiens
cagtcctctcactcaggccttt

SEQ ID NO: 9123956 - DNA, 22 bp, Homo sapiens
tcagaaatgatcgttattcatt

SEQ ID NO: 9123957 - DNA, 22 bp, Homo sapiens
tcagaaatactatcagcttttg

SEQ ID NO: 9123958 - DNA, 22 bp, Homo sapiens
tcaccaggctggaatgcagtgg

SEQ ID NO: 9123959 - DNA, 22 bp, Homo sapiens
tcaccaggctagagtgcagtgg

SEQ ID NO: 9123960 - DNA, 22 bp, Homo sapiens
tcacattgattacattccatgt

SEQ ID NO: 9123961 - DNA, 22 bp, Homo sapiens
tcaccagggagcttgtcctctg

SEQ ID NO: 9123962 - DNA, 22 bp, Homo sapiens
tcaccagggctccagccagcct

SEQ ID NO: 9123963 - DNA, 22 bp, Homo sapiens
tcaccaggctggagtgcagtgg

SEQ ID NO: 9123964 - DNA, 19 bp, Homo sapiens
cagtgcccaccctagcaca

SEQ ID NO: 9123965 - DNA, 22 bp, Homo sapiens
cagtgcccaagatgtgccatgc

SEQ ID NO: 9123966 - DNA, 22 bp, Homo sapiens
catccaggcaccacaaccagct

SEQ ID NO: 9123967 - DNA, 22 bp, Homo sapiens
catccagggcagccatggcctg

SEQ ID NO: 9123968 - DNA, 22 bp, Homo sapiens
tcatgtcccgttgctggctgcc

SEQ ID NO: 9123969 - DNA, 22 bp, Homo sapiens
catggccagccctgaggttcag

SEQ ID NO: 9123970 - DNA, 22 bp, Homo sapiens
catggctgaggcagaggactga

SEQ ID NO: 9123971 - DNA, 22 bp, Homo sapiens
catggctgcgagaagagtgggt

SEQ ID NO: 9123972 - DNA, 22 bp, Homo sapiens
tctgactagggacttggtgtat

SEQ ID NO: 9123973 - DNA, 22 bp, Homo sapiens
tctgacaggttgggatatggaa

SEQ ID NO: 9123974 - DNA, 22 bp, Homo sapiens
tctgacagttatataagcacca

SEQ ID NO: 9123975 - DNA, 22 bp, Homo sapiens
tctgacagagaaggctcagcag

SEQ ID NO: 9123976 - DNA, 22 bp, Homo sapiens
tctgacagaggtggtagataca

SEQ ID NO: 9123977 - DNA, 22 bp, Homo sapiens
tctgagacaacttagccctcga

SEQ ID NO: 9123978 - DNA, 22 bp, Homo sapiens
tctgagcagagcatcatttcag

SEQ ID NO: 9123979 - DNA, 22 bp, Homo sapiens
tctgggagggctggttcagtat

SEQ ID NO: 9123980 - DNA, 22 bp, Homo sapiens
tctgggagggagcctcagaatc

SEQ ID NO: 9123981 - DNA, 22 bp, Homo sapiens
tctgggccctaaaccagctcta

SEQ ID NO: 9123982 - DNA, 21 bp, Homo sapiens
tctgggcccatgctgcctcac

SEQ ID NO: 9123983 - DNA, 23 bp, Homo sapiens
tctgggccacttgtctgcacttc

SEQ ID NO: 9123984 - DNA, 22 bp, Homo sapiens
tctgggagttagaatacatggg

SEQ ID NO: 9123985 - DNA, 22 bp, Homo sapiens
tctggctgaaaggggctgtgcc

SEQ ID NO: 9123986 - DNA, 22 bp, Homo sapiens
tctggctgaattagccttgggt

SEQ ID NO: 9123987 - DNA, 22 bp, Homo sapiens
tctggctctgtgtccccaccca

SEQ ID NO: 9123988 - DNA, 22 bp, Homo sapiens
tctggctctgtgtcctcaccca

SEQ ID NO: 9123989 - DNA, 22 bp, Homo sapiens
tctggctctataactcctagct

SEQ ID NO: 9123990 - DNA, 22 bp, Homo sapiens
tctggctgggctgacattgaac

SEQ ID NO: 9123991 - DNA, 22 bp, Homo sapiens
tctggctgattccctgggactg

SEQ ID NO: 9123992 - DNA, 22 bp, Homo sapiens
tctggctggctcggccgggagt

SEQ ID NO: 9123993 - DNA, 23 bp, Homo sapiens
tctggctgctcctttcaatgctc

SEQ ID NO: 9123994 - DNA, 22 bp, Homo sapiens
tctggagagcagatgcctctgg

SEQ ID NO: 9123995 - DNA, 22 bp, Homo sapiens
tctggaataaccctgcttccaa

SEQ ID NO: 9123996 - DNA, 22 bp, Homo sapiens
tctggactaatattctggctgc

SEQ ID NO: 9123997 - DNA, 22 bp, Homo sapiens
tctggactccatgctgcctgga

SEQ ID NO: 9123998 - DNA, 22 bp, Homo sapiens
tctggaggggtttagagggaca

SEQ ID NO: 9123999 - DNA, 22 bp, Homo sapiens
tctggccactaataggtctcac

SEQ ID NO: 9124000 - DNA, 22 bp, Homo sapiens
tctgtctcaagttcttgcactc

SEQ ID NO: 9124001 - DNA, 22 bp, Homo sapiens
tctgtctcctctgaggtgccag

SEQ ID NO: 9124002 - DNA, 22 bp, Homo sapiens
tctgtcattttgtatctacatg

SEQ ID NO: 9124003 - DNA, 22 bp, Homo sapiens
tctgtcattgcaataaaatttc

SEQ ID NO: 9124004 - DNA, 22 bp, Homo sapiens
tctgggtcggaagccccaggga

SEQ ID NO: 9124005 - DNA, 20 bp, Homo sapiens
tctgttattattacattgcc

SEQ ID NO: 9124006 - DNA, 22 bp, Homo sapiens
tcttatatgcacatacattggg

SEQ ID NO: 9124007 - DNA, 22 bp, Homo sapiens
tctgtggctttcttatgttgta

SEQ ID NO: 9124008 - DNA, 22 bp, Homo sapiens
tctgtggcttcctatttcttgg

SEQ ID NO: 9124009 - DNA, 22 bp, Homo sapiens
tctgtggcttctatttaacttt

SEQ ID NO: 9124010 - DNA, 22 bp, Homo sapiens
tctgtggcttgggcctgcctgt

SEQ ID NO: 9124011 - DNA, 22 bp, Homo sapiens
tctgtggctttcgtgtaagatg

SEQ ID NO: 9124012 - DNA, 22 bp, Homo sapiens
tctgtgctagcacgcagcaagg

SEQ ID NO: 9124013 - DNA, 23 bp, Homo sapiens
tctgtggctccttcaggctgctg

SEQ ID NO: 9124014 - DNA, 22 bp, Homo sapiens
tctgtggctggtaattgcatgt

SEQ ID NO: 9124015 - DNA, 22 bp, Homo sapiens
tctgtggctggagaacttgtct

SEQ ID NO: 9124016 - DNA, 19 bp, Homo sapiens
tctgtggctgtggggagga

SEQ ID NO: 9124017 - DNA, 22 bp, Homo sapiens
tctgtggctgtgctgggccaga

SEQ ID NO: 9124018 - DNA, 22 bp, Homo sapiens
tctgtggctgttatctttatat

SEQ ID NO: 9124019 - DNA, 22 bp, Homo sapiens
tctgtggctgtctttccagagg

SEQ ID NO: 9124020 - DNA, 22 bp, Homo sapiens
tctgtgcctgcttccccaccca

SEQ ID NO: 9124021 - DNA, 22 bp, Homo sapiens
tctgtgccatcagtctccagag

SEQ ID NO: 9124022 - DNA, 22 bp, Homo sapiens
tcttccagcttctggtggctgc

SEQ ID NO: 9124023 - DNA, 22 bp, Homo sapiens
tcttccaggacctggggctcca

SEQ ID NO: 9124024 - DNA, 22 bp, Homo sapiens
tcttccagctccccacggtgtc

SEQ ID NO: 9124025 - DNA, 22 bp, Homo sapiens
tcttccagcttctagaggatgc

SEQ ID NO: 9124026 - DNA, 22 bp, Homo sapiens
tcttcctccctacagagctcag

SEQ ID NO: 9124027 - DNA, 22 bp, Homo sapiens
tcttccagatgcagatgcttct

SEQ ID NO: 9124028 - DNA, 22 bp, Homo sapiens
tcttcagtgcatgttacctata

SEQ ID NO: 9124029 - DNA, 22 bp, Homo sapiens
tcttcagtaggtcctcagaatc

SEQ ID NO: 9124030 - DNA, 22 bp, Homo sapiens
tcttcatgtcttgcctgatata

SEQ ID NO: 9124031 - DNA, 22 bp, Homo sapiens
tcttcaaagaagccttggatta

SEQ ID NO: 9124032 - DNA, 22 bp, Homo sapiens
tcttattgtctagattgagatg

SEQ ID NO: 9124033 - DNA, 22 bp, Homo sapiens
tctttccagaggaatttttaga

SEQ ID NO: 9124034 - DNA, 22 bp, Homo sapiens
tctttcctaggtgatatgcaat

SEQ ID NO: 9124035 - DNA, 22 bp, Homo sapiens
tctttctgtaagctccatggaa

SEQ ID NO: 9124036 - DNA, 21 bp, Homo sapiens
tctttctgaaatctcagtctg

SEQ ID NO: 9124037 - DNA, 22 bp, Homo sapiens
tctttctgaatatttgacctca

SEQ ID NO: 9124038 - DNA, 22 bp, Homo sapiens
tctttctggtctcgccttattc

SEQ ID NO: 9124039 - DNA, 22 bp, Homo sapiens
tctttctgcagcacaggggcag

SEQ ID NO: 9124040 - DNA, 22 bp, Homo sapiens
tctttctggttatgtatagaga

SEQ ID NO: 9124041 - DNA, 22 bp, Homo sapiens
tctttctgatgggaagggtcaa

SEQ ID NO: 9124042 - DNA, 22 bp, Homo sapiens
tctttctgcacttagtggggct

SEQ ID NO: 9124043 - DNA, 21 bp, Homo sapiens
tcttgggataaacttcaagaa

SEQ ID NO: 9124044 - DNA, 22 bp, Homo sapiens
tctttaatgtactttctttcac

SEQ ID NO: 9124045 - DNA, 22 bp, Homo sapiens
tcttggaagggttgtgggatga

SEQ ID NO: 9124046 - DNA, 22 bp, Homo sapiens
tccttagcacccaccaaggact

SEQ ID NO: 9124047 - DNA, 22 bp, Homo sapiens
tccttggaagagcattcccagg

SEQ ID NO: 9124048 - DNA, 22 bp, Homo sapiens
tcctttgcttctgtcattctcc

SEQ ID NO: 9124049 - DNA, 21 bp, Homo sapiens
tccttgggcagtgcccagctt

SEQ ID NO: 9124050 - DNA, 22 bp, Homo sapiens
tcgttttaccaaattgaatgtt

SEQ ID NO: 9124051 - DNA, 22 bp, Homo sapiens
tctacagaaactggctactctc

SEQ ID NO: 9124052 - DNA, 22 bp, Homo sapiens
tctacagagagcaaacattcta

SEQ ID NO: 9124053 - DNA, 22 bp, Homo sapiens
tctagacaatgcactgtaagga

SEQ ID NO: 9124054 - DNA, 22 bp, Homo sapiens
tctactgccacttaagacattt

SEQ ID NO: 9124055 - DNA, 22 bp, Homo sapiens
tctagggtgtgcggcagggcta

SEQ ID NO: 9124056 - DNA, 22 bp, Homo sapiens
tctagggtgatgattcaggatg

SEQ ID NO: 9124057 - DNA, 20 bp, Homo sapiens
tctagggtggctgtagcagc

SEQ ID NO: 9124058 - DNA, 22 bp, Homo sapiens
tctcaaggaaaagtgatggcat

SEQ ID NO: 9124059 - DNA, 22 bp, Homo sapiens
tcctggggtgtgttttgctgct

SEQ ID NO: 9124060 - DNA, 21 bp, Homo sapiens
tcctgtgaggacctgtcagtg

SEQ ID NO: 9124061 - DNA, 22 bp, Homo sapiens
tcctgtgatggcttgcgatgtg

SEQ ID NO: 9124062 - DNA, 22 bp, Homo sapiens
tcctgtgaagaatagcactcaa

SEQ ID NO: 9124063 - DNA, 22 bp, Homo sapiens
tcctgtgagcagcacagagaca

SEQ ID NO: 9124064 - DNA, 22 bp, Homo sapiens
tcctgggcacaagtgagtctcc

SEQ ID NO: 9124065 - DNA, 22 bp, Homo sapiens
tcctgggcagcctctctggaag

SEQ ID NO: 9124066 - DNA, 22 bp, Homo sapiens
tcctgggccaagggctgtgagg

SEQ ID NO: 9124067 - DNA, 22 bp, Homo sapiens
tcctgggcggttatgtgatctg

SEQ ID NO: 9124068 - DNA, 22 bp, Homo sapiens
tcctgggcgattttctgaatat

SEQ ID NO: 9124069 - DNA, 22 bp, Homo sapiens
tcctggagaaactcagagatct

SEQ ID NO: 9124070 - DNA, 22 bp, Homo sapiens
tcctggagataattgcagtgaa

SEQ ID NO: 9124071 - DNA, 22 bp, Homo sapiens
tcctggagaatggacaatgcac

SEQ ID NO: 9124072 - DNA, 22 bp, Homo sapiens
tcctggagggaggcggtgctac

SEQ ID NO: 9124073 - DNA, 22 bp, Homo sapiens
tcctggctcctggagacctgct

SEQ ID NO: 9124074 - DNA, 22 bp, Homo sapiens
tcctggcctccgttctctgcat

SEQ ID NO: 9124075 - DNA, 22 bp, Homo sapiens
tcctggagttgtctgtactcat

SEQ ID NO: 9124076 - DNA, 22 bp, Homo sapiens
tcctggagttgtgcagtgcaca

SEQ ID NO: 9124077 - DNA, 22 bp, Homo sapiens
tctctcagaggccagggtcctg

SEQ ID NO: 9124078 - DNA, 22 bp, Homo sapiens
tctctcagatggggcactagta

SEQ ID NO: 9124079 - DNA, 22 bp, Homo sapiens
tctctcaggaggcaggttccta

SEQ ID NO: 9124080 - DNA, 22 bp, Homo sapiens
tctctcaacctcggcactattg

SEQ ID NO: 9124081 - DNA, 22 bp, Homo sapiens
tctctggactcgagcttactca

SEQ ID NO: 9124082 - DNA, 22 bp, Homo sapiens
tctctggcagacacctccctga

SEQ ID NO: 9124083 - DNA, 22 bp, Homo sapiens
tctctggcactcccttatggct

SEQ ID NO: 9124084 - DNA, 22 bp, Homo sapiens
tctctggccgagagtccctggg

SEQ ID NO: 9124085 - DNA, 22 bp, Homo sapiens
tctctggctgatattcctctgc

SEQ ID NO: 9124086 - DNA, 22 bp, Homo sapiens
tctcttaattgtaatggttcct

SEQ ID NO: 9124087 - DNA, 22 bp, Homo sapiens
tctctgtggcaagcatgctgct

SEQ ID NO: 9124088 - DNA, 20 bp, Homo sapiens
tctcttttagcttacagctg

SEQ ID NO: 9124089 - DNA, 22 bp, Homo sapiens
tctcttttatgtacaccctgac

SEQ ID NO: 9124090 - DNA, 18 bp, Homo sapiens
tctcttttcccctcattg

SEQ ID NO: 9124091 - DNA, 22 bp, Homo sapiens
tctcttttctttctggataaaa

SEQ ID NO: 9124092 - DNA, 18 bp, Homo sapiens
tctgaaagcccttttcca

SEQ ID NO: 9124093 - DNA, 20 bp, Homo sapiens
tctcagggttcagcaaagta

SEQ ID NO: 9124094 - DNA, 22 bp, Homo sapiens
tctcagggtgaggaaagaattt

SEQ ID NO: 9124095 - DNA, 22 bp, Homo sapiens
tctcagtccaaatgagaggttg

SEQ ID NO: 9124096 - DNA, 23 bp, Homo sapiens
tctccaggccttactccaggcct

SEQ ID NO: 9124097 - DNA, 22 bp, Homo sapiens
tctcagagtgacaatgagaatt

SEQ ID NO: 9124098 - DNA, 22 bp, Homo sapiens
tctcagcaaggaaagaggcagg

SEQ ID NO: 9124099 - DNA, 22 bp, Homo sapiens
tctcagcagggccatcctgagc

SEQ ID NO: 9124100 - DNA, 22 bp, Homo sapiens
tctcagcaacgatccggagtaa

SEQ ID NO: 9124101 - DNA, 22 bp, Homo sapiens
tctcagagtttagagctgagcc

SEQ ID NO: 9124102 - DNA, 22 bp, Homo sapiens
tctcagcagccagatccagagc

SEQ ID NO: 9124103 - DNA, 22 bp, Homo sapiens
tctcactgatttgagaccaagg

SEQ ID NO: 9124104 - DNA, 22 bp, Homo sapiens
tctcactgcaaatattatgtat

SEQ ID NO: 9124105 - DNA, 22 bp, Homo sapiens
tctcactgggtcacagcagagg

SEQ ID NO: 9124106 - DNA, 22 bp, Homo sapiens
tctcagaaaaaggagaaactgg

SEQ ID NO: 9124107 - DNA, 22 bp, Homo sapiens
tctcacatgcaaacagtccaca

SEQ ID NO: 9124108 - DNA, 22 bp, Homo sapiens
tctccagggaggtagcccagtg

SEQ ID NO: 9124109 - DNA, 22 bp, Homo sapiens
tctcccctagtgcattaaagtg

SEQ ID NO: 9124110 - DNA, 22 bp, Homo sapiens
tctcccctactctaaatctgca

SEQ ID NO: 9124111 - DNA, 22 bp, Homo sapiens
tctctagttgaggactgagcag

SEQ ID NO: 9124112 - DNA, 22 bp, Homo sapiens
tctcgggtttaggtgatagtat

SEQ ID NO: 9124113 - DNA, 22 bp, Homo sapiens
tctcgggtcatgatttccatca

SEQ ID NO: 9124114 - DNA, 22 bp, Homo sapiens
tctcgctctgtcgcccaggctg

SEQ ID NO: 9124115 - DNA, 22 bp, Homo sapiens
tctcctgatatctgcagaccta

SEQ ID NO: 9124116 - DNA, 22 bp, Homo sapiens
tctcctccagaggctgtgggga

SEQ ID NO: 9124117 - DNA, 23 bp, Homo sapiens
tctcctcctagatacagtcatgg

SEQ ID NO: 9124118 - DNA, 22 bp, Homo sapiens
tgcattgagaatttctcaggga

SEQ ID NO: 9124119 - DNA, 19 bp, Homo sapiens
tgcattgagggctgtctca

SEQ ID NO: 9124120 - DNA, 23 bp, Homo sapiens
tgccagaggcagtcacagtggtg

SEQ ID NO: 9124121 - DNA, 23 bp, Homo sapiens
tgccacccttctcttcccagctt

SEQ ID NO: 9124122 - DNA, 22 bp, Homo sapiens
tgccaccccggcccagagagca

SEQ ID NO: 9124123 - DNA, 22 bp, Homo sapiens
tgccaccctctctgctacccgc

SEQ ID NO: 9124124 - DNA, 22 bp, Homo sapiens
tgccacccctctgcaccctcag

SEQ ID NO: 9124125 - DNA, 22 bp, Homo sapiens
tgcattccacacccatagagat

SEQ ID NO: 9124126 - DNA, 22 bp, Homo sapiens
tgcaggtgaaaattatgaggat

SEQ ID NO: 9124127 - DNA, 22 bp, Homo sapiens
tgcaggtggtacttctttttct

SEQ ID NO: 9124128 - DNA, 22 bp, Homo sapiens
tgcccctcttgctggccctgtc

SEQ ID NO: 9124129 - DNA, 18 bp, Homo sapiens
tgcctggaaggaacagga

SEQ ID NO: 9124130 - DNA, 22 bp, Homo sapiens
tgcctcctctttgccaaggtca

SEQ ID NO: 9124131 - DNA, 22 bp, Homo sapiens
tgcctccttcaggagggcccgg

SEQ ID NO: 9124132 - DNA, 22 bp, Homo sapiens
tgcctctgctgcatattcacct

SEQ ID NO: 9124133 - DNA, 22 bp, Homo sapiens
tgcctctggttatctggtacct

SEQ ID NO: 9124134 - DNA, 22 bp, Homo sapiens
tgcctctgggtgaccaaggagc

SEQ ID NO: 9124135 - DNA, 22 bp, Homo sapiens
tgcctctgtgggcagagctgcc

SEQ ID NO: 9124136 - DNA, 19 bp, Homo sapiens
tgcccaggccaggttgggc

SEQ ID NO: 9124137 - DNA, 22 bp, Homo sapiens
tgccccctggtggccagagccg

SEQ ID NO: 9124138 - DNA, 22 bp, Homo sapiens
tgcccctctcctgtgatccaag

SEQ ID NO: 9124139 - DNA, 22 bp, Homo sapiens
tgcccccttttcttgttacact

SEQ ID NO: 9124140 - DNA, 22 bp, Homo sapiens
tgcccaagtcctccaccgaggt

SEQ ID NO: 9124141 - DNA, 22 bp, Homo sapiens
tgcaccaagcccagctggagaa

SEQ ID NO: 9124142 - DNA, 18 bp, Homo sapiens
tgcaccctaagggcccca

SEQ ID NO: 9124143 - DNA, 22 bp, Homo sapiens
tgattaaaatttaacttagtta

SEQ ID NO: 9124144 - DNA, 22 bp, Homo sapiens
tgatgtctagtacatacaagag

SEQ ID NO: 9124145 - DNA, 22 bp, Homo sapiens
tgatggtcaggatgcatggaga

SEQ ID NO: 9124146 - DNA, 23 bp, Homo sapiens
tgatgcagtaaattggtctctaa

SEQ ID NO: 9124147 - DNA, 22 bp, Homo sapiens
tgatgcagaatcctagagtgtc

SEQ ID NO: 9124148 - DNA, 22 bp, Homo sapiens
tgatggcctttttcaccaggct

SEQ ID NO: 9124149 - DNA, 22 bp, Homo sapiens
tgatggctatccctggaagggc

SEQ ID NO: 9124150 - DNA, 22 bp, Homo sapiens
tgatggctcccatgggcatatg

SEQ ID NO: 9124151 - DNA, 22 bp, Homo sapiens
tgatggctcatgtttggggatg

SEQ ID NO: 9124152 - DNA, 22 bp, Homo sapiens
tgatggcttagtggcagggcga

SEQ ID NO: 9124153 - DNA, 22 bp, Homo sapiens
tgatggcttatggagagagcaa

SEQ ID NO: 9124154 - DNA, 22 bp, Homo sapiens
tgatctggtcctactgtgggca

SEQ ID NO: 9124155 - DNA, 22 bp, Homo sapiens
tgcaaattcaaacattttcctg

SEQ ID NO: 9124156 - DNA, 22 bp, Homo sapiens
tgcaaatttgacttcacacatc

SEQ ID NO: 9124157 - DNA, 22 bp, Homo sapiens
tgcaatttcaggcatatattgt

SEQ ID NO: 9124158 - DNA, 22 bp, Homo sapiens
tgagaaagcctttagtcccagg

SEQ ID NO: 9124159 - DNA, 22 bp, Homo sapiens
tgagagagcgcctgggatcatt

SEQ ID NO: 9124160 - DNA, 20 bp, Homo sapiens
tgagagctgggcagggatac

SEQ ID NO: 9124161 - DNA, 22 bp, Homo sapiens
tgagccaggctccatgccacct

SEQ ID NO: 9124162 - DNA, 22 bp, Homo sapiens
tgagccaggctcaagtgatcct

SEQ ID NO: 9124163 - DNA, 20 bp, Homo sapiens
tgagccaggctaggaagggc

SEQ ID NO: 9124164 - DNA, 22 bp, Homo sapiens
tgagccagcaggcctccagtgg

SEQ ID NO: 9124165 - DNA, 22 bp, Homo sapiens
tgagccagataagggctcacgc

SEQ ID NO: 9124166 - DNA, 22 bp, Homo sapiens
tgagccacagtgagagctcctg

SEQ ID NO: 9124167 - DNA, 22 bp, Homo sapiens
tgagctggtcttgagtgtagct

SEQ ID NO: 9124168 - DNA, 20 bp, Homo sapiens
tgagccagtcaagctacatt

SEQ ID NO: 9124169 - DNA, 22 bp, Homo sapiens
tgaggccaactagggagatgga

SEQ ID NO: 9124170 - DNA, 22 bp, Homo sapiens
tgaggcaggagttcaggctgcg

SEQ ID NO: 9124171 - DNA, 22 bp, Homo sapiens
tgagggtgggcctgcaggaaga

SEQ ID NO: 9124172 - DNA, 22 bp, Homo sapiens
tgagggagctgacctttctgtg

SEQ ID NO: 9124173 - DNA, 23 bp, Homo sapiens
tgaaagttctgaagagatcatgc

SEQ ID NO: 9124174 - DNA, 22 bp, Homo sapiens
tgaaatacacaaatttagtaag

SEQ ID NO: 9124175 - DNA, 22 bp, Homo sapiens
tgaaatgtaagcatagaggttg

SEQ ID NO: 9124176 - DNA, 22 bp, Homo sapiens
tgaaatgtgtaatgtggatgcc

SEQ ID NO: 9124177 - DNA, 22 bp, Homo sapiens
tgaaatgttaatcacacaaagg

SEQ ID NO: 9124178 - DNA, 22 bp, Homo sapiens
tgaaatgttctggagtttctgt

SEQ ID NO: 9124179 - DNA, 22 bp, Homo sapiens
tgaaatgtctcacttagacttt

SEQ ID NO: 9124180 - DNA, 22 bp, Homo sapiens
tgaaatgtctttgcaattgaaa

SEQ ID NO: 9124181 - DNA, 22 bp, Homo sapiens
tgaacagtgtatctagatcatg

SEQ ID NO: 9124182 - DNA, 22 bp, Homo sapiens
tgaacagtgggcatgtgaagac

SEQ ID NO: 9124183 - DNA, 22 bp, Homo sapiens
tgaacagtggttcatgtcacgg

SEQ ID NO: 9124184 - DNA, 22 bp, Homo sapiens
tgaacagttactttgtagaaga

SEQ ID NO: 9124185 - DNA, 22 bp, Homo sapiens
tctttgcatcccttccatagtt

SEQ ID NO: 9124186 - DNA, 22 bp, Homo sapiens
tctttgcactgtgcaagcagaa

SEQ ID NO: 9124187 - DNA, 22 bp, Homo sapiens
tctttgcaaaatacaacaatgg

SEQ ID NO: 9124188 - DNA, 20 bp, Homo sapiens
tcttttattggcagatcctg

SEQ ID NO: 9124189 - DNA, 22 bp, Homo sapiens
tcttttattaggctgaaatggg

SEQ ID NO: 9124190 - DNA, 22 bp, Homo sapiens
tcttttatctgttgtgtaacaa

SEQ ID NO: 9124191 - DNA, 22 bp, Homo sapiens
tcttttatcctacatttagctc

SEQ ID NO: 9124192 - DNA, 22 bp, Homo sapiens
tcttttatagtgaattttcttg

SEQ ID NO: 9124193 - DNA, 22 bp, Homo sapiens
tcttttaaaagccctgctgtct

SEQ ID NO: 9124194 - DNA, 22 bp, Homo sapiens
tgaatttatcaaagattcttaa

SEQ ID NO: 9124195 - DNA, 22 bp, Homo sapiens
tgaatttaagcactgatgttaa

SEQ ID NO: 9124196 - DNA, 22 bp, Homo sapiens
tgaatgtgatgctaaacatatg

SEQ ID NO: 9124197 - DNA, 22 bp, Homo sapiens
tgaatgttgatatgagtacaga

SEQ ID NO: 9124198 - DNA, 22 bp, Homo sapiens
tgacagcagcatagtgagcaat

SEQ ID NO: 9124199 - DNA, 22 bp, Homo sapiens
tgacagcatgaccacagggtct

SEQ ID NO: 9124200 - DNA, 21 bp, Homo sapiens
tgacacccagagcctcctccc

SEQ ID NO: 9124201 - DNA, 23 bp, Homo sapiens
tgacaccctcattgtgtgtcgca

SEQ ID NO: 9124202 - DNA, 22 bp, Homo sapiens
tgacacccattatctgtgtgac

SEQ ID NO: 9124203 - DNA, 19 bp, Homo sapiens
tgacttcctcacttagcat

SEQ ID NO: 9124204 - DNA, 22 bp, Homo sapiens
tgacttgtctctttgggagaca

SEQ ID NO: 9124205 - DNA, 22 bp, Homo sapiens
tggctgcagttcacaggagcaa

SEQ ID NO: 9124206 - DNA, 22 bp, Homo sapiens
tggctgagttctccaggagtag

SEQ ID NO: 9124207 - DNA, 21 bp, Homo sapiens
tggctgcaagcagctgcctcc

SEQ ID NO: 9124208 - DNA, 22 bp, Homo sapiens
tggctcagttccatcatctgga

SEQ ID NO: 9124209 - DNA, 22 bp, Homo sapiens
tggctcagcattcactggtctt

SEQ ID NO: 9124210 - DNA, 22 bp, Homo sapiens
tggctcagcttacttttgaggg

SEQ ID NO: 9124211 - DNA, 21 bp, Homo sapiens
tggctaaaccctagtaaatta

SEQ ID NO: 9124212 - DNA, 23 bp, Homo sapiens
tggctaaacagtggagaaagctt

SEQ ID NO: 9124213 - DNA, 22 bp, Homo sapiens
tgggacacaaaccagaccagga

SEQ ID NO: 9124214 - DNA, 22 bp, Homo sapiens
tgggacacacaaggtcagctct

SEQ ID NO: 9124215 - DNA, 22 bp, Homo sapiens
tgggacaccctcacgcctgcac

SEQ ID NO: 9124216 - DNA, 22 bp, Homo sapiens
tgggacacagtgtgtgaagtgc

SEQ ID NO: 9124217 - DNA, 22 bp, Homo sapiens
tgggacatctgtgaagctgaat

SEQ ID NO: 9124218 - DNA, 22 bp, Homo sapiens
tgggaccagataaagggaggtc

SEQ ID NO: 9124219 - DNA, 21 bp, Homo sapiens
tgggagagggctcagctaccc

SEQ ID NO: 9124220 - DNA, 22 bp, Homo sapiens
tgggagatggttctgagacttt

SEQ ID NO: 9124221 - DNA, 22 bp, Homo sapiens
tgggagatgctcattctatgtt

SEQ ID NO: 9124222 - DNA, 22 bp, Homo sapiens
tgggagcaaatgactgggagat

SEQ ID NO: 9124223 - DNA, 22 bp, Homo sapiens
tgggagcaagctacttagggaa

SEQ ID NO: 9124224 - DNA, 22 bp, Homo sapiens
tgggagcaccctgaggagcttc

SEQ ID NO: 9124225 - DNA, 22 bp, Homo sapiens
tgggagcagcctcagcttcggg

SEQ ID NO: 9124226 - DNA, 22 bp, Homo sapiens
tgggaggatcgcttgagcccag

SEQ ID NO: 9124227 - DNA, 22 bp, Homo sapiens
tgggaacattttgagctgagag

SEQ ID NO: 9124228 - DNA, 22 bp, Homo sapiens
tggctggcagtaggctagtggc

SEQ ID NO: 9124229 - DNA, 22 bp, Homo sapiens
tggctggcgccgggctagccac

SEQ ID NO: 9124230 - DNA, 22 bp, Homo sapiens
tggctggccctgggagtgcaga

SEQ ID NO: 9124231 - DNA, 22 bp, Homo sapiens
tggctggagtataggagtagga

SEQ ID NO: 9124232 - DNA, 22 bp, Homo sapiens
tggctggacagtgggcagtgga

SEQ ID NO: 9124233 - DNA, 22 bp, Homo sapiens
tggctggagggttagtgagata

SEQ ID NO: 9124234 - DNA, 22 bp, Homo sapiens
tggctgtagaatcagagacttg

SEQ ID NO: 9124235 - DNA, 22 bp, Homo sapiens
tggctgtagaacagtggatatt

SEQ ID NO: 9124236 - DNA, 22 bp, Homo sapiens
tggctgtgtccctgtccagagt

SEQ ID NO: 9124237 - DNA, 22 bp, Homo sapiens
tggctgtgtcatcatagctgtg

SEQ ID NO: 9124238 - DNA, 22 bp, Homo sapiens
tggctgtgcctctttccaggcc

SEQ ID NO: 9124239 - DNA, 22 bp, Homo sapiens
tggctgtcagctgcctggtgcg

SEQ ID NO: 9124240 - DNA, 22 bp, Homo sapiens
tggctgtgaacaaagagaataa

SEQ ID NO: 9124241 - DNA, 22 bp, Homo sapiens
tggctgtgatttgcacgagatg

SEQ ID NO: 9124242 - DNA, 22 bp, Homo sapiens
tggcaacatgtcgaagtgctgt

SEQ ID NO: 9124243 - DNA, 22 bp, Homo sapiens
tggattcacaccattctcctgc

SEQ ID NO: 9124244 - DNA, 22 bp, Homo sapiens
tggccagtcttagctgtgcctg

SEQ ID NO: 9124245 - DNA, 22 bp, Homo sapiens
tggccagccataaaagaaccca

SEQ ID NO: 9124246 - DNA, 22 bp, Homo sapiens
tggccagcagagttcactctct

SEQ ID NO: 9124247 - DNA, 22 bp, Homo sapiens
tggccagccagaaagaagcctt

SEQ ID NO: 9124248 - DNA, 22 bp, Homo sapiens
tggccagcacttagcccttacc

SEQ ID NO: 9124249 - DNA, 21 bp, Homo sapiens
tggccagctgctcgtctcctc

SEQ ID NO: 9124250 - DNA, 21 bp, Homo sapiens
tgctccttagctgcccctgcc

SEQ ID NO: 9124251 - DNA, 22 bp, Homo sapiens
tgctccctgctcagagaggcca

SEQ ID NO: 9124252 - DNA, 22 bp, Homo sapiens
tgctccaggagcaacctttgag

SEQ ID NO: 9124253 - DNA, 22 bp, Homo sapiens
tgctccaggctgctgaagatct

SEQ ID NO: 9124254 - DNA, 20 bp, Homo sapiens
tgctgaggttgacatgccca

SEQ ID NO: 9124255 - DNA, 22 bp, Homo sapiens
tgctaacaaagtctaaatcata

SEQ ID NO: 9124256 - DNA, 22 bp, Homo sapiens
tgctcagcagatctcaggagat

SEQ ID NO: 9124257 - DNA, 22 bp, Homo sapiens
tgctcagccgtgagcagagccg

SEQ ID NO: 9124258 - DNA, 22 bp, Homo sapiens
tgctcagcgccaaagctgatgg

SEQ ID NO: 9124259 - DNA, 19 bp, Homo sapiens
tgctcagctcctgtgagtc

SEQ ID NO: 9124260 - DNA, 22 bp, Homo sapiens
tgctcagctaggctgaagaaga

SEQ ID NO: 9124261 - DNA, 22 bp, Homo sapiens
tgctgtgatggagaattctgga

SEQ ID NO: 9124262 - DNA, 22 bp, Homo sapiens
tgctgggtggttgctcctcccg

SEQ ID NO: 9124263 - DNA, 22 bp, Homo sapiens
tgctgggttacctaagcctaaa

SEQ ID NO: 9124264 - DNA, 22 bp, Homo sapiens
tgctggctctaggctgagacag

SEQ ID NO: 9124265 - DNA, 22 bp, Homo sapiens
tgctggctgaggcctgagcggg

SEQ ID NO: 9124266 - DNA, 22 bp, Homo sapiens
tgctggagtgcagtggcttaac

SEQ ID NO: 9124267 - DNA, 22 bp, Homo sapiens
tgctggagctccgggctgtagg

SEQ ID NO: 9124268 - DNA, 22 bp, Homo sapiens
tgctggaagctcctgcatgtct

SEQ ID NO: 9124269 - DNA, 20 bp, Homo sapiens
tgctggaaaaagtcactcat

SEQ ID NO: 9124270 - DNA, 22 bp, Homo sapiens
tggagcccagggtgagaaggag

SEQ ID NO: 9124271 - DNA, 22 bp, Homo sapiens
tggaggccgaattagagcgttg

SEQ ID NO: 9124272 - DNA, 22 bp, Homo sapiens
tggaggccgcgtagtctgagca

SEQ ID NO: 9124273 - DNA, 22 bp, Homo sapiens
tggaggcctgggtgtgttgagc

SEQ ID NO: 9124274 - DNA, 22 bp, Homo sapiens
tggaggccggactgagaggcat

SEQ ID NO: 9124275 - DNA, 22 bp, Homo sapiens
tggaggcccacactgggtagat

SEQ ID NO: 9124276 - DNA, 22 bp, Homo sapiens
tggataaaacgttctgaaaaac

SEQ ID NO: 9124277 - DNA, 23 bp, Homo sapiens
tggataaaatacttacattcaac

SEQ ID NO: 9124278 - DNA, 22 bp, Homo sapiens
tggaacctggcattagggacac

SEQ ID NO: 9124279 - DNA, 22 bp, Homo sapiens
tgcttctgtattgaaattgtta

SEQ ID NO: 9124280 - DNA, 22 bp, Homo sapiens
tgctttctcctgtctgaaagat

SEQ ID NO: 9124281 - DNA, 22 bp, Homo sapiens
tggactcagtgctgccattccc

SEQ ID NO: 9124282 - DNA, 22 bp, Homo sapiens
tggacagcttgcagagccaccc

SEQ ID NO: 9124283 - DNA, 22 bp, Homo sapiens
tgtcacaaacatacattataga

SEQ ID NO: 9124284 - DNA, 22 bp, Homo sapiens
tgtatttcctggtttagatcaa

SEQ ID NO: 9124285 - DNA, 22 bp, Homo sapiens
tggtttctttccactctccacc

SEQ ID NO: 9124286 - DNA, 22 bp, Homo sapiens
tggttttcaacaagggcagcga

SEQ ID NO: 9124287 - DNA, 22 bp, Homo sapiens
tggttttctggtggtggcagtg

SEQ ID NO: 9124288 - DNA, 22 bp, Homo sapiens
tgtaaatcactgaactaaatga

SEQ ID NO: 9124289 - DNA, 21 bp, Homo sapiens
tggtttctaagctgtcagtct

SEQ ID NO: 9124290 - DNA, 22 bp, Homo sapiens
tggtttctgccctcagagctca

SEQ ID NO: 9124291 - DNA, 22 bp, Homo sapiens
tggtttctgggtttgtctagga

SEQ ID NO: 9124292 - DNA, 22 bp, Homo sapiens
tggtttctgtctgagttcctcc

SEQ ID NO: 9124293 - DNA, 22 bp, Homo sapiens
tggtttctcccttcgcagtgag

SEQ ID NO: 9124294 - DNA, 22 bp, Homo sapiens
tggttgcctctcagagattccg

SEQ ID NO: 9124295 - DNA, 22 bp, Homo sapiens
tggttaaatgggaagagcaaca

SEQ ID NO: 9124296 - DNA, 23 bp, Homo sapiens
tggtggggtcttggagacagcac

SEQ ID NO: 9124297 - DNA, 20 bp, Homo sapiens
tgtaacacatgagctttgag

SEQ ID NO: 9124298 - DNA, 22 bp, Homo sapiens
tgtacacaacctacagtctgct

SEQ ID NO: 9124299 - DNA, 20 bp, Homo sapiens
tgtacacagtactttacaat

SEQ ID NO: 9124300 - DNA, 22 bp, Homo sapiens
tggtgcccactccagacaccta

SEQ ID NO: 9124301 - DNA, 22 bp, Homo sapiens
tggtgcccactctggacccagc

SEQ ID NO: 9124302 - DNA, 22 bp, Homo sapiens
tggtgcccattctggtcccatg

SEQ ID NO: 9124303 - DNA, 22 bp, Homo sapiens
tggtgcccttgtgggtgagatg

SEQ ID NO: 9124304 - DNA, 22 bp, Homo sapiens
tggtgcccttgacagagccagc

SEQ ID NO: 9124305 - DNA, 21 bp, Homo sapiens
tggtggaccagtgctgggaga

SEQ ID NO: 9124306 - DNA, 22 bp, Homo sapiens
tggtggacatcccagggtgaaa

SEQ ID NO: 9124307 - DNA, 22 bp, Homo sapiens
tggtggacattctggatgtgct

SEQ ID NO: 9124308 - DNA, 23 bp, Homo sapiens
tggtctcagcctgtgagagctga

SEQ ID NO: 9124309 - DNA, 23 bp, Homo sapiens
tggtctcagcctgtgagagctga

SEQ ID NO: 9124310 - DNA, 23 bp, Homo sapiens
tggtctcacttggtaagatgaag

SEQ ID NO: 9124311 - DNA, 22 bp, Homo sapiens
tgggctcagggaagcttggcct

SEQ ID NO: 9124312 - DNA, 22 bp, Homo sapiens
tggggacatagccagtctggct

SEQ ID NO: 9124313 - DNA, 22 bp, Homo sapiens
tggggccaggtggctgcaggtc

SEQ ID NO: 9124314 - DNA, 22 bp, Homo sapiens
tggggcagagtaggattttggc

SEQ ID NO: 9124315 - DNA, 22 bp, Homo sapiens
tggggcagcagacctttcttgg

SEQ ID NO: 9124316 - DNA, 22 bp, Homo sapiens
tggggcctgtgacgggtccaga

SEQ ID NO: 9124317 - DNA, 22 bp, Homo sapiens
tggggctgaggagcctcactct

SEQ ID NO: 9124318 - DNA, 22 bp, Homo sapiens
tggggctggcacagtctctatt

SEQ ID NO: 9124319 - DNA, 22 bp, Homo sapiens
tggggctggctattgtctccct

SEQ ID NO: 9124320 - DNA, 22 bp, Homo sapiens
tgggtcccttcagctctcatgg

SEQ ID NO: 9124321 - DNA, 22 bp, Homo sapiens
tgggtccctctggagtagtaca

SEQ ID NO: 9124322 - DNA, 20 bp, Homo sapiens
tgggtccctgcagtttgaag

SEQ ID NO: 9124323 - DNA, 22 bp, Homo sapiens
tgggtccctcatgagaggcatt

SEQ ID NO: 9124324 - DNA, 22 bp, Homo sapiens
tgggtcccaatctgaaatgtca

SEQ ID NO: 9124325 - DNA, 22 bp, Homo sapiens
tgggtcccaaactcctagaggt

SEQ ID NO: 9124326 - DNA, 22 bp, Homo sapiens
tgggtcccaggaaggaccagca

SEQ ID NO: 9124327 - DNA, 21 bp, Homo sapiens
tgggtccccgacacgctacct

SEQ ID NO: 9124328 - DNA, 22 bp, Homo sapiens
tgggtgtgtccatattttgact

SEQ ID NO: 9124329 - DNA, 22 bp, Homo sapiens
tgggtgtgagcccgggagccgc

SEQ ID NO: 9124330 - DNA, 22 bp, Homo sapiens
tggtaagaacccatcagagaag

SEQ ID NO: 9124331 - DNA, 22 bp, Homo sapiens
tggtaaaatattacaaggcact

SEQ ID NO: 9124332 - DNA, 22 bp, Homo sapiens
tggtaaaaactgcaattacttt

SEQ ID NO: 9124333 - DNA, 22 bp, Homo sapiens
tggtaaaaaccgcaattacatt

SEQ ID NO: 9124334 - DNA, 22 bp, Homo sapiens
tgggtttttgtttctctggtat

SEQ ID NO: 9124335 - DNA, 22 bp, Homo sapiens
tgggttttgtgaccatagatta

SEQ ID NO: 9124336 - DNA, 22 bp, Homo sapiens
tgggttttgtcctgatccatca

SEQ ID NO: 9124337 - DNA, 22 bp, Homo sapiens
tgggttttatatgtggtggaca

SEQ ID NO: 9124338 - DNA, 22 bp, Homo sapiens
tgggttttcagcatgagtttat

SEQ ID NO: 9124339 - DNA, 22 bp, Homo sapiens
tgggttttccacatatgccatg

SEQ ID NO: 9124340 - DNA, 22 bp, Homo sapiens
tgggttttctgccgattgttcc

SEQ ID NO: 9124341 - DNA, 22 bp, Homo sapiens
tgggttttccatctatttactc

SEQ ID NO: 9124342 - DNA, 22 bp, Homo sapiens
tggtcaaagaccaggaaatgct

SEQ ID NO: 9124343 - DNA, 22 bp, Homo sapiens
tggtcaaggcttggagatagta

SEQ ID NO: 9124344 - DNA, 22 bp, Homo sapiens
tggtcaagggacagagctgaac

SEQ ID NO: 9124345 - DNA, 17 bp, Homo sapiens
ttacaacaattcatgag

SEQ ID NO: 9124346 - DNA, 19 bp, Homo sapiens
ttatctgtgttgcagtggt

SEQ ID NO: 9124347 - DNA, 22 bp, Homo sapiens
ttatgaaagacatttctgttgg

SEQ ID NO: 9124348 - DNA, 22 bp, Homo sapiens
ttccagaggatctcaggtattt

SEQ ID NO: 9124349 - DNA, 22 bp, Homo sapiens
ttccagagtattggtagctata

SEQ ID NO: 9124350 - DNA, 22 bp, Homo sapiens
ttccagagtccatgttggctca

SEQ ID NO: 9124351 - DNA, 19 bp, Homo sapiens
ttcacatttttgtggcact

SEQ ID NO: 9124352 - DNA, 22 bp, Homo sapiens
ttcacatttctctgctgtttga

SEQ ID NO: 9124353 - DNA, 20 bp, Homo sapiens
ttcacatttctgtagtgatt

SEQ ID NO: 9124354 - DNA, 22 bp, Homo sapiens
ttcacattgttttaatgtgaat

SEQ ID NO: 9124355 - DNA, 22 bp, Homo sapiens
ttcacatttactggtttgtccg

SEQ ID NO: 9124356 - DNA, 22 bp, Homo sapiens
ttcacattgtggttcatgtgaa

SEQ ID NO: 9124357 - DNA, 22 bp, Homo sapiens
ttcacattgtgcagattatggt

SEQ ID NO: 9124358 - DNA, 22 bp, Homo sapiens
ttcagcatagcagcttcaggac

SEQ ID NO: 9124359 - DNA, 22 bp, Homo sapiens
tgttaaaaatgcagattcctat

SEQ ID NO: 9124360 - DNA, 22 bp, Homo sapiens
tgtggctgcaaaggaaggctgc

SEQ ID NO: 9124361 - DNA, 19 bp, Homo sapiens
tgtggctgagcactcctta

SEQ ID NO: 9124362 - DNA, 22 bp, Homo sapiens
tgtggaatgtcctcagcatcct

SEQ ID NO: 9124363 - DNA, 22 bp, Homo sapiens
ttaaaattatggcccatttgga

SEQ ID NO: 9124364 - DNA, 22 bp, Homo sapiens
ttaaaatttccccaccatgtat

SEQ ID NO: 9124365 - DNA, 22 bp, Homo sapiens
tgtttgcacattcgtttcaata

SEQ ID NO: 9124366 - DNA, 22 bp, Homo sapiens
tgtttcaaagaaagaaaatata

SEQ ID NO: 9124367 - DNA, 22 bp, Homo sapiens
tgtttattttcaggatggattg

SEQ ID NO: 9124368 - DNA, 22 bp, Homo sapiens
tgtttcaaaacagtgataattt

SEQ ID NO: 9124369 - DNA, 22 bp, Homo sapiens
tgtttattacagttcttggaat

SEQ ID NO: 9124370 - DNA, 22 bp, Homo sapiens
tgtgccctcctgccaggggctg

SEQ ID NO: 9124371 - DNA, 22 bp, Homo sapiens
tgtgctgagcaaatccatctgt

SEQ ID NO: 9124372 - DNA, 22 bp, Homo sapiens
tgtgctgacaattcacagagaa

SEQ ID NO: 9124373 - DNA, 22 bp, Homo sapiens
tgtgatttccagccattaaaaa

SEQ ID NO: 9124374 - DNA, 22 bp, Homo sapiens
tgtgaatgcttgttatggagtg

SEQ ID NO: 9124375 - DNA, 20 bp, Homo sapiens
tgtgaaagcagtagaatgac

SEQ ID NO: 9124376 - DNA, 22 bp, Homo sapiens
tgtgaaatgtgtgtataattaa

SEQ ID NO: 9124377 - DNA, 22 bp, Homo sapiens
aaacatgtttagaaagcagctg

SEQ ID NO: 9124378 - DNA, 22 bp, Homo sapiens
aaactgtgaagcaagtacaagg

SEQ ID NO: 9124379 - DNA, 22 bp, Homo sapiens
aaaagtaatcgcagtttttgcc

SEQ ID NO: 9124380 - DNA, 22 bp, Homo sapiens
aaaagtaattgcggtttttgct

SEQ ID NO: 9124381 - DNA, 22 bp, Homo sapiens
aaaagtaattgcggtttttgcc

SEQ ID NO: 9124382 - DNA, 22 bp, Homo sapiens
aaaagtaattgcagtttttgcc

SEQ ID NO: 9124383 - DNA, 22 bp, Homo sapiens
aaaagtaattgcagttttgtca

SEQ ID NO: 9124384 - DNA, 22 bp, Homo sapiens
aagcaggagatgcaggaatgta

SEQ ID NO: 9124385 - DNA, 22 bp, Homo sapiens
aaatacatttacagtcgtggct

SEQ ID NO: 9124386 - DNA, 22 bp, Homo sapiens
aactgtggacttgagactgatg

SEQ ID NO: 9124387 - DNA, 22 bp, Homo sapiens
aactgtgggatgcattaattca

SEQ ID NO: 9124388 - DNA, 22 bp, Homo sapiens
aagatgctggcaggaatagcta

SEQ ID NO: 9124389 - DNA, 22 bp, Homo sapiens
aagatgcttattgctcctgcag

SEQ ID NO: 9124390 - DNA, 22 bp, Homo sapiens
aagatgctcttaatgggtttat

SEQ ID NO: 9124391 - DNA, 22 bp, Homo sapiens
aagatgcttgcaaatttctgaa

SEQ ID NO: 9124392 - DNA, 22 bp, Homo sapiens
aagatgcttgagaactgtttga

SEQ ID NO: 9124393 - DNA, 22 bp, Homo sapiens
aagatgcttccactgcagtggc

SEQ ID NO: 9124394 - DNA, 22 bp, Homo sapiens
aagatgctaattgtggaagttg

SEQ ID NO: 9124395 - DNA, 22 bp, Homo sapiens
aattctacattggttcacattt

SEQ ID NO: 9124396 - DNA, 22 bp, Homo sapiens
aagaacaactgctttaaaagca

SEQ ID NO: 9124397 - DNA, 22 bp, Homo sapiens
aagactttctggggtgtaaagg

SEQ ID NO: 9124398 - DNA, 22 bp, Homo sapiens
aagactttctcccaaatcctca

SEQ ID NO: 9124399 - DNA, 22 bp, Homo sapiens
aagactttctgtaaagctacag

SEQ ID NO: 9124400 - DNA, 22 bp, Homo sapiens
aagactttccctcatcagaacg

SEQ ID NO: 9124401 - DNA, 22 bp, Homo sapiens
aagactttcaaacctatgtttg

SEQ ID NO: 9124402 - DNA, 22 bp, Homo sapiens
aagactttcaagtatgcatgca

SEQ ID NO: 9124403 - DNA, 22 bp, Homo sapiens
acacaaactgctagaaaattgg

SEQ ID NO: 9124404 - DNA, 22 bp, Homo sapiens
aacagaacccgagtgtgaatct

SEQ ID NO: 9124405 - DNA, 23 bp, Homo sapiens
aacacaaagctgattccagtggc

SEQ ID NO: 9124406 - DNA, 22 bp, Homo sapiens
aacacagaagtgccaagagcca

SEQ ID NO: 9124407 - DNA, 20 bp, Homo sapiens
aacacagataccaaaggttg

SEQ ID NO: 9124408 - DNA, 22 bp, Homo sapiens
aaatgtcagaagctttacttct

SEQ ID NO: 9124409 - DNA, 22 bp, Homo sapiens
aatagaggagctttggactccc

SEQ ID NO: 9124410 - DNA, 22 bp, Homo sapiens
aactagaaccacttgtatttcc

SEQ ID NO: 9124411 - DNA, 22 bp, Homo sapiens
aactagaaagaacatatttcca

SEQ ID NO: 9124412 - DNA, 22 bp, Homo sapiens
agcagagtgtgaaggcagggct

SEQ ID NO: 9124413 - DNA, 22 bp, Homo sapiens
acaatgcacctattttaaaact

SEQ ID NO: 9124414 - DNA, 19 bp, Homo sapiens
acactgatcagatcagcag

SEQ ID NO: 9124415 - DNA, 22 bp, Homo sapiens
acactgatgttggccctggtca

SEQ ID NO: 9124416 - DNA, 22 bp, Homo sapiens
acactgattgtagtctgtggtg

SEQ ID NO: 9124417 - DNA, 19 bp, Homo sapiens
acagatgcttttgctgccc

SEQ ID NO: 9124418 - DNA, 22 bp, Homo sapiens
acagatgcttactggtggttcc

SEQ ID NO: 9124419 - DNA, 17 bp, Homo sapiens
acagatgctgataagaa

SEQ ID NO: 9124420 - DNA, 22 bp, Homo sapiens
acagatgcaaggaaatgattgc

SEQ ID NO: 9124421 - DNA, 22 bp, Homo sapiens
acagatgcgcttggttgccaga

SEQ ID NO: 9124422 - DNA, 22 bp, Homo sapiens
acagatgctctgatgtctgggt

SEQ ID NO: 9124423 - DNA, 22 bp, Homo sapiens
acagaaaaatgagggagctgga

SEQ ID NO: 9124424 - DNA, 22 bp, Homo sapiens
agaggctctaatcccctccaca

SEQ ID NO: 9124425 - DNA, 22 bp, Homo sapiens
agaggctctaataccagcatgg

SEQ ID NO: 9124426 - DNA, 22 bp, Homo sapiens
agaggctctgccgcctcaggta

SEQ ID NO: 9124427 - DNA, 22 bp, Homo sapiens
agaggctctggtgcagcatgca

SEQ ID NO: 9124428 - DNA, 22 bp, Homo sapiens
agaggctctggtgggagttggt

SEQ ID NO: 9124429 - DNA, 18 bp, Homo sapiens
agaggctcgatactagaa

SEQ ID NO: 9124430 - DNA, 22 bp, Homo sapiens
agataaattcctaagatttcag

SEQ ID NO: 9124431 - DNA, 22 bp, Homo sapiens
acaagcatgggctttgacatca

SEQ ID NO: 9124432 - DNA, 23 bp, Homo sapiens
agaagcagcttctggagtatcgg

SEQ ID NO: 9124433 - DNA, 22 bp, Homo sapiens
aatgatgacaggataaagaaca

SEQ ID NO: 9124434 - DNA, 22 bp, Homo sapiens
aatcataattcaaataagctta

SEQ ID NO: 9124435 - DNA, 22 bp, Homo sapiens
acgtcatcgttgtcatcgtcat

SEQ ID NO: 9124436 - DNA, 22 bp, Homo sapiens
aaggctctgcaaaacctccaag

SEQ ID NO: 9124437 - DNA, 22 bp, Homo sapiens
aaggctcagctactcagcctgc

SEQ ID NO: 9124438 - DNA, 22 bp, Homo sapiens
aaggctcaattaactaagaagt

SEQ ID NO: 9124439 - DNA, 22 bp, Homo sapiens
aaggctcaaagaagctaagtga

SEQ ID NO: 9124440 - DNA, 22 bp, Homo sapiens
aaggccttctcttgtgtctgtg

SEQ ID NO: 9124441 - DNA, 22 bp, Homo sapiens
aaggcctttctagctttgtgct

SEQ ID NO: 9124442 - DNA, 22 bp, Homo sapiens
acccagagtcatggcacttagc

SEQ ID NO: 9124443 - DNA, 22 bp, Homo sapiens
acccagagtgtctgtctcagtc

SEQ ID NO: 9124444 - DNA, 22 bp, Homo sapiens
aaggaggaataaagaggtggtg

SEQ ID NO: 9124445 - DNA, 22 bp, Homo sapiens
acagttcaagtcttagacaaca

SEQ ID NO: 9124446 - DNA, 22 bp, Homo sapiens
acagctcctaacaaaggctctc

SEQ ID NO: 9124447 - DNA, 22 bp, Homo sapiens
agggaagaggaccagagtctct

SEQ ID NO: 9124448 - DNA, 22 bp, Homo sapiens
agggaagagcttgcaagaaacc

SEQ ID NO: 9124449 - DNA, 22 bp, Homo sapiens
agggaagaatcactgggatgtt

SEQ ID NO: 9124450 - DNA, 22 bp, Homo sapiens
agggcctgggccagcacccttt

SEQ ID NO: 9124451 - DNA, 22 bp, Homo sapiens
atatatttgagaatattcatga

SEQ ID NO: 9124452 - DNA, 22 bp, Homo sapiens
acttgggaggctgaaggacatt

SEQ ID NO: 9124453 - DNA, 22 bp, Homo sapiens
acttgggagttctggaagcctg

SEQ ID NO: 9124454 - DNA, 22 bp, Homo sapiens
atcacccaagctggagtgcagt

SEQ ID NO: 9124455 - DNA, 22 bp, Homo sapiens
atcacccaggctggagtgcagt

SEQ ID NO: 9124456 - DNA, 22 bp, Homo sapiens
atcattgtaaataatgctgcca

SEQ ID NO: 9124457 - DNA, 22 bp, Homo sapiens
actgatgttaaccctctcttct

SEQ ID NO: 9124458 - DNA, 22 bp, Homo sapiens
actgatgaaaggtaagactcca

SEQ ID NO: 9124459 - DNA, 22 bp, Homo sapiens
acctggacacctgctgtcatct

SEQ ID NO: 9124460 - DNA, 20 bp, Homo sapiens
agggtggggacgttctgact

SEQ ID NO: 9124461 - DNA, 22 bp, Homo sapiens
actaaatagttttgacagaaca

SEQ ID NO: 9124462 - DNA, 21 bp, Homo sapiens
atggagtcaggggaatgggcc

SEQ ID NO: 9124463 - DNA, 22 bp, Homo sapiens
atggacaggtggataggtggat

SEQ ID NO: 9124464 - DNA, 22 bp, Homo sapiens
atgggaggcaaagatcgcagaa

SEQ ID NO: 9124465 - DNA, 22 bp, Homo sapiens
agacacagtttgggatgggttg

SEQ ID NO: 9124466 - DNA, 22 bp, Homo sapiens
agacacagctgcaggaggtggg

SEQ ID NO: 9124467 - DNA, 22 bp, Homo sapiens
atctttaaagacatgtgaactt

SEQ ID NO: 9124468 - DNA, 22 bp, Homo sapiens
atctttaatttggatcagggcc

SEQ ID NO: 9124469 - DNA, 20 bp, Homo sapiens
agaagaggatacaaccaggc

SEQ ID NO: 9124470 - DNA, 22 bp, Homo sapiens
agaaggctcatttgactgcatt

SEQ ID NO: 9124471 - DNA, 22 bp, Homo sapiens
agaatacagtatgcaaaaagat

SEQ ID NO: 9124472 - DNA, 22 bp, Homo sapiens
agaaggcctaacttgggggcaa

SEQ ID NO: 9124473 - DNA, 22 bp, Homo sapiens
agaaggctcactaagagtgact

SEQ ID NO: 9124474 - DNA, 22 bp, Homo sapiens
agaaggctaaagaaacagattg

SEQ ID NO: 9124475 - DNA, 22 bp, Homo sapiens
agaaggccagatggacggggct

SEQ ID NO: 9124476 - DNA, 22 bp, Homo sapiens
agaaggccaatagggtgcactg

SEQ ID NO: 9124477 - DNA, 22 bp, Homo sapiens
agaaggccaagaagaagcctat

SEQ ID NO: 9124478 - DNA, 22 bp, Homo sapiens
atgttaaatggtttattattaa

SEQ ID NO: 9124479 - DNA, 23 bp, Homo sapiens
atgtgtgggaggtcagagagcca

SEQ ID NO: 9124480 - DNA, 22 bp, Homo sapiens
attctggacaaggcaagctcct

SEQ ID NO: 9124481 - DNA, 22 bp, Homo sapiens
agagtgggcctctgagtcccag

SEQ ID NO: 9124482 - DNA, 22 bp, Homo sapiens
atttattattgtggttacttct

SEQ ID NO: 9124483 - DNA, 22 bp, Homo sapiens
atttattatgggatttggctca

SEQ ID NO: 9124484 - DNA, 22 bp, Homo sapiens
caatgaaagcaactgcctataa

SEQ ID NO: 9124485 - DNA, 22 bp, Homo sapiens
cagcaggagcagtcagactcct

SEQ ID NO: 9124486 - DNA, 22 bp, Homo sapiens
cagcagaggttttgctccatga

SEQ ID NO: 9124487 - DNA, 22 bp, Homo sapiens
cagcagaggcacgtctgtgaat

SEQ ID NO: 9124488 - DNA, 22 bp, Homo sapiens
cagagagggagcagtagtctct

SEQ ID NO: 9124489 - DNA, 22 bp, Homo sapiens
cagacagaaggctccttgaggt

SEQ ID NO: 9124490 - DNA, 22 bp, Homo sapiens
agccaggacgttgctcagctcc

SEQ ID NO: 9124491 - DNA, 22 bp, Homo sapiens
gacagaggtgtccttgagtcca

SEQ ID NO: 9124492 - DNA, 22 bp, Homo sapiens
gaggggagacagggaaatcagt

SEQ ID NO: 9124493 - DNA, 22 bp, Homo sapiens
cttttcaaacgctgatgtcagt

SEQ ID NO: 9124494 - DNA, 22 bp, Homo sapiens
atgaaatatcttgaagaaattc

SEQ ID NO: 9124495 - DNA, 22 bp, Homo sapiens
atcttctcatgtgtaatgaggt

SEQ ID NO: 9124496 - DNA, 22 bp, Homo sapiens
atgcacttcaagcatctctctg

SEQ ID NO: 9124497 - DNA, 22 bp, Homo sapiens
atttaatttacatttgacagag

SEQ ID NO: 9124498 - DNA, 22 bp, Homo sapiens
atttaatttatagatgtggata

SEQ ID NO: 9124499 - DNA, 22 bp, Homo sapiens
atttaatttggagagagaaacc

SEQ ID NO: 9124500 - DNA, 22 bp, Homo sapiens
atttaattttctcaacagtgct

SEQ ID NO: 9124501 - DNA, 22 bp, Homo sapiens
atttaatttgtgtctttagctg

SEQ ID NO: 9124502 - DNA, 22 bp, Homo sapiens
atttaattaatcatggtgaatt

SEQ ID NO: 9124503 - DNA, 22 bp, Homo sapiens
atttaattgttcttctggctat

SEQ ID NO: 9124504 - DNA, 22 bp, Homo sapiens
atttattatgggatttggcaca

SEQ ID NO: 9124505 - DNA, 22 bp, Homo sapiens
gcctccagctggggcatttcag

SEQ ID NO: 9124506 - DNA, 22 bp, Homo sapiens
attcagtgagtgtttaccggaa

SEQ ID NO: 9124507 - DNA, 22 bp, Homo sapiens
attcagtgattcatttgtacaa

SEQ ID NO: 9124508 - DNA, 19 bp, Homo sapiens
attcagtgtctctgacttc

SEQ ID NO: 9124509 - DNA, 22 bp, Homo sapiens
attcagtgtcttgatctgggaa

SEQ ID NO: 9124510 - DNA, 17 bp, Homo sapiens
gcaagggatgggagatt

SEQ ID NO: 9124511 - DNA, 22 bp, Homo sapiens
atgttttcaaagtaaacttgta

SEQ ID NO: 9124512 - DNA, 22 bp, Homo sapiens
atgttttccccaaatgatcttc

SEQ ID NO: 9124513 - DNA, 22 bp, Homo sapiens
atgttttccattgccatggaaa

SEQ ID NO: 9124514 - DNA, 22 bp, Homo sapiens
atgttttctagagtttaaaatc

SEQ ID NO: 9124515 - DNA, 22 bp, Homo sapiens
atgttttcctgggagagcactc

SEQ ID NO: 9124516 - DNA, 22 bp, Homo sapiens
atgttttctccatgttatgctt

SEQ ID NO: 9124517 - DNA, 22 bp, Homo sapiens
atgttttctttcagacttccct

SEQ ID NO: 9124518 - DNA, 22 bp, Homo sapiens
atgttttatgttccactcaagg

SEQ ID NO: 9124519 - DNA, 22 bp, Homo sapiens
cacccacattccatcactctgc

SEQ ID NO: 9124520 - DNA, 22 bp, Homo sapiens
cacactgactggaatcaaggat

SEQ ID NO: 9124521 - DNA, 22 bp, Homo sapiens
ggatgttctggggttctcttgt

SEQ ID NO: 9124522 - DNA, 22 bp, Homo sapiens
ggatgggagcagaggacgacca

SEQ ID NO: 9124523 - DNA, 23 bp, Homo sapiens
cacaaaggttccattctctcacc

SEQ ID NO: 9124524 - DNA, 22 bp, Homo sapiens
gggacttaatgcagagagggac

SEQ ID NO: 9124525 - DNA, 22 bp, Homo sapiens
gggacagaaggaagtgagcaca

SEQ ID NO: 9124526 - DNA, 22 bp, Homo sapiens
gggacagacccatgggccaggt

SEQ ID NO: 9124527 - DNA, 22 bp, Homo sapiens
gggacagagcaacttgggatgg

SEQ ID NO: 9124528 - DNA, 22 bp, Homo sapiens
gggacagacccatgggccaggt

SEQ ID NO: 9124529 - DNA, 22 bp, Homo sapiens
gggaaagagaggtggacgcagg

SEQ ID NO: 9124530 - DNA, 22 bp, Homo sapiens
cagaggcctggcttggacacct

SEQ ID NO: 9124531 - DNA, 22 bp, Homo sapiens
cagaggttacctagagcaagaa

SEQ ID NO: 9124532 - DNA, 22 bp, Homo sapiens
ggggaagaaccgggattcccat

SEQ ID NO: 9124533 - DNA, 22 bp, Homo sapiens
cagaggcctatccagtgtccat

SEQ ID NO: 9124534 - DNA, 22 bp, Homo sapiens
cagaggcccagtgagagggctg

SEQ ID NO: 9124535 - DNA, 19 bp, Homo sapiens
cagaggccagaagcacagg

SEQ ID NO: 9124536 - DNA, 22 bp, Homo sapiens
cagaggccaggctgcctgactg

SEQ ID NO: 9124537 - DNA, 22 bp, Homo sapiens
cagaggccagtggacaagggcc

SEQ ID NO: 9124538 - DNA, 22 bp, Homo sapiens
cagaggccagggggctcacaaa

SEQ ID NO: 9124539 - DNA, 22 bp, Homo sapiens
cagagccagcccactgttcccg

SEQ ID NO: 9124540 - DNA, 20 bp, Homo sapiens
ggggaagaaaaggatgtgat

SEQ ID NO: 9124541 - DNA, 20 bp, Homo sapiens
ggggaagaaaaggatgtgat

SEQ ID NO: 9124542 - DNA, 22 bp, Homo sapiens
ggggaacaccgggcagaggcgc

SEQ ID NO: 9124543 - DNA, 22 bp, Homo sapiens
gggctgtgtactatgaggaggg

SEQ ID NO: 9124544 - DNA, 22 bp, Homo sapiens
cagcagagtatggcactcaact

SEQ ID NO: 9124545 - DNA, 22 bp, Homo sapiens
cagcagagtaattctcacctct

SEQ ID NO: 9124546 - DNA, 22 bp, Homo sapiens
ggttggacactaggtaggagcg

SEQ ID NO: 9124547 - DNA, 22 bp, Homo sapiens
ggttgacagaagaaggatgaca

SEQ ID NO: 9124548 - DNA, 22 bp, Homo sapiens
ggttgacagatatacattgtag

SEQ ID NO: 9124549 - DNA, 22 bp, Homo sapiens
ggttggacactaggtaggagcg

SEQ ID NO: 9124550 - DNA, 22 bp, Homo sapiens
agggaagggcagggtctatgca

SEQ ID NO: 9124551 - DNA, 22 bp, Homo sapiens
agggaaggaggccatgtgtccc

SEQ ID NO: 9124552 - DNA, 22 bp, Homo sapiens
ccccatgaagtagggtctctga

SEQ ID NO: 9124553 - DNA, 22 bp, Homo sapiens
ccataatcgtgtgttaaataat

SEQ ID NO: 9124554 - DNA, 22 bp, Homo sapiens
ccataatctggctttgagagag

SEQ ID NO: 9124555 - DNA, 22 bp, Homo sapiens
ccagttttgccatggtaacact

SEQ ID NO: 9124556 - DNA, 22 bp, Homo sapiens
ccagtttttccagtgctttctg

SEQ ID NO: 9124557 - DNA, 22 bp, Homo sapiens
cccagcagtagagctcatatgg

SEQ ID NO: 9124558 - DNA, 22 bp, Homo sapiens
cccagcagtggttctcaaactt

SEQ ID NO: 9124559 - DNA, 21 bp, Homo sapiens
cctcagtctccctgctccact

SEQ ID NO: 9124560 - DNA, 22 bp, Homo sapiens
aggccccaaagcagtgcaagta

SEQ ID NO: 9124561 - DNA, 20 bp, Homo sapiens
aggccccaggaaactctcag

SEQ ID NO: 9124562 - DNA, 22 bp, Homo sapiens
ccagtttaggtactaggctcta

SEQ ID NO: 9124563 - DNA, 22 bp, Homo sapiens
aggcctcagtttgtcatctgta

SEQ ID NO: 9124564 - DNA, 22 bp, Homo sapiens
aggcctcactctcagagcttct

SEQ ID NO: 9124565 - DNA, 22 bp, Homo sapiens
aggcctcagttcttgccaggtg

SEQ ID NO: 9124566 - DNA, 22 bp, Homo sapiens
aggcctcagctcagtgtgacag

SEQ ID NO: 9124567 - DNA, 22 bp, Homo sapiens
aggctccataccatctccggag

SEQ ID NO: 9124568 - DNA, 22 bp, Homo sapiens
aggctccattcatgtgaaggca

SEQ ID NO: 9124569 - DNA, 22 bp, Homo sapiens
caggcctgggttcaaatccctt

SEQ ID NO: 9124570 - DNA, 23 bp, Homo sapiens
agctgggaattttctgaagcttt

SEQ ID NO: 9124571 - DNA, 22 bp, Homo sapiens
agctgggaagactggaagacag

SEQ ID NO: 9124572 - DNA, 22 bp, Homo sapiens
agcttgacagacagatggtagc

SEQ ID NO: 9124573 - DNA, 22 bp, Homo sapiens
aggaacaattgataaactcaca

SEQ ID NO: 9124574 - DNA, 22 bp, Homo sapiens
aggaacaactgattcagtcaac

SEQ ID NO: 9124575 - DNA, 22 bp, Homo sapiens
aggaacaagggagccttttctc

SEQ ID NO: 9124576 - DNA, 22 bp, Homo sapiens
caggaggttgagggtgcagtga

SEQ ID NO: 9124577 - DNA, 22 bp, Homo sapiens
caggagtctctcttgagcccag

SEQ ID NO: 9124578 - DNA, 22 bp, Homo sapiens
caggacacttgttcttctctgc

SEQ ID NO: 9124579 - DNA, 20 bp, Homo sapiens
aggaggcaatgtagataagc

SEQ ID NO: 9124580 - DNA, 22 bp, Homo sapiens
aggaggaaggcttcattaggtt

SEQ ID NO: 9124581 - DNA, 22 bp, Homo sapiens
aggaggaagggaagacaagtaa

SEQ ID NO: 9124582 - DNA, 18 bp, Homo sapiens
aggagcctttgcactgga

SEQ ID NO: 9124583 - DNA, 22 bp, Homo sapiens
catgcctgtaatcccagctctt

SEQ ID NO: 9124584 - DNA, 22 bp, Homo sapiens
cattcccttggggagttcatgc

SEQ ID NO: 9124585 - DNA, 22 bp, Homo sapiens
cggctcagacttcccaagaaca

SEQ ID NO: 9124586 - DNA, 20 bp, Homo sapiens
cggctcagcctctccctccc

SEQ ID NO: 9124587 - DNA, 22 bp, Homo sapiens
aggtgggggctgtgtccttgac

SEQ ID NO: 9124588 - DNA, 22 bp, Homo sapiens
aggtggggtgagctgcagacta

SEQ ID NO: 9124589 - DNA, 22 bp, Homo sapiens
aggtgctgaactggtgaggtct

SEQ ID NO: 9124590 - DNA, 22 bp, Homo sapiens
cctgctctagactctgggaagg

SEQ ID NO: 9124591 - DNA, 22 bp, Homo sapiens
ctctggagaacgctatggatct

SEQ ID NO: 9124592 - DNA, 19 bp, Homo sapiens
ctctggagaacaatagtgc

SEQ ID NO: 9124593 - DNA, 22 bp, Homo sapiens
agtggtcttagcttgctgggct

SEQ ID NO: 9124594 - DNA, 22 bp, Homo sapiens
ctctttggcgttggcagagcca

SEQ ID NO: 9124595 - DNA, 22 bp, Homo sapiens
ctcagggaggccctgggaccct

SEQ ID NO: 9124596 - DNA, 22 bp, Homo sapiens
ctcagggaggagcttctgggcc

SEQ ID NO: 9124597 - DNA, 22 bp, Homo sapiens
ctcagggacttggatcctggcc

SEQ ID NO: 9124598 - DNA, 22 bp, Homo sapiens
ctcagggacgttagaggacagg

SEQ ID NO: 9124599 - DNA, 22 bp, Homo sapiens
agttggaccttgtagagtttcc

SEQ ID NO: 9124600 - DNA, 22 bp, Homo sapiens
ataaatagtgtgtcataaagtc

SEQ ID NO: 9124601 - DNA, 22 bp, Homo sapiens
ctgggtcccctcagtgacactg

SEQ ID NO: 9124602 - DNA, 22 bp, Homo sapiens
ctgggtcagtctgtccctaggg

SEQ ID NO: 9124603 - DNA, 20 bp, Homo sapiens
ctgggtcacttggctgctct

SEQ ID NO: 9124604 - DNA, 22 bp, Homo sapiens
atcatcatctaaattgtgtcgc

SEQ ID NO: 9124605 - DNA, 22 bp, Homo sapiens
atcctttaagttaataaaattc

SEQ ID NO: 9124606 - DNA, 22 bp, Homo sapiens
atcctagaatcagcccttgctg

SEQ ID NO: 9124607 - DNA, 22 bp, Homo sapiens
atatttctctcagacatggaag

SEQ ID NO: 9124608 - DNA, 22 bp, Homo sapiens
atatttctctcagacatggaag

SEQ ID NO: 9124609 - DNA, 22 bp, Homo sapiens
atataatacaacctgctaagtg

SEQ ID NO: 9124610 - DNA, 22 bp, Homo sapiens
ctgggaagccacagggtgtggg

SEQ ID NO: 9124611 - DNA, 22 bp, Homo sapiens
ctgggaagcatggtgatggtat

SEQ ID NO: 9124612 - DNA, 22 bp, Homo sapiens
ctgggaaggagggttgcgaagg

SEQ ID NO: 9124613 - DNA, 22 bp, Homo sapiens
ctgggaagcttcgagcaggaaa

SEQ ID NO: 9124614 - DNA, 22 bp, Homo sapiens
ctgggaagcttcgagcaggaaa

SEQ ID NO: 9124615 - DNA, 22 bp, Homo sapiens
ctgggaagtagaatcagatgag

SEQ ID NO: 9124616 - DNA, 22 bp, Homo sapiens
ctgggaagtagaatcagatgag

SEQ ID NO: 9124617 - DNA, 22 bp, Homo sapiens
tccagccaggatggcccaggga

SEQ ID NO: 9124618 - DNA, 22 bp, Homo sapiens
tccagccacttgcacagttaaa

SEQ ID NO: 9124619 - DNA, 22 bp, Homo sapiens
tcagttgcacctgcatggtact

SEQ ID NO: 9124620 - DNA, 22 bp, Homo sapiens
catccccagagcagttccacta

SEQ ID NO: 9124621 - DNA, 22 bp, Homo sapiens
catccccaattagcgcccagct

SEQ ID NO: 9124622 - DNA, 22 bp, Homo sapiens
catagaatgtaataaagagtag

SEQ ID NO: 9124623 - DNA, 22 bp, Homo sapiens
tcactccatctttgctactggt

SEQ ID NO: 9124624 - DNA, 22 bp, Homo sapiens
cagtcctggggaccaggctgag

SEQ ID NO: 9124625 - DNA, 22 bp, Homo sapiens
cagtgagtaagtagacagctta

SEQ ID NO: 9124626 - DNA, 22 bp, Homo sapiens
tatgtttttcaagtgcacacta

SEQ ID NO: 9124627 - DNA, 22 bp, Homo sapiens
tatgtttttcagacgtcctaca

SEQ ID NO: 9124628 - DNA, 22 bp, Homo sapiens
tatgtttttaagagaatgcatt

SEQ ID NO: 9124629 - DNA, 22 bp, Homo sapiens
tatgttttaggaattaattgtt

SEQ ID NO: 9124630 - DNA, 22 bp, Homo sapiens
tatctctagcgcacagaagaaa

SEQ ID NO: 9124631 - DNA, 22 bp, Homo sapiens
ccagaagagatcacagttcttg

SEQ ID NO: 9124632 - DNA, 19 bp, Homo sapiens
ccagaagggcagctatgga

SEQ ID NO: 9124633 - DNA, 22 bp, Homo sapiens
ccagaatccaaaacgttttgag

SEQ ID NO: 9124634 - DNA, 23 bp, Homo sapiens
ccactgatgcattttctctctgt

SEQ ID NO: 9124635 - DNA, 22 bp, Homo sapiens
ccagaaaagcatctggttcttt

SEQ ID NO: 9124636 - DNA, 22 bp, Homo sapiens
tcctggtgaggctagaagtgtc

SEQ ID NO: 9124637 - DNA, 18 bp, Homo sapiens
tcctggtggagaagtggt

SEQ ID NO: 9124638 - DNA, 19 bp, Homo sapiens
ccagaggactgttaatgaa

SEQ ID NO: 9124639 - DNA, 22 bp, Homo sapiens
ccagaggacttgggggctgaat

SEQ ID NO: 9124640 - DNA, 22 bp, Homo sapiens
ccagaggagcatggccttgaga

SEQ ID NO: 9124641 - DNA, 21 bp, Homo sapiens
ccagatgcaaatgcagacatt

SEQ ID NO: 9124642 - DNA, 17 bp, Homo sapiens
ccagatgccctgtctcc

SEQ ID NO: 9124643 - DNA, 22 bp, Homo sapiens
ccacagcatgcaggcctgacac

SEQ ID NO: 9124644 - DNA, 22 bp, Homo sapiens
ccacagcaccgctgccagtccc

SEQ ID NO: 9124645 - DNA, 22 bp, Homo sapiens
ccacagccattccagggaggct

SEQ ID NO: 9124646 - DNA, 22 bp, Homo sapiens
ccaaatcaccagcacgatcatt

SEQ ID NO: 9124647 - DNA, 22 bp, Homo sapiens
ccaaatagtctttcattgaatt

SEQ ID NO: 9124648 - DNA, 22 bp, Homo sapiens
ccaggaggcggaaggtacagtg

SEQ ID NO: 9124649 - DNA, 22 bp, Homo sapiens
ccaggaggcggaggttgcagcg

SEQ ID NO: 9124650 - DNA, 22 bp, Homo sapiens
ccaggaggcagaggttacagtg

SEQ ID NO: 9124651 - DNA, 22 bp, Homo sapiens
ccaggaggcagaggttgtagtg

SEQ ID NO: 9124652 - DNA, 22 bp, Homo sapiens
ccaggaggatgattttaagagg

SEQ ID NO: 9124653 - DNA, 22 bp, Homo sapiens
ccaggaggatggttgttaggtg

SEQ ID NO: 9124654 - DNA, 22 bp, Homo sapiens
ccaggaggcaatatcaagtcca

SEQ ID NO: 9124655 - DNA, 22 bp, Homo sapiens
ccaggaggcagaagttgcagtg

SEQ ID NO: 9124656 - DNA, 22 bp, Homo sapiens
tctcttggggaaagagaagaat

SEQ ID NO: 9124657 - DNA, 22 bp, Homo sapiens
tctcttggtacacagatgatca

SEQ ID NO: 9124658 - DNA, 22 bp, Homo sapiens
tctcttgggaggaaagagagaa

SEQ ID NO: 9124659 - DNA, 22 bp, Homo sapiens
ccagccatgcacaaaccatgag

SEQ ID NO: 9124660 - DNA, 22 bp, Homo sapiens
tctgaggcccagttcaactctt

SEQ ID NO: 9124661 - DNA, 22 bp, Homo sapiens
ccagcctggagggcagtggtgg

SEQ ID NO: 9124662 - DNA, 22 bp, Homo sapiens
ccagctcctgggtcttagtcag

SEQ ID NO: 9124663 - DNA, 19 bp, Homo sapiens
gtgtggcagagagtgacca

SEQ ID NO: 9124664 - DNA, 22 bp, Homo sapiens
gtgggaagtctctcggaggaag

SEQ ID NO: 9124665 - DNA, 22 bp, Homo sapiens
gtgggaagaacttcaagtggct

SEQ ID NO: 9124666 - DNA, 22 bp, Homo sapiens
gtttattattcaacttcatgtt

SEQ ID NO: 9124667 - DNA, 22 bp, Homo sapiens
gtttattatacaacaaaagcta

SEQ ID NO: 9124668 - DNA, 22 bp, Homo sapiens
gttattagtaagactcgcacat

SEQ ID NO: 9124669 - DNA, 22 bp, Homo sapiens
gttattagaagtgaaggattgt

SEQ ID NO: 9124670 - DNA, 22 bp, Homo sapiens
taacactgtgtctgccatatcc

SEQ ID NO: 9124671 - DNA, 22 bp, Homo sapiens
taagcaaataatgcatcaaggg

SEQ ID NO: 9124672 - DNA, 22 bp, Homo sapiens
taagcaaatagctagatcagag

SEQ ID NO: 9124673 - DNA, 22 bp, Homo sapiens
taagcaaagtttataaggctct

SEQ ID NO: 9124674 - DNA, 20 bp, Homo sapiens
tacaatacacatgcatatga

SEQ ID NO: 9124675 - DNA, 22 bp, Homo sapiens
caggacagtttgctttgccctg

SEQ ID NO: 9124676 - DNA, 22 bp, Homo sapiens
caggaggccaactgtgggactt

SEQ ID NO: 9124677 - DNA, 22 bp, Homo sapiens
caggaggctttgggatccaagt

SEQ ID NO: 9124678 - DNA, 22 bp, Homo sapiens
caggaggcagcgctctcaggac

SEQ ID NO: 9124679 - DNA, 22 bp, Homo sapiens
taaatagaatctaaactgctca

SEQ ID NO: 9124680 - DNA, 19 bp, Homo sapiens
ctctccagctccagtagct

SEQ ID NO: 9124681 - DNA, 22 bp, Homo sapiens
tttagacatagctgaaatcatt

SEQ ID NO: 9124682 - DNA, 22 bp, Homo sapiens
tttagacagcggctctgaacca

SEQ ID NO: 9124683 - DNA, 21 bp, Homo sapiens
ttgttacaatgcaagagtatg

SEQ ID NO: 9124684 - DNA, 22 bp, Homo sapiens
ttgttacagcagcaatagaaaa

SEQ ID NO: 9124685 - DNA, 22 bp, Homo sapiens
ctccagtgagtgagcaggcgac

SEQ ID NO: 9124686 - DNA, 22 bp, Homo sapiens
cggctcaggccacaggacggca

SEQ ID NO: 9124687 - DNA, 21 bp, Homo sapiens
cggctcagtgcctgctccttc

SEQ ID NO: 9124688 - DNA, 22 bp, Homo sapiens
ttccggaaggttctctagaatt

SEQ ID NO: 9124689 - DNA, 22 bp, Homo sapiens
ttccaaagtcatgttgctgata

SEQ ID NO: 9124690 - DNA, 22 bp, Homo sapiens
ttccaaagaaattgaccaagac

SEQ ID NO: 9124691 - DNA, 22 bp, Homo sapiens
ttccaaagctgctttatttagt

SEQ ID NO: 9124692 - DNA, 22 bp, Homo sapiens
ctagggaaggacaacctcttcc

SEQ ID NO: 9124693 - DNA, 22 bp, Homo sapiens
ttcttgttctggttctgttagc

SEQ ID NO: 9124694 - DNA, 22 bp, Homo sapiens
ctattttctgtctctatagagt

SEQ ID NO: 9124695 - DNA, 22 bp, Homo sapiens
ctattttcccatatggttgaca

SEQ ID NO: 9124696 - DNA, 22 bp, Homo sapiens
ctattttccgcagcaggaagta

SEQ ID NO: 9124697 - DNA, 22 bp, Homo sapiens
ctattttcattcttacattgtc

SEQ ID NO: 9124698 - DNA, 22 bp, Homo sapiens
ctggacaggaagaattgggagc

SEQ ID NO: 9124699 - DNA, 22 bp, Homo sapiens
ctggacagtgctgcttgagatg

SEQ ID NO: 9124700 - DNA, 23 bp, Homo sapiens
ctggctccgaagactccaggatc

SEQ ID NO: 9124701 - DNA, 22 bp, Homo sapiens
ctggctccaccccaggaggatg

SEQ ID NO: 9124702 - DNA, 22 bp, Homo sapiens
ttttattatctttgaatgggac

SEQ ID NO: 9124703 - DNA, 22 bp, Homo sapiens
tttgtctttcccctcctcattg

SEQ ID NO: 9124704 - DNA, 19 bp, Homo sapiens
ctgaaaaacattctcagga

SEQ ID NO: 9124705 - DNA, 22 bp, Homo sapiens
tttttaacctaccttaagagca

SEQ ID NO: 9124706 - DNA, 22 bp, Homo sapiens
ctgaagagaaagggagctcttc

SEQ ID NO: 9124707 - DNA, 20 bp, Homo sapiens
ctgaagagactggaggggca

SEQ ID NO: 9124708 - DNA, 22 bp, Homo sapiens
ctgaagagactggagggggcat

SEQ ID NO: 9124709 - DNA, 22 bp, Homo sapiens
cccccaccgtgttcctgctcgg

SEQ ID NO: 9124710 - DNA, 22 bp, Homo sapiens
cccccacctgaggacagtctta

SEQ ID NO: 9124711 - DNA, 22 bp, Homo sapiens
cctccagcattactggcccatg

SEQ ID NO: 9124712 - DNA, 22 bp, Homo sapiens
cctccagcgcgatccactccgg

SEQ ID NO: 9124713 - DNA, 22 bp, Homo sapiens
tggctcagctgtcacagcctgg

SEQ ID NO: 9124714 - DNA, 22 bp, Homo sapiens
tggctcagctgactcggcttct

SEQ ID NO: 9124715 - DNA, 22 bp, Homo sapiens
tggctcagtttagcagctcagt

SEQ ID NO: 9124716 - DNA, 22 bp, Homo sapiens
tggctcagtttcagtcctggtt

SEQ ID NO: 9124717 - DNA, 22 bp, Homo sapiens
tggctcagtttgggggattgaa

SEQ ID NO: 9124718 - DNA, 22 bp, Homo sapiens
tggctcagtttctgcccagctg

SEQ ID NO: 9124719 - DNA, 22 bp, Homo sapiens
tggccccattttacagatgaaa

SEQ ID NO: 9124720 - DNA, 22 bp, Homo sapiens
tggccccatcaagggatgagtt

SEQ ID NO: 9124721 - DNA, 20 bp, Homo sapiens
cctctctgcatgctccctga

SEQ ID NO: 9124722 - DNA, 22 bp, Homo sapiens
tgtgtgggtggtaaggaaggcc

SEQ ID NO: 9124723 - DNA, 22 bp, Homo sapiens
tgtgtggggaaggaaggagctg

SEQ ID NO: 9124724 - DNA, 22 bp, Homo sapiens
cctgggaggcggaggttgcagt

SEQ ID NO: 9124725 - DNA, 22 bp, Homo sapiens
cctgggaggcggaggttgcagg

SEQ ID NO: 9124726 - DNA, 22 bp, Homo sapiens
tgtgggaaatgggagtggaaga

SEQ ID NO: 9124727 - DNA, 22 bp, Homo sapiens
cctgggaggcagaggttgcagt

SEQ ID NO: 9124728 - DNA, 22 bp, Homo sapiens
tgtgaggcctagacagcctggg

SEQ ID NO: 9124729 - DNA, 22 bp, Homo sapiens
tgtctttctgacccaaggtagt

SEQ ID NO: 9124730 - DNA, 22 bp, Homo sapiens
tgtctttctgcaccacctcaca

SEQ ID NO: 9124731 - DNA, 22 bp, Homo sapiens
tgtaggacatgtacttgtaaca

SEQ ID NO: 9124732 - DNA, 20 bp, Homo sapiens
tggtcctcacaggtcctccc

SEQ ID NO: 9124733 - DNA, 22 bp, Homo sapiens
tggtgggacatctgaggagagg

SEQ ID NO: 9124734 - DNA, 22 bp, Homo sapiens
cctggctcctgcctctgcaggg

SEQ ID NO: 9124735 - DNA, 22 bp, Homo sapiens
cctggctcctgcacagatcttt

SEQ ID NO: 9124736 - DNA, 22 bp, Homo sapiens
cctggctctgaagtccacatca

SEQ ID NO: 9124737 - DNA, 22 bp, Homo sapiens
tgtcctcatcttttccagaaat

SEQ ID NO: 9124738 - DNA, 20 bp, Homo sapiens
cttgaactgattctatttcc

SEQ ID NO: 9124739 - DNA, 22 bp, Homo sapiens
ctttagtttaagaacatgatga

SEQ ID NO: 9124740 - DNA, 23 bp, Homo sapiens
cttttaaccggcatgggagggca

SEQ ID NO: 9124741 - DNA, 23 bp, Homo sapiens
cttttaactagagtatcagctgc

SEQ ID NO: 9124742 - DNA, 22 bp, Homo sapiens
ctttgttttactcagaggcatg

SEQ ID NO: 9124743 - DNA, 23 bp, Homo sapiens
cttttaacttgatctgagaccag

SEQ ID NO: 9124744 - DNA, 22 bp, Homo sapiens
gaaaacatccagagatagacct

SEQ ID NO: 9124745 - DNA, 22 bp, Homo sapiens
gaacacaactcagaatgctggt

SEQ ID NO: 9124746 - DNA, 22 bp, Homo sapiens
gaacacaagcgtatgtctttgt

SEQ ID NO: 9124747 - DNA, 22 bp, Homo sapiens
gaaatacaaatgcctagatcct

SEQ ID NO: 9124748 - DNA, 22 bp, Homo sapiens
gaacctttttccaagtaaacaa

SEQ ID NO: 9124749 - DNA, 21 bp, Homo sapiens
gactttaatttgagagcaaaa

SEQ ID NO: 9124750 - DNA, 22 bp, Homo sapiens
gagacagagatcttgctgagtc

SEQ ID NO: 9124751 - DNA, 22 bp, Homo sapiens
gagagctgggctttgggtgaag

SEQ ID NO: 9124752 - DNA, 22 bp, Homo sapiens
gactgttacctatatttatgtg

SEQ ID NO: 9124753 - DNA, 22 bp, Homo sapiens
gactttaaaagtttgtgcttgg

SEQ ID NO: 9124754 - DNA, 18 bp, Homo sapiens
gactttaaaacactgctc

SEQ ID NO: 9124755 - DNA, 22 bp, Homo sapiens
gactttaaaggttctgctgctt

SEQ ID NO: 9124756 - DNA, 22 bp, Homo sapiens
gactttaaagcctgacatttta

SEQ ID NO: 9124757 - DNA, 22 bp, Homo sapiens
gactttaagtaagtcaaggagc

SEQ ID NO: 9124758 - DNA, 22 bp, Homo sapiens
gactttaagtcctatctgtgcg

SEQ ID NO: 9124759 - DNA, 22 bp, Homo sapiens
gactttaaaatgctagaacagg

SEQ ID NO: 9124760 - DNA, 22 bp, Homo sapiens
gacaggaggcagagctcaggtg

SEQ ID NO: 9124761 - DNA, 22 bp, Homo sapiens
gaattctgggagagatctgaca

SEQ ID NO: 9124762 - DNA, 22 bp, Homo sapiens
gacacagctttctgaagagcat

SEQ ID NO: 9124763 - DNA, 22 bp, Homo sapiens
gacacagagataggcctgtgtt

SEQ ID NO: 9124764 - DNA, 22 bp, Homo sapiens
gaaggctctggggattgagata

SEQ ID NO: 9124765 - DNA, 22 bp, Homo sapiens
gaaggccctggtattcttgagg

SEQ ID NO: 9124766 - DNA, 22 bp, Homo sapiens
gaaggagaggattgtgaggctg

SEQ ID NO: 9124767 - DNA, 22 bp, Homo sapiens
gaactgtgggtaatatattaga

SEQ ID NO: 9124768 - DNA, 22 bp, Homo sapiens
gaactgtgtacattgtagataa

SEQ ID NO: 9124769 - DNA, 22 bp, Homo sapiens
gagggcagtgaattttgaagct

SEQ ID NO: 9124770 - DNA, 22 bp, Homo sapiens
gaggctggaggtcaaagatgaa

SEQ ID NO: 9124771 - DNA, 22 bp, Homo sapiens
gaggtcaggctcaagctgggcc

SEQ ID NO: 9124772 - DNA, 22 bp, Homo sapiens
gaggtcaggggagaggctgatg

SEQ ID NO: 9124773 - DNA, 22 bp, Homo sapiens
gaggtccactgaggcaacaggg

SEQ ID NO: 9124774 - DNA, 22 bp, Homo sapiens
gaggtccagggtggggcctgag

SEQ ID NO: 9124775 - DNA, 22 bp, Homo sapiens
gaggtccagccaagcggcaagg

SEQ ID NO: 9124776 - DNA, 22 bp, Homo sapiens
gaggcccagtcctgcaagcacg

SEQ ID NO: 9124777 - DNA, 23 bp, Homo sapiens
gaggagggtctgacaagtgtagc

SEQ ID NO: 9124778 - DNA, 22 bp, Homo sapiens
gaggacagcttagggcttcctg

SEQ ID NO: 9124779 - DNA, 22 bp, Homo sapiens
gagctgggacttggaatccaca

SEQ ID NO: 9124780 - DNA, 22 bp, Homo sapiens
gaggaagatggttgagtggtcc

SEQ ID NO: 9124781 - DNA, 22 bp, Homo sapiens
gatgaaaatcttgagatgtcga

SEQ ID NO: 9124782 - DNA, 22 bp, Homo sapiens
gatccccaggactagggggtgg

SEQ ID NO: 9124783 - DNA, 22 bp, Homo sapiens
gatccccagggcaggcctcccg

SEQ ID NO: 9124784 - DNA, 22 bp, Homo sapiens
gataataagcacagcaggatgt

SEQ ID NO: 9124785 - DNA, 22 bp, Homo sapiens
gatagaaagaatatagattcca

SEQ ID NO: 9124786 - DNA, 22 bp, Homo sapiens
gagttgactcctccagaggagt

SEQ ID NO: 9124787 - DNA, 22 bp, Homo sapiens
gagttgactacatagatgcaga

SEQ ID NO: 9124788 - DNA, 22 bp, Homo sapiens
gcctgggattctcaaaggggtg

SEQ ID NO: 9124789 - DNA, 22 bp, Homo sapiens
gcctgggaagactaagtgggag

SEQ ID NO: 9124790 - DNA, 21 bp, Homo sapiens
gcctgggaaatctgggaagcc

SEQ ID NO: 9124791 - DNA, 21 bp, Homo sapiens
gctgctcgagatccagtgctt

SEQ ID NO: 9124792 - DNA, 22 bp, Homo sapiens
gcctgtttccatcaacacatgc

SEQ ID NO: 9124793 - DNA, 22 bp, Homo sapiens
gcctgtttgtttgcaaaggagc

SEQ ID NO: 9124794 - DNA, 19 bp, Homo sapiens
gcaggtggatgtggtcagc

SEQ ID NO: 9124795 - DNA, 22 bp, Homo sapiens
gcagtatacactgatacatgag

SEQ ID NO: 9124796 - DNA, 22 bp, Homo sapiens
gcagtatatactctttgagggg

SEQ ID NO: 9124797 - DNA, 22 bp, Homo sapiens
gcagtataagtggattatgtcc

SEQ ID NO: 9124798 - DNA, 22 bp, Homo sapiens
gcagtggtccagctaagatttg

SEQ ID NO: 9124799 - DNA, 22 bp, Homo sapiens
gcagtggtggtgtttcagtgac

SEQ ID NO: 9124800 - DNA, 22 bp, Homo sapiens
gcagtggtggagcttacatatc

SEQ ID NO: 9124801 - DNA, 17 bp, Homo sapiens
gcatgtagtacatgtaa

SEQ ID NO: 9124802 - DNA, 22 bp, Homo sapiens
gccacagcccgagcaccatgag

SEQ ID NO: 9124803 - DNA, 22 bp, Homo sapiens
gatttagtggcccttggtacac

SEQ ID NO: 9124804 - DNA, 22 bp, Homo sapiens
gatgcattacaaaagtgattat

SEQ ID NO: 9124805 - DNA, 22 bp, Homo sapiens
gattttcatttgcactctagaa

SEQ ID NO: 9124806 - DNA, 22 bp, Homo sapiens
gattttcattatagctagtttc

SEQ ID NO: 9124807 - DNA, 22 bp, Homo sapiens
gattttcatgataaacttgtga

SEQ ID NO: 9124808 - DNA, 22 bp, Homo sapiens
gcaaacataatatgaagacact

SEQ ID NO: 9124809 - DNA, 22 bp, Homo sapiens
gcaaacattcaggagtacagga

SEQ ID NO: 9124810 - DNA, 22 bp, Homo sapiens
gcaaacattccacagaaggaag

SEQ ID NO: 9124811 - DNA, 22 bp, Homo sapiens
taacactgtggtgttctttgtc

SEQ ID NO: 9124812 - DNA, 22 bp, Homo sapiens
taacactgtgcccagagtccca

SEQ ID NO: 9124813 - DNA, 22 bp, Homo sapiens
taacactgtccaaagaattcca

SEQ ID NO: 9124814 - DNA, 22 bp, Homo sapiens
taacactgaaaatgatgcatgt

SEQ ID NO: 9124815 - DNA, 22 bp, Homo sapiens
taacactgatttgttctcaggg

SEQ ID NO: 9124816 - DNA, 22 bp, Homo sapiens
taacactggtatttcatttagt

SEQ ID NO: 9124817 - DNA, 22 bp, Homo sapiens
gtggggtagatctttctcagga

SEQ ID NO: 9124818 - DNA, 22 bp, Homo sapiens
gtggggagcagccttagcccct

SEQ ID NO: 9124819 - DNA, 22 bp, Homo sapiens
gtggggaggcattcttctccct

SEQ ID NO: 9124820 - DNA, 22 bp, Homo sapiens
gtggggaggcctaagcaagttg

SEQ ID NO: 9124821 - DNA, 22 bp, Homo sapiens
gtgtgggctgcagaggcacagc

SEQ ID NO: 9124822 - DNA, 22 bp, Homo sapiens
gtgtctgagtttggaaagtcca

SEQ ID NO: 9124823 - DNA, 22 bp, Homo sapiens
gttctgagtggcccaagccctg

SEQ ID NO: 9124824 - DNA, 22 bp, Homo sapiens
gtggaggaaaagaagttgggtg

SEQ ID NO: 9124825 - DNA, 22 bp, Homo sapiens
gtggctggagtatgaggaaagg

SEQ ID NO: 9124826 - DNA, 22 bp, Homo sapiens
gtctgagggacagagtcctggc

SEQ ID NO: 9124827 - DNA, 22 bp, Homo sapiens
gtctgagactgggcacatacct

SEQ ID NO: 9124828 - DNA, 22 bp, Homo sapiens
gtctgaagccagtggtagtccg

SEQ ID NO: 9124829 - DNA, 22 bp, Homo sapiens
gggtggggccaggcaatttgca

SEQ ID NO: 9124830 - DNA, 22 bp, Homo sapiens
gtaaataactggtaattggggt

SEQ ID NO: 9124831 - DNA, 23 bp, Homo sapiens
gtaaaatacgcagtgcagtgtga

SEQ ID NO: 9124832 - DNA, 22 bp, Homo sapiens
ggcacagagctttgtcccagtt

SEQ ID NO: 9124833 - DNA, 22 bp, Homo sapiens
ggcacagaggttgcctccagat

SEQ ID NO: 9124834 - DNA, 22 bp, Homo sapiens
ggagggctccctgggagtggat

SEQ ID NO: 9124835 - DNA, 22 bp, Homo sapiens
ggagggctgccaggtggagcgg

SEQ ID NO: 9124836 - DNA, 18 bp, Homo sapiens
ggagggctttggggactg

SEQ ID NO: 9124837 - DNA, 22 bp, Homo sapiens
ggaggctctgcttatgaaaggc

SEQ ID NO: 9124838 - DNA, 22 bp, Homo sapiens
ggaggctccatgagctcctgca

SEQ ID NO: 9124839 - DNA, 20 bp, Homo sapiens
ggaaaaatgcatgctcaaga

SEQ ID NO: 9124840 - DNA, 22 bp, Homo sapiens
ggaaagagcccagcagtgcttg

SEQ ID NO: 9124841 - DNA, 19 bp, Homo sapiens
ggaaggtgacagtggtgaa

SEQ ID NO: 9124842 - DNA, 22 bp, Homo sapiens
ggaggccagcctgaggctgagg

SEQ ID NO: 9124843 - DNA, 22 bp, Homo sapiens
ggaggcagaatagagtgtgggt

SEQ ID NO: 9124844 - DNA, 18 bp, Homo sapiens
ggaaggtgctggagtgca

SEQ ID NO: 9124845 - DNA, 22 bp, Homo sapiens
gggatggggagctggaaagggg

SEQ ID NO: 9124846 - DNA, 20 bp, Homo sapiens
gggaggccccagagtccagg

SEQ ID NO: 9124847 - DNA, 20 bp, Homo sapiens
gggagaagggctgatgagag

SEQ ID NO: 9124848 - DNA, 23 bp, Homo sapiens
ggggaagtggcagtgagtgaggc

SEQ ID NO: 9124849 - DNA, 23 bp, Homo sapiens
ggggacagagggcagcccgcatc

SEQ ID NO: 9124850 - DNA, 22 bp, Homo sapiens
ggggacagtcgatctagtgatt

SEQ ID NO: 9124851 - DNA, 20 bp, Homo sapiens
ggggggcttcagggcctgtg

SEQ ID NO: 9124852 - DNA, 22 bp, Homo sapiens
gggggctggaatatccatcaac

SEQ ID NO: 9124853 - DNA, 22 bp, Homo sapiens
gggggctagagagatgaaatat

SEQ ID NO: 9124854 - DNA, 22 bp, Homo sapiens
ggctggctggatgaatggatta

SEQ ID NO: 9124855 - DNA, 22 bp, Homo sapiens
ggcttcagtgagctgagctcac

SEQ ID NO: 9124856 - DNA, 22 bp, Homo sapiens
gggaacagagtgccagactgac

SEQ ID NO: 9124857 - DNA, 22 bp, Homo sapiens
gggaacagggcctgagctgggg

SEQ ID NO: 9124858 - DNA, 23 bp, Homo sapiens
ggctcctggattcaaatcctgcc

SEQ ID NO: 9124859 - DNA, 22 bp, Homo sapiens
ggctggctacattggaggaagg

SEQ ID NO: 9124860 - DNA, 22 bp, Homo sapiens
ggccagaggacctctcatagcc

SEQ ID NO: 9124861 - DNA, 18 bp, Homo sapiens
ggccagagggagggtccc

SEQ ID NO: 9124862 - DNA, 22 bp, Homo sapiens
ggccagaagttggaaaagagcc

SEQ ID NO: 9124863 - DNA, 22 bp, Homo sapiens
ggctccaagtctcagagtgaag

SEQ ID NO: 9124864 - DNA, 20 bp, Homo sapiens
tgtctgaaaaggaagctatc

SEQ ID NO: 9124865 - DNA, 22 bp, Homo sapiens
tgtctgaaacttggtcctatgc

SEQ ID NO: 9124866 - DNA, 22 bp, Homo sapiens
tgtctgaaagaggacgagctgg

SEQ ID NO: 9124867 - DNA, 22 bp, Homo sapiens
tgtctgaagcagccagtgctgt

SEQ ID NO: 9124868 - DNA, 22 bp, Homo sapiens
tgtctgaacgaagtaggtccac

SEQ ID NO: 9124869 - DNA, 22 bp, Homo sapiens
tgtctgaactgcactgaaagac

SEQ ID NO: 9124870 - DNA, 22 bp, Homo sapiens
tgtctgaacaaactctgcctcc

SEQ ID NO: 9124871 - DNA, 22 bp, Homo sapiens
tgtctgaattcaagaaattcaa

SEQ ID NO: 9124872 - DNA, 22 bp, Homo sapiens
tgtctgaatctcggtttcctca

SEQ ID NO: 9124873 - DNA, 22 bp, Homo sapiens
tgtctgaaggcaggtggagaac

SEQ ID NO: 9124874 - DNA, 22 bp, Homo sapiens
tgtctgaatcgcttcctagagg

SEQ ID NO: 9124875 - DNA, 22 bp, Homo sapiens
tgtctgaattttggaatcaagt

SEQ ID NO: 9124876 - DNA, 22 bp, Homo sapiens
tgtctgaggaagtcagcccttt

SEQ ID NO: 9124877 - DNA, 22 bp, Homo sapiens
tgtctgagtggtgcaaggctga

SEQ ID NO: 9124878 - DNA, 22 bp, Homo sapiens
tgttgacaataaagtctaccat

SEQ ID NO: 9124879 - DNA, 19 bp, Homo sapiens
tgttgacattctgagttga

SEQ ID NO: 9124880 - DNA, 22 bp, Homo sapiens
tgtttaaatagaacatactgca

SEQ ID NO: 9124881 - DNA, 22 bp, Homo sapiens
tgtttactcctgatatattttt

SEQ ID NO: 9124882 - DNA, 22 bp, Homo sapiens
tgttttaatctcccattgctct

SEQ ID NO: 9124883 - DNA, 22 bp, Homo sapiens
tgttttaagagcgcactttata

SEQ ID NO: 9124884 - DNA, 22 bp, Homo sapiens
tgtttttccatgtgcagaacaa

SEQ ID NO: 9124885 - DNA, 22 bp, Homo sapiens
tgtgggaagatgttgcaggaga

SEQ ID NO: 9124886 - DNA, 22 bp, Homo sapiens
tgtgggaagtttggagggaaag

SEQ ID NO: 9124887 - DNA, 22 bp, Homo sapiens
tgtgggaatcagccaggggggc

SEQ ID NO: 9124888 - DNA, 22 bp, Homo sapiens
tgtgggaagagcagtggcagca

SEQ ID NO: 9124889 - DNA, 22 bp, Homo sapiens
tgtgggaatgacgaggaagagg

SEQ ID NO: 9124890 - DNA, 22 bp, Homo sapiens
tgtgggaatgctgatgggatct

SEQ ID NO: 9124891 - DNA, 23 bp, Homo sapiens
tgtgggaatgttggagaggaaac

SEQ ID NO: 9124892 - DNA, 20 bp, Homo sapiens
tgtgggccttcggcgtgctc

SEQ ID NO: 9124893 - DNA, 22 bp, Homo sapiens
tgtgggcctgggaaggtgacac

SEQ ID NO: 9124894 - DNA, 20 bp, Homo sapiens
tgtgggcccttggctggcaa

SEQ ID NO: 9124895 - DNA, 22 bp, Homo sapiens
tgtgggattcatttggatcagc

SEQ ID NO: 9124896 - DNA, 22 bp, Homo sapiens
tgtgtgggagcacgggctgttg

SEQ ID NO: 9124897 - DNA, 22 bp, Homo sapiens
ttagtagtgatgttatttcaag

SEQ ID NO: 9124898 - DNA, 22 bp, Homo sapiens
ttagggttacaccagcctcctg

SEQ ID NO: 9124899 - DNA, 22 bp, Homo sapiens
ttaggtaagtaggatcaaaaaa

SEQ ID NO: 9124900 - DNA, 22 bp, Homo sapiens
ttaattaaattcatgagcattg

SEQ ID NO: 9124901 - DNA, 22 bp, Homo sapiens
ttacacaaaaataagatatggc

SEQ ID NO: 9124902 - DNA, 22 bp, Homo sapiens
ttacagatcatcaaggtataat

SEQ ID NO: 9124903 - DNA, 22 bp, Homo sapiens
tgggggcacttcgaggtcgcct

SEQ ID NO: 9124904 - DNA, 22 bp, Homo sapiens
tgggggagccttcacagtagct

SEQ ID NO: 9124905 - DNA, 22 bp, Homo sapiens
tggggacattcatgcaggttgt

SEQ ID NO: 9124906 - DNA, 22 bp, Homo sapiens
tggggacagggctcagcaattt

SEQ ID NO: 9124907 - DNA, 22 bp, Homo sapiens
tggggacaggagacttacagct

SEQ ID NO: 9124908 - DNA, 17 bp, Homo sapiens
tggggaagctcagattt

SEQ ID NO: 9124909 - DNA, 22 bp, Homo sapiens
tggggaaggcggagcttgcagc

SEQ ID NO: 9124910 - DNA, 22 bp, Homo sapiens
tggggacacagaggttcgttgg

SEQ ID NO: 9124911 - DNA, 22 bp, Homo sapiens
tggggaagggcaccctggagac

SEQ ID NO: 9124912 - DNA, 22 bp, Homo sapiens
tgggctcagggtcgaggacttt

SEQ ID NO: 9124913 - DNA, 22 bp, Homo sapiens
tgggctcaggaccccagaggcc

SEQ ID NO: 9124914 - DNA, 18 bp, Homo sapiens
tgggctcaaaggatcctc

SEQ ID NO: 9124915 - DNA, 22 bp, Homo sapiens
tgggcctcatcttcaatgagtc

SEQ ID NO: 9124916 - DNA, 22 bp, Homo sapiens
tgggcaagctctgggtggacac

SEQ ID NO: 9124917 - DNA, 18 bp, Homo sapiens
tggtgaagggtggaggag

SEQ ID NO: 9124918 - DNA, 22 bp, Homo sapiens
tggtcctcaccctacccagctg

SEQ ID NO: 9124919 - DNA, 20 bp, Homo sapiens
tggtcctcacatgccatctt

SEQ ID NO: 9124920 - DNA, 22 bp, Homo sapiens
tggtgggagtgagggcatgcca

SEQ ID NO: 9124921 - DNA, 16 bp, Homo sapiens
tggtggggaggacagc

SEQ ID NO: 9124922 - DNA, 22 bp, Homo sapiens
tggtggggccagacttcagctc

SEQ ID NO: 9124923 - DNA, 22 bp, Homo sapiens
tggtggggctttccttctgctt

SEQ ID NO: 9124924 - DNA, 22 bp, Homo sapiens
tggtgggggaggctgtctagca

SEQ ID NO: 9124925 - DNA, 22 bp, Homo sapiens
tgtacacaattcttaacataca

SEQ ID NO: 9124926 - DNA, 23 bp, Homo sapiens
tggtggggtcttggagacagcac

SEQ ID NO: 9124927 - DNA, 17 bp, Homo sapiens
tgtagcttctccttctc

SEQ ID NO: 9124928 - DNA, 18 bp, Homo sapiens
tgtagagccaggtttgcc

SEQ ID NO: 9124929 - DNA, 22 bp, Homo sapiens
tgtatcaaaccaaattaattct

SEQ ID NO: 9124930 - DNA, 22 bp, Homo sapiens
tgtatcaagggtttatgtaagc

SEQ ID NO: 9124931 - DNA, 22 bp, Homo sapiens
tgtcatctgcgggtggcactgc

SEQ ID NO: 9124932 - DNA, 22 bp, Homo sapiens
tgtcatttaatagatatgatgg

SEQ ID NO: 9124933 - DNA, 22 bp, Homo sapiens
tgtcatttactccataccctca

SEQ ID NO: 9124934 - DNA, 22 bp, Homo sapiens
tgtcatttcacaatatcactca

SEQ ID NO: 9124935 - DNA, 22 bp, Homo sapiens
tgtcctcacaggaatgaacttt

SEQ ID NO: 9124936 - DNA, 22 bp, Homo sapiens
tgtcctcagatatgtctactct

SEQ ID NO: 9124937 - DNA, 22 bp, Homo sapiens
tggaatggaaacaaactgagga

SEQ ID NO: 9124938 - DNA, 23 bp, Homo sapiens
tggaagcaatcactgtagtgaat

SEQ ID NO: 9124939 - DNA, 22 bp, Homo sapiens
tggaagcacaggatcagtggaa

SEQ ID NO: 9124940 - DNA, 22 bp, Homo sapiens
tggaacaattcttgaagggaat

SEQ ID NO: 9124941 - DNA, 22 bp, Homo sapiens
tggaacaatcccggtttagctc

SEQ ID NO: 9124942 - DNA, 22 bp, Homo sapiens
tggaacaaattttggggacctt

SEQ ID NO: 9124943 - DNA, 22 bp, Homo sapiens
tggaacaaattacaattaactt

SEQ ID NO: 9124944 - DNA, 19 bp, Homo sapiens
tggaacaaactgcaatgac

SEQ ID NO: 9124945 - DNA, 22 bp, Homo sapiens
tggaacaaacatggtgatggct

SEQ ID NO: 9124946 - DNA, 22 bp, Homo sapiens
tggaacaaaatatttatgtttg

SEQ ID NO: 9124947 - DNA, 22 bp, Homo sapiens
tggaacaagggttcatttaaat

SEQ ID NO: 9124948 - DNA, 22 bp, Homo sapiens
tggaacaagggcgtggcggtcg

SEQ ID NO: 9124949 - DNA, 22 bp, Homo sapiens
tggaacaagacagcatagagct

SEQ ID NO: 9124950 - DNA, 22 bp, Homo sapiens
tggaacaacatgctggaaaatt

SEQ ID NO: 9124951 - DNA, 22 bp, Homo sapiens
tggaacaactccctcggagcct

SEQ ID NO: 9124952 - DNA, 22 bp, Homo sapiens
tggaacaagaagcaggtcgctt

SEQ ID NO: 9124953 - DNA, 21 bp, Homo sapiens
tggacttatggagtgtttctt

SEQ ID NO: 9124954 - DNA, 22 bp, Homo sapiens
tgctgcttggcaccctcagagt

SEQ ID NO: 9124955 - DNA, 22 bp, Homo sapiens
tgggaacagtagctgctgagct

SEQ ID NO: 9124956 - DNA, 22 bp, Homo sapiens
tgggaacattttgagctgagag

SEQ ID NO: 9124957 - DNA, 22 bp, Homo sapiens
tgggaacacctgctgcccagtg

SEQ ID NO: 9124958 - DNA, 22 bp, Homo sapiens
tgggaacaacatgcactgccac

SEQ ID NO: 9124959 - DNA, 22 bp, Homo sapiens
tgggaacagaggacttgactgt

SEQ ID NO: 9124960 - DNA, 20 bp, Homo sapiens
tgggaaagtctaagtgcctc

SEQ ID NO: 9124961 - DNA, 22 bp, Homo sapiens
tgggaaagactcaggacaggag

SEQ ID NO: 9124962 - DNA, 22 bp, Homo sapiens
tgggaggatctcttgaggccag

SEQ ID NO: 9124963 - DNA, 22 bp, Homo sapiens
tgggaggacttgtgggcttcat

SEQ ID NO: 9124964 - DNA, 22 bp, Homo sapiens
tgggacaggttggagagaagca

SEQ ID NO: 9124965 - DNA, 22 bp, Homo sapiens
tgggaaggcgtggaagtagaag

SEQ ID NO: 9124966 - DNA, 22 bp, Homo sapiens
tgggaaggtacacgggaaagag

SEQ ID NO: 9124967 - DNA, 22 bp, Homo sapiens
tgggaaggggagctggaaagga

SEQ ID NO: 9124968 - DNA, 22 bp, Homo sapiens
tggctcagaagaaaaggtaaac

SEQ ID NO: 9124969 - DNA, 22 bp, Homo sapiens
tggctcagaactacttctagtt

SEQ ID NO: 9124970 - DNA, 22 bp, Homo sapiens
tggctcagagcagggactctgg

SEQ ID NO: 9124971 - DNA, 22 bp, Homo sapiens
tggctcagagccttgagagctg

SEQ ID NO: 9124972 - DNA, 22 bp, Homo sapiens
tggctcagaaggctgccttcac

SEQ ID NO: 9124973 - DNA, 22 bp, Homo sapiens
tggctcagagagggagtgtgga

SEQ ID NO: 9124974 - DNA, 22 bp, Homo sapiens
tggctcagatttttgtaggctt

SEQ ID NO: 9124975 - DNA, 18 bp, Homo sapiens
tggctcagatggctttaa

SEQ ID NO: 9124976 - DNA, 22 bp, Homo sapiens
tggctcagatgctcttccagtg

SEQ ID NO: 9124977 - DNA, 22 bp, Homo sapiens
tggctcagaggggaagtggttt

SEQ ID NO: 9124978 - DNA, 22 bp, Homo sapiens
tggctcagagttcatcttttag

SEQ ID NO: 9124979 - DNA, 22 bp, Homo sapiens
tggctcagataattcaaggggc

SEQ ID NO: 9124980 - DNA, 22 bp, Homo sapiens
tggctcagctttccccatctgg

SEQ ID NO: 9124981 - DNA, 22 bp, Homo sapiens
tggctcaggagggatctttgct

SEQ ID NO: 9124982 - DNA, 22 bp, Homo sapiens
tggctcaggataattttcccaa

SEQ ID NO: 9124983 - DNA, 22 bp, Homo sapiens
tggctcaggccacttcttttat

SEQ ID NO: 9124984 - DNA, 22 bp, Homo sapiens
tggctcaggatctaagcagaat

SEQ ID NO: 9124985 - DNA, 22 bp, Homo sapiens
tggctcaggcttgaaaatagat

SEQ ID NO: 9124986 - DNA, 22 bp, Homo sapiens
tggctcaggcctacgacgcctt

SEQ ID NO: 9124987 - DNA, 22 bp, Homo sapiens
tggctcagcattcactggtctt

SEQ ID NO: 9124988 - DNA, 22 bp, Homo sapiens
tggctcagcaggttagaaacta

SEQ ID NO: 9124989 - DNA, 22 bp, Homo sapiens
tggctcagcaagacattgacct

SEQ ID NO: 9124990 - DNA, 22 bp, Homo sapiens
tggctcagccagccctaggaac

SEQ ID NO: 9124991 - DNA, 22 bp, Homo sapiens
tggctcagcttacttttgaggg

SEQ ID NO: 9124992 - DNA, 22 bp, Homo sapiens
tggctcagtcatggatgagtaa

SEQ ID NO: 9124993 - DNA, 22 bp, Homo sapiens
tggctcagtgaagagataactt

SEQ ID NO: 9124994 - DNA, 22 bp, Homo sapiens
tggctcagtctgggttgactga

SEQ ID NO: 9124995 - DNA, 22 bp, Homo sapiens
tggctcagtgcattcacagtaa

SEQ ID NO: 9124996 - DNA, 22 bp, Homo sapiens
tggctcagtgacattcctccca

SEQ ID NO: 9124997 - DNA, 22 bp, Homo sapiens
tggctcaggggtctggctctgt

SEQ ID NO: 9124998 - DNA, 23 bp, Homo sapiens
tggctcagggtctcttatgaagt

SEQ ID NO: 9124999 - DNA, 22 bp, Homo sapiens
tggctcagggtccccaaatggt

SEQ ID NO: 9125000 - DNA, 22 bp, Homo sapiens
tggctcagtaatcgagtctcct

SEQ ID NO: 9125001 - DNA, 22 bp, Homo sapiens
tggctcagtagcagtgtggtca

SEQ ID NO: 9125002 - DNA, 22 bp, Homo sapiens
tggctcaggtgtgagctgaaga

SEQ ID NO: 9125003 - DNA, 22 bp, Homo sapiens
tggctcagttccatcatctgga

SEQ ID NO: 9125004 - DNA, 22 bp, Homo sapiens
tggctcagtggcagccgcagct

SEQ ID NO: 9125005 - DNA, 22 bp, Homo sapiens
tggctcagttaggtcagaaaca

SEQ ID NO: 9125006 - DNA, 21 bp, Homo sapiens
tggctcagttgctgggcacag

SEQ ID NO: 9125007 - DNA, 19 bp, Homo sapiens
tgaatgacgggcatgagca

SEQ ID NO: 9125008 - DNA, 22 bp, Homo sapiens
tgaaggcccagccacagaatgg

SEQ ID NO: 9125009 - DNA, 22 bp, Homo sapiens
tgaaggcctaacttccagtgct

SEQ ID NO: 9125010 - DNA, 23 bp, Homo sapiens
tgaaggccctggagccacgaggc

SEQ ID NO: 9125011 - DNA, 22 bp, Homo sapiens
tgaaggccagcagagtgaaggc

SEQ ID NO: 9125012 - DNA, 17 bp, Homo sapiens
tgaaagaatcagggaga

SEQ ID NO: 9125013 - DNA, 22 bp, Homo sapiens
tgaaaattgttgtacttgataa

SEQ ID NO: 9125014 - DNA, 21 bp, Homo sapiens
tgaacaaagttcttatcgtga

SEQ ID NO: 9125015 - DNA, 22 bp, Homo sapiens
tgaacacacacatcttaataat

SEQ ID NO: 9125016 - DNA, 22 bp, Homo sapiens
tgaacaaactgcattcttcact

SEQ ID NO: 9125017 - DNA, 22 bp, Homo sapiens
tgaaatgtctttgcaattgaaa

SEQ ID NO: 9125018 - DNA, 22 bp, Homo sapiens
tgaaatgtacaagtgctttttt

SEQ ID NO: 9125019 - DNA, 23 bp, Homo sapiens
tgaaatattcttttgcatgagct

SEQ ID NO: 9125020 - DNA, 22 bp, Homo sapiens
tgaaagtatttgatttctatta

SEQ ID NO: 9125021 - DNA, 22 bp, Homo sapiens
tgagggaggccctttgagcaga

SEQ ID NO: 9125022 - DNA, 22 bp, Homo sapiens
tgagggagtgtggatacagtag

SEQ ID NO: 9125023 - DNA, 22 bp, Homo sapiens
tgagggagtgtggatacagtag

SEQ ID NO: 9125024 - DNA, 22 bp, Homo sapiens
tgaggccagccacagccaccct

SEQ ID NO: 9125025 - DNA, 22 bp, Homo sapiens
tgaggaagcaaaggcttgtgtg

SEQ ID NO: 9125026 - DNA, 22 bp, Homo sapiens
tgaggaaggaattgaggtttta

SEQ ID NO: 9125027 - DNA, 22 bp, Homo sapiens
tgaggaaggaattgaggtttta

SEQ ID NO: 9125028 - DNA, 22 bp, Homo sapiens
tgaggaagggtgtgacggcacc

SEQ ID NO: 9125029 - DNA, 22 bp, Homo sapiens
tgaggagaaatgctcagagcca

SEQ ID NO: 9125030 - DNA, 22 bp, Homo sapiens
tgaggaagtggttgtatggttt

SEQ ID NO: 9125031 - DNA, 22 bp, Homo sapiens
tgagccaggtctcactcacctt

SEQ ID NO: 9125032 - DNA, 22 bp, Homo sapiens
tgagccaggcactgctcctgga

SEQ ID NO: 9125033 - DNA, 21 bp, Homo sapiens
tgagccaggctgacggctgtg

SEQ ID NO: 9125034 - DNA, 22 bp, Homo sapiens
tgagcagaggagtgacgtaggt

SEQ ID NO: 9125035 - DNA, 22 bp, Homo sapiens
tgagatcattgacttgttcctg

SEQ ID NO: 9125036 - DNA, 22 bp, Homo sapiens
tgagatgctgctgtaacaaata

SEQ ID NO: 9125037 - DNA, 22 bp, Homo sapiens
tgagaagattgggcagagtgga

SEQ ID NO: 9125038 - DNA, 22 bp, Homo sapiens
tgcaaactattggtagagatgg

SEQ ID NO: 9125039 - DNA, 22 bp, Homo sapiens
tgagtgggatgagttagaggtg

SEQ ID NO: 9125040 - DNA, 22 bp, Homo sapiens
tgagtgggattaaatgaggtga

SEQ ID NO: 9125041 - DNA, 23 bp, Homo sapiens
tgatgctcagaatgcaggtatag

SEQ ID NO: 9125042 - DNA, 19 bp, Homo sapiens
tgatgctcactggtttggg

SEQ ID NO: 9125043 - DNA, 22 bp, Homo sapiens
tgatgctctcctaatatgaaaa

SEQ ID NO: 9125044 - DNA, 22 bp, Homo sapiens
tgcagctcaggattctcagggc

SEQ ID NO: 9125045 - DNA, 22 bp, Homo sapiens
tgccccagacctactgaatggg

SEQ ID NO: 9125046 - DNA, 22 bp, Homo sapiens
tctcctggagcaggaaggtggg

SEQ ID NO: 9125047 - DNA, 22 bp, Homo sapiens
tctcccagtggtgcagaaagca

SEQ ID NO: 9125048 - DNA, 20 bp, Homo sapiens
tctcccaggctcagggaaga

SEQ ID NO: 9125049 - DNA, 22 bp, Homo sapiens
tctcccaggtgggtgcctggag

SEQ ID NO: 9125050 - DNA, 22 bp, Homo sapiens
tctccaggcttaatctcagctt

SEQ ID NO: 9125051 - DNA, 22 bp, Homo sapiens
tctcccagaagtcctcagtaca

SEQ ID NO: 9125052 - DNA, 22 bp, Homo sapiens
tctcccagaggatcccagtgga

SEQ ID NO: 9125053 - DNA, 22 bp, Homo sapiens
tctcaccccgttttctgtgtga

SEQ ID NO: 9125054 - DNA, 22 bp, Homo sapiens
tctcacagtgcaggtctgtctc

SEQ ID NO: 9125055 - DNA, 22 bp, Homo sapiens
tctcagctcttttttcacagaa

SEQ ID NO: 9125056 - DNA, 22 bp, Homo sapiens
tctccaggcactacctgggtaa

SEQ ID NO: 9125057 - DNA, 22 bp, Homo sapiens
tctccaggaagccctccctgac

SEQ ID NO: 9125058 - DNA, 22 bp, Homo sapiens
tctccaaatagttatatttaga

SEQ ID NO: 9125059 - DNA, 22 bp, Homo sapiens
tctcatggagtcaggagcagaa

SEQ ID NO: 9125060 - DNA, 22 bp, Homo sapiens
tctgaagcacagcaggaagggt

SEQ ID NO: 9125061 - DNA, 22 bp, Homo sapiens
tctgaagagtcttgcaagaaag

SEQ ID NO: 9125062 - DNA, 19 bp, Homo sapiens
tctgaagaattagagagca

SEQ ID NO: 9125063 - DNA, 22 bp, Homo sapiens
tctgaagagctttggaagtatg

SEQ ID NO: 9125064 - DNA, 22 bp, Homo sapiens
tctgaaggttgagaagggctga

SEQ ID NO: 9125065 - DNA, 22 bp, Homo sapiens
tctgaaggtgctagagaaagct

SEQ ID NO: 9125066 - DNA, 22 bp, Homo sapiens
tctgaaggaaaagggtagatat

SEQ ID NO: 9125067 - DNA, 22 bp, Homo sapiens
tctgaagctggaggaagctttg

SEQ ID NO: 9125068 - DNA, 18 bp, Homo sapiens
tctgaaggaatgattcca

SEQ ID NO: 9125069 - DNA, 22 bp, Homo sapiens
tcctggggaggtcgaggctgag

SEQ ID NO: 9125070 - DNA, 22 bp, Homo sapiens
tcctgggattaaggtggtgatt

SEQ ID NO: 9125071 - DNA, 22 bp, Homo sapiens
tcctgggaccgagggaagagct

SEQ ID NO: 9125072 - DNA, 22 bp, Homo sapiens
tcctgggaagactgtgaggaca

SEQ ID NO: 9125073 - DNA, 22 bp, Homo sapiens
tcctggggccagcactggtgga

SEQ ID NO: 9125074 - DNA, 19 bp, Homo sapiens
tcctggggatgtggtcacc

SEQ ID NO: 9125075 - DNA, 22 bp, Homo sapiens
tcctggggctgcaaggcctgtc

SEQ ID NO: 9125076 - DNA, 22 bp, Homo sapiens
tctcaaggactttgggcactaa

SEQ ID NO: 9125077 - DNA, 22 bp, Homo sapiens
tctaccctgcggtcttggggca

SEQ ID NO: 9125078 - DNA, 22 bp, Homo sapiens
tcgcccaggctggaagtgcagt

SEQ ID NO: 9125079 - DNA, 22 bp, Homo sapiens
tcgtcatctgaaggctgtcaat

SEQ ID NO: 9125080 - DNA, 22 bp, Homo sapiens
tctttaatgtactttctttcac

SEQ ID NO: 9125081 - DNA, 22 bp, Homo sapiens
tctttaatatctgccccagagc

SEQ ID NO: 9125082 - DNA, 22 bp, Homo sapiens
tctttaatatctgccccagagc

SEQ ID NO: 9125083 - DNA, 22 bp, Homo sapiens
tctttaatcataaccaagatgg

SEQ ID NO: 9125084 - DNA, 22 bp, Homo sapiens
tctttaatcataaccaagatgg

SEQ ID NO: 9125085 - DNA, 22 bp, Homo sapiens
tctttaattgtggaagagcagc

SEQ ID NO: 9125086 - DNA, 22 bp, Homo sapiens
tctttaattgtggaagagcagc

SEQ ID NO: 9125087 - DNA, 22 bp, Homo sapiens
tctttaattcagcatgatgcgg

SEQ ID NO: 9125088 - DNA, 22 bp, Homo sapiens
tctttaattcagcatgatgcgg

SEQ ID NO: 9125089 - DNA, 22 bp, Homo sapiens
tctttaatgtactttctttcac

SEQ ID NO: 9125090 - DNA, 22 bp, Homo sapiens
tctttaatgtgattgtaattat

SEQ ID NO: 9125091 - DNA, 22 bp, Homo sapiens
tctttaatgtgattgtaattat

SEQ ID NO: 9125092 - DNA, 22 bp, Homo sapiens
tcttccagctccccacggtgtc

SEQ ID NO: 9125093 - DNA, 22 bp, Homo sapiens
tctgtgcactaacattcctggt

SEQ ID NO: 9125094 - DNA, 22 bp, Homo sapiens
tctgttttgtaccagatacagc

SEQ ID NO: 9125095 - DNA, 22 bp, Homo sapiens
tctggggcagttactggggcct

SEQ ID NO: 9125096 - DNA, 22 bp, Homo sapiens
tctgtagggtagtagtggagat

SEQ ID NO: 9125097 - DNA, 22 bp, Homo sapiens
tctgtaggacagagaaatgggg

SEQ ID NO: 9125098 - DNA, 20 bp, Homo sapiens
tctgtaggcaagttagcagg

SEQ ID NO: 9125099 - DNA, 22 bp, Homo sapiens
tctggaggctctgagggtgagt

SEQ ID NO: 9125100 - DNA, 22 bp, Homo sapiens
tctggagaaggaagagtctttg

SEQ ID NO: 9125101 - DNA, 22 bp, Homo sapiens
tctgagccagacaagacagcca

SEQ ID NO: 9125102 - DNA, 22 bp, Homo sapiens
tctgagcccctagaactgagcg

SEQ ID NO: 9125103 - DNA, 22 bp, Homo sapiens
tctgagggtgggagaaggagct

SEQ ID NO: 9125104 - DNA, 22 bp, Homo sapiens
aatactttcctatataaggtgc

SEQ ID NO: 9125105 - DNA, 22 bp, Homo sapiens
aagtaaatatctgtttatagca

SEQ ID NO: 9125106 - DNA, 21 bp, Homo sapiens
acctttaattcaagcatcagg

SEQ ID NO: 9125107 - DNA, 22 bp, Homo sapiens
aataaatgaacaaagcaggttg

SEQ ID NO: 9125108 - DNA, 22 bp, Homo sapiens
acaggaggagctgtttcaggga

SEQ ID NO: 9125109 - DNA, 22 bp, Homo sapiens
acaggaggagcagctgtgtgcc

SEQ ID NO: 9125110 - DNA, 22 bp, Homo sapiens
acattctgaaaaacagtgtttt

SEQ ID NO: 9125111 - DNA, 22 bp, Homo sapiens
acattctgtgagtcatgtttta

SEQ ID NO: 9125112 - DNA, 22 bp, Homo sapiens
acattctgtttccccaaagaga

SEQ ID NO: 9125113 - DNA, 22 bp, Homo sapiens
acattctgtcaacagtgagcag

SEQ ID NO: 9125114 - DNA, 22 bp, Homo sapiens
aaggttgatatgtatctaggga

SEQ ID NO: 9125115 - DNA, 22 bp, Homo sapiens
aatgtataaagtgttaataact

SEQ ID NO: 9125116 - DNA, 22 bp, Homo sapiens
agagagaggcagcagtgctcac

SEQ ID NO: 9125117 - DNA, 22 bp, Homo sapiens
agactcttggtcattggcatta

SEQ ID NO: 9125118 - DNA, 22 bp, Homo sapiens
agaggccaatagtaggtggcat

SEQ ID NO: 9125119 - DNA, 22 bp, Homo sapiens
agatctggccctcagcttgatt

SEQ ID NO: 9125120 - DNA, 22 bp, Homo sapiens
agatctggaactgaggtttatt

SEQ ID NO: 9125121 - DNA, 22 bp, Homo sapiens
agatctggttggagtcctgaca

SEQ ID NO: 9125122 - DNA, 22 bp, Homo sapiens
acacacagaaggaagccccact

SEQ ID NO: 9125123 - DNA, 22 bp, Homo sapiens
agcactttagaatttagagttg

SEQ ID NO: 9125124 - DNA, 22 bp, Homo sapiens
acagaacatggatttttgaagt

SEQ ID NO: 9125125 - DNA, 22 bp, Homo sapiens
acagaacagagggttttagaat

SEQ ID NO: 9125126 - DNA, 22 bp, Homo sapiens
acagaacaggctgagaaaaaca

SEQ ID NO: 9125127 - DNA, 22 bp, Homo sapiens
acagaacatattgcttctctca

SEQ ID NO: 9125128 - DNA, 22 bp, Homo sapiens
acagaacaagacctgcttattg

SEQ ID NO: 9125129 - DNA, 22 bp, Homo sapiens
agcattccacactgaagtctgc

SEQ ID NO: 9125130 - DNA, 22 bp, Homo sapiens
aatgttttttggtctgatgaat

SEQ ID NO: 9125131 - DNA, 22 bp, Homo sapiens
aatgttttgtatgcctctgagc

SEQ ID NO: 9125132 - DNA, 22 bp, Homo sapiens
aagaggaggattgatgtgggag

SEQ ID NO: 9125133 - DNA, 22 bp, Homo sapiens
aagagtggagctggaaagtggg

SEQ ID NO: 9125134 - DNA, 21 bp, Homo sapiens
aagagtggctgaggaggtgat

SEQ ID NO: 9125135 - DNA, 18 bp, Homo sapiens
acagaggcagacatgtat

SEQ ID NO: 9125136 - DNA, 22 bp, Homo sapiens
aagctgtgaaatagattacaca

SEQ ID NO: 9125137 - DNA, 22 bp, Homo sapiens
aagttacattttggtctaattg

SEQ ID NO: 9125138 - DNA, 22 bp, Homo sapiens
aacactgagtatcagagttggg

SEQ ID NO: 9125139 - DNA, 22 bp, Homo sapiens
aacactgagggaaaagagatag

SEQ ID NO: 9125140 - DNA, 22 bp, Homo sapiens
aagtcaaagctttcagaggaaa

SEQ ID NO: 9125141 - DNA, 22 bp, Homo sapiens
aataaactgctcaattgcatca

SEQ ID NO: 9125142 - DNA, 19 bp, Homo sapiens
aaatatcagagagatgata

SEQ ID NO: 9125143 - DNA, 22 bp, Homo sapiens
aagaatgtggcatttatttata

SEQ ID NO: 9125144 - DNA, 22 bp, Homo sapiens
aaaaatgtgaccacagggtgtt

SEQ ID NO: 9125145 - DNA, 22 bp, Homo sapiens
aaaaatgtcattatggaactga

SEQ ID NO: 9125146 - DNA, 22 bp, Homo sapiens
aaacatagataatagatagatg

SEQ ID NO: 9125147 - DNA, 22 bp, Homo sapiens
aaaggaggaatggagagatgct

SEQ ID NO: 9125148 - DNA, 22 bp, Homo sapiens
aaatcatgtgcagagatcagga

SEQ ID NO: 9125149 - DNA, 23 bp, Homo sapiens
aaaccttttgtagaacaattgct

SEQ ID NO: 9125150 - DNA, 22 bp, Homo sapiens
aaaccttttcagctgaatggag

SEQ ID NO: 9125151 - DNA, 22 bp, Homo sapiens
aaatagaattggaagcagagtt

SEQ ID NO: 9125152 - DNA, 22 bp, Homo sapiens
aaactaaacctggcttagtaag

SEQ ID NO: 9125153 - DNA, 22 bp, Homo sapiens
agccagatgaagaggtccttaa

SEQ ID NO: 9125154 - DNA, 23 bp, Homo sapiens
agccagttgtagccacagaactc

SEQ ID NO: 9125155 - DNA, 20 bp, Homo sapiens
cagcaactttggactgagtt

SEQ ID NO: 9125156 - DNA, 22 bp, Homo sapiens
agcagagtcttcaagggcaggc

SEQ ID NO: 9125157 - DNA, 21 bp, Homo sapiens
agcagaggcagaatgtatgca

SEQ ID NO: 9125158 - DNA, 22 bp, Homo sapiens
agagtccaccctggggtcaggc

SEQ ID NO: 9125159 - DNA, 23 bp, Homo sapiens
agaggggagcatctgctggctga

SEQ ID NO: 9125160 - DNA, 22 bp, Homo sapiens
agaggaggctgggtccagataa

SEQ ID NO: 9125161 - DNA, 22 bp, Homo sapiens
agagctggctgtgggtgacttt

SEQ ID NO: 9125162 - DNA, 22 bp, Homo sapiens
agaggccagcaaccacagtaaa

SEQ ID NO: 9125163 - DNA, 23 bp, Homo sapiens
agaggccagcctttggagacacc

SEQ ID NO: 9125164 - DNA, 22 bp, Homo sapiens
caaagcagacctttacccttta

SEQ ID NO: 9125165 - DNA, 22 bp, Homo sapiens
agatggcagcagaacaaacagg

SEQ ID NO: 9125166 - DNA, 22 bp, Homo sapiens
agagctggcagcagcttctcct

SEQ ID NO: 9125167 - DNA, 22 bp, Homo sapiens
agagctggaatcagacctcagg

SEQ ID NO: 9125168 - DNA, 22 bp, Homo sapiens
agactttatccctgtttttctc

SEQ ID NO: 9125169 - DNA, 22 bp, Homo sapiens
agactttatagtttttggctat

SEQ ID NO: 9125170 - DNA, 22 bp, Homo sapiens
agactttataaatcttaatttc

SEQ ID NO: 9125171 - DNA, 22 bp, Homo sapiens
agactttagggccatggtaggt

SEQ ID NO: 9125172 - DNA, 22 bp, Homo sapiens
agactttagatacgtcttcttc

SEQ ID NO: 9125173 - DNA, 22 bp, Homo sapiens
agactttagaatcagatagcct

SEQ ID NO: 9125174 - DNA, 19 bp, Homo sapiens
agacttgtcaaattatagt

SEQ ID NO: 9125175 - DNA, 22 bp, Homo sapiens
agactttaacaatgggtatgaa

SEQ ID NO: 9125176 - DNA, 22 bp, Homo sapiens
agactttaatgtgcaaatgaaa

SEQ ID NO: 9125177 - DNA, 19 bp, Homo sapiens
agacttttgtaagttgaga

SEQ ID NO: 9125178 - DNA, 22 bp, Homo sapiens
agagaagggtgtagcctgggcc

SEQ ID NO: 9125179 - DNA, 22 bp, Homo sapiens
agagaatacaaagaagatatgt

SEQ ID NO: 9125180 - DNA, 22 bp, Homo sapiens
agagaggcattcggtgatccca

SEQ ID NO: 9125181 - DNA, 22 bp, Homo sapiens
agagaggctgctggactatatg

SEQ ID NO: 9125182 - DNA, 22 bp, Homo sapiens
agaaggagtgtacaggtcatgc

SEQ ID NO: 9125183 - DNA, 22 bp, Homo sapiens
atccccacgatatagccaaagc

SEQ ID NO: 9125184 - DNA, 22 bp, Homo sapiens
atatttctccaaatgttttcaa

SEQ ID NO: 9125185 - DNA, 21 bp, Homo sapiens
actttaatatacatgaggagg

SEQ ID NO: 9125186 - DNA, 21 bp, Homo sapiens
actttaatatacatgaggagg

SEQ ID NO: 9125187 - DNA, 22 bp, Homo sapiens
actttaattaatgaactgtggc

SEQ ID NO: 9125188 - DNA, 22 bp, Homo sapiens
actttaattaatgaactgtggc

SEQ ID NO: 9125189 - DNA, 21 bp, Homo sapiens
actttacaatttacatagtga

SEQ ID NO: 9125190 - DNA, 22 bp, Homo sapiens
agtactttacttcttacagttt

SEQ ID NO: 9125191 - DNA, 22 bp, Homo sapiens
agtagtggcttcctggagtgct

SEQ ID NO: 9125192 - DNA, 22 bp, Homo sapiens
aggtggggaaaccagcgatccc

SEQ ID NO: 9125193 - DNA, 22 bp, Homo sapiens
agtaataatagctgtaaagtgc

SEQ ID NO: 9125194 - DNA, 22 bp, Homo sapiens
agctgggatgataacctcagtc

SEQ ID NO: 9125195 - DNA, 22 bp, Homo sapiens
agctgggatgaggagcatcctt

SEQ ID NO: 9125196 - DNA, 22 bp, Homo sapiens
agctgggaggtgggcagtgaga

SEQ ID NO: 9125197 - DNA, 22 bp, Homo sapiens
agctgggagcagagccacagcc

SEQ ID NO: 9125198 - DNA, 22 bp, Homo sapiens
aggaagagcattcacatggtag

SEQ ID NO: 9125199 - DNA, 22 bp, Homo sapiens
acagccagtcctcccacagggt

SEQ ID NO: 9125200 - DNA, 22 bp, Homo sapiens
acagccagtaatctacccctgt

SEQ ID NO: 9125201 - DNA, 22 bp, Homo sapiens
aggaggccgatttcagaggtcg

SEQ ID NO: 9125202 - DNA, 22 bp, Homo sapiens
aggagcctccttctcatgtgca

SEQ ID NO: 9125203 - DNA, 22 bp, Homo sapiens
aggcccagcttgaagtgggaag

SEQ ID NO: 9125204 - DNA, 22 bp, Homo sapiens
aggctccaggcaaaatttcgga

SEQ ID NO: 9125205 - DNA, 22 bp, Homo sapiens
acattaatgaggtgatgacaca

SEQ ID NO: 9125206 - DNA, 19 bp, Homo sapiens
accaggagtatcagagctg

SEQ ID NO: 9125207 - DNA, 22 bp, Homo sapiens
accaggagtctagcctagtcaa

SEQ ID NO: 9125208 - DNA, 22 bp, Homo sapiens
acccaccctactagcagtgtcc

SEQ ID NO: 9125209 - DNA, 22 bp, Homo sapiens
acccagagatggacctggctgc

SEQ ID NO: 9125210 - DNA, 22 bp, Homo sapiens
ccccagagaaagtcagcagcat

SEQ ID NO: 9125211 - DNA, 22 bp, Homo sapiens
cccagtttcaactttccagtgg

SEQ ID NO: 9125212 - DNA, 22 bp, Homo sapiens
agggtcaaaggaaaggcccaca

SEQ ID NO: 9125213 - DNA, 22 bp, Homo sapiens
agggctggagccacagctggga

SEQ ID NO: 9125214 - DNA, 22 bp, Homo sapiens
aggctgggaaggtaaagttgta

SEQ ID NO: 9125215 - DNA, 22 bp, Homo sapiens
aggctacagatacagaggctac

SEQ ID NO: 9125216 - DNA, 22 bp, Homo sapiens
aggctacatgttggggtggaag

SEQ ID NO: 9125217 - DNA, 22 bp, Homo sapiens
ccagagaaagctcacaggcagt

SEQ ID NO: 9125218 - DNA, 22 bp, Homo sapiens
ccagagaaaagaggccaaggat

SEQ ID NO: 9125219 - DNA, 22 bp, Homo sapiens
ccagagaaaaatgtgtccctgt

SEQ ID NO: 9125220 - DNA, 22 bp, Homo sapiens
aggccacagttgaggccagcaa

SEQ ID NO: 9125221 - DNA, 22 bp, Homo sapiens
ccagaaaatatggctaaggtga

SEQ ID NO: 9125222 - DNA, 22 bp, Homo sapiens
ccagctccggtgtgcttatttc

SEQ ID NO: 9125223 - DNA, 22 bp, Homo sapiens
ccagcaggagatgcctgtgtct

SEQ ID NO: 9125224 - DNA, 22 bp, Homo sapiens
aggagttatggcagaatcaaat

SEQ ID NO: 9125225 - DNA, 19 bp, Homo sapiens
ccaaaggaagtttccctcc

SEQ ID NO: 9125226 - DNA, 22 bp, Homo sapiens
cagttctacttggatgtctgca

SEQ ID NO: 9125227 - DNA, 22 bp, Homo sapiens
aggaggctgggcacagtggcct

SEQ ID NO: 9125228 - DNA, 22 bp, Homo sapiens
catcattaccatcattagtagt

SEQ ID NO: 9125229 - DNA, 22 bp, Homo sapiens
catcattaccttgtaaccaata

SEQ ID NO: 9125230 - DNA, 19 bp, Homo sapiens
catcattatcagttcactg

SEQ ID NO: 9125231 - DNA, 22 bp, Homo sapiens
aggagggttgaggaggatactt

SEQ ID NO: 9125232 - DNA, 22 bp, Homo sapiens
aggagggtggcctcatgtgagt

SEQ ID NO: 9125233 - DNA, 22 bp, Homo sapiens
atcataagacccagccagtatt

SEQ ID NO: 9125234 - DNA, 22 bp, Homo sapiens
atattattctagtaacagtgat

SEQ ID NO: 9125235 - DNA, 22 bp, Homo sapiens
ctgggggcaagcagacagctgt

SEQ ID NO: 9125236 - DNA, 22 bp, Homo sapiens
atcatcatcaacaagaaacatt

SEQ ID NO: 9125237 - DNA, 22 bp, Homo sapiens
cttaatctcacctgcaaagtcc

SEQ ID NO: 9125238 - DNA, 22 bp, Homo sapiens
cttattagaaagaaaagacatg

SEQ ID NO: 9125239 - DNA, 22 bp, Homo sapiens
cttattagtgtctgtctgagtt

SEQ ID NO: 9125240 - DNA, 22 bp, Homo sapiens
cttattagagttgtgttctgtt

SEQ ID NO: 9125241 - DNA, 19 bp, Homo sapiens
cttattagagtgagagctt

SEQ ID NO: 9125242 - DNA, 22 bp, Homo sapiens
ctgggagctggaatgggagaag

SEQ ID NO: 9125243 - DNA, 22 bp, Homo sapiens
ctgctaccctagagctcactct

SEQ ID NO: 9125244 - DNA, 22 bp, Homo sapiens
agtcacagaatgatggctccag

SEQ ID NO: 9125245 - DNA, 22 bp, Homo sapiens
ctagacttcagctttgtgatct

SEQ ID NO: 9125246 - DNA, 22 bp, Homo sapiens
ctagacttgcagcgtcaccatt

SEQ ID NO: 9125247 - DNA, 23 bp, Homo sapiens
ctagacttggaggtcttgaggac

SEQ ID NO: 9125248 - DNA, 22 bp, Homo sapiens
ctaggaggcgggggctgcagta

SEQ ID NO: 9125249 - DNA, 22 bp, Homo sapiens
agtaaatggtggtttttatcat

SEQ ID NO: 9125250 - DNA, 18 bp, Homo sapiens
agtaaatggtttattttc

SEQ ID NO: 9125251 - DNA, 22 bp, Homo sapiens
agtcaaggctattatgtgggaa

SEQ ID NO: 9125252 - DNA, 22 bp, Homo sapiens
ccttccaagtgctgctttttcc

SEQ ID NO: 9125253 - DNA, 22 bp, Homo sapiens
cctgggaggtggaggttgcagt

SEQ ID NO: 9125254 - DNA, 22 bp, Homo sapiens
cctgggaggtggaggttgcagc

SEQ ID NO: 9125255 - DNA, 22 bp, Homo sapiens
ctcaccacaccgtcggcctcct

SEQ ID NO: 9125256 - DNA, 20 bp, Homo sapiens
agtgagttatcagctacagt

SEQ ID NO: 9125257 - DNA, 21 bp, Homo sapiens
ctctggagtttgaaggctggg

SEQ ID NO: 9125258 - DNA, 22 bp, Homo sapiens
ctgagccactgcttgttcagtg

SEQ ID NO: 9125259 - DNA, 22 bp, Homo sapiens
ctgagccaccggcagggacatc

SEQ ID NO: 9125260 - DNA, 22 bp, Homo sapiens
ctgagccaaggggacagtgaca

SEQ ID NO: 9125261 - DNA, 22 bp, Homo sapiens
ctgagccagcgggctcactttt

SEQ ID NO: 9125262 - DNA, 22 bp, Homo sapiens
ctgagccagctggcatgtgcta

SEQ ID NO: 9125263 - DNA, 22 bp, Homo sapiens
ctgagccagggccacacatgga

SEQ ID NO: 9125264 - DNA, 22 bp, Homo sapiens
agtgtggccaatgaggatgggc

SEQ ID NO: 9125265 - DNA, 20 bp, Homo sapiens
caaatccctgctctgtgctg

SEQ ID NO: 9125266 - DNA, 22 bp, Homo sapiens
gcgttggggaccccgaagctgg

SEQ ID NO: 9125267 - DNA, 22 bp, Homo sapiens
attttcttctctccctggctgc

SEQ ID NO: 9125268 - DNA, 22 bp, Homo sapiens
attgttttaattccattgtgaa

SEQ ID NO: 9125269 - DNA, 22 bp, Homo sapiens
gcagatgcaactgcaggtgagt

SEQ ID NO: 9125270 - DNA, 22 bp, Homo sapiens
gcagatgccactaggtgaagtg

SEQ ID NO: 9125271 - DNA, 22 bp, Homo sapiens
gcagatgcatcttggtttaaac

SEQ ID NO: 9125272 - DNA, 22 bp, Homo sapiens
gcagatgcaagggtactggggc

SEQ ID NO: 9125273 - DNA, 22 bp, Homo sapiens
gcagatgcagaactcagtgggt

SEQ ID NO: 9125274 - DNA, 22 bp, Homo sapiens
gcagatgcagagatggctgggg

SEQ ID NO: 9125275 - DNA, 22 bp, Homo sapiens
gcagatgcctgaaggagctggg

SEQ ID NO: 9125276 - DNA, 22 bp, Homo sapiens
gcagatgccagatcatgcaggg

SEQ ID NO: 9125277 - DNA, 22 bp, Homo sapiens
gcagatgctgagatttatttct

SEQ ID NO: 9125278 - DNA, 22 bp, Homo sapiens
gcagaggcctaggtggaaggcc

SEQ ID NO: 9125279 - DNA, 22 bp, Homo sapiens
gcagaggcctgaaggtggcggg

SEQ ID NO: 9125280 - DNA, 22 bp, Homo sapiens
gcagaggctgtagggaaggttg

SEQ ID NO: 9125281 - DNA, 22 bp, Homo sapiens
gcagaggctgggtgtcccagtc

SEQ ID NO: 9125282 - DNA, 22 bp, Homo sapiens
gaaaatgtgtcatccctactgt

SEQ ID NO: 9125283 - DNA, 22 bp, Homo sapiens
gaaaatgtgcctttgggtattg

SEQ ID NO: 9125284 - DNA, 22 bp, Homo sapiens
atgaatgaaatacagagtactt

SEQ ID NO: 9125285 - DNA, 22 bp, Homo sapiens
atgaatgagagaatagtggagc

SEQ ID NO: 9125286 - DNA, 22 bp, Homo sapiens
atgaatgattaaagagtacagt

SEQ ID NO: 9125287 - DNA, 22 bp, Homo sapiens
atgaatgatgcaaaagacactg

SEQ ID NO: 9125288 - DNA, 22 bp, Homo sapiens
gaaaactattggcctagaacaa

SEQ ID NO: 9125289 - DNA, 22 bp, Homo sapiens
gaggaaggaatgcagtgtatgc

SEQ ID NO: 9125290 - DNA, 22 bp, Homo sapiens
gaggccacagtcctgaggcatc

SEQ ID NO: 9125291 - DNA, 22 bp, Homo sapiens
gagtccaggctgttgctcatct

SEQ ID NO: 9125292 - DNA, 22 bp, Homo sapiens
atgtttcatgactgagcaaaat

SEQ ID NO: 9125293 - DNA, 22 bp, Homo sapiens
atgtttcagatacagatcaaat

SEQ ID NO: 9125294 - DNA, 22 bp, Homo sapiens
gatctggaatctgaaggctgag

SEQ ID NO: 9125295 - DNA, 19 bp, Homo sapiens
ggctcctgtggctgcagcc

SEQ ID NO: 9125296 - DNA, 22 bp, Homo sapiens
cagaagaggactgggtagctca

SEQ ID NO: 9125297 - DNA, 22 bp, Homo sapiens
cagaagagtagctgaacaagtt

SEQ ID NO: 9125298 - DNA, 22 bp, Homo sapiens
cagaacacattttcagagtcaa

SEQ ID NO: 9125299 - DNA, 22 bp, Homo sapiens
ggctgggagccccacagagtca

SEQ ID NO: 9125300 - DNA, 23 bp, Homo sapiens
ggctgggagctccgggtgcacgt

SEQ ID NO: 9125301 - DNA, 22 bp, Homo sapiens
ggctgggacgatgaggattagt

SEQ ID NO: 9125302 - DNA, 22 bp, Homo sapiens
ggccccagcagaccctcctctg

SEQ ID NO: 9125303 - DNA, 22 bp, Homo sapiens
ggccccaggcctttggtctggc

SEQ ID NO: 9125304 - DNA, 20 bp, Homo sapiens
ggatcagatggagcctctgc

SEQ ID NO: 9125305 - DNA, 22 bp, Homo sapiens
cacaggagagctgggaggtgcc

SEQ ID NO: 9125306 - DNA, 19 bp, Homo sapiens
cacagccacagccaacctc

SEQ ID NO: 9125307 - DNA, 22 bp, Homo sapiens
ggagcagcttgcatgctcaggg

SEQ ID NO: 9125308 - DNA, 22 bp, Homo sapiens
ggacagagggttgacagagtat

SEQ ID NO: 9125309 - DNA, 22 bp, Homo sapiens
ggaagagagatcccatagatgt

SEQ ID NO: 9125310 - DNA, 22 bp, Homo sapiens
ggaagagaaatgagtcaagact

SEQ ID NO: 9125311 - DNA, 22 bp, Homo sapiens
ggaagagaatgatggctatggg

SEQ ID NO: 9125312 - DNA, 17 bp, Homo sapiens
ggaacaaatactatgca

SEQ ID NO: 9125313 - DNA, 22 bp, Homo sapiens
ggaacacagtgccttacaaact

SEQ ID NO: 9125314 - DNA, 22 bp, Homo sapiens
gctggtgagcaaaggagaagga

SEQ ID NO: 9125315 - DNA, 22 bp, Homo sapiens
cagctcccctctgtggggcagt

SEQ ID NO: 9125316 - DNA, 22 bp, Homo sapiens
cagcagagctgggaataaaatt

SEQ ID NO: 9125317 - DNA, 22 bp, Homo sapiens
gtaaccttgggaaatttgacct

SEQ ID NO: 9125318 - DNA, 22 bp, Homo sapiens
cagatgcttggaggacacttgg

SEQ ID NO: 9125319 - DNA, 22 bp, Homo sapiens
cagatgcttgttggctggtctc

SEQ ID NO: 9125320 - DNA, 22 bp, Homo sapiens
cagatgcttttgattctggggt

SEQ ID NO: 9125321 - DNA, 22 bp, Homo sapiens
cagcactgctgctgtacacaca

SEQ ID NO: 9125322 - DNA, 22 bp, Homo sapiens
cagaggcctttctacagtgata

SEQ ID NO: 9125323 - DNA, 22 bp, Homo sapiens
cagaggctgccagccatgtgca

SEQ ID NO: 9125324 - DNA, 22 bp, Homo sapiens
ggggtctgctgcggagcagaga

SEQ ID NO: 9125325 - DNA, 18 bp, Homo sapiens
cagatgctaggcctccag

SEQ ID NO: 9125326 - DNA, 22 bp, Homo sapiens
cagatgctatagtgctgccata

SEQ ID NO: 9125327 - DNA, 22 bp, Homo sapiens
cagatgctatgtattatgtatg

SEQ ID NO: 9125328 - DNA, 22 bp, Homo sapiens
cagatgctgcctgggaatgtct

SEQ ID NO: 9125329 - DNA, 20 bp, Homo sapiens
cagatgctggatcttggtcc

SEQ ID NO: 9125330 - DNA, 22 bp, Homo sapiens
cagatgctgctcacctgattat

SEQ ID NO: 9125331 - DNA, 22 bp, Homo sapiens
cagatgctgctatttcaccctg

SEQ ID NO: 9125332 - DNA, 22 bp, Homo sapiens
cagatgctggtatgggggaggt

SEQ ID NO: 9125333 - DNA, 22 bp, Homo sapiens
cagatgcttcgtgggtgagcac

SEQ ID NO: 9125334 - DNA, 16 bp, Homo sapiens
cagatgcttgctggca

SEQ ID NO: 9125335 - DNA, 22 bp, Homo sapiens
cagatatattcatttgcagtgc

SEQ ID NO: 9125336 - DNA, 22 bp, Homo sapiens
cagataaaggcttactagtagt

SEQ ID NO: 9125337 - DNA, 22 bp, Homo sapiens
cagaggaagctgggtgtggagt

SEQ ID NO: 9125338 - DNA, 22 bp, Homo sapiens
cagaggaagcagacacatcttg

SEQ ID NO: 9125339 - DNA, 22 bp, Homo sapiens
gggctcagtctgcggcgcgcgg

SEQ ID NO: 9125340 - DNA, 22 bp, Homo sapiens
gggctcagtctggcgtggaatg

SEQ ID NO: 9125341 - DNA, 22 bp, Homo sapiens
gggctcagtcggcaagcccctt

SEQ ID NO: 9125342 - DNA, 22 bp, Homo sapiens
gggctcaggtcagggcatcagc

SEQ ID NO: 9125343 - DNA, 22 bp, Homo sapiens
gggctcagtcctggttctaccc

SEQ ID NO: 9125344 - DNA, 22 bp, Homo sapiens
gggctcagggacacatgtgtgt

SEQ ID NO: 9125345 - DNA, 22 bp, Homo sapiens
gggctcaggagtttgaggctgc

SEQ ID NO: 9125346 - DNA, 22 bp, Homo sapiens
gggctcaggcctggcctctcac

SEQ ID NO: 9125347 - DNA, 22 bp, Homo sapiens
cattttcagcacccatctgaaa

SEQ ID NO: 9125348 - DNA, 22 bp, Homo sapiens
cattttcatgagtttctgttca

SEQ ID NO: 9125349 - DNA, 22 bp, Homo sapiens
ccaaattaaatcatacagacag

SEQ ID NO: 9125350 - DNA, 22 bp, Homo sapiens
tcctgcccagagctctccactc

SEQ ID NO: 9125351 - DNA, 22 bp, Homo sapiens
tctcagcttgagtggatgagct

SEQ ID NO: 9125352 - DNA, 22 bp, Homo sapiens
catgtgggaagaggccagctgg

SEQ ID NO: 9125353 - DNA, 22 bp, Homo sapiens
catgttttgtgtacagaatatt

SEQ ID NO: 9125354 - DNA, 22 bp, Homo sapiens
catgtgggacaatctcaggtat

SEQ ID NO: 9125355 - DNA, 22 bp, Homo sapiens
tcatcagtccttttcattatga

SEQ ID NO: 9125356 - DNA, 22 bp, Homo sapiens
catcaggaggagatgaagaaaa

SEQ ID NO: 9125357 - DNA, 22 bp, Homo sapiens
tcataagctagctgcaccatat

SEQ ID NO: 9125358 - DNA, 22 bp, Homo sapiens
tcaggaggcctgagtagctcta

SEQ ID NO: 9125359 - DNA, 22 bp, Homo sapiens
tcaggaggccgtgtgctcagtg

SEQ ID NO: 9125360 - DNA, 22 bp, Homo sapiens
tcaggaggcggaggttgcagtg

SEQ ID NO: 9125361 - DNA, 22 bp, Homo sapiens
tcaggaggccaccaggacctgt

SEQ ID NO: 9125362 - DNA, 22 bp, Homo sapiens
tcaggaggccggcaggatttga

SEQ ID NO: 9125363 - DNA, 21 bp, Homo sapiens
tcaggaggctcagactcctgc

SEQ ID NO: 9125364 - DNA, 22 bp, Homo sapiens
tcaggaggcggtgctgcctttg

SEQ ID NO: 9125365 - DNA, 22 bp, Homo sapiens
tcaggaggcgtctcgctggggc

SEQ ID NO: 9125366 - DNA, 22 bp, Homo sapiens
tcaggaggctcaagacctggca

SEQ ID NO: 9125367 - DNA, 22 bp, Homo sapiens
tcaggaggcgtgctggggtaca

SEQ ID NO: 9125368 - DNA, 22 bp, Homo sapiens
tacacagcctgtaatgatgact

SEQ ID NO: 9125369 - DNA, 22 bp, Homo sapiens
caggctccctgggcagtggcag

SEQ ID NO: 9125370 - DNA, 22 bp, Homo sapiens
caggctccctaagtcagcagcc

SEQ ID NO: 9125371 - DNA, 22 bp, Homo sapiens
caggctcccgctccactgggca

SEQ ID NO: 9125372 - DNA, 20 bp, Homo sapiens
caggctccgcaggactaggg

SEQ ID NO: 9125373 - DNA, 17 bp, Homo sapiens
caggctccttccagatt

SEQ ID NO: 9125374 - DNA, 22 bp, Homo sapiens
caggctccttatcttacaactt

SEQ ID NO: 9125375 - DNA, 22 bp, Homo sapiens
caggctccttcccagggatggt

SEQ ID NO: 9125376 - DNA, 22 bp, Homo sapiens
caggctccactgtaggcagctc

SEQ ID NO: 9125377 - DNA, 22 bp, Homo sapiens
caggctcccgaaatcacccatg

SEQ ID NO: 9125378 - DNA, 22 bp, Homo sapiens
tagacattatgtattaagttct

SEQ ID NO: 9125379 - DNA, 22 bp, Homo sapiens
tcaaaggaatttgattttgatg

SEQ ID NO: 9125380 - DNA, 22 bp, Homo sapiens
ccctttaaggtctgattttcag

SEQ ID NO: 9125381 - DNA, 20 bp, Homo sapiens
ccctttaagctttagtatgc

SEQ ID NO: 9125382 - DNA, 22 bp, Homo sapiens
ccctttaaggaaaggaaggatg

SEQ ID NO: 9125383 - DNA, 23 bp, Homo sapiens
ccctttaagatttgaatagtcag

SEQ ID NO: 9125384 - DNA, 22 bp, Homo sapiens
ccctttaaagttttaccagcag

SEQ ID NO: 9125385 - DNA, 22 bp, Homo sapiens
ccctttaacacacagaggctgc

SEQ ID NO: 9125386 - DNA, 22 bp, Homo sapiens
ccctttaattccaacacaggaa

SEQ ID NO: 9125387 - DNA, 22 bp, Homo sapiens
ccctttaagtcctggaacaaag

SEQ ID NO: 9125388 - DNA, 22 bp, Homo sapiens
ccctttaagtagaatatattat

SEQ ID NO: 9125389 - DNA, 22 bp, Homo sapiens
tgctctgaaggggaagggatgg

SEQ ID NO: 9125390 - DNA, 22 bp, Homo sapiens
cctccagctgcctcagtctctt

SEQ ID NO: 9125391 - DNA, 22 bp, Homo sapiens
tggtacacatgtccaaggtcag

SEQ ID NO: 9125392 - DNA, 22 bp, Homo sapiens
tggggagagattgaggagtttt

SEQ ID NO: 9125393 - DNA, 22 bp, Homo sapiens
tggggagagattgaggagtttt

SEQ ID NO: 9125394 - DNA, 22 bp, Homo sapiens
tggggagagaccggaatgtttc

SEQ ID NO: 9125395 - DNA, 22 bp, Homo sapiens
ccagtgcattgccgtgtctagg

SEQ ID NO: 9125396 - DNA, 22 bp, Homo sapiens
tgagccagttcttcagatccat

SEQ ID NO: 9125397 - DNA, 22 bp, Homo sapiens
tgagttctgactgtgatgccag

SEQ ID NO: 9125398 - DNA, 22 bp, Homo sapiens
tgataaatccatgtaaatggta

SEQ ID NO: 9125399 - DNA, 22 bp, Homo sapiens
ccaggagcaggagctggacaga

SEQ ID NO: 9125400 - DNA, 22 bp, Homo sapiens
ccaggagccactcaggcccaca

SEQ ID NO: 9125401 - DNA, 22 bp, Homo sapiens
tcttaattgagaacagtgtagg

SEQ ID NO: 9125402 - DNA, 16 bp, Homo sapiens
ccaggaggctgacacc

SEQ ID NO: 9125403 - DNA, 22 bp, Homo sapiens
ccaggaggcttcgtccgtggag

SEQ ID NO: 9125404 - DNA, 22 bp, Homo sapiens
ccaggaggcggaggttgcagtg

SEQ ID NO: 9125405 - DNA, 22 bp, Homo sapiens
ccaggaggctctgactggaccc

SEQ ID NO: 9125406 - DNA, 22 bp, Homo sapiens
ccaggaggctctgcccatccca

SEQ ID NO: 9125407 - DNA, 22 bp, Homo sapiens
ccaggaggctcttgtccctggt

SEQ ID NO: 9125408 - DNA, 22 bp, Homo sapiens
gaaaatgtttgtccggagctga

SEQ ID NO: 9125409 - DNA, 22 bp, Homo sapiens
gaaaatgtttcctgttatttgc

SEQ ID NO: 9125410 - DNA, 22 bp, Homo sapiens
cttttcttctcacggctgtcag

SEQ ID NO: 9125411 - DNA, 22 bp, Homo sapiens
cttttcttgtattggatgcccc

SEQ ID NO: 9125412 - DNA, 22 bp, Homo sapiens
ctttgattccaggcacatgttt

SEQ ID NO: 9125413 - DNA, 22 bp, Homo sapiens
ctttaattgtagctcccataat

SEQ ID NO: 9125414 - DNA, 22 bp, Homo sapiens
ctttaattctcaggtgcacata

SEQ ID NO: 9125415 - DNA, 20 bp, Homo sapiens
ctttaactggaaggctgctt

SEQ ID NO: 9125416 - DNA, 22 bp, Homo sapiens
ctttaattcagatttgaaggga

SEQ ID NO: 9125417 - DNA, 22 bp, Homo sapiens
ctttaattaggaagtataatga

SEQ ID NO: 9125418 - DNA, 22 bp, Homo sapiens
cttagtaggcttcacccctctc

SEQ ID NO: 9125419 - DNA, 22 bp, Homo sapiens
cttagtagccattatataattt

SEQ ID NO: 9125420 - DNA, 22 bp, Homo sapiens
cttagtagaacgtggatgggaa

SEQ ID NO: 9125421 - DNA, 22 bp, Homo sapiens
cttaattacccaatgtggtagg

SEQ ID NO: 9125422 - DNA, 22 bp, Homo sapiens
ctgtctgaatcctaagcttcct

SEQ ID NO: 9125423 - DNA, 22 bp, Homo sapiens
ctggtcactggtctcatccagc

SEQ ID NO: 9125424 - DNA, 22 bp, Homo sapiens
ctgggagaggtggtgggaagta

SEQ ID NO: 9125425 - DNA, 22 bp, Homo sapiens
ctgggcagctgtatcagggagt

SEQ ID NO: 9125426 - DNA, 22 bp, Homo sapiens
gagggaggcatcatgaatccag

SEQ ID NO: 9125427 - DNA, 22 bp, Homo sapiens
gagggaggggagctccaccctc

SEQ ID NO: 9125428 - DNA, 22 bp, Homo sapiens
gaggagaggggctcccaagagc

SEQ ID NO: 9125429 - DNA, 22 bp, Homo sapiens
gaggctcagagaggtccacata

SEQ ID NO: 9125430 - DNA, 22 bp, Homo sapiens
gaggctcagagaagtcatggta

SEQ ID NO: 9125431 - DNA, 22 bp, Homo sapiens
gaggctcacctagggagcactg

SEQ ID NO: 9125432 - DNA, 22 bp, Homo sapiens
gaggaagaatcagggtggtgag

SEQ ID NO: 9125433 - DNA, 22 bp, Homo sapiens
gaggaagaaagcataggtgggg

SEQ ID NO: 9125434 - DNA, 22 bp, Homo sapiens
gagcccaggaagtggaggctga

SEQ ID NO: 9125435 - DNA, 22 bp, Homo sapiens
gacagaggagaagatgctgtgg

SEQ ID NO: 9125436 - DNA, 22 bp, Homo sapiens
gagactttctgatctcactcat

SEQ ID NO: 9125437 - DNA, 22 bp, Homo sapiens
gagactttaaaaaacattaaga

SEQ ID NO: 9125438 - DNA, 22 bp, Homo sapiens
gagactttttaatcactaggaa

SEQ ID NO: 9125439 - DNA, 22 bp, Homo sapiens
gaaggcccagcttgaatgctgc

SEQ ID NO: 9125440 - DNA, 22 bp, Homo sapiens
ttttttgttgggtagaacggaa

SEQ ID NO: 9125441 - DNA, 22 bp, Homo sapiens
ctgaaaaacgggatttggctgg

SEQ ID NO: 9125442 - DNA, 22 bp, Homo sapiens
ctgaaaaatatgttttggagaa

SEQ ID NO: 9125443 - DNA, 22 bp, Homo sapiens
ctccccaccttcgcggtccctg

SEQ ID NO: 9125444 - DNA, 22 bp, Homo sapiens
ctccccacatttctccctgtct

SEQ ID NO: 9125445 - DNA, 22 bp, Homo sapiens
ctcaggctgtgatgtgatggca

SEQ ID NO: 9125446 - DNA, 22 bp, Homo sapiens
tttcaaagtggagaattagaca

SEQ ID NO: 9125447 - DNA, 22 bp, Homo sapiens
tttcaaagttgggaattgtaat

SEQ ID NO: 9125448 - DNA, 22 bp, Homo sapiens
tttcaaataccataaacctaat

SEQ ID NO: 9125449 - DNA, 22 bp, Homo sapiens
ctctggagtaagagctatgaaa

SEQ ID NO: 9125450 - DNA, 22 bp, Homo sapiens
ctctggaggtggaggttgcagt

SEQ ID NO: 9125451 - DNA, 22 bp, Homo sapiens
ctctggaggcctaaggaagtgg

SEQ ID NO: 9125452 - DNA, 22 bp, Homo sapiens
ctctggagggaggctgagctgg

SEQ ID NO: 9125453 - DNA, 19 bp, Homo sapiens
ctctggagcagacactgga

SEQ ID NO: 9125454 - DNA, 22 bp, Homo sapiens
ttaccaagctctgcatgttaag

SEQ ID NO: 9125455 - DNA, 22 bp, Homo sapiens
cctttaatttacaatgttaatt

SEQ ID NO: 9125456 - DNA, 22 bp, Homo sapiens
cctttaatttacaatgttaatt

SEQ ID NO: 9125457 - DNA, 22 bp, Homo sapiens
ttcaaaaaggtatgttcaagtc

SEQ ID NO: 9125458 - DNA, 19 bp, Homo sapiens
tgtttcttcctccatctga

SEQ ID NO: 9125459 - DNA, 21 bp, Homo sapiens
tgttttctaaagggcggatca

SEQ ID NO: 9125460 - DNA, 22 bp, Homo sapiens
tgtttctagagaaaatatttac

SEQ ID NO: 9125461 - DNA, 22 bp, Homo sapiens
tgtttctaggtcaataattttt

SEQ ID NO: 9125462 - DNA, 22 bp, Homo sapiens
tgttttctagaaacaatgccta

SEQ ID NO: 9125463 - DNA, 22 bp, Homo sapiens
tgttttctattacctgagattg

SEQ ID NO: 9125464 - DNA, 22 bp, Homo sapiens
cgggaacatgctttcatttcag

SEQ ID NO: 9125465 - DNA, 22 bp, Homo sapiens
cgtcatcacggcaagcatctcc

SEQ ID NO: 9125466 - DNA, 22 bp, Homo sapiens
ctacattcaacagcagagtttt

SEQ ID NO: 9125467 - DNA, 22 bp, Homo sapiens
ctacattctgggaaatcagatg

SEQ ID NO: 9125468 - DNA, 18 bp, Homo sapiens
ctacattcataggaaagg

SEQ ID NO: 9125469 - DNA, 22 bp, Homo sapiens
ttgcctattgttcttacatgtt

SEQ ID NO: 9125470 - DNA, 22 bp, Homo sapiens
ctcagccatgcaacatgctggg

SEQ ID NO: 9125471 - DNA, 22 bp, Homo sapiens
ctcactgcaagctctgcctccc

SEQ ID NO: 9125472 - DNA, 22 bp, Homo sapiens
ctcactgcaagctctgcctcca

SEQ ID NO: 9125473 - DNA, 22 bp, Homo sapiens
tattttcatcttgtccttggat

SEQ ID NO: 9125474 - DNA, 22 bp, Homo sapiens
tattttcattctgtgtgactgt

SEQ ID NO: 9125475 - DNA, 22 bp, Homo sapiens
tattttcaccttctctggatat

SEQ ID NO: 9125476 - DNA, 22 bp, Homo sapiens
tatgtttagtatccattttcag

SEQ ID NO: 9125477 - DNA, 22 bp, Homo sapiens
tatgttcatgtcaaacaaatgc

SEQ ID NO: 9125478 - DNA, 18 bp, Homo sapiens
tatatttcacacatattc

SEQ ID NO: 9125479 - DNA, 21 bp, Homo sapiens
tatcaaggcactttttaaaga

SEQ ID NO: 9125480 - DNA, 22 bp, Homo sapiens
tatattataagccctttcagaa

SEQ ID NO: 9125481 - DNA, 22 bp, Homo sapiens
tatagactgtgaaatttaggca

SEQ ID NO: 9125482 - DNA, 22 bp, Homo sapiens
tatagacttggcatgcatgttc

SEQ ID NO: 9125483 - DNA, 22 bp, Homo sapiens
tatagactagcagcagaattta

SEQ ID NO: 9125484 - DNA, 22 bp, Homo sapiens
taggacaggatcatgatgctgg

SEQ ID NO: 9125485 - DNA, 22 bp, Homo sapiens
taggacagagttccctgatggc

SEQ ID NO: 9125486 - DNA, 22 bp, Homo sapiens
taggaaggaggccatcttggcg

SEQ ID NO: 9125487 - DNA, 22 bp, Homo sapiens
taggaaggtgtttttaaggagc

SEQ ID NO: 9125488 - DNA, 22 bp, Homo sapiens
tagatgctactttacatagggt

SEQ ID NO: 9125489 - DNA, 22 bp, Homo sapiens
tagatgctagtagcacctgacc

SEQ ID NO: 9125490 - DNA, 22 bp, Homo sapiens
tagatgctacaattttgtactc

SEQ ID NO: 9125491 - DNA, 22 bp, Homo sapiens
tagatgcttgggcaaaggtaga

SEQ ID NO: 9125492 - DNA, 22 bp, Homo sapiens
tagatgcttgtcagtttctgtc

SEQ ID NO: 9125493 - DNA, 22 bp, Homo sapiens
tagatgcttgttcagaaatagg

SEQ ID NO: 9125494 - DNA, 22 bp, Homo sapiens
tagatgcttcagaaggcctgca

SEQ ID NO: 9125495 - DNA, 22 bp, Homo sapiens
tagatgcttcatgagaaatata

SEQ ID NO: 9125496 - DNA, 22 bp, Homo sapiens
tagatgcttgcagacagaatga

SEQ ID NO: 9125497 - DNA, 22 bp, Homo sapiens
tagatgcttgctatgtatagag

SEQ ID NO: 9125498 - DNA, 20 bp, Homo sapiens
tagatgctgccataagattc

SEQ ID NO: 9125499 - DNA, 22 bp, Homo sapiens
tagatgctgggaaggctgctgg

SEQ ID NO: 9125500 - DNA, 22 bp, Homo sapiens
tagatgctgtagaaatacttat

SEQ ID NO: 9125501 - DNA, 22 bp, Homo sapiens
tagatgctgtgggcacatggaa

SEQ ID NO: 9125502 - DNA, 22 bp, Homo sapiens
tagatgcttataaagagcatat

SEQ ID NO: 9125503 - DNA, 22 bp, Homo sapiens
tagatgcttatagggtggttaa

SEQ ID NO: 9125504 - DNA, 22 bp, Homo sapiens
tagatgctattatggcagtgtt

SEQ ID NO: 9125505 - DNA, 22 bp, Homo sapiens
tagatgctcatgagtcagccag

SEQ ID NO: 9125506 - DNA, 22 bp, Homo sapiens
tagatgctgaaacatggaggcg

SEQ ID NO: 9125507 - DNA, 22 bp, Homo sapiens
tagatgctcgctttccccctga

SEQ ID NO: 9125508 - DNA, 22 bp, Homo sapiens
tagatgctgagcttaagagaat

SEQ ID NO: 9125509 - DNA, 22 bp, Homo sapiens
gttagtagtaaagcagggattc

SEQ ID NO: 9125510 - DNA, 22 bp, Homo sapiens
gttagtagcatttcatgacatg

SEQ ID NO: 9125511 - DNA, 22 bp, Homo sapiens
gttagtaggaggtggtatcttg

SEQ ID NO: 9125512 - DNA, 22 bp, Homo sapiens
gttagtaggttgcaaatttgga

SEQ ID NO: 9125513 - DNA, 22 bp, Homo sapiens
gtttaattcccacacctgccct

SEQ ID NO: 9125514 - DNA, 22 bp, Homo sapiens
gtttaattttaggttgtcaagc

SEQ ID NO: 9125515 - DNA, 22 bp, Homo sapiens
gtttagaccaatcataatttat

SEQ ID NO: 9125516 - DNA, 22 bp, Homo sapiens
gtttctcagtttggtctgcaga

SEQ ID NO: 9125517 - DNA, 22 bp, Homo sapiens
gtttctcaagcttgaatgcaca

SEQ ID NO: 9125518 - DNA, 22 bp, Homo sapiens
gtttctaaatgttctgagtttt

SEQ ID NO: 9125519 - DNA, 22 bp, Homo sapiens
gtttctaagcacatgtgagtgt

SEQ ID NO: 9125520 - DNA, 22 bp, Homo sapiens
taactgtgtgaacgtgatcatt

SEQ ID NO: 9125521 - DNA, 22 bp, Homo sapiens
taactgtgaagtaattgtggat

SEQ ID NO: 9125522 - DNA, 22 bp, Homo sapiens
taaactgtgtaatatgatgtct

SEQ ID NO: 9125523 - DNA, 22 bp, Homo sapiens
taataaatgaaagtgctggcat

SEQ ID NO: 9125524 - DNA, 22 bp, Homo sapiens
tcctccacgatggcacacctgg

SEQ ID NO: 9125525 - DNA, 22 bp, Homo sapiens
tcctccagctgtatcctgcctg

SEQ ID NO: 9125526 - DNA, 22 bp, Homo sapiens
tcctccagccctctaggaaaat

SEQ ID NO: 9125527 - DNA, 22 bp, Homo sapiens
tcctccagtggtactggccaat

SEQ ID NO: 9125528 - DNA, 22 bp, Homo sapiens
tccctgtgtccatgccaggagg

SEQ ID NO: 9125529 - DNA, 22 bp, Homo sapiens
tccctgtgggatgaggactctg

SEQ ID NO: 9125530 - DNA, 22 bp, Homo sapiens
tccacccagcacactgtggtag

SEQ ID NO: 9125531 - DNA, 22 bp, Homo sapiens
tccacagctgtcctgtaacagg

SEQ ID NO: 9125532 - DNA, 22 bp, Homo sapiens
tcccacatgtgaatcctcaggt

SEQ ID NO: 9125533 - DNA, 22 bp, Homo sapiens
tcccagctcacatatggtaact

SEQ ID NO: 9125534 - DNA, 22 bp, Homo sapiens
tcacagagaggttaagcagttg

SEQ ID NO: 9125535 - DNA, 22 bp, Homo sapiens
tcagaggcatcattcatagtta

SEQ ID NO: 9125536 - DNA, 21 bp, Homo sapiens
tcagaggcactgagagcaatg

SEQ ID NO: 9125537 - DNA, 22 bp, Homo sapiens
tcagaggctacagtctgggagt

SEQ ID NO: 9125538 - DNA, 22 bp, Homo sapiens
tcagaggcctgaaagaatttgg

SEQ ID NO: 9125539 - DNA, 22 bp, Homo sapiens
tcagccagggctctggcctcag

SEQ ID NO: 9125540 - DNA, 22 bp, Homo sapiens
tcagaggcttgaagcccaagcc

SEQ ID NO: 9125541 - DNA, 22 bp, Homo sapiens
tcagaggcttccttcctcggag

SEQ ID NO: 9125542 - DNA, 22 bp, Homo sapiens
tcagaggcttctggccagtctg

SEQ ID NO: 9125543 - DNA, 21 bp, Homo sapiens
tcagaggctgggggaatgccc

SEQ ID NO: 9125544 - DNA, 20 bp, Homo sapiens
tcagaggctgccagctgggg

SEQ ID NO: 9125545 - DNA, 22 bp, Homo sapiens
tcaggaggtccgcccgggaggg

SEQ ID NO: 9125546 - DNA, 22 bp, Homo sapiens
tcaggaggtaggacatactggt

SEQ ID NO: 9125547 - DNA, 22 bp, Homo sapiens
tcaggaggtaaggtaaaacaga

SEQ ID NO: 9125548 - DNA, 22 bp, Homo sapiens
tcaggaggtctgctgcggggtg

SEQ ID NO: 9125549 - DNA, 19 bp, Homo sapiens
tcaggaggtcgacctggca

SEQ ID NO: 9125550 - DNA, 22 bp, Homo sapiens
tcaggaggtgtaacgaatacag

SEQ ID NO: 9125551 - DNA, 22 bp, Homo sapiens
tcaggaaatggacatctttgct

SEQ ID NO: 9125552 - DNA, 22 bp, Homo sapiens
tcaggaaagtgttctcagagga

SEQ ID NO: 9125553 - DNA, 22 bp, Homo sapiens
tcaggaggatgtcggcaaattt

SEQ ID NO: 9125554 - DNA, 22 bp, Homo sapiens
tcaggagggagtgtggatagag

SEQ ID NO: 9125555 - DNA, 22 bp, Homo sapiens
tcaggaggcaagtaggtattga

SEQ ID NO: 9125556 - DNA, 22 bp, Homo sapiens
tcaggaggacagataaggatag

SEQ ID NO: 9125557 - DNA, 22 bp, Homo sapiens
tcaggaggagctcataagtttg

SEQ ID NO: 9125558 - DNA, 22 bp, Homo sapiens
tcaggagggtctctattttcct

SEQ ID NO: 9125559 - DNA, 22 bp, Homo sapiens
tcaggagggtgacaggccctgg

SEQ ID NO: 9125560 - DNA, 22 bp, Homo sapiens
tcaggagggctaagactgtagc

SEQ ID NO: 9125561 - DNA, 22 bp, Homo sapiens
tcaggagggattgttgcctatt

SEQ ID NO: 9125562 - DNA, 22 bp, Homo sapiens
gtaaatgtgaatgtcatttagc

SEQ ID NO: 9125563 - DNA, 19 bp, Homo sapiens
gtagactttggttatgcag

SEQ ID NO: 9125564 - DNA, 22 bp, Homo sapiens
gtagaggggtgattctgtgaga

SEQ ID NO: 9125565 - DNA, 22 bp, Homo sapiens
ggtcagggtataatcaagtgag

SEQ ID NO: 9125566 - DNA, 22 bp, Homo sapiens
ggtgggagtggaacgtggaaga

SEQ ID NO: 9125567 - DNA, 22 bp, Homo sapiens
ggtgaaattccttgtggaaagt

SEQ ID NO: 9125568 - DNA, 22 bp, Homo sapiens
gggctgggatggcttgaagatt

SEQ ID NO: 9125569 - DNA, 22 bp, Homo sapiens
ggggctgtttttggaatggctg

SEQ ID NO: 9125570 - DNA, 22 bp, Homo sapiens
gggggctaccgtctctggagct

SEQ ID NO: 9125571 - DNA, 20 bp, Homo sapiens
gggctggcgcatggggaaag

SEQ ID NO: 9125572 - DNA, 22 bp, Homo sapiens
gggcctcagctctgctctgcaa

SEQ ID NO: 9125573 - DNA, 22 bp, Homo sapiens
gggcctcagctggagtctgcct

SEQ ID NO: 9125574 - DNA, 22 bp, Homo sapiens
ggagcagagctgggcttggctg

SEQ ID NO: 9125575 - DNA, 22 bp, Homo sapiens
ggatgctcagtgcctgtgtcca

SEQ ID NO: 9125576 - DNA, 22 bp, Homo sapiens
ggatgctctgtctcttgctgtt

SEQ ID NO: 9125577 - DNA, 22 bp, Homo sapiens
ggatgctctcctcggcgtgacc

SEQ ID NO: 9125578 - DNA, 22 bp, Homo sapiens
ggctccagggagtggagagaag

SEQ ID NO: 9125579 - DNA, 22 bp, Homo sapiens
gggaaggctgcctgagggatgg

SEQ ID NO: 9125580 - DNA, 22 bp, Homo sapiens
gcgccccatctacagtactttt

SEQ ID NO: 9125581 - DNA, 22 bp, Homo sapiens
gctcctgttttcttccagaaat

SEQ ID NO: 9125582 - DNA, 22 bp, Homo sapiens
gctgggttttcttccgggccta

SEQ ID NO: 9125583 - DNA, 22 bp, Homo sapiens
gctgggaagaacaggagagaat

SEQ ID NO: 9125584 - DNA, 22 bp, Homo sapiens
gctgggaagagatgcacatgat

SEQ ID NO: 9125585 - DNA, 22 bp, Homo sapiens
gctgggaaccatgggaaggcag

SEQ ID NO: 9125586 - DNA, 22 bp, Homo sapiens
gctgggaatgattttggagagg

SEQ ID NO: 9125587 - DNA, 22 bp, Homo sapiens
ggacagagccctggtggcctaa

SEQ ID NO: 9125588 - DNA, 22 bp, Homo sapiens
ggacagagccctggtggcctaa

SEQ ID NO: 9125589 - DNA, 19 bp, Homo sapiens
ggagaggctggagggatgc

SEQ ID NO: 9125590 - DNA, 22 bp, Homo sapiens
ggagaggcttccagagtcgtgc

SEQ ID NO: 9125591 - DNA, 22 bp, Homo sapiens
ggacgcagccgagggagcaggg

SEQ ID NO: 9125592 - DNA, 22 bp, Homo sapiens
ggacgcagcgagggaagcagcc

SEQ ID NO: 9125593 - DNA, 22 bp, Homo sapiens
gcaaatcctcctgcctgaagaa

SEQ ID NO: 9125594 - DNA, 22 bp, Homo sapiens
gcaaatcaccacctagctggat

SEQ ID NO: 9125595 - DNA, 22 bp, Homo sapiens
gcactgagcaccagccacagat

SEQ ID NO: 9125596 - DNA, 17 bp, Homo sapiens
gcactgagccacagttt

SEQ ID NO: 9125597 - DNA, 22 bp, Homo sapiens
gcagagctgcagcgaggcctgg

SEQ ID NO: 9125598 - DNA, 22 bp, Homo sapiens
gcaggaggagcattaactgagc

SEQ ID NO: 9125599 - DNA, 22 bp, Homo sapiens
gcaggaggatcacttgagccca

SEQ ID NO: 9125600 - DNA, 22 bp, Homo sapiens
gcaggaggttgagccaggactg

SEQ ID NO: 9125601 - DNA, 22 bp, Homo sapiens
gcaggaggccaggtatgcttta

SEQ ID NO: 9125602 - DNA, 22 bp, Homo sapiens
gcagtctatcttgtgatttaac

SEQ ID NO: 9125603 - DNA, 22 bp, Homo sapiens
gcagtatatccattacttcata

SEQ ID NO: 9125604 - DNA, 22 bp, Homo sapiens
gcagtatatggattttaaacat

SEQ ID NO: 9125605 - DNA, 22 bp, Homo sapiens
gccagagaggcaaatcctagca

SEQ ID NO: 9125606 - DNA, 22 bp, Homo sapiens
gccagagaggccgaggtaccca

SEQ ID NO: 9125607 - DNA, 22 bp, Homo sapiens
gccagagagagtccctgggcct

SEQ ID NO: 9125608 - DNA, 22 bp, Homo sapiens
tttgaacatgctgcatgataat

SEQ ID NO: 9125609 - DNA, 23 bp, Homo sapiens
tttgaacatttctagattacata

SEQ ID NO: 9125610 - DNA, 22 bp, Homo sapiens
ttttaattttagcccttctggt

SEQ ID NO: 9125611 - DNA, 22 bp, Homo sapiens
ttttaattttgcaaatctggtg

SEQ ID NO: 9125612 - DNA, 23 bp, Homo sapiens
ttttaatttggacataagaagat

SEQ ID NO: 9125613 - DNA, 22 bp, Homo sapiens
ttttacacctcagatgagcaga

SEQ ID NO: 9125614 - DNA, 22 bp, Homo sapiens
ttttacacctgttaactctaag

SEQ ID NO: 9125615 - DNA, 22 bp, Homo sapiens
tttgtcttatccaatctctcag

SEQ ID NO: 9125616 - DNA, 22 bp, Homo sapiens
tttgtcttaaatcttgttactg

SEQ ID NO: 9125617 - DNA, 22 bp, Homo sapiens
tttttgtgaaatctccagacat

SEQ ID NO: 9125618 - DNA, 22 bp, Homo sapiens
tttttgtgatatgacactgtat

SEQ ID NO: 9125619 - DNA, 22 bp, Homo sapiens
tttttgtggtatattgcaacaa

SEQ ID NO: 9125620 - DNA, 22 bp, Homo sapiens
tttttgtggtgcagactaaagc

SEQ ID NO: 9125621 - DNA, 22 bp, Homo sapiens
tttttgtggtgtgagtggacat

SEQ ID NO: 9125622 - DNA, 22 bp, Homo sapiens
tttttgtgtatcctgctccatg

SEQ ID NO: 9125623 - DNA, 22 bp, Homo sapiens
tttttgtgtgagcagggtgtta

SEQ ID NO: 9125624 - DNA, 22 bp, Homo sapiens
ttttgtgttgccatgttaagca

SEQ ID NO: 9125625 - DNA, 22 bp, Homo sapiens
ttttgtgtccttcacatcatgt

SEQ ID NO: 9125626 - DNA, 19 bp, Homo sapiens
ttttgtgtagctgctggtt

SEQ ID NO: 9125627 - DNA, 22 bp, Homo sapiens
ttttgtgttgtaatgtcagcta

SEQ ID NO: 9125628 - DNA, 22 bp, Homo sapiens
ttttgtctaagaactttgcaaa

SEQ ID NO: 9125629 - DNA, 21 bp, Homo sapiens
ttttggtcctggcttaggagc

SEQ ID NO: 9125630 - DNA, 22 bp, Homo sapiens
ttttgggtggaagctgttatgg

SEQ ID NO: 9125631 - DNA, 22 bp, Homo sapiens
ttttttgtagcaagcgcagata

SEQ ID NO: 9125632 - DNA, 22 bp, Homo sapiens
ttgttgaatggataaataaatt

SEQ ID NO: 9125633 - DNA, 22 bp, Homo sapiens
tttaactcatttctggcagttt

SEQ ID NO: 9125634 - DNA, 22 bp, Homo sapiens
tttaaccagaaaggtactcatc

SEQ ID NO: 9125635 - DNA, 19 bp, Homo sapiens
tttctaagctaaatgcttc

SEQ ID NO: 9125636 - DNA, 22 bp, Homo sapiens
tttctaagatgtggtttcaagg

SEQ ID NO: 9125637 - DNA, 22 bp, Homo sapiens
tttctaaggctaggtcttaagg

SEQ ID NO: 9125638 - DNA, 22 bp, Homo sapiens
tttctaagaaagtaatggttat

SEQ ID NO: 9125639 - DNA, 22 bp, Homo sapiens
ttattttctcctcagaaagtgg

SEQ ID NO: 9125640 - DNA, 22 bp, Homo sapiens
ttattttcagctaggaaagcca

SEQ ID NO: 9125641 - DNA, 21 bp, Homo sapiens
ttcatcagccagaaatcaagc

SEQ ID NO: 9125642 - DNA, 22 bp, Homo sapiens
ttcatagagcagctcactgaat

SEQ ID NO: 9125643 - DNA, 22 bp, Homo sapiens
ttctttgggcaattgctggccc

SEQ ID NO: 9125644 - DNA, 22 bp, Homo sapiens
ttgaaaaaattggtagaggatg

SEQ ID NO: 9125645 - DNA, 23 bp, Homo sapiens
ttgaaaaatatagtcccattgtc

SEQ ID NO: 9125646 - DNA, 22 bp, Homo sapiens
ttctgagctgcaacactaacat

SEQ ID NO: 9125647 - DNA, 20 bp, Homo sapiens
ttctggaggctacaagtctg

SEQ ID NO: 9125648 - DNA, 22 bp, Homo sapiens
ttctccagtttctcccttcagt

SEQ ID NO: 9125649 - DNA, 22 bp, Homo sapiens
ttcgttttctaggaccaacaga

SEQ ID NO: 9125650 - DNA, 21 bp, Homo sapiens
ttctccaggcaaccatttcag

SEQ ID NO: 9125651 - DNA, 22 bp, Homo sapiens
atttctcattttgcttcaaagg

SEQ ID NO: 9125652 - DNA, 22 bp, Homo sapiens
agatacattgttctaagcattg

SEQ ID NO: 9125653 - DNA, 22 bp, Homo sapiens
agatactaagcatttccagcac

SEQ ID NO: 9125654 - DNA, 22 bp, Homo sapiens
agaggcctgtgtgctccagtgg

SEQ ID NO: 9125655 - DNA, 22 bp, Homo sapiens
agaggctcagaggcctggtcct

SEQ ID NO: 9125656 - DNA, 22 bp, Homo sapiens
atgtttatgttgggctatattt

SEQ ID NO: 9125657 - DNA, 22 bp, Homo sapiens
atgtttatggagcaggtattag

SEQ ID NO: 9125658 - DNA, 22 bp, Homo sapiens
atgtttatgacctccataagga

SEQ ID NO: 9125659 - DNA, 21 bp, Homo sapiens
agagctggtaggtaggtaggt

SEQ ID NO: 9125660 - DNA, 21 bp, Homo sapiens
agagctgggacttgcctgaga

SEQ ID NO: 9125661 - DNA, 22 bp, Homo sapiens
agaggaggatttgtaaaggtct

SEQ ID NO: 9125662 - DNA, 22 bp, Homo sapiens
agaggaggctctgggatcgtcc

SEQ ID NO: 9125663 - DNA, 22 bp, Homo sapiens
attattaggtgctctctgacaa

SEQ ID NO: 9125664 - DNA, 22 bp, Homo sapiens
attattaggactactggggttg

SEQ ID NO: 9125665 - DNA, 22 bp, Homo sapiens
attattagacttatatggtagt

SEQ ID NO: 9125666 - DNA, 22 bp, Homo sapiens
attattagattcttaattgtaa

SEQ ID NO: 9125667 - DNA, 22 bp, Homo sapiens
attattagtgatgttgttactg

SEQ ID NO: 9125668 - DNA, 22 bp, Homo sapiens
agaaggctggccatggtgccct

SEQ ID NO: 9125669 - DNA, 22 bp, Homo sapiens
agaaggctggccctgggtggcc

SEQ ID NO: 9125670 - DNA, 22 bp, Homo sapiens
atgaaagtgaaggtttactaag

SEQ ID NO: 9125671 - DNA, 22 bp, Homo sapiens
caaatagattgttcaatcctga

SEQ ID NO: 9125672 - DNA, 22 bp, Homo sapiens
caaatagacttcaatctcttga

SEQ ID NO: 9125673 - DNA, 22 bp, Homo sapiens
agcaggggtctctgctaatgaa

SEQ ID NO: 9125674 - DNA, 22 bp, Homo sapiens
cagaaggagcgctaaggtccca

SEQ ID NO: 9125675 - DNA, 22 bp, Homo sapiens
cagacttttgggaggtctgtgg

SEQ ID NO: 9125676 - DNA, 22 bp, Homo sapiens
cagacttttgacattaatacag

SEQ ID NO: 9125677 - DNA, 22 bp, Homo sapiens
cagactttcaaggagtgaaggc

SEQ ID NO: 9125678 - DNA, 22 bp, Homo sapiens
cagactttctgactcccttgcc

SEQ ID NO: 9125679 - DNA, 22 bp, Homo sapiens
cagactttctggaagctaaaaa

SEQ ID NO: 9125680 - DNA, 22 bp, Homo sapiens
cagagggacagtatgatgaaag

SEQ ID NO: 9125681 - DNA, 22 bp, Homo sapiens
agtctttagaaggtagttgagg

SEQ ID NO: 9125682 - DNA, 22 bp, Homo sapiens
actgaggaacatatataagatg

SEQ ID NO: 9125683 - DNA, 19 bp, Homo sapiens
agtatagagtattgaggag

SEQ ID NO: 9125684 - DNA, 19 bp, Homo sapiens
atcatcctgggtcatgcac

SEQ ID NO: 9125685 - DNA, 22 bp, Homo sapiens
agaaagtgaacgtgttcagttt

SEQ ID NO: 9125686 - DNA, 22 bp, Homo sapiens
agaacacatagagaagttttat

SEQ ID NO: 9125687 - DNA, 22 bp, Homo sapiens
ataatgcatttagaataattca

SEQ ID NO: 9125688 - DNA, 22 bp, Homo sapiens
acagctgctcacctgtgagccc

SEQ ID NO: 9125689 - DNA, 22 bp, Homo sapiens
acaggaggggcatgaaagacgg

SEQ ID NO: 9125690 - DNA, 23 bp, Homo sapiens
acaggaggggacaggtggccgtg

SEQ ID NO: 9125691 - DNA, 22 bp, Homo sapiens
acaggagggacaccttcctgct

SEQ ID NO: 9125692 - DNA, 22 bp, Homo sapiens
acatagtaagtgctcagtaaat

SEQ ID NO: 9125693 - DNA, 22 bp, Homo sapiens
acagtctgcctctcagagcagc

SEQ ID NO: 9125694 - DNA, 22 bp, Homo sapiens
agggggctcagcaggctctgga

SEQ ID NO: 9125695 - DNA, 22 bp, Homo sapiens
agggggctcagcatggatggag

SEQ ID NO: 9125696 - DNA, 22 bp, Homo sapiens
agggggctcagtgactgaagtg

SEQ ID NO: 9125697 - DNA, 22 bp, Homo sapiens
aagggccattgctgagagcagt

SEQ ID NO: 9125698 - DNA, 22 bp, Homo sapiens
aagggccatcccagaacagaaa

SEQ ID NO: 9125699 - DNA, 22 bp, Homo sapiens
aaggcagtcaaagcagacttct

SEQ ID NO: 9125700 - DNA, 22 bp, Homo sapiens
aatccccatcaaattaatacgt

SEQ ID NO: 9125701 - DNA, 22 bp, Homo sapiens
aatgactgtagtcatattaagg

SEQ ID NO: 9125702 - DNA, 19 bp, Homo sapiens
aatgactgagtacattgtc

SEQ ID NO: 9125703 - DNA, 18 bp, Homo sapiens
agaaggagctatgggcag

SEQ ID NO: 9125704 - DNA, 22 bp, Homo sapiens
aagtggactaatacaaggacta

SEQ ID NO: 9125705 - DNA, 22 bp, Homo sapiens
aagtggactaatacaaggacta

SEQ ID NO: 9125706 - DNA, 22 bp, Homo sapiens
acagaacaacaaggtggaccag

SEQ ID NO: 9125707 - DNA, 22 bp, Homo sapiens
agcagtgtgaaatgatttaagg

SEQ ID NO: 9125708 - DNA, 22 bp, Homo sapiens
agcagtgtttgtgactttagat

SEQ ID NO: 9125709 - DNA, 22 bp, Homo sapiens
acagcaagacccctagcatggt

SEQ ID NO: 9125710 - DNA, 22 bp, Homo sapiens
agctctgggggaaagtctgctc

SEQ ID NO: 9125711 - DNA, 22 bp, Homo sapiens
aatgttgaggatatcagaaaat

SEQ ID NO: 9125712 - DNA, 21 bp, Homo sapiens
agacagagtgcagtctacata

SEQ ID NO: 9125713 - DNA, 21 bp, Homo sapiens
agacagagtgcagtctacata

SEQ ID NO: 9125714 - DNA, 22 bp, Homo sapiens
agacagagatactatgttgtca

SEQ ID NO: 9125715 - DNA, 22 bp, Homo sapiens
aatgtctgctctactcaggagg

SEQ ID NO: 9125716 - DNA, 22 bp, Homo sapiens
agatggggctcagtgtggaggc

SEQ ID NO: 9125717 - DNA, 22 bp, Homo sapiens
acaatgtttttgttcaaagagt

SEQ ID NO: 9125718 - DNA, 19 bp, Homo sapiens
agatggggaagagtgtgag

SEQ ID NO: 9125719 - DNA, 20 bp, Homo sapiens
agaggccagttaggagtcta

SEQ ID NO: 9125720 - DNA, 22 bp, Homo sapiens
agaggccccaggtgagcatgcc

SEQ ID NO: 9125721 - DNA, 22 bp, Homo sapiens
agaggccccatgggatggcggt

SEQ ID NO: 9125722 - DNA, 22 bp, Homo sapiens
aattttcacagtgctgtgagat

SEQ ID NO: 9125723 - DNA, 22 bp, Homo sapiens
agagctggggccagagtcaagg

SEQ ID NO: 9125724 - DNA, 22 bp, Homo sapiens
agagctgggtggtggtgactca

SEQ ID NO: 9125725 - DNA, 22 bp, Homo sapiens
acaaacagctaacatatgttaa

SEQ ID NO: 9125726 - DNA, 17 bp, Homo sapiens
aagagaggctgagctgg

SEQ ID NO: 9125727 - DNA, 23 bp, Homo sapiens
aagagcagggaatatttatttgc

SEQ ID NO: 9125728 - DNA, 22 bp, Homo sapiens
aatgttttctgactgctaactt

SEQ ID NO: 9125729 - DNA, 22 bp, Homo sapiens
aatgttttcccagtgcagacga

SEQ ID NO: 9125730 - DNA, 22 bp, Homo sapiens
aatgttttctctgtgaacacat

SEQ ID NO: 9125731 - DNA, 22 bp, Homo sapiens
aatgttttatagctcaagcaat

SEQ ID NO: 9125732 - DNA, 22 bp, Homo sapiens
aatgttttaaaagagattgaga

SEQ ID NO: 9125733 - DNA, 22 bp, Homo sapiens
aatgttttagattactgctggg

SEQ ID NO: 9125734 - DNA, 22 bp, Homo sapiens
aattggactgtgctgctcaaaa

SEQ ID NO: 9125735 - DNA, 22 bp, Homo sapiens
aatgataccaaacatgtagata

SEQ ID NO: 9125736 - DNA, 22 bp, Homo sapiens
aacttaggaaaataaggcatga

SEQ ID NO: 9125737 - DNA, 22 bp, Homo sapiens
aactgtttcagaaatattgttg

SEQ ID NO: 9125738 - DNA, 22 bp, Homo sapiens
aacactgaaatgtcttaagatt

SEQ ID NO: 9125739 - DNA, 22 bp, Homo sapiens
aacactgaagccgttaaacctt

SEQ ID NO: 9125740 - DNA, 22 bp, Homo sapiens
aacactgaagtagtgaatactg

SEQ ID NO: 9125741 - DNA, 22 bp, Homo sapiens
aacactgagctattacggtgga

SEQ ID NO: 9125742 - DNA, 22 bp, Homo sapiens
aacaaacattacctggtgctgg

SEQ ID NO: 9125743 - DNA, 22 bp, Homo sapiens
aacaaacagttaagtgtggatg

SEQ ID NO: 9125744 - DNA, 22 bp, Homo sapiens
aacaaacaaacattttgtcatc

SEQ ID NO: 9125745 - DNA, 22 bp, Homo sapiens
aaagccagttcttttatattgg

SEQ ID NO: 9125746 - DNA, 22 bp, Homo sapiens
aaatcccttgctctctcagacc

SEQ ID NO: 9125747 - DNA, 22 bp, Homo sapiens
aaatgcaggaaattatgctttt

SEQ ID NO: 9125748 - DNA, 22 bp, Homo sapiens
aaagtgtggagattgaactaaa

SEQ ID NO: 9125749 - DNA, 22 bp, Homo sapiens
aaataagtgtgggccagtcaaa

SEQ ID NO: 9125750 - DNA, 22 bp, Homo sapiens
aaataacttggtttcatcagag

SEQ ID NO: 9125751 - DNA, 22 bp, Homo sapiens
aaatagcagcctttagttaaca

SEQ ID NO: 9125752 - DNA, 22 bp, Homo sapiens
aaacctttgtgtgtctgtgcct

SEQ ID NO: 9125753 - DNA, 22 bp, Homo sapiens
aaacctttgcctggaagggagt

SEQ ID NO: 9125754 - DNA, 22 bp, Homo sapiens
aaacctttctgctctcagcgta

SEQ ID NO: 9125755 - DNA, 22 bp, Homo sapiens
aaacctttctcagtgctaaaat

SEQ ID NO: 9125756 - DNA, 22 bp, Homo sapiens
aaacctttaccagactagcaag

SEQ ID NO: 9125757 - DNA, 22 bp, Homo sapiens
aaacaatgttcctatattagag

SEQ ID NO: 9125758 - DNA, 22 bp, Homo sapiens
aaatgcagatccctgaatctca

SEQ ID NO: 9125759 - DNA, 22 bp, Homo sapiens
aaatgcagaatgatttcatcta

SEQ ID NO: 9125760 - DNA, 22 bp, Homo sapiens
aaaagtaattgtggtttttgct

SEQ ID NO: 9125761 - DNA, 22 bp, Homo sapiens
aaaagtaattgtggtttttgcc

SEQ ID NO: 9125762 - DNA, 22 bp, Homo sapiens
aaacaatgaaatatttttatgg

SEQ ID NO: 9125763 - DNA, 22 bp, Homo sapiens
aaaaaattccattctgtgcctt

SEQ ID NO: 9125764 - DNA, 22 bp, Homo sapiens
gcacccacttaggccagtcaat

SEQ ID NO: 9125765 - DNA, 18 bp, Homo sapiens
gatgtgggccctggatat

SEQ ID NO: 9125766 - DNA, 22 bp, Homo sapiens
gatgtggggataatactggtac

SEQ ID NO: 9125767 - DNA, 22 bp, Homo sapiens
gatgtggggttgagggaccagc

SEQ ID NO: 9125768 - DNA, 22 bp, Homo sapiens
attctgagaggcacaatgtgga

SEQ ID NO: 9125769 - DNA, 22 bp, Homo sapiens
attctgagtacaacaagatgtt

SEQ ID NO: 9125770 - DNA, 22 bp, Homo sapiens
attctgagttagagtcagccag

SEQ ID NO: 9125771 - DNA, 21 bp, Homo sapiens
attctgagttgtcagtcttca

SEQ ID NO: 9125772 - DNA, 22 bp, Homo sapiens
caaacttttgaggagttcagga

SEQ ID NO: 9125773 - DNA, 22 bp, Homo sapiens
caaaagcagcaagtttatatgt

SEQ ID NO: 9125774 - DNA, 22 bp, Homo sapiens
caaaagcaaagtccctgaatgt

SEQ ID NO: 9125775 - DNA, 22 bp, Homo sapiens
atttattaagcatctgctatgt

SEQ ID NO: 9125776 - DNA, 22 bp, Homo sapiens
atttattacctcggagtttctg

SEQ ID NO: 9125777 - DNA, 22 bp, Homo sapiens
atgtcagaatctacattctact

SEQ ID NO: 9125778 - DNA, 21 bp, Homo sapiens
atgtggccattgtagtccacg

SEQ ID NO: 9125779 - DNA, 22 bp, Homo sapiens
gaggcacagtgtttggtcagtg

SEQ ID NO: 9125780 - DNA, 22 bp, Homo sapiens
gaggaggggcacttgtctccta

SEQ ID NO: 9125781 - DNA, 22 bp, Homo sapiens
gaggcacagagtaggtgcacac

SEQ ID NO: 9125782 - DNA, 22 bp, Homo sapiens
gaggcacagagccctaggagct

SEQ ID NO: 9125783 - DNA, 22 bp, Homo sapiens
gagcacaggctttggtggacac

SEQ ID NO: 9125784 - DNA, 22 bp, Homo sapiens
gagcacagctggaggtagcatt

SEQ ID NO: 9125785 - DNA, 22 bp, Homo sapiens
gaagagagagccctggggtccg

SEQ ID NO: 9125786 - DNA, 22 bp, Homo sapiens
gaagagagagccctggggtccg

SEQ ID NO: 9125787 - DNA, 22 bp, Homo sapiens
gacagcttagtgaaaatgtaaa

SEQ ID NO: 9125788 - DNA, 16 bp, Homo sapiens
atgctgctattagagg

SEQ ID NO: 9125789 - DNA, 22 bp, Homo sapiens
ctttattagatgtagactttct

SEQ ID NO: 9125790 - DNA, 22 bp, Homo sapiens
ctttcaaaacgctctgtatgca

SEQ ID NO: 9125791 - DNA, 22 bp, Homo sapiens
atgacatggtgcagacagtgtc

SEQ ID NO: 9125792 - DNA, 22 bp, Homo sapiens
gggaggcagtgctggaggctgg

SEQ ID NO: 9125793 - DNA, 22 bp, Homo sapiens
cagatgctaaacaaaggacttt

SEQ ID NO: 9125794 - DNA, 22 bp, Homo sapiens
cagatgctaggccaattcctga

SEQ ID NO: 9125795 - DNA, 22 bp, Homo sapiens
cagatgctaagttatcagcagg

SEQ ID NO: 9125796 - DNA, 22 bp, Homo sapiens
gggctgtgagagtggggctgct

SEQ ID NO: 9125797 - DNA, 18 bp, Homo sapiens
gggctgtgagatgggaag

SEQ ID NO: 9125798 - DNA, 22 bp, Homo sapiens
gggctgtgctgagtaggaggtg

SEQ ID NO: 9125799 - DNA, 22 bp, Homo sapiens
gtaggcagtgcttgattttcca

SEQ ID NO: 9125800 - DNA, 22 bp, Homo sapiens
cagcatcctttgctggtttccc

SEQ ID NO: 9125801 - DNA, 19 bp, Homo sapiens
cacttcacatggtgaaagc

SEQ ID NO: 9125802 - DNA, 22 bp, Homo sapiens
cactttaaaactgacagccctt

SEQ ID NO: 9125803 - DNA, 21 bp, Homo sapiens
cactttaaaaatatctttata

SEQ ID NO: 9125804 - DNA, 23 bp, Homo sapiens
caacttttggctacatgcttagc

SEQ ID NO: 9125805 - DNA, 22 bp, Homo sapiens
ataatcagaattcatgaaagat

SEQ ID NO: 9125806 - DNA, 22 bp, Homo sapiens
ataataaaccaggatgggtctg

SEQ ID NO: 9125807 - DNA, 22 bp, Homo sapiens
agtttattctctggtcttagta

SEQ ID NO: 9125808 - DNA, 22 bp, Homo sapiens
atcattatcctcctatttgcct

SEQ ID NO: 9125809 - DNA, 22 bp, Homo sapiens
atcattataatggtatagttgt

SEQ ID NO: 9125810 - DNA, 22 bp, Homo sapiens
atctcccaattccctgataaat

SEQ ID NO: 9125811 - DNA, 22 bp, Homo sapiens
ctggggaggatgctacgacctg

SEQ ID NO: 9125812 - DNA, 22 bp, Homo sapiens
atattttctggaactatgcctg

SEQ ID NO: 9125813 - DNA, 22 bp, Homo sapiens
atattttccgaacttgaggtag

SEQ ID NO: 9125814 - DNA, 22 bp, Homo sapiens
atattttcactgaaccaaagta

SEQ ID NO: 9125815 - DNA, 22 bp, Homo sapiens
atattttcacagaacttgcaaa

SEQ ID NO: 9125816 - DNA, 22 bp, Homo sapiens
agtctgaaccagatggcaaggt

SEQ ID NO: 9125817 - DNA, 22 bp, Homo sapiens
agtctgaagactcatgtctgaa

SEQ ID NO: 9125818 - DNA, 22 bp, Homo sapiens
agtctgaagtagtctttagtgt

SEQ ID NO: 9125819 - DNA, 22 bp, Homo sapiens
agtctgaaggcaatctgctgac

SEQ ID NO: 9125820 - DNA, 22 bp, Homo sapiens
agtctgaagatattcttgcagg

SEQ ID NO: 9125821 - DNA, 23 bp, Homo sapiens
agtctgaattgagatgtgctgtg

SEQ ID NO: 9125822 - DNA, 22 bp, Homo sapiens
agtctggaatttggcctgagca

SEQ ID NO: 9125823 - DNA, 22 bp, Homo sapiens
ctcccagggtctaggctgctgg

SEQ ID NO: 9125824 - DNA, 22 bp, Homo sapiens
ctcccaggttccgacgcctctt

SEQ ID NO: 9125825 - DNA, 20 bp, Homo sapiens
ctccagtgttcaggggagtg

SEQ ID NO: 9125826 - DNA, 22 bp, Homo sapiens
ctccagtggtgatggggaagaa

SEQ ID NO: 9125827 - DNA, 22 bp, Homo sapiens
ctccagttggccccagttggtt

SEQ ID NO: 9125828 - DNA, 22 bp, Homo sapiens
ctccagttggccccagttggtt

SEQ ID NO: 9125829 - DNA, 22 bp, Homo sapiens
ctgaagccacgatagcttccta

SEQ ID NO: 9125830 - DNA, 22 bp, Homo sapiens
ctcttaatgaggctgacttgta

SEQ ID NO: 9125831 - DNA, 22 bp, Homo sapiens
aggggctgtggaaaccaactct

SEQ ID NO: 9125832 - DNA, 19 bp, Homo sapiens
agggtggcaaaggagggtg

SEQ ID NO: 9125833 - DNA, 22 bp, Homo sapiens
cctggctcagaccccagttctg

SEQ ID NO: 9125834 - DNA, 22 bp, Homo sapiens
aggtctgagtatggcctgagaa

SEQ ID NO: 9125835 - DNA, 18 bp, Homo sapiens
aggtctgaggaagagcct

SEQ ID NO: 9125836 - DNA, 22 bp, Homo sapiens
cgccttcaggccctttttgttg

SEQ ID NO: 9125837 - DNA, 22 bp, Homo sapiens
aggtggggttcagtctcagccg

SEQ ID NO: 9125838 - DNA, 22 bp, Homo sapiens
caggaaggggctcactctggcc

SEQ ID NO: 9125839 - DNA, 22 bp, Homo sapiens
cagttttagctagagcaaacca

SEQ ID NO: 9125840 - DNA, 23 bp, Homo sapiens
cccagagcacagcctccagatgc

SEQ ID NO: 9125841 - DNA, 22 bp, Homo sapiens
aggctcagtatagctggcaagt

SEQ ID NO: 9125842 - DNA, 22 bp, Homo sapiens
aggctcaggtgcctcattcaca

SEQ ID NO: 9125843 - DNA, 22 bp, Homo sapiens
aggctcagtcccggcccgcgcc

SEQ ID NO: 9125844 - DNA, 22 bp, Homo sapiens
aggctcagtctgttcatgcact

SEQ ID NO: 9125845 - DNA, 22 bp, Homo sapiens
aggctcagtgatgtaaaatata

SEQ ID NO: 9125846 - DNA, 22 bp, Homo sapiens
ccaggaggaaagaccagcccat

SEQ ID NO: 9125847 - DNA, 22 bp, Homo sapiens
ccaggaggaaattctaaaggta

SEQ ID NO: 9125848 - DNA, 22 bp, Homo sapiens
aggctccaccctacagagctcc

SEQ ID NO: 9125849 - DNA, 23 bp, Homo sapiens
aggctccacatgggcactttgca

SEQ ID NO: 9125850 - DNA, 22 bp, Homo sapiens
aggctccaccagtcaggtgcat

SEQ ID NO: 9125851 - DNA, 22 bp, Homo sapiens
aggctccaccccgccagacctt

SEQ ID NO: 9125852 - DNA, 22 bp, Homo sapiens
aggctcagttctgtggtgagcc

SEQ ID NO: 9125853 - DNA, 22 bp, Homo sapiens
aggctcagttctgtggtgagcc

SEQ ID NO: 9125854 - DNA, 22 bp, Homo sapiens
aggctcagtgcaaatcattctg

SEQ ID NO: 9125855 - DNA, 22 bp, Homo sapiens
aggctcagttcacgtcaacttt

SEQ ID NO: 9125856 - DNA, 22 bp, Homo sapiens
aggctcagtttggtttccattg

SEQ ID NO: 9125857 - DNA, 22 bp, Homo sapiens
aggctccaaattaccaagctct

SEQ ID NO: 9125858 - DNA, 22 bp, Homo sapiens
aggctccgtccagtctcaggcc

SEQ ID NO: 9125859 - DNA, 22 bp, Homo sapiens
aggccagagaggggaccagcct

SEQ ID NO: 9125860 - DNA, 22 bp, Homo sapiens
ccaggagcaaagatcactggga

SEQ ID NO: 9125861 - DNA, 23 bp, Homo sapiens
agggaagaaacatgaagggctgt

SEQ ID NO: 9125862 - DNA, 22 bp, Homo sapiens
agggaagaaaatccatcgctgc

SEQ ID NO: 9125863 - DNA, 22 bp, Homo sapiens
agggaagaagctggtagtaggt

SEQ ID NO: 9125864 - DNA, 22 bp, Homo sapiens
agggaacagtgaaaggcatcag

SEQ ID NO: 9125865 - DNA, 20 bp, Homo sapiens
agggaacaatggacgctgtc

SEQ ID NO: 9125866 - DNA, 22 bp, Homo sapiens
agggaacagtgaaaggcatcag

SEQ ID NO: 9125867 - DNA, 22 bp, Homo sapiens
agggaacatttgcactgttggt

SEQ ID NO: 9125868 - DNA, 22 bp, Homo sapiens
agggaacaaaactctaaaattc

SEQ ID NO: 9125869 - DNA, 23 bp, Homo sapiens
agggaacaagcaagctgctagtc

SEQ ID NO: 9125870 - DNA, 22 bp, Homo sapiens
agggaggagtcctcaaagtcat

SEQ ID NO: 9125871 - DNA, 22 bp, Homo sapiens
aggggctgctgggtccgcccct

SEQ ID NO: 9125872 - DNA, 22 bp, Homo sapiens
tccagctggcctaacttcaggg

SEQ ID NO: 9125873 - DNA, 22 bp, Homo sapiens
tccagagaaatctagtcttaca

SEQ ID NO: 9125874 - DNA, 22 bp, Homo sapiens
tccagctgctgacccagtagcc

SEQ ID NO: 9125875 - DNA, 18 bp, Homo sapiens
tcctcagcctcacctagc

SEQ ID NO: 9125876 - DNA, 22 bp, Homo sapiens
tcccaggaggtgcttcctagga

SEQ ID NO: 9125877 - DNA, 22 bp, Homo sapiens
ccagagaggccaaggtcgtggt

SEQ ID NO: 9125878 - DNA, 22 bp, Homo sapiens
ccagagagagtactgggctctg

SEQ ID NO: 9125879 - DNA, 19 bp, Homo sapiens
ccagagagctaggtacaga

SEQ ID NO: 9125880 - DNA, 22 bp, Homo sapiens
tctccaggaaagacactggact

SEQ ID NO: 9125881 - DNA, 22 bp, Homo sapiens
ccagaaaaatcctcccttgtcc

SEQ ID NO: 9125882 - DNA, 19 bp, Homo sapiens
ccactttgcttctctgggt

SEQ ID NO: 9125883 - DNA, 22 bp, Homo sapiens
ccactttgaaccactgaggtgg

SEQ ID NO: 9125884 - DNA, 22 bp, Homo sapiens
tctgagagtctctgaggcagat

SEQ ID NO: 9125885 - DNA, 22 bp, Homo sapiens
tctgagagatacaaggaggcaa

SEQ ID NO: 9125886 - DNA, 22 bp, Homo sapiens
ccagccacagcttccagctcct

SEQ ID NO: 9125887 - DNA, 20 bp, Homo sapiens
ccagcatgtacacatgtgga

SEQ ID NO: 9125888 - DNA, 19 bp, Homo sapiens
tctgaagtccagggcatac

SEQ ID NO: 9125889 - DNA, 21 bp, Homo sapiens
taggactttacaatttaggaa

SEQ ID NO: 9125890 - DNA, 22 bp, Homo sapiens
tagataaaagggcaaagggcat

SEQ ID NO: 9125891 - DNA, 22 bp, Homo sapiens
tagataaattagaaagtttact

SEQ ID NO: 9125892 - DNA, 22 bp, Homo sapiens
cagtatagaaagttttaaattg

SEQ ID NO: 9125893 - DNA, 22 bp, Homo sapiens
tatttcattctttatcaggagc

SEQ ID NO: 9125894 - DNA, 22 bp, Homo sapiens
tatttcatctggaacaaggtaa

SEQ ID NO: 9125895 - DNA, 22 bp, Homo sapiens
tcagacttcagtttttagttgt

SEQ ID NO: 9125896 - DNA, 21 bp, Homo sapiens
tcaggaaacacctcttaagga

SEQ ID NO: 9125897 - DNA, 22 bp, Homo sapiens
tcagatgccaactgaacaacag

SEQ ID NO: 9125898 - DNA, 22 bp, Homo sapiens
tcagatgccaactgaacaacag

SEQ ID NO: 9125899 - DNA, 22 bp, Homo sapiens
tcagatgccctttgttttagac

SEQ ID NO: 9125900 - DNA, 22 bp, Homo sapiens
tcagatgccctttgttttagac

SEQ ID NO: 9125901 - DNA, 22 bp, Homo sapiens
tcagatgcctgtggggtctagg

SEQ ID NO: 9125902 - DNA, 22 bp, Homo sapiens
tcagatgcgatgcattcaggct

SEQ ID NO: 9125903 - DNA, 20 bp, Homo sapiens
tggaaggcatctgcattatt

SEQ ID NO: 9125904 - DNA, 21 bp, Homo sapiens
tggaaggctgctctgccaggg

SEQ ID NO: 9125905 - DNA, 17 bp, Homo sapiens
tggaaggcttcaatatt

SEQ ID NO: 9125906 - DNA, 22 bp, Homo sapiens
tggaaggcttggaatacttcca

SEQ ID NO: 9125907 - DNA, 22 bp, Homo sapiens
tgcctcagtttctccatatgaa

SEQ ID NO: 9125908 - DNA, 22 bp, Homo sapiens
ccctgccttggggtccacaccg

SEQ ID NO: 9125909 - DNA, 22 bp, Homo sapiens
cctcacagccctcctctagcac

SEQ ID NO: 9125910 - DNA, 22 bp, Homo sapiens
cctcacccagtcacctaggtgg

SEQ ID NO: 9125911 - DNA, 22 bp, Homo sapiens
tggcctcaagtctgagggcctt

SEQ ID NO: 9125912 - DNA, 22 bp, Homo sapiens
tggctcagcgcggcctggtctt

SEQ ID NO: 9125913 - DNA, 22 bp, Homo sapiens
tggctcagcctggccctttcat

SEQ ID NO: 9125914 - DNA, 22 bp, Homo sapiens
tggctcagccattcgtgttgcc

SEQ ID NO: 9125915 - DNA, 22 bp, Homo sapiens
tggctcagcggtggcagcagac

SEQ ID NO: 9125916 - DNA, 23 bp, Homo sapiens
tggctcagctagttttccatttc

SEQ ID NO: 9125917 - DNA, 22 bp, Homo sapiens
cctgaaaatcaaggtagtttgg

SEQ ID NO: 9125918 - DNA, 22 bp, Homo sapiens
cctgaaaatatcctctcctttg

SEQ ID NO: 9125919 - DNA, 22 bp, Homo sapiens
tggctctcccaatacctttctg

SEQ ID NO: 9125920 - DNA, 22 bp, Homo sapiens
tctttaatataaaggaatgaat

SEQ ID NO: 9125921 - DNA, 22 bp, Homo sapiens
tctttaatataaaggaatgaat

SEQ ID NO: 9125922 - DNA, 22 bp, Homo sapiens
tcttgttttgaactcatcagga

SEQ ID NO: 9125923 - DNA, 17 bp, Homo sapiens
tgactttatttgcttgg

SEQ ID NO: 9125924 - DNA, 21 bp, Homo sapiens
tgactttatttgacagcccag

SEQ ID NO: 9125925 - DNA, 21 bp, Homo sapiens
tgactttatattgtgtcagga

SEQ ID NO: 9125926 - DNA, 22 bp, Homo sapiens
tgactttagacttagtcaagtt

SEQ ID NO: 9125927 - DNA, 22 bp, Homo sapiens
tgactttagagatgggaggtca

SEQ ID NO: 9125928 - DNA, 22 bp, Homo sapiens
tgactttacagatatgtttcct

SEQ ID NO: 9125929 - DNA, 22 bp, Homo sapiens
tgactttaataggattttgcat

SEQ ID NO: 9125930 - DNA, 22 bp, Homo sapiens
tgactttaagctatctgattct

SEQ ID NO: 9125931 - DNA, 22 bp, Homo sapiens
tgactttagaattttatccaga

SEQ ID NO: 9125932 - DNA, 22 bp, Homo sapiens
tgactttaaaataacaagttta

SEQ ID NO: 9125933 - DNA, 22 bp, Homo sapiens
tgactttaaagctcactctttt

SEQ ID NO: 9125934 - DNA, 22 bp, Homo sapiens
tgaggaagttgtttctcttcta

SEQ ID NO: 9125935 - DNA, 22 bp, Homo sapiens
tgagcagaaaagaatgctgagc

SEQ ID NO: 9125936 - DNA, 22 bp, Homo sapiens
tgagcagacttgatgaggcagc

SEQ ID NO: 9125937 - DNA, 22 bp, Homo sapiens
cccaggagatctggatctcgtc

SEQ ID NO: 9125938 - DNA, 22 bp, Homo sapiens
cccacccagcctggctgagggg

SEQ ID NO: 9125939 - DNA, 22 bp, Homo sapiens
cccagagagcatttggacaaag

SEQ ID NO: 9125940 - DNA, 22 bp, Homo sapiens
tgatgaccgccaacgtttaggt

SEQ ID NO: 9125941 - DNA, 22 bp, Homo sapiens
ttatttattgtgtacctactgt

SEQ ID NO: 9125942 - DNA, 22 bp, Homo sapiens
ttcaaagtgtgacctgacaagc

SEQ ID NO: 9125943 - DNA, 22 bp, Homo sapiens
ttatcatctcctgctgtggtta

SEQ ID NO: 9125944 - DNA, 22 bp, Homo sapiens
ttagcaaatatcttgaaacagg

SEQ ID NO: 9125945 - DNA, 21 bp, Homo sapiens
tgtcagagcttgtaggacatt

SEQ ID NO: 9125946 - DNA, 22 bp, Homo sapiens
cgttttcttcactttgcaagtt

SEQ ID NO: 9125947 - DNA, 22 bp, Homo sapiens
cgtttagttgtcccttcttaaa

SEQ ID NO: 9125948 - DNA, 23 bp, Homo sapiens
ttctggaagatttacttgagaca

SEQ ID NO: 9125949 - DNA, 22 bp, Homo sapiens
ttctgaagctcccttttgtagt

SEQ ID NO: 9125950 - DNA, 22 bp, Homo sapiens
ctcactgcaacctctgcctccc

SEQ ID NO: 9125951 - DNA, 22 bp, Homo sapiens
ctcacccatatctccatgactc

SEQ ID NO: 9125952 - DNA, 22 bp, Homo sapiens
ctcaggtcttagttctgtcatc

SEQ ID NO: 9125953 - DNA, 22 bp, Homo sapiens
ctcagggagtagcacatgtgga

SEQ ID NO: 9125954 - DNA, 22 bp, Homo sapiens
ctgagccaaaaagcagagcttg

SEQ ID NO: 9125955 - DNA, 22 bp, Homo sapiens
ctccaggatgttagacgtccag

SEQ ID NO: 9125956 - DNA, 23 bp, Homo sapiens
tttcagaagtggtcctaggaagc

SEQ ID NO: 9125957 - DNA, 22 bp, Homo sapiens
tttcagaaggggagaaaggtca

SEQ ID NO: 9125958 - DNA, 22 bp, Homo sapiens
tttcagaaccgctaaaataaat

SEQ ID NO: 9125959 - DNA, 17 bp, Homo sapiens
ctctgtggaggtgttta

SEQ ID NO: 9125960 - DNA, 22 bp, Homo sapiens
ctctgtgggccagagaggcccc

SEQ ID NO: 9125961 - DNA, 22 bp, Homo sapiens
ctgtgggtggctgtgccccagg

SEQ ID NO: 9125962 - DNA, 22 bp, Homo sapiens
ctgtgggtgaagacaagggaga

SEQ ID NO: 9125963 - DNA, 22 bp, Homo sapiens
ctgtgggtattaaaaatgaatt

SEQ ID NO: 9125964 - DNA, 22 bp, Homo sapiens
ctggtcacctccttcccagcta

SEQ ID NO: 9125965 - DNA, 22 bp, Homo sapiens
ctggtcaccaggtagcattgta

SEQ ID NO: 9125966 - DNA, 22 bp, Homo sapiens
ctgggctctagaaaggaaagaa

SEQ ID NO: 9125967 - DNA, 22 bp, Homo sapiens
ctgggggccttacggaactcca

SEQ ID NO: 9125968 - DNA, 22 bp, Homo sapiens
ctgggggcagcaagaagccatg

SEQ ID NO: 9125969 - DNA, 22 bp, Homo sapiens
ctgggatccacgggctcccaag

SEQ ID NO: 9125970 - DNA, 22 bp, Homo sapiens
gaaatacagaaagggctgaatg

SEQ ID NO: 9125971 - DNA, 22 bp, Homo sapiens
gaaagaatgctatagtgacttc

SEQ ID NO: 9125972 - DNA, 22 bp, Homo sapiens
gaaactgtttctggctttggtg

SEQ ID NO: 9125973 - DNA, 22 bp, Homo sapiens
gaaaaatgagctgatgtcaggg

SEQ ID NO: 9125974 - DNA, 22 bp, Homo sapiens
ctttttgtgtatgctacagttg

SEQ ID NO: 9125975 - DNA, 22 bp, Homo sapiens
gaaaaatgctccaaatctgtgg

SEQ ID NO: 9125976 - DNA, 22 bp, Homo sapiens
cttcagaaccagccagaagagg

SEQ ID NO: 9125977 - DNA, 22 bp, Homo sapiens
gacattaaatgtcttagttgcc

SEQ ID NO: 9125978 - DNA, 22 bp, Homo sapiens
gactattacatgctttcaagac

SEQ ID NO: 9125979 - DNA, 22 bp, Homo sapiens
gaagaaggtggcccaggggtag

SEQ ID NO: 9125980 - DNA, 22 bp, Homo sapiens
gaagaaggtgccagaggcttac

SEQ ID NO: 9125981 - DNA, 22 bp, Homo sapiens
gagaggagacttatccagattg

SEQ ID NO: 9125982 - DNA, 22 bp, Homo sapiens
gagaggcaggaatcctgggtga

SEQ ID NO: 9125983 - DNA, 18 bp, Homo sapiens
gagcagaggctcaactgg

SEQ ID NO: 9125984 - DNA, 22 bp, Homo sapiens
gagcagagcttctcaaagtaaa

SEQ ID NO: 9125985 - DNA, 22 bp, Homo sapiens
gagcagagaatccagctaagtg

SEQ ID NO: 9125986 - DNA, 21 bp, Homo sapiens
gaggccactaataggggcaga

SEQ ID NO: 9125987 - DNA, 22 bp, Homo sapiens
gaggagtctttttagggcctga

SEQ ID NO: 9125988 - DNA, 22 bp, Homo sapiens
gaggagtctagtttatggcttc

SEQ ID NO: 9125989 - DNA, 22 bp, Homo sapiens
gaggaggtggagtcatgcagag

SEQ ID NO: 9125990 - DNA, 22 bp, Homo sapiens
gaggagagaagctaacggtgct

SEQ ID NO: 9125991 - DNA, 22 bp, Homo sapiens
gagctcagagcctatagttggt

SEQ ID NO: 9125992 - DNA, 19 bp, Homo sapiens
gagcaggccacacatgtgt

SEQ ID NO: 9125993 - DNA, 22 bp, Homo sapiens
gagggtggtggcttaaggtgct

SEQ ID NO: 9125994 - DNA, 22 bp, Homo sapiens
gaggtgctgctgtacttcttgc

SEQ ID NO: 9125995 - DNA, 22 bp, Homo sapiens
tccccttggcttggtcaagagg

SEQ ID NO: 9125996 - DNA, 22 bp, Homo sapiens
tcccagcctcctgacagttttg

SEQ ID NO: 9125997 - DNA, 22 bp, Homo sapiens
tcattgtcttgatatgattgtc

SEQ ID NO: 9125998 - DNA, 22 bp, Homo sapiens
tcattgtcagctcttgacttct

SEQ ID NO: 9125999 - DNA, 22 bp, Homo sapiens
tcattgtctctcttttcatata

SEQ ID NO: 9126000 - DNA, 22 bp, Homo sapiens
tcattgtcgctctgcggtgttc

SEQ ID NO: 9126001 - DNA, 22 bp, Homo sapiens
tcattgttaattgtatgatctg

SEQ ID NO: 9126002 - DNA, 22 bp, Homo sapiens
tcattgtttctgcttttcatga

SEQ ID NO: 9126003 - DNA, 22 bp, Homo sapiens
tcatttcttaactagagtgaac

SEQ ID NO: 9126004 - DNA, 22 bp, Homo sapiens
tcataaattgattatgtgcttt

SEQ ID NO: 9126005 - DNA, 22 bp, Homo sapiens
tcatagaaatggaaagtatatt

SEQ ID NO: 9126006 - DNA, 22 bp, Homo sapiens
tcagccagaggcttcttggttt

SEQ ID NO: 9126007 - DNA, 19 bp, Homo sapiens
tcagcatcaatttggtcct

SEQ ID NO: 9126008 - DNA, 22 bp, Homo sapiens
tcagccagctcttggactctga

SEQ ID NO: 9126009 - DNA, 22 bp, Homo sapiens
tcagccagctgtgtgcttctgc

SEQ ID NO: 9126010 - DNA, 22 bp, Homo sapiens
tcagccaggcagccccctggtc

SEQ ID NO: 9126011 - DNA, 22 bp, Homo sapiens
tcagatgctagggctgagctat

SEQ ID NO: 9126012 - DNA, 22 bp, Homo sapiens
tcagatgctaaagatggaatta

SEQ ID NO: 9126013 - DNA, 22 bp, Homo sapiens
tcagatgcttagtgactacaca

SEQ ID NO: 9126014 - DNA, 19 bp, Homo sapiens
tcagatgcttctcgtctca

SEQ ID NO: 9126015 - DNA, 22 bp, Homo sapiens
tcagatgcttagtgactacaca

SEQ ID NO: 9126016 - DNA, 22 bp, Homo sapiens
tcagatgcttagagattagact

SEQ ID NO: 9126017 - DNA, 22 bp, Homo sapiens
tcagatgcttagagattagact

SEQ ID NO: 9126018 - DNA, 22 bp, Homo sapiens
tcagatgctgttttcttatata

SEQ ID NO: 9126019 - DNA, 22 bp, Homo sapiens
tcactgcaacctccacctcccg

SEQ ID NO: 9126020 - DNA, 22 bp, Homo sapiens
tcactgcaacctccacctcctg

SEQ ID NO: 9126021 - DNA, 22 bp, Homo sapiens
gtgctggcctcagagggtcatg

SEQ ID NO: 9126022 - DNA, 22 bp, Homo sapiens
gtgctggctgccaggaggctgc

SEQ ID NO: 9126023 - DNA, 22 bp, Homo sapiens
gtgctggctggacatggagcac

SEQ ID NO: 9126024 - DNA, 22 bp, Homo sapiens
gttgaaatcctaaccccctagt

SEQ ID NO: 9126025 - DNA, 22 bp, Homo sapiens
gtttattaactgtcaagtgatt

SEQ ID NO: 9126026 - DNA, 22 bp, Homo sapiens
gtttattagagttttctgtctg

SEQ ID NO: 9126027 - DNA, 18 bp, Homo sapiens
taaatgcatgttaataac

SEQ ID NO: 9126028 - DNA, 22 bp, Homo sapiens
taagagaatgttgtggctaggt

SEQ ID NO: 9126029 - DNA, 19 bp, Homo sapiens
taccaaattgcattatggc

SEQ ID NO: 9126030 - DNA, 22 bp, Homo sapiens
taccaaatgtaatcattctaat

SEQ ID NO: 9126031 - DNA, 22 bp, Homo sapiens
tacagaggcacatgcaattttc

SEQ ID NO: 9126032 - DNA, 22 bp, Homo sapiens
tagactttactaaggctcattt

SEQ ID NO: 9126033 - DNA, 22 bp, Homo sapiens
tagactttccagcctgctgctt

SEQ ID NO: 9126034 - DNA, 19 bp, Homo sapiens
tagacttttccagcaggca

SEQ ID NO: 9126035 - DNA, 22 bp, Homo sapiens
tagacttttcaaaatctagacc

SEQ ID NO: 9126036 - DNA, 20 bp, Homo sapiens
tagacttttcatcaacctta

SEQ ID NO: 9126037 - DNA, 22 bp, Homo sapiens
tagacttttaagtccctcttta

SEQ ID NO: 9126038 - DNA, 22 bp, Homo sapiens
tagactttgatattgtacaccc

SEQ ID NO: 9126039 - DNA, 22 bp, Homo sapiens
tagagaggtttgaattggctgc

SEQ ID NO: 9126040 - DNA, 22 bp, Homo sapiens
tagagaggtttgaattggctgc

SEQ ID NO: 9126041 - DNA, 22 bp, Homo sapiens
tagagaatggccttgaagtagt

SEQ ID NO: 9126042 - DNA, 22 bp, Homo sapiens
tagtttaatggtcaactaatga

SEQ ID NO: 9126043 - DNA, 22 bp, Homo sapiens
tcaaatcccagctcagcctctc

SEQ ID NO: 9126044 - DNA, 22 bp, Homo sapiens
tatttaactggaaacacaatga

SEQ ID NO: 9126045 - DNA, 22 bp, Homo sapiens
ggctgtggcattaggtgaggcc

SEQ ID NO: 9126046 - DNA, 22 bp, Homo sapiens
ggctgtggcagctggaagtggt

SEQ ID NO: 9126047 - DNA, 22 bp, Homo sapiens
ggctgtggtcattaggaggttg

SEQ ID NO: 9126048 - DNA, 22 bp, Homo sapiens
gggaagagggagctggaatgat

SEQ ID NO: 9126049 - DNA, 22 bp, Homo sapiens
gggaaggcagtgtctggttgaa

SEQ ID NO: 9126050 - DNA, 22 bp, Homo sapiens
gggaaggcagtgggaggaactg

SEQ ID NO: 9126051 - DNA, 22 bp, Homo sapiens
gggaaggcatacctgagggaga

SEQ ID NO: 9126052 - DNA, 22 bp, Homo sapiens
gggaaggcaccatggtgttcca

SEQ ID NO: 9126053 - DNA, 22 bp, Homo sapiens
gggaaggcaggattctctggtg

SEQ ID NO: 9126054 - DNA, 22 bp, Homo sapiens
gggaaggcaggcctctgttgga

SEQ ID NO: 9126055 - DNA, 23 bp, Homo sapiens
gggctcagatttcattctgtgcc

SEQ ID NO: 9126056 - DNA, 16 bp, Homo sapiens
gggctcagatctttga

SEQ ID NO: 9126057 - DNA, 22 bp, Homo sapiens
gggctcagccccattgaaccag

SEQ ID NO: 9126058 - DNA, 22 bp, Homo sapiens
gggctcagcctcctcacttcga

SEQ ID NO: 9126059 - DNA, 22 bp, Homo sapiens
gggctcagaggagtggcctggg

SEQ ID NO: 9126060 - DNA, 22 bp, Homo sapiens
gggctcagacatccctcctgga

SEQ ID NO: 9126061 - DNA, 22 bp, Homo sapiens
gggctcagagcatttgggttgg

SEQ ID NO: 9126062 - DNA, 21 bp, Homo sapiens
gggctcagtggaaaagagtgt

SEQ ID NO: 9126063 - DNA, 21 bp, Homo sapiens
gggctcagtggaaaagagtgt

SEQ ID NO: 9126064 - DNA, 22 bp, Homo sapiens
gggctcagttctgcttcatgct

SEQ ID NO: 9126065 - DNA, 22 bp, Homo sapiens
gggctcagctgggcgtgctggt

SEQ ID NO: 9126066 - DNA, 21 bp, Homo sapiens
gggctcagcgctcggctcctc

SEQ ID NO: 9126067 - DNA, 22 bp, Homo sapiens
gggctcagctccttccttccta

SEQ ID NO: 9126068 - DNA, 22 bp, Homo sapiens
gggagtcagagaggtaatggga

SEQ ID NO: 9126069 - DNA, 22 bp, Homo sapiens
gggagctgaatggcaatggaga

SEQ ID NO: 9126070 - DNA, 19 bp, Homo sapiens
gggatcagcccagggctct

SEQ ID NO: 9126071 - DNA, 22 bp, Homo sapiens
gggcagaggctctggcccatcc

SEQ ID NO: 9126072 - DNA, 22 bp, Homo sapiens
ggaggatgagctacgaggagct

SEQ ID NO: 9126073 - DNA, 21 bp, Homo sapiens
ggccacagttagggctcagga

SEQ ID NO: 9126074 - DNA, 22 bp, Homo sapiens
ggccagagttgatggcatcttg

SEQ ID NO: 9126075 - DNA, 22 bp, Homo sapiens
ggctcagattccgagtggccct

SEQ ID NO: 9126076 - DNA, 22 bp, Homo sapiens
ggctcagattccgagtggccct

SEQ ID NO: 9126077 - DNA, 22 bp, Homo sapiens
ggctcagactcccaggccctct

SEQ ID NO: 9126078 - DNA, 22 bp, Homo sapiens
ggctcagagacctgcgatctga

SEQ ID NO: 9126079 - DNA, 20 bp, Homo sapiens
gtcagaggaccctagagcga

SEQ ID NO: 9126080 - DNA, 22 bp, Homo sapiens
gtcagaggaatggatgagtgat

SEQ ID NO: 9126081 - DNA, 22 bp, Homo sapiens
gtcagaggaggctgagtaggaa

SEQ ID NO: 9126082 - DNA, 22 bp, Homo sapiens
gtcctgggaactggacagctaa

SEQ ID NO: 9126083 - DNA, 22 bp, Homo sapiens
gtattttcaagagcagtagtat

SEQ ID NO: 9126084 - DNA, 22 bp, Homo sapiens
gtattttcatgatttcagacca

SEQ ID NO: 9126085 - DNA, 22 bp, Homo sapiens
gtaggtcagacataagaggaca

SEQ ID NO: 9126086 - DNA, 21 bp, Homo sapiens
gtctttaaaaaaggctgatac

SEQ ID NO: 9126087 - DNA, 22 bp, Homo sapiens
gtgaaaaatcatcatgacttga

SEQ ID NO: 9126088 - DNA, 22 bp, Homo sapiens
gtgaaaaatgatttgttaactg

SEQ ID NO: 9126089 - DNA, 21 bp, Homo sapiens
gggtggggttccagccttttc

SEQ ID NO: 9126090 - DNA, 18 bp, Homo sapiens
ggtgagggagctggaagc

SEQ ID NO: 9126091 - DNA, 22 bp, Homo sapiens
gcttaaatcccaatgctagacc

SEQ ID NO: 9126092 - DNA, 22 bp, Homo sapiens
gctttaatgcttcgtggggcca

SEQ ID NO: 9126093 - DNA, 22 bp, Homo sapiens
gctttaatgcttcgtggggcca

SEQ ID NO: 9126094 - DNA, 22 bp, Homo sapiens
gctttaatgaagtcacgcaaag

SEQ ID NO: 9126095 - DNA, 22 bp, Homo sapiens
gctttaatgaagtcacgcaaag

SEQ ID NO: 9126096 - DNA, 22 bp, Homo sapiens
gctttaatgcaatttcacctca

SEQ ID NO: 9126097 - DNA, 22 bp, Homo sapiens
gctttaatgcaatttcacctca

SEQ ID NO: 9126098 - DNA, 17 bp, Homo sapiens
ggactttaggttcttcc

SEQ ID NO: 9126099 - DNA, 22 bp, Homo sapiens
ggactttaattctttcctaagc

SEQ ID NO: 9126100 - DNA, 22 bp, Homo sapiens
ggactttaaaaagatgaccttt

SEQ ID NO: 9126101 - DNA, 22 bp, Homo sapiens
ggactttagcagctggagagga

SEQ ID NO: 9126102 - DNA, 22 bp, Homo sapiens
ggactttaggtgagaaggcatt

SEQ ID NO: 9126103 - DNA, 22 bp, Homo sapiens
ggactttagctgtaatgtgtgt

SEQ ID NO: 9126104 - DNA, 22 bp, Homo sapiens
ggactttaggaagggccaagtg

SEQ ID NO: 9126105 - DNA, 22 bp, Homo sapiens
ggacagggctcttggcactcct

SEQ ID NO: 9126106 - DNA, 22 bp, Homo sapiens
ggacagagggttgacagagtat

SEQ ID NO: 9126107 - DNA, 22 bp, Homo sapiens
ggaaaaatagagtatactttaa

SEQ ID NO: 9126108 - DNA, 22 bp, Homo sapiens
ggaaaaatgacacatatctcaa

SEQ ID NO: 9126109 - DNA, 18 bp, Homo sapiens
ggagaagaacagatgtgg

SEQ ID NO: 9126110 - DNA, 22 bp, Homo sapiens
ggagaagaggagctggaagcct

SEQ ID NO: 9126111 - DNA, 22 bp, Homo sapiens
gctaggaagctggggagaagtc

SEQ ID NO: 9126112 - DNA, 22 bp, Homo sapiens
gctctgtgtatgtggcaggtgc

SEQ ID NO: 9126113 - DNA, 22 bp, Homo sapiens
gctctgtggcattcatgggcag

SEQ ID NO: 9126114 - DNA, 22 bp, Homo sapiens
gcacagaataacactctgggct

SEQ ID NO: 9126115 - DNA, 22 bp, Homo sapiens
gcacagaaccagacatgaggca

SEQ ID NO: 9126116 - DNA, 22 bp, Homo sapiens
gcccgcagagatctttaacaaa

SEQ ID NO: 9126117 - DNA, 22 bp, Homo sapiens
gcccacagaggcaccaccaggc

SEQ ID NO: 9126118 - DNA, 22 bp, Homo sapiens
gcctccctggcccacagcagcg

SEQ ID NO: 9126119 - DNA, 22 bp, Homo sapiens
ttttctgtttgcttcaagacat

SEQ ID NO: 9126120 - DNA, 22 bp, Homo sapiens
ttttctgtgtatccaggcttcc

SEQ ID NO: 9126121 - DNA, 22 bp, Homo sapiens
ttttattagtggctagatgggg

SEQ ID NO: 9126122 - DNA, 22 bp, Homo sapiens
ttttaattcaaagtgaatagtg

SEQ ID NO: 9126123 - DNA, 18 bp, Homo sapiens
ttttaatttcaggggtgg

SEQ ID NO: 9126124 - DNA, 22 bp, Homo sapiens
ttttaattgcaattatggtccc

SEQ ID NO: 9126125 - DNA, 22 bp, Homo sapiens
ttttaacactcagcactatctc

SEQ ID NO: 9126126 - DNA, 22 bp, Homo sapiens
tttgtgtcgtcactgtcttctc

SEQ ID NO: 9126127 - DNA, 22 bp, Homo sapiens
tttggtctggaatcttcagggt

SEQ ID NO: 9126128 - DNA, 22 bp, Homo sapiens
tttgagtctgcttccattttca

SEQ ID NO: 9126129 - DNA, 22 bp, Homo sapiens
ttctgtgtgtctcagcaagctg

SEQ ID NO: 9126130 - DNA, 22 bp, Homo sapiens
ttctggagattgagaaggcatt

SEQ ID NO: 9126131 - DNA, 22 bp, Homo sapiens
ttctggagaggaacagaaaggt

SEQ ID NO: 9126132 - DNA, 22 bp, Homo sapiens
ttctggagccccaagatctgta

SEQ ID NO: 9126133 - DNA, 22 bp, Homo sapiens
ttctggagacccagcaacaggg

SEQ ID NO: 9126134 - DNA, 22 bp, Homo sapiens
ttctggaattcttgcagccact

SEQ ID NO: 9126135 - DNA, 22 bp, Homo sapiens
ttctggaatactaagttccttt

SEQ ID NO: 9126136 - DNA, 22 bp, Homo sapiens
ttctggaagtggaatttttgta

SEQ ID NO: 9126137 - DNA, 23 bp, Homo sapiens
ttctttgtggataatctccagtg

SEQ ID NO: 9126138 - DNA, 22 bp, Homo sapiens
ttattgaaggaactgaaataaa

SEQ ID NO: 9126139 - DNA, 22 bp, Homo sapiens
ttattaggaactcaggattttt

SEQ ID NO: 9126140 - DNA, 22 bp, Homo sapiens
ttcattgtgaacacattctgcc

SEQ ID NO: 9126141 - DNA, 22 bp, Homo sapiens
ttgtgtctgggggagtgacatc

SEQ ID NO: 9126142 - DNA, 22 bp, Homo sapiens
ttggccatctaagcccagccac

SEQ ID NO: 9126143 - DNA, 22 bp, Homo sapiens
ttggacagaatttatcttcagt

SEQ ID NO: 9126144 - DNA, 23 bp, Homo sapiens
tttcaacaatgcttagagaaaac

SEQ ID NO: 9126145 - DNA, 22 bp, Homo sapiens
tttcaaaggtggaagagtgaat

SEQ ID NO: 9126146 - DNA, 22 bp, Homo sapiens
tttcaaaggttttgtcatgtct

SEQ ID NO: 9126147 - DNA, 23 bp, Homo sapiens
tttcaacaggcagagaagactta

SEQ ID NO: 9126148 - DNA, 23 bp, Homo sapiens
tttcacaatgagcattacagaat

SEQ ID NO: 9126149 - DNA, 22 bp, Homo sapiens
tttcagaaaacttatcatcagt

SEQ ID NO: 9126150 - DNA, 22 bp, Homo sapiens
tttcagaaagctgaacatatga

SEQ ID NO: 9126151 - DNA, 22 bp, Homo sapiens
tttcagaaacgattatgaacac

SEQ ID NO: 9126152 - DNA, 22 bp, Homo sapiens
tttcagaaagcatcatcaaagt

SEQ ID NO: 9126153 - DNA, 22 bp, Homo sapiens
tttcagaaatggcactgaaatc

SEQ ID NO: 9126154 - DNA, 22 bp, Homo sapiens
tttagataatgctcaagcaatt

SEQ ID NO: 9126155 - DNA, 22 bp, Homo sapiens
tttatattgtaaaaatggttct

SEQ ID NO: 9126156 - DNA, 22 bp, Homo sapiens
acagaggctgcgcttgggaacg

SEQ ID NO: 9126157 - DNA, 23 bp, Homo sapiens
acagaggcttaaatgagtggcag

SEQ ID NO: 9126158 - DNA, 22 bp, Homo sapiens
acagaggcctcggcctgcccag

SEQ ID NO: 9126159 - DNA, 22 bp, Homo sapiens
acagaggcctcgtaggtacaac

SEQ ID NO: 9126160 - DNA, 22 bp, Homo sapiens
acagaggccccgtgggagagcc

SEQ ID NO: 9126161 - DNA, 17 bp, Homo sapiens
acagaggcaggagtgga

SEQ ID NO: 9126162 - DNA, 19 bp, Homo sapiens
agcaggccacagggccagc

SEQ ID NO: 9126163 - DNA, 22 bp, Homo sapiens
acacccacctctttaggccatg

SEQ ID NO: 9126164 - DNA, 21 bp, Homo sapiens
acacccacttatgcccgcttg

SEQ ID NO: 9126165 - DNA, 22 bp, Homo sapiens
agaggaggtggtgatgctttaa

SEQ ID NO: 9126166 - DNA, 22 bp, Homo sapiens
agaggagtattttctaagggaa

SEQ ID NO: 9126167 - DNA, 22 bp, Homo sapiens
agaggatgattttaaggacact

SEQ ID NO: 9126168 - DNA, 22 bp, Homo sapiens
agaggaagtaatcaggacctgc

SEQ ID NO: 9126169 - DNA, 21 bp, Homo sapiens
agaggaagtgattggtctggc

SEQ ID NO: 9126170 - DNA, 21 bp, Homo sapiens
agaggaagtgattggtctggc

SEQ ID NO: 9126171 - DNA, 22 bp, Homo sapiens
agagctggaagctgctcttaga

SEQ ID NO: 9126172 - DNA, 22 bp, Homo sapiens
agagcaattagcttaggtaaaa

SEQ ID NO: 9126173 - DNA, 22 bp, Homo sapiens
agatgctctctattatgcagaa

SEQ ID NO: 9126174 - DNA, 22 bp, Homo sapiens
agatgctctcttgctggttcat

SEQ ID NO: 9126175 - DNA, 22 bp, Homo sapiens
agatgctcttgccaaagaagtc

SEQ ID NO: 9126176 - DNA, 20 bp, Homo sapiens
agatctttgggttgtcatat

SEQ ID NO: 9126177 - DNA, 22 bp, Homo sapiens
aataatacatgagattaatgtt

SEQ ID NO: 9126178 - DNA, 22 bp, Homo sapiens
aatagaatgtaatctaatacat

SEQ ID NO: 9126179 - DNA, 22 bp, Homo sapiens
actgaaaaagacatcttggtaa

SEQ ID NO: 9126180 - DNA, 22 bp, Homo sapiens
actgaaaatgaattagaaacag

SEQ ID NO: 9126181 - DNA, 22 bp, Homo sapiens
acttttaaatgagtttcagttg

SEQ ID NO: 9126182 - DNA, 22 bp, Homo sapiens
aaggccagagcgtgtcctgcct

SEQ ID NO: 9126183 - DNA, 22 bp, Homo sapiens
aaggccagattcactttacaat

SEQ ID NO: 9126184 - DNA, 21 bp, Homo sapiens
aagctgtgttccactgatagc

SEQ ID NO: 9126185 - DNA, 22 bp, Homo sapiens
aaggaagggaaatagtgatgtc

SEQ ID NO: 9126186 - DNA, 22 bp, Homo sapiens
aaggaaggaattgatcatgcgc

SEQ ID NO: 9126187 - DNA, 22 bp, Homo sapiens
aaggaaggttcatagtcaaaga

SEQ ID NO: 9126188 - DNA, 22 bp, Homo sapiens
aaggaaggtactcagtgattct

SEQ ID NO: 9126189 - DNA, 22 bp, Homo sapiens
aagtccctttaatcagtgcctt

SEQ ID NO: 9126190 - DNA, 22 bp, Homo sapiens
acaaatttgaatcctgacttct

SEQ ID NO: 9126191 - DNA, 22 bp, Homo sapiens
acacagccgtgaatctgcttct

SEQ ID NO: 9126192 - DNA, 22 bp, Homo sapiens
aagaatcattgtaaagttctgt

SEQ ID NO: 9126193 - DNA, 22 bp, Homo sapiens
aactttaaaaaatatgtctgtt

SEQ ID NO: 9126194 - DNA, 22 bp, Homo sapiens
aactttaaggctataaattatg

SEQ ID NO: 9126195 - DNA, 22 bp, Homo sapiens
aactttaaagaggaggcttggg

SEQ ID NO: 9126196 - DNA, 22 bp, Homo sapiens
aatgctttagcagtgattagtg

SEQ ID NO: 9126197 - DNA, 22 bp, Homo sapiens
aatgcagtgagccattaaatgg

SEQ ID NO: 9126198 - DNA, 22 bp, Homo sapiens
aatctgaatatttatgtgtatt

SEQ ID NO: 9126199 - DNA, 22 bp, Homo sapiens
aatatctgtctctaatgcatat

SEQ ID NO: 9126200 - DNA, 22 bp, Homo sapiens
aatatctgtggccatacaattt

SEQ ID NO: 9126201 - DNA, 22 bp, Homo sapiens
aagttacagtcagaggttaaca

SEQ ID NO: 9126202 - DNA, 22 bp, Homo sapiens
aaactgttgtggtttatcatta

SEQ ID NO: 9126203 - DNA, 22 bp, Homo sapiens
aaactgtgagctagtaaatagg

SEQ ID NO: 9126204 - DNA, 22 bp, Homo sapiens
aaatacacgtacatgtgtaaaa

SEQ ID NO: 9126205 - DNA, 22 bp, Homo sapiens
aaaaatgttatctactgtccga

SEQ ID NO: 9126206 - DNA, 22 bp, Homo sapiens
aaaagcagtaaatgtatgacct

SEQ ID NO: 9126207 - DNA, 18 bp, Homo sapiens
aaaatgcaggcgacatgg

SEQ ID NO: 9126208 - DNA, 22 bp, Homo sapiens
aaaatgatgctgtaatttggca

SEQ ID NO: 9126209 - DNA, 22 bp, Homo sapiens
aaagcagtccttcccttaaggt

SEQ ID NO: 9126210 - DNA, 22 bp, Homo sapiens
aaagcagtgcaccttaattgat

SEQ ID NO: 9126211 - DNA, 22 bp, Homo sapiens
aaagcagtctgttttaacctga

SEQ ID NO: 9126212 - DNA, 22 bp, Homo sapiens
aaagcagtctcagacttaagca

SEQ ID NO: 9126213 - DNA, 22 bp, Homo sapiens
aaaggaggccacatggctagga

SEQ ID NO: 9126214 - DNA, 22 bp, Homo sapiens
aaaggctcacgcagttagtgat

SEQ ID NO: 9126215 - DNA, 22 bp, Homo sapiens
aaaggctctaacaaggagagag

SEQ ID NO: 9126216 - DNA, 22 bp, Homo sapiens
aaagtctgaaagataagagtga

SEQ ID NO: 9126217 - DNA, 22 bp, Homo sapiens
aaagttgaccgaaagattttga

SEQ ID NO: 9126218 - DNA, 22 bp, Homo sapiens
aaagttgagttttatgtgttac

SEQ ID NO: 9126219 - DNA, 22 bp, Homo sapiens
aaatacatacactgtacgtggc

SEQ ID NO: 9126220 - DNA, 19 bp, Homo sapiens
aaatatcagagagatgata

SEQ ID NO: 9126221 - DNA, 22 bp, Homo sapiens
cagcactgtgataactgagcca

SEQ ID NO: 9126222 - DNA, 22 bp, Homo sapiens
cagagccaggcctgccctcttt

SEQ ID NO: 9126223 - DNA, 22 bp, Homo sapiens
cacaggaaatgattctgcagca

SEQ ID NO: 9126224 - DNA, 22 bp, Homo sapiens
caaggaaggagagatgatgggt

SEQ ID NO: 9126225 - DNA, 22 bp, Homo sapiens
caagggaaggctaagggcaaca

SEQ ID NO: 9126226 - DNA, 22 bp, Homo sapiens
attttgttatagaactctgtga

SEQ ID NO: 9126227 - DNA, 22 bp, Homo sapiens
agaggcctaaccaagatgtcct

SEQ ID NO: 9126228 - DNA, 22 bp, Homo sapiens
agaggccctggctagagcagct

SEQ ID NO: 9126229 - DNA, 22 bp, Homo sapiens
agaggccctgggctggtgtgct

SEQ ID NO: 9126230 - DNA, 22 bp, Homo sapiens
agaggccctctctgctcagtct

SEQ ID NO: 9126231 - DNA, 22 bp, Homo sapiens
atgccagtgttataaatagata

SEQ ID NO: 9126232 - DNA, 22 bp, Homo sapiens
atgattgaaaatgacattgcca

SEQ ID NO: 9126233 - DNA, 22 bp, Homo sapiens
atgacaatatagctttgatttt

SEQ ID NO: 9126234 - DNA, 22 bp, Homo sapiens
atggacagctggcctcaaggga

SEQ ID NO: 9126235 - DNA, 22 bp, Homo sapiens
aggggagcttgcctggtcaccc

SEQ ID NO: 9126236 - DNA, 22 bp, Homo sapiens
aggggagcaaggccgtggtgta

SEQ ID NO: 9126237 - DNA, 22 bp, Homo sapiens
aggggagcatctgtgatggtta

SEQ ID NO: 9126238 - DNA, 22 bp, Homo sapiens
aggggagccgaggggcatctgt

SEQ ID NO: 9126239 - DNA, 22 bp, Homo sapiens
aggggagcgacattccgtgccg

SEQ ID NO: 9126240 - DNA, 22 bp, Homo sapiens
accagagatggggcttctctgt

SEQ ID NO: 9126241 - DNA, 22 bp, Homo sapiens
accagagaatgtgcatctctaa

SEQ ID NO: 9126242 - DNA, 22 bp, Homo sapiens
aggctcaggtctcaggtctggc

SEQ ID NO: 9126243 - DNA, 20 bp, Homo sapiens
aggctcagggtgtttaggaa

SEQ ID NO: 9126244 - DNA, 22 bp, Homo sapiens
aggctcagggactccctccctc

SEQ ID NO: 9126245 - DNA, 22 bp, Homo sapiens
aggctcagggacggggcccctt

SEQ ID NO: 9126246 - DNA, 22 bp, Homo sapiens
aggctcaggaggagctgccgga

SEQ ID NO: 9126247 - DNA, 22 bp, Homo sapiens
aggctcaggcaggaatggcgga

SEQ ID NO: 9126248 - DNA, 22 bp, Homo sapiens
aggctcagacaggaaaagtaac

SEQ ID NO: 9126249 - DNA, 20 bp, Homo sapiens
aggctcagctgagctcttgg

SEQ ID NO: 9126250 - DNA, 22 bp, Homo sapiens
aggctcagctggtggtgatcgc

SEQ ID NO: 9126251 - DNA, 22 bp, Homo sapiens
acagccagaggagccaggctgg

SEQ ID NO: 9126252 - DNA, 22 bp, Homo sapiens
aggacttagaacattatgtact

SEQ ID NO: 9126253 - DNA, 22 bp, Homo sapiens
agtgtctggtgagggctctctc

SEQ ID NO: 9126254 - DNA, 22 bp, Homo sapiens
agtgtctgtgatgaggtcagga

SEQ ID NO: 9126255 - DNA, 18 bp, Homo sapiens
atcaaggaggggaaggtc

SEQ ID NO: 9126256 - DNA, 22 bp, Homo sapiens
atatagaaggtgctatttacat

SEQ ID NO: 9126257 - DNA, 22 bp, Homo sapiens
agaaaaatcttggcgcttgtct

SEQ ID NO: 9126258 - DNA, 22 bp, Homo sapiens
actttacaggcacttcaagtat

SEQ ID NO: 9126259 - DNA, 22 bp, Homo sapiens
atagaatagcatagaaaattga

SEQ ID NO: 9126260 - DNA, 19 bp, Homo sapiens
ataaataaaaagtgggaga

SEQ ID NO: 9126261 - DNA, 22 bp, Homo sapiens
agttgacaataaatttaattgg

SEQ ID NO: 9126262 - DNA, 22 bp, Homo sapiens
agttgacacgcagaggggctgc

SEQ ID NO: 9126263 - DNA, 22 bp, Homo sapiens
agttgacagaggtatgaggttt

SEQ ID NO: 9126264 - DNA, 22 bp, Homo sapiens
agttgacatccagagacattct

SEQ ID NO: 9126265 - DNA, 22 bp, Homo sapiens
agttgacatccataacaggaag

SEQ ID NO: 9126266 - DNA, 22 bp, Homo sapiens
atttctgataaacgtaagctgc

SEQ ID NO: 9126267 - DNA, 22 bp, Homo sapiens
atttctgatacccggtcaccct

SEQ ID NO: 9126268 - DNA, 17 bp, Homo sapiens
gcccacccttaggagct

SEQ ID NO: 9126269 - DNA, 23 bp, Homo sapiens
gcccaccctcagcgtcctcacgg

SEQ ID NO: 9126270 - DNA, 21 bp, Homo sapiens
gcccacagtgaggaggatccc

SEQ ID NO: 9126271 - DNA, 22 bp, Homo sapiens
caaagctgacgaggtcagcatc

SEQ ID NO: 9126272 - DNA, 22 bp, Homo sapiens
caaaatgttctggcacctttaa

SEQ ID NO: 9126273 - DNA, 22 bp, Homo sapiens
caaaatgtgagtcccacctcaa

SEQ ID NO: 9126274 - DNA, 22 bp, Homo sapiens
caaagcagtgatccttaaagga

SEQ ID NO: 9126275 - DNA, 22 bp, Homo sapiens
caaagcagtattggattcttta

SEQ ID NO: 9126276 - DNA, 22 bp, Homo sapiens
caaagcaggcttgtcaaattgc

SEQ ID NO: 9126277 - DNA, 22 bp, Homo sapiens
caaagcagagccagagcttgtc

SEQ ID NO: 9126278 - DNA, 22 bp, Homo sapiens
attcttgtaaattttgtgtgaa

SEQ ID NO: 9126279 - DNA, 22 bp, Homo sapiens
attgtcattggcttctatgtct

SEQ ID NO: 9126280 - DNA, 22 bp, Homo sapiens
attgtcattccagtcattgtta

SEQ ID NO: 9126281 - DNA, 22 bp, Homo sapiens
attgtcgtcaatggacacatag

SEQ ID NO: 9126282 - DNA, 21 bp, Homo sapiens
attcagaaagggaataaactc

SEQ ID NO: 9126283 - DNA, 22 bp, Homo sapiens
gcagatgcttggcactgacagt

SEQ ID NO: 9126284 - DNA, 22 bp, Homo sapiens
gcagatgctgctcctctctaga

SEQ ID NO: 9126285 - DNA, 23 bp, Homo sapiens
gcagatgcttagcaggtcctctc

SEQ ID NO: 9126286 - DNA, 22 bp, Homo sapiens
gcagatgctgtgtgaatgttgg

SEQ ID NO: 9126287 - DNA, 22 bp, Homo sapiens
gcagatgctgtggtgatagaag

SEQ ID NO: 9126288 - DNA, 22 bp, Homo sapiens
attacagtgggtaaacagaatt

SEQ ID NO: 9126289 - DNA, 22 bp, Homo sapiens
gatttctagtaagtcatgaagg

SEQ ID NO: 9126290 - DNA, 22 bp, Homo sapiens
attagtagagggagaagcttgg

SEQ ID NO: 9126291 - DNA, 22 bp, Homo sapiens
attagtagtagttagcagcctc

SEQ ID NO: 9126292 - DNA, 22 bp, Homo sapiens
attagtagctgtaataactggg

SEQ ID NO: 9126293 - DNA, 19 bp, Homo sapiens
attagtagctagtgcctgg

SEQ ID NO: 9126294 - DNA, 22 bp, Homo sapiens
attagtagcacacagagatcag

SEQ ID NO: 9126295 - DNA, 22 bp, Homo sapiens
attagatatttgctgttggatt

SEQ ID NO: 9126296 - DNA, 22 bp, Homo sapiens
atgggagaaacatcatgaggca

SEQ ID NO: 9126297 - DNA, 22 bp, Homo sapiens
atggggagagaagggctgagct

SEQ ID NO: 9126298 - DNA, 22 bp, Homo sapiens
gagagaggcctccatgtactga

SEQ ID NO: 9126299 - DNA, 22 bp, Homo sapiens
atgttgactcagagtgagggta

SEQ ID NO: 9126300 - DNA, 20 bp, Homo sapiens
atgtctgaagtaatccattt

SEQ ID NO: 9126301 - DNA, 22 bp, Homo sapiens
atgtctgataaataatgcataa

SEQ ID NO: 9126302 - DNA, 22 bp, Homo sapiens
atgtgagggaaatcagtcagaa

SEQ ID NO: 9126303 - DNA, 22 bp, Homo sapiens
atgacatgacctggtagagaca

SEQ ID NO: 9126304 - DNA, 22 bp, Homo sapiens
gaaaatgttagcttcatagtca

SEQ ID NO: 9126305 - DNA, 22 bp, Homo sapiens
atgatgaaattttctatcatgt

SEQ ID NO: 9126306 - DNA, 22 bp, Homo sapiens
gaccttgtgatctgcctgcctt

SEQ ID NO: 9126307 - DNA, 22 bp, Homo sapiens
gaataatattgactttgcaggc

SEQ ID NO: 9126308 - DNA, 19 bp, Homo sapiens
gaacaaacttaaacttttc

SEQ ID NO: 9126309 - DNA, 22 bp, Homo sapiens
gaacaaagacatggaggaggat

SEQ ID NO: 9126310 - DNA, 22 bp, Homo sapiens
gaaggctggggccttctcatct

SEQ ID NO: 9126311 - DNA, 22 bp, Homo sapiens
gtcatcatttttagcatatggg

SEQ ID NO: 9126312 - DNA, 22 bp, Homo sapiens
cagcaggctgcgattgctcatt

SEQ ID NO: 9126313 - DNA, 22 bp, Homo sapiens
cagcaggaaggtttcccctgca

SEQ ID NO: 9126314 - DNA, 22 bp, Homo sapiens
cagcaggaaagacatctgagca

SEQ ID NO: 9126315 - DNA, 22 bp, Homo sapiens
cagctaccatggtttgttccag

SEQ ID NO: 9126316 - DNA, 22 bp, Homo sapiens
ggtctgaggctccaaggaggtg

SEQ ID NO: 9126317 - DNA, 22 bp, Homo sapiens
ggtctgagtagagggctggcga

SEQ ID NO: 9126318 - DNA, 22 bp, Homo sapiens
ggtctgagatatttgttcagct

SEQ ID NO: 9126319 - DNA, 22 bp, Homo sapiens
ggtctgagtgccagggagagaa

SEQ ID NO: 9126320 - DNA, 22 bp, Homo sapiens
cagagggctgccctgagttcgt

SEQ ID NO: 9126321 - DNA, 22 bp, Homo sapiens
cacaggaatataagtttgagtt

SEQ ID NO: 9126322 - DNA, 21 bp, Homo sapiens
cacacagctgcccttaggtag

SEQ ID NO: 9126323 - DNA, 22 bp, Homo sapiens
cacacagctcaggggcactgcc

SEQ ID NO: 9126324 - DNA, 22 bp, Homo sapiens
cacagaggaaaggcagttggta

SEQ ID NO: 9126325 - DNA, 22 bp, Homo sapiens
cacagaggatttttagggcagt

SEQ ID NO: 9126326 - DNA, 22 bp, Homo sapiens
cacagaggatgcccaagcgatc

SEQ ID NO: 9126327 - DNA, 21 bp, Homo sapiens
cactttaatggatatttgttt

SEQ ID NO: 9126328 - DNA, 22 bp, Homo sapiens
cactttaactcacatttcagct

SEQ ID NO: 9126329 - DNA, 18 bp, Homo sapiens
ggctccagtcttcagtgg

SEQ ID NO: 9126330 - DNA, 23 bp, Homo sapiens
ctgtggccctgcttcatgcagcc

SEQ ID NO: 9126331 - DNA, 23 bp, Homo sapiens
atctgaaaagcatttgcagtttg

SEQ ID NO: 9126332 - DNA, 22 bp, Homo sapiens
atctgaaaagctttaatgagct

SEQ ID NO: 9126333 - DNA, 22 bp, Homo sapiens
atctgaagggaagtggaaggca

SEQ ID NO: 9126334 - DNA, 21 bp, Homo sapiens
atctgaagtttgagaggaaag

SEQ ID NO: 9126335 - DNA, 22 bp, Homo sapiens
atctgaagaatgaatggaatta

SEQ ID NO: 9126336 - DNA, 22 bp, Homo sapiens
atcaaatacaaagggcataagg

SEQ ID NO: 9126337 - DNA, 22 bp, Homo sapiens
atagacttgaggatataatgaa

SEQ ID NO: 9126338 - DNA, 22 bp, Homo sapiens
atagacttggttagtaaatttg

SEQ ID NO: 9126339 - DNA, 22 bp, Homo sapiens
ctggctccatcactgggtgatg

SEQ ID NO: 9126340 - DNA, 22 bp, Homo sapiens
ctggctccatcctaggcaaatg

SEQ ID NO: 9126341 - DNA, 22 bp, Homo sapiens
ctccagctagggctggcttact

SEQ ID NO: 9126342 - DNA, 22 bp, Homo sapiens
ctctggggtggaggaggctgac

SEQ ID NO: 9126343 - DNA, 22 bp, Homo sapiens
ctgaggagaccatcaactaatt

SEQ ID NO: 9126344 - DNA, 22 bp, Homo sapiens
agtgtctgcctgggaggagcat

SEQ ID NO: 9126345 - DNA, 22 bp, Homo sapiens
agtgtctgcgggcagaggagcg

SEQ ID NO: 9126346 - DNA, 22 bp, Homo sapiens
agtgtctgctcagacagctaca

SEQ ID NO: 9126347 - DNA, 22 bp, Homo sapiens
agtgtctgctttgagtcaggtg

SEQ ID NO: 9126348 - DNA, 22 bp, Homo sapiens
aggtggggaggagtgtctcttt

SEQ ID NO: 9126349 - DNA, 22 bp, Homo sapiens
aggtggggcccaccaatttgca

SEQ ID NO: 9126350 - DNA, 22 bp, Homo sapiens
aggtggggccaaatgctacagt

SEQ ID NO: 9126351 - DNA, 22 bp, Homo sapiens
aggtccagttttctgacaaggg

SEQ ID NO: 9126352 - DNA, 21 bp, Homo sapiens
ctaagcaaggagcaggggtag

SEQ ID NO: 9126353 - DNA, 22 bp, Homo sapiens
ctaagcaagaatgagtgcaaca

SEQ ID NO: 9126354 - DNA, 22 bp, Homo sapiens
cggctcagctagcttggcccca

SEQ ID NO: 9126355 - DNA, 22 bp, Homo sapiens
agggactccctgggccgacacg

SEQ ID NO: 9126356 - DNA, 22 bp, Homo sapiens
agggggctgccaaggaatgtaa

SEQ ID NO: 9126357 - DNA, 22 bp, Homo sapiens
agggggctcctccggtgcttcc

SEQ ID NO: 9126358 - DNA, 22 bp, Homo sapiens
cctgagtctgtgttttcctaag

SEQ ID NO: 9126359 - DNA, 22 bp, Homo sapiens
aggggtcttgggagtcctggct

SEQ ID NO: 9126360 - DNA, 22 bp, Homo sapiens
cctcaggtgtgggccagctgtc

SEQ ID NO: 9126361 - DNA, 22 bp, Homo sapiens
ccagtgtatttttgggacctgc

SEQ ID NO: 9126362 - DNA, 22 bp, Homo sapiens
cccactccctacgacacgctcc

SEQ ID NO: 9126363 - DNA, 22 bp, Homo sapiens
aggctcagattcacatttggtt

SEQ ID NO: 9126364 - DNA, 22 bp, Homo sapiens
aggctcagatccttgtgtcctg

SEQ ID NO: 9126365 - DNA, 22 bp, Homo sapiens
aggctcagcctgggcctagagc

SEQ ID NO: 9126366 - DNA, 22 bp, Homo sapiens
aggctcagcccctgggaggaga

SEQ ID NO: 9126367 - DNA, 22 bp, Homo sapiens
aggctcagcccaaggtggagag

SEQ ID NO: 9126368 - DNA, 22 bp, Homo sapiens
aggctcagcccaaggtggagag

SEQ ID NO: 9126369 - DNA, 21 bp, Homo sapiens
aggctcagcaggtgtataaag

SEQ ID NO: 9126370 - DNA, 22 bp, Homo sapiens
aggctcagcatctgattcatat

SEQ ID NO: 9126371 - DNA, 20 bp, Homo sapiens
aggctcagatacccagggaa

SEQ ID NO: 9126372 - DNA, 20 bp, Homo sapiens
aggctcagagcagtagtaca

SEQ ID NO: 9126373 - DNA, 22 bp, Homo sapiens
aggctcagaggtgagcatctgc

SEQ ID NO: 9126374 - DNA, 16 bp, Homo sapiens
aggctcagaggctgga

SEQ ID NO: 9126375 - DNA, 21 bp, Homo sapiens
aggctcagagatcaaacagta

SEQ ID NO: 9126376 - DNA, 22 bp, Homo sapiens
aggctcagagatgagtaagcac

SEQ ID NO: 9126377 - DNA, 21 bp, Homo sapiens
aggctcagagagaaactcttg

SEQ ID NO: 9126378 - DNA, 22 bp, Homo sapiens
aggctcagagagctgtgtccat

SEQ ID NO: 9126379 - DNA, 22 bp, Homo sapiens
ccaggaggggtctctgtctccc

SEQ ID NO: 9126380 - DNA, 22 bp, Homo sapiens
ccaggagggtggttactcaatc

SEQ ID NO: 9126381 - DNA, 22 bp, Homo sapiens
ccaggaggtctgagtgtggaca

SEQ ID NO: 9126382 - DNA, 22 bp, Homo sapiens
ccaggaggtgaaacttcaccag

SEQ ID NO: 9126383 - DNA, 22 bp, Homo sapiens
ccaggaggatcatcctgttttc

SEQ ID NO: 9126384 - DNA, 22 bp, Homo sapiens
ccaggaggatgaggggcataga

SEQ ID NO: 9126385 - DNA, 22 bp, Homo sapiens
ccaggagggaggagttcctgag

SEQ ID NO: 9126386 - DNA, 22 bp, Homo sapiens
ccaggaggtggcaggacttgcc

SEQ ID NO: 9126387 - DNA, 22 bp, Homo sapiens
ccaggaggtgctggaagaaagc

SEQ ID NO: 9126388 - DNA, 22 bp, Homo sapiens
ccaggaggtggagattgcagtg

SEQ ID NO: 9126389 - DNA, 22 bp, Homo sapiens
ccaggaggtggaggttgcggtg

SEQ ID NO: 9126390 - DNA, 22 bp, Homo sapiens
caggagaaggtttggagtgcag

SEQ ID NO: 9126391 - DNA, 22 bp, Homo sapiens
caggacgggcaaacaggatggt

SEQ ID NO: 9126392 - DNA, 22 bp, Homo sapiens
aggaagagcccgggtgacataa

SEQ ID NO: 9126393 - DNA, 22 bp, Homo sapiens
aggaagagctggaccagaggac

SEQ ID NO: 9126394 - DNA, 22 bp, Homo sapiens
aggaggcctacgcacatgtcta

SEQ ID NO: 9126395 - DNA, 23 bp, Homo sapiens
aggaggcctgaaactgaggctga

SEQ ID NO: 9126396 - DNA, 22 bp, Homo sapiens
aggaggccgctgatgggctccc

SEQ ID NO: 9126397 - DNA, 22 bp, Homo sapiens
cagtgtggctgagacagaggct

SEQ ID NO: 9126398 - DNA, 20 bp, Homo sapiens
ccacccacgcgggctctgcc

SEQ ID NO: 9126399 - DNA, 22 bp, Homo sapiens
ccacccacaaccagctggctgt

SEQ ID NO: 9126400 - DNA, 20 bp, Homo sapiens
cattggacttggcttcatgg

SEQ ID NO: 9126401 - DNA, 22 bp, Homo sapiens
cattgtcacccaaagctcatag

SEQ ID NO: 9126402 - DNA, 22 bp, Homo sapiens
cattgtcattctatgctattca

SEQ ID NO: 9126403 - DNA, 22 bp, Homo sapiens
tcccaccccttgactctttaag

SEQ ID NO: 9126404 - DNA, 22 bp, Homo sapiens
tcccaccccggtcaagggctga

SEQ ID NO: 9126405 - DNA, 22 bp, Homo sapiens
tcccaccccctccaaggaggaa

SEQ ID NO: 9126406 - DNA, 22 bp, Homo sapiens
tcccacccatcctgcatctctt

SEQ ID NO: 9126407 - DNA, 23 bp, Homo sapiens
tcctttaatgctggaatggctag

SEQ ID NO: 9126408 - DNA, 23 bp, Homo sapiens
tcctttaagatatcttattcctt

SEQ ID NO: 9126409 - DNA, 22 bp, Homo sapiens
tcctttaacttgattattttca

SEQ ID NO: 9126410 - DNA, 22 bp, Homo sapiens
tcctttaaactcctttcaagtc

SEQ ID NO: 9126411 - DNA, 22 bp, Homo sapiens
tcctttaaacaaccagctctca

SEQ ID NO: 9126412 - DNA, 22 bp, Homo sapiens
tcctttaaagaactgtgctttt

SEQ ID NO: 9126413 - DNA, 22 bp, Homo sapiens
tcctttaactagttaccatgtt

SEQ ID NO: 9126414 - DNA, 22 bp, Homo sapiens
ccagagaaggtggagcttgtgt

SEQ ID NO: 9126415 - DNA, 22 bp, Homo sapiens
ccagagaagaaaagcacctttt

SEQ ID NO: 9126416 - DNA, 22 bp, Homo sapiens
ccagagaaccttgagctgtgag

SEQ ID NO: 9126417 - DNA, 22 bp, Homo sapiens
tcagcagtcctccaggatcaag

SEQ ID NO: 9126418 - DNA, 22 bp, Homo sapiens
cataatcagatgtgtacataag

SEQ ID NO: 9126419 - DNA, 22 bp, Homo sapiens
catagaatcatagcacatttga

SEQ ID NO: 9126420 - DNA, 22 bp, Homo sapiens
catagaatgcagcaggaaagtt

SEQ ID NO: 9126421 - DNA, 22 bp, Homo sapiens
catagaatggattgacaagatt

SEQ ID NO: 9126422 - DNA, 22 bp, Homo sapiens
taggctttccttgttgccatgt

SEQ ID NO: 9126423 - DNA, 22 bp, Homo sapiens
caggtaggggagagctccaaca

SEQ ID NO: 9126424 - DNA, 22 bp, Homo sapiens
caggtagggatatgatggtgat

SEQ ID NO: 9126425 - DNA, 22 bp, Homo sapiens
caggtaggtatggtgcagtctt

SEQ ID NO: 9126426 - DNA, 22 bp, Homo sapiens
caggtcaaaggttagttatgtt

SEQ ID NO: 9126427 - DNA, 22 bp, Homo sapiens
tattttcaccatgtatccctgt

SEQ ID NO: 9126428 - DNA, 22 bp, Homo sapiens
caggccagtgtgcttcccaggc

SEQ ID NO: 9126429 - DNA, 22 bp, Homo sapiens
tagattcagatatttaggacaa

SEQ ID NO: 9126430 - DNA, 22 bp, Homo sapiens
tagaaaatggccaagcaggact

SEQ ID NO: 9126431 - DNA, 22 bp, Homo sapiens
tactttaaagaggtgtaatgag

SEQ ID NO: 9126432 - DNA, 22 bp, Homo sapiens
tactttaatatatgtgaagttc

SEQ ID NO: 9126433 - DNA, 22 bp, Homo sapiens
tactttaaaaactgataattca

SEQ ID NO: 9126434 - DNA, 18 bp, Homo sapiens
tactgtggatcaggggtt

SEQ ID NO: 9126435 - DNA, 22 bp, Homo sapiens
tactgtgggatgttgtgattag

SEQ ID NO: 9126436 - DNA, 22 bp, Homo sapiens
tgggaaggacgtgtcagtggca

SEQ ID NO: 9126437 - DNA, 22 bp, Homo sapiens
cctgagccgagcgctctttctc

SEQ ID NO: 9126438 - DNA, 22 bp, Homo sapiens
tgccagttgggaaaacagacat

SEQ ID NO: 9126439 - DNA, 22 bp, Homo sapiens
ccccaccctcgctccatttcgg

SEQ ID NO: 9126440 - DNA, 22 bp, Homo sapiens
ccccacccacctaagagaaact

SEQ ID NO: 9126441 - DNA, 22 bp, Homo sapiens
cccagttgttgccggctctgga

SEQ ID NO: 9126442 - DNA, 22 bp, Homo sapiens
tggaatggggactttgggacat

SEQ ID NO: 9126443 - DNA, 22 bp, Homo sapiens
tcttcccccgtgctccagtgca

SEQ ID NO: 9126444 - DNA, 22 bp, Homo sapiens
ccaggaggttgaggctgcagtg

SEQ ID NO: 9126445 - DNA, 22 bp, Homo sapiens
ccaggagggaccgcggcatccc

SEQ ID NO: 9126446 - DNA, 22 bp, Homo sapiens
ccagagagagaggtcaatggca

SEQ ID NO: 9126447 - DNA, 22 bp, Homo sapiens
tctggaaagatcattaaatcca

SEQ ID NO: 9126448 - DNA, 22 bp, Homo sapiens
ccagctgctgtgcagggaggct

SEQ ID NO: 9126449 - DNA, 22 bp, Homo sapiens
ccagctgcccaagaggcatcct

SEQ ID NO: 9126450 - DNA, 22 bp, Homo sapiens
tgcaaatagcctgatgaaagaa

SEQ ID NO: 9126451 - DNA, 22 bp, Homo sapiens
tgagggctaaattgtggcaggt

SEQ ID NO: 9126452 - DNA, 20 bp, Homo sapiens
ccagtccctgagcaccaggg

SEQ ID NO: 9126453 - DNA, 22 bp, Homo sapiens
tttaggttttttcacgtggcta

SEQ ID NO: 9126454 - DNA, 22 bp, Homo sapiens
tttagtagaaatatttgggcct

SEQ ID NO: 9126455 - DNA, 22 bp, Homo sapiens
tttagtaggcactaggagggga

SEQ ID NO: 9126456 - DNA, 22 bp, Homo sapiens
tttagtagtgacagattctggg

SEQ ID NO: 9126457 - DNA, 22 bp, Homo sapiens
tttagtagaatgatacagggca

SEQ ID NO: 9126458 - DNA, 22 bp, Homo sapiens
tttagtagaatagtatatcaaa

SEQ ID NO: 9126459 - DNA, 22 bp, Homo sapiens
tttagtagctacagttagaagg

SEQ ID NO: 9126460 - DNA, 22 bp, Homo sapiens
tttagtagatgcagcattattt

SEQ ID NO: 9126461 - DNA, 22 bp, Homo sapiens
tttagtaggaaattgtcttata

SEQ ID NO: 9126462 - DNA, 22 bp, Homo sapiens
ctcccgtgatcctggaggagag

SEQ ID NO: 9126463 - DNA, 22 bp, Homo sapiens
ctctccaggctgggacaggacc

SEQ ID NO: 9126464 - DNA, 22 bp, Homo sapiens
ctctccaggggtagatgccttc

SEQ ID NO: 9126465 - DNA, 22 bp, Homo sapiens
ctctccagtcatattctcagtc

SEQ ID NO: 9126466 - DNA, 22 bp, Homo sapiens
ctccagattccgtttattcagg

SEQ ID NO: 9126467 - DNA, 22 bp, Homo sapiens
ctcccagccttcgccagtctga

SEQ ID NO: 9126468 - DNA, 22 bp, Homo sapiens
ctccagtgcgcaggacagcccc

SEQ ID NO: 9126469 - DNA, 20 bp, Homo sapiens
ctgagccaactctcttcttg

SEQ ID NO: 9126470 - DNA, 22 bp, Homo sapiens
ctgagccataagggaggctggg

SEQ ID NO: 9126471 - DNA, 22 bp, Homo sapiens
ctgagccatgagcctgcgccca

SEQ ID NO: 9126472 - DNA, 22 bp, Homo sapiens
ctgagccatgggtctaagcact

SEQ ID NO: 9126473 - DNA, 22 bp, Homo sapiens
ctgagccaaccacagcaggagc

SEQ ID NO: 9126474 - DNA, 22 bp, Homo sapiens
ctgaggccagctgcagagctct

SEQ ID NO: 9126475 - DNA, 22 bp, Homo sapiens
cctgggagtggcactcacagca

SEQ ID NO: 9126476 - DNA, 22 bp, Homo sapiens
ctacttgttcactgtaggtcgc

SEQ ID NO: 9126477 - DNA, 22 bp, Homo sapiens
ctacccttaagtttctgtgggg

SEQ ID NO: 9126478 - DNA, 22 bp, Homo sapiens
ctcaaggaaagtctggagaaga

SEQ ID NO: 9126479 - DNA, 20 bp, Homo sapiens
cgcccagtgcggttctgacc

SEQ ID NO: 9126480 - DNA, 22 bp, Homo sapiens
ttcagggacttagtgtcagttt

SEQ ID NO: 9126481 - DNA, 22 bp, Homo sapiens
ttcagggactttgatgtatcag

SEQ ID NO: 9126482 - DNA, 22 bp, Homo sapiens
ttcatgaatatattgaattagc

SEQ ID NO: 9126483 - DNA, 22 bp, Homo sapiens
ttcatgaaattctcgtgtacct

SEQ ID NO: 9126484 - DNA, 22 bp, Homo sapiens
ttcatgaatgttccatgtgagt

SEQ ID NO: 9126485 - DNA, 22 bp, Homo sapiens
ctaaataatccctctggtctta

SEQ ID NO: 9126486 - DNA, 22 bp, Homo sapiens
cggtctcccgtgtgtgtgcgct

SEQ ID NO: 9126487 - DNA, 22 bp, Homo sapiens
ttcatgaaacttaactgttggg

SEQ ID NO: 9126488 - DNA, 22 bp, Homo sapiens
gaagatgggaatgatgagtggg

SEQ ID NO: 9126489 - DNA, 22 bp, Homo sapiens
gacaggccaggggctgaggtgg

SEQ ID NO: 9126490 - DNA, 22 bp, Homo sapiens
gaatatcccgctatgcaaagta

SEQ ID NO: 9126491 - DNA, 22 bp, Homo sapiens
gaatacatggcagggagtcatc

SEQ ID NO: 9126492 - DNA, 22 bp, Homo sapiens
gaggccaggacatgaaagctga

SEQ ID NO: 9126493 - DNA, 22 bp, Homo sapiens
gaggcacatcacttggtgcatt

SEQ ID NO: 9126494 - DNA, 22 bp, Homo sapiens
gaggcaagagaagccagctttc

SEQ ID NO: 9126495 - DNA, 22 bp, Homo sapiens
gaggcaaggccgcacgtctcag

SEQ ID NO: 9126496 - DNA, 22 bp, Homo sapiens
gagatgcttttggtccaagagt

SEQ ID NO: 9126497 - DNA, 21 bp, Homo sapiens
gagatgctttttattcaaccc

SEQ ID NO: 9126498 - DNA, 22 bp, Homo sapiens
gagatgctttgtgtatagacaa

SEQ ID NO: 9126499 - DNA, 22 bp, Homo sapiens
gagccagactgcctgaagctca

SEQ ID NO: 9126500 - DNA, 22 bp, Homo sapiens
gagccagaaaagctgcctgact

SEQ ID NO: 9126501 - DNA, 22 bp, Homo sapiens
gagaggcatggaacagattctt

SEQ ID NO: 9126502 - DNA, 19 bp, Homo sapiens
gagaggcctgtgcttgaag

SEQ ID NO: 9126503 - DNA, 22 bp, Homo sapiens
gagaggccctgaagcccacaga

SEQ ID NO: 9126504 - DNA, 22 bp, Homo sapiens
gagaggccctgtggtcccagct

SEQ ID NO: 9126505 - DNA, 22 bp, Homo sapiens
gagaggctgtgtgccattgttg

SEQ ID NO: 9126506 - DNA, 22 bp, Homo sapiens
gagatgctgtcaggctatctgt

SEQ ID NO: 9126507 - DNA, 22 bp, Homo sapiens
gagatgcttgtctgtcttatca

SEQ ID NO: 9126508 - DNA, 22 bp, Homo sapiens
gagatgctttatctcctttgtc

SEQ ID NO: 9126509 - DNA, 22 bp, Homo sapiens
gagatgctttctgcccttggta

SEQ ID NO: 9126510 - DNA, 17 bp, Homo sapiens
gagatgctaatctgatc

SEQ ID NO: 9126511 - DNA, 15 bp, Homo sapiens
gagatgctctcaggg

SEQ ID NO: 9126512 - DNA, 22 bp, Homo sapiens
gagatgctatggctattcccct

SEQ ID NO: 9126513 - DNA, 22 bp, Homo sapiens
gagatgctgaaatctgagtgta

SEQ ID NO: 9126514 - DNA, 22 bp, Homo sapiens
gagatgctgcctgatttattca

SEQ ID NO: 9126515 - DNA, 22 bp, Homo sapiens
gagatgctgctcttactgtata

SEQ ID NO: 9126516 - DNA, 22 bp, Homo sapiens
ctggctccaaggaagaggtttt

SEQ ID NO: 9126517 - DNA, 22 bp, Homo sapiens
ctgggaagaaattgtgggaggc

SEQ ID NO: 9126518 - DNA, 22 bp, Homo sapiens
ctggggccagtgaggaggcttt

SEQ ID NO: 9126519 - DNA, 22 bp, Homo sapiens
ctgggtctggccacaggaagta

SEQ ID NO: 9126520 - DNA, 20 bp, Homo sapiens
ctggggaggaggatgtgttc

SEQ ID NO: 9126521 - DNA, 22 bp, Homo sapiens
gtagaatatatggttagtattg

SEQ ID NO: 9126522 - DNA, 22 bp, Homo sapiens
gtcctgggcccaggggctgcct

SEQ ID NO: 9126523 - DNA, 22 bp, Homo sapiens
gtgaaatgaatctggaaatatt

SEQ ID NO: 9126524 - DNA, 22 bp, Homo sapiens
gtgaagagctgttgcagagatt

SEQ ID NO: 9126525 - DNA, 22 bp, Homo sapiens
gtgaccatcatctcagctagtt

SEQ ID NO: 9126526 - DNA, 22 bp, Homo sapiens
gtcctgggcctgctgaggctga

SEQ ID NO: 9126527 - DNA, 22 bp, Homo sapiens
ggggaagaggcgtgatggatcc

SEQ ID NO: 9126528 - DNA, 22 bp, Homo sapiens
ggggaagaggcgtgatggatcc

SEQ ID NO: 9126529 - DNA, 22 bp, Homo sapiens
ggggaagatggccctccatgtg

SEQ ID NO: 9126530 - DNA, 22 bp, Homo sapiens
ggggaagatttttaattagtaa

SEQ ID NO: 9126531 - DNA, 22 bp, Homo sapiens
ggggtgggcgtgcagggacacc

SEQ ID NO: 9126532 - DNA, 21 bp, Homo sapiens
ggggttggcaagagcagagac

SEQ ID NO: 9126533 - DNA, 22 bp, Homo sapiens
ggtcacccatgatcacatcacc

SEQ ID NO: 9126534 - DNA, 19 bp, Homo sapiens
gggagagccaggctcaccc

SEQ ID NO: 9126535 - DNA, 22 bp, Homo sapiens
gggagacacgctgcaggcataa

SEQ ID NO: 9126536 - DNA, 22 bp, Homo sapiens
ggcctcagggtcactctgtaga

SEQ ID NO: 9126537 - DNA, 20 bp, Homo sapiens
ggcaagcaactgagggagga

SEQ ID NO: 9126538 - DNA, 22 bp, Homo sapiens
ggcaagaggtccaagaggtctc

SEQ ID NO: 9126539 - DNA, 22 bp, Homo sapiens
ggaagagtaacaggaggtggaa

SEQ ID NO: 9126540 - DNA, 22 bp, Homo sapiens
ggaagaggctggtagtgcccgt

SEQ ID NO: 9126541 - DNA, 22 bp, Homo sapiens
ggaagaggctctcattgagggc

SEQ ID NO: 9126542 - DNA, 22 bp, Homo sapiens
ggaagaggctgagccaggtccc

SEQ ID NO: 9126543 - DNA, 22 bp, Homo sapiens
ggaagacaagcagtggctgagc

SEQ ID NO: 9126544 - DNA, 22 bp, Homo sapiens
gctggggctgggctgaggaaga

SEQ ID NO: 9126545 - DNA, 22 bp, Homo sapiens
gcttggaagtaggattgggaga

SEQ ID NO: 9126546 - DNA, 22 bp, Homo sapiens
gcctttaaagccccgagagccc

SEQ ID NO: 9126547 - DNA, 22 bp, Homo sapiens
gcctttaaagctggcaggcttt

SEQ ID NO: 9126548 - DNA, 22 bp, Homo sapiens
gctctgggattaccagccttag

SEQ ID NO: 9126549 - DNA, 20 bp, Homo sapiens
gaggcccagagaggtgaagc

SEQ ID NO: 9126550 - DNA, 22 bp, Homo sapiens
gaggcccagagaggttgcatga

SEQ ID NO: 9126551 - DNA, 22 bp, Homo sapiens
gcaaagatattagaatagagta

SEQ ID NO: 9126552 - DNA, 22 bp, Homo sapiens
gcacacagtactatatgctaca

SEQ ID NO: 9126553 - DNA, 21 bp, Homo sapiens
gcagaggcacggcaccaaggg

SEQ ID NO: 9126554 - DNA, 22 bp, Homo sapiens
gcagaggcacagccccagatga

SEQ ID NO: 9126555 - DNA, 22 bp, Homo sapiens
gcagaggccaggccaccagcaa

SEQ ID NO: 9126556 - DNA, 22 bp, Homo sapiens
gcagaggcatttctgacgctgc

SEQ ID NO: 9126557 - DNA, 22 bp, Homo sapiens
gcctcctggcctttgctcctca

SEQ ID NO: 9126558 - DNA, 22 bp, Homo sapiens
gccccaccgagggtgcagtcct

SEQ ID NO: 9126559 - DNA, 22 bp, Homo sapiens
gccccaccttgagagcagaaac

SEQ ID NO: 9126560 - DNA, 22 bp, Homo sapiens
gccccacctgctaccttccagc

SEQ ID NO: 9126561 - DNA, 22 bp, Homo sapiens
taaccaaagggcctaaggaatg

SEQ ID NO: 9126562 - DNA, 22 bp, Homo sapiens
taacctttgttcaatgtaagat

SEQ ID NO: 9126563 - DNA, 22 bp, Homo sapiens
taacctttttatcttacctcca

SEQ ID NO: 9126564 - DNA, 22 bp, Homo sapiens
taacctttggtgaaatattaac

SEQ ID NO: 9126565 - DNA, 22 bp, Homo sapiens
taacctttcaggcatgtaggtt

SEQ ID NO: 9126566 - DNA, 22 bp, Homo sapiens
taacctttgaccttgcttgtgc

SEQ ID NO: 9126567 - DNA, 22 bp, Homo sapiens
taacctttctcttgtggctgac

SEQ ID NO: 9126568 - DNA, 22 bp, Homo sapiens
taaagtgctggatttgagtaaa

SEQ ID NO: 9126569 - DNA, 22 bp, Homo sapiens
taaaatgtttgcaagagaccag

SEQ ID NO: 9126570 - DNA, 22 bp, Homo sapiens
taaaatgtagcttctaggctgg

SEQ ID NO: 9126571 - DNA, 19 bp, Homo sapiens
taaaatgtctgtggtcagt

SEQ ID NO: 9126572 - DNA, 22 bp, Homo sapiens
taaaatgtgtttctgtatggtt

SEQ ID NO: 9126573 - DNA, 21 bp, Homo sapiens
gttttctttgatagagggaag

SEQ ID NO: 9126574 - DNA, 22 bp, Homo sapiens
gttttctttgaatgcttctaga

SEQ ID NO: 9126575 - DNA, 22 bp, Homo sapiens
gttttcttcctgcaattggcat

SEQ ID NO: 9126576 - DNA, 22 bp, Homo sapiens
gtgtgggacgggtgagtggcca

SEQ ID NO: 9126577 - DNA, 22 bp, Homo sapiens
tacaaaggaaacttcttttccc

SEQ ID NO: 9126578 - DNA, 22 bp, Homo sapiens
taataatagcagtagctgccac

SEQ ID NO: 9126579 - DNA, 22 bp, Homo sapiens
taatacatcattcatctaagga

SEQ ID NO: 9126580 - DNA, 22 bp, Homo sapiens
tacactgaagtgtcttggtata

SEQ ID NO: 9126581 - DNA, 21 bp, Homo sapiens
tacattgactacaaataaagc

SEQ ID NO: 9126582 - DNA, 22 bp, Homo sapiens
tagggactagtttcaaggctaa

SEQ ID NO: 9126583 - DNA, 22 bp, Homo sapiens
tagggaggctacttcttgtagg

SEQ ID NO: 9126584 - DNA, 22 bp, Homo sapiens
taggagtcatttggtccctctt

SEQ ID NO: 9126585 - DNA, 22 bp, Homo sapiens
tagaggcctgaaagaatgatca

SEQ ID NO: 9126586 - DNA, 22 bp, Homo sapiens
tatccccacctctgttaaggac

SEQ ID NO: 9126587 - DNA, 22 bp, Homo sapiens
tatacacacctccaaagcagga

SEQ ID NO: 9126588 - DNA, 22 bp, Homo sapiens
tccccacctacacactgctcct

SEQ ID NO: 9126589 - DNA, 22 bp, Homo sapiens
tccccacctaagatacccatct

SEQ ID NO: 9126590 - DNA, 22 bp, Homo sapiens
tccccaccccagaactactagg

SEQ ID NO: 9126591 - DNA, 22 bp, Homo sapiens
tccccaggggcatctctctgct

SEQ ID NO: 9126592 - DNA, 22 bp, Homo sapiens
tcccacaggggctctgtgggtt

SEQ ID NO: 9126593 - DNA, 22 bp, Homo sapiens
tcccagtttttctccactaagg

SEQ ID NO: 9126594 - DNA, 21 bp, Homo sapiens
tcccacagcgccagctcctgt

SEQ ID NO: 9126595 - DNA, 22 bp, Homo sapiens
tccaggagtgtgtgctaatggg

SEQ ID NO: 9126596 - DNA, 22 bp, Homo sapiens
tcagaaaagaccacattattct

SEQ ID NO: 9126597 - DNA, 22 bp, Homo sapiens
tcagaaaagagaaaatcttata

SEQ ID NO: 9126598 - DNA, 22 bp, Homo sapiens
tcactttacagatgggaaaact

SEQ ID NO: 9126599 - DNA, 22 bp, Homo sapiens
tcactttacagctaaggttgtt

SEQ ID NO: 9126600 - DNA, 22 bp, Homo sapiens
tcactttactttgttaatctgg

SEQ ID NO: 9126601 - DNA, 22 bp, Homo sapiens
tcaagagaaggggaaatagact

SEQ ID NO: 9126602 - DNA, 22 bp, Homo sapiens
tcaaggaagggatattcttgaa

SEQ ID NO: 9126603 - DNA, 22 bp, Homo sapiens
tcaaggaatgactatatgagga

SEQ ID NO: 9126604 - DNA, 22 bp, Homo sapiens
tcagctccagagttgcacagtg

SEQ ID NO: 9126605 - DNA, 22 bp, Homo sapiens
tcaggagtaaagaagacttgac

SEQ ID NO: 9126606 - DNA, 22 bp, Homo sapiens
tcaggaggtttggattcagtta

SEQ ID NO: 9126607 - DNA, 17 bp, Homo sapiens
tcaggaggtgtttctag

SEQ ID NO: 9126608 - DNA, 22 bp, Homo sapiens
tcaggaggttgaccacggggca

SEQ ID NO: 9126609 - DNA, 22 bp, Homo sapiens
tcaggaggtgtaggtcaagtga

SEQ ID NO: 9126610 - DNA, 22 bp, Homo sapiens
tcagggaaaagtcacactgggt

SEQ ID NO: 9126611 - DNA, 22 bp, Homo sapiens
tcagggaaatagcagggctgaa

SEQ ID NO: 9126612 - DNA, 22 bp, Homo sapiens
tcataggagtagcagtgagagg

SEQ ID NO: 9126613 - DNA, 22 bp, Homo sapiens
tcattacagagatataatctac

SEQ ID NO: 9126614 - DNA, 22 bp, Homo sapiens
tcattacagtgtttatatgtct

SEQ ID NO: 9126615 - DNA, 22 bp, Homo sapiens
tcattatcttggctcatttctg

SEQ ID NO: 9126616 - DNA, 22 bp, Homo sapiens
tcattatcctagtatcttgaat

SEQ ID NO: 9126617 - DNA, 19 bp, Homo sapiens
tcagggaagttcaaagctc

SEQ ID NO: 9126618 - DNA, 22 bp, Homo sapiens
tcagggaagacttcttagagga

SEQ ID NO: 9126619 - DNA, 22 bp, Homo sapiens
ttcatcatgatgttcccctcta

SEQ ID NO: 9126620 - DNA, 22 bp, Homo sapiens
ttcacaaaaatgctgaacagtt

SEQ ID NO: 9126621 - DNA, 22 bp, Homo sapiens
ttctaagtcactcagattttgg

SEQ ID NO: 9126622 - DNA, 22 bp, Homo sapiens
ttctaagctctgaaataaatct

SEQ ID NO: 9126623 - DNA, 19 bp, Homo sapiens
ttctaagttttgcttgctg

SEQ ID NO: 9126624 - DNA, 22 bp, Homo sapiens
ttctagtgtccttggacttgct

SEQ ID NO: 9126625 - DNA, 22 bp, Homo sapiens
ttctgaagggctaagtgtctat

SEQ ID NO: 9126626 - DNA, 22 bp, Homo sapiens
ttctgaaggtcagcagcttggt

SEQ ID NO: 9126627 - DNA, 22 bp, Homo sapiens
ttctgagcctcattcatgaggc

SEQ ID NO: 9126628 - DNA, 22 bp, Homo sapiens
ttctggaaaagaaagttaagat

SEQ ID NO: 9126629 - DNA, 22 bp, Homo sapiens
ttctgttttagaaataagtagt

SEQ ID NO: 9126630 - DNA, 20 bp, Homo sapiens
tgtgtgaattagggcatgtt

SEQ ID NO: 9126631 - DNA, 19 bp, Homo sapiens
tgtgtcctagcagccagtc

SEQ ID NO: 9126632 - DNA, 22 bp, Homo sapiens
tgtggcctggaaggggctgctc

SEQ ID NO: 9126633 - DNA, 22 bp, Homo sapiens
tgtggcacatacacaggagggc

SEQ ID NO: 9126634 - DNA, 22 bp, Homo sapiens
tgtggacgtcattaaagcagtg

SEQ ID NO: 9126635 - DNA, 22 bp, Homo sapiens
tgttttctcttgaaaagcagtc

SEQ ID NO: 9126636 - DNA, 22 bp, Homo sapiens
tgtttcatgtggacatagttgt

SEQ ID NO: 9126637 - DNA, 21 bp, Homo sapiens
ttaatttattcatgatagcta

SEQ ID NO: 9126638 - DNA, 22 bp, Homo sapiens
ttagaggggctgctgaatggga

SEQ ID NO: 9126639 - DNA, 21 bp, Homo sapiens
ttagacttgggtttttcctgg

SEQ ID NO: 9126640 - DNA, 22 bp, Homo sapiens
ttagactttaagctgggtgcag

SEQ ID NO: 9126641 - DNA, 22 bp, Homo sapiens
ttaatttaagaaacggcaggcc

SEQ ID NO: 9126642 - DNA, 17 bp, Homo sapiens
tgttttctgctaccttt

SEQ ID NO: 9126643 - DNA, 22 bp, Homo sapiens
tgttttctgattctcgtgtggt

SEQ ID NO: 9126644 - DNA, 22 bp, Homo sapiens
tgttttctgatggttaatgagt

SEQ ID NO: 9126645 - DNA, 22 bp, Homo sapiens
tgttttctgtgtagagatcaca

SEQ ID NO: 9126646 - DNA, 22 bp, Homo sapiens
tgttttctgggtggaaggtact

SEQ ID NO: 9126647 - DNA, 22 bp, Homo sapiens
tgttttcttcctaattgctcat

SEQ ID NO: 9126648 - DNA, 22 bp, Homo sapiens
tgttttcttctgtaccgtgcca

SEQ ID NO: 9126649 - DNA, 19 bp, Homo sapiens
tgttttgttaaagcagtcc

SEQ ID NO: 9126650 - DNA, 22 bp, Homo sapiens
tgttttgtagctaatagctatt

SEQ ID NO: 9126651 - DNA, 23 bp, Homo sapiens
tgttttcttgtcctggtataatt

SEQ ID NO: 9126652 - DNA, 22 bp, Homo sapiens
ttaaatattatgttgtctgcaa

SEQ ID NO: 9126653 - DNA, 22 bp, Homo sapiens
tgttttgtttatgagagcacag

SEQ ID NO: 9126654 - DNA, 22 bp, Homo sapiens
ttaacaaaaatatcaggcatca

SEQ ID NO: 9126655 - DNA, 22 bp, Homo sapiens
ttaacaaatatttcccatgccc

SEQ ID NO: 9126656 - DNA, 22 bp, Homo sapiens
ttaacaaggtgactgcattaaa

SEQ ID NO: 9126657 - DNA, 22 bp, Homo sapiens
ttaacaaagtaacgggaaaaga

SEQ ID NO: 9126658 - DNA, 22 bp, Homo sapiens
ttaacaaagctctgttcctttt

SEQ ID NO: 9126659 - DNA, 22 bp, Homo sapiens
ttaacacagggggagacaaagt

SEQ ID NO: 9126660 - DNA, 22 bp, Homo sapiens
ttaaatattttcagcagggtca

SEQ ID NO: 9126661 - DNA, 22 bp, Homo sapiens
ttaaatgctcacataaaggtag

SEQ ID NO: 9126662 - DNA, 22 bp, Homo sapiens
tttgttcacctagcaaactttt

SEQ ID NO: 9126663 - DNA, 22 bp, Homo sapiens
tttgttcttgcaacagttatta

SEQ ID NO: 9126664 - DNA, 22 bp, Homo sapiens
ttttatacttaagacagagttt

SEQ ID NO: 9126665 - DNA, 22 bp, Homo sapiens
ttttatcagcagggataacaag

SEQ ID NO: 9126666 - DNA, 23 bp, Homo sapiens
ttttttgtcttgctaggctgccc

SEQ ID NO: 9126667 - DNA, 22 bp, Homo sapiens
ttttttgtcccagagagcctgg

SEQ ID NO: 9126668 - DNA, 22 bp, Homo sapiens
ttttttgtcttgaagaaatggt

SEQ ID NO: 9126669 - DNA, 22 bp, Homo sapiens
ttgtgttaaggtgcatctagtg

SEQ ID NO: 9126670 - DNA, 22 bp, Homo sapiens
ttgtctgaaccatctccctggc

SEQ ID NO: 9126671 - DNA, 22 bp, Homo sapiens
ttgtctgaagtcacacagatgc

SEQ ID NO: 9126672 - DNA, 22 bp, Homo sapiens
ttgtctgagagatggcagaggt

SEQ ID NO: 9126673 - DNA, 22 bp, Homo sapiens
ttgtctgagggtttgagagaat

SEQ ID NO: 9126674 - DNA, 22 bp, Homo sapiens
ttgtctgagaaagtgagttgct

SEQ ID NO: 9126675 - DNA, 22 bp, Homo sapiens
ttgtctgatgttccctcatgat

SEQ ID NO: 9126676 - DNA, 22 bp, Homo sapiens
ttgtctgacttctttagttact

SEQ ID NO: 9126677 - DNA, 22 bp, Homo sapiens
ttgtctgaattcttctaggcag

SEQ ID NO: 9126678 - DNA, 22 bp, Homo sapiens
ttgtctgaatatgtatgtatcc

SEQ ID NO: 9126679 - DNA, 22 bp, Homo sapiens
ttgtctgaatctggagctctct

SEQ ID NO: 9126680 - DNA, 22 bp, Homo sapiens
tttaattatatctgggcagtta

SEQ ID NO: 9126681 - DNA, 22 bp, Homo sapiens
tttaattaggaaatgggcaggg

SEQ ID NO: 9126682 - DNA, 21 bp, Homo sapiens
tttaatttgcatgtatgacgc

SEQ ID NO: 9126683 - DNA, 22 bp, Homo sapiens
tttagttattgcacagaattag

SEQ ID NO: 9126684 - DNA, 22 bp, Homo sapiens
tttattagattatcaaagaggt

SEQ ID NO: 9126685 - DNA, 22 bp, Homo sapiens
tttattagtgcttgtatcactg

SEQ ID NO: 9126686 - DNA, 22 bp, Homo sapiens
tttctaagtgtattgagcttgg

SEQ ID NO: 9126687 - DNA, 21 bp, Homo sapiens
tttctaagtgcttggtttggg

SEQ ID NO: 9126688 - DNA, 22 bp, Homo sapiens
tttctaagtgtgattttagatt

SEQ ID NO: 9126689 - DNA, 22 bp, Homo sapiens
tttctaagtgtgtttcatagga

SEQ ID NO: 9126690 - DNA, 21 bp, Homo sapiens
tttctaagtaactggcagcat

SEQ ID NO: 9126691 - DNA, 22 bp, Homo sapiens
tttctaagtaaacacagcatac

SEQ ID NO: 9126692 - DNA, 22 bp, Homo sapiens
tttctaagtatcttgcagtttt

SEQ ID NO: 9126693 - DNA, 22 bp, Homo sapiens
tttctaaggtgaggtagaaaat

SEQ ID NO: 9126694 - DNA, 22 bp, Homo sapiens
tttcaaagggaagttatgaagt

SEQ ID NO: 9126695 - DNA, 22 bp, Homo sapiens
tttcaaagagttgtaaattact

SEQ ID NO: 9126696 - DNA, 22 bp, Homo sapiens
tttcttcagccttcacaacctg

SEQ ID NO: 9126697 - DNA, 22 bp, Homo sapiens
tttcttgtctttagtatctggc

SEQ ID NO: 9126698 - DNA, 22 bp, Homo sapiens
tttcttgtttcatggtgtctca

SEQ ID NO: 9126699 - DNA, 22 bp, Homo sapiens
tttcttgtaagatgtttattaa

SEQ ID NO: 9126700 - DNA, 20 bp, Homo sapiens
tttcttgtcggctgttgctg

SEQ ID NO: 9126701 - DNA, 22 bp, Homo sapiens
tttctgaacttggtactggagc

SEQ ID NO: 9126702 - DNA, 22 bp, Homo sapiens
tttctgaagatacagctttgct

SEQ ID NO: 9126703 - DNA, 22 bp, Homo sapiens
tttctgaaggttaaggaattag

SEQ ID NO: 9126704 - DNA, 22 bp, Homo sapiens
tttctgaataactctatgatat

SEQ ID NO: 9126705 - DNA, 23 bp, Homo sapiens
tttctgaagttgagatggacttt

SEQ ID NO: 9126706 - DNA, 22 bp, Homo sapiens
tttctgaattcctaggatgttg

SEQ ID NO: 9126707 - DNA, 22 bp, Homo sapiens
tttctggcagcgggacaggggt

SEQ ID NO: 9126708 - DNA, 22 bp, Homo sapiens
aggcaatcagtgtagagtaaca

SEQ ID NO: 9126709 - DNA, 22 bp, Homo sapiens
aggcaactggttaagtaaattg

SEQ ID NO: 9126710 - DNA, 22 bp, Homo sapiens
aggcaagctgcagagagtcctt

SEQ ID NO: 9126711 - DNA, 22 bp, Homo sapiens
aggaggcagatgcttggctgta

SEQ ID NO: 9126712 - DNA, 22 bp, Homo sapiens
aggagctgtgaatgggaggggt

SEQ ID NO: 9126713 - DNA, 22 bp, Homo sapiens
aggagctgtcagagtgccagag

SEQ ID NO: 9126714 - DNA, 16 bp, Homo sapiens
aggagctgggtaggag

SEQ ID NO: 9126715 - DNA, 22 bp, Homo sapiens
aggatgagagatacatggagca

SEQ ID NO: 9126716 - DNA, 23 bp, Homo sapiens
aggatgtaggatgtatggcagag

SEQ ID NO: 9126717 - DNA, 22 bp, Homo sapiens
aggaagagctggaccagaggac

SEQ ID NO: 9126718 - DNA, 22 bp, Homo sapiens
agctttcttgattttgcctgta

SEQ ID NO: 9126719 - DNA, 22 bp, Homo sapiens
agctttctggttacagtcttca

SEQ ID NO: 9126720 - DNA, 22 bp, Homo sapiens
caggcccagtgatcagggctct

SEQ ID NO: 9126721 - DNA, 22 bp, Homo sapiens
agctgtctacagcaataaagga

SEQ ID NO: 9126722 - DNA, 22 bp, Homo sapiens
caggcaggtcagtgaagaagga

SEQ ID NO: 9126723 - DNA, 22 bp, Homo sapiens
caggcagggagctggaaaggat

SEQ ID NO: 9126724 - DNA, 22 bp, Homo sapiens
caggcagcgtcctgcttcctgt

SEQ ID NO: 9126725 - DNA, 22 bp, Homo sapiens
ccagctcccgcaggctgcacag

SEQ ID NO: 9126726 - DNA, 22 bp, Homo sapiens
ccagctccgggagttgctgctg

SEQ ID NO: 9126727 - DNA, 23 bp, Homo sapiens
ccagctcccaggtctgaggactg

SEQ ID NO: 9126728 - DNA, 22 bp, Homo sapiens
ccaggcactgctcgaggtgcta

SEQ ID NO: 9126729 - DNA, 20 bp, Homo sapiens
ccaggcactgtcccatgcag

SEQ ID NO: 9126730 - DNA, 22 bp, Homo sapiens
ccaggcactggctgggttcttt

SEQ ID NO: 9126731 - DNA, 22 bp, Homo sapiens
ccaggcacggtggctcatgcct

SEQ ID NO: 9126732 - DNA, 22 bp, Homo sapiens
aggcaggtcccctggaaggcac

SEQ ID NO: 9126733 - DNA, 18 bp, Homo sapiens
ccagccctgcagcacctg

SEQ ID NO: 9126734 - DNA, 22 bp, Homo sapiens
ccagccctcggtagtcccatag

SEQ ID NO: 9126735 - DNA, 22 bp, Homo sapiens
ccagccctgaaccctgctgcat

SEQ ID NO: 9126736 - DNA, 22 bp, Homo sapiens
ccagccagtatattccaaagcc

SEQ ID NO: 9126737 - DNA, 22 bp, Homo sapiens
ccagccagcaagctcccagttc

SEQ ID NO: 9126738 - DNA, 22 bp, Homo sapiens
ccagccactgggccactgccag

SEQ ID NO: 9126739 - DNA, 22 bp, Homo sapiens
cccacacactggctgctgccaa

SEQ ID NO: 9126740 - DNA, 22 bp, Homo sapiens
cccagagtcacatggggtgttc

SEQ ID NO: 9126741 - DNA, 22 bp, Homo sapiens
cccagagtctctgctcttgcct

SEQ ID NO: 9126742 - DNA, 22 bp, Homo sapiens
cccagagtcaagcttaccatta

SEQ ID NO: 9126743 - DNA, 22 bp, Homo sapiens
cccagagtatttgtgatgttag

SEQ ID NO: 9126744 - DNA, 22 bp, Homo sapiens
cccagagttggtcaggggaccc

SEQ ID NO: 9126745 - DNA, 22 bp, Homo sapiens
cccagagtggagggtgcagaat

SEQ ID NO: 9126746 - DNA, 22 bp, Homo sapiens
cccagagttcaaaccctgcgtc

SEQ ID NO: 9126747 - DNA, 23 bp, Homo sapiens
cccagagtcatctgtagctgtgg

SEQ ID NO: 9126748 - DNA, 22 bp, Homo sapiens
cccagagtggacggtggcccct

SEQ ID NO: 9126749 - DNA, 22 bp, Homo sapiens
agggaaaggtagtgaggtcaca

SEQ ID NO: 9126750 - DNA, 22 bp, Homo sapiens
agtaaaaagttcagaatggttg

SEQ ID NO: 9126751 - DNA, 22 bp, Homo sapiens
cgcagggatttcaaggggcctt

SEQ ID NO: 9126752 - DNA, 22 bp, Homo sapiens
ctagaaatgctcaagagaaagt

SEQ ID NO: 9126753 - DNA, 22 bp, Homo sapiens
aggtaggatgggtggagatgat

SEQ ID NO: 9126754 - DNA, 22 bp, Homo sapiens
aggtaggatagataggaagacc

SEQ ID NO: 9126755 - DNA, 22 bp, Homo sapiens
ctccagagccagtgcttttcca

SEQ ID NO: 9126756 - DNA, 22 bp, Homo sapiens
ctccagagatacacggtcttgc

SEQ ID NO: 9126757 - DNA, 22 bp, Homo sapiens
ctccagagatccattgaatgta

SEQ ID NO: 9126758 - DNA, 22 bp, Homo sapiens
agtcttatgtttgtgaagaact

SEQ ID NO: 9126759 - DNA, 22 bp, Homo sapiens
atagcaaagcctggcacaatga

SEQ ID NO: 9126760 - DNA, 22 bp, Homo sapiens
atcaacatgacaggagaagaga

SEQ ID NO: 9126761 - DNA, 22 bp, Homo sapiens
atatgcagtctcttgcccttct

SEQ ID NO: 9126762 - DNA, 22 bp, Homo sapiens
cttccataatcttgtttattta

SEQ ID NO: 9126763 - DNA, 22 bp, Homo sapiens
ctgtgtgtcctcggacgagttt

SEQ ID NO: 9126764 - DNA, 22 bp, Homo sapiens
cagaaagccaactccaactgtc

SEQ ID NO: 9126765 - DNA, 22 bp, Homo sapiens
cagaaagcagttgtcaatgggc

SEQ ID NO: 9126766 - DNA, 22 bp, Homo sapiens
cagaaaggcacccactgggtct

SEQ ID NO: 9126767 - DNA, 22 bp, Homo sapiens
cagaaaggtatgtgtgcctttg

SEQ ID NO: 9126768 - DNA, 22 bp, Homo sapiens
cagaaaggacagagtgagggtg

SEQ ID NO: 9126769 - DNA, 22 bp, Homo sapiens
cagaaaggactttggttggctt

SEQ ID NO: 9126770 - DNA, 22 bp, Homo sapiens
ggcagggaggaggtgaaagtga

SEQ ID NO: 9126771 - DNA, 20 bp, Homo sapiens
ggcagggagggatactgagg

SEQ ID NO: 9126772 - DNA, 22 bp, Homo sapiens
ggcaggcagtgtggtgtgaaac

SEQ ID NO: 9126773 - DNA, 22 bp, Homo sapiens
ggcaggcatcatcagttgatca

SEQ ID NO: 9126774 - DNA, 22 bp, Homo sapiens
ggcagggagtggagactcccta

SEQ ID NO: 9126775 - DNA, 22 bp, Homo sapiens
ggcaggtgatctagagtcaata

SEQ ID NO: 9126776 - DNA, 22 bp, Homo sapiens
cacacagacagctctctgaaga

SEQ ID NO: 9126777 - DNA, 22 bp, Homo sapiens
cacagaatcatattgtcagttt

SEQ ID NO: 9126778 - DNA, 22 bp, Homo sapiens
cacagaatcggccgatggtgct

SEQ ID NO: 9126779 - DNA, 22 bp, Homo sapiens
cacagaataaattggtatcaga

SEQ ID NO: 9126780 - DNA, 22 bp, Homo sapiens
cacagaagaatcatgctgtgtt

SEQ ID NO: 9126781 - DNA, 22 bp, Homo sapiens
cacagagtggaggcttggcctg

SEQ ID NO: 9126782 - DNA, 22 bp, Homo sapiens
ggagctggagagtacagagttt

SEQ ID NO: 9126783 - DNA, 22 bp, Homo sapiens
gctgttctttggtcaaaggtat

SEQ ID NO: 9126784 - DNA, 22 bp, Homo sapiens
gctttgcacagattaggttatt

SEQ ID NO: 9126785 - DNA, 22 bp, Homo sapiens
caagcatactgtgagagtttta

SEQ ID NO: 9126786 - DNA, 22 bp, Homo sapiens
ggtgagaaaaatgagtatgatt

SEQ ID NO: 9126787 - DNA, 22 bp, Homo sapiens
cagcacatttactcagccctca

SEQ ID NO: 9126788 - DNA, 22 bp, Homo sapiens
cagagacagcctgggagggaca

SEQ ID NO: 9126789 - DNA, 22 bp, Homo sapiens
cagccctggaacagctgactca

SEQ ID NO: 9126790 - DNA, 20 bp, Homo sapiens
cagcctccactcactcagct

SEQ ID NO: 9126791 - DNA, 22 bp, Homo sapiens
cagccctcaaaccacttccagg

SEQ ID NO: 9126792 - DNA, 22 bp, Homo sapiens
cagccccatggtgtgctccagc

SEQ ID NO: 9126793 - DNA, 22 bp, Homo sapiens
cagccctcaggtcctcagcagc

SEQ ID NO: 9126794 - DNA, 22 bp, Homo sapiens
gaaggcaagcagcataaatgtc

SEQ ID NO: 9126795 - DNA, 22 bp, Homo sapiens
gactggaaagcctgtcctcaga

SEQ ID NO: 9126796 - DNA, 22 bp, Homo sapiens
gacaccagaagacataagcaga

SEQ ID NO: 9126797 - DNA, 22 bp, Homo sapiens
gacaccagcaaggctgtgagga

SEQ ID NO: 9126798 - DNA, 22 bp, Homo sapiens
gacaccagagactgatgaggcc

SEQ ID NO: 9126799 - DNA, 22 bp, Homo sapiens
gacaccaggaatagttctgtct

SEQ ID NO: 9126800 - DNA, 18 bp, Homo sapiens
gacaccagcctctgcccc

SEQ ID NO: 9126801 - DNA, 23 bp, Homo sapiens
gacaccaggcgtggccctcgaca

SEQ ID NO: 9126802 - DNA, 22 bp, Homo sapiens
gacaccaggtctgttgtcctcc

SEQ ID NO: 9126803 - DNA, 22 bp, Homo sapiens
gacaccagtaaatattcaaaag

SEQ ID NO: 9126804 - DNA, 22 bp, Homo sapiens
gaaatacagttgggaggaggta

SEQ ID NO: 9126805 - DNA, 22 bp, Homo sapiens
gaaagcagtatttagttctgtt

SEQ ID NO: 9126806 - DNA, 22 bp, Homo sapiens
atgacagatagtcttcatttgc

SEQ ID NO: 9126807 - DNA, 22 bp, Homo sapiens
atgaacattaaaatggtagaat

SEQ ID NO: 9126808 - DNA, 22 bp, Homo sapiens
atgtgaggaagaaagaggtaag

SEQ ID NO: 9126809 - DNA, 22 bp, Homo sapiens
atgtgaggcagcacggagatta

SEQ ID NO: 9126810 - DNA, 22 bp, Homo sapiens
atgtctcggctctaaacgatcg

SEQ ID NO: 9126811 - DNA, 19 bp, Homo sapiens
gatatgaacgttactggcc

SEQ ID NO: 9126812 - DNA, 22 bp, Homo sapiens
gagagaggcctccatgtactga

SEQ ID NO: 9126813 - DNA, 22 bp, Homo sapiens
gagagaggcctccatgtactga

SEQ ID NO: 9126814 - DNA, 23 bp, Homo sapiens
gagagagattgctaaaccactcc

SEQ ID NO: 9126815 - DNA, 22 bp, Homo sapiens
gagagagaagtgggtgtcacct

SEQ ID NO: 9126816 - DNA, 22 bp, Homo sapiens
gagagagacatgtaaacgcggt

SEQ ID NO: 9126817 - DNA, 22 bp, Homo sapiens
gagagagaggtgctgccaggca

SEQ ID NO: 9126818 - DNA, 17 bp, Homo sapiens
atggaggcagacaggtc

SEQ ID NO: 9126819 - DNA, 22 bp, Homo sapiens
gaggagaagggcacggagaaaa

SEQ ID NO: 9126820 - DNA, 22 bp, Homo sapiens
gaggagaagctaagaaacacag

SEQ ID NO: 9126821 - DNA, 22 bp, Homo sapiens
gatatgtattccactataaagg

SEQ ID NO: 9126822 - DNA, 22 bp, Homo sapiens
attacctatttcattttctgtc

SEQ ID NO: 9126823 - DNA, 22 bp, Homo sapiens
gcagcgaggtgatgaaatagct

SEQ ID NO: 9126824 - DNA, 22 bp, Homo sapiens
caaaattagggagtgagctgga

SEQ ID NO: 9126825 - DNA, 22 bp, Homo sapiens
caaaattagaaatgcagctgtt

SEQ ID NO: 9126826 - DNA, 22 bp, Homo sapiens
caaagctcgccacctctgaggg

SEQ ID NO: 9126827 - DNA, 22 bp, Homo sapiens
caaaggaggtgataggccctct

SEQ ID NO: 9126828 - DNA, 22 bp, Homo sapiens
gctgactgagctggcttttcgt

SEQ ID NO: 9126829 - DNA, 22 bp, Homo sapiens
gctgactgctcagggccagctg

SEQ ID NO: 9126830 - DNA, 22 bp, Homo sapiens
atttccattatcatgacaaatt

SEQ ID NO: 9126831 - DNA, 22 bp, Homo sapiens
atttccattttcagccattact

SEQ ID NO: 9126832 - DNA, 22 bp, Homo sapiens
atttccatgtccaaaaattagt

SEQ ID NO: 9126833 - DNA, 22 bp, Homo sapiens
atttccatgtcggtattttata

SEQ ID NO: 9126834 - DNA, 22 bp, Homo sapiens
atttccatgaaggcagatttta

SEQ ID NO: 9126835 - DNA, 22 bp, Homo sapiens
atttccatgaagtttagttata

SEQ ID NO: 9126836 - DNA, 22 bp, Homo sapiens
atttccatgccttagcttaagg

SEQ ID NO: 9126837 - DNA, 22 bp, Homo sapiens
atttccatgaattcccactcat

SEQ ID NO: 9126838 - DNA, 22 bp, Homo sapiens
atttccatagagcgtctcacag

SEQ ID NO: 9126839 - DNA, 22 bp, Homo sapiens
atttccatacacccatttctga

SEQ ID NO: 9126840 - DNA, 22 bp, Homo sapiens
atttccatcatcattaggccta

SEQ ID NO: 9126841 - DNA, 22 bp, Homo sapiens
atttccagtacccagaacagag

SEQ ID NO: 9126842 - DNA, 22 bp, Homo sapiens
atacacatttgctagagatggg

SEQ ID NO: 9126843 - DNA, 22 bp, Homo sapiens
atactgtttctcttctacatga

SEQ ID NO: 9126844 - DNA, 22 bp, Homo sapiens
atagaagatagcttttgtttct

SEQ ID NO: 9126845 - DNA, 17 bp, Homo sapiens
agaaaagagaccagcag

SEQ ID NO: 9126846 - DNA, 22 bp, Homo sapiens
agaaactgtgttactagaatgt

SEQ ID NO: 9126847 - DNA, 22 bp, Homo sapiens
agaaagacgtgatgaagaagta

SEQ ID NO: 9126848 - DNA, 22 bp, Homo sapiens
agaaagaacgttggttatctta

SEQ ID NO: 9126849 - DNA, 22 bp, Homo sapiens
agaagccatgtttagtaggatg

SEQ ID NO: 9126850 - DNA, 17 bp, Homo sapiens
agtgtgtgaaatggtgg

SEQ ID NO: 9126851 - DNA, 22 bp, Homo sapiens
agtgcaaagcagcctgtacacc

SEQ ID NO: 9126852 - DNA, 22 bp, Homo sapiens
agtgaggcaaagtgagaggcag

SEQ ID NO: 9126853 - DNA, 22 bp, Homo sapiens
agtgaggataccaatgtgtaga

SEQ ID NO: 9126854 - DNA, 22 bp, Homo sapiens
agtgaggaaatccattatcaag

SEQ ID NO: 9126855 - DNA, 22 bp, Homo sapiens
agtccagaccccggcagctggt

SEQ ID NO: 9126856 - DNA, 22 bp, Homo sapiens
agggtcccgaaggagacagcaa

SEQ ID NO: 9126857 - DNA, 22 bp, Homo sapiens
aggtggaaatggctttcctagg

SEQ ID NO: 9126858 - DNA, 22 bp, Homo sapiens
aggaggcaggaagtctatggga

SEQ ID NO: 9126859 - DNA, 20 bp, Homo sapiens
aggaggcatgaggggattta

SEQ ID NO: 9126860 - DNA, 20 bp, Homo sapiens
aggaggcatagtctggaaag

SEQ ID NO: 9126861 - DNA, 22 bp, Homo sapiens
aggaggcagtctgtcccttagc

SEQ ID NO: 9126862 - DNA, 22 bp, Homo sapiens
aggaggccgatttcagaggtcg

SEQ ID NO: 9126863 - DNA, 22 bp, Homo sapiens
aggcaccagtaagagtagaact

SEQ ID NO: 9126864 - DNA, 20 bp, Homo sapiens
aggcagtgtagagatgagta

SEQ ID NO: 9126865 - DNA, 22 bp, Homo sapiens
aggcagattacttgaggccagg

SEQ ID NO: 9126866 - DNA, 22 bp, Homo sapiens
aggcagatgggagctggaagtt

SEQ ID NO: 9126867 - DNA, 22 bp, Homo sapiens
aggcagatcacttgaggccagg

SEQ ID NO: 9126868 - DNA, 20 bp, Homo sapiens
acagccagaggaggcagaca

SEQ ID NO: 9126869 - DNA, 22 bp, Homo sapiens
aggctctcactatcctcctagc

SEQ ID NO: 9126870 - DNA, 22 bp, Homo sapiens
aggctctccagagagctgcttt

SEQ ID NO: 9126871 - DNA, 22 bp, Homo sapiens
accagagaatgtgcatctctaa

SEQ ID NO: 9126872 - DNA, 22 bp, Homo sapiens
accagagaatttagccaagaaa

SEQ ID NO: 9126873 - DNA, 22 bp, Homo sapiens
accagagaaaacacagcaggct

SEQ ID NO: 9126874 - DNA, 20 bp, Homo sapiens
accagagacctgaatcagtt

SEQ ID NO: 9126875 - DNA, 22 bp, Homo sapiens
accagagactctttctagtcct

SEQ ID NO: 9126876 - DNA, 22 bp, Homo sapiens
accagagactgcatttctctga

SEQ ID NO: 9126877 - DNA, 20 bp, Homo sapiens
accagagatagcaatagtgc

SEQ ID NO: 9126878 - DNA, 22 bp, Homo sapiens
accagagatgtctaataggggc

SEQ ID NO: 9126879 - DNA, 22 bp, Homo sapiens
accagagatggggcttctctgt

SEQ ID NO: 9126880 - DNA, 22 bp, Homo sapiens
accagagagagacagggttgtg

SEQ ID NO: 9126881 - DNA, 20 bp, Homo sapiens
accagagactggggacaagt

SEQ ID NO: 9126882 - DNA, 22 bp, Homo sapiens
accagagaggctgcagtgtgtg

SEQ ID NO: 9126883 - DNA, 22 bp, Homo sapiens
accagagagcctaggctgggca

SEQ ID NO: 9126884 - DNA, 22 bp, Homo sapiens
agagaagacttacagccacagt

SEQ ID NO: 9126885 - DNA, 18 bp, Homo sapiens
agagatgggagttggaaa

SEQ ID NO: 9126886 - DNA, 18 bp, Homo sapiens
agagatggtgtagagttt

SEQ ID NO: 9126887 - DNA, 22 bp, Homo sapiens
agagccttgcctggggccctgt

SEQ ID NO: 9126888 - DNA, 22 bp, Homo sapiens
atgaggcaaggctggccgtgtt

SEQ ID NO: 9126889 - DNA, 22 bp, Homo sapiens
atgaggcaaggatcaggtaagg

SEQ ID NO: 9126890 - DNA, 22 bp, Homo sapiens
atgaggcaaaggtggaggtggg

SEQ ID NO: 9126891 - DNA, 22 bp, Homo sapiens
atgaggcacatcacagccaatg

SEQ ID NO: 9126892 - DNA, 22 bp, Homo sapiens
atgaggcaatcatggtccagtt

SEQ ID NO: 9126893 - DNA, 22 bp, Homo sapiens
atgaggcacagagatgttaatg

SEQ ID NO: 9126894 - DNA, 22 bp, Homo sapiens
atgaggcaatagaatattgaat

SEQ ID NO: 9126895 - DNA, 19 bp, Homo sapiens
atgcaacaaaagtgtaaga

SEQ ID NO: 9126896 - DNA, 22 bp, Homo sapiens
attcaaaccccatagacaactt

SEQ ID NO: 9126897 - DNA, 23 bp, Homo sapiens
atttacagctgtgtgagcaagtt

SEQ ID NO: 9126898 - DNA, 22 bp, Homo sapiens
agatgagaatttttagagtgct

SEQ ID NO: 9126899 - DNA, 21 bp, Homo sapiens
agcagacagcccaagaaaatc

SEQ ID NO: 9126900 - DNA, 22 bp, Homo sapiens
caagcttgtttctcctgggggt

SEQ ID NO: 9126901 - DNA, 22 bp, Homo sapiens
caaggaaaaagcgagctcgggg

SEQ ID NO: 9126902 - DNA, 22 bp, Homo sapiens
cacaggaaaataaaagatctaa

SEQ ID NO: 9126903 - DNA, 22 bp, Homo sapiens
cacacagaaccgctcgccactt

SEQ ID NO: 9126904 - DNA, 22 bp, Homo sapiens
agcatttccgccctcttctgcc

SEQ ID NO: 9126905 - DNA, 22 bp, Homo sapiens
cagagcagtctggagatccagc

SEQ ID NO: 9126906 - DNA, 22 bp, Homo sapiens
cagagcagtagaaaacagcctt

SEQ ID NO: 9126907 - DNA, 20 bp, Homo sapiens
cagaggagtacatatgttca

SEQ ID NO: 9126908 - DNA, 22 bp, Homo sapiens
cagaggagtgggccgttatggt

SEQ ID NO: 9126909 - DNA, 22 bp, Homo sapiens
cagaggaggcggtatacactgc

SEQ ID NO: 9126910 - DNA, 22 bp, Homo sapiens
cagccccacacggtctagctct

SEQ ID NO: 9126911 - DNA, 19 bp, Homo sapiens
cagcccagggtgctaccaa

SEQ ID NO: 9126912 - DNA, 22 bp, Homo sapiens
aagagagaccatgggggacagg

SEQ ID NO: 9126913 - DNA, 22 bp, Homo sapiens
aagaagctaagactatctgggt

SEQ ID NO: 9126914 - DNA, 22 bp, Homo sapiens
aacttctcatacaaagaacaag

SEQ ID NO: 9126915 - DNA, 22 bp, Homo sapiens
aaagttctgggggagaagaacg

SEQ ID NO: 9126916 - DNA, 22 bp, Homo sapiens
aaaggctctaacaaggagagag

SEQ ID NO: 9126917 - DNA, 22 bp, Homo sapiens
aaagggagcatggctgcaggga

SEQ ID NO: 9126918 - DNA, 22 bp, Homo sapiens
aaaggatggctctgcatatttg

SEQ ID NO: 9126919 - DNA, 22 bp, Homo sapiens
aaaggagttactcataaagctt

SEQ ID NO: 9126920 - DNA, 22 bp, Homo sapiens
aaactgttgtggtttatcatta

SEQ ID NO: 9126921 - DNA, 22 bp, Homo sapiens
aaaggagacttcagatctcctt

SEQ ID NO: 9126922 - DNA, 23 bp, Homo sapiens
aactttactattttgaataatgc

SEQ ID NO: 9126923 - DNA, 22 bp, Homo sapiens
aaggagaagggtaatcaacaca

SEQ ID NO: 9126924 - DNA, 22 bp, Homo sapiens
aaatggatctgtggaatacatt

SEQ ID NO: 9126925 - DNA, 22 bp, Homo sapiens
aaatggagttctaagtatagta

SEQ ID NO: 9126926 - DNA, 22 bp, Homo sapiens
aaggagtttgggtagtcataca

SEQ ID NO: 9126927 - DNA, 22 bp, Homo sapiens
aaggtgttatagctgaggaata

SEQ ID NO: 9126928 - DNA, 22 bp, Homo sapiens
aagtaacatctgaacatgatgt

SEQ ID NO: 9126929 - DNA, 23 bp, Homo sapiens
aaggtgtttgttttcagaaagca

SEQ ID NO: 9126930 - DNA, 22 bp, Homo sapiens
aaggtgttcttcagtagaggtc

SEQ ID NO: 9126931 - DNA, 23 bp, Homo sapiens
aaggtgtttgatgggttgaggaa

SEQ ID NO: 9126932 - DNA, 22 bp, Homo sapiens
aagtaacaggtgcttagtttat

SEQ ID NO: 9126933 - DNA, 22 bp, Homo sapiens
aagaactgtttacaattttcac

SEQ ID NO: 9126934 - DNA, 22 bp, Homo sapiens
aagaactgagtacgttaataaa

SEQ ID NO: 9126935 - DNA, 22 bp, Homo sapiens
acacagaagatctcttaatgct

SEQ ID NO: 9126936 - DNA, 22 bp, Homo sapiens
acacagaagatctcttaatgct

SEQ ID NO: 9126937 - DNA, 23 bp, Homo sapiens
aagccccaaggaacttcctggga

SEQ ID NO: 9126938 - DNA, 23 bp, Homo sapiens
acagccaggatgggagcagaagc

SEQ ID NO: 9126939 - DNA, 17 bp, Homo sapiens
aagtcccagctaacaca

SEQ ID NO: 9126940 - DNA, 22 bp, Homo sapiens
aagtagttgtccctgaggaacg

SEQ ID NO: 9126941 - DNA, 17 bp, Homo sapiens
accagagttttccatgc

SEQ ID NO: 9126942 - DNA, 22 bp, Homo sapiens
accagagttttattagttctaa

SEQ ID NO: 9126943 - DNA, 22 bp, Homo sapiens
accagagttggaataattttga

SEQ ID NO: 9126944 - DNA, 22 bp, Homo sapiens
accagagtaatgtgtggaaatt

SEQ ID NO: 9126945 - DNA, 22 bp, Homo sapiens
accagagtcaattattttgcca

SEQ ID NO: 9126946 - DNA, 22 bp, Homo sapiens
aaggatttttgctaggaagaca

SEQ ID NO: 9126947 - DNA, 22 bp, Homo sapiens
aaggaggcctggcagatgaaga

SEQ ID NO: 9126948 - DNA, 22 bp, Homo sapiens
aagctgttaatggcttgcagct

SEQ ID NO: 9126949 - DNA, 23 bp, Homo sapiens
aagcttctagggtgggcaagatg

SEQ ID NO: 9126950 - DNA, 22 bp, Homo sapiens
aagctgttgttcatcctgaatt

SEQ ID NO: 9126951 - DNA, 22 bp, Homo sapiens
aagctgttctgaatcagtaagt

SEQ ID NO: 9126952 - DNA, 22 bp, Homo sapiens
aagctgttttggccttagttga

SEQ ID NO: 9126953 - DNA, 22 bp, Homo sapiens
aagctgttgaagtaattcagcc

SEQ ID NO: 9126954 - DNA, 22 bp, Homo sapiens
aagctgttggcagatagctctg

SEQ ID NO: 9126955 - DNA, 22 bp, Homo sapiens
aagctgttctccagtgactcag

SEQ ID NO: 9126956 - DNA, 22 bp, Homo sapiens
aagctgttctctaagtttcatg

SEQ ID NO: 9126957 - DNA, 22 bp, Homo sapiens
aaggcaactgtaaaacatgcac

SEQ ID NO: 9126958 - DNA, 22 bp, Homo sapiens
agaaaggaagggaggagtttat

SEQ ID NO: 9126959 - DNA, 22 bp, Homo sapiens
agaaagctggagtcaagcagag

SEQ ID NO: 9126960 - DNA, 22 bp, Homo sapiens
aatgaagacacatctttctcat

SEQ ID NO: 9126961 - DNA, 18 bp, Homo sapiens
agaagccacgaggagtcc

SEQ ID NO: 9126962 - DNA, 22 bp, Homo sapiens
agaagccaccagctgaggaaga

SEQ ID NO: 9126963 - DNA, 17 bp, Homo sapiens
agaactgtagtagctcc

SEQ ID NO: 9126964 - DNA, 22 bp, Homo sapiens
agaactggtggtgatcagttat

SEQ ID NO: 9126965 - DNA, 22 bp, Homo sapiens
agagttcacactcagtgcaccc

SEQ ID NO: 9126966 - DNA, 22 bp, Homo sapiens
agagtgtttttctgtcaaggac

SEQ ID NO: 9126967 - DNA, 22 bp, Homo sapiens
agagcaaatagagaagccagct

SEQ ID NO: 9126968 - DNA, 22 bp, Homo sapiens
agagatgaaaagggtactgagg

SEQ ID NO: 9126969 - DNA, 22 bp, Homo sapiens
aattaatatttgtggaattaat

SEQ ID NO: 9126970 - DNA, 22 bp, Homo sapiens
agaggaggtggtgatgctttaa

SEQ ID NO: 9126971 - DNA, 22 bp, Homo sapiens
agaggaggtccttttctgatgt

SEQ ID NO: 9126972 - DNA, 22 bp, Homo sapiens
agcagggactacgtgaaagtga

SEQ ID NO: 9126973 - DNA, 22 bp, Homo sapiens
agcagggaatagcggaaagaat

SEQ ID NO: 9126974 - DNA, 22 bp, Homo sapiens
acacaatttcctgtccatatgt

SEQ ID NO: 9126975 - DNA, 22 bp, Homo sapiens
acagaattaaagtgtttgtgga

SEQ ID NO: 9126976 - DNA, 22 bp, Homo sapiens
acagaattaacatttgatgaat

SEQ ID NO: 9126977 - DNA, 22 bp, Homo sapiens
acagagctgtacatgtgccatg

SEQ ID NO: 9126978 - DNA, 22 bp, Homo sapiens
acagaagcagcgcggctcttct

SEQ ID NO: 9126979 - DNA, 22 bp, Homo sapiens
acagatatttaagagcttttgt

SEQ ID NO: 9126980 - DNA, 22 bp, Homo sapiens
acagatatgttgggttcttgtt

SEQ ID NO: 9126981 - DNA, 22 bp, Homo sapiens
acagcagcatcctatttcactc

SEQ ID NO: 9126982 - DNA, 22 bp, Homo sapiens
tcacagaataaattgagaagac

SEQ ID NO: 9126983 - DNA, 22 bp, Homo sapiens
tcactttactttgttaatctgg

SEQ ID NO: 9126984 - DNA, 22 bp, Homo sapiens
tcactttagaggaaacattgag

SEQ ID NO: 9126985 - DNA, 23 bp, Homo sapiens
tcagagaggccccctgcagagat

SEQ ID NO: 9126986 - DNA, 22 bp, Homo sapiens
tccagagaggtttctccatgct

SEQ ID NO: 9126987 - DNA, 22 bp, Homo sapiens
tccagagataactatttaggag

SEQ ID NO: 9126988 - DNA, 20 bp, Homo sapiens
tccagagagtggcaaagctc

SEQ ID NO: 9126989 - DNA, 22 bp, Homo sapiens
tccagagatccaaagaatatga

SEQ ID NO: 9126990 - DNA, 22 bp, Homo sapiens
tccagagatcacactgggcagg

SEQ ID NO: 9126991 - DNA, 22 bp, Homo sapiens
tccagagatctctcttccctgt

SEQ ID NO: 9126992 - DNA, 22 bp, Homo sapiens
tccccaccccagaactactagg

SEQ ID NO: 9126993 - DNA, 22 bp, Homo sapiens
tataggaatgacgtcatttcct

SEQ ID NO: 9126994 - DNA, 22 bp, Homo sapiens
tatgaggcttacaggcaggcca

SEQ ID NO: 9126995 - DNA, 22 bp, Homo sapiens
tatgaggtattacaggaaatat

SEQ ID NO: 9126996 - DNA, 22 bp, Homo sapiens
tatgtacaagcacacatgtgac

SEQ ID NO: 9126997 - DNA, 22 bp, Homo sapiens
tatgtacaatcagcagttcata

SEQ ID NO: 9126998 - DNA, 22 bp, Homo sapiens
tatgtacacacacatgcatgta

SEQ ID NO: 9126999 - DNA, 22 bp, Homo sapiens
tatgtacataacatgaaatgca

SEQ ID NO: 9127000 - DNA, 22 bp, Homo sapiens
tagaaaggctgctgccaaccca

SEQ ID NO: 9127001 - DNA, 22 bp, Homo sapiens
tagaaaggcaatcattcttgga

SEQ ID NO: 9127002 - DNA, 22 bp, Homo sapiens
tagaaaggaacaggtcagcgtt

SEQ ID NO: 9127003 - DNA, 22 bp, Homo sapiens
tagaaaggaagctacttagggg

SEQ ID NO: 9127004 - DNA, 22 bp, Homo sapiens
tagaaaggcaagcgtgaaatat

SEQ ID NO: 9127005 - DNA, 22 bp, Homo sapiens
tagaaaggagcattttagacta

SEQ ID NO: 9127006 - DNA, 22 bp, Homo sapiens
tagaaaggatattgagatgaat

SEQ ID NO: 9127007 - DNA, 22 bp, Homo sapiens
tagggagatgcaagggacggag

SEQ ID NO: 9127008 - DNA, 22 bp, Homo sapiens
taggcaacatgtcgaatactgt

SEQ ID NO: 9127009 - DNA, 22 bp, Homo sapiens
tagccccagctactcggaagct

SEQ ID NO: 9127010 - DNA, 17 bp, Homo sapiens
tacaggagagcaggaac

SEQ ID NO: 9127011 - DNA, 22 bp, Homo sapiens
tacaggagcacaaaagagttga

SEQ ID NO: 9127012 - DNA, 22 bp, Homo sapiens
tacatagagaagttacagtgga

SEQ ID NO: 9127013 - DNA, 22 bp, Homo sapiens
tacaacaatttccacattagaa

SEQ ID NO: 9127014 - DNA, 22 bp, Homo sapiens
tacagagtatttttaatatggt

SEQ ID NO: 9127015 - DNA, 22 bp, Homo sapiens
taatagcattatcatcaaaact

SEQ ID NO: 9127016 - DNA, 22 bp, Homo sapiens
taatactgtgcttcattttcct

SEQ ID NO: 9127017 - DNA, 22 bp, Homo sapiens
gttaagaattcgttctcatgtt

SEQ ID NO: 9127018 - DNA, 22 bp, Homo sapiens
gttacaaaggaagcttcactgc

SEQ ID NO: 9127019 - DNA, 22 bp, Homo sapiens
gttcagtcacgtgcccaagttc

SEQ ID NO: 9127020 - DNA, 22 bp, Homo sapiens
gttgatatttgcagagtgtacc

SEQ ID NO: 9127021 - DNA, 22 bp, Homo sapiens
gtttcatatgcagttaacagca

SEQ ID NO: 9127022 - DNA, 22 bp, Homo sapiens
gtttcatatatagtaactgaaa

SEQ ID NO: 9127023 - DNA, 21 bp, Homo sapiens
gttttctttgatagagggaag

SEQ ID NO: 9127024 - DNA, 22 bp, Homo sapiens
gtttccatatttttagtgccaa

SEQ ID NO: 9127025 - DNA, 22 bp, Homo sapiens
gtttccatctccaggacataat

SEQ ID NO: 9127026 - DNA, 22 bp, Homo sapiens
gtttccatgaaaatgtttctgc

SEQ ID NO: 9127027 - DNA, 22 bp, Homo sapiens
gtttccatgcagtagagcttag

SEQ ID NO: 9127028 - DNA, 22 bp, Homo sapiens
gtttccattgtcctatctatag

SEQ ID NO: 9127029 - DNA, 22 bp, Homo sapiens
gtttccatggtgtttcttgggt

SEQ ID NO: 9127030 - DNA, 22 bp, Homo sapiens
gtttccatgggagaagacagtg

SEQ ID NO: 9127031 - DNA, 22 bp, Homo sapiens
gtttccatggctctgttaatgg

SEQ ID NO: 9127032 - DNA, 22 bp, Homo sapiens
gtttccatggaagcaaaggtgg

SEQ ID NO: 9127033 - DNA, 22 bp, Homo sapiens
gcccagctcctctgcagaccct

SEQ ID NO: 9127034 - DNA, 22 bp, Homo sapiens
gcccagcctccaagctccaagg

SEQ ID NO: 9127035 - DNA, 22 bp, Homo sapiens
gccccagcctgggaactggagg

SEQ ID NO: 9127036 - DNA, 22 bp, Homo sapiens
gccccagcgtggctgtgttagg

SEQ ID NO: 9127037 - DNA, 22 bp, Homo sapiens
gccccagctctgccacaactag

SEQ ID NO: 9127038 - DNA, 22 bp, Homo sapiens
gccccagaaggggaaagcctgg

SEQ ID NO: 9127039 - DNA, 22 bp, Homo sapiens
gccccagcagcaatgcggttga

SEQ ID NO: 9127040 - DNA, 22 bp, Homo sapiens
gccccagccaaggtgacacgaa

SEQ ID NO: 9127041 - DNA, 22 bp, Homo sapiens
gccccagccctgtggaccatgg

SEQ ID NO: 9127042 - DNA, 22 bp, Homo sapiens
gccccagcctagttttctttca

SEQ ID NO: 9127043 - DNA, 22 bp, Homo sapiens
gccccagcctcccgagtagctg

SEQ ID NO: 9127044 - DNA, 22 bp, Homo sapiens
gccagccctgggagacttatgg

SEQ ID NO: 9127045 - DNA, 22 bp, Homo sapiens
gccaccagtgggggcctgggca

SEQ ID NO: 9127046 - DNA, 18 bp, Homo sapiens
gccagccctccaacctcc

SEQ ID NO: 9127047 - DNA, 20 bp, Homo sapiens
gccagccctgacacaggagc

SEQ ID NO: 9127048 - DNA, 17 bp, Homo sapiens
gccagggagaggaagcc

SEQ ID NO: 9127049 - DNA, 22 bp, Homo sapiens
gccagggagtctgggccacaga

SEQ ID NO: 9127050 - DNA, 22 bp, Homo sapiens
gccaccaggagcccagtccaaa

SEQ ID NO: 9127051 - DNA, 22 bp, Homo sapiens
gccaccagggggctccagtgag

SEQ ID NO: 9127052 - DNA, 22 bp, Homo sapiens
gccaccagccccatgcgctgtg

SEQ ID NO: 9127053 - DNA, 22 bp, Homo sapiens
gccaccagcagaaaaggggcca

SEQ ID NO: 9127054 - DNA, 22 bp, Homo sapiens
gccaccagggggtgcaaggtcc

SEQ ID NO: 9127055 - DNA, 22 bp, Homo sapiens
gccaccaggttagatccagcct

SEQ ID NO: 9127056 - DNA, 22 bp, Homo sapiens
gccaccagtagctaacaacagt

SEQ ID NO: 9127057 - DNA, 22 bp, Homo sapiens
gccaccaggttctgggttaagc

SEQ ID NO: 9127058 - DNA, 22 bp, Homo sapiens
gcagccccaggagacgcccagg

SEQ ID NO: 9127059 - DNA, 18 bp, Homo sapiens
gcagcccctcttccttcc

SEQ ID NO: 9127060 - DNA, 22 bp, Homo sapiens
gcagggaccaaaagaggcagta

SEQ ID NO: 9127061 - DNA, 22 bp, Homo sapiens
gcaggcagaggtggaggagaca

SEQ ID NO: 9127062 - DNA, 22 bp, Homo sapiens
gcaggcagttatttagtagaat

SEQ ID NO: 9127063 - DNA, 22 bp, Homo sapiens
gctgaggctcctcgggaggaca

SEQ ID NO: 9127064 - DNA, 22 bp, Homo sapiens
gccttgggattcttggatgctc

SEQ ID NO: 9127065 - DNA, 22 bp, Homo sapiens
ggagagaaattgaggtagcaag

SEQ ID NO: 9127066 - DNA, 22 bp, Homo sapiens
ggagagaactggctccttctag

SEQ ID NO: 9127067 - DNA, 22 bp, Homo sapiens
ggagagaagggagaatttgttc

SEQ ID NO: 9127068 - DNA, 22 bp, Homo sapiens
ggagagagacctccatgcccag

SEQ ID NO: 9127069 - DNA, 22 bp, Homo sapiens
ggagagagagattgtgtttatt

SEQ ID NO: 9127070 - DNA, 22 bp, Homo sapiens
ggacccacagattcttcattct

SEQ ID NO: 9127071 - DNA, 21 bp, Homo sapiens
ggcaacagatattttgcttag

SEQ ID NO: 9127072 - DNA, 23 bp, Homo sapiens
ggagtgcaatggcgccatctcgg

SEQ ID NO: 9127073 - DNA, 22 bp, Homo sapiens
ggagtgcagtggctattaaccg

SEQ ID NO: 9127074 - DNA, 22 bp, Homo sapiens
ggcacagctcaggtcccagctc

SEQ ID NO: 9127075 - DNA, 22 bp, Homo sapiens
ggcacagctacttgctcactct

SEQ ID NO: 9127076 - DNA, 22 bp, Homo sapiens
ggcagaggagctggaaacatgg

SEQ ID NO: 9127077 - DNA, 22 bp, Homo sapiens
ggcaggcagaaaaatagaatat

SEQ ID NO: 9127078 - DNA, 22 bp, Homo sapiens
ggcaggcactgtgatagattct

SEQ ID NO: 9127079 - DNA, 22 bp, Homo sapiens
ggcaggcacatttgggggccgt

SEQ ID NO: 9127080 - DNA, 22 bp, Homo sapiens
ggcaggcacagtaatacatgtt

SEQ ID NO: 9127081 - DNA, 22 bp, Homo sapiens
ggcaggcaacggaccactagtc

SEQ ID NO: 9127082 - DNA, 22 bp, Homo sapiens
ggcaggcaatgaggatgggaag

SEQ ID NO: 9127083 - DNA, 22 bp, Homo sapiens
ggcagaggtagctggaaccagg

SEQ ID NO: 9127084 - DNA, 22 bp, Homo sapiens
ggcaggcagaggctgagacagg

SEQ ID NO: 9127085 - DNA, 22 bp, Homo sapiens
gggagagaattattgccagacc

SEQ ID NO: 9127086 - DNA, 22 bp, Homo sapiens
gggagagaagggcatgtacact

SEQ ID NO: 9127087 - DNA, 22 bp, Homo sapiens
gggagagaaattatagcaatga

SEQ ID NO: 9127088 - DNA, 22 bp, Homo sapiens
gggagagagaaaacgtggcgca

SEQ ID NO: 9127089 - DNA, 22 bp, Homo sapiens
gggagagagagctcatgttgaa

SEQ ID NO: 9127090 - DNA, 22 bp, Homo sapiens
gggagagatgctgattgccaat

SEQ ID NO: 9127091 - DNA, 17 bp, Homo sapiens
gggagatgaagggatat

SEQ ID NO: 9127092 - DNA, 22 bp, Homo sapiens
gggagatgaatcagaagtgatc

SEQ ID NO: 9127093 - DNA, 22 bp, Homo sapiens
ggctgctgcccacccctgcatg

SEQ ID NO: 9127094 - DNA, 22 bp, Homo sapiens
ggtctcaggtagggcctaggaa

SEQ ID NO: 9127095 - DNA, 22 bp, Homo sapiens
ggtgtgtggttttgatacagtc

SEQ ID NO: 9127096 - DNA, 22 bp, Homo sapiens
ggtgttgtacattctgtggatt

SEQ ID NO: 9127097 - DNA, 22 bp, Homo sapiens
gtgagagaaattggagggaatg

SEQ ID NO: 9127098 - DNA, 22 bp, Homo sapiens
gtgccaaagaacataaggctga

SEQ ID NO: 9127099 - DNA, 22 bp, Homo sapiens
gtccccagaaaggtgaggcagg

SEQ ID NO: 9127100 - DNA, 22 bp, Homo sapiens
ggtttattgttaataagtttga

SEQ ID NO: 9127101 - DNA, 22 bp, Homo sapiens
ctgggcagtttattcagttctg

SEQ ID NO: 9127102 - DNA, 22 bp, Homo sapiens
ctgggaggcactattcaggagg

SEQ ID NO: 9127103 - DNA, 19 bp, Homo sapiens
ctggccaggccaggggccc

SEQ ID NO: 9127104 - DNA, 23 bp, Homo sapiens
ctgttaaattccttaagagcagg

SEQ ID NO: 9127105 - DNA, 22 bp, Homo sapiens
ctgttacacggaccttcaaatc

SEQ ID NO: 9127106 - DNA, 22 bp, Homo sapiens
cttcagtgaatgttgagtaagg

SEQ ID NO: 9127107 - DNA, 22 bp, Homo sapiens
cttcctggcatgggtctcatga

SEQ ID NO: 9127108 - DNA, 22 bp, Homo sapiens
cttcctggctcggtgcctcacc

SEQ ID NO: 9127109 - DNA, 22 bp, Homo sapiens
cttgtctgtgtcggataaaact

SEQ ID NO: 9127110 - DNA, 21 bp, Homo sapiens
cttgtctgcagtgtttatagc

SEQ ID NO: 9127111 - DNA, 21 bp, Homo sapiens
cttgtcttgcttagaatagac

SEQ ID NO: 9127112 - DNA, 22 bp, Homo sapiens
gagaagggatatgccactctcg

SEQ ID NO: 9127113 - DNA, 22 bp, Homo sapiens
gacctcgtgatccgccctcctt

SEQ ID NO: 9127114 - DNA, 22 bp, Homo sapiens
gagaaggagctccttggggtct

SEQ ID NO: 9127115 - DNA, 22 bp, Homo sapiens
gagaaggaggcgaagcgtgtgc

SEQ ID NO: 9127116 - DNA, 22 bp, Homo sapiens
gagatggaaaactgctggtagt

SEQ ID NO: 9127117 - DNA, 22 bp, Homo sapiens
gagatggaatctgtgtggaggg

SEQ ID NO: 9127118 - DNA, 20 bp, Homo sapiens
gagatggacagatgaagggg

SEQ ID NO: 9127119 - DNA, 22 bp, Homo sapiens
gagatggagaaggaagctgttt

SEQ ID NO: 9127120 - DNA, 22 bp, Homo sapiens
gagatgttattcttcagtgtgt

SEQ ID NO: 9127121 - DNA, 22 bp, Homo sapiens
gagatgtttagatgtttgtcca

SEQ ID NO: 9127122 - DNA, 22 bp, Homo sapiens
gaggaggctatcagcaatcagg

SEQ ID NO: 9127123 - DNA, 22 bp, Homo sapiens
gaggaggcacttgagcagatgt

SEQ ID NO: 9127124 - DNA, 22 bp, Homo sapiens
gaggaggcagcctatcccttag

SEQ ID NO: 9127125 - DNA, 22 bp, Homo sapiens
gaggaggccagtggaaggaagc

SEQ ID NO: 9127126 - DNA, 22 bp, Homo sapiens
gaggaggctaagtgggctctgg

SEQ ID NO: 9127127 - DNA, 22 bp, Homo sapiens
gaggaggcactagttagtgaca

SEQ ID NO: 9127128 - DNA, 22 bp, Homo sapiens
gaggcagaagttgcagtgagca

SEQ ID NO: 9127129 - DNA, 22 bp, Homo sapiens
gagctgttcaaggacaggcacg

SEQ ID NO: 9127130 - DNA, 22 bp, Homo sapiens
gagctgtttgtgacaggctgtg

SEQ ID NO: 9127131 - DNA, 22 bp, Homo sapiens
gagctgttctgtgattgatcta

SEQ ID NO: 9127132 - DNA, 22 bp, Homo sapiens
gagctgttttttaaagttagga

SEQ ID NO: 9127133 - DNA, 22 bp, Homo sapiens
gagctgtttttccaaactattg

SEQ ID NO: 9127134 - DNA, 23 bp, Homo sapiens
gagctgtttgtgcagagagccct

SEQ ID NO: 9127135 - DNA, 22 bp, Homo sapiens
gaagcttggataactgtatggg

SEQ ID NO: 9127136 - DNA, 22 bp, Homo sapiens
gaagatgtgggcccactccaga

SEQ ID NO: 9127137 - DNA, 22 bp, Homo sapiens
gaagatgttatggagagctcag

SEQ ID NO: 9127138 - DNA, 22 bp, Homo sapiens
gaagatgtgggaactgctgaaa

SEQ ID NO: 9127139 - DNA, 22 bp, Homo sapiens
gaagatgtgcaatacaaagaaa

SEQ ID NO: 9127140 - DNA, 22 bp, Homo sapiens
gaagagaaaggcaaggagtttt

SEQ ID NO: 9127141 - DNA, 22 bp, Homo sapiens
cgcccagctgaaatctccaggc

SEQ ID NO: 9127142 - DNA, 21 bp, Homo sapiens
tgtgtatcttgctgtttccac

SEQ ID NO: 9127143 - DNA, 22 bp, Homo sapiens
tgtgtctgaacatgctttgtaa

SEQ ID NO: 9127144 - DNA, 22 bp, Homo sapiens
tgttacagaaagtttatgaatg

SEQ ID NO: 9127145 - DNA, 22 bp, Homo sapiens
tgttacaatattatcaactgag

SEQ ID NO: 9127146 - DNA, 22 bp, Homo sapiens
ttagaatcaggtgttataatca

SEQ ID NO: 9127147 - DNA, 22 bp, Homo sapiens
ttagaagtcatctagtctaaaa

SEQ ID NO: 9127148 - DNA, 19 bp, Homo sapiens
ccttccccttcagcctctg

SEQ ID NO: 9127149 - DNA, 22 bp, Homo sapiens
ctgaggcatgttacaggacata

SEQ ID NO: 9127150 - DNA, 22 bp, Homo sapiens
ctcccagagaccaagctgagaa

SEQ ID NO: 9127151 - DNA, 22 bp, Homo sapiens
ctctccaggcgaggtcctactg

SEQ ID NO: 9127152 - DNA, 23 bp, Homo sapiens
ctccccagtgtcctcatgcatct

SEQ ID NO: 9127153 - DNA, 20 bp, Homo sapiens
ccagtccctgagcaccaggg

SEQ ID NO: 9127154 - DNA, 22 bp, Homo sapiens
tgaggcagcattcttcaagaca

SEQ ID NO: 9127155 - DNA, 22 bp, Homo sapiens
tgaggcagcccactttccttag

SEQ ID NO: 9127156 - DNA, 22 bp, Homo sapiens
tgaggcagcctgcattaaagag

SEQ ID NO: 9127157 - DNA, 22 bp, Homo sapiens
tgaggtaggttgaaagatagat

SEQ ID NO: 9127158 - DNA, 22 bp, Homo sapiens
tgaggtagtgattgtagaagtg

SEQ ID NO: 9127159 - DNA, 22 bp, Homo sapiens
tgaggtaggtgtcgagagaggt

SEQ ID NO: 9127160 - DNA, 22 bp, Homo sapiens
tgaggtaggtggtaagagatac

SEQ ID NO: 9127161 - DNA, 22 bp, Homo sapiens
tgaggtcacctggaggcagcct

SEQ ID NO: 9127162 - DNA, 22 bp, Homo sapiens
tgaggtcaagcccagagcagca

SEQ ID NO: 9127163 - DNA, 22 bp, Homo sapiens
ccatgccccaatacaggacacc

SEQ ID NO: 9127164 - DNA, 22 bp, Homo sapiens
ccatgccctaaaggactggcag

SEQ ID NO: 9127165 - DNA, 20 bp, Homo sapiens
cccagaagtcacctccactc

SEQ ID NO: 9127166 - DNA, 22 bp, Homo sapiens
tgaggcagatatttattgggtt

SEQ ID NO: 9127167 - DNA, 22 bp, Homo sapiens
tgaggcagcaattgtattgtat

SEQ ID NO: 9127168 - DNA, 22 bp, Homo sapiens
tgaggcagcaattgattattca

SEQ ID NO: 9127169 - DNA, 22 bp, Homo sapiens
tgaggcagagtaagatacatga

SEQ ID NO: 9127170 - DNA, 22 bp, Homo sapiens
tgaggcagaaattcctgttttc

SEQ ID NO: 9127171 - DNA, 22 bp, Homo sapiens
tgaggcagaaaatagcagttca

SEQ ID NO: 9127172 - DNA, 22 bp, Homo sapiens
tcttcacattttaagaagttct

SEQ ID NO: 9127173 - DNA, 22 bp, Homo sapiens
tcttcacatggaacatgaagct

SEQ ID NO: 9127174 - DNA, 22 bp, Homo sapiens
ccaggagttggaagctgccatg

SEQ ID NO: 9127175 - DNA, 22 bp, Homo sapiens
ccaggcccagggtactgaccaa

SEQ ID NO: 9127176 - DNA, 22 bp, Homo sapiens
tggaatggaaacaaactgagga

SEQ ID NO: 9127177 - DNA, 22 bp, Homo sapiens
tgctgtgtaaaaggtgattgaa

SEQ ID NO: 9127178 - DNA, 22 bp, Homo sapiens
ccccaaagcctcagcctgcctg

SEQ ID NO: 9127179 - DNA, 22 bp, Homo sapiens
ccccaccaccaaggctcagttt

SEQ ID NO: 9127180 - DNA, 22 bp, Homo sapiens
ccccaccagcaccctctctatc

SEQ ID NO: 9127181 - DNA, 22 bp, Homo sapiens
ccccaccatgtagaaactgaga

SEQ ID NO: 9127182 - DNA, 22 bp, Homo sapiens
tgcccagccaatttgttatgtt

SEQ ID NO: 9127183 - DNA, 22 bp, Homo sapiens
tgcccagcctaaacttggcaag

SEQ ID NO: 9127184 - DNA, 22 bp, Homo sapiens
tgcccagctattcctttcttag

SEQ ID NO: 9127185 - DNA, 22 bp, Homo sapiens
tgcccagcgcccacattctgtc

SEQ ID NO: 9127186 - DNA, 22 bp, Homo sapiens
cccaggctggggctcctccagc

SEQ ID NO: 9127187 - DNA, 22 bp, Homo sapiens
caggcgagggccctgaggagcc

SEQ ID NO: 9127188 - DNA, 22 bp, Homo sapiens
caggcccacgaggcacacagag

SEQ ID NO: 9127189 - DNA, 22 bp, Homo sapiens
taatacaaggcaggaagcagta

SEQ ID NO: 9127190 - DNA, 22 bp, Homo sapiens
caggcagatgctgacaagagtt

SEQ ID NO: 9127191 - DNA, 22 bp, Homo sapiens
tcaacaaatacttaaagcagag

SEQ ID NO: 9127192 - DNA, 22 bp, Homo sapiens
taggcagggattagggttgatt

SEQ ID NO: 9127193 - DNA, 22 bp, Homo sapiens
taggaggctcatgttacaggaa

SEQ ID NO: 9127194 - DNA, 22 bp, Homo sapiens
cagggagatcttggctcctggt

SEQ ID NO: 9127195 - DNA, 22 bp, Homo sapiens
tcagagagtgcaaaatatagct

SEQ ID NO: 9127196 - DNA, 21 bp, Homo sapiens
tcagagagtcacagtgaactg

SEQ ID NO: 9127197 - DNA, 22 bp, Homo sapiens
tcagggagggacctgaggctgg

SEQ ID NO: 9127198 - DNA, 22 bp, Homo sapiens
tcagggagtgttggcaggatca

SEQ ID NO: 9127199 - DNA, 19 bp, Homo sapiens
tcagggagtttacagcatg

SEQ ID NO: 9127200 - DNA, 22 bp, Homo sapiens
catgaagatcctgtatgttttt

SEQ ID NO: 9127201 - DNA, 22 bp, Homo sapiens
ccagagaaccttgagctgtgag

SEQ ID NO: 9127202 - DNA, 22 bp, Homo sapiens
ccagagaattttagacaaaaat

SEQ ID NO: 9127203 - DNA, 22 bp, Homo sapiens
ccagagaagtcttgcctggatt

SEQ ID NO: 9127204 - DNA, 22 bp, Homo sapiens
ccagagacaaggagctggagtc

SEQ ID NO: 9127205 - DNA, 22 bp, Homo sapiens
ccacagaaagttgtctagagta

SEQ ID NO: 9127206 - DNA, 22 bp, Homo sapiens
tcccaccaggtgaccatttcat

SEQ ID NO: 9127207 - DNA, 22 bp, Homo sapiens
tccatttggcactctatttcca

SEQ ID NO: 9127208 - DNA, 22 bp, Homo sapiens
tttcttcattgacaaggaaaaa

SEQ ID NO: 9127209 - DNA, 22 bp, Homo sapiens
tttcttcccaagcagtttcaga

SEQ ID NO: 9127210 - DNA, 22 bp, Homo sapiens
tttatagttatatacagatgtt

SEQ ID NO: 9127211 - DNA, 22 bp, Homo sapiens
ttgcaagggcatgtgtgcgtgt

SEQ ID NO: 9127212 - DNA, 19 bp, Homo sapiens
ttgtgtgtcagtcagagtt

SEQ ID NO: 9127213 - DNA, 22 bp, Homo sapiens
ttttatatggcacattggttgg

SEQ ID NO: 9127214 - DNA, 22 bp, Homo sapiens
ttttatattgagtgagagttcc

SEQ ID NO: 9127215 - DNA, 22 bp, Homo sapiens
tttgtatgaactggtatgtagg

SEQ ID NO: 9127216 - DNA, 22 bp, Homo sapiens
tttgtatgtgataagactattc

SEQ ID NO: 9127217 - DNA, 22 bp, Homo sapiens
ttaacacatatttatcaattgc

SEQ ID NO: 9127218 - DNA, 22 bp, Homo sapiens
tgttttcttctgtaccgtgcca

SEQ ID NO: 9127219 - DNA, 22 bp, Homo sapiens
tgtttccaaagtcttttcttaa

SEQ ID NO: 9127220 - DNA, 22 bp, Homo sapiens
tgtttgcaaccccttgtgagaa

SEQ ID NO: 9127221 - DNA, 22 bp, Homo sapiens
tgtgtttcagaaccttctttca

SEQ ID NO: 9127222 - DNA, 22 bp, Homo sapiens
tcccccaggctggagtgcagtg

SEQ ID NO: 9127223 - DNA, 22 bp, Homo sapiens
tgtggcagctgctgcaggagct

SEQ ID NO: 9127224 - DNA, 22 bp, Homo sapiens
tgtggcagtctcactggagggc

SEQ ID NO: 9127225 - DNA, 22 bp, Homo sapiens
ttgaagatggtagcaatttcct

SEQ ID NO: 9127226 - DNA, 22 bp, Homo sapiens
ttgaggcacacacaggttgcat

SEQ ID NO: 9127227 - DNA, 22 bp, Homo sapiens
ttgaggcagggcatggtggccc

SEQ ID NO: 9127228 - DNA, 22 bp, Homo sapiens
ttccagagcccatgctctaggc

SEQ ID NO: 9127229 - DNA, 22 bp, Homo sapiens
ttccagagcctagaatcttgat

SEQ ID NO: 9127230 - DNA, 22 bp, Homo sapiens
ttccagagcagttttcagatca

SEQ ID NO: 9127231 - DNA, 21 bp, Homo sapiens
ttccagagattgtttcacctg

SEQ ID NO: 9127232 - DNA, 20 bp, Homo sapiens
ttccagagatctgcatttta

SEQ ID NO: 9127233 - DNA, 22 bp, Homo sapiens
ttccagagagttattcccctgg

SEQ ID NO: 9127234 - DNA, 22 bp, Homo sapiens
ttccagagaggctcatgttccc

SEQ ID NO: 9127235 - DNA, 22 bp, Homo sapiens
ttccagagaaaaggtttatttc

SEQ ID NO: 9127236 - DNA, 22 bp, Homo sapiens
ttccagagagagaaaatttgat

SEQ ID NO: 9127237 - DNA, 22 bp, Homo sapiens
ttcaacaagtagtacacacagt

SEQ ID NO: 9127238 - DNA, 18 bp, Homo sapiens
ttcaggtcagaaagatgg

SEQ ID NO: 9127239 - DNA, 22 bp, Homo sapiens
ttcagtctcatggatgtgaaat

SEQ ID NO: 9127240 - DNA, 22 bp, Homo sapiens
agggagaacagttgcagcagac

SEQ ID NO: 9127241 - DNA, 22 bp, Homo sapiens
agggagaacagttgcagcagac

SEQ ID NO: 9127242 - DNA, 22 bp, Homo sapiens
agggatgatcagggtagaggct

SEQ ID NO: 9127243 - DNA, 22 bp, Homo sapiens
agggaacatttgcactgttggt

SEQ ID NO: 9127244 - DNA, 20 bp, Homo sapiens
ccagctttccctgcagcatc

SEQ ID NO: 9127245 - DNA, 22 bp, Homo sapiens
ccagcagagcatggggaggaag

SEQ ID NO: 9127246 - DNA, 21 bp, Homo sapiens
aggcatggaaatggcacactg

SEQ ID NO: 9127247 - DNA, 22 bp, Homo sapiens
ccagagagtcgatgggggacac

SEQ ID NO: 9127248 - DNA, 22 bp, Homo sapiens
ccagagagtatcatggagagta

SEQ ID NO: 9127249 - DNA, 22 bp, Homo sapiens
ccagagagggcgccacctggag

SEQ ID NO: 9127250 - DNA, 22 bp, Homo sapiens
ccagagaaagtgaagcaaatgt

SEQ ID NO: 9127251 - DNA, 22 bp, Homo sapiens
aggcagggtgatgataatgatt

SEQ ID NO: 9127252 - DNA, 22 bp, Homo sapiens
aggcagggtcttgctatgttgc

SEQ ID NO: 9127253 - DNA, 22 bp, Homo sapiens
aggcaggggagctggaagggta

SEQ ID NO: 9127254 - DNA, 22 bp, Homo sapiens
ccagggagcccacaggacaatg

SEQ ID NO: 9127255 - DNA, 22 bp, Homo sapiens
cccagagatgtcctgagtgata

SEQ ID NO: 9127256 - DNA, 22 bp, Homo sapiens
aggacgtttcctggagagaatt

SEQ ID NO: 9127257 - DNA, 22 bp, Homo sapiens
aggatgttatctgtgcaggtgg

SEQ ID NO: 9127258 - DNA, 22 bp, Homo sapiens
caggaagagaacatggaggctg

SEQ ID NO: 9127259 - DNA, 22 bp, Homo sapiens
caggtgaggctgaacagatgaa

SEQ ID NO: 9127260 - DNA, 23 bp, Homo sapiens
ctacaagagcaagcatggacaag

SEQ ID NO: 9127261 - DNA, 22 bp, Homo sapiens
ctacaagaggaatggaggtctg

SEQ ID NO: 9127262 - DNA, 22 bp, Homo sapiens
aggtgaggtttgggaggtgtca

SEQ ID NO: 9127263 - DNA, 22 bp, Homo sapiens
aggtggagtgtgcagggagagc

SEQ ID NO: 9127264 - DNA, 23 bp, Homo sapiens
agggtgagcaagctatggagacc

SEQ ID NO: 9127265 - DNA, 22 bp, Homo sapiens
ctcttaaagcttccagtttcaa

SEQ ID NO: 9127266 - DNA, 22 bp, Homo sapiens
ctcttaaaaacttgatatattt

SEQ ID NO: 9127267 - DNA, 22 bp, Homo sapiens
ctcttaaaattacctttgcaaa

SEQ ID NO: 9127268 - DNA, 22 bp, Homo sapiens
ctcttaaagaatgttccagctg

SEQ ID NO: 9127269 - DNA, 22 bp, Homo sapiens
ctgaagccatgtgctcactggt

SEQ ID NO: 9127270 - DNA, 22 bp, Homo sapiens
ctgaagccagtttgctgccctt

SEQ ID NO: 9127271 - DNA, 22 bp, Homo sapiens
agtgtgtgcatgcattcgtgca

SEQ ID NO: 9127272 - DNA, 21 bp, Homo sapiens
agtgtgtgataggcaggaaga

SEQ ID NO: 9127273 - DNA, 21 bp, Homo sapiens
agtgtgtgtggaatgagaata

SEQ ID NO: 9127274 - DNA, 22 bp, Homo sapiens
agtttcatgagacagattttca

SEQ ID NO: 9127275 - DNA, 22 bp, Homo sapiens
agttttctttcgcaaaggtaca

SEQ ID NO: 9127276 - DNA, 20 bp, Homo sapiens
atacacattcatagaaaaat

SEQ ID NO: 9127277 - DNA, 22 bp, Homo sapiens
atagtacaagggaagagtgaag

SEQ ID NO: 9127278 - DNA, 22 bp, Homo sapiens
ctggagctgtcttcacaggcct

SEQ ID NO: 9127279 - DNA, 22 bp, Homo sapiens
caagcccccggcaagtgtgtat

SEQ ID NO: 9127280 - DNA, 22 bp, Homo sapiens
ggaagctgcagtcccccccaag

SEQ ID NO: 9127281 - DNA, 22 bp, Homo sapiens
ggaagctgccagtccaccagct

SEQ ID NO: 9127282 - DNA, 22 bp, Homo sapiens
ggagagaggctggccgtgatga

SEQ ID NO: 9127283 - DNA, 22 bp, Homo sapiens
ggagagaggagcccactgctgt

SEQ ID NO: 9127284 - DNA, 22 bp, Homo sapiens
cacatgaagattcaactggatg

SEQ ID NO: 9127285 - DNA, 18 bp, Homo sapiens
ggcagatgacaggagaga

SEQ ID NO: 9127286 - DNA, 22 bp, Homo sapiens
gtccagagaggcaggaggctac

SEQ ID NO: 9127287 - DNA, 22 bp, Homo sapiens
gtccagagagtaaagggggtaa

SEQ ID NO: 9127288 - DNA, 22 bp, Homo sapiens
gtccagagatggacgagcagat

SEQ ID NO: 9127289 - DNA, 22 bp, Homo sapiens
gtccagagccggaagagtgaca

SEQ ID NO: 9127290 - DNA, 22 bp, Homo sapiens
gtccagagggctgcaggatgct

SEQ ID NO: 9127291 - DNA, 22 bp, Homo sapiens
gtccagagctggcacactgtca

SEQ ID NO: 9127292 - DNA, 22 bp, Homo sapiens
gtccagagggtcaagtttcttg

SEQ ID NO: 9127293 - DNA, 22 bp, Homo sapiens
gtccagaggtccaggatcaagg

SEQ ID NO: 9127294 - DNA, 22 bp, Homo sapiens
gtccagagtattcaagtaactt

SEQ ID NO: 9127295 - DNA, 20 bp, Homo sapiens
gtccagagtaatgtgctgac

SEQ ID NO: 9127296 - DNA, 22 bp, Homo sapiens
gtccagagtagtcgagtattct

SEQ ID NO: 9127297 - DNA, 22 bp, Homo sapiens
gtccagagttagaaatgaatat

SEQ ID NO: 9127298 - DNA, 22 bp, Homo sapiens
gtaggcagtggttggaagagaa

SEQ ID NO: 9127299 - DNA, 22 bp, Homo sapiens
gtaggcaggtggaggagtgaag

SEQ ID NO: 9127300 - DNA, 22 bp, Homo sapiens
cagccctcctttcactcccagg

SEQ ID NO: 9127301 - DNA, 22 bp, Homo sapiens
cagccctctctgggccccaagg

SEQ ID NO: 9127302 - DNA, 22 bp, Homo sapiens
cagatgttgttcctgcctgtag

SEQ ID NO: 9127303 - DNA, 19 bp, Homo sapiens
cagatgttttcagttcatt

SEQ ID NO: 9127304 - DNA, 22 bp, Homo sapiens
cagatgtttgtctatatgcttt

SEQ ID NO: 9127305 - DNA, 22 bp, Homo sapiens
gggaggcatgtgttatccactt

SEQ ID NO: 9127306 - DNA, 22 bp, Homo sapiens
cagagacaacctggtagagaaa

SEQ ID NO: 9127307 - DNA, 22 bp, Homo sapiens
gggatgagagctgggacagaag

SEQ ID NO: 9127308 - DNA, 22 bp, Homo sapiens
atgaattgaggaaaacagtcgt

SEQ ID NO: 9127309 - DNA, 22 bp, Homo sapiens
ctttacagataggaactactca

SEQ ID NO: 9127310 - DNA, 22 bp, Homo sapiens
ctttacagcctccagaaggaac

SEQ ID NO: 9127311 - DNA, 22 bp, Homo sapiens
ctttacagcttagtggtatgga

SEQ ID NO: 9127312 - DNA, 22 bp, Homo sapiens
ctttacagtgctgctaatggct

SEQ ID NO: 9127313 - DNA, 22 bp, Homo sapiens
ctttacataaggataaacctgg

SEQ ID NO: 9127314 - DNA, 22 bp, Homo sapiens
ctttacaggaaaaggtggctgt

SEQ ID NO: 9127315 - DNA, 22 bp, Homo sapiens
ctttacagaataagaatactgg

SEQ ID NO: 9127316 - DNA, 22 bp, Homo sapiens
atctttctatttctaaaaacta

SEQ ID NO: 9127317 - DNA, 22 bp, Homo sapiens
gaagagagcagcaaactggagt

SEQ ID NO: 9127318 - DNA, 23 bp, Homo sapiens
atgatgtttttggtagtcaaatg

SEQ ID NO: 9127319 - DNA, 22 bp, Homo sapiens
gaagctgtgaacaagctacgtg

SEQ ID NO: 9127320 - DNA, 21 bp, Homo sapiens
atgggcagaggcagagaggct

SEQ ID NO: 9127321 - DNA, 22 bp, Homo sapiens
gagctgcatgcaactgtttaaa

SEQ ID NO: 9127322 - DNA, 22 bp, Homo sapiens
gagccccaccctagacattctg

SEQ ID NO: 9127323 - DNA, 22 bp, Homo sapiens
gagccccagccctgcttctata

SEQ ID NO: 9127324 - DNA, 22 bp, Homo sapiens
gagccccaggacagctctagtt

SEQ ID NO: 9127325 - DNA, 22 bp, Homo sapiens
atgggcagagctggtgggaggc

SEQ ID NO: 9127326 - DNA, 22 bp, Homo sapiens
atgttacggaatgtcaaggact

SEQ ID NO: 9127327 - DNA, 22 bp, Homo sapiens
gccagagtgccatcagtgccat

SEQ ID NO: 9127328 - DNA, 20 bp, Homo sapiens
gccagagttatgatgagagg

SEQ ID NO: 9127329 - DNA, 22 bp, Homo sapiens
gccagagttgaggcagtttatt

SEQ ID NO: 9127330 - DNA, 22 bp, Homo sapiens
gccagagtgatgtaacatatat

SEQ ID NO: 9127331 - DNA, 22 bp, Homo sapiens
gccagagtcttctgaccctgtg

SEQ ID NO: 9127332 - DNA, 21 bp, Homo sapiens
caaaagagactgattcttgga

SEQ ID NO: 9127333 - DNA, 22 bp, Homo sapiens
gctccccaaaagctccaggaaa

SEQ ID NO: 9127334 - DNA, 22 bp, Homo sapiens
gctccccagcttagccctggct

SEQ ID NO: 9127335 - DNA, 22 bp, Homo sapiens
caaagaagagatttacagagct

SEQ ID NO: 9127336 - DNA, 22 bp, Homo sapiens
caaagaatgagtgagtacataa

SEQ ID NO: 9127337 - DNA, 22 bp, Homo sapiens
gcatgcttttatatctgtttaa

SEQ ID NO: 9127338 - DNA, 22 bp, Homo sapiens
gcatggagaagtgggaacaggt

SEQ ID NO: 9127339 - DNA, 22 bp, Homo sapiens
gcatcatcacggtcaccgagcc

SEQ ID NO: 9127340 - DNA, 22 bp, Homo sapiens
gatgtgacaaaccaagaggact

SEQ ID NO: 9127341 - DNA, 22 bp, Homo sapiens
gatgtgaggtggtaaacaggga

SEQ ID NO: 9127342 - DNA, 22 bp, Homo sapiens
gcagagaaggattgaaaccaga

SEQ ID NO: 9127343 - DNA, 22 bp, Homo sapiens
gcagagaggaatgaagccatcc

SEQ ID NO: 9127344 - DNA, 22 bp, Homo sapiens
gcaccaggaggcccttctcatc

SEQ ID NO: 9127345 - DNA, 22 bp, Homo sapiens
aaaatgaataagttaacccagg

SEQ ID NO: 9127346 - DNA, 22 bp, Homo sapiens
aaacagagggccactgaggctc

SEQ ID NO: 9127347 - DNA, 22 bp, Homo sapiens
aaacagagagatgtatgtggag

SEQ ID NO: 9127348 - DNA, 22 bp, Homo sapiens
aaagaggaaccaagagcacgtg

SEQ ID NO: 9127349 - DNA, 22 bp, Homo sapiens
aaagaatgtctgaacagctggc

SEQ ID NO: 9127350 - DNA, 22 bp, Homo sapiens
aaagctgtagaatcatcttaat

SEQ ID NO: 9127351 - DNA, 22 bp, Homo sapiens
aaagctgttaaatgcataatgc

SEQ ID NO: 9127352 - DNA, 22 bp, Homo sapiens
aacagagtttcaaataacatct

SEQ ID NO: 9127353 - DNA, 21 bp, Homo sapiens
aacaaagggatgctcatcttt

SEQ ID NO: 9127354 - DNA, 22 bp, Homo sapiens
aacaccagtcccaagagaggct

SEQ ID NO: 9127355 - DNA, 19 bp, Homo sapiens
aacaccagagtcaggagtc

SEQ ID NO: 9127356 - DNA, 22 bp, Homo sapiens
aacagagtggagccaaactttg

SEQ ID NO: 9127357 - DNA, 21 bp, Homo sapiens
aactggttcaattcaactaga

SEQ ID NO: 9127358 - DNA, 22 bp, Homo sapiens
aaccagagagtcttcttcattg

SEQ ID NO: 9127359 - DNA, 18 bp, Homo sapiens
aagaagttggccaaagag

SEQ ID NO: 9127360 - DNA, 22 bp, Homo sapiens
aagaaagcattagacaggcatt

SEQ ID NO: 9127361 - DNA, 17 bp, Homo sapiens
aagagaggctgagctgg

SEQ ID NO: 9127362 - DNA, 22 bp, Homo sapiens
aagagagtcagtctgagcacca

SEQ ID NO: 9127363 - DNA, 22 bp, Homo sapiens
acaaggagagcacacatgggga

SEQ ID NO: 9127364 - DNA, 22 bp, Homo sapiens
acaaagatgtttaaagcattta

SEQ ID NO: 9127365 - DNA, 22 bp, Homo sapiens
acagaattaggagatcctcttg

SEQ ID NO: 9127366 - DNA, 22 bp, Homo sapiens
aagatgttgactcctttgatgt

SEQ ID NO: 9127367 - DNA, 22 bp, Homo sapiens
aagatgttctattttcactttt

SEQ ID NO: 9127368 - DNA, 22 bp, Homo sapiens
acagagtagctcaagaagattg

SEQ ID NO: 9127369 - DNA, 22 bp, Homo sapiens
acagagtagcagcactgtgctt

SEQ ID NO: 9127370 - DNA, 20 bp, Homo sapiens
acagagtagaacatatgcca

SEQ ID NO: 9127371 - DNA, 22 bp, Homo sapiens
acagagtacattcagagactat

SEQ ID NO: 9127372 - DNA, 23 bp, Homo sapiens
acagagtacagtgtgcttagtgg

SEQ ID NO: 9127373 - DNA, 22 bp, Homo sapiens
acagagtacagacaaaggtcag

SEQ ID NO: 9127374 - DNA, 22 bp, Homo sapiens
acagagtaaatccaagaacgct

SEQ ID NO: 9127375 - DNA, 22 bp, Homo sapiens
acagagtattggaaaggcagtg

SEQ ID NO: 9127376 - DNA, 16 bp, Homo sapiens
acagagtatcaagcga

SEQ ID NO: 9127377 - DNA, 22 bp, Homo sapiens
acagagtatctatcaggagtat

SEQ ID NO: 9127378 - DNA, 22 bp, Homo sapiens
acagagtaggtgctgtcgactg

SEQ ID NO: 9127379 - DNA, 21 bp, Homo sapiens
acagagtagttgaaacagaga

SEQ ID NO: 9127380 - DNA, 22 bp, Homo sapiens
acagagtaggtgctcagtaaat

SEQ ID NO: 9127381 - DNA, 22 bp, Homo sapiens
acagaattctctctgcagaggc

SEQ ID NO: 9127382 - DNA, 22 bp, Homo sapiens
acagaattgatggaaatctcag

SEQ ID NO: 9127383 - DNA, 22 bp, Homo sapiens
acagaattggggttcttgggga

SEQ ID NO: 9127384 - DNA, 22 bp, Homo sapiens
acaaaattgtgttaaactttat

SEQ ID NO: 9127385 - DNA, 22 bp, Homo sapiens
acaaaatttttagacaaggctt

SEQ ID NO: 9127386 - DNA, 22 bp, Homo sapiens
acagagagggagtgataaatcc

SEQ ID NO: 9127387 - DNA, 22 bp, Homo sapiens
agcccagctgctatgtacctgg

SEQ ID NO: 9127388 - DNA, 22 bp, Homo sapiens
acagagtcattcattgtccagt

SEQ ID NO: 9127389 - DNA, 22 bp, Homo sapiens
acagaaagataggcacaaggtc

SEQ ID NO: 9127390 - DNA, 22 bp, Homo sapiens
acagaaattgctaatagctcat

SEQ ID NO: 9127391 - DNA, 22 bp, Homo sapiens
aagtttatgttggtaagatatc

SEQ ID NO: 9127392 - DNA, 22 bp, Homo sapiens
aagtttattaattgacttgtgc

SEQ ID NO: 9127393 - DNA, 22 bp, Homo sapiens
aagtttatgttctttgaaggca

SEQ ID NO: 9127394 - DNA, 22 bp, Homo sapiens
agaaaacataggagacaggaaa

SEQ ID NO: 9127395 - DNA, 22 bp, Homo sapiens
agaaaacattacataggtgtgt

SEQ ID NO: 9127396 - DNA, 22 bp, Homo sapiens
aaggcagtggttgggtggagga

SEQ ID NO: 9127397 - DNA, 22 bp, Homo sapiens
aaggcaggtattgatgccacag

SEQ ID NO: 9127398 - DNA, 22 bp, Homo sapiens
aaggaaagacatataaatgact

SEQ ID NO: 9127399 - DNA, 22 bp, Homo sapiens
aaggaaagctgtggttctgaga

SEQ ID NO: 9127400 - DNA, 22 bp, Homo sapiens
acagtaccaggccaaaccatga

SEQ ID NO: 9127401 - DNA, 22 bp, Homo sapiens
accatgagttatttgacaggcc

SEQ ID NO: 9127402 - DNA, 19 bp, Homo sapiens
acccagcccaggagtggca

SEQ ID NO: 9127403 - DNA, 22 bp, Homo sapiens
acccagcctacaaagctcacct

SEQ ID NO: 9127404 - DNA, 22 bp, Homo sapiens
acccagccatgttcagttctct

SEQ ID NO: 9127405 - DNA, 19 bp, Homo sapiens
agggagaattccaagagga

SEQ ID NO: 9127406 - DNA, 22 bp, Homo sapiens
accagccccaccgggactgcag

SEQ ID NO: 9127407 - DNA, 19 bp, Homo sapiens
accagcccactcccagttt

SEQ ID NO: 9127408 - DNA, 22 bp, Homo sapiens
accagccctcaggtcagatact

SEQ ID NO: 9127409 - DNA, 22 bp, Homo sapiens
agggagaggagggtcttgttga

SEQ ID NO: 9127410 - DNA, 22 bp, Homo sapiens
agggagaggagcgtttcacatc

SEQ ID NO: 9127411 - DNA, 16 bp, Homo sapiens
agggagagaggaacat

SEQ ID NO: 9127412 - DNA, 18 bp, Homo sapiens
agggagagaccgcgggtc

SEQ ID NO: 9127413 - DNA, 22 bp, Homo sapiens
agggagagacatttccttcttg

SEQ ID NO: 9127414 - DNA, 22 bp, Homo sapiens
agggagagaagttatacaagat

SEQ ID NO: 9127415 - DNA, 22 bp, Homo sapiens
acatttcttgatgcctctgtga

SEQ ID NO: 9127416 - DNA, 22 bp, Homo sapiens
acatttctatagtgcatctgtt

SEQ ID NO: 9127417 - DNA, 22 bp, Homo sapiens
acatttctagttgttcatctcc

SEQ ID NO: 9127418 - DNA, 22 bp, Homo sapiens
aggagattgtggtgcaaggaat

SEQ ID NO: 9127419 - DNA, 22 bp, Homo sapiens
aggagatggagctcagtgggca

SEQ ID NO: 9127420 - DNA, 22 bp, Homo sapiens
acttcttcttcagctgggggat

SEQ ID NO: 9127421 - DNA, 22 bp, Homo sapiens
atcatccagtttttcagcctct

SEQ ID NO: 9127422 - DNA, 22 bp, Homo sapiens
actttccacaccattttgtggt

SEQ ID NO: 9127423 - DNA, 22 bp, Homo sapiens
agtcaaagatgaccgagttcct

SEQ ID NO: 9127424 - DNA, 22 bp, Homo sapiens
actcaggctacaacgcgtggct

SEQ ID NO: 9127425 - DNA, 22 bp, Homo sapiens
acctgccagctgagaagggtgt

SEQ ID NO: 9127426 - DNA, 22 bp, Homo sapiens
acctgccagtgaatactatctt

SEQ ID NO: 9127427 - DNA, 21 bp, Homo sapiens
agtgtgtgataggcaggaaga

SEQ ID NO: 9127428 - DNA, 22 bp, Homo sapiens
agcccagcccgggctgcgcttt

SEQ ID NO: 9127429 - DNA, 22 bp, Homo sapiens
cagaggagttcagtacacagcc

SEQ ID NO: 9127430 - DNA, 22 bp, Homo sapiens
cagagaaaaaatcctgctctca

SEQ ID NO: 9127431 - DNA, 22 bp, Homo sapiens
cagagaaactcagatagctgat

SEQ ID NO: 9127432 - DNA, 22 bp, Homo sapiens
cagagaaagaagcccattcatt

SEQ ID NO: 9127433 - DNA, 22 bp, Homo sapiens
cagagaaagacttgcccttagt

SEQ ID NO: 9127434 - DNA, 22 bp, Homo sapiens
cagagaaagggtgaattccttc

SEQ ID NO: 9127435 - DNA, 22 bp, Homo sapiens
agcccaagctatgaggtgacct

SEQ ID NO: 9127436 - DNA, 22 bp, Homo sapiens
agcccagcactgggggcccagc

SEQ ID NO: 9127437 - DNA, 23 bp, Homo sapiens
agcccagcagagaacctaggtcc

SEQ ID NO: 9127438 - DNA, 22 bp, Homo sapiens
cagccccagcacttagctgagt

SEQ ID NO: 9127439 - DNA, 22 bp, Homo sapiens
cactgcttatgtctccttttca

SEQ ID NO: 9127440 - DNA, 22 bp, Homo sapiens
cactgcttctggaggaatttgg

SEQ ID NO: 9127441 - DNA, 22 bp, Homo sapiens
agcaggcaagcgtgagttctct

SEQ ID NO: 9127442 - DNA, 21 bp, Homo sapiens
agcaggcaaaggtgaagtctt

SEQ ID NO: 9127443 - DNA, 22 bp, Homo sapiens
agcaccaggcaccaaagggcct

SEQ ID NO: 9127444 - DNA, 22 bp, Homo sapiens
caacagagagaccagaaacagg

SEQ ID NO: 9127445 - DNA, 22 bp, Homo sapiens
caacagagggaatggatctcat

SEQ ID NO: 9127446 - DNA, 20 bp, Homo sapiens
caacagaggggtctggagta

SEQ ID NO: 9127447 - DNA, 22 bp, Homo sapiens
caacagagcagttgatcaggaa

SEQ ID NO: 9127448 - DNA, 22 bp, Homo sapiens
caacagaggagtggcctgatcc

SEQ ID NO: 9127449 - DNA, 22 bp, Homo sapiens
agagaagagtcttgtcaaatta

SEQ ID NO: 9127450 - DNA, 22 bp, Homo sapiens
agagaagattcttatatgtctt

SEQ ID NO: 9127451 - DNA, 22 bp, Homo sapiens
agacccacactttgagtagcaa

SEQ ID NO: 9127452 - DNA, 22 bp, Homo sapiens
agagaagagcaatgataaattt

SEQ ID NO: 9127453 - DNA, 21 bp, Homo sapiens
agagaagaggactttctcaca

SEQ ID NO: 9127454 - DNA, 22 bp, Homo sapiens
agaggaggctctgggatcgtcc

SEQ ID NO: 9127455 - DNA, 22 bp, Homo sapiens
agaggaggccaggcccacacct

SEQ ID NO: 9127456 - DNA, 22 bp, Homo sapiens
agaggaggcagcttaactcagt

SEQ ID NO: 9127457 - DNA, 22 bp, Homo sapiens
agaggaggatttgtaaaggtct

SEQ ID NO: 9127458 - DNA, 20 bp, Homo sapiens
agaggaggattattttattc

SEQ ID NO: 9127459 - DNA, 22 bp, Homo sapiens
agaggaggaagagctttaaaat

SEQ ID NO: 9127460 - DNA, 22 bp, Homo sapiens
attcatttgctattgtgtatgg

SEQ ID NO: 9127461 - DNA, 22 bp, Homo sapiens
atttgtgggactataatgcagg

SEQ ID NO: 9127462 - DNA, 22 bp, Homo sapiens
gcccacagaggcaccaccaggc

SEQ ID NO: 9127463 - DNA, 22 bp, Homo sapiens
gccagagaatgaaaatcagatt

SEQ ID NO: 9127464 - DNA, 22 bp, Homo sapiens
gccagagacacttggaggtaga

SEQ ID NO: 9127465 - DNA, 22 bp, Homo sapiens
gagtatgatgggatgacaggag

SEQ ID NO: 9127466 - DNA, 22 bp, Homo sapiens
gagtataatgattttcattcac

SEQ ID NO: 9127467 - DNA, 22 bp, Homo sapiens
gagtataagctttttcacttca

SEQ ID NO: 9127468 - DNA, 22 bp, Homo sapiens
gagtataagtaatttcaagcaa

SEQ ID NO: 9127469 - DNA, 22 bp, Homo sapiens
gcaaggagcctggaggtgagtg

SEQ ID NO: 9127470 - DNA, 22 bp, Homo sapiens
gcaaggaggctggtggaggaag

SEQ ID NO: 9127471 - DNA, 22 bp, Homo sapiens
gcagagtatgagcatggcttta

SEQ ID NO: 9127472 - DNA, 22 bp, Homo sapiens
gcagggtgtgtctcatacagtt

SEQ ID NO: 9127473 - DNA, 22 bp, Homo sapiens
gcaggtgaaagtgagtagtgag

SEQ ID NO: 9127474 - DNA, 22 bp, Homo sapiens
gctagggactagggaaggagca

SEQ ID NO: 9127475 - DNA, 22 bp, Homo sapiens
gctatacaagtgtagaatagag

SEQ ID NO: 9127476 - DNA, 22 bp, Homo sapiens
gctcagggccatggaccagcag

SEQ ID NO: 9127477 - DNA, 22 bp, Homo sapiens
gctccccaggctggtcccctcg

SEQ ID NO: 9127478 - DNA, 22 bp, Homo sapiens
gctccccattgatctgcaggct

SEQ ID NO: 9127479 - DNA, 22 bp, Homo sapiens
gctctctgtcgttatgcttcat

SEQ ID NO: 9127480 - DNA, 22 bp, Homo sapiens
gctctctggaaggtatcattat

SEQ ID NO: 9127481 - DNA, 18 bp, Homo sapiens
ggagaagaacagatgtgg

SEQ ID NO: 9127482 - DNA, 18 bp, Homo sapiens
ggagaagaacagatgtgg

SEQ ID NO: 9127483 - DNA, 22 bp, Homo sapiens
ggagaagaggagctggaagcct

SEQ ID NO: 9127484 - DNA, 22 bp, Homo sapiens
ggagaaagggactgatctgctc

SEQ ID NO: 9127485 - DNA, 22 bp, Homo sapiens
ggagaaagtacagcaggcaaca

SEQ ID NO: 9127486 - DNA, 22 bp, Homo sapiens
ggagaaagtcagctccaagcag

SEQ ID NO: 9127487 - DNA, 22 bp, Homo sapiens
ggagaaagtacagcaggcaaca

SEQ ID NO: 9127488 - DNA, 21 bp, Homo sapiens
ggaggaaaaaggaatgacttg

SEQ ID NO: 9127489 - DNA, 22 bp, Homo sapiens
ggaaaaacagtctttattattt

SEQ ID NO: 9127490 - DNA, 23 bp, Homo sapiens
ggaaaaacactgtgtcttggcag

SEQ ID NO: 9127491 - DNA, 22 bp, Homo sapiens
ggacagagggttgacagagtat

SEQ ID NO: 9127492 - DNA, 22 bp, Homo sapiens
ggagaaagaaatttttgattgg

SEQ ID NO: 9127493 - DNA, 22 bp, Homo sapiens
ggagaaagaagacgaacattgt

SEQ ID NO: 9127494 - DNA, 22 bp, Homo sapiens
ggagaaaggcatagcagaacct

SEQ ID NO: 9127495 - DNA, 22 bp, Homo sapiens
ggagaaaggataggaatgtgct

SEQ ID NO: 9127496 - DNA, 22 bp, Homo sapiens
ggagaaagctgtagtggaatgt

SEQ ID NO: 9127497 - DNA, 22 bp, Homo sapiens
ggagaaagctatgtgggggagt

SEQ ID NO: 9127498 - DNA, 22 bp, Homo sapiens
gctttacatgagatgaggacaa

SEQ ID NO: 9127499 - DNA, 22 bp, Homo sapiens
gctgtttctccaggtcaggaag

SEQ ID NO: 9127500 - DNA, 22 bp, Homo sapiens
gctgtttccagttacgtggata

SEQ ID NO: 9127501 - DNA, 22 bp, Homo sapiens
gctgtttaattcaccattcaac

SEQ ID NO: 9127502 - DNA, 22 bp, Homo sapiens
gctgtttagatccacactgttg

SEQ ID NO: 9127503 - DNA, 22 bp, Homo sapiens
gcttttgtcatggtgactcagt

SEQ ID NO: 9127504 - DNA, 22 bp, Homo sapiens
gcttttgtggctgtcttcattg

SEQ ID NO: 9127505 - DNA, 22 bp, Homo sapiens
gcttttgtcattcaaatgctct

SEQ ID NO: 9127506 - DNA, 22 bp, Homo sapiens
gctttacattttggaaaggtga

SEQ ID NO: 9127507 - DNA, 22 bp, Homo sapiens
ggtgagaggcctgagagctgga

SEQ ID NO: 9127508 - DNA, 22 bp, Homo sapiens
gtgaggaagtggtcaggcatcc

SEQ ID NO: 9127509 - DNA, 22 bp, Homo sapiens
gtgaggaagtctgagagccaca

SEQ ID NO: 9127510 - DNA, 22 bp, Homo sapiens
gtgaggatgtactgagataaat

SEQ ID NO: 9127511 - DNA, 22 bp, Homo sapiens
gtgccagatgctgctttgtttt

SEQ ID NO: 9127512 - DNA, 22 bp, Homo sapiens
gtgccagagtttgaggacaatt

SEQ ID NO: 9127513 - DNA, 19 bp, Homo sapiens
gtacaagaatgactgagca

SEQ ID NO: 9127514 - DNA, 22 bp, Homo sapiens
gtcaaagatcctatgagttaaa

SEQ ID NO: 9127515 - DNA, 22 bp, Homo sapiens
gtccagagaagtcattacttca

SEQ ID NO: 9127516 - DNA, 22 bp, Homo sapiens
gtccagagaagggaggggactc

SEQ ID NO: 9127517 - DNA, 21 bp, Homo sapiens
gtccagagagccggctcctga

SEQ ID NO: 9127518 - DNA, 22 bp, Homo sapiens
gtccagagagatcttctgatag

SEQ ID NO: 9127519 - DNA, 22 bp, Homo sapiens
ggcccagcgaggccacctacag

SEQ ID NO: 9127520 - DNA, 22 bp, Homo sapiens
ggcccagctgtgcttccagccc

SEQ ID NO: 9127521 - DNA, 22 bp, Homo sapiens
ggcccagctttcattccttgct

SEQ ID NO: 9127522 - DNA, 22 bp, Homo sapiens
ggaggcaaagcactttgcttgg

SEQ ID NO: 9127523 - DNA, 17 bp, Homo sapiens
ggaggcaacagacaggg

SEQ ID NO: 9127524 - DNA, 22 bp, Homo sapiens
ggaggcaacacagggtgtgttt

SEQ ID NO: 9127525 - DNA, 22 bp, Homo sapiens
ggaggcaacatgcttgtttcta

SEQ ID NO: 9127526 - DNA, 22 bp, Homo sapiens
ggaggcacccttcattgagttt

SEQ ID NO: 9127527 - DNA, 22 bp, Homo sapiens
ggcagtgagtcccggagaggcc

SEQ ID NO: 9127528 - DNA, 22 bp, Homo sapiens
ggcagggaaacagctgatccca

SEQ ID NO: 9127529 - DNA, 22 bp, Homo sapiens
ggcagggacaggatagggtttt

SEQ ID NO: 9127530 - DNA, 22 bp, Homo sapiens
ggcagggaagctggcatcacgg

SEQ ID NO: 9127531 - DNA, 22 bp, Homo sapiens
ggcagggactatgtttcatgga

SEQ ID NO: 9127532 - DNA, 22 bp, Homo sapiens
ggcagggactttgcaaatcttt

SEQ ID NO: 9127533 - DNA, 22 bp, Homo sapiens
ggcagggagagcatgctgataa

SEQ ID NO: 9127534 - DNA, 18 bp, Homo sapiens
ggcagggaaaagataggg

SEQ ID NO: 9127535 - DNA, 22 bp, Homo sapiens
ggcaggcttggtggcaccggtt

SEQ ID NO: 9127536 - DNA, 22 bp, Homo sapiens
gggcagagactcagaaacagaa

SEQ ID NO: 9127537 - DNA, 22 bp, Homo sapiens
gggaagatagtgttgagggccc

SEQ ID NO: 9127538 - DNA, 22 bp, Homo sapiens
gggagatggctcagaggccgcg

SEQ ID NO: 9127539 - DNA, 22 bp, Homo sapiens
tcaaactgtttacagtgagata

SEQ ID NO: 9127540 - DNA, 22 bp, Homo sapiens
tcaaactggcagacttctactt

SEQ ID NO: 9127541 - DNA, 22 bp, Homo sapiens
tcaaactgaattaaacacttgt

SEQ ID NO: 9127542 - DNA, 22 bp, Homo sapiens
tcaaactgaactaagatccaac

SEQ ID NO: 9127543 - DNA, 22 bp, Homo sapiens
tcaaactgttagatttcagctc

SEQ ID NO: 9127544 - DNA, 22 bp, Homo sapiens
tcaaagatagatgttgagaaat

SEQ ID NO: 9127545 - DNA, 22 bp, Homo sapiens
tcaaagatcagatggttgtagg

SEQ ID NO: 9127546 - DNA, 22 bp, Homo sapiens
tcaaagattgaaactaaggaga

SEQ ID NO: 9127547 - DNA, 22 bp, Homo sapiens
tcaaagatgatgctgaagttat

SEQ ID NO: 9127548 - DNA, 22 bp, Homo sapiens
tcaaagatgggttttgtttgat

SEQ ID NO: 9127549 - DNA, 22 bp, Homo sapiens
tatgtataaatgcatgtgtgga

SEQ ID NO: 9127550 - DNA, 22 bp, Homo sapiens
tatgtataatcacagagtgtca

SEQ ID NO: 9127551 - DNA, 22 bp, Homo sapiens
tatgtatatgtgtgttgacaac

SEQ ID NO: 9127552 - DNA, 22 bp, Homo sapiens
tatgtacatacatgtgcatacg

SEQ ID NO: 9127553 - DNA, 22 bp, Homo sapiens
tatcactacacctggctaatta

SEQ ID NO: 9127554 - DNA, 20 bp, Homo sapiens
tatgaagatatgtgaacagc

SEQ ID NO: 9127555 - DNA, 22 bp, Homo sapiens
tatgaagattgcggtctggaat

SEQ ID NO: 9127556 - DNA, 22 bp, Homo sapiens
taggcaggctgaatgtagattt

SEQ ID NO: 9127557 - DNA, 22 bp, Homo sapiens
tagagaaaaccactggtgagct

SEQ ID NO: 9127558 - DNA, 21 bp, Homo sapiens
tagagaaaagaagctgttcct

SEQ ID NO: 9127559 - DNA, 22 bp, Homo sapiens
tagagaaataagctttgccttg

SEQ ID NO: 9127560 - DNA, 22 bp, Homo sapiens
tagagaaacagaaccaacaggg

SEQ ID NO: 9127561 - DNA, 23 bp, Homo sapiens
tagagaaagccaccgagtctctc

SEQ ID NO: 9127562 - DNA, 22 bp, Homo sapiens
tagagaaaagcagggatcagga

SEQ ID NO: 9127563 - DNA, 21 bp, Homo sapiens
tagaactgacgatttcagagt

SEQ ID NO: 9127564 - DNA, 22 bp, Homo sapiens
tacagagtaatttgcatgggga

SEQ ID NO: 9127565 - DNA, 22 bp, Homo sapiens
tacaagaggatgtggacatgga

SEQ ID NO: 9127566 - DNA, 22 bp, Homo sapiens
taaagatgctatagtgaaggag

SEQ ID NO: 9127567 - DNA, 22 bp, Homo sapiens
taaaactgaatacatactgagg

SEQ ID NO: 9127568 - DNA, 22 bp, Homo sapiens
gtttatattcaacggagtatct

SEQ ID NO: 9127569 - DNA, 21 bp, Homo sapiens
gttcttcctgactagagtagt

SEQ ID NO: 9127570 - DNA, 23 bp, Homo sapiens
tcaacagagcagagggaggcttt

SEQ ID NO: 9127571 - DNA, 18 bp, Homo sapiens
tcatagaagtgaatcaga

SEQ ID NO: 9127572 - DNA, 22 bp, Homo sapiens
tcatagaagtagtatccacatt

SEQ ID NO: 9127573 - DNA, 22 bp, Homo sapiens
tccaagttctaggaactgctgc

SEQ ID NO: 9127574 - DNA, 22 bp, Homo sapiens
tcccagagcagtactccaggag

SEQ ID NO: 9127575 - DNA, 22 bp, Homo sapiens
gaggtgagtggatcacgaggtc

SEQ ID NO: 9127576 - DNA, 22 bp, Homo sapiens
gaggtgagaagggggtcagatg

SEQ ID NO: 9127577 - DNA, 22 bp, Homo sapiens
gaggtggaaggcaggaacaaat

SEQ ID NO: 9127578 - DNA, 22 bp, Homo sapiens
gaggtggaggggaaaaatagat

SEQ ID NO: 9127579 - DNA, 22 bp, Homo sapiens
gaggcgagaagctggagatggt

SEQ ID NO: 9127580 - DNA, 19 bp, Homo sapiens
gagcaggccacacatgtgt

SEQ ID NO: 9127581 - DNA, 22 bp, Homo sapiens
gagctggtgtgtgcccaagcac

SEQ ID NO: 9127582 - DNA, 22 bp, Homo sapiens
gaggaggtggagtcatgcagag

SEQ ID NO: 9127583 - DNA, 22 bp, Homo sapiens
gaggcaacattgagcttctgta

SEQ ID NO: 9127584 - DNA, 22 bp, Homo sapiens
gaggcaactgcttttcctcctt

SEQ ID NO: 9127585 - DNA, 22 bp, Homo sapiens
gaggcaacacatttggaaagca

SEQ ID NO: 9127586 - DNA, 22 bp, Homo sapiens
gaggcaactggaacactggtca

SEQ ID NO: 9127587 - DNA, 22 bp, Homo sapiens
gaggcaacttcctgtcctctcc

SEQ ID NO: 9127588 - DNA, 22 bp, Homo sapiens
gaggcaacaatgatggtgtgta

SEQ ID NO: 9127589 - DNA, 22 bp, Homo sapiens
gagcagagcttctcaaagtaaa

SEQ ID NO: 9127590 - DNA, 22 bp, Homo sapiens
gagaggagttactatttccgag

SEQ ID NO: 9127591 - DNA, 22 bp, Homo sapiens
gagcaaagcttttagggccttt

SEQ ID NO: 9127592 - DNA, 22 bp, Homo sapiens
gagcaacacgcagtagtatacg

SEQ ID NO: 9127593 - DNA, 22 bp, Homo sapiens
gagaggagacttatccagattg

SEQ ID NO: 9127594 - DNA, 22 bp, Homo sapiens
gagaggagaagcctgcgcttca

SEQ ID NO: 9127595 - DNA, 22 bp, Homo sapiens
gagaggagtagacactttggtt

SEQ ID NO: 9127596 - DNA, 22 bp, Homo sapiens
gagaggagtccctatcacagtt

SEQ ID NO: 9127597 - DNA, 22 bp, Homo sapiens
gagaggagtccctatcacagtt

SEQ ID NO: 9127598 - DNA, 22 bp, Homo sapiens
gagaggagtaggctgatggtgc

SEQ ID NO: 9127599 - DNA, 22 bp, Homo sapiens
gagaggaggtggctatgacagc

SEQ ID NO: 9127600 - DNA, 18 bp, Homo sapiens
gagaggagccagaatttt

SEQ ID NO: 9127601 - DNA, 22 bp, Homo sapiens
gagagagaaccccgtgcccttc

SEQ ID NO: 9127602 - DNA, 22 bp, Homo sapiens
gagagagaaaatgactccggac

SEQ ID NO: 9127603 - DNA, 22 bp, Homo sapiens
gagagcaggaggcagcgggacg

SEQ ID NO: 9127604 - DNA, 22 bp, Homo sapiens
gagaagaacttgggcaaagtca

SEQ ID NO: 9127605 - DNA, 22 bp, Homo sapiens
gagaacattgggaaagctagac

SEQ ID NO: 9127606 - DNA, 22 bp, Homo sapiens
gagaacatgtttagtgacagtc

SEQ ID NO: 9127607 - DNA, 22 bp, Homo sapiens
gagaaagggaacttacagagtg

SEQ ID NO: 9127608 - DNA, 22 bp, Homo sapiens
gagaaagggaacttacagagtg

SEQ ID NO: 9127609 - DNA, 22 bp, Homo sapiens
gagagaagaaagccatggtcct

SEQ ID NO: 9127610 - DNA, 22 bp, Homo sapiens
gagagaagaacaatgtcattca

SEQ ID NO: 9127611 - DNA, 22 bp, Homo sapiens
gaagaagtgtaagtctgtttca

SEQ ID NO: 9127612 - DNA, 22 bp, Homo sapiens
gaattaactggcagttagtgct

SEQ ID NO: 9127613 - DNA, 22 bp, Homo sapiens
gaccttcttgctgtgtcctaac

SEQ ID NO: 9127614 - DNA, 22 bp, Homo sapiens
gaccttctgttggaggcattta

SEQ ID NO: 9127615 - DNA, 22 bp, Homo sapiens
ctgttaaatgagaaagcagact

SEQ ID NO: 9127616 - DNA, 22 bp, Homo sapiens
cttccctgataagagcctcaga

SEQ ID NO: 9127617 - DNA, 20 bp, Homo sapiens
cttcttcagtagtttgttct

SEQ ID NO: 9127618 - DNA, 22 bp, Homo sapiens
cttggaggtggaagttgcagtg

SEQ ID NO: 9127619 - DNA, 22 bp, Homo sapiens
cttggaggaaaggcagggagac

SEQ ID NO: 9127620 - DNA, 22 bp, Homo sapiens
cttggagcccagcaggcctgga

SEQ ID NO: 9127621 - DNA, 22 bp, Homo sapiens
cttcttcccagcttccctcacc

SEQ ID NO: 9127622 - DNA, 22 bp, Homo sapiens
cttcttccagttataagagctt

SEQ ID NO: 9127623 - DNA, 22 bp, Homo sapiens
cttcttccaagcttatgctcaa

SEQ ID NO: 9127624 - DNA, 22 bp, Homo sapiens
cttcttcatgtattgatagtct

SEQ ID NO: 9127625 - DNA, 22 bp, Homo sapiens
cttcttcctgctgcagcctcca

SEQ ID NO: 9127626 - DNA, 22 bp, Homo sapiens
cttcttcctgaaagctggctct

SEQ ID NO: 9127627 - DNA, 22 bp, Homo sapiens
gaaactgtttctggctttggtg

SEQ ID NO: 9127628 - DNA, 22 bp, Homo sapiens
gaaactgtgatcgtgttctggg

SEQ ID NO: 9127629 - DNA, 22 bp, Homo sapiens
gaaactgtgaggatcttaactt

SEQ ID NO: 9127630 - DNA, 22 bp, Homo sapiens
gaaagacatagttgcaagatgg

SEQ ID NO: 9127631 - DNA, 22 bp, Homo sapiens
gaagaagcaggagtgtgtagca

SEQ ID NO: 9127632 - DNA, 22 bp, Homo sapiens
ctggagctaggaagtccaagat

SEQ ID NO: 9127633 - DNA, 22 bp, Homo sapiens
ctggtagctcctgaatatccct

SEQ ID NO: 9127634 - DNA, 22 bp, Homo sapiens
ctgtgtgtgaacacagcccagc

SEQ ID NO: 9127635 - DNA, 22 bp, Homo sapiens
ctgtgtgtttatatcatttcct

SEQ ID NO: 9127636 - DNA, 22 bp, Homo sapiens
ctggttttatgttatagatgga

SEQ ID NO: 9127637 - DNA, 22 bp, Homo sapiens
ctggttttaagctgtcagagag

SEQ ID NO: 9127638 - DNA, 22 bp, Homo sapiens
ttttgcgataaagtgtgtgtct

SEQ ID NO: 9127639 - DNA, 18 bp, Homo sapiens
tttcattataaagcaggc

SEQ ID NO: 9127640 - DNA, 22 bp, Homo sapiens
tttccaatgtagatgtctctgg

SEQ ID NO: 9127641 - DNA, 22 bp, Homo sapiens
ctgccccaccccaacctgaggt

SEQ ID NO: 9127642 - DNA, 18 bp, Homo sapiens
ctgccatgtcctactgtc

SEQ ID NO: 9127643 - DNA, 23 bp, Homo sapiens
ctgaggtggagagtgaggtaagt

SEQ ID NO: 9127644 - DNA, 22 bp, Homo sapiens
ctgaggtggaacagaggtgaag

SEQ ID NO: 9127645 - DNA, 22 bp, Homo sapiens
ctgaggtgatgtcaaatgggtt

SEQ ID NO: 9127646 - DNA, 19 bp, Homo sapiens
ctgaggtgcagtaagaggc

SEQ ID NO: 9127647 - DNA, 22 bp, Homo sapiens
ctgaggtgctatggaggatacg

SEQ ID NO: 9127648 - DNA, 22 bp, Homo sapiens
ctgctgggtttgcctttcacca

SEQ ID NO: 9127649 - DNA, 21 bp, Homo sapiens
ctcagggcttggtgtcctcat

SEQ ID NO: 9127650 - DNA, 22 bp, Homo sapiens
ctcagccccaatttgccctctt

SEQ ID NO: 9127651 - DNA, 18 bp, Homo sapiens
ctccagagctgtgagaca

SEQ ID NO: 9127652 - DNA, 22 bp, Homo sapiens
ctccagaggaaagcacatagtg

SEQ ID NO: 9127653 - DNA, 22 bp, Homo sapiens
ctccagaggatgcaggtgaggg

SEQ ID NO: 9127654 - DNA, 22 bp, Homo sapiens
ctccagaggcgacttgcatcac

SEQ ID NO: 9127655 - DNA, 22 bp, Homo sapiens
ctccagagggtcagactctgag

SEQ ID NO: 9127656 - DNA, 22 bp, Homo sapiens
ctccagaggccctatcccacta

SEQ ID NO: 9127657 - DNA, 22 bp, Homo sapiens
ctccagaggtccccgcggcact

SEQ ID NO: 9127658 - DNA, 22 bp, Homo sapiens
ctccagaggttctcatctggga

SEQ ID NO: 9127659 - DNA, 22 bp, Homo sapiens
ctccagagtcacactgcctggg

SEQ ID NO: 9127660 - DNA, 22 bp, Homo sapiens
ctccagagtcatcgagcattcc

SEQ ID NO: 9127661 - DNA, 22 bp, Homo sapiens
ttctttctgaatacagttgagt

SEQ ID NO: 9127662 - DNA, 20 bp, Homo sapiens
cgtgtgtggctattttgggt

SEQ ID NO: 9127663 - DNA, 22 bp, Homo sapiens
cggagttgtaagggatgtggct

SEQ ID NO: 9127664 - DNA, 22 bp, Homo sapiens
tgatgagggggaacagagattt

SEQ ID NO: 9127665 - DNA, 22 bp, Homo sapiens
tgatgaggggctcagaggtcag

SEQ ID NO: 9127666 - DNA, 22 bp, Homo sapiens
tgaggcagtgatgtttaagcac

SEQ ID NO: 9127667 - DNA, 18 bp, Homo sapiens
tgaggcagtcagtgatgg

SEQ ID NO: 9127668 - DNA, 22 bp, Homo sapiens
tgaggcagtcaccccctcctgc

SEQ ID NO: 9127669 - DNA, 22 bp, Homo sapiens
tgaggcagtattttagtgactt

SEQ ID NO: 9127670 - DNA, 22 bp, Homo sapiens
tgaggcagtattctccattcca

SEQ ID NO: 9127671 - DNA, 22 bp, Homo sapiens
tgaggcaggtggattacaaggt

SEQ ID NO: 9127672 - DNA, 21 bp, Homo sapiens
tgaggcaggggtgcttttgtc

SEQ ID NO: 9127673 - DNA, 22 bp, Homo sapiens
tgaggcaggtaagcaagttttg

SEQ ID NO: 9127674 - DNA, 22 bp, Homo sapiens
cccaagagcttctaggacgctg

SEQ ID NO: 9127675 - DNA, 22 bp, Homo sapiens
cccaagaggtggaggttgcagt

SEQ ID NO: 9127676 - DNA, 22 bp, Homo sapiens
cccaaccagaaattgacagaca

SEQ ID NO: 9127677 - DNA, 22 bp, Homo sapiens
cccaaccagaaattgacagaga

SEQ ID NO: 9127678 - DNA, 22 bp, Homo sapiens
cccagagagcatttggacaaag

SEQ ID NO: 9127679 - DNA, 22 bp, Homo sapiens
cccagagagcacaggtggtggg

SEQ ID NO: 9127680 - DNA, 22 bp, Homo sapiens
cccagagagctttctttgtgct

SEQ ID NO: 9127681 - DNA, 22 bp, Homo sapiens
cccagagaggtaaaacagcctt

SEQ ID NO: 9127682 - DNA, 19 bp, Homo sapiens
cccagagagatctcttgcc

SEQ ID NO: 9127683 - DNA, 22 bp, Homo sapiens
cccagagactttgtccgacgac

SEQ ID NO: 9127684 - DNA, 22 bp, Homo sapiens
cccagagaattccacatagagg

SEQ ID NO: 9127685 - DNA, 22 bp, Homo sapiens
cccagagatctactgagcccag

SEQ ID NO: 9127686 - DNA, 22 bp, Homo sapiens
cccagagggtggaggttgcagt

SEQ ID NO: 9127687 - DNA, 22 bp, Homo sapiens
cccagagatcttgtcctttcca

SEQ ID NO: 9127688 - DNA, 22 bp, Homo sapiens
cccagagaagtgaagtgacttg

SEQ ID NO: 9127689 - DNA, 22 bp, Homo sapiens
cccagagaatctttcagaaagg

SEQ ID NO: 9127690 - DNA, 22 bp, Homo sapiens
cccagactgcagagcgggcaga

SEQ ID NO: 9127691 - DNA, 22 bp, Homo sapiens
cccagagaaccttctgtgccac

SEQ ID NO: 9127692 - DNA, 22 bp, Homo sapiens
cccaccagtacagatggtagat

SEQ ID NO: 9127693 - DNA, 22 bp, Homo sapiens
cccaccagccatctgagagtgt

SEQ ID NO: 9127694 - DNA, 22 bp, Homo sapiens
cccaccagattctcaaatatct

SEQ ID NO: 9127695 - DNA, 22 bp, Homo sapiens
cccaccagacctgcaccggcac

SEQ ID NO: 9127696 - DNA, 22 bp, Homo sapiens
cccagctccaagggacagcgaa

SEQ ID NO: 9127697 - DNA, 22 bp, Homo sapiens
cccagccagcctcttcccatat

SEQ ID NO: 9127698 - DNA, 22 bp, Homo sapiens
cccagccaagtgatctgaccgc

SEQ ID NO: 9127699 - DNA, 22 bp, Homo sapiens
cccagcccatctcaaaggtcta

SEQ ID NO: 9127700 - DNA, 22 bp, Homo sapiens
cccagcccccgagtgtctggaa

SEQ ID NO: 9127701 - DNA, 20 bp, Homo sapiens
cccagcccgggccgcgctcg

SEQ ID NO: 9127702 - DNA, 22 bp, Homo sapiens
cccagccctgacctattggaaa

SEQ ID NO: 9127703 - DNA, 20 bp, Homo sapiens
cccagcccctacctgttgcc

SEQ ID NO: 9127704 - DNA, 18 bp, Homo sapiens
cccagcccaccatttctc

SEQ ID NO: 9127705 - DNA, 22 bp, Homo sapiens
cccagcccacggtcctgggtgg

SEQ ID NO: 9127706 - DNA, 22 bp, Homo sapiens
cccagcccagcgttcgaggggt

SEQ ID NO: 9127707 - DNA, 22 bp, Homo sapiens
tgaggacatgagtgggacagag

SEQ ID NO: 9127708 - DNA, 22 bp, Homo sapiens
tgaggacattgagactggagac

SEQ ID NO: 9127709 - DNA, 22 bp, Homo sapiens
tgaggacattggtcaggacatg

SEQ ID NO: 9127710 - DNA, 22 bp, Homo sapiens
ccagcccttgaggtctgtccat

SEQ ID NO: 9127711 - DNA, 17 bp, Homo sapiens
tgaagatgcatggcagc

SEQ ID NO: 9127712 - DNA, 22 bp, Homo sapiens
tgaagatgtcagcaggggtggt

SEQ ID NO: 9127713 - DNA, 19 bp, Homo sapiens
ccctagagtaagactgcat

SEQ ID NO: 9127714 - DNA, 22 bp, Homo sapiens
tcaggaaactacagttgaacta

SEQ ID NO: 9127715 - DNA, 22 bp, Homo sapiens
tcaggaaagaagatgctcagtg

SEQ ID NO: 9127716 - DNA, 22 bp, Homo sapiens
tcagctttgatctcaggcaatc

SEQ ID NO: 9127717 - DNA, 22 bp, Homo sapiens
tcagcttttaaaaacaagaagt

SEQ ID NO: 9127718 - DNA, 22 bp, Homo sapiens
cagggcacggagaagtcacccc

SEQ ID NO: 9127719 - DNA, 19 bp, Homo sapiens
tagaggagaagggaagtgg

SEQ ID NO: 9127720 - DNA, 22 bp, Homo sapiens
tagaggagaacacaaattatag

SEQ ID NO: 9127721 - DNA, 22 bp, Homo sapiens
caggggagttttatgcaacaga

SEQ ID NO: 9127722 - DNA, 22 bp, Homo sapiens
ccagccacagcttccagctcct

SEQ ID NO: 9127723 - DNA, 22 bp, Homo sapiens
ccagccctcactgaggcctctc

SEQ ID NO: 9127724 - DNA, 22 bp, Homo sapiens
ccagccctgcctctcagggccc

SEQ ID NO: 9127725 - DNA, 22 bp, Homo sapiens
ccagcccttcccaactggccag

SEQ ID NO: 9127726 - DNA, 22 bp, Homo sapiens
tctccacactttctctcccagg

SEQ ID NO: 9127727 - DNA, 22 bp, Homo sapiens
tctccagaaatggggctgggga

SEQ ID NO: 9127728 - DNA, 22 bp, Homo sapiens
tctccagagtaaccttggagca

SEQ ID NO: 9127729 - DNA, 21 bp, Homo sapiens
tctccagagtgggaggaaatc

SEQ ID NO: 9127730 - DNA, 19 bp, Homo sapiens
ccagagagctaggtacaga

SEQ ID NO: 9127731 - DNA, 21 bp, Homo sapiens
ccagagagagggaagtgggtt

SEQ ID NO: 9127732 - DNA, 22 bp, Homo sapiens
ccaccagcttcagcagccgcgg

SEQ ID NO: 9127733 - DNA, 22 bp, Homo sapiens
ccaccagctgcatatgcacgta

SEQ ID NO: 9127734 - DNA, 22 bp, Homo sapiens
tcgcttgaacccaggaagtgga

SEQ ID NO: 9127735 - DNA, 19 bp, Homo sapiens
tccccagcacctctgagtc

SEQ ID NO: 9127736 - DNA, 22 bp, Homo sapiens
tccccagaggtgaggcagcttt

SEQ ID NO: 9127737 - DNA, 22 bp, Homo sapiens
tccccagccgtgaaggagagga

SEQ ID NO: 9127738 - DNA, 22 bp, Homo sapiens
tccccagcattgagggtctctc

SEQ ID NO: 9127739 - DNA, 22 bp, Homo sapiens
tccccagcttgctacttctgct

SEQ ID NO: 9127740 - DNA, 22 bp, Homo sapiens
tccccagctctgtgcttccact

SEQ ID NO: 9127741 - DNA, 22 bp, Homo sapiens
tcccagagctctgacaccagct

SEQ ID NO: 9127742 - DNA, 22 bp, Homo sapiens
tcccagaggaaatggcagctga

SEQ ID NO: 9127743 - DNA, 22 bp, Homo sapiens
tccagagaaatctagtcttaca

SEQ ID NO: 9127744 - DNA, 22 bp, Homo sapiens
tccagagaacgatgaaagctgg

SEQ ID NO: 9127745 - DNA, 22 bp, Homo sapiens
tccagagaattctacgcagtgc

SEQ ID NO: 9127746 - DNA, 22 bp, Homo sapiens
tccagagacttgcatgtgcttg

SEQ ID NO: 9127747 - DNA, 22 bp, Homo sapiens
tccagagagaaaaacaagcttt

SEQ ID NO: 9127748 - DNA, 22 bp, Homo sapiens
tccagagagatagtggctaata

SEQ ID NO: 9127749 - DNA, 22 bp, Homo sapiens
tccagagaggcatatttacaag

SEQ ID NO: 9127750 - DNA, 22 bp, Homo sapiens
tccagagagccacggacagggg

SEQ ID NO: 9127751 - DNA, 22 bp, Homo sapiens
tccagcccagctgtccccttca

SEQ ID NO: 9127752 - DNA, 22 bp, Homo sapiens
tccagccctgtggcttccaccc

SEQ ID NO: 9127753 - DNA, 22 bp, Homo sapiens
tccagccctgtgtctgggagag

SEQ ID NO: 9127754 - DNA, 19 bp, Homo sapiens
tccagccctgttccctttt

SEQ ID NO: 9127755 - DNA, 22 bp, Homo sapiens
tcatcatcactctggcaagcat

SEQ ID NO: 9127756 - DNA, 22 bp, Homo sapiens
tcatcatcattctcccccactt

SEQ ID NO: 9127757 - DNA, 22 bp, Homo sapiens
tttatattgggagtcgttttga

SEQ ID NO: 9127758 - DNA, 22 bp, Homo sapiens
tttagcagtatatttaaagcca

SEQ ID NO: 9127759 - DNA, 22 bp, Homo sapiens
tttcaacatataccataatgcc

SEQ ID NO: 9127760 - DNA, 17 bp, Homo sapiens
tttcaacatcactcagc

SEQ ID NO: 9127761 - DNA, 20 bp, Homo sapiens
tttcaacaatttcccttcca

SEQ ID NO: 9127762 - DNA, 18 bp, Homo sapiens
ttcacagatccacaggaa

SEQ ID NO: 9127763 - DNA, 22 bp, Homo sapiens
ttcagagatgacacctggtgtt

SEQ ID NO: 9127764 - DNA, 22 bp, Homo sapiens
ttcagagatggaaggcagaatg

SEQ ID NO: 9127765 - DNA, 22 bp, Homo sapiens
ttcagagagaaaccagtgggaa

SEQ ID NO: 9127766 - DNA, 22 bp, Homo sapiens
ttcagagacagcaaccaggaca

SEQ ID NO: 9127767 - DNA, 22 bp, Homo sapiens
ttattagagatatttggttagg

SEQ ID NO: 9127768 - DNA, 22 bp, Homo sapiens
ttatatgaactggactttagga

SEQ ID NO: 9127769 - DNA, 22 bp, Homo sapiens
ttatatgagtatcatatcactt

SEQ ID NO: 9127770 - DNA, 22 bp, Homo sapiens
ttatatgattgaagtgcataag

SEQ ID NO: 9127771 - DNA, 22 bp, Homo sapiens
ttatagaatggtggattttctg

SEQ ID NO: 9127772 - DNA, 22 bp, Homo sapiens
ttctgtgtgggtagctcctgtt

SEQ ID NO: 9127773 - DNA, 22 bp, Homo sapiens
ttctgtgttctgtgcaatgagc

SEQ ID NO: 9127774 - DNA, 17 bp, Homo sapiens
ttcctggaagtcattcc

SEQ ID NO: 9127775 - DNA, 22 bp, Homo sapiens
tttgaggttagctagcagatca

SEQ ID NO: 9127776 - DNA, 22 bp, Homo sapiens
tttgctttcttgattcagatta

SEQ ID NO: 9127777 - DNA, 22 bp, Homo sapiens
cagagagagcaggaaacctccg

SEQ ID NO: 9127778 - DNA, 22 bp, Homo sapiens
cagaagcagattctaaagcaag

SEQ ID NO: 9127779 - DNA, 16 bp, Homo sapiens
cagagaggacagaggc

SEQ ID NO: 9127780 - DNA, 22 bp, Homo sapiens
cagatatatattcatcaggctg

SEQ ID NO: 9127781 - DNA, 22 bp, Homo sapiens
cagatatattcatttgcagtgc

SEQ ID NO: 9127782 - DNA, 22 bp, Homo sapiens
cagcagagaaattaaacttctg

SEQ ID NO: 9127783 - DNA, 22 bp, Homo sapiens
cagctcccagtggcagctcctt

SEQ ID NO: 9127784 - DNA, 22 bp, Homo sapiens
cagctccagcctgacaccaaga

SEQ ID NO: 9127785 - DNA, 21 bp, Homo sapiens
cagctccactaaagcagctgt

SEQ ID NO: 9127786 - DNA, 18 bp, Homo sapiens
ggagagtgacagagtcgt

SEQ ID NO: 9127787 - DNA, 22 bp, Homo sapiens
ggaggagacagtaaaaagcacg

SEQ ID NO: 9127788 - DNA, 22 bp, Homo sapiens
cacagccctgcgccccagtttg

SEQ ID NO: 9127789 - DNA, 22 bp, Homo sapiens
cacagcccccttgacactctgg

SEQ ID NO: 9127790 - DNA, 21 bp, Homo sapiens
ggagtttttctggaagggact

SEQ ID NO: 9127791 - DNA, 21 bp, Homo sapiens
ggctgctgtcaccgctgtcac

SEQ ID NO: 9127792 - DNA, 20 bp, Homo sapiens
ggctgctggtttggctctgt

SEQ ID NO: 9127793 - DNA, 22 bp, Homo sapiens
cagaacagagtcaaaagtatgt

SEQ ID NO: 9127794 - DNA, 22 bp, Homo sapiens
cagaacagtacctagcacatag

SEQ ID NO: 9127795 - DNA, 22 bp, Homo sapiens
cactgcccaggacctgccaccc

SEQ ID NO: 9127796 - DNA, 20 bp, Homo sapiens
cactgccctccagcctgagc

SEQ ID NO: 9127797 - DNA, 22 bp, Homo sapiens
atgtttcgtggaaaaagagtct

SEQ ID NO: 9127798 - DNA, 22 bp, Homo sapiens
gaggtaggctgtgaaagggggt

SEQ ID NO: 9127799 - DNA, 17 bp, Homo sapiens
gaggtaggaagtgagtc

SEQ ID NO: 9127800 - DNA, 22 bp, Homo sapiens
gaggaaggaatgcagtgtatgc

SEQ ID NO: 9127801 - DNA, 19 bp, Homo sapiens
atgaatgatccggtttctc

SEQ ID NO: 9127802 - DNA, 22 bp, Homo sapiens
atgaattgaggaaaacagtcgt

SEQ ID NO: 9127803 - DNA, 22 bp, Homo sapiens
atgaggcatctgcagtcactag

SEQ ID NO: 9127804 - DNA, 21 bp, Homo sapiens
atgaggcatgagagggtttct

SEQ ID NO: 9127805 - DNA, 22 bp, Homo sapiens
atgaggcatgggatcaaaatga

SEQ ID NO: 9127806 - DNA, 22 bp, Homo sapiens
atgaggcatctaacattgcaaa

SEQ ID NO: 9127807 - DNA, 22 bp, Homo sapiens
atgaggcatatcctcctatggt

SEQ ID NO: 9127808 - DNA, 16 bp, Homo sapiens
atgaggcataggctgc

SEQ ID NO: 9127809 - DNA, 22 bp, Homo sapiens
atgaggcatagcagggatcgga

SEQ ID NO: 9127810 - DNA, 22 bp, Homo sapiens
atgaggcagtctggcctgaggg

SEQ ID NO: 9127811 - DNA, 22 bp, Homo sapiens
atgaggcatgtgaggagaaggg

SEQ ID NO: 9127812 - DNA, 23 bp, Homo sapiens
atgaggcattaaacaggcttttt

SEQ ID NO: 9127813 - DNA, 22 bp, Homo sapiens
atgaggcattcacagaaggcac

SEQ ID NO: 9127814 - DNA, 15 bp, Homo sapiens
atgaggcatttgggg

SEQ ID NO: 9127815 - DNA, 22 bp, Homo sapiens
atgaggcattccactcaaactc

SEQ ID NO: 9127816 - DNA, 22 bp, Homo sapiens
gaagaaagattggcatgcttca

SEQ ID NO: 9127817 - DNA, 21 bp, Homo sapiens
gaccccagaccagcagacaca

SEQ ID NO: 9127818 - DNA, 18 bp, Homo sapiens
gcaacagatcaacagaaa

SEQ ID NO: 9127819 - DNA, 23 bp, Homo sapiens
gcaacagagaagtaggagatggc

SEQ ID NO: 9127820 - DNA, 22 bp, Homo sapiens
gcagggactttggcaacaggtg

SEQ ID NO: 9127821 - DNA, 22 bp, Homo sapiens
gcagggaggaagagatgcttcc

SEQ ID NO: 9127822 - DNA, 22 bp, Homo sapiens
gcagggagggcctttcatgaca

SEQ ID NO: 9127823 - DNA, 22 bp, Homo sapiens
gcagggaggtttgctgacctgg

SEQ ID NO: 9127824 - DNA, 22 bp, Homo sapiens
gcagggattgtgcagggggcta

SEQ ID NO: 9127825 - DNA, 22 bp, Homo sapiens
atttacagtttagcatttcaag

SEQ ID NO: 9127826 - DNA, 22 bp, Homo sapiens
atttacagtgtgcctactatat

SEQ ID NO: 9127827 - DNA, 22 bp, Homo sapiens
gcccagccagagctgtgtgatg

SEQ ID NO: 9127828 - DNA, 20 bp, Homo sapiens
caaatccctgctctgtgctg

SEQ ID NO: 9127829 - DNA, 22 bp, Homo sapiens
agtgtgagatgattgaggagca

SEQ ID NO: 9127830 - DNA, 22 bp, Homo sapiens
agtgccagctccacacagcagc

SEQ ID NO: 9127831 - DNA, 18 bp, Homo sapiens
agtgccagctctgctttc

SEQ ID NO: 9127832 - DNA, 22 bp, Homo sapiens
agtggaggttattgagttaagg

SEQ ID NO: 9127833 - DNA, 22 bp, Homo sapiens
aggtcaggtatcagcaggtatt

SEQ ID NO: 9127834 - DNA, 18 bp, Homo sapiens
aggtcaggaaagcagagt

SEQ ID NO: 9127835 - DNA, 22 bp, Homo sapiens
aggtcaggaggttaagagtctt

SEQ ID NO: 9127836 - DNA, 22 bp, Homo sapiens
aggtaacactacttagtatact

SEQ ID NO: 9127837 - DNA, 22 bp, Homo sapiens
aggtggcagactaacagaagga

SEQ ID NO: 9127838 - DNA, 22 bp, Homo sapiens
agtagaaatgtaagaaggatta

SEQ ID NO: 9127839 - DNA, 22 bp, Homo sapiens
agtagaaagttgcaggaggaat

SEQ ID NO: 9127840 - DNA, 22 bp, Homo sapiens
ccttctcctgccttgggttcat

SEQ ID NO: 9127841 - DNA, 22 bp, Homo sapiens
atacacatctatttaagagaca

SEQ ID NO: 9127842 - DNA, 21 bp, Homo sapiens
atacacatacacataaatgtg

SEQ ID NO: 9127843 - DNA, 22 bp, Homo sapiens
agttctatttctaacatgttat

SEQ ID NO: 9127844 - DNA, 22 bp, Homo sapiens
agttttgtaattctcaaaaata

SEQ ID NO: 9127845 - DNA, 22 bp, Homo sapiens
atatacaggtggtatgtgtaaa

SEQ ID NO: 9127846 - DNA, 20 bp, Homo sapiens
atacacatgcagacagatgc

SEQ ID NO: 9127847 - DNA, 22 bp, Homo sapiens
atcatcatcaacaagaaacatt

SEQ ID NO: 9127848 - DNA, 22 bp, Homo sapiens
ctgtctctgataagctcgaggg

SEQ ID NO: 9127849 - DNA, 22 bp, Homo sapiens
aggaggtagtcttataaatgtt

SEQ ID NO: 9127850 - DNA, 22 bp, Homo sapiens
catcagaagaaagacaaatgat

SEQ ID NO: 9127851 - DNA, 22 bp, Homo sapiens
catcagaacgtgagctccttgt

SEQ ID NO: 9127852 - DNA, 20 bp, Homo sapiens
aggagatgatccagagtcag

SEQ ID NO: 9127853 - DNA, 22 bp, Homo sapiens
aggagctggcctagaaaggaga

SEQ ID NO: 9127854 - DNA, 22 bp, Homo sapiens
aggagctgggcccaaggatgct

SEQ ID NO: 9127855 - DNA, 22 bp, Homo sapiens
aggcaggctgctatggagtaga

SEQ ID NO: 9127856 - DNA, 22 bp, Homo sapiens
aggcagctttcagtgtctctca

SEQ ID NO: 9127857 - DNA, 16 bp, Homo sapiens
aggagttgaggctatt

SEQ ID NO: 9127858 - DNA, 23 bp, Homo sapiens
aggagttgagggttgggttggca

SEQ ID NO: 9127859 - DNA, 22 bp, Homo sapiens
aggagtgttcagcgtggggatg

SEQ ID NO: 9127860 - DNA, 22 bp, Homo sapiens
aggagttggtcaccgtggccca

SEQ ID NO: 9127861 - DNA, 22 bp, Homo sapiens
aggagttggtgctctccaaata

SEQ ID NO: 9127862 - DNA, 22 bp, Homo sapiens
aggagttgtatgtccaagggac

SEQ ID NO: 9127863 - DNA, 23 bp, Homo sapiens
aggagttgcatgatttttagagc

SEQ ID NO: 9127864 - DNA, 21 bp, Homo sapiens
aggagttgctgtggcctggtt

SEQ ID NO: 9127865 - DNA, 21 bp, Homo sapiens
aggagttgagtgcacagttgg

SEQ ID NO: 9127866 - DNA, 22 bp, Homo sapiens
aggagttgattacgtttatttt

SEQ ID NO: 9127867 - DNA, 22 bp, Homo sapiens
agctgggtggagggcccacggt

SEQ ID NO: 9127868 - DNA, 22 bp, Homo sapiens
agctttctccctgacgctttgg

SEQ ID NO: 9127869 - DNA, 20 bp, Homo sapiens
agctttctccttggagctcc

SEQ ID NO: 9127870 - DNA, 22 bp, Homo sapiens
agctttctatatatgagttgct

SEQ ID NO: 9127871 - DNA, 22 bp, Homo sapiens
agctttctagatttggaattgt

SEQ ID NO: 9127872 - DNA, 22 bp, Homo sapiens
aggaaaaataaggcagcagggc

SEQ ID NO: 9127873 - DNA, 22 bp, Homo sapiens
aggaaacaacttggcatgagcc

SEQ ID NO: 9127874 - DNA, 20 bp, Homo sapiens
aggaagatcctttcttttaa

SEQ ID NO: 9127875 - DNA, 22 bp, Homo sapiens
agggcgaggagacggaggcaca

SEQ ID NO: 9127876 - DNA, 22 bp, Homo sapiens
aggggatggagctggaaggcag

SEQ ID NO: 9127877 - DNA, 22 bp, Homo sapiens
cccaggaggtcgaagctgcagt

SEQ ID NO: 9127878 - DNA, 22 bp, Homo sapiens
ccccagagaaagtcagcagcat

SEQ ID NO: 9127879 - DNA, 21 bp, Homo sapiens
ccccagcaccttgccagcctg

SEQ ID NO: 9127880 - DNA, 22 bp, Homo sapiens
acccaccacagtggctggcaca

SEQ ID NO: 9127881 - DNA, 20 bp, Homo sapiens
accccagcccctctatctga

SEQ ID NO: 9127882 - DNA, 22 bp, Homo sapiens
accccagccctgcttctgggag

SEQ ID NO: 9127883 - DNA, 22 bp, Homo sapiens
accccagcgcatatggtctgcg

SEQ ID NO: 9127884 - DNA, 22 bp, Homo sapiens
aggccagccctgggctgagaga

SEQ ID NO: 9127885 - DNA, 18 bp, Homo sapiens
aggccagccctgctactg

SEQ ID NO: 9127886 - DNA, 22 bp, Homo sapiens
aggccagcattctctctccagg

SEQ ID NO: 9127887 - DNA, 22 bp, Homo sapiens
aggccagcagacgtgggactga

SEQ ID NO: 9127888 - DNA, 22 bp, Homo sapiens
aggccagccctcacctgtgttc

SEQ ID NO: 9127889 - DNA, 22 bp, Homo sapiens
aggcatgggtagaagagaagcc

SEQ ID NO: 9127890 - DNA, 22 bp, Homo sapiens
aggcatggctttaggcaggcgt

SEQ ID NO: 9127891 - DNA, 19 bp, Homo sapiens
aggcatgggaagagaagtc

SEQ ID NO: 9127892 - DNA, 22 bp, Homo sapiens
aggagctggaatggtccttttg

SEQ ID NO: 9127893 - DNA, 22 bp, Homo sapiens
aggagacatctaactgtaggtt

SEQ ID NO: 9127894 - DNA, 22 bp, Homo sapiens
aggagggaataagaaagagtca

SEQ ID NO: 9127895 - DNA, 22 bp, Homo sapiens
aggcaaaagaatgtcataaatg

SEQ ID NO: 9127896 - DNA, 22 bp, Homo sapiens
aggcaacataacacgaaagtct

SEQ ID NO: 9127897 - DNA, 22 bp, Homo sapiens
aggcaacaggaaaccacatgat

SEQ ID NO: 9127898 - DNA, 22 bp, Homo sapiens
aggcaacatgactcacttgcac

SEQ ID NO: 9127899 - DNA, 22 bp, Homo sapiens
aggcaacatgggccaggcagaa

SEQ ID NO: 9127900 - DNA, 22 bp, Homo sapiens
aggcaacaagggtagtcagtga

SEQ ID NO: 9127901 - DNA, 22 bp, Homo sapiens
aggcaacacttgcattttttag

SEQ ID NO: 9127902 - DNA, 22 bp, Homo sapiens
aggcacacagcttgcataaatc

SEQ ID NO: 9127903 - DNA, 22 bp, Homo sapiens
acagccagtaaggaaagaccca

SEQ ID NO: 9127904 - DNA, 22 bp, Homo sapiens
acagccagtgactggacaagct

SEQ ID NO: 9127905 - DNA, 22 bp, Homo sapiens
acagccccagcgcggcggggtc

SEQ ID NO: 9127906 - DNA, 23 bp, Homo sapiens
acagccccatgcaggtgtgtttg

SEQ ID NO: 9127907 - DNA, 22 bp, Homo sapiens
acagccccccgctcagtttcca

SEQ ID NO: 9127908 - DNA, 22 bp, Homo sapiens
agtataaagtggttttcagcac

SEQ ID NO: 9127909 - DNA, 22 bp, Homo sapiens
aggtgaagttgaggaggcagaa

SEQ ID NO: 9127910 - DNA, 22 bp, Homo sapiens
actttgcaatacttaatacaaa

SEQ ID NO: 9127911 - DNA, 22 bp, Homo sapiens
agttttatctgtaagctgttca

SEQ ID NO: 9127912 - DNA, 22 bp, Homo sapiens
agtttctagcaaggattgttga

SEQ ID NO: 9127913 - DNA, 22 bp, Homo sapiens
agaaagcatctccattgtaggt

SEQ ID NO: 9127914 - DNA, 22 bp, Homo sapiens
agaaagcacgggccccaggctc

SEQ ID NO: 9127915 - DNA, 22 bp, Homo sapiens
agaacagtgctgataaatcata

SEQ ID NO: 9127916 - DNA, 22 bp, Homo sapiens
atccattttctctctgtggggt

SEQ ID NO: 9127917 - DNA, 22 bp, Homo sapiens
atccatttgtttactgatggac

SEQ ID NO: 9127918 - DNA, 22 bp, Homo sapiens
agaaggagtgtacaggtcatgc

SEQ ID NO: 9127919 - DNA, 22 bp, Homo sapiens
agaaggcatcagaagtgtgtag

SEQ ID NO: 9127920 - DNA, 22 bp, Homo sapiens
agagaggctgctggactatatg

SEQ ID NO: 9127921 - DNA, 22 bp, Homo sapiens
agagaggatttgtttttctcct

SEQ ID NO: 9127922 - DNA, 22 bp, Homo sapiens
agagagcattgaggaaatcttc

SEQ ID NO: 9127923 - DNA, 22 bp, Homo sapiens
agagaaggtcactaaggaccca

SEQ ID NO: 9127924 - DNA, 22 bp, Homo sapiens
agagccctcttcactgcccctt

SEQ ID NO: 9127925 - DNA, 22 bp, Homo sapiens
agacgagggcctggcacacagt

SEQ ID NO: 9127926 - DNA, 20 bp, Homo sapiens
agacagaatcagagataaag

SEQ ID NO: 9127927 - DNA, 22 bp, Homo sapiens
atgaggcagaaaaaagtcggag

SEQ ID NO: 9127928 - DNA, 22 bp, Homo sapiens
atgaggcacttaaaagtgaaga

SEQ ID NO: 9127929 - DNA, 22 bp, Homo sapiens
atgaggcacgtgttactggcct

SEQ ID NO: 9127930 - DNA, 22 bp, Homo sapiens
agatggagttgtagcagtgact

SEQ ID NO: 9127931 - DNA, 22 bp, Homo sapiens
agatggagtggagatgagtaaa

SEQ ID NO: 9127932 - DNA, 22 bp, Homo sapiens
agatggagttagtaccagagtc

SEQ ID NO: 9127933 - DNA, 22 bp, Homo sapiens
agatggagaccttggatgaact

SEQ ID NO: 9127934 - DNA, 22 bp, Homo sapiens
caaagatgccaaaaggaagaca

SEQ ID NO: 9127935 - DNA, 22 bp, Homo sapiens
caaagatgctgatgttggatca

SEQ ID NO: 9127936 - DNA, 22 bp, Homo sapiens
caaagatgctgatgttggatca

SEQ ID NO: 9127937 - DNA, 22 bp, Homo sapiens
agatgtggccggctagggagag

SEQ ID NO: 9127938 - DNA, 22 bp, Homo sapiens
agatgtggcctttgggagatta

SEQ ID NO: 9127939 - DNA, 22 bp, Homo sapiens
agatgtgtttctagttcctgca

SEQ ID NO: 9127940 - DNA, 22 bp, Homo sapiens
agatgttccagccaatgggaat

SEQ ID NO: 9127941 - DNA, 22 bp, Homo sapiens
agatgttcctagatgcgtgggc

SEQ ID NO: 9127942 - DNA, 18 bp, Homo sapiens
agatgttcaatatttctc

SEQ ID NO: 9127943 - DNA, 22 bp, Homo sapiens
agcaacaggaaatagctgatta

SEQ ID NO: 9127944 - DNA, 22 bp, Homo sapiens
agaggaggctgggtccagataa

SEQ ID NO: 9127945 - DNA, 22 bp, Homo sapiens
agaggcaagttcagagctagga

SEQ ID NO: 9127946 - DNA, 22 bp, Homo sapiens
agaggcaatgaaagcagtctct

SEQ ID NO: 9127947 - DNA, 22 bp, Homo sapiens
agaggggaggcgaaccagagtc

SEQ ID NO: 9127948 - DNA, 22 bp, Homo sapiens
agaggtgacataggagaggctc

SEQ ID NO: 9127949 - DNA, 21 bp, Homo sapiens
agagtataataaaggcatgtc

SEQ ID NO: 9127950 - DNA, 18 bp, Homo sapiens
agagtatacagacaacaa

SEQ ID NO: 9127951 - DNA, 22 bp, Homo sapiens
agagtataggcaggatgccagt

SEQ ID NO: 9127952 - DNA, 22 bp, Homo sapiens
agagtactgcctcagttatgaa

SEQ ID NO: 9127953 - DNA, 22 bp, Homo sapiens
agagtgagggggcactgagacg

SEQ ID NO: 9127954 - DNA, 20 bp, Homo sapiens
agcactgtctgaccagtggc

SEQ ID NO: 9127955 - DNA, 22 bp, Homo sapiens
caccagccagagtgacagctcc

SEQ ID NO: 9127956 - DNA, 22 bp, Homo sapiens
caccagagttgtccaaatgatt

SEQ ID NO: 9127957 - DNA, 22 bp, Homo sapiens
agcagggaggcccagggcactg

SEQ ID NO: 9127958 - DNA, 22 bp, Homo sapiens
agccccacgttgtctagcacct

SEQ ID NO: 9127959 - DNA, 22 bp, Homo sapiens
agccccagcccctctctcacaa

SEQ ID NO: 9127960 - DNA, 22 bp, Homo sapiens
agccccacactctctctgagaa

SEQ ID NO: 9127961 - DNA, 20 bp, Homo sapiens
agccccacccttgtcctggc

SEQ ID NO: 9127962 - DNA, 22 bp, Homo sapiens
agccctgctcatctggatcccg

SEQ ID NO: 9127963 - DNA, 22 bp, Homo sapiens
agccagccagttcactaggaaa

SEQ ID NO: 9127964 - DNA, 22 bp, Homo sapiens
aaaggaggaatggagagatgct

SEQ ID NO: 9127965 - DNA, 19 bp, Homo sapiens
aaagatgtccttttgggct

SEQ ID NO: 9127966 - DNA, 23 bp, Homo sapiens
aaagatgtgagtattcatatggc

SEQ ID NO: 9127967 - DNA, 22 bp, Homo sapiens
aaacatcataggcatgcatgat

SEQ ID NO: 9127968 - DNA, 19 bp, Homo sapiens
aaaaacttagtccagaaag

SEQ ID NO: 9127969 - DNA, 22 bp, Homo sapiens
aaaaatgaaacggctggttggc

SEQ ID NO: 9127970 - DNA, 22 bp, Homo sapiens
aaacaaagccagggaagttatg

SEQ ID NO: 9127971 - DNA, 22 bp, Homo sapiens
aaacaaagcatcttgctatgca

SEQ ID NO: 9127972 - DNA, 22 bp, Homo sapiens
aaacttcttgctgcattttctg

SEQ ID NO: 9127973 - DNA, 22 bp, Homo sapiens
aaagatgtcacaagatgtgatg

SEQ ID NO: 9127974 - DNA, 22 bp, Homo sapiens
aaagaagagctggaaggagtct

SEQ ID NO: 9127975 - DNA, 22 bp, Homo sapiens
aagaagttaataatggtgagaa

SEQ ID NO: 9127976 - DNA, 22 bp, Homo sapiens
aagaaagggctattgttctcca

SEQ ID NO: 9127977 - DNA, 22 bp, Homo sapiens
aagaaaggtgtgtttgcagatg

SEQ ID NO: 9127978 - DNA, 22 bp, Homo sapiens
aagaaaggtctctgcccgctat

SEQ ID NO: 9127979 - DNA, 22 bp, Homo sapiens
aagaaagggagaaggatggtgt

SEQ ID NO: 9127980 - DNA, 22 bp, Homo sapiens
aagaaaggatatatgggaggta

SEQ ID NO: 9127981 - DNA, 22 bp, Homo sapiens
aagaggagaaaggctggctttg

SEQ ID NO: 9127982 - DNA, 18 bp, Homo sapiens
aagaggaggagcaggttg

SEQ ID NO: 9127983 - DNA, 18 bp, Homo sapiens
aagaggaggagcaggttg

SEQ ID NO: 9127984 - DNA, 18 bp, Homo sapiens
aagaggaggaaacccagg

SEQ ID NO: 9127985 - DNA, 22 bp, Homo sapiens
aagaggaggacggttcccagaa

SEQ ID NO: 9127986 - DNA, 22 bp, Homo sapiens
aagaggagacttcagcaacttg

SEQ ID NO: 9127987 - DNA, 22 bp, Homo sapiens
aacaagagactctgttccagaa

SEQ ID NO: 9127988 - DNA, 22 bp, Homo sapiens
aacagtacaactccacaagact

SEQ ID NO: 9127989 - DNA, 22 bp, Homo sapiens
aacagtttgcctgaaatgtatt

SEQ ID NO: 9127990 - DNA, 22 bp, Homo sapiens
aacactgctgctgggttctgtg

SEQ ID NO: 9127991 - DNA, 22 bp, Homo sapiens
aagttgaatcagtaacacagtt

SEQ ID NO: 9127992 - DNA, 17 bp, Homo sapiens
aaggaccaacaggaaat

SEQ ID NO: 9127993 - DNA, 22 bp, Homo sapiens
aagggagacagttgtgtgagga

SEQ ID NO: 9127994 - DNA, 21 bp, Homo sapiens
aagggagataggaatcaggcc

SEQ ID NO: 9127995 - DNA, 22 bp, Homo sapiens
acagaagcaaaagcaggatctt

SEQ ID NO: 9127996 - DNA, 22 bp, Homo sapiens
acagaagcagccgtcacagata

SEQ ID NO: 9127997 - DNA, 22 bp, Homo sapiens
acaccttctgagaactgagcag

SEQ ID NO: 9127998 - DNA, 22 bp, Homo sapiens
aagaggaggattgatgtgggag

SEQ ID NO: 9127999 - DNA, 23 bp, Homo sapiens
aagaggaggccctgctcccgtcc

SEQ ID NO: 9128000 - DNA, 22 bp, Homo sapiens
aagaggaggattgatgtgggag

SEQ ID NO: 9128001 - DNA, 22 bp, Homo sapiens
aagaggcagtggtgatgaatgg

SEQ ID NO: 9128002 - DNA, 22 bp, Homo sapiens
aagaggagggcagattcaaggc

SEQ ID NO: 9128003 - DNA, 22 bp, Homo sapiens
aagaggagtagatgtggttggt

SEQ ID NO: 9128004 - DNA, 22 bp, Homo sapiens
aatgttagtaacttgagtattt

SEQ ID NO: 9128005 - DNA, 23 bp, Homo sapiens
acaactttacagatacattttgt

SEQ ID NO: 9128006 - DNA, 22 bp, Homo sapiens
acagaactgtgatctcataaat

SEQ ID NO: 9128007 - DNA, 22 bp, Homo sapiens
agcaggcatttgatatatattt

SEQ ID NO: 9128008 - DNA, 22 bp, Homo sapiens
agatgtttttccaggtctaatt

SEQ ID NO: 9128009 - DNA, 22 bp, Homo sapiens
agagtgaaaagctagagcagta

SEQ ID NO: 9128010 - DNA, 18 bp, Homo sapiens
agagaaagaccaaagcat

SEQ ID NO: 9128011 - DNA, 23 bp, Homo sapiens
agagaaagggataacacgttgaa

SEQ ID NO: 9128012 - DNA, 19 bp, Homo sapiens
agagaaagaattgagtcta

SEQ ID NO: 9128013 - DNA, 22 bp, Homo sapiens
agagagaggggcgagcaaacac

SEQ ID NO: 9128014 - DNA, 20 bp, Homo sapiens
agagagaggtaaattgagca

SEQ ID NO: 9128015 - DNA, 22 bp, Homo sapiens
agagaaagtcctgatctctcta

SEQ ID NO: 9128016 - DNA, 21 bp, Homo sapiens
agagaaagtcatggctgtggc

SEQ ID NO: 9128017 - DNA, 22 bp, Homo sapiens
agagaaagtaaagattctacct

SEQ ID NO: 9128018 - DNA, 22 bp, Homo sapiens
agagagcagtctggaagaaaca

SEQ ID NO: 9128019 - DNA, 23 bp, Homo sapiens
agagagagtttgtgtcaggtacc

SEQ ID NO: 9128020 - DNA, 22 bp, Homo sapiens
accaccaggggattttcagaac

SEQ ID NO: 9128021 - DNA, 22 bp, Homo sapiens
acattacctggcatttgatctt

SEQ ID NO: 9128022 - DNA, 22 bp, Homo sapiens
acatagaaatttatttcttaca

SEQ ID NO: 9128023 - DNA, 22 bp, Homo sapiens
acaggaaatgaaatggtatcta

SEQ ID NO: 9128024 - DNA, 22 bp, Homo sapiens
aagtgagttaatggatgtgaac

SEQ ID NO: 9128025 - DNA, 22 bp, Homo sapiens
aagtgagtggcctggagaggtg

SEQ ID NO: 9128026 - DNA, 22 bp, Homo sapiens
aagtgatacgtgtttatttcca

SEQ ID NO: 9128027 - DNA, 22 bp, Homo sapiens
aagtgatgctacgactttgaca

SEQ ID NO: 9128028 - DNA, 22 bp, Homo sapiens
aagtaacacatgttacttctgc

SEQ ID NO: 9128029 - DNA, 22 bp, Homo sapiens
aatctgtttccattagagtcat

SEQ ID NO: 9128030 - DNA, 22 bp, Homo sapiens
gccagagagactgatacatgct

SEQ ID NO: 9128031 - DNA, 22 bp, Homo sapiens
gccagagaggcctaaggccata

SEQ ID NO: 9128032 - DNA, 22 bp, Homo sapiens
gccagagaggcaaatcctagca

SEQ ID NO: 9128033 - DNA, 22 bp, Homo sapiens
gccagagagagtccctgggcct

SEQ ID NO: 9128034 - DNA, 22 bp, Homo sapiens
gccagagagatggaaaagctta

SEQ ID NO: 9128035 - DNA, 22 bp, Homo sapiens
gccagagaggccttagaatcca

SEQ ID NO: 9128036 - DNA, 22 bp, Homo sapiens
gccagagaggccgaggtaccca

SEQ ID NO: 9128037 - DNA, 22 bp, Homo sapiens
gccagcccattaacccctgtcc

SEQ ID NO: 9128038 - DNA, 22 bp, Homo sapiens
gccagcccagctccaggggaaa

SEQ ID NO: 9128039 - DNA, 22 bp, Homo sapiens
gccagccccttagggctctccc

SEQ ID NO: 9128040 - DNA, 22 bp, Homo sapiens
gccagccccagacatcctatcg

SEQ ID NO: 9128041 - DNA, 22 bp, Homo sapiens
gccagcccctccatcctgttca

SEQ ID NO: 9128042 - DNA, 22 bp, Homo sapiens
gcccagagagatgctgtagacc

SEQ ID NO: 9128043 - DNA, 23 bp, Homo sapiens
gcccagagaggctcaccaggaat

SEQ ID NO: 9128044 - DNA, 22 bp, Homo sapiens
gcccagagggaagaggtgtcat

SEQ ID NO: 9128045 - DNA, 22 bp, Homo sapiens
gcccagagagatgaagtgatgg

SEQ ID NO: 9128046 - DNA, 22 bp, Homo sapiens
gcccagagttcaaggctgcagt

SEQ ID NO: 9128047 - DNA, 22 bp, Homo sapiens
gcccagagtttgaagatacagt

SEQ ID NO: 9128048 - DNA, 22 bp, Homo sapiens
gcagggcggcccagagcaggcc

SEQ ID NO: 9128049 - DNA, 22 bp, Homo sapiens
gcagaggacacaggagggcaag

SEQ ID NO: 9128050 - DNA, 22 bp, Homo sapiens
gcacagcctgtccctgtcctgg

SEQ ID NO: 9128051 - DNA, 22 bp, Homo sapiens
gcacagccttgccctgtgccct

SEQ ID NO: 9128052 - DNA, 22 bp, Homo sapiens
ggagagagagctcattagctgc

SEQ ID NO: 9128053 - DNA, 22 bp, Homo sapiens
ggagagagatgccgccttgctc

SEQ ID NO: 9128054 - DNA, 22 bp, Homo sapiens
ggagaggatgttttagtaactt

SEQ ID NO: 9128055 - DNA, 22 bp, Homo sapiens
ggagaggaaatgccagcacttc

SEQ ID NO: 9128056 - DNA, 22 bp, Homo sapiens
ggacccaccaggccgggctcca

SEQ ID NO: 9128057 - DNA, 23 bp, Homo sapiens
ggacccacggtctttgaggctct

SEQ ID NO: 9128058 - DNA, 21 bp, Homo sapiens
ggacagaggagaaggcaccct

SEQ ID NO: 9128059 - DNA, 22 bp, Homo sapiens
ggaaaggagatattggagagtg

SEQ ID NO: 9128060 - DNA, 22 bp, Homo sapiens
ggaagccaggcccagagatgct

SEQ ID NO: 9128061 - DNA, 20 bp, Homo sapiens
ggaagctgtgggtccccagg

SEQ ID NO: 9128062 - DNA, 22 bp, Homo sapiens
gctgtcttggaaaaggcaaaga

SEQ ID NO: 9128063 - DNA, 22 bp, Homo sapiens
gcgagaaactaagtgccctttg

SEQ ID NO: 9128064 - DNA, 22 bp, Homo sapiens
gcggcaggagtaaaggaggaag

SEQ ID NO: 9128065 - DNA, 21 bp, Homo sapiens
gctatacagaatggccagagg

SEQ ID NO: 9128066 - DNA, 22 bp, Homo sapiens
gctatacagcaggagaatggaa

SEQ ID NO: 9128067 - DNA, 22 bp, Homo sapiens
gggagggatctgctaggcaatg

SEQ ID NO: 9128068 - DNA, 22 bp, Homo sapiens
ggagatggctggcaggtagatg

SEQ ID NO: 9128069 - DNA, 22 bp, Homo sapiens
ggccagcttctctgctgcctgt

SEQ ID NO: 9128070 - DNA, 22 bp, Homo sapiens
ggcaggtacagcaagaggacaa

SEQ ID NO: 9128071 - DNA, 22 bp, Homo sapiens
ggcaggtagcctagaggaggtt

SEQ ID NO: 9128072 - DNA, 22 bp, Homo sapiens
ggcagggtaaaccgaggtaagt

SEQ ID NO: 9128073 - DNA, 22 bp, Homo sapiens
gtagaggacatttgacatgatg

SEQ ID NO: 9128074 - DNA, 22 bp, Homo sapiens
gtgcccaggggccagctgccgg

SEQ ID NO: 9128075 - DNA, 22 bp, Homo sapiens
gtctgggtggctgctttcagct

SEQ ID NO: 9128076 - DNA, 22 bp, Homo sapiens
gtctctctgctaggcctccagt

SEQ ID NO: 9128077 - DNA, 22 bp, Homo sapiens
gtgaggcagggaaagaggataa

SEQ ID NO: 9128078 - DNA, 22 bp, Homo sapiens
gtgaggcattgaagaccggaat

SEQ ID NO: 9128079 - DNA, 22 bp, Homo sapiens
gtgaggtgagtagtgagaagcc

SEQ ID NO: 9128080 - DNA, 22 bp, Homo sapiens
gtgaggtggtacaatattaact

SEQ ID NO: 9128081 - DNA, 22 bp, Homo sapiens
tcaggaaagtgttctcagagga

SEQ ID NO: 9128082 - DNA, 21 bp, Homo sapiens
tcaggcaggcgcagagggaag

SEQ ID NO: 9128083 - DNA, 22 bp, Homo sapiens
tcaggcaggctcagaggaaaac

SEQ ID NO: 9128084 - DNA, 22 bp, Homo sapiens
tcagagtacgcatgctctgatt

SEQ ID NO: 9128085 - DNA, 22 bp, Homo sapiens
tcagctttctcaaagaagctgg

SEQ ID NO: 9128086 - DNA, 22 bp, Homo sapiens
tcatcatctgcaagctcatgtc

SEQ ID NO: 9128087 - DNA, 22 bp, Homo sapiens
tcataaactcactagtttatgt

SEQ ID NO: 9128088 - DNA, 22 bp, Homo sapiens
tcataaacaaaacagtttatgc

SEQ ID NO: 9128089 - DNA, 22 bp, Homo sapiens
tcagtttcctggttttgacatt

SEQ ID NO: 9128090 - DNA, 22 bp, Homo sapiens
tcagtttctttactcatagaat

SEQ ID NO: 9128091 - DNA, 20 bp, Homo sapiens
tcagagagagggtgccactt

SEQ ID NO: 9128092 - DNA, 22 bp, Homo sapiens
tcacagaatagcactgtaagcg

SEQ ID NO: 9128093 - DNA, 20 bp, Homo sapiens
tcacagaatgcctgaagaag

SEQ ID NO: 9128094 - DNA, 20 bp, Homo sapiens
tcaatgtaatcatatcatca

SEQ ID NO: 9128095 - DNA, 22 bp, Homo sapiens
tcccagagttcaatgggaaggt

SEQ ID NO: 9128096 - DNA, 20 bp, Homo sapiens
tccaccaggaagggtaggga

SEQ ID NO: 9128097 - DNA, 22 bp, Homo sapiens
tccaccagttcaccttgtagca

SEQ ID NO: 9128098 - DNA, 22 bp, Homo sapiens
tccaccagggtttcatctccct

SEQ ID NO: 9128099 - DNA, 18 bp, Homo sapiens
tccaccagtcaatctgtc

SEQ ID NO: 9128100 - DNA, 22 bp, Homo sapiens
tccaccagagccttcccatgct

SEQ ID NO: 9128101 - DNA, 22 bp, Homo sapiens
tccaccagagccctctttgcgg

SEQ ID NO: 9128102 - DNA, 22 bp, Homo sapiens
tccaccagcttcttcaccagct

SEQ ID NO: 9128103 - DNA, 22 bp, Homo sapiens
tccaccagccaggcccaggctg

SEQ ID NO: 9128104 - DNA, 21 bp, Homo sapiens
tccaccagctcttcctcttca

SEQ ID NO: 9128105 - DNA, 22 bp, Homo sapiens
tccaccagcagcctgtcagcct

SEQ ID NO: 9128106 - DNA, 22 bp, Homo sapiens
tccaccaggctccatgttcagt

SEQ ID NO: 9128107 - DNA, 20 bp, Homo sapiens
tccagccctgcttctctctt

SEQ ID NO: 9128108 - DNA, 20 bp, Homo sapiens
tccagccctcatgtcgctca

SEQ ID NO: 9128109 - DNA, 22 bp, Homo sapiens
tccagccctcctgggatcacag

SEQ ID NO: 9128110 - DNA, 22 bp, Homo sapiens
tccagccctctggcccgcggtg

SEQ ID NO: 9128111 - DNA, 22 bp, Homo sapiens
tccagccctgcactgattagat

SEQ ID NO: 9128112 - DNA, 22 bp, Homo sapiens
tccagccctgcccattctctcg

SEQ ID NO: 9128113 - DNA, 17 bp, Homo sapiens
tccagccctgcccgacg

SEQ ID NO: 9128114 - DNA, 22 bp, Homo sapiens
tccagccctgcttcctgcctca

SEQ ID NO: 9128115 - DNA, 22 bp, Homo sapiens
tccagccccttttactcattca

SEQ ID NO: 9128116 - DNA, 20 bp, Homo sapiens
tccagcccctgcatgttgct

SEQ ID NO: 9128117 - DNA, 22 bp, Homo sapiens
tccagccctcagccaagtggaa

SEQ ID NO: 9128118 - DNA, 22 bp, Homo sapiens
tccagcccgagggcgctgatga

SEQ ID NO: 9128119 - DNA, 22 bp, Homo sapiens
tccagcccctcctgagccaagc

SEQ ID NO: 9128120 - DNA, 22 bp, Homo sapiens
tccagcccgactgggcctgccg

SEQ ID NO: 9128121 - DNA, 22 bp, Homo sapiens
tccagcccgggggcaggtgacc

SEQ ID NO: 9128122 - DNA, 19 bp, Homo sapiens
tccagcccctctgtgtgtg

SEQ ID NO: 9128123 - DNA, 22 bp, Homo sapiens
tccagccccgggatgttcttca

SEQ ID NO: 9128124 - DNA, 22 bp, Homo sapiens
tccagccccggcttccttacag

SEQ ID NO: 9128125 - DNA, 22 bp, Homo sapiens
tccagccccgaggccggcgacg

SEQ ID NO: 9128126 - DNA, 22 bp, Homo sapiens
tccagcccatccctagcctggg

SEQ ID NO: 9128127 - DNA, 22 bp, Homo sapiens
tccagcccagtttggtgaattg

SEQ ID NO: 9128128 - DNA, 20 bp, Homo sapiens
tccagcccaggtcctgcctg

SEQ ID NO: 9128129 - DNA, 22 bp, Homo sapiens
tccagcccaggctggagtgtag

SEQ ID NO: 9128130 - DNA, 21 bp, Homo sapiens
tacaccagtttacacttcctc

SEQ ID NO: 9128131 - DNA, 22 bp, Homo sapiens
tacaccagtatcttaagcatga

SEQ ID NO: 9128132 - DNA, 22 bp, Homo sapiens
tacaccaggtgttatggtcaat

SEQ ID NO: 9128133 - DNA, 22 bp, Homo sapiens
tacaccaggttaccaatcactg

SEQ ID NO: 9128134 - DNA, 22 bp, Homo sapiens
tacaccagattatttataacat

SEQ ID NO: 9128135 - DNA, 22 bp, Homo sapiens
tacaccagaatctctgtgggga

SEQ ID NO: 9128136 - DNA, 22 bp, Homo sapiens
tacaccagcttgcctgggctct

SEQ ID NO: 9128137 - DNA, 22 bp, Homo sapiens
taaagtttggcagacaataaca

SEQ ID NO: 9128138 - DNA, 20 bp, Homo sapiens
gttttatgccagttctgtgt

SEQ ID NO: 9128139 - DNA, 22 bp, Homo sapiens
gtttatatgaacttcataccca

SEQ ID NO: 9128140 - DNA, 22 bp, Homo sapiens
gtttatatgtgtgccactctta

SEQ ID NO: 9128141 - DNA, 23 bp, Homo sapiens
gttttacaggtgagaaaatggag

SEQ ID NO: 9128142 - DNA, 22 bp, Homo sapiens
gtttagatgaaagtttgtttca

SEQ ID NO: 9128143 - DNA, 22 bp, Homo sapiens
gttataaatacctaataggatt

SEQ ID NO: 9128144 - DNA, 22 bp, Homo sapiens
gtgtgtgtctccgcggccgtag

SEQ ID NO: 9128145 - DNA, 22 bp, Homo sapiens
tagaggagagttgctggatgga

SEQ ID NO: 9128146 - DNA, 22 bp, Homo sapiens
tagaggagcggcgagctgagct

SEQ ID NO: 9128147 - DNA, 23 bp, Homo sapiens
tagaggaggatgtgatgcatatt

SEQ ID NO: 9128148 - DNA, 22 bp, Homo sapiens
tagaggcaccctggaggagact

SEQ ID NO: 9128149 - DNA, 22 bp, Homo sapiens
tagaggaggtgattcttgagct

SEQ ID NO: 9128150 - DNA, 22 bp, Homo sapiens
tacttggtaaatgcttatggaa

SEQ ID NO: 9128151 - DNA, 22 bp, Homo sapiens
tacttggtattgtcagttgtaa

SEQ ID NO: 9128152 - DNA, 23 bp, Homo sapiens
tacttggttttgatagaaatcca

SEQ ID NO: 9128153 - DNA, 22 bp, Homo sapiens
tagatgttaagcttctagaagg

SEQ ID NO: 9128154 - DNA, 22 bp, Homo sapiens
tagatgtgttgcctggagttgt

SEQ ID NO: 9128155 - DNA, 22 bp, Homo sapiens
tagatgttttaactcttggtta

SEQ ID NO: 9128156 - DNA, 20 bp, Homo sapiens
tagatgtttcctgtcataaa

SEQ ID NO: 9128157 - DNA, 22 bp, Homo sapiens
tagtatagattgaagcagatca

SEQ ID NO: 9128158 - DNA, 22 bp, Homo sapiens
tatatgtagtcagtcagagtaa

SEQ ID NO: 9128159 - DNA, 22 bp, Homo sapiens
tgtttatacctgcaacctgtca

SEQ ID NO: 9128160 - DNA, 21 bp, Homo sapiens
cctttacaattttgcattcct

SEQ ID NO: 9128161 - DNA, 23 bp, Homo sapiens
ccttgtctggctggctggacttt

SEQ ID NO: 9128162 - DNA, 22 bp, Homo sapiens
ttaccatagaaacttccttttt

SEQ ID NO: 9128163 - DNA, 22 bp, Homo sapiens
tttatatgtttgtacaattaag

SEQ ID NO: 9128164 - DNA, 22 bp, Homo sapiens
tttatatggttgactatgagtt

SEQ ID NO: 9128165 - DNA, 22 bp, Homo sapiens
tttatatgtgaaggtttgcaga

SEQ ID NO: 9128166 - DNA, 22 bp, Homo sapiens
tttatatgtattgactttgatg

SEQ ID NO: 9128167 - DNA, 18 bp, Homo sapiens
tttatatggatagagacc

SEQ ID NO: 9128168 - DNA, 22 bp, Homo sapiens
tttatatgaaagtgaccagtgg

SEQ ID NO: 9128169 - DNA, 22 bp, Homo sapiens
tttatatcttatgtcatttcaa

SEQ ID NO: 9128170 - DNA, 22 bp, Homo sapiens
ctccccaggttcaggaggtggg

SEQ ID NO: 9128171 - DNA, 22 bp, Homo sapiens
ctccccagctcgcgggtgacgg

SEQ ID NO: 9128172 - DNA, 22 bp, Homo sapiens
ctgaagatgttctttttggttc

SEQ ID NO: 9128173 - DNA, 22 bp, Homo sapiens
ctgaagattcgcctttgtttat

SEQ ID NO: 9128174 - DNA, 22 bp, Homo sapiens
ctgctgcccctgagctcagcct

SEQ ID NO: 9128175 - DNA, 22 bp, Homo sapiens
gaagggagaaggttgggtgacg

SEQ ID NO: 9128176 - DNA, 21 bp, Homo sapiens
gaagccaagacaggatcaagg

SEQ ID NO: 9128177 - DNA, 18 bp, Homo sapiens
gaaaggagagacagtagg

SEQ ID NO: 9128178 - DNA, 18 bp, Homo sapiens
gaaaggagagacagtagg

SEQ ID NO: 9128179 - DNA, 17 bp, Homo sapiens
gaaaggaggcaacactg

SEQ ID NO: 9128180 - DNA, 22 bp, Homo sapiens
gaaaggagagggttaaggagct

SEQ ID NO: 9128181 - DNA, 22 bp, Homo sapiens
gaaaggagagggttaaggagct

SEQ ID NO: 9128182 - DNA, 22 bp, Homo sapiens
gaaaggagtgaatatttgtgac

SEQ ID NO: 9128183 - DNA, 22 bp, Homo sapiens
gaaaggagtgctttccaggtct

SEQ ID NO: 9128184 - DNA, 22 bp, Homo sapiens
gaaaggagtgctttccaggtct

SEQ ID NO: 9128185 - DNA, 22 bp, Homo sapiens
gaaaggagggctcacaaaagtg

SEQ ID NO: 9128186 - DNA, 22 bp, Homo sapiens
gaaaggagggctcacaaaagtg

SEQ ID NO: 9128187 - DNA, 22 bp, Homo sapiens
gaaaggagggaaacagagcggt

SEQ ID NO: 9128188 - DNA, 20 bp, Homo sapiens
gaaaggagtgtccctgtgag

SEQ ID NO: 9128189 - DNA, 22 bp, Homo sapiens
gaaggtgtcagcaagtcaaagc

SEQ ID NO: 9128190 - DNA, 22 bp, Homo sapiens
gaaggtgtgcagggccaaagtt

SEQ ID NO: 9128191 - DNA, 22 bp, Homo sapiens
gagagaaaaatgagcttcattg

SEQ ID NO: 9128192 - DNA, 22 bp, Homo sapiens
gagagaaaacaagttctccatt

SEQ ID NO: 9128193 - DNA, 22 bp, Homo sapiens
gagagaaaggataacagctcaa

SEQ ID NO: 9128194 - DNA, 22 bp, Homo sapiens
gagagaaagcccctgcatccct

SEQ ID NO: 9128195 - DNA, 22 bp, Homo sapiens
gagagaaaagggggaattgatt

SEQ ID NO: 9128196 - DNA, 22 bp, Homo sapiens
gagacccaggggtctgctgccc

SEQ ID NO: 9128197 - DNA, 22 bp, Homo sapiens
gagagaaaggcttgcaggctgt

SEQ ID NO: 9128198 - DNA, 22 bp, Homo sapiens
gagagaaattagttggtttgct

SEQ ID NO: 9128199 - DNA, 22 bp, Homo sapiens
gagagaaatgtgcagtttgggc

SEQ ID NO: 9128200 - DNA, 22 bp, Homo sapiens
gagaaagaaagggaagtttgtt

SEQ ID NO: 9128201 - DNA, 22 bp, Homo sapiens
gagaaaggcatccttggcttca

SEQ ID NO: 9128202 - DNA, 22 bp, Homo sapiens
gagaaaggcattcctatgcaaa

SEQ ID NO: 9128203 - DNA, 18 bp, Homo sapiens
gagaaagcagggaatgtt

SEQ ID NO: 9128204 - DNA, 22 bp, Homo sapiens
gagaaagattgtccttcagggg

SEQ ID NO: 9128205 - DNA, 22 bp, Homo sapiens
gaccagagaaaggcactggaag

SEQ ID NO: 9128206 - DNA, 22 bp, Homo sapiens
gaggaaagaaccccagtcaata

SEQ ID NO: 9128207 - DNA, 23 bp, Homo sapiens
gaggaaagaatatagatgcaatc

SEQ ID NO: 9128208 - DNA, 22 bp, Homo sapiens
gaggaaacattgtagaagcagt

SEQ ID NO: 9128209 - DNA, 22 bp, Homo sapiens
gagccctggcagtctgggatgg

SEQ ID NO: 9128210 - DNA, 22 bp, Homo sapiens
gaggcagtggtctgatgcaagg

SEQ ID NO: 9128211 - DNA, 22 bp, Homo sapiens
gaggcagtgttgaaaaggagag

SEQ ID NO: 9128212 - DNA, 22 bp, Homo sapiens
gaggcagggtgttgattacaga

SEQ ID NO: 9128213 - DNA, 22 bp, Homo sapiens
gaggcaggccctgaatgagtca

SEQ ID NO: 9128214 - DNA, 22 bp, Homo sapiens
gaggcaggcactgttatcagca

SEQ ID NO: 9128215 - DNA, 22 bp, Homo sapiens
gaggcaggaggattgcttgagc

SEQ ID NO: 9128216 - DNA, 22 bp, Homo sapiens
gaggcaggcagattgcttgagg

SEQ ID NO: 9128217 - DNA, 22 bp, Homo sapiens
gagggagaattgcagccagcgt

SEQ ID NO: 9128218 - DNA, 22 bp, Homo sapiens
ctgggcagctgtatcagggagt

SEQ ID NO: 9128219 - DNA, 22 bp, Homo sapiens
ctgtctctgttgcctgtaggtg

SEQ ID NO: 9128220 - DNA, 22 bp, Homo sapiens
cttacaaaggagaggagatagg

SEQ ID NO: 9128221 - DNA, 22 bp, Homo sapiens
ctgtttaaccagatctcatatc

SEQ ID NO: 9128222 - DNA, 22 bp, Homo sapiens
cttctcaaacctgaaaggacaa

SEQ ID NO: 9128223 - DNA, 22 bp, Homo sapiens
ctttacaaactataaagtgcgg

SEQ ID NO: 9128224 - DNA, 21 bp, Homo sapiens
cttttacattcagtcatgatg

SEQ ID NO: 9128225 - DNA, 22 bp, Homo sapiens
gaaagaggaaggagatgtatta

SEQ ID NO: 9128226 - DNA, 22 bp, Homo sapiens
ccaggcacactgccctgccctt

SEQ ID NO: 9128227 - DNA, 22 bp, Homo sapiens
tcttttgtagctaacacattca

SEQ ID NO: 9128228 - DNA, 22 bp, Homo sapiens
tcttttgtactcagtattgaca

SEQ ID NO: 9128229 - DNA, 22 bp, Homo sapiens
tcttttgtcggtgtatcatgga

SEQ ID NO: 9128230 - DNA, 22 bp, Homo sapiens
tcttttgtcatcccttgtacat

SEQ ID NO: 9128231 - DNA, 22 bp, Homo sapiens
tcttttgtggatgaagaaatgg

SEQ ID NO: 9128232 - DNA, 22 bp, Homo sapiens
tcttttgtgattctttagttac

SEQ ID NO: 9128233 - DNA, 22 bp, Homo sapiens
ccagggagtttccaatctgaga

SEQ ID NO: 9128234 - DNA, 22 bp, Homo sapiens
cccagagatgggaggtgatcgg

SEQ ID NO: 9128235 - DNA, 17 bp, Homo sapiens
cccagagatgctgcctt

SEQ ID NO: 9128236 - DNA, 22 bp, Homo sapiens
tgcagagaaaccagtggaggac

SEQ ID NO: 9128237 - DNA, 22 bp, Homo sapiens
cccagcaggtcggtgctgcctg

SEQ ID NO: 9128238 - DNA, 22 bp, Homo sapiens
cccagcagccttgtcccttctc

SEQ ID NO: 9128239 - DNA, 22 bp, Homo sapiens
tgcaggcagggccagcgtgagg

SEQ ID NO: 9128240 - DNA, 21 bp, Homo sapiens
tgcaggcaggcagagatgctg

SEQ ID NO: 9128241 - DNA, 22 bp, Homo sapiens
tgcaggcaggggatgagcagcc

SEQ ID NO: 9128242 - DNA, 22 bp, Homo sapiens
tgcaggcattggtgagagaagc

SEQ ID NO: 9128243 - DNA, 22 bp, Homo sapiens
ccatatgtctactgctttctgt

SEQ ID NO: 9128244 - DNA, 22 bp, Homo sapiens
tgaggcagtgtgagataataaa

SEQ ID NO: 9128245 - DNA, 22 bp, Homo sapiens
tgaggctgacaaaagatgaggt

SEQ ID NO: 9128246 - DNA, 22 bp, Homo sapiens
tgagccagtggaagatggcagt

SEQ ID NO: 9128247 - DNA, 22 bp, Homo sapiens
tgaggcagtgctgggaagcctg

SEQ ID NO: 9128248 - DNA, 22 bp, Homo sapiens
tgggagagaataatcaataggt

SEQ ID NO: 9128249 - DNA, 22 bp, Homo sapiens
tgctcagggagcttcctggtgg

SEQ ID NO: 9128250 - DNA, 22 bp, Homo sapiens
tggagatgaacatggtgatgtt

SEQ ID NO: 9128251 - DNA, 22 bp, Homo sapiens
tggagatgaggacatggacgtc

SEQ ID NO: 9128252 - DNA, 22 bp, Homo sapiens
tggaggcagtcacctgaagtca

SEQ ID NO: 9128253 - DNA, 22 bp, Homo sapiens
tggaggcagtttaagtctgaga

SEQ ID NO: 9128254 - DNA, 22 bp, Homo sapiens
tggagatgggttaatggagaga

SEQ ID NO: 9128255 - DNA, 22 bp, Homo sapiens
tggagatgcctggagattaggg

SEQ ID NO: 9128256 - DNA, 22 bp, Homo sapiens
tggagatgggaaaaaggaggta

SEQ ID NO: 9128257 - DNA, 22 bp, Homo sapiens
tggagatgcacgagcaggtgga

SEQ ID NO: 9128258 - DNA, 22 bp, Homo sapiens
tcaaaggagacacaaggagaaa

SEQ ID NO: 9128259 - DNA, 22 bp, Homo sapiens
tcaaaggagacacaaggagaaa

SEQ ID NO: 9128260 - DNA, 22 bp, Homo sapiens
tatgaagaaacctatcctctag

SEQ ID NO: 9128261 - DNA, 22 bp, Homo sapiens
tatgaagaaatctttgaaaatc

SEQ ID NO: 9128262 - DNA, 22 bp, Homo sapiens
tatgaagactcatttattgggt

SEQ ID NO: 9128263 - DNA, 20 bp, Homo sapiens
tatgaagactcaagtagggc

SEQ ID NO: 9128264 - DNA, 22 bp, Homo sapiens
tatgaagacaatgatagcatga

SEQ ID NO: 9128265 - DNA, 22 bp, Homo sapiens
tatgaagaagacaaatgacact

SEQ ID NO: 9128266 - DNA, 19 bp, Homo sapiens
tatgaagaatgtggcaaag

SEQ ID NO: 9128267 - DNA, 22 bp, Homo sapiens
tatgaagaagttctgtgaaatg

SEQ ID NO: 9128268 - DNA, 22 bp, Homo sapiens
tatgaagatatatctgatctct

SEQ ID NO: 9128269 - DNA, 22 bp, Homo sapiens
tatatagaaaagcagatgttgg

SEQ ID NO: 9128270 - DNA, 22 bp, Homo sapiens
cagggagaggcatcatagggaa

SEQ ID NO: 9128271 - DNA, 22 bp, Homo sapiens
cagggagaagtctggtcagtcc

SEQ ID NO: 9128272 - DNA, 22 bp, Homo sapiens
cagggagaggctggtggagtaa

SEQ ID NO: 9128273 - DNA, 22 bp, Homo sapiens
cagggagaggcctctgttgccc

SEQ ID NO: 9128274 - DNA, 22 bp, Homo sapiens
cagggagaaatctccaggaggt

SEQ ID NO: 9128275 - DNA, 22 bp, Homo sapiens
cagggagtcaacaaacagatca

SEQ ID NO: 9128276 - DNA, 22 bp, Homo sapiens
tacagagagataagtgtaaaag

SEQ ID NO: 9128277 - DNA, 22 bp, Homo sapiens
tacagagacccacaagagactg

SEQ ID NO: 9128278 - DNA, 22 bp, Homo sapiens
tacacagatttaaaagcaggga

SEQ ID NO: 9128279 - DNA, 20 bp, Homo sapiens
catcaacaccttgtcagcct

SEQ ID NO: 9128280 - DNA, 22 bp, Homo sapiens
catatgttgacatttaaacctc

SEQ ID NO: 9128281 - DNA, 17 bp, Homo sapiens
catccgtgagctcggca

SEQ ID NO: 9128282 - DNA, 22 bp, Homo sapiens
catcatcaactggcaggtaagt

SEQ ID NO: 9128283 - DNA, 22 bp, Homo sapiens
catcatcaaaagtgacagagaa

SEQ ID NO: 9128284 - DNA, 22 bp, Homo sapiens
tccagagtgacaaatgactgat

SEQ ID NO: 9128285 - DNA, 22 bp, Homo sapiens
tccagagtgctgacgcagaccc

SEQ ID NO: 9128286 - DNA, 22 bp, Homo sapiens
tccagagtctcctgttgttgtt

SEQ ID NO: 9128287 - DNA, 22 bp, Homo sapiens
tccagagttgtaagtgttgaca

SEQ ID NO: 9128288 - DNA, 23 bp, Homo sapiens
tccagagtgtgagcttgccgtgc

SEQ ID NO: 9128289 - DNA, 22 bp, Homo sapiens
tccagagtacggaagagtcatc

SEQ ID NO: 9128290 - DNA, 22 bp, Homo sapiens
tccagagtttgagtctccttcc

SEQ ID NO: 9128291 - DNA, 18 bp, Homo sapiens
tccagagagggagaagtg

SEQ ID NO: 9128292 - DNA, 17 bp, Homo sapiens
tccagagaggcttccct

SEQ ID NO: 9128293 - DNA, 23 bp, Homo sapiens
catggaaaactgaaagctgacct

SEQ ID NO: 9128294 - DNA, 22 bp, Homo sapiens
ccagagaggccttggcaagaca

SEQ ID NO: 9128295 - DNA, 22 bp, Homo sapiens
tccataaaccatgcttccaggt

SEQ ID NO: 9128296 - DNA, 22 bp, Homo sapiens
ttctcagaattgactgggagca

SEQ ID NO: 9128297 - DNA, 22 bp, Homo sapiens
ttctatgaaggtaagatgtacg

SEQ ID NO: 9128298 - DNA, 22 bp, Homo sapiens
ttcgttcatagtagaaatggct

SEQ ID NO: 9128299 - DNA, 22 bp, Homo sapiens
ttcgtcaagggctgttggacta

SEQ ID NO: 9128300 - DNA, 22 bp, Homo sapiens
ttcgcccatcatgtctgtagaa

SEQ ID NO: 9128301 - DNA, 22 bp, Homo sapiens
ttctcttagtattgctagttta

SEQ ID NO: 9128302 - DNA, 22 bp, Homo sapiens
ttcttctccgaggagggctggt

SEQ ID NO: 9128303 - DNA, 22 bp, Homo sapiens
ttccaataaaatgttatttgca

SEQ ID NO: 9128304 - DNA, 22 bp, Homo sapiens
ttccccagtagtgacaatcaaa

SEQ ID NO: 9128305 - DNA, 22 bp, Homo sapiens
tttcagtttgaaggaaaggcca

SEQ ID NO: 9128306 - DNA, 22 bp, Homo sapiens
tttcacatggactttttgttct

SEQ ID NO: 9128307 - DNA, 22 bp, Homo sapiens
tttacagatgaggaaactgaga

SEQ ID NO: 9128308 - DNA, 22 bp, Homo sapiens
tttacagagaatgtacataaag

SEQ ID NO: 9128309 - DNA, 22 bp, Homo sapiens
tttatctgtgggagttgtttgg

SEQ ID NO: 9128310 - DNA, 22 bp, Homo sapiens
ttggctggtttcaagaaggcat

SEQ ID NO: 9128311 - DNA, 22 bp, Homo sapiens
tttgtcttcatccttcgagctg

SEQ ID NO: 9128312 - DNA, 22 bp, Homo sapiens
ttttacaggtcataggtatagt

SEQ ID NO: 9128313 - DNA, 22 bp, Homo sapiens
ttttacagttccatgcaaagcg

SEQ ID NO: 9128314 - DNA, 22 bp, Homo sapiens
tttgacagtaataaagcacaag

SEQ ID NO: 9128315 - DNA, 18 bp, Homo sapiens
tttggctgttcaagagca

SEQ ID NO: 9128316 - DNA, 19 bp, Homo sapiens
ctgggaggtgttcagagaa

SEQ ID NO: 9128317 - DNA, 22 bp, Homo sapiens
atatgtggcattatttctgagg

SEQ ID NO: 9128318 - DNA, 22 bp, Homo sapiens
ctgggcaggatacttcatggga

SEQ ID NO: 9128319 - DNA, 22 bp, Homo sapiens
atatgacgatatttttcgatga

SEQ ID NO: 9128320 - DNA, 22 bp, Homo sapiens
atatgaagttacaggtaagaaa

SEQ ID NO: 9128321 - DNA, 22 bp, Homo sapiens
atatgaagtcagacaaactggg

SEQ ID NO: 9128322 - DNA, 22 bp, Homo sapiens
atatgaagaatctaggataggc

SEQ ID NO: 9128323 - DNA, 22 bp, Homo sapiens
atatgaagaattccaatttgga

SEQ ID NO: 9128324 - DNA, 22 bp, Homo sapiens
atccacaagaccccttttcact

SEQ ID NO: 9128325 - DNA, 22 bp, Homo sapiens
atcatcatctaaattgtgtcgc

SEQ ID NO: 9128326 - DNA, 22 bp, Homo sapiens
atcatcatcattgctaacatct

SEQ ID NO: 9128327 - DNA, 22 bp, Homo sapiens
atcatcatgctacaatcagcaa

SEQ ID NO: 9128328 - DNA, 22 bp, Homo sapiens
ctgtctttagtacaaaaaatgt

SEQ ID NO: 9128329 - DNA, 22 bp, Homo sapiens
agtttgatctgacagattttaa

SEQ ID NO: 9128330 - DNA, 22 bp, Homo sapiens
agttggagtgaacatgagattg

SEQ ID NO: 9128331 - DNA, 22 bp, Homo sapiens
ctgaggcatcatggagaacagt

SEQ ID NO: 9128332 - DNA, 22 bp, Homo sapiens
ctgaggcaggggcagctggaga

SEQ ID NO: 9128333 - DNA, 22 bp, Homo sapiens
agttgtatctgaatgcatgtag

SEQ ID NO: 9128334 - DNA, 18 bp, Homo sapiens
atacaagatcaagtgttc

SEQ ID NO: 9128335 - DNA, 19 bp, Homo sapiens
atacaagagagcagttgag

SEQ ID NO: 9128336 - DNA, 22 bp, Homo sapiens
atacaagacagtaggaaactga

SEQ ID NO: 9128337 - DNA, 21 bp, Homo sapiens
atacaagaagatggcagtctg

SEQ ID NO: 9128338 - DNA, 22 bp, Homo sapiens
ctgctttaaaactgatacatga

SEQ ID NO: 9128339 - DNA, 22 bp, Homo sapiens
ctccagagagaaaggaggccgc

SEQ ID NO: 9128340 - DNA, 22 bp, Homo sapiens
ctccagagacacttctcatgat

SEQ ID NO: 9128341 - DNA, 22 bp, Homo sapiens
agtcccaacagcttacaaggaa

SEQ ID NO: 9128342 - DNA, 22 bp, Homo sapiens
agtatgaacctgggttctggat

SEQ ID NO: 9128343 - DNA, 22 bp, Homo sapiens
ctccagagagtccagctctggg

SEQ ID NO: 9128344 - DNA, 22 bp, Homo sapiens
cgaggcagacaaaagttggaag

SEQ ID NO: 9128345 - DNA, 22 bp, Homo sapiens
cgaggcaatagagcccagaggt

SEQ ID NO: 9128346 - DNA, 22 bp, Homo sapiens
cgaggaggaaacgcggagaact

SEQ ID NO: 9128347 - DNA, 22 bp, Homo sapiens
cgaggcagaggctgaaacggct

SEQ ID NO: 9128348 - DNA, 22 bp, Homo sapiens
cgaggcaggcaggcggaggata

SEQ ID NO: 9128349 - DNA, 22 bp, Homo sapiens
aggaggcactcactctcagggt

SEQ ID NO: 9128350 - DNA, 22 bp, Homo sapiens
aggaggtgctagagaagatgtt

SEQ ID NO: 9128351 - DNA, 22 bp, Homo sapiens
aggagaggcatcaagaaaatcg

SEQ ID NO: 9128352 - DNA, 22 bp, Homo sapiens
aggaggaagggaagacaagtaa

SEQ ID NO: 9128353 - DNA, 20 bp, Homo sapiens
aggagctgaattagagggtt

SEQ ID NO: 9128354 - DNA, 20 bp, Homo sapiens
aggaggcaatgtagataagc

SEQ ID NO: 9128355 - DNA, 22 bp, Homo sapiens
aggaggcaactgagatttagaa

SEQ ID NO: 9128356 - DNA, 22 bp, Homo sapiens
aggaggcaaaggtctctgataa

SEQ ID NO: 9128357 - DNA, 22 bp, Homo sapiens
aggaggaggtgggacacagtga

SEQ ID NO: 9128358 - DNA, 22 bp, Homo sapiens
aggaggaggtgggacacagtga

SEQ ID NO: 9128359 - DNA, 22 bp, Homo sapiens
aggaggaggctggagtacaccc

SEQ ID NO: 9128360 - DNA, 22 bp, Homo sapiens
aggaggaattgacacagaagcc

SEQ ID NO: 9128361 - DNA, 22 bp, Homo sapiens
aggaggaattgacacagaagcc

SEQ ID NO: 9128362 - DNA, 22 bp, Homo sapiens
agcttgtcagcagttaatgata

SEQ ID NO: 9128363 - DNA, 22 bp, Homo sapiens
aggccagctcaccctggctcct

SEQ ID NO: 9128364 - DNA, 22 bp, Homo sapiens
aggccagctatgactctgctcc

SEQ ID NO: 9128365 - DNA, 22 bp, Homo sapiens
aggccagccttgtaaatgcctc

SEQ ID NO: 9128366 - DNA, 22 bp, Homo sapiens
aggccagcctgcccaaagctgc

SEQ ID NO: 9128367 - DNA, 22 bp, Homo sapiens
aggccagcgctgctagctcccg

SEQ ID NO: 9128368 - DNA, 22 bp, Homo sapiens
aggccagcctcaggcagggacc

SEQ ID NO: 9128369 - DNA, 22 bp, Homo sapiens
aggccagcaagaaagagagtct

SEQ ID NO: 9128370 - DNA, 22 bp, Homo sapiens
aggcagttgttgctgagcagct

SEQ ID NO: 9128371 - DNA, 22 bp, Homo sapiens
cccagcagttgttggtgcacat

SEQ ID NO: 9128372 - DNA, 21 bp, Homo sapiens
ccataaacagatggtaactgt

SEQ ID NO: 9128373 - DNA, 22 bp, Homo sapiens
agggagagtttgatgtttcctc

SEQ ID NO: 9128374 - DNA, 22 bp, Homo sapiens
agggagaggttgaaacctcagt

SEQ ID NO: 9128375 - DNA, 22 bp, Homo sapiens
agggagaggctgaactatccta

SEQ ID NO: 9128376 - DNA, 22 bp, Homo sapiens
agggagagtagatatcaggtgt

SEQ ID NO: 9128377 - DNA, 22 bp, Homo sapiens
cagagtatatatctcattttta

SEQ ID NO: 9128378 - DNA, 22 bp, Homo sapiens
cagagtatctaactgatgggta

SEQ ID NO: 9128379 - DNA, 22 bp, Homo sapiens
cagagtatttctctttggggag

SEQ ID NO: 9128380 - DNA, 22 bp, Homo sapiens
cagagtatccctttagaattaa

SEQ ID NO: 9128381 - DNA, 22 bp, Homo sapiens
gtatgaagtaagatattgttca

SEQ ID NO: 9128382 - DNA, 22 bp, Homo sapiens
gggaaagagaggtggacgcagg

SEQ ID NO: 9128383 - DNA, 22 bp, Homo sapiens
cacaaaatatcaagcactttta

SEQ ID NO: 9128384 - DNA, 22 bp, Homo sapiens
cacaaaatctttctcgattatt

SEQ ID NO: 9128385 - DNA, 21 bp, Homo sapiens
cacaccaggcatgtcttgagc

SEQ ID NO: 9128386 - DNA, 23 bp, Homo sapiens
cacaccaggagccgtctgggcca

SEQ ID NO: 9128387 - DNA, 22 bp, Homo sapiens
cacaccagcatggtctcagtgt

SEQ ID NO: 9128388 - DNA, 22 bp, Homo sapiens
cacaccagatggcagcgtggga

SEQ ID NO: 9128389 - DNA, 22 bp, Homo sapiens
cacaccagaggttacctgcaaa

SEQ ID NO: 9128390 - DNA, 22 bp, Homo sapiens
gcttctcttgtccaagggcagg

SEQ ID NO: 9128391 - DNA, 22 bp, Homo sapiens
gctgcagtgagccaagatcgtg

SEQ ID NO: 9128392 - DNA, 22 bp, Homo sapiens
caagatggacataaggagagaa

SEQ ID NO: 9128393 - DNA, 22 bp, Homo sapiens
ggatgttctggggttctcttgt

SEQ ID NO: 9128394 - DNA, 22 bp, Homo sapiens
ggcagatggaagaggctgggtc

SEQ ID NO: 9128395 - DNA, 22 bp, Homo sapiens
ggcagttgctgtggatgaggtt

SEQ ID NO: 9128396 - DNA, 22 bp, Homo sapiens
caccccagtctaaaaccagcct

SEQ ID NO: 9128397 - DNA, 22 bp, Homo sapiens
ggcatacaagagaaatataaga

SEQ ID NO: 9128398 - DNA, 22 bp, Homo sapiens
ggctagggatctagaccaggac

SEQ ID NO: 9128399 - DNA, 22 bp, Homo sapiens
ggctagggagacagagggcatg

SEQ ID NO: 9128400 - DNA, 22 bp, Homo sapiens
atgtgtgtgtgcgcgcgcagga

SEQ ID NO: 9128401 - DNA, 22 bp, Homo sapiens
atgtgtgtgtttaatcctcaaa

SEQ ID NO: 9128402 - DNA, 22 bp, Homo sapiens
gatgaggctagagacatgtgta

SEQ ID NO: 9128403 - DNA, 22 bp, Homo sapiens
gatgaggccacacggggtgggc

SEQ ID NO: 9128404 - DNA, 22 bp, Homo sapiens
gatgaggcataaacacagtcac

SEQ ID NO: 9128405 - DNA, 22 bp, Homo sapiens
gatgaggcagctcagggggaaa

SEQ ID NO: 9128406 - DNA, 22 bp, Homo sapiens
gatgaggcaagccagaggactg

SEQ ID NO: 9128407 - DNA, 18 bp, Homo sapiens
gatgaggctgtctgagaa

SEQ ID NO: 9128408 - DNA, 22 bp, Homo sapiens
gatgaggctgtagagggtggca

SEQ ID NO: 9128409 - DNA, 23 bp, Homo sapiens
attagaaaggctttctggtgaaa

SEQ ID NO: 9128410 - DNA, 22 bp, Homo sapiens
attcagtgtttgcagcaacttt

SEQ ID NO: 9128411 - DNA, 22 bp, Homo sapiens
attcagtgggtgctcagcacaa

SEQ ID NO: 9128412 - DNA, 22 bp, Homo sapiens
caaactgtatgaccctaggccg

SEQ ID NO: 9128413 - DNA, 22 bp, Homo sapiens
atgcagatgtttggttcattgt

SEQ ID NO: 9128414 - DNA, 22 bp, Homo sapiens
atgaggtggtcttcagtaggtc

SEQ ID NO: 9128415 - DNA, 22 bp, Homo sapiens
atgaggcaggtggaggctgcca

SEQ ID NO: 9128416 - DNA, 22 bp, Homo sapiens
atgaggcaggattaagctatca

SEQ ID NO: 9128417 - DNA, 22 bp, Homo sapiens
atgaggcaggatattaactttt

SEQ ID NO: 9128418 - DNA, 22 bp, Homo sapiens
atgaggcagtacacacaaagcc

SEQ ID NO: 9128419 - DNA, 22 bp, Homo sapiens
atgaggcaggagtgcagtggca

SEQ ID NO: 9128420 - DNA, 22 bp, Homo sapiens
atgaggcaggaaaggcgtatct

SEQ ID NO: 9128421 - DNA, 22 bp, Homo sapiens
atgaggcaggagcggggaccct

SEQ ID NO: 9128422 - DNA, 22 bp, Homo sapiens
atgaggcagctgacagctgttc

SEQ ID NO: 9128423 - DNA, 22 bp, Homo sapiens
atgaggcagctggctttctccc

SEQ ID NO: 9128424 - DNA, 22 bp, Homo sapiens
atgaggcagctgctggagaacg

SEQ ID NO: 9128425 - DNA, 22 bp, Homo sapiens
atgaggcagatgttgcatgagg

SEQ ID NO: 9128426 - DNA, 22 bp, Homo sapiens
atgaggcagagggctgtgccag

SEQ ID NO: 9128427 - DNA, 22 bp, Homo sapiens
atgaggcagcacatgggattgt

SEQ ID NO: 9128428 - DNA, 22 bp, Homo sapiens
atgaggcagcccttcccttctc

SEQ ID NO: 9128429 - DNA, 22 bp, Homo sapiens
atgaagattctatttatcactt

SEQ ID NO: 9128430 - DNA, 22 bp, Homo sapiens
atgaagatgtgaaggctggatt

SEQ ID NO: 9128431 - DNA, 22 bp, Homo sapiens
atgaagatggttcaactggcct

SEQ ID NO: 9128432 - DNA, 22 bp, Homo sapiens
atgaagatattcttgttttctg

SEQ ID NO: 9128433 - DNA, 21 bp, Homo sapiens
atgaagatgacaatttgagag

SEQ ID NO: 9128434 - DNA, 22 bp, Homo sapiens
atgaagataagaccaggctgga

SEQ ID NO: 9128435 - DNA, 22 bp, Homo sapiens
atgaagatacaggcagggccat

SEQ ID NO: 9128436 - DNA, 22 bp, Homo sapiens
atgaagataatagcattggttg

SEQ ID NO: 9128437 - DNA, 22 bp, Homo sapiens
atgaagatttataattgccttt

SEQ ID NO: 9128438 - DNA, 19 bp, Homo sapiens
atgaagattggtaaattca

SEQ ID NO: 9128439 - DNA, 22 bp, Homo sapiens
atgaagatttcccagagacatg

SEQ ID NO: 9128440 - DNA, 22 bp, Homo sapiens
cttggttaggttatgaatgccc

SEQ ID NO: 9128441 - DNA, 22 bp, Homo sapiens
atctatcacctttaggtttgtt

SEQ ID NO: 9128442 - DNA, 22 bp, Homo sapiens
atgaaaacggaccagagctatt

SEQ ID NO: 9128443 - DNA, 22 bp, Homo sapiens
gaggggagacagggaaatcagt

SEQ ID NO: 9128444 - DNA, 22 bp, Homo sapiens
atgtgtgtatgtgcctatatct

SEQ ID NO: 9128445 - DNA, 22 bp, Homo sapiens
atgtgtgtgatgggcgccgcca

SEQ ID NO: 9128446 - DNA, 22 bp, Homo sapiens
atgtgtgtatatatagtcattt

SEQ ID NO: 9128447 - DNA, 22 bp, Homo sapiens
atgtcttttatggagatgtcat

SEQ ID NO: 9128448 - DNA, 22 bp, Homo sapiens
atgtctttggctttgacatggc

SEQ ID NO: 9128449 - DNA, 22 bp, Homo sapiens
atgtcttttatgattacgggat

SEQ ID NO: 9128450 - DNA, 22 bp, Homo sapiens
atgtctttgccatagttcatat

SEQ ID NO: 9128451 - DNA, 22 bp, Homo sapiens
atgtctttattaatatcatgcc

SEQ ID NO: 9128452 - DNA, 23 bp, Homo sapiens
gacagagtgagaccttgtcttac

SEQ ID NO: 9128453 - DNA, 22 bp, Homo sapiens
gagaaaggtactattccctcca

SEQ ID NO: 9128454 - DNA, 22 bp, Homo sapiens
gagaaagggataatttgaagag

SEQ ID NO: 9128455 - DNA, 22 bp, Homo sapiens
agccacagagcaggagaccttt

SEQ ID NO: 9128456 - DNA, 22 bp, Homo sapiens
agccacagagagggagctgcaa

SEQ ID NO: 9128457 - DNA, 22 bp, Homo sapiens
agccacagcccacaggactctt

SEQ ID NO: 9128458 - DNA, 22 bp, Homo sapiens
cagagagggagcagtagtctct

SEQ ID NO: 9128459 - DNA, 22 bp, Homo sapiens
agccctcatggaacagctccta

SEQ ID NO: 9128460 - DNA, 17 bp, Homo sapiens
agcccccactcccaagt

SEQ ID NO: 9128461 - DNA, 22 bp, Homo sapiens
agctcccagagtcctctgccca

SEQ ID NO: 9128462 - DNA, 22 bp, Homo sapiens
agctcccagcagagctggccac

SEQ ID NO: 9128463 - DNA, 22 bp, Homo sapiens
agctcccagtctcctctccatg

SEQ ID NO: 9128464 - DNA, 22 bp, Homo sapiens
agcagttgtagtcatggaaaat

SEQ ID NO: 9128465 - DNA, 22 bp, Homo sapiens
agaggtagaggttgcagtgagc

SEQ ID NO: 9128466 - DNA, 22 bp, Homo sapiens
agaggtagaaaataatggagag

SEQ ID NO: 9128467 - DNA, 22 bp, Homo sapiens
agatgtggatcctagggtagaa

SEQ ID NO: 9128468 - DNA, 22 bp, Homo sapiens
agatgaaaagataagcagcaat

SEQ ID NO: 9128469 - DNA, 22 bp, Homo sapiens
atgtgtgtacacacgtgactct

SEQ ID NO: 9128470 - DNA, 22 bp, Homo sapiens
agaagatgactttggagttgga

SEQ ID NO: 9128471 - DNA, 22 bp, Homo sapiens
agaagatgtcactgcagacagc

SEQ ID NO: 9128472 - DNA, 22 bp, Homo sapiens
agaagatgttgcagttgatgcg

SEQ ID NO: 9128473 - DNA, 20 bp, Homo sapiens
agaagaggatacaaccaggc

SEQ ID NO: 9128474 - DNA, 22 bp, Homo sapiens
atgcagggaggtaagaggtgcc

SEQ ID NO: 9128475 - DNA, 21 bp, Homo sapiens
agaattaaattggatttgtgt

SEQ ID NO: 9128476 - DNA, 22 bp, Homo sapiens
agaatgctttggatatattgga

SEQ ID NO: 9128477 - DNA, 22 bp, Homo sapiens
atggagttctgccagcgctgct

SEQ ID NO: 9128478 - DNA, 22 bp, Homo sapiens
aggtacatggggtgtgtgcacg

SEQ ID NO: 9128479 - DNA, 22 bp, Homo sapiens
aggtagaggcctccaggcagca

SEQ ID NO: 9128480 - DNA, 22 bp, Homo sapiens
actgcaaagccagatattatca

SEQ ID NO: 9128481 - DNA, 22 bp, Homo sapiens
atccagagtggccttctttcca

SEQ ID NO: 9128482 - DNA, 22 bp, Homo sapiens
atccagagtgtaattctccatg

SEQ ID NO: 9128483 - DNA, 22 bp, Homo sapiens
atccagaggcactgccctttgt

SEQ ID NO: 9128484 - DNA, 22 bp, Homo sapiens
atccagagtaatacagaatgca

SEQ ID NO: 9128485 - DNA, 22 bp, Homo sapiens
atccagagttgctgtatatctt

SEQ ID NO: 9128486 - DNA, 22 bp, Homo sapiens
atccagagttatatccaagcag

SEQ ID NO: 9128487 - DNA, 22 bp, Homo sapiens
atccagagacccaaggacagaa

SEQ ID NO: 9128488 - DNA, 22 bp, Homo sapiens
atccagagactggggctgggat

SEQ ID NO: 9128489 - DNA, 22 bp, Homo sapiens
atccagagaggttaggtgacat

SEQ ID NO: 9128490 - DNA, 22 bp, Homo sapiens
atccagagggtagcaggattag

SEQ ID NO: 9128491 - DNA, 22 bp, Homo sapiens
atcactagctcaacatttacta

SEQ ID NO: 9128492 - DNA, 23 bp, Homo sapiens
atcaccagcggaagctgcagacc

SEQ ID NO: 9128493 - DNA, 22 bp, Homo sapiens
atcagagtagttgttgcccaga

SEQ ID NO: 9128494 - DNA, 22 bp, Homo sapiens
acttcagtaggtgatatgtgca

SEQ ID NO: 9128495 - DNA, 22 bp, Homo sapiens
agtttataaaacattgcgtggc

SEQ ID NO: 9128496 - DNA, 22 bp, Homo sapiens
agtttatagcccagattcatgg

SEQ ID NO: 9128497 - DNA, 22 bp, Homo sapiens
agtttcatttcttagtaccagt

SEQ ID NO: 9128498 - DNA, 22 bp, Homo sapiens
accccagctctgagccacacca

SEQ ID NO: 9128499 - DNA, 22 bp, Homo sapiens
agggaagaggaccagagtctct

SEQ ID NO: 9128500 - DNA, 22 bp, Homo sapiens
acatgaaagttattctgagttg

SEQ ID NO: 9128501 - DNA, 22 bp, Homo sapiens
aggcagggctgggattagactc

SEQ ID NO: 9128502 - DNA, 22 bp, Homo sapiens
aggcagggctcatttcttaggc

SEQ ID NO: 9128503 - DNA, 17 bp, Homo sapiens
aggcaggcagagcggga

SEQ ID NO: 9128504 - DNA, 22 bp, Homo sapiens
aggcagggaccagttgttttct

SEQ ID NO: 9128505 - DNA, 22 bp, Homo sapiens
acatggaagcaaagttctattt

SEQ ID NO: 9128506 - DNA, 20 bp, Homo sapiens
acatggaaggtcaaactatc

SEQ ID NO: 9128507 - DNA, 22 bp, Homo sapiens
acatggaaagtactccacaatt

SEQ ID NO: 9128508 - DNA, 22 bp, Homo sapiens
acatggaaaactaactgctttt

SEQ ID NO: 9128509 - DNA, 22 bp, Homo sapiens
acatggaatgtgtactaagtta

SEQ ID NO: 9128510 - DNA, 22 bp, Homo sapiens
aggcaggattgctgacaacaat

SEQ ID NO: 9128511 - DNA, 22 bp, Homo sapiens
aggagtgccttttcatgagtgt

SEQ ID NO: 9128512 - DNA, 20 bp, Homo sapiens
aggaggaaaaaatgacgagc

SEQ ID NO: 9128513 - DNA, 22 bp, Homo sapiens
aaggaggaatttcagggtgaat

SEQ ID NO: 9128514 - DNA, 22 bp, Homo sapiens
aaggaggaatttcagggtgaat

SEQ ID NO: 9128515 - DNA, 17 bp, Homo sapiens
aagcggagggccgggcc

SEQ ID NO: 9128516 - DNA, 22 bp, Homo sapiens
actgttcttgtaacacttaaat

SEQ ID NO: 9128517 - DNA, 22 bp, Homo sapiens
actgttcgaggctgacaaagta

SEQ ID NO: 9128518 - DNA, 22 bp, Homo sapiens
aatgtgaggccttggtagttat

SEQ ID NO: 9128519 - DNA, 22 bp, Homo sapiens
aatgtgagccaatgcccgtggg

SEQ ID NO: 9128520 - DNA, 22 bp, Homo sapiens
aattaacaaatgtagctgtgat

SEQ ID NO: 9128521 - DNA, 22 bp, Homo sapiens
agaccccatacctcagcaggta

SEQ ID NO: 9128522 - DNA, 22 bp, Homo sapiens
acaacaaagacacttgaaatga

SEQ ID NO: 9128523 - DNA, 22 bp, Homo sapiens
acaagagattatctacagatga

SEQ ID NO: 9128524 - DNA, 22 bp, Homo sapiens
acagaattaatgaaaattacaa

SEQ ID NO: 9128525 - DNA, 19 bp, Homo sapiens
agccagggtgagaaggagc

SEQ ID NO: 9128526 - DNA, 22 bp, Homo sapiens
acagagagaaacaatcagcagc

SEQ ID NO: 9128527 - DNA, 22 bp, Homo sapiens
acagagaaagtgggctgaagat

SEQ ID NO: 9128528 - DNA, 17 bp, Homo sapiens
acagagctacatattct

SEQ ID NO: 9128529 - DNA, 22 bp, Homo sapiens
acacagagggcagaagatacat

SEQ ID NO: 9128530 - DNA, 22 bp, Homo sapiens
aaccttcttgtgcagaactgta

SEQ ID NO: 9128531 - DNA, 22 bp, Homo sapiens
aacacagagtatttgaagcatt

SEQ ID NO: 9128532 - DNA, 22 bp, Homo sapiens
aacacagacatagtgattacag

SEQ ID NO: 9128533 - DNA, 20 bp, Homo sapiens
aacacagataccaaaggttg

SEQ ID NO: 9128534 - DNA, 22 bp, Homo sapiens
aacacagatcaaaatatttcct

SEQ ID NO: 9128535 - DNA, 22 bp, Homo sapiens
aagagaaggccctgacccaccc

SEQ ID NO: 9128536 - DNA, 22 bp, Homo sapiens
aagagaaggtgaggaagccggt

SEQ ID NO: 9128537 - DNA, 22 bp, Homo sapiens
aagagaaagcagactttgtcat

SEQ ID NO: 9128538 - DNA, 22 bp, Homo sapiens
aagaaactcactttgggaggca

SEQ ID NO: 9128539 - DNA, 22 bp, Homo sapiens
aagatggagtagtgtaatggtt

SEQ ID NO: 9128540 - DNA, 22 bp, Homo sapiens
aagatgttagaggtcatgcaga

SEQ ID NO: 9128541 - DNA, 22 bp, Homo sapiens
aagatgttaggaaagttagggt

SEQ ID NO: 9128542 - DNA, 22 bp, Homo sapiens
aagatgttagattatggggaca

SEQ ID NO: 9128543 - DNA, 22 bp, Homo sapiens
aagatgttactcaaccaggata

SEQ ID NO: 9128544 - DNA, 22 bp, Homo sapiens
aagatgttaaattgggggcatt

SEQ ID NO: 9128545 - DNA, 22 bp, Homo sapiens
aagatgttaaatctgtagaatt

SEQ ID NO: 9128546 - DNA, 22 bp, Homo sapiens
aagatgttattgtcttccttgc

SEQ ID NO: 9128547 - DNA, 22 bp, Homo sapiens
aagatgttagggtggaagggat

SEQ ID NO: 9128548 - DNA, 22 bp, Homo sapiens
acagcaaaagacaagaacttaa

SEQ ID NO: 9128549 - DNA, 21 bp, Homo sapiens
aaagatgtttcttttcctcac

SEQ ID NO: 9128550 - DNA, 22 bp, Homo sapiens
aaatacattagacggagagtta

SEQ ID NO: 9128551 - DNA, 22 bp, Homo sapiens
aagaggaggatgctttacagct

SEQ ID NO: 9128552 - DNA, 22 bp, Homo sapiens
aagatgttttaatatttcgagg

SEQ ID NO: 9128553 - DNA, 22 bp, Homo sapiens
aagatgtttaggtaaaaagttt

SEQ ID NO: 9128554 - DNA, 22 bp, Homo sapiens
aagatgttgggtgcctccggaa

SEQ ID NO: 9128555 - DNA, 22 bp, Homo sapiens
aagatgttgtcgttagtgatga

SEQ ID NO: 9128556 - DNA, 22 bp, Homo sapiens
aagatgtttagatttatacaat

SEQ ID NO: 9128557 - DNA, 18 bp, Homo sapiens
aagatgtttaatgggaag

SEQ ID NO: 9128558 - DNA, 22 bp, Homo sapiens
aagatgttgcattagaatacct

SEQ ID NO: 9128559 - DNA, 22 bp, Homo sapiens
aagatgttgcaagggactcttc

SEQ ID NO: 9128560 - DNA, 22 bp, Homo sapiens
aaaattaagtgtctgggaagcc

SEQ ID NO: 9128561 - DNA, 22 bp, Homo sapiens
aaaaggaggcaaacagcctaga

SEQ ID NO: 9128562 - DNA, 22 bp, Homo sapiens
aaactgtgaagcaagtacaagg

SEQ ID NO: 9128563 - DNA, 22 bp, Homo sapiens
aaatagtttagctctcatttca

SEQ ID NO: 9128564 - DNA, 22 bp, Homo sapiens
aaagaaacctatcagccacatg

SEQ ID NO: 9128565 - DNA, 22 bp, Homo sapiens
aaagagaacttttacccaagaa

SEQ ID NO: 9128566 - DNA, 21 bp, Homo sapiens
aaagatgtttcatctgagaaa

SEQ ID NO: 9128567 - DNA, 23 bp, Homo sapiens
aaagatgttcccaaagttcacgt

SEQ ID NO: 9128568 - DNA, 22 bp, Homo sapiens
aaacagagtttggtaaatagcc

SEQ ID NO: 9128569 - DNA, 22 bp, Homo sapiens
ggctcagcccccacgcttcttc

SEQ ID NO: 9128570 - DNA, 22 bp, Homo sapiens
ggcccagcccgagtcagccttc

SEQ ID NO: 9128571 - DNA, 22 bp, Homo sapiens
ggcccagcctcagacatgccct

SEQ ID NO: 9128572 - DNA, 22 bp, Homo sapiens
ggccccacgggggagtcctagt

SEQ ID NO: 9128573 - DNA, 22 bp, Homo sapiens
gggtctctgagcttccaagata

SEQ ID NO: 9128574 - DNA, 22 bp, Homo sapiens
gggtgagacagaaagagcaaaa

SEQ ID NO: 9128575 - DNA, 22 bp, Homo sapiens
gggaggagcttggagattcact

SEQ ID NO: 9128576 - DNA, 21 bp, Homo sapiens
gggccacaccttctgcagacc

SEQ ID NO: 9128577 - DNA, 22 bp, Homo sapiens
gggcagcccagaactgctgcag

SEQ ID NO: 9128578 - DNA, 22 bp, Homo sapiens
ggagacacccacattgctgggt

SEQ ID NO: 9128579 - DNA, 22 bp, Homo sapiens
ggaggcagaatagagtgtgggt

SEQ ID NO: 9128580 - DNA, 22 bp, Homo sapiens
ggaggaggcaagtaccagatgc

SEQ ID NO: 9128581 - DNA, 22 bp, Homo sapiens
ggaggccaggtgggagtcatct

SEQ ID NO: 9128582 - DNA, 22 bp, Homo sapiens
ggaggaagggcccaggctttat

SEQ ID NO: 9128583 - DNA, 22 bp, Homo sapiens
ggaggaaatccttagtaaggca

SEQ ID NO: 9128584 - DNA, 22 bp, Homo sapiens
ggaagaaatgctcttctatgcg

SEQ ID NO: 9128585 - DNA, 22 bp, Homo sapiens
ggaagaaagacatttattttga

SEQ ID NO: 9128586 - DNA, 22 bp, Homo sapiens
ggaaagagctaaaagggtgaga

SEQ ID NO: 9128587 - DNA, 22 bp, Homo sapiens
ggaaactgcttacactagaggg

SEQ ID NO: 9128588 - DNA, 22 bp, Homo sapiens
ggaggtcataagtgtatagatg

SEQ ID NO: 9128589 - DNA, 22 bp, Homo sapiens
ggcagacctctccagccccaca

SEQ ID NO: 9128590 - DNA, 22 bp, Homo sapiens
ggagttgacagtttagaagctt

SEQ ID NO: 9128591 - DNA, 22 bp, Homo sapiens
ggagttgatcagagtaggaggt

SEQ ID NO: 9128592 - DNA, 22 bp, Homo sapiens
ggcaggtgctaagagaggtaaa

SEQ ID NO: 9128593 - DNA, 22 bp, Homo sapiens
ggcaggcattgcaacatgtaca

SEQ ID NO: 9128594 - DNA, 22 bp, Homo sapiens
ggcagaggaagctggaagtggg

SEQ ID NO: 9128595 - DNA, 22 bp, Homo sapiens
ggcagctggggcagtgccctgt

SEQ ID NO: 9128596 - DNA, 22 bp, Homo sapiens
ggcagctgtgaagtgcctcaca

SEQ ID NO: 9128597 - DNA, 22 bp, Homo sapiens
gtacaggatgtgtaaacttggg

SEQ ID NO: 9128598 - DNA, 22 bp, Homo sapiens
gtatatatgtgtgaacatgtat

SEQ ID NO: 9128599 - DNA, 22 bp, Homo sapiens
gtatatgagctctatgtaatgg

SEQ ID NO: 9128600 - DNA, 22 bp, Homo sapiens
gtacatgtgcacaacatgcatg

SEQ ID NO: 9128601 - DNA, 22 bp, Homo sapiens
ggtgcaaaagtaatcacagttt

SEQ ID NO: 9128602 - DNA, 22 bp, Homo sapiens
gtctgactcataagatctcttg

SEQ ID NO: 9128603 - DNA, 22 bp, Homo sapiens
gtctgacttgcgggcactctgg

SEQ ID NO: 9128604 - DNA, 22 bp, Homo sapiens
gtccttccccagccagctctgg

SEQ ID NO: 9128605 - DNA, 22 bp, Homo sapiens
gtggccagcaagtgctgcctct

SEQ ID NO: 9128606 - DNA, 22 bp, Homo sapiens
gtggaggtcccgggcaggagca

SEQ ID NO: 9128607 - DNA, 22 bp, Homo sapiens
gtggaggcagtgacacagtagc

SEQ ID NO: 9128608 - DNA, 22 bp, Homo sapiens
gttctgagtcctcctttgaagg

SEQ ID NO: 9128609 - DNA, 22 bp, Homo sapiens
gttgtatatgtagagaatggtc

SEQ ID NO: 9128610 - DNA, 22 bp, Homo sapiens
gttgtataaggaatgttgttta

SEQ ID NO: 9128611 - DNA, 22 bp, Homo sapiens
gtgggcagtggtttgcgcggtc

SEQ ID NO: 9128612 - DNA, 22 bp, Homo sapiens
gtgggcagcaccagggaagtgt

SEQ ID NO: 9128613 - DNA, 22 bp, Homo sapiens
taacactggtatttcatttagt

SEQ ID NO: 9128614 - DNA, 22 bp, Homo sapiens
taaagctgaaatgattatgaca

SEQ ID NO: 9128615 - DNA, 22 bp, Homo sapiens
taaagctgcaggctcagaaaac

SEQ ID NO: 9128616 - DNA, 22 bp, Homo sapiens
gcagaagcccggtcagcgcacg

SEQ ID NO: 9128617 - DNA, 22 bp, Homo sapiens
gatggacacctcctgaggttct

SEQ ID NO: 9128618 - DNA, 22 bp, Homo sapiens
gatggaggagatggcagggtgc

SEQ ID NO: 9128619 - DNA, 22 bp, Homo sapiens
gatgttcagactctaggtcaga

SEQ ID NO: 9128620 - DNA, 22 bp, Homo sapiens
gatgttcgagcagaagaccagg

SEQ ID NO: 9128621 - DNA, 22 bp, Homo sapiens
gatgttcgctttggtttgtccc

SEQ ID NO: 9128622 - DNA, 22 bp, Homo sapiens
gatgttcggcgattgggggtgg

SEQ ID NO: 9128623 - DNA, 22 bp, Homo sapiens
gcaggagagccagcaggcttcc

SEQ ID NO: 9128624 - DNA, 22 bp, Homo sapiens
gcaggcaccgggttgctcccct

SEQ ID NO: 9128625 - DNA, 22 bp, Homo sapiens
gcaggcaccgcggcggcaggtt

SEQ ID NO: 9128626 - DNA, 22 bp, Homo sapiens
gcaggcaccacggctcaggtct

SEQ ID NO: 9128627 - DNA, 22 bp, Homo sapiens
gcaggcacatgggcgggtctgg

SEQ ID NO: 9128628 - DNA, 20 bp, Homo sapiens
gcagggcaagggatatgaaa

SEQ ID NO: 9128629 - DNA, 17 bp, Homo sapiens
gcaggcactgctgcctg

SEQ ID NO: 9128630 - DNA, 22 bp, Homo sapiens
gctccagagcagagactaggtt

SEQ ID NO: 9128631 - DNA, 22 bp, Homo sapiens
gctccagatgaaaggccagagg

SEQ ID NO: 9128632 - DNA, 22 bp, Homo sapiens
gcctgccagtgtttgaggattg

SEQ ID NO: 9128633 - DNA, 21 bp, Homo sapiens
gccgctgctgcgtgtcccttt

SEQ ID NO: 9128634 - DNA, 22 bp, Homo sapiens
gccaggctctcagtgactgccc

SEQ ID NO: 9128635 - DNA, 22 bp, Homo sapiens
gagtggagcaaaagaggtagat

SEQ ID NO: 9128636 - DNA, 22 bp, Homo sapiens
gatcatcaagcaagaacctgat

SEQ ID NO: 9128637 - DNA, 22 bp, Homo sapiens
gaggaggctgaacaatgccctg

SEQ ID NO: 9128638 - DNA, 22 bp, Homo sapiens
gaggaggctggcgccgcctgcc

SEQ ID NO: 9128639 - DNA, 22 bp, Homo sapiens
gaggaggctgtttctctgcatt

SEQ ID NO: 9128640 - DNA, 19 bp, Homo sapiens
gaggaggcttcagctttct

SEQ ID NO: 9128641 - DNA, 22 bp, Homo sapiens
gaggaggcttccgggaggcacg

SEQ ID NO: 9128642 - DNA, 22 bp, Homo sapiens
gaggcagaggttgcagtgagct

SEQ ID NO: 9128643 - DNA, 22 bp, Homo sapiens
gaggcagcaggctgaggaggat

SEQ ID NO: 9128644 - DNA, 22 bp, Homo sapiens
gaggtcaggcttgcagcagggt

SEQ ID NO: 9128645 - DNA, 22 bp, Homo sapiens
gaggtcaggggagaggctgatg

SEQ ID NO: 9128646 - DNA, 19 bp, Homo sapiens
gaggtcagcaagaagtatt

SEQ ID NO: 9128647 - DNA, 22 bp, Homo sapiens
gaactgtgtacattgtagataa

SEQ ID NO: 9128648 - DNA, 22 bp, Homo sapiens
gaaggagaggattgtgaggctg

SEQ ID NO: 9128649 - DNA, 22 bp, Homo sapiens
gacacagagggcaccagatatg

SEQ ID NO: 9128650 - DNA, 22 bp, Homo sapiens
gaacagagctgactacaaggca

SEQ ID NO: 9128651 - DNA, 22 bp, Homo sapiens
gaacagagttgaaacaaggctg

SEQ ID NO: 9128652 - DNA, 22 bp, Homo sapiens
gaacagagaagctttactaaag

SEQ ID NO: 9128653 - DNA, 22 bp, Homo sapiens
ctttatatccagatgtttggtg

SEQ ID NO: 9128654 - DNA, 22 bp, Homo sapiens
tgtaggcatattcatagagttg

SEQ ID NO: 9128655 - DNA, 20 bp, Homo sapiens
tgtaggtgtacagtaaggag

SEQ ID NO: 9128656 - DNA, 22 bp, Homo sapiens
tgtgaggatgttaaggggatga

SEQ ID NO: 9128657 - DNA, 22 bp, Homo sapiens
tgtgaggaacaggactagagca

SEQ ID NO: 9128658 - DNA, 22 bp, Homo sapiens
tgtgaggaacccggaatgtggg

SEQ ID NO: 9128659 - DNA, 22 bp, Homo sapiens
tgtgaggacattggaggactca

SEQ ID NO: 9128660 - DNA, 22 bp, Homo sapiens
tgtgaggacctcagcagagtct

SEQ ID NO: 9128661 - DNA, 22 bp, Homo sapiens
tgtgaggataaaaaggaaggag

SEQ ID NO: 9128662 - DNA, 22 bp, Homo sapiens
tgtctttacttagaagttcagg

SEQ ID NO: 9128663 - DNA, 22 bp, Homo sapiens
tgtctttacttaataaatatac

SEQ ID NO: 9128664 - DNA, 22 bp, Homo sapiens
cctgggcaatatagtgaggccc

SEQ ID NO: 9128665 - DNA, 22 bp, Homo sapiens
tgtgtgtcagagtctccatggt

SEQ ID NO: 9128666 - DNA, 20 bp, Homo sapiens
cctctctgcatgctccctga

SEQ ID NO: 9128667 - DNA, 22 bp, Homo sapiens
cctctctgtagcagcccccagt

SEQ ID NO: 9128668 - DNA, 22 bp, Homo sapiens
cctctctgtcacaccagtggcc

SEQ ID NO: 9128669 - DNA, 22 bp, Homo sapiens
cctccagactttggccatcctc

SEQ ID NO: 9128670 - DNA, 21 bp, Homo sapiens
tggccagctggagtctccaca

SEQ ID NO: 9128671 - DNA, 22 bp, Homo sapiens
cccccagccagcagtgctcagc

SEQ ID NO: 9128672 - DNA, 22 bp, Homo sapiens
cccccagctctgctgggtcccg

SEQ ID NO: 9128673 - DNA, 18 bp, Homo sapiens
cccccagccaaattctct

SEQ ID NO: 9128674 - DNA, 22 bp, Homo sapiens
cccccagatgcgagccatagcc

SEQ ID NO: 9128675 - DNA, 22 bp, Homo sapiens
cccccggttcctgtttgcagag

SEQ ID NO: 9128676 - DNA, 22 bp, Homo sapiens
ccccaggcagggcctaacagag

SEQ ID NO: 9128677 - DNA, 22 bp, Homo sapiens
tgcagggacacgaagacaaata

SEQ ID NO: 9128678 - DNA, 22 bp, Homo sapiens
tgcagggaatgcttgcagcatg

SEQ ID NO: 9128679 - DNA, 22 bp, Homo sapiens
tgcagggagctctggggtgcag

SEQ ID NO: 9128680 - DNA, 22 bp, Homo sapiens
ctgaagatagtgtctgatcatg

SEQ ID NO: 9128681 - DNA, 22 bp, Homo sapiens
ctctttgtcactcatacagtca

SEQ ID NO: 9128682 - DNA, 22 bp, Homo sapiens
ctgaggcagaaaaagcaagggt

SEQ ID NO: 9128683 - DNA, 22 bp, Homo sapiens
ctgaggcactaacaaggacaag

SEQ ID NO: 9128684 - DNA, 22 bp, Homo sapiens
ctgaggcactgtcagctgaggc

SEQ ID NO: 9128685 - DNA, 22 bp, Homo sapiens
ctggctctcgctgggagtactt

SEQ ID NO: 9128686 - DNA, 22 bp, Homo sapiens
ctggccagttgccttcctgggt

SEQ ID NO: 9128687 - DNA, 23 bp, Homo sapiens
ctgctttcccactccatgctctt

SEQ ID NO: 9128688 - DNA, 22 bp, Homo sapiens
ctggagctctccagagccccgt

SEQ ID NO: 9128689 - DNA, 22 bp, Homo sapiens
ctatttgaagttgcagagatga

SEQ ID NO: 9128690 - DNA, 22 bp, Homo sapiens
tttaaaaaactagtctgagtct

SEQ ID NO: 9128691 - DNA, 22 bp, Homo sapiens
ttggccagaggtttctctcatg

SEQ ID NO: 9128692 - DNA, 22 bp, Homo sapiens
ctcatctgctcttattatctta

SEQ ID NO: 9128693 - DNA, 22 bp, Homo sapiens
ttgatatgttaggaagactgat

SEQ ID NO: 9128694 - DNA, 22 bp, Homo sapiens
ttgcttttaatctttgtacatc

SEQ ID NO: 9128695 - DNA, 22 bp, Homo sapiens
ttgcttttgggaaaacatgcct

SEQ ID NO: 9128696 - DNA, 22 bp, Homo sapiens
tttacatggaatattgtcttgt

SEQ ID NO: 9128697 - DNA, 22 bp, Homo sapiens
tttacatgagtagcagatgttc

SEQ ID NO: 9128698 - DNA, 22 bp, Homo sapiens
tttacatgtaatgttatacaaa

SEQ ID NO: 9128699 - DNA, 22 bp, Homo sapiens
tttacatgtccttcaagagcag

SEQ ID NO: 9128700 - DNA, 22 bp, Homo sapiens
tttacatgagtagcagatgttc

SEQ ID NO: 9128701 - DNA, 22 bp, Homo sapiens
tttaacactcagtttaatagcc

SEQ ID NO: 9128702 - DNA, 19 bp, Homo sapiens
ctctccagctccagtagct

SEQ ID NO: 9128703 - DNA, 23 bp, Homo sapiens
tttcagttccagaaaaggggagc

SEQ ID NO: 9128704 - DNA, 22 bp, Homo sapiens
ctctcccccacagcagccttct

SEQ ID NO: 9128705 - DNA, 22 bp, Homo sapiens
ctctccagatctgctgagccag

SEQ ID NO: 9128706 - DNA, 22 bp, Homo sapiens
caggaggcagtttcagaagtca

SEQ ID NO: 9128707 - DNA, 22 bp, Homo sapiens
caggaggcatatttaaatccaa

SEQ ID NO: 9128708 - DNA, 22 bp, Homo sapiens
caggagacaatggctgtggggc

SEQ ID NO: 9128709 - DNA, 22 bp, Homo sapiens
taaaaatcttatgaatggcaag

SEQ ID NO: 9128710 - DNA, 22 bp, Homo sapiens
tacaaggaggctaatgatgaca

SEQ ID NO: 9128711 - DNA, 22 bp, Homo sapiens
tacaaactaacatgtctcatcc

SEQ ID NO: 9128712 - DNA, 22 bp, Homo sapiens
taagatgtcaaagggtcacagt

SEQ ID NO: 9128713 - DNA, 22 bp, Homo sapiens
taaggcagccgctcagagaggt

SEQ ID NO: 9128714 - DNA, 22 bp, Homo sapiens
caggcaacgtccttagagatgc

SEQ ID NO: 9128715 - DNA, 22 bp, Homo sapiens
cagcttggcttccgctttactg

SEQ ID NO: 9128716 - DNA, 22 bp, Homo sapiens
caggaaagaaatgagaacacca

SEQ ID NO: 9128717 - DNA, 22 bp, Homo sapiens
gttcacagcaaacctatgaact

SEQ ID NO: 9128718 - DNA, 22 bp, Homo sapiens
caggaagagaacatggaggctg

SEQ ID NO: 9128719 - DNA, 22 bp, Homo sapiens
caggaagattgtggaggtggtt

SEQ ID NO: 9128720 - DNA, 22 bp, Homo sapiens
caggaagattgtggaggtggtt

SEQ ID NO: 9128721 - DNA, 21 bp, Homo sapiens
gtttacaaggctttgctcctg

SEQ ID NO: 9128722 - DNA, 22 bp, Homo sapiens
gttcacagctgggacaagactg

SEQ ID NO: 9128723 - DNA, 22 bp, Homo sapiens
gttcacagttaggacaactgct

SEQ ID NO: 9128724 - DNA, 22 bp, Homo sapiens
gtgggcaggccccaaagcaggg

SEQ ID NO: 9128725 - DNA, 22 bp, Homo sapiens
cagctcttccatttccttcagc

SEQ ID NO: 9128726 - DNA, 19 bp, Homo sapiens
gtgtatgtaagttgtgagg

SEQ ID NO: 9128727 - DNA, 22 bp, Homo sapiens
cagctgcctatgacctagcctc

SEQ ID NO: 9128728 - DNA, 23 bp, Homo sapiens
ccagctccgtgagcctcgggctc

SEQ ID NO: 9128729 - DNA, 22 bp, Homo sapiens
ccagctccagcatagccaccat

SEQ ID NO: 9128730 - DNA, 22 bp, Homo sapiens
ccagctcagggtcacatggcac

SEQ ID NO: 9128731 - DNA, 22 bp, Homo sapiens
ccagccccgggaacctggccgt

SEQ ID NO: 9128732 - DNA, 22 bp, Homo sapiens
ccagcccaaacaagccgccttc

SEQ ID NO: 9128733 - DNA, 22 bp, Homo sapiens
ccagccccgggccttaccgtgc

SEQ ID NO: 9128734 - DNA, 22 bp, Homo sapiens
ccagcccctatcctcgctccac

SEQ ID NO: 9128735 - DNA, 22 bp, Homo sapiens
ccagccacgaagctcccttcat

SEQ ID NO: 9128736 - DNA, 22 bp, Homo sapiens
ccagccagtcccgcatgaccgc

SEQ ID NO: 9128737 - DNA, 22 bp, Homo sapiens
tcctccccaaagcccagcctgg

SEQ ID NO: 9128738 - DNA, 23 bp, Homo sapiens
ccacagagctgccaattcctgtg

SEQ ID NO: 9128739 - DNA, 20 bp, Homo sapiens
ccacagaggacagggctgtg

SEQ ID NO: 9128740 - DNA, 22 bp, Homo sapiens
tcctgccagcaggaggtggcag

SEQ ID NO: 9128741 - DNA, 22 bp, Homo sapiens
ccaaaagcagctgtctgtgaat

SEQ ID NO: 9128742 - DNA, 22 bp, Homo sapiens
ccagaggacttgggggctgaat

SEQ ID NO: 9128743 - DNA, 22 bp, Homo sapiens
tctctagcttccttaggaacac

SEQ ID NO: 9128744 - DNA, 22 bp, Homo sapiens
ccagaggaattgggaaacatgt

SEQ ID NO: 9128745 - DNA, 22 bp, Homo sapiens
ccagagctgcatccagcaggtt

SEQ ID NO: 9128746 - DNA, 20 bp, Homo sapiens
ccagagctgatggctgcccg

SEQ ID NO: 9128747 - DNA, 20 bp, Homo sapiens
ccagaagcactcttcatgtt

SEQ ID NO: 9128748 - DNA, 22 bp, Homo sapiens
ccagaagcttctacacaggaga

SEQ ID NO: 9128749 - DNA, 22 bp, Homo sapiens
ccagaagcttcaaggagattct

SEQ ID NO: 9128750 - DNA, 22 bp, Homo sapiens
ccagaagcagagcctgaggcag

SEQ ID NO: 9128751 - DNA, 22 bp, Homo sapiens
ccagaagcacctccttttgtgc

SEQ ID NO: 9128752 - DNA, 22 bp, Homo sapiens
ccagaagccctttgtttgttgt

SEQ ID NO: 9128753 - DNA, 22 bp, Homo sapiens
ccagaagctatgttttagataa

SEQ ID NO: 9128754 - DNA, 22 bp, Homo sapiens
tattggagaggtcttgggtaga

SEQ ID NO: 9128755 - DNA, 22 bp, Homo sapiens
catatgaagatgtctttttgta

SEQ ID NO: 9128756 - DNA, 21 bp, Homo sapiens
catatgaaagaagtatctgac

SEQ ID NO: 9128757 - DNA, 23 bp, Homo sapiens
catatgaaagtagacactttcca

SEQ ID NO: 9128758 - DNA, 22 bp, Homo sapiens
catcacatcagtgtgaacagtt

SEQ ID NO: 9128759 - DNA, 22 bp, Homo sapiens
cagtttcttcatctgcagaatc

SEQ ID NO: 9128760 - DNA, 22 bp, Homo sapiens
cagtttggtacttttctagcaa

SEQ ID NO: 9128761 - DNA, 22 bp, Homo sapiens
tcagccccacggggtcagccaa

SEQ ID NO: 9128762 - DNA, 22 bp, Homo sapiens
tccagcccacacctgaagctgg

SEQ ID NO: 9128763 - DNA, 20 bp, Homo sapiens
tccagcccagcagcctgaca

SEQ ID NO: 9128764 - DNA, 18 bp, Homo sapiens
tccagcccacattttctg

SEQ ID NO: 9128765 - DNA, 22 bp, Homo sapiens
tccagcccagctcctctcagaa

SEQ ID NO: 9128766 - DNA, 17 bp, Homo sapiens
tctgaggtgaggatgca

SEQ ID NO: 9128767 - DNA, 22 bp, Homo sapiens
tctgcccaggacacctgccact

SEQ ID NO: 9128768 - DNA, 22 bp, Homo sapiens
tctgtttcttcttctgttatat

SEQ ID NO: 9128769 - DNA, 22 bp, Homo sapiens
tcttcacaggagcctgcctgcc

SEQ ID NO: 9128770 - DNA, 22 bp, Homo sapiens
tcttcctgaaaccctgttccag

SEQ ID NO: 9128771 - DNA, 22 bp, Homo sapiens
tcttcctgcttggtgtgtctgg

SEQ ID NO: 9128772 - DNA, 22 bp, Homo sapiens
tcttcctgctttggtgaggctt

SEQ ID NO: 9128773 - DNA, 22 bp, Homo sapiens
tcttcctgtcaatgagaattaa

SEQ ID NO: 9128774 - DNA, 22 bp, Homo sapiens
tcttctcccagggtcgcccaag

SEQ ID NO: 9128775 - DNA, 22 bp, Homo sapiens
tctttacaagtcacattttctg

SEQ ID NO: 9128776 - DNA, 22 bp, Homo sapiens
tctttacaatctaagcatagtt

SEQ ID NO: 9128777 - DNA, 21 bp, Homo sapiens
tctttacatttgcctcttgca

SEQ ID NO: 9128778 - DNA, 22 bp, Homo sapiens
tctttacatcacaattgtatgg

SEQ ID NO: 9128779 - DNA, 22 bp, Homo sapiens
tctttacagtcctctgtcaatc

SEQ ID NO: 9128780 - DNA, 22 bp, Homo sapiens
tccttggaggtgttcatctgcc

SEQ ID NO: 9128781 - DNA, 22 bp, Homo sapiens
tctagagacaaaggaaggaggg

SEQ ID NO: 9128782 - DNA, 20 bp, Homo sapiens
tcctggaggcttcatccata

SEQ ID NO: 9128783 - DNA, 22 bp, Homo sapiens
taagaatcagtagatatagatt

SEQ ID NO: 9128784 - DNA, 22 bp, Homo sapiens
taagaatcggtcgcaacagagg

SEQ ID NO: 9128785 - DNA, 22 bp, Homo sapiens
tcctgcttcaggtagagggggt

SEQ ID NO: 9128786 - DNA, 20 bp, Homo sapiens
tcctgcttccaccagagcac

SEQ ID NO: 9128787 - DNA, 22 bp, Homo sapiens
tctctgagggagatggcctgcc

SEQ ID NO: 9128788 - DNA, 21 bp, Homo sapiens
tctctgacccaggaagagggc

SEQ ID NO: 9128789 - DNA, 22 bp, Homo sapiens
tctcatctttaaatgaaaattt

SEQ ID NO: 9128790 - DNA, 22 bp, Homo sapiens
tctcccagtgtctggcagtcag

SEQ ID NO: 9128791 - DNA, 22 bp, Homo sapiens
tctccccaaaggactcactctc

SEQ ID NO: 9128792 - DNA, 22 bp, Homo sapiens
tgcccagcagggagctacctgg

SEQ ID NO: 9128793 - DNA, 22 bp, Homo sapiens
tgcccagcacccagcatgatgc

SEQ ID NO: 9128794 - DNA, 22 bp, Homo sapiens
tgcctgccaatgatgcttgtgt

SEQ ID NO: 9128795 - DNA, 22 bp, Homo sapiens
tgcaggtgtgtgcaagggaggg

SEQ ID NO: 9128796 - DNA, 22 bp, Homo sapiens
tgcaggtgtgggcaggggagca

SEQ ID NO: 9128797 - DNA, 22 bp, Homo sapiens
tgcaggggcttgtctgggcctg

SEQ ID NO: 9128798 - DNA, 22 bp, Homo sapiens
tgcagggtatccttgtctctgc

SEQ ID NO: 9128799 - DNA, 22 bp, Homo sapiens
tgcagggatgctagaggtaaga

SEQ ID NO: 9128800 - DNA, 22 bp, Homo sapiens
tgcagggattgttggcatccat

SEQ ID NO: 9128801 - DNA, 22 bp, Homo sapiens
tgcaggctctctgctgccagat

SEQ ID NO: 9128802 - DNA, 22 bp, Homo sapiens
tgcaggctgctcaagacttagt

SEQ ID NO: 9128803 - DNA, 22 bp, Homo sapiens
tgcagggaaaacccaggatgct

SEQ ID NO: 9128804 - DNA, 22 bp, Homo sapiens
tgcagggaagcaagggtggctc

SEQ ID NO: 9128805 - DNA, 22 bp, Homo sapiens
tgcagctgagtcacccagccat

SEQ ID NO: 9128806 - DNA, 21 bp, Homo sapiens
tgcaggctacttctgactcta

SEQ ID NO: 9128807 - DNA, 22 bp, Homo sapiens
tgatgttcaacaagtacatatt

SEQ ID NO: 9128808 - DNA, 22 bp, Homo sapiens
tgagtgtggggaatgtcatgag

SEQ ID NO: 9128809 - DNA, 20 bp, Homo sapiens
tgcaaacattacttgggtgt

SEQ ID NO: 9128810 - DNA, 22 bp, Homo sapiens
tgcaacagactttattaactct

SEQ ID NO: 9128811 - DNA, 22 bp, Homo sapiens
tgcaacaggctgtgacatggaa

SEQ ID NO: 9128812 - DNA, 22 bp, Homo sapiens
tgagaagattgggcagagtgga

SEQ ID NO: 9128813 - DNA, 22 bp, Homo sapiens
tgagaaagcctttagtcccagg

SEQ ID NO: 9128814 - DNA, 22 bp, Homo sapiens
tgagaaagacagacattcctaa

SEQ ID NO: 9128815 - DNA, 22 bp, Homo sapiens
tgagaaagtgggtgcctagcaa

SEQ ID NO: 9128816 - DNA, 20 bp, Homo sapiens
tgagaaagtagagactcagg

SEQ ID NO: 9128817 - DNA, 22 bp, Homo sapiens
tgagaaaggtatttcatgcact

SEQ ID NO: 9128818 - DNA, 22 bp, Homo sapiens
tgagacagtcaccaggcaggcc

SEQ ID NO: 9128819 - DNA, 17 bp, Homo sapiens
tgagacagggcaggccc

SEQ ID NO: 9128820 - DNA, 22 bp, Homo sapiens
tgagatgaataactcctgctaa

SEQ ID NO: 9128821 - DNA, 22 bp, Homo sapiens
tgagatgtaaggtatgcttact

SEQ ID NO: 9128822 - DNA, 22 bp, Homo sapiens
tgagaggagtgattgtaaaatt

SEQ ID NO: 9128823 - DNA, 22 bp, Homo sapiens
tgagaggaacaggcagtaggtt

SEQ ID NO: 9128824 - DNA, 22 bp, Homo sapiens
tgagagagtaattgagtggtaa

SEQ ID NO: 9128825 - DNA, 22 bp, Homo sapiens
tgagagagcgcctgggatcatt

SEQ ID NO: 9128826 - DNA, 21 bp, Homo sapiens
tgagagagtagcaggacatat

SEQ ID NO: 9128827 - DNA, 22 bp, Homo sapiens
tgagcaggcgcagcaggaggtc

SEQ ID NO: 9128828 - DNA, 20 bp, Homo sapiens
tgagccaggctaggaagggc

SEQ ID NO: 9128829 - DNA, 22 bp, Homo sapiens
tgagcagggactttggagtctg

SEQ ID NO: 9128830 - DNA, 22 bp, Homo sapiens
tgagccaggttaagacaggagc

SEQ ID NO: 9128831 - DNA, 22 bp, Homo sapiens
tgaggaagggtgtgacggcacc

SEQ ID NO: 9128832 - DNA, 22 bp, Homo sapiens
tgaggaggtgggcacacagagt

SEQ ID NO: 9128833 - DNA, 22 bp, Homo sapiens
tgaggatggtcccgaggacact

SEQ ID NO: 9128834 - DNA, 22 bp, Homo sapiens
tgaggcaatccctagggtaagg

SEQ ID NO: 9128835 - DNA, 22 bp, Homo sapiens
tgaggcaaggctgaatgaaggc

SEQ ID NO: 9128836 - DNA, 22 bp, Homo sapiens
tgaggcaaagacaaagcagcat

SEQ ID NO: 9128837 - DNA, 22 bp, Homo sapiens
tgaggcaaaagttatgtggtag

SEQ ID NO: 9128838 - DNA, 22 bp, Homo sapiens
tgaggcaaagttcaagctgaaa

SEQ ID NO: 9128839 - DNA, 22 bp, Homo sapiens
tgaggcaagagtttgattagag

SEQ ID NO: 9128840 - DNA, 22 bp, Homo sapiens
tgaggcaaaaacactgattagg

SEQ ID NO: 9128841 - DNA, 22 bp, Homo sapiens
tgaggcaggacatggacaactg

SEQ ID NO: 9128842 - DNA, 22 bp, Homo sapiens
tgaggcaggaatggggaaaagt

SEQ ID NO: 9128843 - DNA, 22 bp, Homo sapiens
tgaggcaggaagttatataatg

SEQ ID NO: 9128844 - DNA, 22 bp, Homo sapiens
tgaggcagctttttctgtgtgt

SEQ ID NO: 9128845 - DNA, 20 bp, Homo sapiens
tgaggcaggagaatggcatg

SEQ ID NO: 9128846 - DNA, 22 bp, Homo sapiens
tgaggcaggagaatcaccggaa

SEQ ID NO: 9128847 - DNA, 22 bp, Homo sapiens
tgaggcaggagaatcacatgaa

SEQ ID NO: 9128848 - DNA, 22 bp, Homo sapiens
tgaggcaggacttgcataaagt

SEQ ID NO: 9128849 - DNA, 22 bp, Homo sapiens
tgaggcaggactgagcgggatg

SEQ ID NO: 9128850 - DNA, 22 bp, Homo sapiens
tgaggcaggatgcttgcacagg

SEQ ID NO: 9128851 - DNA, 22 bp, Homo sapiens
tgaggcaggagttaatgtgctc

SEQ ID NO: 9128852 - DNA, 22 bp, Homo sapiens
tgaggcaggagttcaggctgcg

SEQ ID NO: 9128853 - DNA, 22 bp, Homo sapiens
tgaggcaggagaatggcgggaa

SEQ ID NO: 9128854 - DNA, 22 bp, Homo sapiens
tgaggcaggaggattgcaggat

SEQ ID NO: 9128855 - DNA, 22 bp, Homo sapiens
tgaggcaggaggttgagaactg

SEQ ID NO: 9128856 - DNA, 22 bp, Homo sapiens
tgaggccaactagggagatgga

SEQ ID NO: 9128857 - DNA, 22 bp, Homo sapiens
tgaggcattaaagggaggtcaa

SEQ ID NO: 9128858 - DNA, 22 bp, Homo sapiens
tgaggcagttgagcttcctgag

SEQ ID NO: 9128859 - DNA, 23 bp, Homo sapiens
tgaggcaggcggatcacgaggtc

SEQ ID NO: 9128860 - DNA, 22 bp, Homo sapiens
tgaggcagggagagtggatatg

SEQ ID NO: 9128861 - DNA, 22 bp, Homo sapiens
tgaggcagttcttacttgtatt

SEQ ID NO: 9128862 - DNA, 22 bp, Homo sapiens
tgaggcagggagtttaattgtc

SEQ ID NO: 9128863 - DNA, 22 bp, Homo sapiens
tgaggctgccttgggaagaggg

SEQ ID NO: 9128864 - DNA, 20 bp, Homo sapiens
tgaggcgacgaagaggcggc

SEQ ID NO: 9128865 - DNA, 22 bp, Homo sapiens
tgaggtagctgtttagaaagac

SEQ ID NO: 9128866 - DNA, 21 bp, Homo sapiens
tgaggtagccagtgagatgga

SEQ ID NO: 9128867 - DNA, 22 bp, Homo sapiens
tgaggtgaagagtggagctcag

SEQ ID NO: 9128868 - DNA, 22 bp, Homo sapiens
tgaggtgaggttgaggaaagaa

SEQ ID NO: 9128869 - DNA, 22 bp, Homo sapiens
tgaggtgaccgcagatgggaag

SEQ ID NO: 9128870 - DNA, 22 bp, Homo sapiens
tgaaatgttggcatcggtacct

SEQ ID NO: 9128871 - DNA, 22 bp, Homo sapiens
tgaacattagttgagtaaagtc

SEQ ID NO: 9128872 - DNA, 19 bp, Homo sapiens
tgaagcaggcagagaagat

SEQ ID NO: 9128873 - DNA, 22 bp, Homo sapiens
tcttttgttgcctacttattaa

SEQ ID NO: 9128874 - DNA, 22 bp, Homo sapiens
tgaagccataggacagaggata

SEQ ID NO: 9128875 - DNA, 22 bp, Homo sapiens
tgaagccagctttggaagacac

SEQ ID NO: 9128876 - DNA, 22 bp, Homo sapiens
tgaagctggcttgacatggcct

SEQ ID NO: 9128877 - DNA, 22 bp, Homo sapiens
tgggagagtttgtttagagtga

SEQ ID NO: 9128878 - DNA, 22 bp, Homo sapiens
tgggagagtctaaaaccgaggt

SEQ ID NO: 9128879 - DNA, 19 bp, Homo sapiens
tgggagaggcaacagagta

SEQ ID NO: 9128880 - DNA, 21 bp, Homo sapiens
tgggagaccgccttcctggga

SEQ ID NO: 9128881 - DNA, 21 bp, Homo sapiens
tggccagctgctcgtctcctc

SEQ ID NO: 9128882 - DNA, 22 bp, Homo sapiens
tggccagcctggtgcttgctcc

SEQ ID NO: 9128883 - DNA, 22 bp, Homo sapiens
tggccagccttgtcatcgcttt

SEQ ID NO: 9128884 - DNA, 22 bp, Homo sapiens
tggccagctgagatttagcaca

SEQ ID NO: 9128885 - DNA, 22 bp, Homo sapiens
tggccagccagaaagaagcctt

SEQ ID NO: 9128886 - DNA, 22 bp, Homo sapiens
tggccagcagagttcactctct

SEQ ID NO: 9128887 - DNA, 22 bp, Homo sapiens
tggccagccataaaagaaccca

SEQ ID NO: 9128888 - DNA, 22 bp, Homo sapiens
tggccagcccttcagccatgcc

SEQ ID NO: 9128889 - DNA, 22 bp, Homo sapiens
tggcagggtacaccttaacacc

SEQ ID NO: 9128890 - DNA, 22 bp, Homo sapiens
tggcaacatgtcgaagtgctgt

SEQ ID NO: 9128891 - DNA, 18 bp, Homo sapiens
tggcagggaggaaatata

SEQ ID NO: 9128892 - DNA, 21 bp, Homo sapiens
tgcttctctagatcaactact

SEQ ID NO: 9128893 - DNA, 22 bp, Homo sapiens
tgcttctccattgatgctaagt

SEQ ID NO: 9128894 - DNA, 22 bp, Homo sapiens
tgcgaccctagccccctcactt

SEQ ID NO: 9128895 - DNA, 22 bp, Homo sapiens
tgctccagcgctgccaccagtt

SEQ ID NO: 9128896 - DNA, 22 bp, Homo sapiens
tggagagaagaggcagtgtgct

SEQ ID NO: 9128897 - DNA, 22 bp, Homo sapiens
tggagagagtcgggatagtaca

SEQ ID NO: 9128898 - DNA, 20 bp, Homo sapiens
tggagttgttctgctaggtc

SEQ ID NO: 9128899 - DNA, 22 bp, Homo sapiens
tggaggcagatacactgtaaaa

SEQ ID NO: 9128900 - DNA, 22 bp, Homo sapiens
tggaggcaggagacagggcaaa

SEQ ID NO: 9128901 - DNA, 22 bp, Homo sapiens
tggaggcaggggatacaggtca

SEQ ID NO: 9128902 - DNA, 22 bp, Homo sapiens
tggaggcaggtggaggagtgaa

SEQ ID NO: 9128903 - DNA, 22 bp, Homo sapiens
tggaggcaactgaagatgtagt

SEQ ID NO: 9128904 - DNA, 19 bp, Homo sapiens
tggaggcaagacatggagg

SEQ ID NO: 9128905 - DNA, 20 bp, Homo sapiens
tggaggcagagccagaggga

SEQ ID NO: 9128906 - DNA, 20 bp, Homo sapiens
tggaggcacctgtggagatc

SEQ ID NO: 9128907 - DNA, 22 bp, Homo sapiens
tgctttctcctgtctgaaagat

SEQ ID NO: 9128908 - DNA, 19 bp, Homo sapiens
tgctttctaaacacatgca

SEQ ID NO: 9128909 - DNA, 22 bp, Homo sapiens
tgctttctttagctcctgagtc

SEQ ID NO: 9128910 - DNA, 22 bp, Homo sapiens
tgctttctgtttttcatataat

SEQ ID NO: 9128911 - DNA, 22 bp, Homo sapiens
tgtccccaaggttcagcccaca

SEQ ID NO: 9128912 - DNA, 22 bp, Homo sapiens
tgtccccagcactcactctcca

SEQ ID NO: 9128913 - DNA, 22 bp, Homo sapiens
tgtatatgtcctggcatgtcat

SEQ ID NO: 9128914 - DNA, 22 bp, Homo sapiens
tgtatgaatctcatttgtttaa

SEQ ID NO: 9128915 - DNA, 22 bp, Homo sapiens
tggtgtgtacatttttgcttct

SEQ ID NO: 9128916 - DNA, 22 bp, Homo sapiens
tggtgtgttagagctcagggca

SEQ ID NO: 9128917 - DNA, 22 bp, Homo sapiens
tggtgaggtcatagagaactgt

SEQ ID NO: 9128918 - DNA, 22 bp, Homo sapiens
tgggcagggagctggaaccaca

SEQ ID NO: 9128919 - DNA, 23 bp, Homo sapiens
tgggcagcttctgcatgcccacc

SEQ ID NO: 9128920 - DNA, 19 bp, Homo sapiens
tgggcagctccctctgtcc

SEQ ID NO: 9128921 - DNA, 22 bp, Homo sapiens
tgggcagggagctggaaccaca

SEQ ID NO: 9128922 - DNA, 22 bp, Homo sapiens
tgggccagctccctgcccctgg

SEQ ID NO: 9128923 - DNA, 22 bp, Homo sapiens
tgggccagcaattgctgctcag

SEQ ID NO: 9128924 - DNA, 22 bp, Homo sapiens
tggtattacagcattccatatt

SEQ ID NO: 9128925 - DNA, 22 bp, Homo sapiens
tggtagtcggcctcggtggctc

SEQ ID NO: 9128926 - DNA, 22 bp, Homo sapiens
tgggtgtgccatattccatttc

SEQ ID NO: 9128927 - DNA, 22 bp, Homo sapiens
ttacaagataacctgatgctgt

SEQ ID NO: 9128928 - DNA, 22 bp, Homo sapiens
ttacaagataacggagaaagca

SEQ ID NO: 9128929 - DNA, 22 bp, Homo sapiens
ttacaagacactgctgacacag

SEQ ID NO: 9128930 - DNA, 22 bp, Homo sapiens
ttacaagattgatttgcttggc

SEQ ID NO: 9128931 - DNA, 22 bp, Homo sapiens
ttacaagatctttgaaggcaag

SEQ ID NO: 9128932 - DNA, 22 bp, Homo sapiens
ttacaagacacagtgctgaagg

SEQ ID NO: 9128933 - DNA, 22 bp, Homo sapiens
ttatatgattgagcatcttggt

SEQ ID NO: 9128934 - DNA, 22 bp, Homo sapiens
ttatatgtttctgtttggaggc

SEQ ID NO: 9128935 - DNA, 22 bp, Homo sapiens
ttatgaagttcctgttacagtg

SEQ ID NO: 9128936 - DNA, 22 bp, Homo sapiens
ttcaccatgggatgacaacagt

SEQ ID NO: 9128937 - DNA, 22 bp, Homo sapiens
ttccagagtccatgttggctca

SEQ ID NO: 9128938 - DNA, 23 bp, Homo sapiens
ttccagagtccacatctgccacc

SEQ ID NO: 9128939 - DNA, 22 bp, Homo sapiens
ttccagagtcagccactgggag

SEQ ID NO: 9128940 - DNA, 22 bp, Homo sapiens
ttccagagtattggtagctata

SEQ ID NO: 9128941 - DNA, 22 bp, Homo sapiens
ttccagaggttctcagccctgt

SEQ ID NO: 9128942 - DNA, 23 bp, Homo sapiens
ttccagagtcttcgacggtaggc

SEQ ID NO: 9128943 - DNA, 22 bp, Homo sapiens
ttccagagtctggttccatggt

SEQ ID NO: 9128944 - DNA, 22 bp, Homo sapiens
ttccagagtgactgtgccactt

SEQ ID NO: 9128945 - DNA, 22 bp, Homo sapiens
ttccagaggctctaggggagaa

SEQ ID NO: 9128946 - DNA, 22 bp, Homo sapiens
ttccagaggcttgaggaaaatt

SEQ ID NO: 9128947 - DNA, 22 bp, Homo sapiens
ttccagaggcttcagggaagaa

SEQ ID NO: 9128948 - DNA, 22 bp, Homo sapiens
ttccagaggggaggtggcagcc

SEQ ID NO: 9128949 - DNA, 22 bp, Homo sapiens
ttccagaggtagcaatgacttg

SEQ ID NO: 9128950 - DNA, 22 bp, Homo sapiens
ttccagagttgggggagtggtt

SEQ ID NO: 9128951 - DNA, 22 bp, Homo sapiens
ttccagaggatctcaggtattt

SEQ ID NO: 9128952 - DNA, 22 bp, Homo sapiens
ttccagaggagtgattcagagg

SEQ ID NO: 9128953 - DNA, 22 bp, Homo sapiens
ttccagaggcctgggcacactc

SEQ ID NO: 9128954 - DNA, 23 bp, Homo sapiens
ttccagaggaagaagtcatgact

SEQ ID NO: 9128955 - DNA, 22 bp, Homo sapiens
ttccagaggaaagaaaatgact

SEQ ID NO: 9128956 - DNA, 22 bp, Homo sapiens
ttccagagctttgcgcttggaa

SEQ ID NO: 9128957 - DNA, 22 bp, Homo sapiens
tgtgtgtgactcatactagaac

SEQ ID NO: 9128958 - DNA, 22 bp, Homo sapiens
tgtgtgtgggcggaacggcccc

SEQ ID NO: 9128959 - DNA, 22 bp, Homo sapiens
tgtgtgtggggaggcagcagat

SEQ ID NO: 9128960 - DNA, 22 bp, Homo sapiens
tgtgtgtgcaggagagcaggtg

SEQ ID NO: 9128961 - DNA, 22 bp, Homo sapiens
tgtgtgtgttcctcctcagcta

SEQ ID NO: 9128962 - DNA, 22 bp, Homo sapiens
tgtgtgtgtcctcatttgcaga

SEQ ID NO: 9128963 - DNA, 23 bp, Homo sapiens
tgtgtgtgtattctacgcaaggt

SEQ ID NO: 9128964 - DNA, 22 bp, Homo sapiens
tgtgtacacaatgattgcagag

SEQ ID NO: 9128965 - DNA, 22 bp, Homo sapiens
tgtgtacaggaactgatcagat

SEQ ID NO: 9128966 - DNA, 22 bp, Homo sapiens
ttaaaaatatgtagggcccgat

SEQ ID NO: 9128967 - DNA, 22 bp, Homo sapiens
ttaaaactgcaaatcctactga

SEQ ID NO: 9128968 - DNA, 22 bp, Homo sapiens
tgtcttaacataaaaggaaatc

SEQ ID NO: 9128969 - DNA, 22 bp, Homo sapiens
tgtctttaagcaaacagtgttt

SEQ ID NO: 9128970 - DNA, 22 bp, Homo sapiens
tgtctttttacctgtgatgagt

SEQ ID NO: 9128971 - DNA, 22 bp, Homo sapiens
tgtctttttactatgttcaatc

SEQ ID NO: 9128972 - DNA, 22 bp, Homo sapiens
tgtctttaattctacatatctc

SEQ ID NO: 9128973 - DNA, 22 bp, Homo sapiens
tgtcttttctactgtaagcata

SEQ ID NO: 9128974 - DNA, 22 bp, Homo sapiens
tgtcttttgccaaagatcagtt

SEQ ID NO: 9128975 - DNA, 22 bp, Homo sapiens
tgtcttttacctaatgagctgg

SEQ ID NO: 9128976 - DNA, 22 bp, Homo sapiens
tgtcttttagtttgtgagatct

SEQ ID NO: 9128977 - DNA, 22 bp, Homo sapiens
tgtcttttataactgacatata

SEQ ID NO: 9128978 - DNA, 22 bp, Homo sapiens
aaacagatgagttataatagcc

SEQ ID NO: 9128979 - DNA, 22 bp, Homo sapiens
aaacattgagtgcctttggtat

SEQ ID NO: 9128980 - DNA, 22 bp, Homo sapiens
aaatagtttagctctcatttca

SEQ ID NO: 9128981 - DNA, 22 bp, Homo sapiens
aaatagttgtttggatcaataa

SEQ ID NO: 9128982 - DNA, 22 bp, Homo sapiens
aaatagttcagcttgtaaaccc

SEQ ID NO: 9128983 - DNA, 22 bp, Homo sapiens
aaatagttagccctgcatatat

SEQ ID NO: 9128984 - DNA, 22 bp, Homo sapiens
aaatagttcagccacggtgact

SEQ ID NO: 9128985 - DNA, 22 bp, Homo sapiens
aaaattgagagtcttgtgcaag

SEQ ID NO: 9128986 - DNA, 22 bp, Homo sapiens
aaaatattttagggccaggaga

SEQ ID NO: 9128987 - DNA, 20 bp, Homo sapiens
aaagtgcacagatacagctc

SEQ ID NO: 9128988 - DNA, 22 bp, Homo sapiens
aaagcagattctgatgcagtag

SEQ ID NO: 9128989 - DNA, 22 bp, Homo sapiens
aaagcagcaaatacttttgcac

SEQ ID NO: 9128990 - DNA, 22 bp, Homo sapiens
aactgtgtccttagctctcact

SEQ ID NO: 9128991 - DNA, 23 bp, Homo sapiens
aaaggcaggcctaggacatattg

SEQ ID NO: 9128992 - DNA, 22 bp, Homo sapiens
aagcacctctatgattgctttt

SEQ ID NO: 9128993 - DNA, 22 bp, Homo sapiens
aagatggagcacgagcagaagc

SEQ ID NO: 9128994 - DNA, 22 bp, Homo sapiens
aagatggagtagtgtaatggtt

SEQ ID NO: 9128995 - DNA, 22 bp, Homo sapiens
aagatgcttgagaactgtttga

SEQ ID NO: 9128996 - DNA, 22 bp, Homo sapiens
acacattctttaaatgtctgtt

SEQ ID NO: 9128997 - DNA, 22 bp, Homo sapiens
aagatgaagaacatgagcacac

SEQ ID NO: 9128998 - DNA, 22 bp, Homo sapiens
aaatgcattaagtcagaacaat

SEQ ID NO: 9128999 - DNA, 22 bp, Homo sapiens
aatgaattcgagtgaaggaaag

SEQ ID NO: 9129000 - DNA, 23 bp, Homo sapiens
aacctgaactagggtcttgcata

SEQ ID NO: 9129001 - DNA, 22 bp, Homo sapiens
aacatattcagatgccaagtcc

SEQ ID NO: 9129002 - DNA, 22 bp, Homo sapiens
aacagcttactcaatggtgatt

SEQ ID NO: 9129003 - DNA, 22 bp, Homo sapiens
aacagcttagaaatgttgctaa

SEQ ID NO: 9129004 - DNA, 22 bp, Homo sapiens
acactgaatcagaaattgttgg

SEQ ID NO: 9129005 - DNA, 22 bp, Homo sapiens
acagacacaggcgtggagtcgc

SEQ ID NO: 9129006 - DNA, 22 bp, Homo sapiens
acaacaaagacacttgaaatga

SEQ ID NO: 9129007 - DNA, 22 bp, Homo sapiens
acaagataggttgagtctagcc

SEQ ID NO: 9129008 - DNA, 22 bp, Homo sapiens
aatgtaaaatatcttgtacttg

SEQ ID NO: 9129009 - DNA, 22 bp, Homo sapiens
aatactgcctgtgaggtaactc

SEQ ID NO: 9129010 - DNA, 22 bp, Homo sapiens
agaaatgacaagactgatcagg

SEQ ID NO: 9129011 - DNA, 22 bp, Homo sapiens
agaacaatgttaaattattaag

SEQ ID NO: 9129012 - DNA, 22 bp, Homo sapiens
agaacaatgaggtatggatgga

SEQ ID NO: 9129013 - DNA, 22 bp, Homo sapiens
aatgattgcaaacattgagaac

SEQ ID NO: 9129014 - DNA, 22 bp, Homo sapiens
actagttttcaggcatgtctgg

SEQ ID NO: 9129015 - DNA, 22 bp, Homo sapiens
accaggcttaatcctttgctat

SEQ ID NO: 9129016 - DNA, 19 bp, Homo sapiens
accaggcttatggtcagtg

SEQ ID NO: 9129017 - DNA, 22 bp, Homo sapiens
accaggctgttgggcccagtgt

SEQ ID NO: 9129018 - DNA, 22 bp, Homo sapiens
accaggcttgataccaagaaat

SEQ ID NO: 9129019 - DNA, 22 bp, Homo sapiens
accaggcttgatgatttgctta

SEQ ID NO: 9129020 - DNA, 22 bp, Homo sapiens
acatttctgtcttagggactgt

SEQ ID NO: 9129021 - DNA, 22 bp, Homo sapiens
acatttctgctagaataggtga

SEQ ID NO: 9129022 - DNA, 22 bp, Homo sapiens
acatttctgcatgtagggtaat

SEQ ID NO: 9129023 - DNA, 22 bp, Homo sapiens
acatttctgcatctcagagcta

SEQ ID NO: 9129024 - DNA, 22 bp, Homo sapiens
acatttaggatgttttgagaga

SEQ ID NO: 9129025 - DNA, 22 bp, Homo sapiens
acatttagatggtgttatagta

SEQ ID NO: 9129026 - DNA, 22 bp, Homo sapiens
acatttattactcaggttgttg

SEQ ID NO: 9129027 - DNA, 22 bp, Homo sapiens
acccggagtcggaggttgcagt

SEQ ID NO: 9129028 - DNA, 22 bp, Homo sapiens
accatttagtaagtatacctgg

SEQ ID NO: 9129029 - DNA, 20 bp, Homo sapiens
actgtgaatgctgaattagc

SEQ ID NO: 9129030 - DNA, 22 bp, Homo sapiens
actgtgaacggactgaagccca

SEQ ID NO: 9129031 - DNA, 22 bp, Homo sapiens
actgtaaagttacgatcaagtt

SEQ ID NO: 9129032 - DNA, 22 bp, Homo sapiens
agtttagacaaagtcttgcatt

SEQ ID NO: 9129033 - DNA, 22 bp, Homo sapiens
actgtaaaatgagatatgtata

SEQ ID NO: 9129034 - DNA, 22 bp, Homo sapiens
actgtaaagaagtaagtatggg

SEQ ID NO: 9129035 - DNA, 22 bp, Homo sapiens
agaaacatttagattatatgtc

SEQ ID NO: 9129036 - DNA, 22 bp, Homo sapiens
atcatttaaaacaagtctctat

SEQ ID NO: 9129037 - DNA, 22 bp, Homo sapiens
atcatttagtggggcattggaa

SEQ ID NO: 9129038 - DNA, 22 bp, Homo sapiens
atcatttacaatgaaagcctga

SEQ ID NO: 9129039 - DNA, 22 bp, Homo sapiens
atcatttacaaactcagcattg

SEQ ID NO: 9129040 - DNA, 22 bp, Homo sapiens
atatatttgagaatattcatga

SEQ ID NO: 9129041 - DNA, 22 bp, Homo sapiens
atatctttgtatggttcagcag

SEQ ID NO: 9129042 - DNA, 22 bp, Homo sapiens
actgcaaacatagtacttgagc

SEQ ID NO: 9129043 - DNA, 22 bp, Homo sapiens
actgcaacacctcctgggttca

SEQ ID NO: 9129044 - DNA, 22 bp, Homo sapiens
actgcaacctccacctcctggg

SEQ ID NO: 9129045 - DNA, 22 bp, Homo sapiens
actgaattcctctttcttatcc

SEQ ID NO: 9129046 - DNA, 22 bp, Homo sapiens
agtggctgagtgactgtgactc

SEQ ID NO: 9129047 - DNA, 21 bp, Homo sapiens
aggtacaggtcttgtgagtct

SEQ ID NO: 9129048 - DNA, 22 bp, Homo sapiens
agaatgatagctagtatttact

SEQ ID NO: 9129049 - DNA, 22 bp, Homo sapiens
agaagatgtcactgcagacagc

SEQ ID NO: 9129050 - DNA, 22 bp, Homo sapiens
agaagcaaggtctgtcagtata

SEQ ID NO: 9129051 - DNA, 22 bp, Homo sapiens
agaatacaattgttcagtaata

SEQ ID NO: 9129052 - DNA, 22 bp, Homo sapiens
agaatacatctagtgctgcatg

SEQ ID NO: 9129053 - DNA, 22 bp, Homo sapiens
atttgcttgtaaatgtatgcct

SEQ ID NO: 9129054 - DNA, 23 bp, Homo sapiens
attcttcattatcttctagaaaa

SEQ ID NO: 9129055 - DNA, 22 bp, Homo sapiens
atttaagattgcgtattcatgt

SEQ ID NO: 9129056 - DNA, 22 bp, Homo sapiens
caaatgatgcatggctagtgag

SEQ ID NO: 9129057 - DNA, 22 bp, Homo sapiens
attttctctttgtatatgctag

SEQ ID NO: 9129058 - DNA, 22 bp, Homo sapiens
cagaacattgttttctcatctg

SEQ ID NO: 9129059 - DNA, 22 bp, Homo sapiens
gagaaataggcaatggtatcta

SEQ ID NO: 9129060 - DNA, 22 bp, Homo sapiens
gagaaatgctagcttaggaatc

SEQ ID NO: 9129061 - DNA, 22 bp, Homo sapiens
atggaatggcctgtcataatct

SEQ ID NO: 9129062 - DNA, 22 bp, Homo sapiens
atggaaatgttccatatattga

SEQ ID NO: 9129063 - DNA, 22 bp, Homo sapiens
atgccactgcgctccagcctgg

SEQ ID NO: 9129064 - DNA, 22 bp, Homo sapiens
atgtggctttcatgattaagca

SEQ ID NO: 9129065 - DNA, 22 bp, Homo sapiens
atgtagaaagttattgtcactg

SEQ ID NO: 9129066 - DNA, 22 bp, Homo sapiens
atgggttcaagtgattctcctg

SEQ ID NO: 9129067 - DNA, 22 bp, Homo sapiens
atgaaatatcttgaagaaattc

SEQ ID NO: 9129068 - DNA, 23 bp, Homo sapiens
atgaaatgatactttattcactg

SEQ ID NO: 9129069 - DNA, 22 bp, Homo sapiens
atgaaatgtattcagatatgta

SEQ ID NO: 9129070 - DNA, 19 bp, Homo sapiens
cttttcaagccatcagttt

SEQ ID NO: 9129071 - DNA, 22 bp, Homo sapiens
atgattcaagaaaataggatgg

SEQ ID NO: 9129072 - DNA, 22 bp, Homo sapiens
atgcagaattgctaagtatctg

SEQ ID NO: 9129073 - DNA, 22 bp, Homo sapiens
atgcagaaagagaatgtaatgt

SEQ ID NO: 9129074 - DNA, 22 bp, Homo sapiens
atgcagaatcttgagaaaaatt

SEQ ID NO: 9129075 - DNA, 22 bp, Homo sapiens
atgcaaataaagcaactataca

SEQ ID NO: 9129076 - DNA, 20 bp, Homo sapiens
atgcaaatcccaaaatcagg

SEQ ID NO: 9129077 - DNA, 22 bp, Homo sapiens
atgcatatgccgtagaataagt

SEQ ID NO: 9129078 - DNA, 22 bp, Homo sapiens
atttcagagaatgaacctaatc

SEQ ID NO: 9129079 - DNA, 22 bp, Homo sapiens
atttcacaaaccatcctgattt

SEQ ID NO: 9129080 - DNA, 22 bp, Homo sapiens
atttctagacttagaactctta

SEQ ID NO: 9129081 - DNA, 22 bp, Homo sapiens
atttctaggtagagaagcttag

SEQ ID NO: 9129082 - DNA, 20 bp, Homo sapiens
atttcagtgtttgcaatttc

SEQ ID NO: 9129083 - DNA, 20 bp, Homo sapiens
atttcaggttgtgttctgtt

SEQ ID NO: 9129084 - DNA, 22 bp, Homo sapiens
atttcagtagaaaatcttgatt

SEQ ID NO: 9129085 - DNA, 22 bp, Homo sapiens
atttcagtagtccttacttgta

SEQ ID NO: 9129086 - DNA, 22 bp, Homo sapiens
atttcagtgttggttagcaagc

SEQ ID NO: 9129087 - DNA, 22 bp, Homo sapiens
atttcaggccaccagatgtctt

SEQ ID NO: 9129088 - DNA, 22 bp, Homo sapiens
attgctttagaaagaaaaatat

SEQ ID NO: 9129089 - DNA, 22 bp, Homo sapiens
attgcttttgagctagaatttt

SEQ ID NO: 9129090 - DNA, 22 bp, Homo sapiens
attgcttttccttaacacatgc

SEQ ID NO: 9129091 - DNA, 22 bp, Homo sapiens
attgcttttagtgaaattatat

SEQ ID NO: 9129092 - DNA, 22 bp, Homo sapiens
atttacagaaacttaatcatag

SEQ ID NO: 9129093 - DNA, 22 bp, Homo sapiens
attatttagaaatcgattgaaa

SEQ ID NO: 9129094 - DNA, 20 bp, Homo sapiens
attgaaatttttctgagatt

SEQ ID NO: 9129095 - DNA, 22 bp, Homo sapiens
attgaaattgatgaaattcttg

SEQ ID NO: 9129096 - DNA, 22 bp, Homo sapiens
attgaatagatgcattatacta

SEQ ID NO: 9129097 - DNA, 22 bp, Homo sapiens
attgaatagctgcttgttgtat

SEQ ID NO: 9129098 - DNA, 22 bp, Homo sapiens
attcttattaaatagccagaag

SEQ ID NO: 9129099 - DNA, 22 bp, Homo sapiens
attaaaattccaaggtatgcca

SEQ ID NO: 9129100 - DNA, 22 bp, Homo sapiens
cactgaatttaacttgtatccc

SEQ ID NO: 9129101 - DNA, 22 bp, Homo sapiens
ggcacagggagccgcagttgca

SEQ ID NO: 9129102 - DNA, 22 bp, Homo sapiens
ggcacagggagaggcggatttt

SEQ ID NO: 9129103 - DNA, 22 bp, Homo sapiens
caagatatcaatgacatagtat

SEQ ID NO: 9129104 - DNA, 22 bp, Homo sapiens
caacatttcaaggtctttagga

SEQ ID NO: 9129105 - DNA, 22 bp, Homo sapiens
gtatctttcccaccaatcacaa

SEQ ID NO: 9129106 - DNA, 22 bp, Homo sapiens
gtatctttgtcttcatgttgga

SEQ ID NO: 9129107 - DNA, 22 bp, Homo sapiens
gtaaaatcatttagttacttaa

SEQ ID NO: 9129108 - DNA, 20 bp, Homo sapiens
gtaaaatatggtctttgggt

SEQ ID NO: 9129109 - DNA, 22 bp, Homo sapiens
aggctgaggcaggtggatcact

SEQ ID NO: 9129110 - DNA, 22 bp, Homo sapiens
aggctgaggcaggtggatcatt

SEQ ID NO: 9129111 - DNA, 22 bp, Homo sapiens
aggctgagataggtggatcatt

SEQ ID NO: 9129112 - DNA, 22 bp, Homo sapiens
agctgctgaagtgagagaattg

SEQ ID NO: 9129113 - DNA, 22 bp, Homo sapiens
catgaaatatgctacctgtctt

SEQ ID NO: 9129114 - DNA, 22 bp, Homo sapiens
catgaaatctgagtatgtttcc

SEQ ID NO: 9129115 - DNA, 22 bp, Homo sapiens
catgaaatcacaagctgaggac

SEQ ID NO: 9129116 - DNA, 22 bp, Homo sapiens
catgaaatggccaaccttcggc

SEQ ID NO: 9129117 - DNA, 22 bp, Homo sapiens
catgaaatgttagaattagaca

SEQ ID NO: 9129118 - DNA, 22 bp, Homo sapiens
catgaaatgtgttaatctcttg

SEQ ID NO: 9129119 - DNA, 22 bp, Homo sapiens
cattatctcttctatatgctag

SEQ ID NO: 9129120 - DNA, 22 bp, Homo sapiens
cattatctgccattgacaccat

SEQ ID NO: 9129121 - DNA, 22 bp, Homo sapiens
catttacagcagactgatgaaa

SEQ ID NO: 9129122 - DNA, 22 bp, Homo sapiens
agtgctgggattacaggcataa

SEQ ID NO: 9129123 - DNA, 22 bp, Homo sapiens
agtgctgggattgcaggcatga

SEQ ID NO: 9129124 - DNA, 22 bp, Homo sapiens
cgggttcacgccattctcctgc

SEQ ID NO: 9129125 - DNA, 22 bp, Homo sapiens
ctcaagaaggatgagctattgc

SEQ ID NO: 9129126 - DNA, 22 bp, Homo sapiens
ctcagaggtggatgccttgtgg

SEQ ID NO: 9129127 - DNA, 18 bp, Homo sapiens
atacaagatcaagtgttc

SEQ ID NO: 9129128 - DNA, 22 bp, Homo sapiens
atacagaatactaattcctgag

SEQ ID NO: 9129129 - DNA, 20 bp, Homo sapiens
ataaaataactgccacaaga

SEQ ID NO: 9129130 - DNA, 22 bp, Homo sapiens
ataaaagtaggaccaacttaca

SEQ ID NO: 9129131 - DNA, 22 bp, Homo sapiens
atatcattctgatgtatatctt

SEQ ID NO: 9129132 - DNA, 22 bp, Homo sapiens
tcattttcacacataaatagca

SEQ ID NO: 9129133 - DNA, 22 bp, Homo sapiens
catctttaaaatgggaacaaca

SEQ ID NO: 9129134 - DNA, 22 bp, Homo sapiens
tcatttgttgctgttacctgag

SEQ ID NO: 9129135 - DNA, 23 bp, Homo sapiens
catgatatttatcttccctgggt

SEQ ID NO: 9129136 - DNA, 22 bp, Homo sapiens
catatattctggttttcactgg

SEQ ID NO: 9129137 - DNA, 22 bp, Homo sapiens
tatttagaacagacaatagaaa

SEQ ID NO: 9129138 - DNA, 22 bp, Homo sapiens
tcagaaatagtctttaaaatga

SEQ ID NO: 9129139 - DNA, 22 bp, Homo sapiens
tcagaaataatgaatgatgggg

SEQ ID NO: 9129140 - DNA, 21 bp, Homo sapiens
tcagaacaattccatgcctcc

SEQ ID NO: 9129141 - DNA, 22 bp, Homo sapiens
tattgcttaaaaaatatgtgag

SEQ ID NO: 9129142 - DNA, 22 bp, Homo sapiens
tatacagatttctgggcaatct

SEQ ID NO: 9129143 - DNA, 22 bp, Homo sapiens
tatacagatggaaagatacaca

SEQ ID NO: 9129144 - DNA, 22 bp, Homo sapiens
tatacagatatctaagatgtaa

SEQ ID NO: 9129145 - DNA, 22 bp, Homo sapiens
tataagaaattgccaacctgtt

SEQ ID NO: 9129146 - DNA, 22 bp, Homo sapiens
tataagaagtgaagaagagtta

SEQ ID NO: 9129147 - DNA, 22 bp, Homo sapiens
catttctcactccagcaacttt

SEQ ID NO: 9129148 - DNA, 20 bp, Homo sapiens
catttagaaattggcatgga

SEQ ID NO: 9129149 - DNA, 22 bp, Homo sapiens
catttagagaagattacaagga

SEQ ID NO: 9129150 - DNA, 22 bp, Homo sapiens
gttcttcagattccatttcagt

SEQ ID NO: 9129151 - DNA, 22 bp, Homo sapiens
gttggagtgcagcttgtgcgat

SEQ ID NO: 9129152 - DNA, 19 bp, Homo sapiens
gttggcactgaaaatggct

SEQ ID NO: 9129153 - DNA, 22 bp, Homo sapiens
caggcacagctgggcaattgcg

SEQ ID NO: 9129154 - DNA, 22 bp, Homo sapiens
taacaatacccattctaattac

SEQ ID NO: 9129155 - DNA, 22 bp, Homo sapiens
taacatttcggtgacagtggga

SEQ ID NO: 9129156 - DNA, 22 bp, Homo sapiens
taaaaagttgaaaggacttatc

SEQ ID NO: 9129157 - DNA, 22 bp, Homo sapiens
taaaatagcatgtgcagtgaaa

SEQ ID NO: 9129158 - DNA, 22 bp, Homo sapiens
taacaaaggttgccaaactaag

SEQ ID NO: 9129159 - DNA, 22 bp, Homo sapiens
taacaaagtaccatagattggg

SEQ ID NO: 9129160 - DNA, 22 bp, Homo sapiens
taacaaagtaccatagactgga

SEQ ID NO: 9129161 - DNA, 22 bp, Homo sapiens
taaagtcaaggtactgtttcac

SEQ ID NO: 9129162 - DNA, 22 bp, Homo sapiens
tttaaattctgtctgccgctta

SEQ ID NO: 9129163 - DNA, 22 bp, Homo sapiens
tttagaatgtgactgtatttga

SEQ ID NO: 9129164 - DNA, 22 bp, Homo sapiens
ttgcttttaattaatcattgct

SEQ ID NO: 9129165 - DNA, 22 bp, Homo sapiens
ttgctttgtggtggttcttcca

SEQ ID NO: 9129166 - DNA, 22 bp, Homo sapiens
ctcagtttctgacattaaaatc

SEQ ID NO: 9129167 - DNA, 22 bp, Homo sapiens
ctatttctaaacctataagtga

SEQ ID NO: 9129168 - DNA, 23 bp, Homo sapiens
ctatttctcatagttcaggtctt

SEQ ID NO: 9129169 - DNA, 22 bp, Homo sapiens
ttcttgttccatgaaagacaga

SEQ ID NO: 9129170 - DNA, 22 bp, Homo sapiens
ttcttgtctttgttatgtagga

SEQ ID NO: 9129171 - DNA, 18 bp, Homo sapiens
ttgataaacaatttcatt

SEQ ID NO: 9129172 - DNA, 22 bp, Homo sapiens
ttccatttggagctcgcagcct

SEQ ID NO: 9129173 - DNA, 22 bp, Homo sapiens
ctaatgaagctgctttctatga

SEQ ID NO: 9129174 - DNA, 22 bp, Homo sapiens
ctaagtcatggaaagtgtgtgt

SEQ ID NO: 9129175 - DNA, 22 bp, Homo sapiens
ttcagaaaaaacttcaataagt

SEQ ID NO: 9129176 - DNA, 22 bp, Homo sapiens
ctgctttggctcagtgacatca

SEQ ID NO: 9129177 - DNA, 22 bp, Homo sapiens
ctggaatgttctccagcatggc

SEQ ID NO: 9129178 - DNA, 22 bp, Homo sapiens
ctggcatgctaatacagcctgt

SEQ ID NO: 9129179 - DNA, 20 bp, Homo sapiens
ctggatgctaaaacacacac

SEQ ID NO: 9129180 - DNA, 22 bp, Homo sapiens
ctgattaactgaactgaattta

SEQ ID NO: 9129181 - DNA, 22 bp, Homo sapiens
ctgattaattagctataaaact

SEQ ID NO: 9129182 - DNA, 22 bp, Homo sapiens
ctgcagaaatatggatgtgata

SEQ ID NO: 9129183 - DNA, 22 bp, Homo sapiens
tttttaagctcctttgatgtca

SEQ ID NO: 9129184 - DNA, 18 bp, Homo sapiens
ctctgggagaggcataca

SEQ ID NO: 9129185 - DNA, 22 bp, Homo sapiens
tgcatcagaggatagctgcagt

SEQ ID NO: 9129186 - DNA, 22 bp, Homo sapiens
cttctctggcatagcaagcagg

SEQ ID NO: 9129187 - DNA, 22 bp, Homo sapiens
gaacagatgcctgattcatagg

SEQ ID NO: 9129188 - DNA, 22 bp, Homo sapiens
gaaataatttagaaggtattcc

SEQ ID NO: 9129189 - DNA, 22 bp, Homo sapiens
gaaataatacagtgctcttctc

SEQ ID NO: 9129190 - DNA, 22 bp, Homo sapiens
gaaataattctgtgtctgaaca

SEQ ID NO: 9129191 - DNA, 22 bp, Homo sapiens
ctttgttagcagccaatttgtt

SEQ ID NO: 9129192 - DNA, 22 bp, Homo sapiens
gaattacatttgtgttactgca

SEQ ID NO: 9129193 - DNA, 22 bp, Homo sapiens
gaccaggctgttccagtctaac

SEQ ID NO: 9129194 - DNA, 22 bp, Homo sapiens
gagtcacaaagcctttcttatt

SEQ ID NO: 9129195 - DNA, 21 bp, Homo sapiens
gatacagagggccactgattg

SEQ ID NO: 9129196 - DNA, 22 bp, Homo sapiens
gatacagatctttaactgccct

SEQ ID NO: 9129197 - DNA, 20 bp, Homo sapiens
gatgaaatcactgggcagcc

SEQ ID NO: 9129198 - DNA, 17 bp, Homo sapiens
gatgaaatgatgcacac

SEQ ID NO: 9129199 - DNA, 22 bp, Homo sapiens
gatgaaatccagatcacaggtg

SEQ ID NO: 9129200 - DNA, 22 bp, Homo sapiens
gatgaaatagcaaaggcatttg

SEQ ID NO: 9129201 - DNA, 22 bp, Homo sapiens
gatgaaatgtgaaagttctggg

SEQ ID NO: 9129202 - DNA, 22 bp, Homo sapiens
gatgaaatgctgagcctgagtt

SEQ ID NO: 9129203 - DNA, 22 bp, Homo sapiens
gatgaaattgttttgatacttt

SEQ ID NO: 9129204 - DNA, 22 bp, Homo sapiens
gagtgggaatgttctaagaatt

SEQ ID NO: 9129205 - DNA, 22 bp, Homo sapiens
gctcagagatgtctgctgcctt

SEQ ID NO: 9129206 - DNA, 22 bp, Homo sapiens
gctcagagcccgaggcttgcat

SEQ ID NO: 9129207 - DNA, 22 bp, Homo sapiens
gctgctctgctgtgtaagcagg

SEQ ID NO: 9129208 - DNA, 22 bp, Homo sapiens
gccagcagccacagaagtcact

SEQ ID NO: 9129209 - DNA, 22 bp, Homo sapiens
gattagaatgggaagatacaag

SEQ ID NO: 9129210 - DNA, 22 bp, Homo sapiens
gcagaaacaggagaaagggatc

SEQ ID NO: 9129211 - DNA, 22 bp, Homo sapiens
gcaatgattgcattagaagatg

SEQ ID NO: 9129212 - DNA, 22 bp, Homo sapiens
gcaatgatattgaagtgatgaa

SEQ ID NO: 9129213 - DNA, 22 bp, Homo sapiens
gatttctgttgagaaacatggg

SEQ ID NO: 9129214 - DNA, 22 bp, Homo sapiens
taagaaatttagttatagaatg

SEQ ID NO: 9129215 - DNA, 22 bp, Homo sapiens
gtatgtcatctgttacccatca

SEQ ID NO: 9129216 - DNA, 23 bp, Homo sapiens
gtaaaatacgcagtgcagtgtga

SEQ ID NO: 9129217 - DNA, 22 bp, Homo sapiens
tgtgaaatgctattgtgacaaa

SEQ ID NO: 9129218 - DNA, 22 bp, Homo sapiens
tgtgaatacagcatgtgcttct

SEQ ID NO: 9129219 - DNA, 22 bp, Homo sapiens
ttaaaatgcagattatgactca

SEQ ID NO: 9129220 - DNA, 22 bp, Homo sapiens
ttaaaatgcagattctgattca

SEQ ID NO: 9129221 - DNA, 22 bp, Homo sapiens
tgttgtgacccagaccaagaag

SEQ ID NO: 9129222 - DNA, 22 bp, Homo sapiens
tgtggaactagtattgtcttaa

SEQ ID NO: 9129223 - DNA, 22 bp, Homo sapiens
ttcacattggtgatatgtttct

SEQ ID NO: 9129224 - DNA, 22 bp, Homo sapiens
ttcacattggttcttgatagct

SEQ ID NO: 9129225 - DNA, 22 bp, Homo sapiens
ttatttgcccatgtttagcaga

SEQ ID NO: 9129226 - DNA, 22 bp, Homo sapiens
ttcagcttgctgactgcggcag

SEQ ID NO: 9129227 - DNA, 22 bp, Homo sapiens
ttagcattctctgtgtgcataa

SEQ ID NO: 9129228 - DNA, 22 bp, Homo sapiens
ttagcattctcatttgcataaa

SEQ ID NO: 9129229 - DNA, 22 bp, Homo sapiens
tggtatattttgctctatggtg

SEQ ID NO: 9129230 - DNA, 22 bp, Homo sapiens
tggtaaatgtctaacaatcact

SEQ ID NO: 9129231 - DNA, 22 bp, Homo sapiens
tgtaaataatgcatgtaaatca

SEQ ID NO: 9129232 - DNA, 23 bp, Homo sapiens
tgtaaaatggggtagtgttacca

SEQ ID NO: 9129233 - DNA, 22 bp, Homo sapiens
tgtaaaataattctccatgttt

SEQ ID NO: 9129234 - DNA, 22 bp, Homo sapiens
tgtaaaataccattccttgtca

SEQ ID NO: 9129235 - DNA, 20 bp, Homo sapiens
tgctttgatggaaatacagc

SEQ ID NO: 9129236 - DNA, 22 bp, Homo sapiens
tggaaatagatagtatcattca

SEQ ID NO: 9129237 - DNA, 22 bp, Homo sapiens
tggaaatagctccagtttcatt

SEQ ID NO: 9129238 - DNA, 22 bp, Homo sapiens
tggaaatattgggtaatagttg

SEQ ID NO: 9129239 - DNA, 22 bp, Homo sapiens
tggaaatatgctccattctttt

SEQ ID NO: 9129240 - DNA, 22 bp, Homo sapiens
tggaaagatgaagatgtttaag

SEQ ID NO: 9129241 - DNA, 22 bp, Homo sapiens
tggaataaaatgtcagttctta

SEQ ID NO: 9129242 - DNA, 22 bp, Homo sapiens
tggaataatgaccacagaaaca

SEQ ID NO: 9129243 - DNA, 22 bp, Homo sapiens
tggaatgatgactaggaattgt

SEQ ID NO: 9129244 - DNA, 22 bp, Homo sapiens
tggaatgagctggctaataacc

SEQ ID NO: 9129245 - DNA, 23 bp, Homo sapiens
tggaatgagctgggaagctgagc

SEQ ID NO: 9129246 - DNA, 22 bp, Homo sapiens
tggaatgacagagagtctgaat

SEQ ID NO: 9129247 - DNA, 22 bp, Homo sapiens
tgctagtgtgtgagatgttcaa

SEQ ID NO: 9129248 - DNA, 22 bp, Homo sapiens
tggattcacaccattctcctgc

SEQ ID NO: 9129249 - DNA, 22 bp, Homo sapiens
tggccaggtgtgggttctcaga

SEQ ID NO: 9129250 - DNA, 22 bp, Homo sapiens
tgaatgaatcctaacaaagaca

SEQ ID NO: 9129251 - DNA, 22 bp, Homo sapiens
tgaattcaagttgttgagccat

SEQ ID NO: 9129252 - DNA, 22 bp, Homo sapiens
tgaatgtaggtctaatatccca

SEQ ID NO: 9129253 - DNA, 22 bp, Homo sapiens
tgaatcattttgctgtttgaac

SEQ ID NO: 9129254 - DNA, 22 bp, Homo sapiens
tgaatacactaaaaatcacttt

SEQ ID NO: 9129255 - DNA, 19 bp, Homo sapiens
tgaatacagagatacagaa

SEQ ID NO: 9129256 - DNA, 22 bp, Homo sapiens
tgaatttcacaaggtgaggata

SEQ ID NO: 9129257 - DNA, 23 bp, Homo sapiens
tgaatttcattattgcagagatt

SEQ ID NO: 9129258 - DNA, 22 bp, Homo sapiens
tgaattcatccatttatgcaag

SEQ ID NO: 9129259 - DNA, 22 bp, Homo sapiens
tgaattcatacagtggatacca

SEQ ID NO: 9129260 - DNA, 17 bp, Homo sapiens
tgaattcaatctgcact

SEQ ID NO: 9129261 - DNA, 22 bp, Homo sapiens
tgacctattagatttccttgcc

SEQ ID NO: 9129262 - DNA, 22 bp, Homo sapiens
tgacatttaattaacgaatgct

SEQ ID NO: 9129263 - DNA, 22 bp, Homo sapiens
tgacattttatcaatatcacag

SEQ ID NO: 9129264 - DNA, 21 bp, Homo sapiens
tgacatttggattcatagtaa

SEQ ID NO: 9129265 - DNA, 22 bp, Homo sapiens
tgacatttgagcatacatgtaa

SEQ ID NO: 9129266 - DNA, 22 bp, Homo sapiens
tgaaaatgccctctatgtctca

SEQ ID NO: 9129267 - DNA, 22 bp, Homo sapiens
tgaaagaagggtggaaaatgta

SEQ ID NO: 9129268 - DNA, 23 bp, Homo sapiens
tcttttcaatggttctttatgtg

SEQ ID NO: 9129269 - DNA, 22 bp, Homo sapiens
tcttttcatcatttaataggta

SEQ ID NO: 9129270 - DNA, 22 bp, Homo sapiens
tgaactatacgataacatgatt

SEQ ID NO: 9129271 - DNA, 22 bp, Homo sapiens
tgaaatggtattctttttcaat

SEQ ID NO: 9129272 - DNA, 22 bp, Homo sapiens
tgaaatcatgagatagtgtcac

SEQ ID NO: 9129273 - DNA, 22 bp, Homo sapiens
tgaaatatgctcccattcactt

SEQ ID NO: 9129274 - DNA, 22 bp, Homo sapiens
tgaaatcagtatgtctttctca

SEQ ID NO: 9129275 - DNA, 22 bp, Homo sapiens
tgaaatagtcaagtatttgaac

SEQ ID NO: 9129276 - DNA, 18 bp, Homo sapiens
tgagaactaggcattgca

SEQ ID NO: 9129277 - DNA, 22 bp, Homo sapiens
tgcacacacggagataggcttt

SEQ ID NO: 9129278 - DNA, 22 bp, Homo sapiens
tgagtcttttatcctgggaatg

SEQ ID NO: 9129279 - DNA, 22 bp, Homo sapiens
tgatcaaaacattactccacca

SEQ ID NO: 9129280 - DNA, 22 bp, Homo sapiens
tgatatttaagcaaaaatatgg

SEQ ID NO: 9129281 - DNA, 22 bp, Homo sapiens
tgatagcagcaaagacattttt

SEQ ID NO: 9129282 - DNA, 23 bp, Homo sapiens
tgattacaagggccaaagaaagg

SEQ ID NO: 9129283 - DNA, 22 bp, Homo sapiens
tgattgaattcaaatgcaatct

SEQ ID NO: 9129284 - DNA, 22 bp, Homo sapiens
tgattctttgaccaaaaaattg

SEQ ID NO: 9129285 - DNA, 22 bp, Homo sapiens
tgcagaaacagtcattaatgta

SEQ ID NO: 9129286 - DNA, 17 bp, Homo sapiens
tgcatgtcctttgttcc

SEQ ID NO: 9129287 - DNA, 22 bp, Homo sapiens
tgcatacacatgtgcacatacg

SEQ ID NO: 9129288 - DNA, 22 bp, Homo sapiens
tgcattctgacttagttaatat

SEQ ID NO: 9129289 - DNA, 22 bp, Homo sapiens
tgcattctatgatatcaaaaca

SEQ ID NO: 9129290 - DNA, 21 bp, Homo sapiens
tgcattctagcagctctgagg

SEQ ID NO: 9129291 - DNA, 22 bp, Homo sapiens
tgcatttacggtacaacagcag

SEQ ID NO: 9129292 - DNA, 18 bp, Homo sapiens
tgcatttagtacatctag

SEQ ID NO: 9129293 - DNA, 22 bp, Homo sapiens
tgcatttatggagttacctcat

SEQ ID NO: 9129294 - DNA, 22 bp, Homo sapiens
tgcctcaagccctccactgcac

SEQ ID NO: 9129295 - DNA, 22 bp, Homo sapiens
tctcctaggctggagtgcagtg

SEQ ID NO: 9129296 - DNA, 22 bp, Homo sapiens
tctcatttggctttgttttaaa

SEQ ID NO: 9129297 - DNA, 23 bp, Homo sapiens
tctcatttcccttgatctatctt

SEQ ID NO: 9129298 - DNA, 22 bp, Homo sapiens
tctgaatttgcattttaacaag

SEQ ID NO: 9129299 - DNA, 22 bp, Homo sapiens
tctgaattttccacagatttgg

SEQ ID NO: 9129300 - DNA, 22 bp, Homo sapiens
taagaatcagtagatatagatt

SEQ ID NO: 9129301 - DNA, 22 bp, Homo sapiens
taagaatcgatgtttatttaga

SEQ ID NO: 9129302 - DNA, 22 bp, Homo sapiens
taagaatagtccctagatgtgt

SEQ ID NO: 9129303 - DNA, 22 bp, Homo sapiens
tccttagcttacaagtcttctg

SEQ ID NO: 9129304 - DNA, 22 bp, Homo sapiens
tcgcccaggctggaagtgcagt

SEQ ID NO: 9129305 - DNA, 22 bp, Homo sapiens
tctttccctgtgttagcctgta

SEQ ID NO: 9129306 - DNA, 22 bp, Homo sapiens
tctttcccttagaacattaaca

SEQ ID NO: 9129307 - DNA, 17 bp, Homo sapiens
tctttccctgggagatg

SEQ ID NO: 9129308 - DNA, 22 bp, Homo sapiens
tctttcccgccagagcatgagt

SEQ ID NO: 9129309 - DNA, 23 bp, Homo sapiens
tcttgaaaagcctacagcagttc

SEQ ID NO: 9129310 - DNA, 22 bp, Homo sapiens
tcttgaaagcatgagatggaca

SEQ ID NO: 9129311 - DNA, 22 bp, Homo sapiens
tcttcatacaatttcagacatc

SEQ ID NO: 9129312 - DNA, 22 bp, Homo sapiens
tctgtcctccggagctcccagt

SEQ ID NO: 9129313 - DNA, 22 bp, Homo sapiens
tctgtcctctttgaagctgctc

SEQ ID NO: 9129314 - DNA, 22 bp, Homo sapiens
tctgcacaattgatcatggcaa

SEQ ID NO: 9129315 - DNA, 22 bp, Homo sapiens
tctgaattttaactacacaaag

SEQ ID NO: 9129316 - DNA, 19 bp, Homo sapiens
aatctttccacaatgaggc

SEQ ID NO: 9129317 - DNA, 22 bp, Homo sapiens
aatctttccctattaaatgtgg

SEQ ID NO: 9129318 - DNA, 22 bp, Homo sapiens
aatatggcttgttactatgttt

SEQ ID NO: 9129319 - DNA, 22 bp, Homo sapiens
aatacttgtcagatgaataaga

SEQ ID NO: 9129320 - DNA, 22 bp, Homo sapiens
aatatcagcacttttgtggtat

SEQ ID NO: 9129321 - DNA, 22 bp, Homo sapiens
aagtgaatggggcagacttcag

SEQ ID NO: 9129322 - DNA, 22 bp, Homo sapiens
aataaatgttaagattgtctca

SEQ ID NO: 9129323 - DNA, 22 bp, Homo sapiens
acaggcttactgtttcataggg

SEQ ID NO: 9129324 - DNA, 22 bp, Homo sapiens
agactgatattaactttagtgt

SEQ ID NO: 9129325 - DNA, 22 bp, Homo sapiens
agaatttttgattatctactcg

SEQ ID NO: 9129326 - DNA, 22 bp, Homo sapiens
aatggaattctccattagatgt

SEQ ID NO: 9129327 - DNA, 22 bp, Homo sapiens
aatggaatgcctcacatgtatt

SEQ ID NO: 9129328 - DNA, 22 bp, Homo sapiens
aattttctggtgtgtaatgaag

SEQ ID NO: 9129329 - DNA, 22 bp, Homo sapiens
agcagaaatagaagtcaatgat

SEQ ID NO: 9129330 - DNA, 22 bp, Homo sapiens
agatttgtatgtctaaatgtaa

SEQ ID NO: 9129331 - DNA, 23 bp, Homo sapiens
agcattctctccaacatttaaca

SEQ ID NO: 9129332 - DNA, 22 bp, Homo sapiens
aagacaatgtttctgatagata

SEQ ID NO: 9129333 - DNA, 22 bp, Homo sapiens
aatgtcaaaggctatacattca

SEQ ID NO: 9129334 - DNA, 22 bp, Homo sapiens
aatgtcaaaatggaatgagact

SEQ ID NO: 9129335 - DNA, 22 bp, Homo sapiens
aatgtcaaaataattgatttgt

SEQ ID NO: 9129336 - DNA, 22 bp, Homo sapiens
acacggcactttaggaaggggc

SEQ ID NO: 9129337 - DNA, 22 bp, Homo sapiens
acagaagacagagtgttcatct

SEQ ID NO: 9129338 - DNA, 22 bp, Homo sapiens
aagcacatacataataaagtcc

SEQ ID NO: 9129339 - DNA, 22 bp, Homo sapiens
aagcacatctcaaacttcatct

SEQ ID NO: 9129340 - DNA, 22 bp, Homo sapiens
aacaagttactcttaaagtata

SEQ ID NO: 9129341 - DNA, 22 bp, Homo sapiens
aacaagatagatatcacttagg

SEQ ID NO: 9129342 - DNA, 22 bp, Homo sapiens
aacactgatggaaagtatgttt

SEQ ID NO: 9129343 - DNA, 22 bp, Homo sapiens
aataaaatggtcagttttctca

SEQ ID NO: 9129344 - DNA, 22 bp, Homo sapiens
aatcacatgtgggtcttgtagc

SEQ ID NO: 9129345 - DNA, 22 bp, Homo sapiens
aacatttatatgggttcatgaa

SEQ ID NO: 9129346 - DNA, 22 bp, Homo sapiens
aacatttattctaattctggga

SEQ ID NO: 9129347 - DNA, 22 bp, Homo sapiens
aacagtacaactccacaagact

SEQ ID NO: 9129348 - DNA, 20 bp, Homo sapiens
aacagtaccatttatctcag

SEQ ID NO: 9129349 - DNA, 22 bp, Homo sapiens
aactgaattttaaatacaggcc

SEQ ID NO: 9129350 - DNA, 22 bp, Homo sapiens
aactgatttcaagttcagtttc

SEQ ID NO: 9129351 - DNA, 22 bp, Homo sapiens
aactgattgttggatgatagtg

SEQ ID NO: 9129352 - DNA, 22 bp, Homo sapiens
aacaagaacacctacagttcta

SEQ ID NO: 9129353 - DNA, 22 bp, Homo sapiens
aacagctttgagcagttctgta

SEQ ID NO: 9129354 - DNA, 22 bp, Homo sapiens
aacagctttgtgctcagatttg

SEQ ID NO: 9129355 - DNA, 22 bp, Homo sapiens
aagcacctgggttatatcttag

SEQ ID NO: 9129356 - DNA, 22 bp, Homo sapiens
aacttttaaaatacacagacaa

SEQ ID NO: 9129357 - DNA, 22 bp, Homo sapiens
aagaaagtgggtaatatgattt

SEQ ID NO: 9129358 - DNA, 22 bp, Homo sapiens
aaagaagagctggaaggagtct

SEQ ID NO: 9129359 - DNA, 22 bp, Homo sapiens
aaagaagagcaaatttgttgta

SEQ ID NO: 9129360 - DNA, 22 bp, Homo sapiens
aaagaagacagacatttctttc

SEQ ID NO: 9129361 - DNA, 22 bp, Homo sapiens
aaagaagatggagacctgacta

SEQ ID NO: 9129362 - DNA, 21 bp, Homo sapiens
aaagatgagaactggatggct

SEQ ID NO: 9129363 - DNA, 22 bp, Homo sapiens
aaacatttttcttcatcatcct

SEQ ID NO: 9129364 - DNA, 19 bp, Homo sapiens
aaaaagaggctataatatt

SEQ ID NO: 9129365 - DNA, 23 bp, Homo sapiens
aaagtgcagttgaggaatcatag

SEQ ID NO: 9129366 - DNA, 22 bp, Homo sapiens
aaatatgtaagattagcactag

SEQ ID NO: 9129367 - DNA, 22 bp, Homo sapiens
aaatcatgtgcagagatcagga

SEQ ID NO: 9129368 - DNA, 22 bp, Homo sapiens
aaatggcagtgtcataaggctc

SEQ ID NO: 9129369 - DNA, 23 bp, Homo sapiens
agctaaggaagctgaggcacagt

SEQ ID NO: 9129370 - DNA, 23 bp, Homo sapiens
caccactttctccttctccttgg

SEQ ID NO: 9129371 - DNA, 22 bp, Homo sapiens
attttcagaacattcattcact

SEQ ID NO: 9129372 - DNA, 22 bp, Homo sapiens
atgcatattgtcatttagtcct

SEQ ID NO: 9129373 - DNA, 22 bp, Homo sapiens
agaacatatctgttttctaact

SEQ ID NO: 9129374 - DNA, 22 bp, Homo sapiens
agaacctcaattatttttgcac

SEQ ID NO: 9129375 - DNA, 23 bp, Homo sapiens
acttttcaattagctatgcttaa

SEQ ID NO: 9129376 - DNA, 22 bp, Homo sapiens
acttttcaaatgggaaactcag

SEQ ID NO: 9129377 - DNA, 22 bp, Homo sapiens
actttaaaactgatcatcagag

SEQ ID NO: 9129378 - DNA, 23 bp, Homo sapiens
actacagatactcctgctgtttg

SEQ ID NO: 9129379 - DNA, 22 bp, Homo sapiens
agtatacagtaatgacatatct

SEQ ID NO: 9129380 - DNA, 22 bp, Homo sapiens
actgaatttattagtatagtct

SEQ ID NO: 9129381 - DNA, 22 bp, Homo sapiens
actgagatgagttgcatagatt

SEQ ID NO: 9129382 - DNA, 22 bp, Homo sapiens
actgcattggagagcatgaatt

SEQ ID NO: 9129383 - DNA, 21 bp, Homo sapiens
agctgctgtggccagaatcca

SEQ ID NO: 9129384 - DNA, 22 bp, Homo sapiens
aggaagcagtttataatgcatt

SEQ ID NO: 9129385 - DNA, 22 bp, Homo sapiens
aggcaacaagggtagtcagtga

SEQ ID NO: 9129386 - DNA, 22 bp, Homo sapiens
acatctttgtttcttagtgtat

SEQ ID NO: 9129387 - DNA, 22 bp, Homo sapiens
accaggagtctagcctagtcaa

SEQ ID NO: 9129388 - DNA, 22 bp, Homo sapiens
accaggctgtgaagtgagacta

SEQ ID NO: 9129389 - DNA, 20 bp, Homo sapiens
accaggagatggaggcaggg

SEQ ID NO: 9129390 - DNA, 19 bp, Homo sapiens
accaggagacagtgagctt

SEQ ID NO: 9129391 - DNA, 22 bp, Homo sapiens
aggctaagtgggtgtcagggcc

SEQ ID NO: 9129392 - DNA, 22 bp, Homo sapiens
aggctgaggcaggtggatcacc

SEQ ID NO: 9129393 - DNA, 22 bp, Homo sapiens
agcttctctcagggtatctttc

SEQ ID NO: 9129394 - DNA, 22 bp, Homo sapiens
caggaaatatctcaacacttta

SEQ ID NO: 9129395 - DNA, 22 bp, Homo sapiens
catcatttcacttagatgaagt

SEQ ID NO: 9129396 - DNA, 22 bp, Homo sapiens
catcatttttgtaagctggtag

SEQ ID NO: 9129397 - DNA, 19 bp, Homo sapiens
ctgtccttggctgcactgt

SEQ ID NO: 9129398 - DNA, 17 bp, Homo sapiens
ctggtcccaccaagccc

SEQ ID NO: 9129399 - DNA, 22 bp, Homo sapiens
atccatttcagtgttccacttg

SEQ ID NO: 9129400 - DNA, 22 bp, Homo sapiens
cttcaagatccatagatattgc

SEQ ID NO: 9129401 - DNA, 22 bp, Homo sapiens
cttcttaaagattacacaatga

SEQ ID NO: 9129402 - DNA, 22 bp, Homo sapiens
ctggcctaaaaatacagaacaa

SEQ ID NO: 9129403 - DNA, 22 bp, Homo sapiens
ataaaagaagttttggtacttg

SEQ ID NO: 9129404 - DNA, 22 bp, Homo sapiens
ctgctgtggtgtcaagcatctc

SEQ ID NO: 9129405 - DNA, 22 bp, Homo sapiens
ctgctgtgcaggtgcctatgat

SEQ ID NO: 9129406 - DNA, 22 bp, Homo sapiens
ctgctgtgccttaaaatgcaag

SEQ ID NO: 9129407 - DNA, 22 bp, Homo sapiens
agtatttctgaatattatcata

SEQ ID NO: 9129408 - DNA, 22 bp, Homo sapiens
ctattgaattaactattaaagt

SEQ ID NO: 9129409 - DNA, 22 bp, Homo sapiens
ctatatttggtgagggatgtct

SEQ ID NO: 9129410 - DNA, 22 bp, Homo sapiens
ctatatttcttggctttaaaca

SEQ ID NO: 9129411 - DNA, 20 bp, Homo sapiens
caaatccctgctctgtgctg

SEQ ID NO: 9129412 - DNA, 22 bp, Homo sapiens
caaatattccaggtacatccct

SEQ ID NO: 9129413 - DNA, 22 bp, Homo sapiens
attttgaagggaattgaagttc

SEQ ID NO: 9129414 - DNA, 18 bp, Homo sapiens
attttgaactgggaatat

SEQ ID NO: 9129415 - DNA, 22 bp, Homo sapiens
attgtaattttagagaaagtgg

SEQ ID NO: 9129416 - DNA, 22 bp, Homo sapiens
atgtttctagttgtatgtcact

SEQ ID NO: 9129417 - DNA, 22 bp, Homo sapiens
gaatgtcagggccagaagaggc

SEQ ID NO: 9129418 - DNA, 22 bp, Homo sapiens
atgccacttcattccagcctcg

SEQ ID NO: 9129419 - DNA, 22 bp, Homo sapiens
atgcaatttactgtacataaat

SEQ ID NO: 9129420 - DNA, 17 bp, Homo sapiens
gaacttttattaaattc

SEQ ID NO: 9129421 - DNA, 22 bp, Homo sapiens
gaacatgaaaagtcttacacgc

SEQ ID NO: 9129422 - DNA, 22 bp, Homo sapiens
gaaaatgagcctcagctacatt

SEQ ID NO: 9129423 - DNA, 22 bp, Homo sapiens
gaaatatacatgaagtcggctg

SEQ ID NO: 9129424 - DNA, 22 bp, Homo sapiens
atgaatgagagaatagtggagc

SEQ ID NO: 9129425 - DNA, 22 bp, Homo sapiens
gaaaagagaacatctgaggatc

SEQ ID NO: 9129426 - DNA, 22 bp, Homo sapiens
atgaatctgttttttgtcaata

SEQ ID NO: 9129427 - DNA, 22 bp, Homo sapiens
atgaatcagaatctgcatttta

SEQ ID NO: 9129428 - DNA, 22 bp, Homo sapiens
gagggggtctatgaggtagagc

SEQ ID NO: 9129429 - DNA, 22 bp, Homo sapiens
cagaacatgatataaacagaag

SEQ ID NO: 9129430 - DNA, 20 bp, Homo sapiens
cagaacatgagcatcgagcc

SEQ ID NO: 9129431 - DNA, 22 bp, Homo sapiens
cagaacatccccactgctacct

SEQ ID NO: 9129432 - DNA, 22 bp, Homo sapiens
cagaaatagacaatggcagtgg

SEQ ID NO: 9129433 - DNA, 22 bp, Homo sapiens
caatgatttttccattgcagga

SEQ ID NO: 9129434 - DNA, 22 bp, Homo sapiens
caagttcacgttgctttttgag

SEQ ID NO: 9129435 - DNA, 22 bp, Homo sapiens
gtgcattcaggggttgacagga

SEQ ID NO: 9129436 - DNA, 22 bp, Homo sapiens
gtgaatgactgttttcagcatt

SEQ ID NO: 9129437 - DNA, 22 bp, Homo sapiens
catttcagtgtcttgtgatgaa

SEQ ID NO: 9129438 - DNA, 22 bp, Homo sapiens
catttcagtgttattctaattt

SEQ ID NO: 9129439 - DNA, 22 bp, Homo sapiens
catttctagagtcccaagaggt

SEQ ID NO: 9129440 - DNA, 22 bp, Homo sapiens
tctatacatgtgcacacacatc

SEQ ID NO: 9129441 - DNA, 22 bp, Homo sapiens
catgtaaagcacttcataacag

SEQ ID NO: 9129442 - DNA, 22 bp, Homo sapiens
tacagactgttcaagtgataat

SEQ ID NO: 9129443 - DNA, 22 bp, Homo sapiens
tacagtttctcattatgctctc

SEQ ID NO: 9129444 - DNA, 22 bp, Homo sapiens
tagaaatgtaggcttcctgaca

SEQ ID NO: 9129445 - DNA, 22 bp, Homo sapiens
tagaaatgtgataatagcttaa

SEQ ID NO: 9129446 - DNA, 22 bp, Homo sapiens
tagaaatgttagatgtattgag

SEQ ID NO: 9129447 - DNA, 22 bp, Homo sapiens
tagaaacaagggagaggattct

SEQ ID NO: 9129448 - DNA, 22 bp, Homo sapiens
tagtgttcagctttatttccag

SEQ ID NO: 9129449 - DNA, 22 bp, Homo sapiens
tagtaatgattgtatcttgtcc

SEQ ID NO: 9129450 - DNA, 22 bp, Homo sapiens
tagtaatgatattttgattatg

SEQ ID NO: 9129451 - DNA, 23 bp, Homo sapiens
cagtacaatgtggaaaaggagtg

SEQ ID NO: 9129452 - DNA, 22 bp, Homo sapiens
tggaaagaattcctatggttca

SEQ ID NO: 9129453 - DNA, 22 bp, Homo sapiens
tgggataataaatagaggcaga

SEQ ID NO: 9129454 - DNA, 22 bp, Homo sapiens
ccatagtacataatacatttta

SEQ ID NO: 9129455 - DNA, 22 bp, Homo sapiens
tgcaaatattgggacagtctag

SEQ ID NO: 9129456 - DNA, 22 bp, Homo sapiens
tgaaatgagataatttaagtgc

SEQ ID NO: 9129457 - DNA, 22 bp, Homo sapiens
tgaaatgacagtcttaagctct

SEQ ID NO: 9129458 - DNA, 22 bp, Homo sapiens
tgaaatgacaaaggtttttctt

SEQ ID NO: 9129459 - DNA, 17 bp, Homo sapiens
ccaggagagatgcttgt

SEQ ID NO: 9129460 - DNA, 21 bp, Homo sapiens
ctttgcaagatgtctatgaaa

SEQ ID NO: 9129461 - DNA, 22 bp, Homo sapiens
cttaggctctattcatgggaag

SEQ ID NO: 9129462 - DNA, 22 bp, Homo sapiens
cttcatttcaggctgaagaata

SEQ ID NO: 9129463 - DNA, 22 bp, Homo sapiens
cttaaaatctggcagttagcta

SEQ ID NO: 9129464 - DNA, 22 bp, Homo sapiens
ctgtccttgctggccaggtatg

SEQ ID NO: 9129465 - DNA, 22 bp, Homo sapiens
ctgtagaacgatccaggcattt

SEQ ID NO: 9129466 - DNA, 22 bp, Homo sapiens
ctgctgtgtggtgaaactcagt

SEQ ID NO: 9129467 - DNA, 22 bp, Homo sapiens
gaccaggctagttcagagcttc

SEQ ID NO: 9129468 - DNA, 22 bp, Homo sapiens
gaccaggcccaggtgcaaggga

SEQ ID NO: 9129469 - DNA, 22 bp, Homo sapiens
gaccaggacacagtggcaaggt

SEQ ID NO: 9129470 - DNA, 22 bp, Homo sapiens
gaatgaattcagcacatggaat

SEQ ID NO: 9129471 - DNA, 22 bp, Homo sapiens
gaatgaataggtgtccagatgg

SEQ ID NO: 9129472 - DNA, 22 bp, Homo sapiens
gaatgaaagatttgcattctat

SEQ ID NO: 9129473 - DNA, 22 bp, Homo sapiens
gaatgattaactagttgataca

SEQ ID NO: 9129474 - DNA, 22 bp, Homo sapiens
gaagcaaaatgtctgcacatat

SEQ ID NO: 9129475 - DNA, 22 bp, Homo sapiens
tttttctgagaatatgagagga

SEQ ID NO: 9129476 - DNA, 22 bp, Homo sapiens
tttttctgagcggtaatcatca

SEQ ID NO: 9129477 - DNA, 22 bp, Homo sapiens
tttgaataaacggttaatgttc

SEQ ID NO: 9129478 - DNA, 22 bp, Homo sapiens
tttctctctggccctgattgtc

SEQ ID NO: 9129479 - DNA, 22 bp, Homo sapiens
ttacagaactgccctagttggc

SEQ ID NO: 9129480 - DNA, 22 bp, Homo sapiens
ttacagaactgtcttgaaattt

SEQ ID NO: 9129481 - DNA, 22 bp, Homo sapiens
ttacagaaaggaaggactgact

SEQ ID NO: 9129482 - DNA, 22 bp, Homo sapiens
cgatagacattcattttctgat

SEQ ID NO: 9129483 - DNA, 17 bp, Homo sapiens
tgttttcattcattgct

SEQ ID NO: 9129484 - DNA, 22 bp, Homo sapiens
ttaaaatgaatattgattagca

SEQ ID NO: 9129485 - DNA, 22 bp, Homo sapiens
ttaaaatagccagtgcccctct

SEQ ID NO: 9129486 - DNA, 22 bp, Homo sapiens
ttgaataatgtgtatgttgtta

SEQ ID NO: 9129487 - DNA, 22 bp, Homo sapiens
ttgaatagtgttttcagtatac

SEQ ID NO: 9129488 - DNA, 21 bp, Homo sapiens
ttcttcatgatgattaatggc

SEQ ID NO: 9129489 - DNA, 22 bp, Homo sapiens
ttcttaactggaaaatgtcaga

SEQ ID NO: 9129490 - DNA, 22 bp, Homo sapiens
ttctcataggagcgcaaaccct

SEQ ID NO: 9129491 - DNA, 22 bp, Homo sapiens
ctagttctagatccctgaggaa

SEQ ID NO: 9129492 - DNA, 22 bp, Homo sapiens
ttcagtttcagtcttgcaaaaa

SEQ ID NO: 9129493 - DNA, 22 bp, Homo sapiens
tatacagataatgaagaccaag

SEQ ID NO: 9129494 - DNA, 22 bp, Homo sapiens
tatacagaactgcacgtgcacg

SEQ ID NO: 9129495 - DNA, 22 bp, Homo sapiens
tatatttgtgtgtgatttatga

SEQ ID NO: 9129496 - DNA, 22 bp, Homo sapiens
tatctttattatgtctatctgc

SEQ ID NO: 9129497 - DNA, 22 bp, Homo sapiens
tatctttagaggaagagaatct

SEQ ID NO: 9129498 - DNA, 22 bp, Homo sapiens
tatctttaacttgcagtattta

SEQ ID NO: 9129499 - DNA, 22 bp, Homo sapiens
tatgccactgctctccatccta

SEQ ID NO: 9129500 - DNA, 22 bp, Homo sapiens
tatttcagggagaataaatttg

SEQ ID NO: 9129501 - DNA, 22 bp, Homo sapiens
tatttcagggggtacaagaaga

SEQ ID NO: 9129502 - DNA, 22 bp, Homo sapiens
tattgcatctcttcatatctgt

SEQ ID NO: 9129503 - DNA, 22 bp, Homo sapiens
tatttcagacactgatcttgca

SEQ ID NO: 9129504 - DNA, 22 bp, Homo sapiens
tatttcagcaagaagaatgtgg

SEQ ID NO: 9129505 - DNA, 22 bp, Homo sapiens
tatttcagccctactacttggc

SEQ ID NO: 9129506 - DNA, 22 bp, Homo sapiens
tagattttgcatttctaacaag

SEQ ID NO: 9129507 - DNA, 22 bp, Homo sapiens
tagcatttcccaaatgcatttg

SEQ ID NO: 9129508 - DNA, 22 bp, Homo sapiens
tagcatttggcaccagttattt

SEQ ID NO: 9129509 - DNA, 22 bp, Homo sapiens
tagcaccaggaaggtttaggat

SEQ ID NO: 9129510 - DNA, 22 bp, Homo sapiens
tagcaccaaaactgaagaacat

SEQ ID NO: 9129511 - DNA, 22 bp, Homo sapiens
gttttcagccaggagcacattt

SEQ ID NO: 9129512 - DNA, 22 bp, Homo sapiens
taacaatttgcttcatttgttt

SEQ ID NO: 9129513 - DNA, 22 bp, Homo sapiens
tacaatcaggctctagcttctc

SEQ ID NO: 9129514 - DNA, 22 bp, Homo sapiens
tacagcttatccagcttgatag

SEQ ID NO: 9129515 - DNA, 22 bp, Homo sapiens
tacgcctgtaatcccagcactt

SEQ ID NO: 9129516 - DNA, 22 bp, Homo sapiens
tactgaatatgttttcaagtct

SEQ ID NO: 9129517 - DNA, 22 bp, Homo sapiens
tactgaatggggcagtaagaaa

SEQ ID NO: 9129518 - DNA, 22 bp, Homo sapiens
tacattccacaagcattgcttt

SEQ ID NO: 9129519 - DNA, 22 bp, Homo sapiens
tcatgtgttaaactccaagata

SEQ ID NO: 9129520 - DNA, 20 bp, Homo sapiens
tcatgtgtgtcctacagaga

SEQ ID NO: 9129521 - DNA, 22 bp, Homo sapiens
tcatgtttttgccatatgactc

SEQ ID NO: 9129522 - DNA, 22 bp, Homo sapiens
tcaaaattctagggagaatggt

SEQ ID NO: 9129523 - DNA, 22 bp, Homo sapiens
tcaatgattagagtttagtgtg

SEQ ID NO: 9129524 - DNA, 22 bp, Homo sapiens
tcagaggattggacttttatgt

SEQ ID NO: 9129525 - DNA, 22 bp, Homo sapiens
tcagaacatggcatgttccatc

SEQ ID NO: 9129526 - DNA, 19 bp, Homo sapiens
tcagttttagtcatcagtt

SEQ ID NO: 9129527 - DNA, 22 bp, Homo sapiens
tcagttttcaatttcatcagag

SEQ ID NO: 9129528 - DNA, 22 bp, Homo sapiens
tcagtttttaaatgatataatt

SEQ ID NO: 9129529 - DNA, 22 bp, Homo sapiens
tcatccatgaagagtgacagaa

SEQ ID NO: 9129530 - DNA, 20 bp, Homo sapiens
gtcttcataatgaccttatt

SEQ ID NO: 9129531 - DNA, 22 bp, Homo sapiens
gtcttcattcaacaaatattca

SEQ ID NO: 9129532 - DNA, 22 bp, Homo sapiens
gtcttcatcgggggaatagaaa

SEQ ID NO: 9129533 - DNA, 22 bp, Homo sapiens
gtaatagtctcaaactcctgga

SEQ ID NO: 9129534 - DNA, 22 bp, Homo sapiens
gtcacattcatgcagaatcaaa

SEQ ID NO: 9129535 - DNA, 22 bp, Homo sapiens
gtcatttaaagaccattgtggg

SEQ ID NO: 9129536 - DNA, 22 bp, Homo sapiens
gtcatttattctggtcaattca

SEQ ID NO: 9129537 - DNA, 22 bp, Homo sapiens
gtcatttatcttcagaatttct

SEQ ID NO: 9129538 - DNA, 19 bp, Homo sapiens
ggtaatattgtcagtgaca

SEQ ID NO: 9129539 - DNA, 22 bp, Homo sapiens
ggcaggagaatggcgtgaactc

SEQ ID NO: 9129540 - DNA, 22 bp, Homo sapiens
gggaatgaccttaataagtagg

SEQ ID NO: 9129541 - DNA, 18 bp, Homo sapiens
gggaatcagaatctcatt

SEQ ID NO: 9129542 - DNA, 22 bp, Homo sapiens
ggcgtgggcgaggtgctctatc

SEQ ID NO: 9129543 - DNA, 22 bp, Homo sapiens
gcatttcttcctggtgtgagcc

SEQ ID NO: 9129544 - DNA, 22 bp, Homo sapiens
tttgcattgcattaagtattct

SEQ ID NO: 9129545 - DNA, 22 bp, Homo sapiens
tttgcatttgttcaagtattga

SEQ ID NO: 9129546 - DNA, 22 bp, Homo sapiens
tttgcatttgtttagaacctga

SEQ ID NO: 9129547 - DNA, 18 bp, Homo sapiens
tttgcatggtaacattga

SEQ ID NO: 9129548 - DNA, 22 bp, Homo sapiens
tttgcattatatttatagaaga

SEQ ID NO: 9129549 - DNA, 18 bp, Homo sapiens
tttgagaatgcatgactg

SEQ ID NO: 9129550 - DNA, 22 bp, Homo sapiens
tttgacattggcttattctgtt

SEQ ID NO: 9129551 - DNA, 22 bp, Homo sapiens
tttgacattatcctgttactgg

SEQ ID NO: 9129552 - DNA, 22 bp, Homo sapiens
tttgaaattaagatattgtcca

SEQ ID NO: 9129553 - DNA, 17 bp, Homo sapiens
tttctagctgtgaaccc

SEQ ID NO: 9129554 - DNA, 22 bp, Homo sapiens
tttctaggatactctaaatgta

SEQ ID NO: 9129555 - DNA, 22 bp, Homo sapiens
ttttacaggtgaaaaatgaaga

SEQ ID NO: 9129556 - DNA, 22 bp, Homo sapiens
ttttcaagagagtgttctatgt

SEQ ID NO: 9129557 - DNA, 22 bp, Homo sapiens
ttttagaaatactgatttagtg

SEQ ID NO: 9129558 - DNA, 22 bp, Homo sapiens
ttgtatagtaagtgaatgttta

SEQ ID NO: 9129559 - DNA, 22 bp, Homo sapiens
ttgtatagcccagagagtgaga

SEQ ID NO: 9129560 - DNA, 22 bp, Homo sapiens
ttggaatatcatgcagaataaa

SEQ ID NO: 9129561 - DNA, 22 bp, Homo sapiens
ttggaatagggaatcaaagttt

SEQ ID NO: 9129562 - DNA, 22 bp, Homo sapiens
ttggaatatgtgtatgaaaagc

SEQ ID NO: 9129563 - DNA, 22 bp, Homo sapiens
tttagcatgtgtgccatgtggc

SEQ ID NO: 9129564 - DNA, 22 bp, Homo sapiens
tttaagaagttatgttataaat

SEQ ID NO: 9129565 - DNA, 20 bp, Homo sapiens
tttaagaagtttctgaggaa

SEQ ID NO: 9129566 - DNA, 22 bp, Homo sapiens
tttaagaagttatgttataaat

SEQ ID NO: 9129567 - DNA, 22 bp, Homo sapiens
ttgttgtagacgcgaagtgact

SEQ ID NO: 9129568 - DNA, 22 bp, Homo sapiens
tttcaagttgttgcattaaatg

SEQ ID NO: 9129569 - DNA, 22 bp, Homo sapiens
tttcaagtcattctataatatc

SEQ ID NO: 9129570 - DNA, 21 bp, Homo sapiens
tttatttatataggacacatg

SEQ ID NO: 9129571 - DNA, 22 bp, Homo sapiens
tttctaaatggtggctgcattg

SEQ ID NO: 9129572 - DNA, 22 bp, Homo sapiens
tttctaaactggattcagcctg

SEQ ID NO: 9129573 - DNA, 22 bp, Homo sapiens
tttcatagccttctaatgagtt

SEQ ID NO: 9129574 - DNA, 22 bp, Homo sapiens
ttcatagtaacagtaactatgg

SEQ ID NO: 9129575 - DNA, 22 bp, Homo sapiens
ttcaagatcttccaaaggatac

SEQ ID NO: 9129576 - DNA, 22 bp, Homo sapiens
ttcaagatggctgcaaatactt

SEQ ID NO: 9129577 - DNA, 22 bp, Homo sapiens
ttcaagatggccccagtgagcc

SEQ ID NO: 9129578 - DNA, 22 bp, Homo sapiens
ttcaagatggcaccagtgagtg

SEQ ID NO: 9129579 - DNA, 22 bp, Homo sapiens
ttcaagatgccagggacgcggc

SEQ ID NO: 9129580 - DNA, 22 bp, Homo sapiens
ttatttaggaggaaactgaggt

SEQ ID NO: 9129581 - DNA, 22 bp, Homo sapiens
ttatttatatctctgcagttta

SEQ ID NO: 9129582 - DNA, 20 bp, Homo sapiens
ttcttctctagttatcttca

SEQ ID NO: 9129583 - DNA, 22 bp, Homo sapiens
ttgagaaccactgagttagata

SEQ ID NO: 9129584 - DNA, 22 bp, Homo sapiens
ttccctctgcgcattgaatttc

SEQ ID NO: 9129585 - DNA, 22 bp, Homo sapiens
atttcacagctgtcagtgttac

SEQ ID NO: 9129586 - DNA, 22 bp, Homo sapiens
atttcacatctatctcagattt

SEQ ID NO: 9129587 - DNA, 22 bp, Homo sapiens
atttcacaaagaacagatgcag

SEQ ID NO: 9129588 - DNA, 22 bp, Homo sapiens
attcatttgctattgtgtatgg

SEQ ID NO: 9129589 - DNA, 22 bp, Homo sapiens
atgcaacatccaattccttttg

SEQ ID NO: 9129590 - DNA, 22 bp, Homo sapiens
caaatagtatgagcaatgattc

SEQ ID NO: 9129591 - DNA, 22 bp, Homo sapiens
cagaaatatttattgagtgaca

SEQ ID NO: 9129592 - DNA, 22 bp, Homo sapiens
cagaaatatgtgccatgcctta

SEQ ID NO: 9129593 - DNA, 22 bp, Homo sapiens
cagaaatattccaagtactgca

SEQ ID NO: 9129594 - DNA, 22 bp, Homo sapiens
cagaaatattccaagtactgca

SEQ ID NO: 9129595 - DNA, 21 bp, Homo sapiens
cagaaatatgaatgatggtga

SEQ ID NO: 9129596 - DNA, 22 bp, Homo sapiens
cagaaatatcagttgaaagtgc

SEQ ID NO: 9129597 - DNA, 22 bp, Homo sapiens
cagaaatatatatgggtcagag

SEQ ID NO: 9129598 - DNA, 19 bp, Homo sapiens
cagaaatagcgaagtgtaa

SEQ ID NO: 9129599 - DNA, 22 bp, Homo sapiens
agcatataaatggacatatttg

SEQ ID NO: 9129600 - DNA, 22 bp, Homo sapiens
cagacatatgttttaacagatt

SEQ ID NO: 9129601 - DNA, 22 bp, Homo sapiens
actggaattaggtttgtataca

SEQ ID NO: 9129602 - DNA, 22 bp, Homo sapiens
acctgaattttggatgagctgt

SEQ ID NO: 9129603 - DNA, 22 bp, Homo sapiens
acctgaatttgaaatgtttatt

SEQ ID NO: 9129604 - DNA, 22 bp, Homo sapiens
acctgaattgtcatatcttatt

SEQ ID NO: 9129605 - DNA, 22 bp, Homo sapiens
acctgaatccaaactcaacaat

SEQ ID NO: 9129606 - DNA, 22 bp, Homo sapiens
agtatttcttcatatgattact

SEQ ID NO: 9129607 - DNA, 22 bp, Homo sapiens
agtaaaatcaccatctctttgt

SEQ ID NO: 9129608 - DNA, 22 bp, Homo sapiens
acgcccggtctccatagttttt

SEQ ID NO: 9129609 - DNA, 22 bp, Homo sapiens
ataatgaatgcagagttatttt

SEQ ID NO: 9129610 - DNA, 22 bp, Homo sapiens
ataaggtatgagcaatgagttt

SEQ ID NO: 9129611 - DNA, 22 bp, Homo sapiens
acagtaaataatgcatgttgat

SEQ ID NO: 9129612 - DNA, 22 bp, Homo sapiens
acatagcacgtctcaatttgga

SEQ ID NO: 9129613 - DNA, 22 bp, Homo sapiens
aggatgaggctggcaggtcttg

SEQ ID NO: 9129614 - DNA, 22 bp, Homo sapiens
acatttctaatttaatgtaaca

SEQ ID NO: 9129615 - DNA, 22 bp, Homo sapiens
acatttcttcctaattatccct

SEQ ID NO: 9129616 - DNA, 22 bp, Homo sapiens
acatttctttgctagacagcag

SEQ ID NO: 9129617 - DNA, 22 bp, Homo sapiens
aggctgagctggtagtgagtac

SEQ ID NO: 9129618 - DNA, 22 bp, Homo sapiens
accagcaggtggcagtatgtat

SEQ ID NO: 9129619 - DNA, 21 bp, Homo sapiens
accagcaggagatcagaagga

SEQ ID NO: 9129620 - DNA, 22 bp, Homo sapiens
accaggctggagtgcagtggcg

SEQ ID NO: 9129621 - DNA, 22 bp, Homo sapiens
accaggctccccttggatcctg

SEQ ID NO: 9129622 - DNA, 22 bp, Homo sapiens
accatgtcatttattggccaaa

SEQ ID NO: 9129623 - DNA, 22 bp, Homo sapiens
acagtacaggacgagttttcct

SEQ ID NO: 9129624 - DNA, 22 bp, Homo sapiens
agaaataagagctttccttggg

SEQ ID NO: 9129625 - DNA, 23 bp, Homo sapiens
aatgagcttcattcttggaagac

SEQ ID NO: 9129626 - DNA, 22 bp, Homo sapiens
aatgagcttctataatcttgtc

SEQ ID NO: 9129627 - DNA, 22 bp, Homo sapiens
aagttggtcgcaattagtcaca

SEQ ID NO: 9129628 - DNA, 22 bp, Homo sapiens
aataagaattgccagatttgaa

SEQ ID NO: 9129629 - DNA, 22 bp, Homo sapiens
aataagaatttacttgtcaaga

SEQ ID NO: 9129630 - DNA, 22 bp, Homo sapiens
acagaaattgctaatagctcat

SEQ ID NO: 9129631 - DNA, 22 bp, Homo sapiens
acagaaattcaaactggaattt

SEQ ID NO: 9129632 - DNA, 19 bp, Homo sapiens
acagaaattagttattttc

SEQ ID NO: 9129633 - DNA, 22 bp, Homo sapiens
acaccagggatatgaggaagga

SEQ ID NO: 9129634 - DNA, 22 bp, Homo sapiens
acaaatgtctacattgagaata

SEQ ID NO: 9129635 - DNA, 22 bp, Homo sapiens
acaaatgtggacatggataatg

SEQ ID NO: 9129636 - DNA, 22 bp, Homo sapiens
aatgtcagcctgaaagctattc

SEQ ID NO: 9129637 - DNA, 22 bp, Homo sapiens
aatgcaagtcaatgctataccc

SEQ ID NO: 9129638 - DNA, 22 bp, Homo sapiens
aatgttctcaacaaaaggaagc

SEQ ID NO: 9129639 - DNA, 22 bp, Homo sapiens
aattatgaggtagatatcacat

SEQ ID NO: 9129640 - DNA, 18 bp, Homo sapiens
acagacaaaatggaaatg

SEQ ID NO: 9129641 - DNA, 22 bp, Homo sapiens
aagaaatattgggccttataaa

SEQ ID NO: 9129642 - DNA, 22 bp, Homo sapiens
aataagaaagagtcagcttcag

SEQ ID NO: 9129643 - DNA, 22 bp, Homo sapiens
aataagaactccatttactcgt

SEQ ID NO: 9129644 - DNA, 22 bp, Homo sapiens
aataagaacaactaaggtttat

SEQ ID NO: 9129645 - DNA, 22 bp, Homo sapiens
aatgatatttattgaatagatg

SEQ ID NO: 9129646 - DNA, 22 bp, Homo sapiens
aatgataccaaacatgtagata

SEQ ID NO: 9129647 - DNA, 22 bp, Homo sapiens
aatcatgtttacgtgacatgtc

SEQ ID NO: 9129648 - DNA, 22 bp, Homo sapiens
aacaaagtttcaggaagataga

SEQ ID NO: 9129649 - DNA, 22 bp, Homo sapiens
aacactgacgacgtgaactaaa

SEQ ID NO: 9129650 - DNA, 22 bp, Homo sapiens
aaggtcaagacacaggaatcta

SEQ ID NO: 9129651 - DNA, 22 bp, Homo sapiens
aaataacttggtttcatcagag

SEQ ID NO: 9129652 - DNA, 22 bp, Homo sapiens
aaatgcagctgggcatgagagg

SEQ ID NO: 9129653 - DNA, 20 bp, Homo sapiens
aaatgcagggctgctgcgga

SEQ ID NO: 9129654 - DNA, 22 bp, Homo sapiens
aaatgcagtggttctacttctc

SEQ ID NO: 9129655 - DNA, 22 bp, Homo sapiens
aaatgtacgggagtagaattag

SEQ ID NO: 9129656 - DNA, 22 bp, Homo sapiens
aaactgaagtagattctgaaat

SEQ ID NO: 9129657 - DNA, 21 bp, Homo sapiens
aaactgaagagacaggaactt

SEQ ID NO: 9129658 - DNA, 22 bp, Homo sapiens
aaactgaagagctttttgacac

SEQ ID NO: 9129659 - DNA, 22 bp, Homo sapiens
aaatgcagaatgatttcatcta

SEQ ID NO: 9129660 - DNA, 22 bp, Homo sapiens
aaaaaagattgatggtggatgc

SEQ ID NO: 9129661 - DNA, 22 bp, Homo sapiens
attcaagtggctgctatgttaa

SEQ ID NO: 9129662 - DNA, 22 bp, Homo sapiens
attatctaggaattgacagaag

SEQ ID NO: 9129663 - DNA, 19 bp, Homo sapiens
gctcagagacacctgttgc

SEQ ID NO: 9129664 - DNA, 22 bp, Homo sapiens
attttgaatcaccttggaagaa

SEQ ID NO: 9129665 - DNA, 22 bp, Homo sapiens
attttcagttgaaaaagttggt

SEQ ID NO: 9129666 - DNA, 22 bp, Homo sapiens
attttcagtgatcatagcacac

SEQ ID NO: 9129667 - DNA, 22 bp, Homo sapiens
atttatgattagcctattgttg

SEQ ID NO: 9129668 - DNA, 22 bp, Homo sapiens
atttatcaccagttagctgact

SEQ ID NO: 9129669 - DNA, 22 bp, Homo sapiens
atttctgtttgctactataagt

SEQ ID NO: 9129670 - DNA, 22 bp, Homo sapiens
atgtggctagtggctatgatct

SEQ ID NO: 9129671 - DNA, 22 bp, Homo sapiens
atgtcagaatctacattctact

SEQ ID NO: 9129672 - DNA, 22 bp, Homo sapiens
atgtcagatattttttggttgc

SEQ ID NO: 9129673 - DNA, 22 bp, Homo sapiens
atgtcagatgtttatctgattt

SEQ ID NO: 9129674 - DNA, 22 bp, Homo sapiens
atgctgtggaagttcctgaagc

SEQ ID NO: 9129675 - DNA, 22 bp, Homo sapiens
gaagccttgaactgcaaacccc

SEQ ID NO: 9129676 - DNA, 22 bp, Homo sapiens
atgctaaggcccaggagaaaat

SEQ ID NO: 9129677 - DNA, 22 bp, Homo sapiens
gaatttcagatcagagaccatt

SEQ ID NO: 9129678 - DNA, 22 bp, Homo sapiens
gaatttcaggacaactggaagg

SEQ ID NO: 9129679 - DNA, 22 bp, Homo sapiens
gaatttcaaagaggttaagagg

SEQ ID NO: 9129680 - DNA, 22 bp, Homo sapiens
gaatttcaagcagtgcaatgtt

SEQ ID NO: 9129681 - DNA, 22 bp, Homo sapiens
atgccactgcactccagcctgg

SEQ ID NO: 9129682 - DNA, 22 bp, Homo sapiens
atgccactgcactccagcctag

SEQ ID NO: 9129683 - DNA, 22 bp, Homo sapiens
atctttcatctctattatttga

SEQ ID NO: 9129684 - DNA, 22 bp, Homo sapiens
atctttcatctctattatttga

SEQ ID NO: 9129685 - DNA, 22 bp, Homo sapiens
atctttcagtttcataccaatt

SEQ ID NO: 9129686 - DNA, 22 bp, Homo sapiens
atctttcagagctccatcaggg

SEQ ID NO: 9129687 - DNA, 22 bp, Homo sapiens
ctttggaaagtggttcaggtga

SEQ ID NO: 9129688 - DNA, 22 bp, Homo sapiens
atgagaatatgatttactattg

SEQ ID NO: 9129689 - DNA, 22 bp, Homo sapiens
cagaaacagagaaatattggct

SEQ ID NO: 9129690 - DNA, 22 bp, Homo sapiens
ggtcaatgccaagtgtggctta

SEQ ID NO: 9129691 - DNA, 22 bp, Homo sapiens
cagatttaagagataaacagtg

SEQ ID NO: 9129692 - DNA, 22 bp, Homo sapiens
gtcacaattataggaactcaga

SEQ ID NO: 9129693 - DNA, 22 bp, Homo sapiens
caccaggaagctgcaatttgag

SEQ ID NO: 9129694 - DNA, 22 bp, Homo sapiens
caccaggaccccacggtgggtt

SEQ ID NO: 9129695 - DNA, 22 bp, Homo sapiens
caccaggaagtggtggcctggg

SEQ ID NO: 9129696 - DNA, 20 bp, Homo sapiens
caccaggaccattggctatg

SEQ ID NO: 9129697 - DNA, 22 bp, Homo sapiens
caccaggagcatctaggaggcg

SEQ ID NO: 9129698 - DNA, 22 bp, Homo sapiens
cacttgttggtggtgaaatcac

SEQ ID NO: 9129699 - DNA, 22 bp, Homo sapiens
caccaggatgggcaggtaggtc

SEQ ID NO: 9129700 - DNA, 22 bp, Homo sapiens
caccaggaggacaggcccctac

SEQ ID NO: 9129701 - DNA, 22 bp, Homo sapiens
caccaggataaaacctctagat

SEQ ID NO: 9129702 - DNA, 22 bp, Homo sapiens
caagaagaggtgattggtaagt

SEQ ID NO: 9129703 - DNA, 22 bp, Homo sapiens
caagaagaggtgattggtaagt

SEQ ID NO: 9129704 - DNA, 22 bp, Homo sapiens
caagaaatttcttaagaactaa

SEQ ID NO: 9129705 - DNA, 22 bp, Homo sapiens
caagaaattctgttcagatagc

SEQ ID NO: 9129706 - DNA, 22 bp, Homo sapiens
atacagaagaactatagccact

SEQ ID NO: 9129707 - DNA, 22 bp, Homo sapiens
ataatgtttttgtataagcatg

SEQ ID NO: 9129708 - DNA, 22 bp, Homo sapiens
atacagaagcctgtatttctgg

SEQ ID NO: 9129709 - DNA, 21 bp, Homo sapiens
atacagaaggtggcaaagtac

SEQ ID NO: 9129710 - DNA, 22 bp, Homo sapiens
agttttctgggatcactggaat

SEQ ID NO: 9129711 - DNA, 22 bp, Homo sapiens
ataataaaccaggatgggtctg

SEQ ID NO: 9129712 - DNA, 22 bp, Homo sapiens
atatattttgcggtcacgtggc

SEQ ID NO: 9129713 - DNA, 22 bp, Homo sapiens
atagtacagatccattaattat

SEQ ID NO: 9129714 - DNA, 22 bp, Homo sapiens
atctatttctgctaataacaat

SEQ ID NO: 9129715 - DNA, 22 bp, Homo sapiens
agtgactgacacctgtaatccc

SEQ ID NO: 9129716 - DNA, 22 bp, Homo sapiens
agtgactggtgtgaagttaaat

SEQ ID NO: 9129717 - DNA, 22 bp, Homo sapiens
aggtatattttgtatatactct

SEQ ID NO: 9129718 - DNA, 22 bp, Homo sapiens
aggtatatgaagatgaaataac

SEQ ID NO: 9129719 - DNA, 22 bp, Homo sapiens
agtcagagaaaacagccctgtg

SEQ ID NO: 9129720 - DNA, 22 bp, Homo sapiens
cctggtccccatcggcccagcg

SEQ ID NO: 9129721 - DNA, 22 bp, Homo sapiens
aggttcagatgacttttatgct

SEQ ID NO: 9129722 - DNA, 22 bp, Homo sapiens
agtaatgacaatttttatctgt

SEQ ID NO: 9129723 - DNA, 22 bp, Homo sapiens
agtaatgaagatttgttgcaca

SEQ ID NO: 9129724 - DNA, 22 bp, Homo sapiens
caggctcagatgccctgcgctg

SEQ ID NO: 9129725 - DNA, 22 bp, Homo sapiens
cattaaaatatctcatggtgtt

SEQ ID NO: 9129726 - DNA, 22 bp, Homo sapiens
cagttttagggcaatgtgaaga

SEQ ID NO: 9129727 - DNA, 22 bp, Homo sapiens
aggctgaggcgggtagatcacc

SEQ ID NO: 9129728 - DNA, 22 bp, Homo sapiens
aggctcagtgatgtaaaatata

SEQ ID NO: 9129729 - DNA, 22 bp, Homo sapiens
ccaggagagcagaagcccaggc

SEQ ID NO: 9129730 - DNA, 22 bp, Homo sapiens
ccgcaaggcagaggttgcagtg

SEQ ID NO: 9129731 - DNA, 22 bp, Homo sapiens
agggccagaatccctcagtcta

SEQ ID NO: 9129732 - DNA, 22 bp, Homo sapiens
tcatttatcatttgtgctgtag

SEQ ID NO: 9129733 - DNA, 22 bp, Homo sapiens
tcatttatcgctgccttttaaa

SEQ ID NO: 9129734 - DNA, 22 bp, Homo sapiens
tcatttatgtctttgccatcca

SEQ ID NO: 9129735 - DNA, 22 bp, Homo sapiens
tcatttatgcaggaatggcata

SEQ ID NO: 9129736 - DNA, 21 bp, Homo sapiens
tcatttattgagaaatgactg

SEQ ID NO: 9129737 - DNA, 22 bp, Homo sapiens
tcatttatttgactttggagtg

SEQ ID NO: 9129738 - DNA, 22 bp, Homo sapiens
tcatttatttataccattgcct

SEQ ID NO: 9129739 - DNA, 21 bp, Homo sapiens
tcatttattgagaaatgactg

SEQ ID NO: 9129740 - DNA, 22 bp, Homo sapiens
catgtttgtacaaaggtacaca

SEQ ID NO: 9129741 - DNA, 22 bp, Homo sapiens
tctgaatttatggcaaaacctg

SEQ ID NO: 9129742 - DNA, 22 bp, Homo sapiens
tctgaattctgacaatttgaat

SEQ ID NO: 9129743 - DNA, 22 bp, Homo sapiens
tctgaattcttagaattaaagg

SEQ ID NO: 9129744 - DNA, 20 bp, Homo sapiens
tctgaattgagtgaatgtct

SEQ ID NO: 9129745 - DNA, 22 bp, Homo sapiens
tctctgggagttgagcagcagc

SEQ ID NO: 9129746 - DNA, 20 bp, Homo sapiens
tctctgcagcagaggctggg

SEQ ID NO: 9129747 - DNA, 23 bp, Homo sapiens
tagagcttcagcgaatgtgctca

SEQ ID NO: 9129748 - DNA, 22 bp, Homo sapiens
tagagcttggactgcattttcg

SEQ ID NO: 9129749 - DNA, 22 bp, Homo sapiens
tagaacataagtcattcatttg

SEQ ID NO: 9129750 - DNA, 22 bp, Homo sapiens
tactatttggaattttaaattg

SEQ ID NO: 9129751 - DNA, 22 bp, Homo sapiens
tactattttgacatgaaattga

SEQ ID NO: 9129752 - DNA, 22 bp, Homo sapiens
tactcagagtcattgcccttct

SEQ ID NO: 9129753 - DNA, 22 bp, Homo sapiens
tatttcttttcgtgacttattg

SEQ ID NO: 9129754 - DNA, 22 bp, Homo sapiens
tcacagttactccttcagatga

SEQ ID NO: 9129755 - DNA, 22 bp, Homo sapiens
tgctttcagtttacatcagaac

SEQ ID NO: 9129756 - DNA, 22 bp, Homo sapiens
tgctttcatgaagtctatagag

SEQ ID NO: 9129757 - DNA, 22 bp, Homo sapiens
tgctttcagctggtaaagaaac

SEQ ID NO: 9129758 - DNA, 21 bp, Homo sapiens
tgctttcagactcttacagaa

SEQ ID NO: 9129759 - DNA, 22 bp, Homo sapiens
tgctttcaaaggctttctagat

SEQ ID NO: 9129760 - DNA, 22 bp, Homo sapiens
tggctagcactctacctttctc

SEQ ID NO: 9129761 - DNA, 22 bp, Homo sapiens
ccggctcggcgaccaggctgaa

SEQ ID NO: 9129762 - DNA, 22 bp, Homo sapiens
tgtcaagagtagtttgaatagt

SEQ ID NO: 9129763 - DNA, 17 bp, Homo sapiens
tgaagatgcatggcagc

SEQ ID NO: 9129764 - DNA, 22 bp, Homo sapiens
tgaaaggaaagtacagtgatgc

SEQ ID NO: 9129765 - DNA, 22 bp, Homo sapiens
ccaggctagagtgcagtggcgt

SEQ ID NO: 9129766 - DNA, 17 bp, Homo sapiens
ccaggctataccaggct

SEQ ID NO: 9129767 - DNA, 22 bp, Homo sapiens
ccaggctagagtgcaatggcgc

SEQ ID NO: 9129768 - DNA, 22 bp, Homo sapiens
ccaggctagagagcagtggcac

SEQ ID NO: 9129769 - DNA, 22 bp, Homo sapiens
ccaggctagagagcagtggcat

SEQ ID NO: 9129770 - DNA, 22 bp, Homo sapiens
ccaggctagagtgcagtggcat

SEQ ID NO: 9129771 - DNA, 22 bp, Homo sapiens
ccaggctagagtgcaatggcat

SEQ ID NO: 9129772 - DNA, 22 bp, Homo sapiens
tgattcaactttcataacaaaa

SEQ ID NO: 9129773 - DNA, 22 bp, Homo sapiens
tgattcaactttcttgaatgca

SEQ ID NO: 9129774 - DNA, 22 bp, Homo sapiens
tgattagatagtaagtgactaa

SEQ ID NO: 9129775 - DNA, 22 bp, Homo sapiens
tgattacattggtaatgtttat

SEQ ID NO: 9129776 - DNA, 22 bp, Homo sapiens
tgattacacagcagtaatttca

SEQ ID NO: 9129777 - DNA, 22 bp, Homo sapiens
cgctccttgagcgtgtcggcct

SEQ ID NO: 9129778 - DNA, 22 bp, Homo sapiens
ccttttgctctcccatccagaa

SEQ ID NO: 9129779 - DNA, 22 bp, Homo sapiens
ttatatttctggtagccttcag

SEQ ID NO: 9129780 - DNA, 22 bp, Homo sapiens
ttggataaagaggaagattatc

SEQ ID NO: 9129781 - DNA, 22 bp, Homo sapiens
ctgctgtgacagctgccgtgtt

SEQ ID NO: 9129782 - DNA, 22 bp, Homo sapiens
tttcagaaattgttattattct

SEQ ID NO: 9129783 - DNA, 22 bp, Homo sapiens
tttatgctactcaatagtcagt

SEQ ID NO: 9129784 - DNA, 21 bp, Homo sapiens
tttatgcatgcctctctgtca

SEQ ID NO: 9129785 - DNA, 22 bp, Homo sapiens
ttttgcttaatctagattttgc

SEQ ID NO: 9129786 - DNA, 22 bp, Homo sapiens
tttggaatgtatttgaccaaag

SEQ ID NO: 9129787 - DNA, 22 bp, Homo sapiens
tttggaatggaatagagattgc

SEQ ID NO: 9129788 - DNA, 22 bp, Homo sapiens
tttggaatgacagatatcaata

SEQ ID NO: 9129789 - DNA, 22 bp, Homo sapiens
gaagaagagataatggggagca

SEQ ID NO: 9129790 - DNA, 22 bp, Homo sapiens
gaaatattacagtggaggggat

SEQ ID NO: 9129791 - DNA, 22 bp, Homo sapiens
gaaatattcttgtcttgttttc

SEQ ID NO: 9129792 - DNA, 22 bp, Homo sapiens
gaaatattgggactcagagctt

SEQ ID NO: 9129793 - DNA, 22 bp, Homo sapiens
gaaatattgtactggagatgtt

SEQ ID NO: 9129794 - DNA, 22 bp, Homo sapiens
gaaagaatgagcatcatgactt

SEQ ID NO: 9129795 - DNA, 22 bp, Homo sapiens
gaaagaatgctatagtgacttc

SEQ ID NO: 9129796 - DNA, 22 bp, Homo sapiens
ctttggaagtgatagatatgat

SEQ ID NO: 9129797 - DNA, 22 bp, Homo sapiens
ctttggaagtaaagtcagcagg

SEQ ID NO: 9129798 - DNA, 22 bp, Homo sapiens
cttggaaaggttttacaaagcg

SEQ ID NO: 9129799 - DNA, 22 bp, Homo sapiens
cttgctttgtccagaaattcag

SEQ ID NO: 9129800 - DNA, 22 bp, Homo sapiens
cttcacttgctcatcatgctat

SEQ ID NO: 9129801 - DNA, 22 bp, Homo sapiens
gaatgatttggttgtttagatt

SEQ ID NO: 9129802 - DNA, 22 bp, Homo sapiens
gagcaaggcggcatctctctga

SEQ ID NO: 9129803 - DNA, 22 bp, Homo sapiens
gagtaatattctgtactggagg

SEQ ID NO: 9129804 - DNA, 22 bp, Homo sapiens
tcctagagagtaatacagtttt

SEQ ID NO: 9129805 - DNA, 22 bp, Homo sapiens
tcctagtaacttatgcgtgcct

SEQ ID NO: 9129806 - DNA, 22 bp, Homo sapiens
tcatttcttaactagagtgaac

SEQ ID NO: 9129807 - DNA, 22 bp, Homo sapiens
tcatttctgagccttccatgat

SEQ ID NO: 9129808 - DNA, 22 bp, Homo sapiens
tcatttctctgagtctgataat

SEQ ID NO: 9129809 - DNA, 22 bp, Homo sapiens
tcatttctcctaagtgaaatat

SEQ ID NO: 9129810 - DNA, 22 bp, Homo sapiens
tcatttctccgacctgctgtcc

SEQ ID NO: 9129811 - DNA, 22 bp, Homo sapiens
tcatttatattgtattctgtag

SEQ ID NO: 9129812 - DNA, 22 bp, Homo sapiens
tcatttatagaagtgggcagta

SEQ ID NO: 9129813 - DNA, 22 bp, Homo sapiens
tcatttataaggatgcaattaa

SEQ ID NO: 9129814 - DNA, 22 bp, Homo sapiens
tcatttatagctaaccttgaat

SEQ ID NO: 9129815 - DNA, 22 bp, Homo sapiens
tcatttacttctatgacaacat

SEQ ID NO: 9129816 - DNA, 22 bp, Homo sapiens
tcatgaaaatagatcagaaatt

SEQ ID NO: 9129817 - DNA, 22 bp, Homo sapiens
tcagtattcctggaaatacaag

SEQ ID NO: 9129818 - DNA, 22 bp, Homo sapiens
tcaagaaaatgacgccaacctt

SEQ ID NO: 9129819 - DNA, 22 bp, Homo sapiens
tcacattttagtaccatgattt

SEQ ID NO: 9129820 - DNA, 22 bp, Homo sapiens
tcagaaacactcttcttctgtc

SEQ ID NO: 9129821 - DNA, 22 bp, Homo sapiens
tcagaaactaaatgtggatttg

SEQ ID NO: 9129822 - DNA, 22 bp, Homo sapiens
tcagagtggtagcctattttct

SEQ ID NO: 9129823 - DNA, 22 bp, Homo sapiens
gttgaataattcatagaagcta

SEQ ID NO: 9129824 - DNA, 22 bp, Homo sapiens
gtttgtttatacaaaagatcct

SEQ ID NO: 9129825 - DNA, 22 bp, Homo sapiens
gtttcacagatggtgttcatat

SEQ ID NO: 9129826 - DNA, 22 bp, Homo sapiens
taacagttggtgtaatttcttg

SEQ ID NO: 9129827 - DNA, 22 bp, Homo sapiens
tagaacatgacttatttttgga

SEQ ID NO: 9129828 - DNA, 22 bp, Homo sapiens
tagaacatgggatagagttttt

SEQ ID NO: 9129829 - DNA, 22 bp, Homo sapiens
tagaaatgggttacatttagag

SEQ ID NO: 9129830 - DNA, 22 bp, Homo sapiens
tagaaatggggaagtagttagg

SEQ ID NO: 9129831 - DNA, 22 bp, Homo sapiens
tagatacatacattttaaaatg

SEQ ID NO: 9129832 - DNA, 22 bp, Homo sapiens
tagcaacagcaatagtggtatt

SEQ ID NO: 9129833 - DNA, 22 bp, Homo sapiens
tatgaaatttctagttctgctt

SEQ ID NO: 9129834 - DNA, 22 bp, Homo sapiens
tatgaaattgccatttttatgg

SEQ ID NO: 9129835 - DNA, 22 bp, Homo sapiens
tatgaaatgatggggaaaatag

SEQ ID NO: 9129836 - DNA, 23 bp, Homo sapiens
tatcatttcagctctctgcctgg

SEQ ID NO: 9129837 - DNA, 22 bp, Homo sapiens
tatcatttgttattattagtgg

SEQ ID NO: 9129838 - DNA, 22 bp, Homo sapiens
tattttgaggtatttttgagct

SEQ ID NO: 9129839 - DNA, 22 bp, Homo sapiens
tcaaatattggctatttcacat

SEQ ID NO: 9129840 - DNA, 22 bp, Homo sapiens
tattttctggggagagtgaacc

SEQ ID NO: 9129841 - DNA, 22 bp, Homo sapiens
tatttgctttgctttatagaga

SEQ ID NO: 9129842 - DNA, 22 bp, Homo sapiens
tatttgcttggaaacctaatcc

SEQ ID NO: 9129843 - DNA, 22 bp, Homo sapiens
ggccacagtctctggaaggatg

SEQ ID NO: 9129844 - DNA, 22 bp, Homo sapiens
ggccacagggctgaacgtggac

SEQ ID NO: 9129845 - DNA, 22 bp, Homo sapiens
gtctttcactgcggtttacatg

SEQ ID NO: 9129846 - DNA, 22 bp, Homo sapiens
gctgctgtcagcaggccttgtt

SEQ ID NO: 9129847 - DNA, 20 bp, Homo sapiens
gagtatatttcttcctttgc

SEQ ID NO: 9129848 - DNA, 22 bp, Homo sapiens
gagtatatttctctctcttaag

SEQ ID NO: 9129849 - DNA, 22 bp, Homo sapiens
gagtatatgactttcttttgca

SEQ ID NO: 9129850 - DNA, 22 bp, Homo sapiens
gcaataaagattttactgtcag

SEQ ID NO: 9129851 - DNA, 22 bp, Homo sapiens
gccaggcgggtctcaaactcct

SEQ ID NO: 9129852 - DNA, 22 bp, Homo sapiens
gcatttatttctttactgcatc

SEQ ID NO: 9129853 - DNA, 22 bp, Homo sapiens
tttgagtaggcttatattttgg

SEQ ID NO: 9129854 - DNA, 22 bp, Homo sapiens
tttggaaagtgtacaaatttga

SEQ ID NO: 9129855 - DNA, 22 bp, Homo sapiens
tttctttgtagtagcataatca

SEQ ID NO: 9129856 - DNA, 22 bp, Homo sapiens
tttgaatatgtgcttgttaaat

SEQ ID NO: 9129857 - DNA, 22 bp, Homo sapiens
ttttcatgttccttgttaagtg

SEQ ID NO: 9129858 - DNA, 22 bp, Homo sapiens
ttttcttatgtgcagctatatg

SEQ ID NO: 9129859 - DNA, 22 bp, Homo sapiens
ttttcatttttgtagatgcaag

SEQ ID NO: 9129860 - DNA, 22 bp, Homo sapiens
ttttctcttgttaatgtactga

SEQ ID NO: 9129861 - DNA, 22 bp, Homo sapiens
ttcttataagttaatatttcca

SEQ ID NO: 9129862 - DNA, 22 bp, Homo sapiens
ttcttataagataggcctcagg

SEQ ID NO: 9129863 - DNA, 22 bp, Homo sapiens
ttcttatattgggtcatggata

SEQ ID NO: 9129864 - DNA, 22 bp, Homo sapiens
ttcttatttcccccttcatcat

SEQ ID NO: 9129865 - DNA, 22 bp, Homo sapiens
ttcttttcttggcaggagtaga

SEQ ID NO: 9129866 - DNA, 22 bp, Homo sapiens
ttgaacattggcaatttcatat

SEQ ID NO: 9129867 - DNA, 22 bp, Homo sapiens
ttagcttttgagaatgatttct

SEQ ID NO: 9129868 - DNA, 22 bp, Homo sapiens
ttagctttagagccattactgg

SEQ ID NO: 9129869 - DNA, 22 bp, Homo sapiens
ttattatggcagttttctaggt

SEQ ID NO: 9129870 - DNA, 22 bp, Homo sapiens
ttcatttaatttgtgtattaac

SEQ ID NO: 9129871 - DNA, 22 bp, Homo sapiens
ttcatttagcatgctaaacctg

SEQ ID NO: 9129872 - DNA, 22 bp, Homo sapiens
ttcatttaatcagaatctctaa

SEQ ID NO: 9129873 - DNA, 22 bp, Homo sapiens
ttcatttattcagcaggtattt

SEQ ID NO: 9129874 - DNA, 23 bp, Homo sapiens
ttcatttaggagttcataagagc

SEQ ID NO: 9129875 - DNA, 23 bp, Homo sapiens
ttcatttaggagttcataagagc

SEQ ID NO: 9129876 - DNA, 22 bp, Homo sapiens
tttcaagactcattgagtattg

SEQ ID NO: 9129877 - DNA, 22 bp, Homo sapiens
tttcactcagctctcattgtct

SEQ ID NO: 9129878 - DNA, 22 bp, Homo sapiens
tttcatgtgcaattagcaatat

SEQ ID NO: 9129879 - DNA, 22 bp, Homo sapiens
tttcccattctaattactcatt

SEQ ID NO: 9129880 - DNA, 22 bp, Homo sapiens
tttagagttgtagctctcagct

SEQ ID NO: 9129881 - DNA, 23 bp, Homo sapiens
ttggaaatggggagaacagattc

SEQ ID NO: 9129882 - DNA, 22 bp, Homo sapiens
agctaaatgttgcttaaaattt

SEQ ID NO: 9129883 - DNA, 19 bp, Homo sapiens
acacaatgacacatatata

SEQ ID NO: 9129884 - DNA, 22 bp, Homo sapiens
acacaatgtcatcataatgtca

SEQ ID NO: 9129885 - DNA, 22 bp, Homo sapiens
acacttaagcatgaagtataaa

SEQ ID NO: 9129886 - DNA, 22 bp, Homo sapiens
agcaaataaagacaattatgtc

SEQ ID NO: 9129887 - DNA, 22 bp, Homo sapiens
acaattttccccataggttatc

SEQ ID NO: 9129888 - DNA, 22 bp, Homo sapiens
aatgaactggagaacaatgacc

SEQ ID NO: 9129889 - DNA, 22 bp, Homo sapiens
aatgaataccgtttcactcagt

SEQ ID NO: 9129890 - DNA, 22 bp, Homo sapiens
agaaactgacaggaaatgaatt

SEQ ID NO: 9129891 - DNA, 22 bp, Homo sapiens
aatcacaaatgcaagttgtcac

SEQ ID NO: 9129892 - DNA, 22 bp, Homo sapiens
aatcacagagtccagcagatga

SEQ ID NO: 9129893 - DNA, 22 bp, Homo sapiens
aatcaagtcaaccatcatgtgc

SEQ ID NO: 9129894 - DNA, 22 bp, Homo sapiens
acttttaaatgagtttcagttg

SEQ ID NO: 9129895 - DNA, 22 bp, Homo sapiens
acagaaatattcgtggtgcttg

SEQ ID NO: 9129896 - DNA, 22 bp, Homo sapiens
acagaaatgatgtttggcaata

SEQ ID NO: 9129897 - DNA, 23 bp, Homo sapiens
acagaaatcatttgtaaggtacc

SEQ ID NO: 9129898 - DNA, 22 bp, Homo sapiens
acagaaataactttttatgttt

SEQ ID NO: 9129899 - DNA, 18 bp, Homo sapiens
acagaaatagctgtgcct

SEQ ID NO: 9129900 - DNA, 22 bp, Homo sapiens
aagatacagacagagccaaaat

SEQ ID NO: 9129901 - DNA, 22 bp, Homo sapiens
aagatacatcaaagcaaattgg

SEQ ID NO: 9129902 - DNA, 22 bp, Homo sapiens
aagatacaaatgtcaatattgg

SEQ ID NO: 9129903 - DNA, 22 bp, Homo sapiens
aagatacaccaagagcctagta

SEQ ID NO: 9129904 - DNA, 22 bp, Homo sapiens
aagaacatgttaaaagattcac

SEQ ID NO: 9129905 - DNA, 22 bp, Homo sapiens
aagaagatggttaactttcagt

SEQ ID NO: 9129906 - DNA, 22 bp, Homo sapiens
aagaatatctgttttatttagg

SEQ ID NO: 9129907 - DNA, 22 bp, Homo sapiens
aagtaacatctgaacatgatgt

SEQ ID NO: 9129908 - DNA, 20 bp, Homo sapiens
aagtaatatttgtgtaactg

SEQ ID NO: 9129909 - DNA, 22 bp, Homo sapiens
aatgaaatctgctgggtaaaga

SEQ ID NO: 9129910 - DNA, 22 bp, Homo sapiens
aatgaaatagttggctgtagag

SEQ ID NO: 9129911 - DNA, 22 bp, Homo sapiens
aatgcacatgccacatgtggta

SEQ ID NO: 9129912 - DNA, 22 bp, Homo sapiens
aatgcacagcgttccatgcttg

SEQ ID NO: 9129913 - DNA, 22 bp, Homo sapiens
aatgcagagtaaatatttaatt

SEQ ID NO: 9129914 - DNA, 21 bp, Homo sapiens
aatgatgaaagatgacagagt

SEQ ID NO: 9129915 - DNA, 22 bp, Homo sapiens
aatgatgaactcagagggaacc

SEQ ID NO: 9129916 - DNA, 18 bp, Homo sapiens
aatgaaatgtacaccttt

SEQ ID NO: 9129917 - DNA, 22 bp, Homo sapiens
aatatttctccttcgttatagc

SEQ ID NO: 9129918 - DNA, 22 bp, Homo sapiens
aaagtacatgtttggccatttg

SEQ ID NO: 9129919 - DNA, 22 bp, Homo sapiens
aaagtacacacagagccaagaa

SEQ ID NO: 9129920 - DNA, 22 bp, Homo sapiens
aaagtacaggaaagcctagcca

SEQ ID NO: 9129921 - DNA, 22 bp, Homo sapiens
aaagtacagatggtgaggttgg

SEQ ID NO: 9129922 - DNA, 21 bp, Homo sapiens
aaatgaatgtggtagtgcaag

SEQ ID NO: 9129923 - DNA, 22 bp, Homo sapiens
aaatacaatttcaggctgtaat

SEQ ID NO: 9129924 - DNA, 22 bp, Homo sapiens
aaaatgcaaacctacctacata

SEQ ID NO: 9129925 - DNA, 22 bp, Homo sapiens
aaaatgaggaacggatcatggc

SEQ ID NO: 9129926 - DNA, 18 bp, Homo sapiens
aaaatgcaggcgacatgg

SEQ ID NO: 9129927 - DNA, 22 bp, Homo sapiens
aaaatgcatgagaatgtgctcg

SEQ ID NO: 9129928 - DNA, 22 bp, Homo sapiens
aaaatggcttaataggcaataa

SEQ ID NO: 9129929 - DNA, 22 bp, Homo sapiens
aaagcagctgtttgactttcca

SEQ ID NO: 9129930 - DNA, 22 bp, Homo sapiens
aaaatgagacacatgtgactcc

SEQ ID NO: 9129931 - DNA, 22 bp, Homo sapiens
aaaatgagcatattgatccttt

SEQ ID NO: 9129932 - DNA, 22 bp, Homo sapiens
aaaatgagatacagtttgaaag

SEQ ID NO: 9129933 - DNA, 22 bp, Homo sapiens
aacatgaaacccaaacagaata

SEQ ID NO: 9129934 - DNA, 22 bp, Homo sapiens
aaatataatttctgcctcaata

SEQ ID NO: 9129935 - DNA, 22 bp, Homo sapiens
aaatatagtgacacttatagtc

SEQ ID NO: 9129936 - DNA, 22 bp, Homo sapiens
aaatgatgtggagtgaaattgt

SEQ ID NO: 9129937 - DNA, 22 bp, Homo sapiens
cagagtgatggcacctgctggg

SEQ ID NO: 9129938 - DNA, 22 bp, Homo sapiens
cagagtgagggcctgcacctgc

SEQ ID NO: 9129939 - DNA, 22 bp, Homo sapiens
cactgcaacctccacctcctgg

SEQ ID NO: 9129940 - DNA, 22 bp, Homo sapiens
cagaaactgtggattcattaaa

SEQ ID NO: 9129941 - DNA, 22 bp, Homo sapiens
cagaaacttttgatgagtgtat

SEQ ID NO: 9129942 - DNA, 22 bp, Homo sapiens
caatgattctgcaactgtgtgc

SEQ ID NO: 9129943 - DNA, 22 bp, Homo sapiens
caatgattgctatttacataaa

SEQ ID NO: 9129944 - DNA, 22 bp, Homo sapiens
atttgaatgcaggtagctgagt

SEQ ID NO: 9129945 - DNA, 22 bp, Homo sapiens
atttgaatggcttaacacaacg

SEQ ID NO: 9129946 - DNA, 22 bp, Homo sapiens
attctctgtacagaaggtaccg

SEQ ID NO: 9129947 - DNA, 22 bp, Homo sapiens
attctctgggttccagtaaatg

SEQ ID NO: 9129948 - DNA, 22 bp, Homo sapiens
attctctggctaaaacctgaag

SEQ ID NO: 9129949 - DNA, 22 bp, Homo sapiens
attctctggtcattgagcatat

SEQ ID NO: 9129950 - DNA, 22 bp, Homo sapiens
agagcttagggggctttgcatc

SEQ ID NO: 9129951 - DNA, 22 bp, Homo sapiens
attgaaatacataaaattgcca

SEQ ID NO: 9129952 - DNA, 22 bp, Homo sapiens
attgagaaggagattggcatct

SEQ ID NO: 9129953 - DNA, 22 bp, Homo sapiens
attgtataagtctatttacaat

SEQ ID NO: 9129954 - DNA, 22 bp, Homo sapiens
attgtataattgtattgccaaa

SEQ ID NO: 9129955 - DNA, 22 bp, Homo sapiens
attgagaatgaagggacatttt

SEQ ID NO: 9129956 - DNA, 22 bp, Homo sapiens
attgagaatatgatttagtata

SEQ ID NO: 9129957 - DNA, 22 bp, Homo sapiens
agatacaactcagaagtgtggt

SEQ ID NO: 9129958 - DNA, 22 bp, Homo sapiens
agatacaaggcagagatgtgca

SEQ ID NO: 9129959 - DNA, 22 bp, Homo sapiens
atgcaacagagaaaatattgag

SEQ ID NO: 9129960 - DNA, 22 bp, Homo sapiens
atgcaacagttcatagttttat

SEQ ID NO: 9129961 - DNA, 21 bp, Homo sapiens
atgattctgcaaatgagtagt

SEQ ID NO: 9129962 - DNA, 22 bp, Homo sapiens
atgattctggcaaatttattat

SEQ ID NO: 9129963 - DNA, 22 bp, Homo sapiens
atgattctaggcattgaagata

SEQ ID NO: 9129964 - DNA, 20 bp, Homo sapiens
atgattcatgatgatgtctc

SEQ ID NO: 9129965 - DNA, 22 bp, Homo sapiens
atgattcaggattgaaccattt

SEQ ID NO: 9129966 - DNA, 22 bp, Homo sapiens
atgcaaatgctagagaatgttg

SEQ ID NO: 9129967 - DNA, 22 bp, Homo sapiens
atgcaaatgtcaccacttctaa

SEQ ID NO: 9129968 - DNA, 22 bp, Homo sapiens
atgttctacagatggaaagggg

SEQ ID NO: 9129969 - DNA, 22 bp, Homo sapiens
atgttattttggaaaatacaaa

SEQ ID NO: 9129970 - DNA, 22 bp, Homo sapiens
aggctcaggtctcaggtctggc

SEQ ID NO: 9129971 - DNA, 22 bp, Homo sapiens
accactgcccatggtgaaaact

SEQ ID NO: 9129972 - DNA, 22 bp, Homo sapiens
acatttctcagggagttttgct

SEQ ID NO: 9129973 - DNA, 22 bp, Homo sapiens
acatttctcaggtaagtcattt

SEQ ID NO: 9129974 - DNA, 22 bp, Homo sapiens
acatttctcatctagtagagta

SEQ ID NO: 9129975 - DNA, 22 bp, Homo sapiens
acatttctcctacttgttattt

SEQ ID NO: 9129976 - DNA, 22 bp, Homo sapiens
acatttctccttgcaggagtca

SEQ ID NO: 9129977 - DNA, 22 bp, Homo sapiens
aggtggaaatggctttcctagg

SEQ ID NO: 9129978 - DNA, 22 bp, Homo sapiens
actcagagcttggctccttgct

SEQ ID NO: 9129979 - DNA, 21 bp, Homo sapiens
agtaacattttgttgtttaca

SEQ ID NO: 9129980 - DNA, 22 bp, Homo sapiens
agtaacatgctaatttgattat

SEQ ID NO: 9129981 - DNA, 22 bp, Homo sapiens
agtaacatatagcacttttgga

SEQ ID NO: 9129982 - DNA, 22 bp, Homo sapiens
agtcagtatgacttatagttct

SEQ ID NO: 9129983 - DNA, 22 bp, Homo sapiens
actggtaaattatgcgactttg

SEQ ID NO: 9129984 - DNA, 22 bp, Homo sapiens
agttcaacaccagcctgaccaa

SEQ ID NO: 9129985 - DNA, 22 bp, Homo sapiens
agaaatggaaatccaagcaact

SEQ ID NO: 9129986 - DNA, 22 bp, Homo sapiens
agaaatgtggatcgttttaaaa

SEQ ID NO: 9129987 - DNA, 20 bp, Homo sapiens
agaagcatcattctgatgtc

SEQ ID NO: 9129988 - DNA, 22 bp, Homo sapiens
agaagcattataacatgcaagg

SEQ ID NO: 9129989 - DNA, 20 bp, Homo sapiens
agaaacatttcttgagaact

SEQ ID NO: 9129990 - DNA, 22 bp, Homo sapiens
agaaatcacttaatgaacgtag

SEQ ID NO: 9129991 - DNA, 22 bp, Homo sapiens
agaaatatgctgattagatgaa

SEQ ID NO: 9129992 - DNA, 22 bp, Homo sapiens
atagaacagaaacagatgcaca

SEQ ID NO: 9129993 - DNA, 22 bp, Homo sapiens
atagaacaaggtagacagcttt

SEQ ID NO: 9129994 - DNA, 22 bp, Homo sapiens
ataaggtaagggtattgtcaga

SEQ ID NO: 9129995 - DNA, 22 bp, Homo sapiens
atttctgtaacttatgaaagtt

SEQ ID NO: 9129996 - DNA, 22 bp, Homo sapiens
atttctggactgaaaaggaagt

SEQ ID NO: 9129997 - DNA, 22 bp, Homo sapiens
gcccccgtagtagatgaggcgc

SEQ ID NO: 9129998 - DNA, 22 bp, Homo sapiens
attttacttcatttgaaatgcc

SEQ ID NO: 9129999 - DNA, 22 bp, Homo sapiens
attgtcagccttcatagatcct

SEQ ID NO: 9130000 - DNA, 22 bp, Homo sapiens
gcatatgatcacgtgtgtcggt

SEQ ID NO: 9130001 - DNA, 22 bp, Homo sapiens
gcatacaaaggtttacaactga

SEQ ID NO: 9130002 - DNA, 22 bp, Homo sapiens
gccacagggcagatgcgcagag

SEQ ID NO: 9130003 - DNA, 22 bp, Homo sapiens
attaggtcatggggaggcccta

SEQ ID NO: 9130004 - DNA, 22 bp, Homo sapiens
attcacatgtgcttcttatcac

SEQ ID NO: 9130005 - DNA, 22 bp, Homo sapiens
atgggaagtgttagaagatttt

SEQ ID NO: 9130006 - DNA, 22 bp, Homo sapiens
gatatatttggaccagagcatt

SEQ ID NO: 9130007 - DNA, 22 bp, Homo sapiens
atgtttaaatttatagacagtg

SEQ ID NO: 9130008 - DNA, 22 bp, Homo sapiens
atgtagaaagttattttactct

SEQ ID NO: 9130009 - DNA, 22 bp, Homo sapiens
atgtagaaattaggatgatagt

SEQ ID NO: 9130010 - DNA, 22 bp, Homo sapiens
atgtagaaataatttcagttcc

SEQ ID NO: 9130011 - DNA, 22 bp, Homo sapiens
atgtagaagtgggcattataga

SEQ ID NO: 9130012 - DNA, 22 bp, Homo sapiens
atgaaattcatctgagaatgct

SEQ ID NO: 9130013 - DNA, 18 bp, Homo sapiens
atgatcttagcaaatatt

SEQ ID NO: 9130014 - DNA, 22 bp, Homo sapiens
gaatcagactacaaatgacccc

SEQ ID NO: 9130015 - DNA, 22 bp, Homo sapiens
gctttgaagacttttccagggt

SEQ ID NO: 9130016 - DNA, 22 bp, Homo sapiens
caaggtaagcgagagatgaggt

SEQ ID NO: 9130017 - DNA, 22 bp, Homo sapiens
cacagaactggttaatagcaga

SEQ ID NO: 9130018 - DNA, 22 bp, Homo sapiens
ggccgccctttccacggtttct

SEQ ID NO: 9130019 - DNA, 22 bp, Homo sapiens
cacagttttgcccagggcttct

SEQ ID NO: 9130020 - DNA, 22 bp, Homo sapiens
cagaaataaacttctcacatcg

SEQ ID NO: 9130021 - DNA, 23 bp, Homo sapiens
cagaaataaactggtttgtagat

SEQ ID NO: 9130022 - DNA, 22 bp, Homo sapiens
cagaaatacccagcatttggag

SEQ ID NO: 9130023 - DNA, 22 bp, Homo sapiens
atattgcctaggtgaatagaat

SEQ ID NO: 9130024 - DNA, 22 bp, Homo sapiens
ctggaatgggagtcagacagag

SEQ ID NO: 9130025 - DNA, 22 bp, Homo sapiens
ctggaatgggaatcaggaaaga

SEQ ID NO: 9130026 - DNA, 22 bp, Homo sapiens
ctggaatgcggagagttggaga

SEQ ID NO: 9130027 - DNA, 22 bp, Homo sapiens
ctggaatgcctccctgtcagag

SEQ ID NO: 9130028 - DNA, 22 bp, Homo sapiens
ctggaatgtagagacagcttag

SEQ ID NO: 9130029 - DNA, 19 bp, Homo sapiens
ctggaatgatagagacctc

SEQ ID NO: 9130030 - DNA, 22 bp, Homo sapiens
ctggaatgaagctatgtacatt

SEQ ID NO: 9130031 - DNA, 19 bp, Homo sapiens
ctggaatgagaacatgccc

SEQ ID NO: 9130032 - DNA, 22 bp, Homo sapiens
atacagtaaccacattctatag

SEQ ID NO: 9130033 - DNA, 22 bp, Homo sapiens
ctggaatgtatgtatcttaaga

SEQ ID NO: 9130034 - DNA, 22 bp, Homo sapiens
ctggaatgtctgctcaatgttt

SEQ ID NO: 9130035 - DNA, 22 bp, Homo sapiens
atacagtataactaataaaccc

SEQ ID NO: 9130036 - DNA, 22 bp, Homo sapiens
ataacattttgacaactggtga

SEQ ID NO: 9130037 - DNA, 22 bp, Homo sapiens
atacaacagaaaatgattattc

SEQ ID NO: 9130038 - DNA, 22 bp, Homo sapiens
ataagaaacattattctttcca

SEQ ID NO: 9130039 - DNA, 23 bp, Homo sapiens
ataagaaaacagtaggctcagag

SEQ ID NO: 9130040 - DNA, 22 bp, Homo sapiens
agtcttagaactacagtgccta

SEQ ID NO: 9130041 - DNA, 22 bp, Homo sapiens
ctgaaatattttaatctcagga

SEQ ID NO: 9130042 - DNA, 22 bp, Homo sapiens
ctgaaatatagatgtgaacagt

SEQ ID NO: 9130043 - DNA, 22 bp, Homo sapiens
agtatttagagacacaagatgg

SEQ ID NO: 9130044 - DNA, 22 bp, Homo sapiens
agtacaacattagagtatctta

SEQ ID NO: 9130045 - DNA, 22 bp, Homo sapiens
agtacaactagaaataggtgta

SEQ ID NO: 9130046 - DNA, 22 bp, Homo sapiens
cctcgacctccccaggctcagg

SEQ ID NO: 9130047 - DNA, 21 bp, Homo sapiens
aggctcagcaggtgtataaag

SEQ ID NO: 9130048 - DNA, 16 bp, Homo sapiens
aggctcagaggctgga

SEQ ID NO: 9130049 - DNA, 22 bp, Homo sapiens
agcttctcagaagagtcctgta

SEQ ID NO: 9130050 - DNA, 22 bp, Homo sapiens
catacagaaaatatattttgat

SEQ ID NO: 9130051 - DNA, 22 bp, Homo sapiens
catacagatggccaggcctcac

SEQ ID NO: 9130052 - DNA, 22 bp, Homo sapiens
cattggtagagtttgttttata

SEQ ID NO: 9130053 - DNA, 22 bp, Homo sapiens
catttctccgccgagatcactg

SEQ ID NO: 9130054 - DNA, 23 bp, Homo sapiens
ccactagcacctgttcaacttct

SEQ ID NO: 9130055 - DNA, 22 bp, Homo sapiens
cattctctgatcttcacatacc

SEQ ID NO: 9130056 - DNA, 22 bp, Homo sapiens
cattctatgaaaactaggcaat

SEQ ID NO: 9130057 - DNA, 22 bp, Homo sapiens
cattctattgtagcaccctgta

SEQ ID NO: 9130058 - DNA, 22 bp, Homo sapiens
tccctctaaactgtaagattct

SEQ ID NO: 9130059 - DNA, 22 bp, Homo sapiens
catttattcatgatctgtagct

SEQ ID NO: 9130060 - DNA, 22 bp, Homo sapiens
tccttcatgatgcttagcagag

SEQ ID NO: 9130061 - DNA, 22 bp, Homo sapiens
catgaaattgctcctttggtgc

SEQ ID NO: 9130062 - DNA, 23 bp, Homo sapiens
cataaaatattagtatggtagca

SEQ ID NO: 9130063 - DNA, 17 bp, Homo sapiens
cataaaacagttctatt

SEQ ID NO: 9130064 - DNA, 22 bp, Homo sapiens
cagttttcttgttatatttggg

SEQ ID NO: 9130065 - DNA, 22 bp, Homo sapiens
catagaaatcaggtgagaatct

SEQ ID NO: 9130066 - DNA, 22 bp, Homo sapiens
catagaaagtattatggaattt

SEQ ID NO: 9130067 - DNA, 22 bp, Homo sapiens
tagatttcaggagacaaaatgg

SEQ ID NO: 9130068 - DNA, 22 bp, Homo sapiens
tagcttctggagtgtttgaaaa

SEQ ID NO: 9130069 - DNA, 22 bp, Homo sapiens
tcaagatgtgatgtaacttttg

SEQ ID NO: 9130070 - DNA, 22 bp, Homo sapiens
taatacagaagtgtattaaaat

SEQ ID NO: 9130071 - DNA, 22 bp, Homo sapiens
taagtcagtagaactgtggtca

SEQ ID NO: 9130072 - DNA, 22 bp, Homo sapiens
taatgtataacaaatactcatc

SEQ ID NO: 9130073 - DNA, 22 bp, Homo sapiens
taatgtcaaggtcattctagag

SEQ ID NO: 9130074 - DNA, 22 bp, Homo sapiens
taatgtcaaggtgatagatttg

SEQ ID NO: 9130075 - DNA, 22 bp, Homo sapiens
taatgtcagcatagtttatttt

SEQ ID NO: 9130076 - DNA, 22 bp, Homo sapiens
taatgtcagtgacctggtttaa

SEQ ID NO: 9130077 - DNA, 22 bp, Homo sapiens
caggctcaagccctgcttatat

SEQ ID NO: 9130078 - DNA, 22 bp, Homo sapiens
caggctaaggaaaggctcaggt

SEQ ID NO: 9130079 - DNA, 22 bp, Homo sapiens
cccagttgttgccggctctgga

SEQ ID NO: 9130080 - DNA, 22 bp, Homo sapiens
tgctgtgggatatatgttcaaa

SEQ ID NO: 9130081 - DNA, 22 bp, Homo sapiens
cctcagtttatcctctgtaaca

SEQ ID NO: 9130082 - DNA, 22 bp, Homo sapiens
cctcagttttctcatctgtaaa

SEQ ID NO: 9130083 - DNA, 22 bp, Homo sapiens
cctcagaggttttcattctgta

SEQ ID NO: 9130084 - DNA, 22 bp, Homo sapiens
tctttcttctttcatagtgtga

SEQ ID NO: 9130085 - DNA, 22 bp, Homo sapiens
tgaatgatacagaattatgtag

SEQ ID NO: 9130086 - DNA, 22 bp, Homo sapiens
tgaatgatctccgattagtcct

SEQ ID NO: 9130087 - DNA, 21 bp, Homo sapiens
tgaatgatctggttgcctttt

SEQ ID NO: 9130088 - DNA, 22 bp, Homo sapiens
tgaatgatttgggtgcattcag

SEQ ID NO: 9130089 - DNA, 22 bp, Homo sapiens
tgaatgatgtataatattgaga

SEQ ID NO: 9130090 - DNA, 22 bp, Homo sapiens
tgcaaatagcctatatttatag

SEQ ID NO: 9130091 - DNA, 22 bp, Homo sapiens
tgcaaataaatttctgttcatt

SEQ ID NO: 9130092 - DNA, 22 bp, Homo sapiens
ccattgtaaattctgtggaagt

SEQ ID NO: 9130093 - DNA, 22 bp, Homo sapiens
ttgaaatagatgcgtcagagat

SEQ ID NO: 9130094 - DNA, 22 bp, Homo sapiens
ttgaaatactgcattgttcagt

SEQ ID NO: 9130095 - DNA, 22 bp, Homo sapiens
ctcatttatgtaatgattaagg

SEQ ID NO: 9130096 - DNA, 22 bp, Homo sapiens
ctcatttatttctcccaaaaca

SEQ ID NO: 9130097 - DNA, 22 bp, Homo sapiens
ctcatttactcatctgcaaaac

SEQ ID NO: 9130098 - DNA, 22 bp, Homo sapiens
ctcatttactactcatgtgacc

SEQ ID NO: 9130099 - DNA, 22 bp, Homo sapiens
ctcatttactgtagaacagtta

SEQ ID NO: 9130100 - DNA, 22 bp, Homo sapiens
ctcatttagggggcatggtaca

SEQ ID NO: 9130101 - DNA, 22 bp, Homo sapiens
ctcatttatccaaaagccagtt

SEQ ID NO: 9130102 - DNA, 22 bp, Homo sapiens
ctcatttaacagattaaaaagt

SEQ ID NO: 9130103 - DNA, 22 bp, Homo sapiens
ctcatttacactatgggaacta

SEQ ID NO: 9130104 - DNA, 22 bp, Homo sapiens
ctcatttacctttgcaatcaag

SEQ ID NO: 9130105 - DNA, 22 bp, Homo sapiens
ctgaatatcatttacatttgga

SEQ ID NO: 9130106 - DNA, 22 bp, Homo sapiens
ctgaatattagtcatgtctgat

SEQ ID NO: 9130107 - DNA, 22 bp, Homo sapiens
ctgaatatcatttatcattggc

SEQ ID NO: 9130108 - DNA, 22 bp, Homo sapiens
ttttcagttatagaatggtaga

SEQ ID NO: 9130109 - DNA, 22 bp, Homo sapiens
ttttcaggccagaagatagacc

SEQ ID NO: 9130110 - DNA, 22 bp, Homo sapiens
ttttcaggtgcagtaatcatat

SEQ ID NO: 9130111 - DNA, 22 bp, Homo sapiens
ttttaagttaatataattgagg

SEQ ID NO: 9130112 - DNA, 21 bp, Homo sapiens
ttacttttgcagcaacctaat

SEQ ID NO: 9130113 - DNA, 21 bp, Homo sapiens
ttacttttgcaccaacctaat

SEQ ID NO: 9130114 - DNA, 22 bp, Homo sapiens
tgtttagacagaatgagttctt

SEQ ID NO: 9130115 - DNA, 22 bp, Homo sapiens
cgccgcctgctgcagcagctgt

SEQ ID NO: 9130116 - DNA, 22 bp, Homo sapiens
ttcatgaatgttccatgtgagt

SEQ ID NO: 9130117 - DNA, 22 bp, Homo sapiens
ttcatgaacgaacatatgtata

SEQ ID NO: 9130118 - DNA, 22 bp, Homo sapiens
ttcatgaagggtgaatatagtc

SEQ ID NO: 9130119 - DNA, 22 bp, Homo sapiens
ctacaacatagtcttctacaga

SEQ ID NO: 9130120 - DNA, 22 bp, Homo sapiens
gaagatgggaatgatgagtggg

SEQ ID NO: 9130121 - DNA, 22 bp, Homo sapiens
gaaatatttctcttgagcccct

SEQ ID NO: 9130122 - DNA, 22 bp, Homo sapiens
ctttcagtctttacaaggttgc

SEQ ID NO: 9130123 - DNA, 18 bp, Homo sapiens
ctttcagtaatttcagcc

SEQ ID NO: 9130124 - DNA, 22 bp, Homo sapiens
gaaatggtagagtaggaagatt

SEQ ID NO: 9130125 - DNA, 23 bp, Homo sapiens
gaatacagagataaatagaacac

SEQ ID NO: 9130126 - DNA, 22 bp, Homo sapiens
gaatacatgatacatgaactgc

SEQ ID NO: 9130127 - DNA, 22 bp, Homo sapiens
gaatacatatcagatgtgtttc

SEQ ID NO: 9130128 - DNA, 22 bp, Homo sapiens
gacctcatgatccacctgcctt

SEQ ID NO: 9130129 - DNA, 22 bp, Homo sapiens
cttatttgcccatgtttcttta

SEQ ID NO: 9130130 - DNA, 22 bp, Homo sapiens
gtagaaattccatttactttga

SEQ ID NO: 9130131 - DNA, 17 bp, Homo sapiens
gtattctttgccttcca

SEQ ID NO: 9130132 - DNA, 22 bp, Homo sapiens
gtgaactgctgagttttatcat

SEQ ID NO: 9130133 - DNA, 22 bp, Homo sapiens
gtgaaatattttgtttatgtca

SEQ ID NO: 9130134 - DNA, 22 bp, Homo sapiens
ggctgagaaggagtgggtgagg

SEQ ID NO: 9130135 - DNA, 22 bp, Homo sapiens
gggaccagaggctgtgcacaat

SEQ ID NO: 9130136 - DNA, 22 bp, Homo sapiens
gggaccagaagaaggatggtga

SEQ ID NO: 9130137 - DNA, 17 bp, Homo sapiens
ggaccaggggttgccat

SEQ ID NO: 9130138 - DNA, 22 bp, Homo sapiens
ggaccaggagctcagagccctc

SEQ ID NO: 9130139 - DNA, 22 bp, Homo sapiens
ggaatgatggtgcctagattat

SEQ ID NO: 9130140 - DNA, 22 bp, Homo sapiens
gctcagagtggcctggctaggg

SEQ ID NO: 9130141 - DNA, 21 bp, Homo sapiens
gctcagagtattgcactgttt

SEQ ID NO: 9130142 - DNA, 17 bp, Homo sapiens
gctcagagtacacgtgt

SEQ ID NO: 9130143 - DNA, 22 bp, Homo sapiens
gccaccaggttagatccagcct

SEQ ID NO: 9130144 - DNA, 22 bp, Homo sapiens
gccaccagggggtgcaaggtcc

SEQ ID NO: 9130145 - DNA, 22 bp, Homo sapiens
gccaccagcagaaaaggggcca

SEQ ID NO: 9130146 - DNA, 22 bp, Homo sapiens
gccaccagccccatgcgctgtg

SEQ ID NO: 9130147 - DNA, 22 bp, Homo sapiens
gccaccagggggctccagtgag

SEQ ID NO: 9130148 - DNA, 22 bp, Homo sapiens
gccaccaggagcccagtccaaa

SEQ ID NO: 9130149 - DNA, 22 bp, Homo sapiens
gccacaggcttaggagggaggt

SEQ ID NO: 9130150 - DNA, 22 bp, Homo sapiens
gccaccagtgggggcctgggca

SEQ ID NO: 9130151 - DNA, 22 bp, Homo sapiens
gcctccggagtcacagtgtctt

SEQ ID NO: 9130152 - DNA, 22 bp, Homo sapiens
gcctccggagtcacagtgtctt

SEQ ID NO: 9130153 - DNA, 22 bp, Homo sapiens
gcctccggagttgcagtgtctt

SEQ ID NO: 9130154 - DNA, 22 bp, Homo sapiens
gcctccggagttgcagtgtctt

SEQ ID NO: 9130155 - DNA, 22 bp, Homo sapiens
taaaatgatctctcatgttctt

SEQ ID NO: 9130156 - DNA, 22 bp, Homo sapiens
taaaatgatctctcatgttctt

SEQ ID NO: 9130157 - DNA, 22 bp, Homo sapiens
gtttttatctaatagcagttat

SEQ ID NO: 9130158 - DNA, 22 bp, Homo sapiens
taactgaagctggaagcgctgg

SEQ ID NO: 9130159 - DNA, 19 bp, Homo sapiens
taaggtttaccagcaaaat

SEQ ID NO: 9130160 - DNA, 22 bp, Homo sapiens
tacagcaatgctacaagatgac

SEQ ID NO: 9130161 - DNA, 22 bp, Homo sapiens
tacagaaaaactggcattgaag

SEQ ID NO: 9130162 - DNA, 22 bp, Homo sapiens
tacattctggtggagaaagtaa

SEQ ID NO: 9130163 - DNA, 22 bp, Homo sapiens
tagaaatgattttgatgcttca

SEQ ID NO: 9130164 - DNA, 22 bp, Homo sapiens
tagaaatgcagtgtactgtgtc

SEQ ID NO: 9130165 - DNA, 22 bp, Homo sapiens
tagaaatgagccatggtagagc

SEQ ID NO: 9130166 - DNA, 22 bp, Homo sapiens
tagacacatcaagtatagttaa

SEQ ID NO: 9130167 - DNA, 22 bp, Homo sapiens
tagaatttcatgtatgttgggg

SEQ ID NO: 9130168 - DNA, 22 bp, Homo sapiens
tagaaacacagatctggtgtca

SEQ ID NO: 9130169 - DNA, 22 bp, Homo sapiens
tagaaacatataggatggcagg

SEQ ID NO: 9130170 - DNA, 22 bp, Homo sapiens
tagaaacagagcaggtggccca

SEQ ID NO: 9130171 - DNA, 22 bp, Homo sapiens
tacttttatgtgatgaaatctg

SEQ ID NO: 9130172 - DNA, 22 bp, Homo sapiens
tatgagataatagatgtgtaaa

SEQ ID NO: 9130173 - DNA, 22 bp, Homo sapiens
tatatattcttaagtagtgtag

SEQ ID NO: 9130174 - DNA, 22 bp, Homo sapiens
tatacagaacattaagaactgt

SEQ ID NO: 9130175 - DNA, 22 bp, Homo sapiens
tatacagaaagaattcaagtct

SEQ ID NO: 9130176 - DNA, 22 bp, Homo sapiens
tcattgatggcttctttcttgc

SEQ ID NO: 9130177 - DNA, 22 bp, Homo sapiens
tatttcttcgggattcaagcta

SEQ ID NO: 9130178 - DNA, 22 bp, Homo sapiens
tatttctgtcagccagatatgg

SEQ ID NO: 9130179 - DNA, 22 bp, Homo sapiens
tcaatttatgtggctattcatt

SEQ ID NO: 9130180 - DNA, 22 bp, Homo sapiens
tcattataaacatatgctaaag

SEQ ID NO: 9130181 - DNA, 21 bp, Homo sapiens
tcatatttctcttgctattgt

SEQ ID NO: 9130182 - DNA, 22 bp, Homo sapiens
tcatatttaggcctttaattca

SEQ ID NO: 9130183 - DNA, 22 bp, Homo sapiens
tcagcactttgaagcagaagga

SEQ ID NO: 9130184 - DNA, 22 bp, Homo sapiens
ttcacattagtggttctatata

SEQ ID NO: 9130185 - DNA, 22 bp, Homo sapiens
ttcatgttcatgcttaggaaaa

SEQ ID NO: 9130186 - DNA, 22 bp, Homo sapiens
ttcatggtattggagtatgagg

SEQ ID NO: 9130187 - DNA, 22 bp, Homo sapiens
ttctagcactgcctggaagaca

SEQ ID NO: 9130188 - DNA, 22 bp, Homo sapiens
ttgattctttgagaccgtgata

SEQ ID NO: 9130189 - DNA, 22 bp, Homo sapiens
ttgcaaataaacaagtatacat

SEQ ID NO: 9130190 - DNA, 22 bp, Homo sapiens
ttgaattatatgtatgtccttt

SEQ ID NO: 9130191 - DNA, 22 bp, Homo sapiens
ttgaattagactttgctacagg

SEQ ID NO: 9130192 - DNA, 22 bp, Homo sapiens
ttctttctcaacatgaatgttt

SEQ ID NO: 9130193 - DNA, 22 bp, Homo sapiens
ttctttatcagttactcatagg

SEQ ID NO: 9130194 - DNA, 22 bp, Homo sapiens
ttctggtagcctcaaatttgag

SEQ ID NO: 9130195 - DNA, 22 bp, Homo sapiens
ttctggtatgggaaatttcaag

SEQ ID NO: 9130196 - DNA, 22 bp, Homo sapiens
ttctgcttggttcttggtatga

SEQ ID NO: 9130197 - DNA, 22 bp, Homo sapiens
ttaagtgtgtattatctcatta

SEQ ID NO: 9130198 - DNA, 22 bp, Homo sapiens
ttaacatttgtgaagcatttag

SEQ ID NO: 9130199 - DNA, 22 bp, Homo sapiens
ttagagctagatgaggtcatga

SEQ ID NO: 9130200 - DNA, 22 bp, Homo sapiens
tttgttgtgataatggtctgca

SEQ ID NO: 9130201 - DNA, 22 bp, Homo sapiens
ttttatagctgaatagtattcc

SEQ ID NO: 9130202 - DNA, 22 bp, Homo sapiens
ttttatctgcttcattagttga

SEQ ID NO: 9130203 - DNA, 22 bp, Homo sapiens
ttgttttcctgggataccaacc

SEQ ID NO: 9130204 - DNA, 22 bp, Homo sapiens
ttgttttggagatgagctaaaa

SEQ ID NO: 9130205 - DNA, 22 bp, Homo sapiens
tttataacatttcttacctgtg

SEQ ID NO: 9130206 - DNA, 22 bp, Homo sapiens
tttatagatgtctgtattataa

SEQ ID NO: 9130207 - DNA, 22 bp, Homo sapiens
tttagaaattcatctatggcct

SEQ ID NO: 9130208 - DNA, 22 bp, Homo sapiens
tttactcttgctacacaactgt

SEQ ID NO: 9130209 - DNA, 22 bp, Homo sapiens
tttaaaatttagacctctccac

SEQ ID NO: 9130210 - DNA, 22 bp, Homo sapiens
tttaaaatcagatgggagttgg

SEQ ID NO: 9130211 - DNA, 22 bp, Homo sapiens
tttcttatggggtagtccttta

SEQ ID NO: 9130212 - DNA, 22 bp, Homo sapiens
tttctgtagtgtggtatgtagg

SEQ ID NO: 9130213 - DNA, 22 bp, Homo sapiens
tttctctttcaatctgcagtac

SEQ ID NO: 9130214 - DNA, 22 bp, Homo sapiens
tttcagtgcacgtagtttattt

SEQ ID NO: 9130215 - DNA, 22 bp, Homo sapiens
tttcagtggagtgacatgatct

SEQ ID NO: 9130216 - DNA, 22 bp, Homo sapiens
ccactattactgtgtggcagtc

SEQ ID NO: 9130217 - DNA, 22 bp, Homo sapiens
ccactcagaccaacgacccttc

SEQ ID NO: 9130218 - DNA, 22 bp, Homo sapiens
ccactcagaccaacgacccttc

SEQ ID NO: 9130219 - DNA, 21 bp, Homo sapiens
ccactcatgactccactcacc

SEQ ID NO: 9130220 - DNA, 22 bp, Homo sapiens
ccactcagttgctctctgtttt

SEQ ID NO: 9130221 - DNA, 22 bp, Homo sapiens
ccactcaggcctcctgctctcc

SEQ ID NO: 9130222 - DNA, 22 bp, Homo sapiens
ccacggccacccgctcatgggc

SEQ ID NO: 9130223 - DNA, 22 bp, Homo sapiens
ccacgggcagatgtggttggtt

SEQ ID NO: 9130224 - DNA, 23 bp, Homo sapiens
ccacgtctgcactgtagctgttg

SEQ ID NO: 9130225 - DNA, 22 bp, Homo sapiens
ccacgtgtaggtggacaggatc

SEQ ID NO: 9130226 - DNA, 22 bp, Homo sapiens
ccactactttgtttttggtgct

SEQ ID NO: 9130227 - DNA, 19 bp, Homo sapiens
ccacgaggttagcagccac

SEQ ID NO: 9130228 - DNA, 22 bp, Homo sapiens
ccacgcatccctccacagagag

SEQ ID NO: 9130229 - DNA, 22 bp, Homo sapiens
ccacctggggctgtggcccctt

SEQ ID NO: 9130230 - DNA, 22 bp, Homo sapiens
ccaccttgggactgctcacccc

SEQ ID NO: 9130231 - DNA, 22 bp, Homo sapiens
ccacgacgagtcatcagggcga

SEQ ID NO: 9130232 - DNA, 22 bp, Homo sapiens
ccacccagccagatgcaggaag

SEQ ID NO: 9130233 - DNA, 22 bp, Homo sapiens
ccacccagcagaggaggcaaga

SEQ ID NO: 9130234 - DNA, 20 bp, Homo sapiens
ccacccacgcgggctctgcc

SEQ ID NO: 9130235 - DNA, 22 bp, Homo sapiens
ccaccattcaaggtcttcacag

SEQ ID NO: 9130236 - DNA, 22 bp, Homo sapiens
ccaccattcaaggtcttcacag

SEQ ID NO: 9130237 - DNA, 22 bp, Homo sapiens
ccaccattatatctcccatgcc

SEQ ID NO: 9130238 - DNA, 22 bp, Homo sapiens
ccaccattatatctcccatgcc

SEQ ID NO: 9130239 - DNA, 22 bp, Homo sapiens
ccaccatgggaagagagactaa

SEQ ID NO: 9130240 - DNA, 19 bp, Homo sapiens
ccaccagtgtgatctaaga

SEQ ID NO: 9130241 - DNA, 21 bp, Homo sapiens
ccaccaggtcttctgctcggg

SEQ ID NO: 9130242 - DNA, 22 bp, Homo sapiens
ccaccaggctctgtccgagcgg

SEQ ID NO: 9130243 - DNA, 21 bp, Homo sapiens
ccaccaggtcttctgctcggg

SEQ ID NO: 9130244 - DNA, 22 bp, Homo sapiens
ccacatcatggatacagttatg

SEQ ID NO: 9130245 - DNA, 22 bp, Homo sapiens
ccacatacaaatggggtgctgt

SEQ ID NO: 9130246 - DNA, 22 bp, Homo sapiens
ccacagtggttgtggcatgtgg

SEQ ID NO: 9130247 - DNA, 23 bp, Homo sapiens
ccacagttcatcgttcactcacc

SEQ ID NO: 9130248 - DNA, 22 bp, Homo sapiens
ccacagttcatgcactggggct

SEQ ID NO: 9130249 - DNA, 22 bp, Homo sapiens
ccacagttattcatttgtgaca

SEQ ID NO: 9130250 - DNA, 19 bp, Homo sapiens
ccacagagcatgctgaggc

SEQ ID NO: 9130251 - DNA, 22 bp, Homo sapiens
ccacagagacagggtccttgct

SEQ ID NO: 9130252 - DNA, 22 bp, Homo sapiens
ccacagagagtgtcagcctttg

SEQ ID NO: 9130253 - DNA, 22 bp, Homo sapiens
ccacagaattctgtctccagga

SEQ ID NO: 9130254 - DNA, 22 bp, Homo sapiens
ccacagaattctgtctccagga

SEQ ID NO: 9130255 - DNA, 22 bp, Homo sapiens
ccacagaccttggcttccacct

SEQ ID NO: 9130256 - DNA, 22 bp, Homo sapiens
catttctgggagacatgctaga

SEQ ID NO: 9130257 - DNA, 22 bp, Homo sapiens
catttgaaacctggaatctacc

SEQ ID NO: 9130258 - DNA, 22 bp, Homo sapiens
catttctcataatattagcact

SEQ ID NO: 9130259 - DNA, 22 bp, Homo sapiens
catttctcctgggtgataaatt

SEQ ID NO: 9130260 - DNA, 22 bp, Homo sapiens
catttcacaaatggccacatca

SEQ ID NO: 9130261 - DNA, 22 bp, Homo sapiens
catttcacaaatggccacatca

SEQ ID NO: 9130262 - DNA, 22 bp, Homo sapiens
catttctcataatattagcact

SEQ ID NO: 9130263 - DNA, 22 bp, Homo sapiens
catttctcataatattagcact

SEQ ID NO: 9130264 - DNA, 22 bp, Homo sapiens
catttcaatgccttcaacatag

SEQ ID NO: 9130265 - DNA, 22 bp, Homo sapiens
catttcaagtaacagattgctt

SEQ ID NO: 9130266 - DNA, 22 bp, Homo sapiens
catttcaagcattgacttctat

SEQ ID NO: 9130267 - DNA, 22 bp, Homo sapiens
catttattggcatgtagtaggt

SEQ ID NO: 9130268 - DNA, 22 bp, Homo sapiens
catttattggttaggccagcag

SEQ ID NO: 9130269 - DNA, 19 bp, Homo sapiens
cattggtctatatgtctat

SEQ ID NO: 9130270 - DNA, 22 bp, Homo sapiens
cattggtcttctaacagagaga

SEQ ID NO: 9130271 - DNA, 22 bp, Homo sapiens
cattgtaagaggctttgcagca

SEQ ID NO: 9130272 - DNA, 20 bp, Homo sapiens
cattggcattcacagaagct

SEQ ID NO: 9130273 - DNA, 22 bp, Homo sapiens
aggcactgtgggtgtggccgga

SEQ ID NO: 9130274 - DNA, 22 bp, Homo sapiens
cattgtaagctgttgaatcctc

SEQ ID NO: 9130275 - DNA, 20 bp, Homo sapiens
cattggagtggagaggaaat

SEQ ID NO: 9130276 - DNA, 22 bp, Homo sapiens
aggcacttgaattgatgatgtt

SEQ ID NO: 9130277 - DNA, 22 bp, Homo sapiens
aggcacttaataaggattcaat

SEQ ID NO: 9130278 - DNA, 22 bp, Homo sapiens
aggcacttctcaaattcatgcc

SEQ ID NO: 9130279 - DNA, 22 bp, Homo sapiens
aggcacttcatgggttcaagga

SEQ ID NO: 9130280 - DNA, 22 bp, Homo sapiens
catttattggcatgtagtaggt

SEQ ID NO: 9130281 - DNA, 22 bp, Homo sapiens
catttacctttaattaaaacac

SEQ ID NO: 9130282 - DNA, 22 bp, Homo sapiens
catttactgtaaaagattctct

SEQ ID NO: 9130283 - DNA, 22 bp, Homo sapiens
aggcacttggaggtctctgccc

SEQ ID NO: 9130284 - DNA, 22 bp, Homo sapiens
aggcacttggaggtctctgccc

SEQ ID NO: 9130285 - DNA, 22 bp, Homo sapiens
aggcacttggagttctttgccc

SEQ ID NO: 9130286 - DNA, 22 bp, Homo sapiens
aggcacttgtaattgcagtcat

SEQ ID NO: 9130287 - DNA, 22 bp, Homo sapiens
aggcacttgtgactgtctgcat

SEQ ID NO: 9130288 - DNA, 22 bp, Homo sapiens
aggcacttgtgactgtctgcat

SEQ ID NO: 9130289 - DNA, 22 bp, Homo sapiens
aggcaagggggcgccaccttcc

SEQ ID NO: 9130290 - DNA, 23 bp, Homo sapiens
aggcaagggtgtaaaggaaatga

SEQ ID NO: 9130291 - DNA, 20 bp, Homo sapiens
aggcaaggtagatgtctgct

SEQ ID NO: 9130292 - DNA, 22 bp, Homo sapiens
aggcaagccgtgcctgtctcaa

SEQ ID NO: 9130293 - DNA, 22 bp, Homo sapiens
aggcaagattaggaccagaaga

SEQ ID NO: 9130294 - DNA, 22 bp, Homo sapiens
aggcaactcatcatgaaagact

SEQ ID NO: 9130295 - DNA, 17 bp, Homo sapiens
aggcaactagttccctc

SEQ ID NO: 9130296 - DNA, 22 bp, Homo sapiens
aggcaagaaactttctgggaga

SEQ ID NO: 9130297 - DNA, 22 bp, Homo sapiens
aggcaagaacagacatgggagt

SEQ ID NO: 9130298 - DNA, 22 bp, Homo sapiens
aggcaagaacagacatgggagt

SEQ ID NO: 9130299 - DNA, 22 bp, Homo sapiens
aggcaagaccagaaagggctga

SEQ ID NO: 9130300 - DNA, 22 bp, Homo sapiens
aggcaatcagtgtagagtaaca

SEQ ID NO: 9130301 - DNA, 22 bp, Homo sapiens
aggcaatcccctgaggatactt

SEQ ID NO: 9130302 - DNA, 22 bp, Homo sapiens
cattccttaacgtggggagtct

SEQ ID NO: 9130303 - DNA, 22 bp, Homo sapiens
aggcaaggtgctacagacagtg

SEQ ID NO: 9130304 - DNA, 22 bp, Homo sapiens
aggcaaggtgctacagacagtg

SEQ ID NO: 9130305 - DNA, 22 bp, Homo sapiens
aggcaaggtgctacagacagtg

SEQ ID NO: 9130306 - DNA, 22 bp, Homo sapiens
cattgcttcctatgtcccttct

SEQ ID NO: 9130307 - DNA, 22 bp, Homo sapiens
cattgctgttatgcataattcc

SEQ ID NO: 9130308 - DNA, 22 bp, Homo sapiens
cattgctgttaattgtctctag

SEQ ID NO: 9130309 - DNA, 22 bp, Homo sapiens
cattgctgcttccaggcacagg

SEQ ID NO: 9130310 - DNA, 22 bp, Homo sapiens
cattgctgtgggcatttgctgc

SEQ ID NO: 9130311 - DNA, 22 bp, Homo sapiens
cattgctgccactggatatttc

SEQ ID NO: 9130312 - DNA, 19 bp, Homo sapiens
cattcctttgtctgccaaa

SEQ ID NO: 9130313 - DNA, 20 bp, Homo sapiens
catacactattctgtatagt

SEQ ID NO: 9130314 - DNA, 22 bp, Homo sapiens
catacaaatgtgtccaggctct

SEQ ID NO: 9130315 - DNA, 22 bp, Homo sapiens
aggaggcctgcagctgccattc

SEQ ID NO: 9130316 - DNA, 22 bp, Homo sapiens
aggaggctctcaggtcctcccc

SEQ ID NO: 9130317 - DNA, 22 bp, Homo sapiens
aggaggctctcaggtcctcccc

SEQ ID NO: 9130318 - DNA, 22 bp, Homo sapiens
aggaggcctgttttctcctgga

SEQ ID NO: 9130319 - DNA, 22 bp, Homo sapiens
aggaggctctcaggtcctcccc

SEQ ID NO: 9130320 - DNA, 22 bp, Homo sapiens
aggaggctgaactagggtctgg

SEQ ID NO: 9130321 - DNA, 22 bp, Homo sapiens
aggaggctgaactagggtctgg

SEQ ID NO: 9130322 - DNA, 19 bp, Homo sapiens
catctcccacagccacaca

SEQ ID NO: 9130323 - DNA, 22 bp, Homo sapiens
catctcctggcagctgttagga

SEQ ID NO: 9130324 - DNA, 22 bp, Homo sapiens
catctcagtgtacagggagtct

SEQ ID NO: 9130325 - DNA, 19 bp, Homo sapiens
catctctgcaaggagctgc

SEQ ID NO: 9130326 - DNA, 22 bp, Homo sapiens
catcttcaggggctacatctgt

SEQ ID NO: 9130327 - DNA, 22 bp, Homo sapiens
catcttcaggggctacatctgt

SEQ ID NO: 9130328 - DNA, 21 bp, Homo sapiens
catcttaggttgtacatatat

SEQ ID NO: 9130329 - DNA, 23 bp, Homo sapiens
aggatgtaggatgtatggcagag

SEQ ID NO: 9130330 - DNA, 23 bp, Homo sapiens
aggatgtaggatgtatggcagag

SEQ ID NO: 9130331 - DNA, 22 bp, Homo sapiens
catgagagatccttcatgagag

SEQ ID NO: 9130332 - DNA, 22 bp, Homo sapiens
aggatgtgccaccagctttgca

SEQ ID NO: 9130333 - DNA, 22 bp, Homo sapiens
catgaggatccaggtgacaggc

SEQ ID NO: 9130334 - DNA, 22 bp, Homo sapiens
catgagcattttggtctagttt

SEQ ID NO: 9130335 - DNA, 19 bp, Homo sapiens
catgagctgctcacttccc

SEQ ID NO: 9130336 - DNA, 22 bp, Homo sapiens
catgagatttgggaggggccag

SEQ ID NO: 9130337 - DNA, 22 bp, Homo sapiens
catgagataatttttctccagt

SEQ ID NO: 9130338 - DNA, 22 bp, Homo sapiens
catgagcataaatcagtcacga

SEQ ID NO: 9130339 - DNA, 22 bp, Homo sapiens
aggatttgaacctgcatccagt

SEQ ID NO: 9130340 - DNA, 20 bp, Homo sapiens
aggatttgagaaggcgtctt

SEQ ID NO: 9130341 - DNA, 22 bp, Homo sapiens
aggatttggccatggcttcggg

SEQ ID NO: 9130342 - DNA, 22 bp, Homo sapiens
aggatttgcactggtgtttgag

SEQ ID NO: 9130343 - DNA, 22 bp, Homo sapiens
aggatttgtatagctttctttt

SEQ ID NO: 9130344 - DNA, 22 bp, Homo sapiens
aggatttggggaagaaaacact

SEQ ID NO: 9130345 - DNA, 22 bp, Homo sapiens
aggatttgtggctctgagtctg

SEQ ID NO: 9130346 - DNA, 22 bp, Homo sapiens
aggatttgttgagttttagtgg

SEQ ID NO: 9130347 - DNA, 22 bp, Homo sapiens
aggatttgtttataggtcttaa

SEQ ID NO: 9130348 - DNA, 22 bp, Homo sapiens
aggatttgaacctaggcaatca

SEQ ID NO: 9130349 - DNA, 22 bp, Homo sapiens
aggatgagagatacatggagca

SEQ ID NO: 9130350 - DNA, 22 bp, Homo sapiens
aggatgggtcagctagagtcca

SEQ ID NO: 9130351 - DNA, 23 bp, Homo sapiens
aggatgggtggcaatagaaagac

SEQ ID NO: 9130352 - DNA, 22 bp, Homo sapiens
aggatggggtctgcagcctggt

SEQ ID NO: 9130353 - DNA, 22 bp, Homo sapiens
catcttgatgctttgacaggtt

SEQ ID NO: 9130354 - DNA, 22 bp, Homo sapiens
catcttgatgctttgacaggtt

SEQ ID NO: 9130355 - DNA, 22 bp, Homo sapiens
catcttctgggacttctcagtt

SEQ ID NO: 9130356 - DNA, 22 bp, Homo sapiens
catcttcataaaggaactgcat

SEQ ID NO: 9130357 - DNA, 22 bp, Homo sapiens
catcttcagtgattacctaaaa

SEQ ID NO: 9130358 - DNA, 22 bp, Homo sapiens
catcttcaggttcatggtcata

SEQ ID NO: 9130359 - DNA, 16 bp, Homo sapiens
aggagctgggtaggag

SEQ ID NO: 9130360 - DNA, 16 bp, Homo sapiens
aggagctgggtaggag

SEQ ID NO: 9130361 - DNA, 16 bp, Homo sapiens
aggagctgggtaggag

SEQ ID NO: 9130362 - DNA, 22 bp, Homo sapiens
aggagctggtagtctcattggg

SEQ ID NO: 9130363 - DNA, 22 bp, Homo sapiens
aggagctgggttcctttggtgg

SEQ ID NO: 9130364 - DNA, 22 bp, Homo sapiens
aggagctgtcagagtgccagag

SEQ ID NO: 9130365 - DNA, 22 bp, Homo sapiens
aggagctgtcagagtgccagag

SEQ ID NO: 9130366 - DNA, 22 bp, Homo sapiens
aggagctgtcagagtgccagag

SEQ ID NO: 9130367 - DNA, 22 bp, Homo sapiens
aggagctgtcatttgattcaca

SEQ ID NO: 9130368 - DNA, 22 bp, Homo sapiens
aggagctgtcatttgattcaca

SEQ ID NO: 9130369 - DNA, 22 bp, Homo sapiens
aggagctgtcatttgattcaca

SEQ ID NO: 9130370 - DNA, 22 bp, Homo sapiens
aggagctgtgaatgggaggggt

SEQ ID NO: 9130371 - DNA, 22 bp, Homo sapiens
aggagctgtcatttgattcaca

SEQ ID NO: 9130372 - DNA, 22 bp, Homo sapiens
aggagctgtgaatgggaggggt

SEQ ID NO: 9130373 - DNA, 22 bp, Homo sapiens
aggaggcctctatccagagaga

SEQ ID NO: 9130374 - DNA, 22 bp, Homo sapiens
aggaggccgggattctggagat

SEQ ID NO: 9130375 - DNA, 22 bp, Homo sapiens
cataacattaagcctctatttc

SEQ ID NO: 9130376 - DNA, 22 bp, Homo sapiens
cagttttattggttgaaatctg

SEQ ID NO: 9130377 - DNA, 22 bp, Homo sapiens
aggagccagttccaccccagga

SEQ ID NO: 9130378 - DNA, 22 bp, Homo sapiens
aggagccatccccatgagaggt

SEQ ID NO: 9130379 - DNA, 22 bp, Homo sapiens
cataactttaaagacagtgtgg

SEQ ID NO: 9130380 - DNA, 22 bp, Homo sapiens
cataagaaatttaacagaactt

SEQ ID NO: 9130381 - DNA, 22 bp, Homo sapiens
cataagaaatttaacagaactt

SEQ ID NO: 9130382 - DNA, 22 bp, Homo sapiens
cataagaaataatgatgatgac

SEQ ID NO: 9130383 - DNA, 22 bp, Homo sapiens
cataactggggacacttctcta

SEQ ID NO: 9130384 - DNA, 22 bp, Homo sapiens
cataactgttaagataattttt

SEQ ID NO: 9130385 - DNA, 22 bp, Homo sapiens
cataagaatatttagtggcagc

SEQ ID NO: 9130386 - DNA, 22 bp, Homo sapiens
cataagaatcttccagggcatg

SEQ ID NO: 9130387 - DNA, 17 bp, Homo sapiens
aggagctgggggtggtg

SEQ ID NO: 9130388 - DNA, 17 bp, Homo sapiens
aggagctgggggtggtg

SEQ ID NO: 9130389 - DNA, 22 bp, Homo sapiens
cataatatactacattgatgaa

SEQ ID NO: 9130390 - DNA, 22 bp, Homo sapiens
cataatatactacattgatgaa

SEQ ID NO: 9130391 - DNA, 22 bp, Homo sapiens
cagtgtggcttagggaataggc

SEQ ID NO: 9130392 - DNA, 22 bp, Homo sapiens
cagtgtgggtttgggaggagta

SEQ ID NO: 9130393 - DNA, 22 bp, Homo sapiens
cagtgtgctatctggaagtctc

SEQ ID NO: 9130394 - DNA, 22 bp, Homo sapiens
cagtgtgctatctggaagtctc

SEQ ID NO: 9130395 - DNA, 22 bp, Homo sapiens
cagtccaggcctggaggagcca

SEQ ID NO: 9130396 - DNA, 22 bp, Homo sapiens
cagtccaggcctggaggagcca

SEQ ID NO: 9130397 - DNA, 22 bp, Homo sapiens
cagtccagctcatcagtggcac

SEQ ID NO: 9130398 - DNA, 22 bp, Homo sapiens
cagtccaggcctggaggagcca

SEQ ID NO: 9130399 - DNA, 22 bp, Homo sapiens
aggagccacctaggagctgttt

SEQ ID NO: 9130400 - DNA, 22 bp, Homo sapiens
aggagccacctaggagctgttt

SEQ ID NO: 9130401 - DNA, 22 bp, Homo sapiens
cagtgtgtggatcctcccagga

SEQ ID NO: 9130402 - DNA, 22 bp, Homo sapiens
cagtgtgtggattgcccttgca

SEQ ID NO: 9130403 - DNA, 22 bp, Homo sapiens
cagtgtggtgtgcacagcttag

SEQ ID NO: 9130404 - DNA, 22 bp, Homo sapiens
cagtgtgtggatcctcccagga

SEQ ID NO: 9130405 - DNA, 22 bp, Homo sapiens
aggagccagcgttcctcaggat

SEQ ID NO: 9130406 - DNA, 22 bp, Homo sapiens
aggagccagcgttcctcaggat

SEQ ID NO: 9130407 - DNA, 22 bp, Homo sapiens
aggagccagaatccagactcgg

SEQ ID NO: 9130408 - DNA, 22 bp, Homo sapiens
aggagccagattctctcacttt

SEQ ID NO: 9130409 - DNA, 22 bp, Homo sapiens
aggagccaggaaacctgctctg

SEQ ID NO: 9130410 - DNA, 22 bp, Homo sapiens
aggagccaggccccatggggct

SEQ ID NO: 9130411 - DNA, 22 bp, Homo sapiens
agcttctcagaagagtcctgta

SEQ ID NO: 9130412 - DNA, 22 bp, Homo sapiens
agcttccttggcgctgaggcct

SEQ ID NO: 9130413 - DNA, 22 bp, Homo sapiens
agcttctcagcttcagaactgt

SEQ ID NO: 9130414 - DNA, 22 bp, Homo sapiens
agcttctcagcttcagaactgt

SEQ ID NO: 9130415 - DNA, 18 bp, Homo sapiens
agcttccctctgagaggg

SEQ ID NO: 9130416 - DNA, 23 bp, Homo sapiens
agcttcctagtgacctggagtct

SEQ ID NO: 9130417 - DNA, 22 bp, Homo sapiens
agcttccttggcgctgaggcct

SEQ ID NO: 9130418 - DNA, 22 bp, Homo sapiens
caggcccagtgatcagggctct

SEQ ID NO: 9130419 - DNA, 22 bp, Homo sapiens
agctgtctggaagttcctcatg

SEQ ID NO: 9130420 - DNA, 22 bp, Homo sapiens
agctgtctgtctcctgaggaga

SEQ ID NO: 9130421 - DNA, 22 bp, Homo sapiens
agctgtctgtgaacacagcatt

SEQ ID NO: 9130422 - DNA, 22 bp, Homo sapiens
agctgtctttctgcctcctgat

SEQ ID NO: 9130423 - DNA, 22 bp, Homo sapiens
agctgtctttctgcctcctgat

SEQ ID NO: 9130424 - DNA, 22 bp, Homo sapiens
agctgtctttcattacctcatt

SEQ ID NO: 9130425 - DNA, 21 bp, Homo sapiens
agcttacattaccattgttgc

SEQ ID NO: 9130426 - DNA, 22 bp, Homo sapiens
agcttccattaactgctacact

SEQ ID NO: 9130427 - DNA, 19 bp, Homo sapiens
agcttccatattctctagt

SEQ ID NO: 9130428 - DNA, 22 bp, Homo sapiens
caggcccatgagggcagccaca

SEQ ID NO: 9130429 - DNA, 22 bp, Homo sapiens
caggcagcgtcctgcttcctgt

SEQ ID NO: 9130430 - DNA, 22 bp, Homo sapiens
caggcagcgtcctgcttcctgt

SEQ ID NO: 9130431 - DNA, 22 bp, Homo sapiens
caggcagcgtcctgcttcctgt

SEQ ID NO: 9130432 - DNA, 22 bp, Homo sapiens
caggcagcgctcgtggcctggc

SEQ ID NO: 9130433 - DNA, 22 bp, Homo sapiens
caggcagcctgcggtctgcaca

SEQ ID NO: 9130434 - DNA, 22 bp, Homo sapiens
caggcagcgctcgtggcctggc

SEQ ID NO: 9130435 - DNA, 22 bp, Homo sapiens
caggcagcctgcggtctgcaca

SEQ ID NO: 9130436 - DNA, 22 bp, Homo sapiens
caggcagggagctggaaaggat

SEQ ID NO: 9130437 - DNA, 22 bp, Homo sapiens
caggcagctcaaccttgggagc

SEQ ID NO: 9130438 - DNA, 22 bp, Homo sapiens
caggcagctcaaccttgggagc

SEQ ID NO: 9130439 - DNA, 22 bp, Homo sapiens
caggcagctagatttataacaa

SEQ ID NO: 9130440 - DNA, 22 bp, Homo sapiens
caggcaggtcagtgaagaagga

SEQ ID NO: 9130441 - DNA, 22 bp, Homo sapiens
caggcaggtcagtgaagaagga

SEQ ID NO: 9130442 - DNA, 22 bp, Homo sapiens
caggcagggagctggaaaggat

SEQ ID NO: 9130443 - DNA, 22 bp, Homo sapiens
caggcaggtcagtgaagaagga

SEQ ID NO: 9130444 - DNA, 22 bp, Homo sapiens
caggcagggagctggaaaggat

SEQ ID NO: 9130445 - DNA, 22 bp, Homo sapiens
caggcagggagctggaaaggat

SEQ ID NO: 9130446 - DNA, 22 bp, Homo sapiens
caggcagggagctggaaaggat

SEQ ID NO: 9130447 - DNA, 22 bp, Homo sapiens
agctgtctccagatacaggatt

SEQ ID NO: 9130448 - DNA, 22 bp, Homo sapiens
agctgtctacctgcagagtcct

SEQ ID NO: 9130449 - DNA, 22 bp, Homo sapiens
agctgtctctggtattatgtga

SEQ ID NO: 9130450 - DNA, 22 bp, Homo sapiens
agctgtctctctggtgtccata

SEQ ID NO: 9130451 - DNA, 22 bp, Homo sapiens
agctgtcagtgctgtgcctgta

SEQ ID NO: 9130452 - DNA, 22 bp, Homo sapiens
agctgtcaggcagaactgagct

SEQ ID NO: 9130453 - DNA, 22 bp, Homo sapiens
agctggtttggggtagaggaca

SEQ ID NO: 9130454 - DNA, 22 bp, Homo sapiens
agctggtttaggatggtctcca

SEQ ID NO: 9130455 - DNA, 22 bp, Homo sapiens
agctggtttaggaaaaggtagg

SEQ ID NO: 9130456 - DNA, 22 bp, Homo sapiens
agctggtttatttctcacaaca

SEQ ID NO: 9130457 - DNA, 22 bp, Homo sapiens
agctggtttgcaagtataatca

SEQ ID NO: 9130458 - DNA, 22 bp, Homo sapiens
agctggttcccactgggcctgt

SEQ ID NO: 9130459 - DNA, 22 bp, Homo sapiens
agctggttcattcattcatggt

SEQ ID NO: 9130460 - DNA, 22 bp, Homo sapiens
caggcaggtcagtgaagaagga

SEQ ID NO: 9130461 - DNA, 22 bp, Homo sapiens
caggcaggtcagtgaagaagga

SEQ ID NO: 9130462 - DNA, 22 bp, Homo sapiens
caggcaggtcagtgaagaagga

SEQ ID NO: 9130463 - DNA, 22 bp, Homo sapiens
caggcagtggctcacagcaacc

SEQ ID NO: 9130464 - DNA, 22 bp, Homo sapiens
caggcagtgtcccaggaagcca

SEQ ID NO: 9130465 - DNA, 22 bp, Homo sapiens
caggcagtgtcccaggaagcca

SEQ ID NO: 9130466 - DNA, 22 bp, Homo sapiens
agctggtggaagggagcccaaa

SEQ ID NO: 9130467 - DNA, 22 bp, Homo sapiens
agctggtggaagggagcccaaa

SEQ ID NO: 9130468 - DNA, 22 bp, Homo sapiens
agctggtggaagggagcccaaa

SEQ ID NO: 9130469 - DNA, 20 bp, Homo sapiens
caggacagcgcaatcggagg

SEQ ID NO: 9130470 - DNA, 22 bp, Homo sapiens
caggacctaactcacctgtctc

SEQ ID NO: 9130471 - DNA, 22 bp, Homo sapiens
caggacctaactcacctgtctc

SEQ ID NO: 9130472 - DNA, 22 bp, Homo sapiens
caggacagagcccagactgtgt

SEQ ID NO: 9130473 - DNA, 22 bp, Homo sapiens
cagctgttgactggtacatgaa

SEQ ID NO: 9130474 - DNA, 22 bp, Homo sapiens
caggagcaaggagcagtgggat

SEQ ID NO: 9130475 - DNA, 22 bp, Homo sapiens
caggagaaacataattttctgg

SEQ ID NO: 9130476 - DNA, 22 bp, Homo sapiens
caggacttattatagcattata

SEQ ID NO: 9130477 - DNA, 22 bp, Homo sapiens
caggacttattatagcattata

SEQ ID NO: 9130478 - DNA, 21 bp, Homo sapiens
caggactttcctccaaagtta

SEQ ID NO: 9130479 - DNA, 22 bp, Homo sapiens
caggactgatgttcctccagcc

SEQ ID NO: 9130480 - DNA, 22 bp, Homo sapiens
caggactgaagggcacagggaa

SEQ ID NO: 9130481 - DNA, 22 bp, Homo sapiens
caggactggaagtctcaagaga

SEQ ID NO: 9130482 - DNA, 22 bp, Homo sapiens
cagctggtcaactgaatgaaca

SEQ ID NO: 9130483 - DNA, 22 bp, Homo sapiens
cagctggtaggtagcagatttg

SEQ ID NO: 9130484 - DNA, 22 bp, Homo sapiens
cagctgggtggctcttctgctc

SEQ ID NO: 9130485 - DNA, 22 bp, Homo sapiens
cagctgggtttagtggggtgtg

SEQ ID NO: 9130486 - DNA, 22 bp, Homo sapiens
cagctgtgtatgagagcatgct

SEQ ID NO: 9130487 - DNA, 22 bp, Homo sapiens
cagctgtgtatgagagcatgct

SEQ ID NO: 9130488 - DNA, 22 bp, Homo sapiens
cagctgtgtatgagagcatgct

SEQ ID NO: 9130489 - DNA, 22 bp, Homo sapiens
cagctgtgtatgagagcatgct

SEQ ID NO: 9130490 - DNA, 22 bp, Homo sapiens
cagctgtgtctaattatggctg

SEQ ID NO: 9130491 - DNA, 22 bp, Homo sapiens
cagctgtgtctaattatggctg

SEQ ID NO: 9130492 - DNA, 22 bp, Homo sapiens
cagctgttcagcaactcgcaga

SEQ ID NO: 9130493 - DNA, 22 bp, Homo sapiens
caggatggccccggggctgtgc

SEQ ID NO: 9130494 - DNA, 22 bp, Homo sapiens
caggatgggatgtagtgggccc

SEQ ID NO: 9130495 - DNA, 22 bp, Homo sapiens
caggatgggtgtcggccagcac

SEQ ID NO: 9130496 - DNA, 22 bp, Homo sapiens
caggcacacatccgtgagagat

SEQ ID NO: 9130497 - DNA, 22 bp, Homo sapiens
caggcacacatccgtgagagat

SEQ ID NO: 9130498 - DNA, 22 bp, Homo sapiens
caggcacacccactggtgcaga

SEQ ID NO: 9130499 - DNA, 22 bp, Homo sapiens
caggcacacatccgtgagagat

SEQ ID NO: 9130500 - DNA, 20 bp, Homo sapiens
caggcacactcattcctgct

SEQ ID NO: 9130501 - DNA, 22 bp, Homo sapiens
caggcagagtgaggtggtctaa

SEQ ID NO: 9130502 - DNA, 22 bp, Homo sapiens
caggagcccagagtcctcagct

SEQ ID NO: 9130503 - DNA, 22 bp, Homo sapiens
caggagcccagagtcctcagct

SEQ ID NO: 9130504 - DNA, 22 bp, Homo sapiens
caggagccagctgtcccaacca

SEQ ID NO: 9130505 - DNA, 22 bp, Homo sapiens
caggagccagctgtcccaacca

SEQ ID NO: 9130506 - DNA, 22 bp, Homo sapiens
caggagccagaggcggatggag

SEQ ID NO: 9130507 - DNA, 22 bp, Homo sapiens
caggagccagctgtcccaacca

SEQ ID NO: 9130508 - DNA, 22 bp, Homo sapiens
caggagccagctgtcccaacca

SEQ ID NO: 9130509 - DNA, 22 bp, Homo sapiens
caggagcccagagtcctcagct

SEQ ID NO: 9130510 - DNA, 22 bp, Homo sapiens
caggagcccagagtcctcagct

SEQ ID NO: 9130511 - DNA, 22 bp, Homo sapiens
caggagtctgttcctcatttgt

SEQ ID NO: 9130512 - DNA, 22 bp, Homo sapiens
caggatggagggagggctgtta

SEQ ID NO: 9130513 - DNA, 22 bp, Homo sapiens
caggatggagagtgaggggtca

SEQ ID NO: 9130514 - DNA, 22 bp, Homo sapiens
caggatggagagttgttggttg

SEQ ID NO: 9130515 - DNA, 18 bp, Homo sapiens
caggagcaggagttgaac

SEQ ID NO: 9130516 - DNA, 18 bp, Homo sapiens
caggagcaggagttgaac

SEQ ID NO: 9130517 - DNA, 18 bp, Homo sapiens
caggagcaggagttgaac

SEQ ID NO: 9130518 - DNA, 22 bp, Homo sapiens
caggagcagagggtggtcagca

SEQ ID NO: 9130519 - DNA, 22 bp, Homo sapiens
caggagcaaggagcagtgggat

SEQ ID NO: 9130520 - DNA, 22 bp, Homo sapiens
caggagccacattccaccttga

SEQ ID NO: 9130521 - DNA, 22 bp, Homo sapiens
caggagccacattccaccttga

SEQ ID NO: 9130522 - DNA, 22 bp, Homo sapiens
caggagccacattccaccttga

SEQ ID NO: 9130523 - DNA, 22 bp, Homo sapiens
caggagccacattccaccttga

SEQ ID NO: 9130524 - DNA, 22 bp, Homo sapiens
caggagccagaggcggatggag

SEQ ID NO: 9130525 - DNA, 22 bp, Homo sapiens
caggagccagaggcggatggag

SEQ ID NO: 9130526 - DNA, 22 bp, Homo sapiens
caggagcaggcccaaggacaca

SEQ ID NO: 9130527 - DNA, 22 bp, Homo sapiens
caggagcaggcccaaggacaca

SEQ ID NO: 9130528 - DNA, 22 bp, Homo sapiens
agctttctggttacagtcttca

SEQ ID NO: 9130529 - DNA, 22 bp, Homo sapiens
cagggcagtaacgggaacatct

SEQ ID NO: 9130530 - DNA, 22 bp, Homo sapiens
agctttcttctagttgtacagt

SEQ ID NO: 9130531 - DNA, 22 bp, Homo sapiens
agctttctgtcacctgtgcttg

SEQ ID NO: 9130532 - DNA, 22 bp, Homo sapiens
agctttgaaattatgtttcaga

SEQ ID NO: 9130533 - DNA, 22 bp, Homo sapiens
agctttggagactgactccatc

SEQ ID NO: 9130534 - DNA, 19 bp, Homo sapiens
agctttggacttgcatttc

SEQ ID NO: 9130535 - DNA, 19 bp, Homo sapiens
agctttggacttgcatttc

SEQ ID NO: 9130536 - DNA, 22 bp, Homo sapiens
agctttgcatactttgggctgt

SEQ ID NO: 9130537 - DNA, 22 bp, Homo sapiens
agctttgcaacctgaggccagt

SEQ ID NO: 9130538 - DNA, 22 bp, Homo sapiens
agctttgggattcaggcaggaa

SEQ ID NO: 9130539 - DNA, 22 bp, Homo sapiens
agctttgggattcaggcaggaa

SEQ ID NO: 9130540 - DNA, 22 bp, Homo sapiens
agctttggctgtgttgctctgt

SEQ ID NO: 9130541 - DNA, 22 bp, Homo sapiens
agctttggctgtgttgctctgt

SEQ ID NO: 9130542 - DNA, 22 bp, Homo sapiens
agctttggctgtgttgctctgt

SEQ ID NO: 9130543 - DNA, 22 bp, Homo sapiens
agctttggcttctgttgaacct

SEQ ID NO: 9130544 - DNA, 22 bp, Homo sapiens
agctttggccctggaggttact

SEQ ID NO: 9130545 - DNA, 22 bp, Homo sapiens
agctttggccctggaggttact

SEQ ID NO: 9130546 - DNA, 22 bp, Homo sapiens
agctttggatgatctttgatac

SEQ ID NO: 9130547 - DNA, 22 bp, Homo sapiens
agctttggcatctgactagccg

SEQ ID NO: 9130548 - DNA, 22 bp, Homo sapiens
agctttggcatctgactagccg

SEQ ID NO: 9130549 - DNA, 22 bp, Homo sapiens
agctttgggcaaaggcttgtga

SEQ ID NO: 9130550 - DNA, 22 bp, Homo sapiens
cagggctggctgtggcaatctc

SEQ ID NO: 9130551 - DNA, 22 bp, Homo sapiens
cagggctggctgtggcaatctc

SEQ ID NO: 9130552 - DNA, 22 bp, Homo sapiens
cagggctggctgtggcaatctc

SEQ ID NO: 9130553 - DNA, 22 bp, Homo sapiens
cagggctggctcatgaaaagtt

SEQ ID NO: 9130554 - DNA, 22 bp, Homo sapiens
cagggctggctcatgaaaagtt

SEQ ID NO: 9130555 - DNA, 22 bp, Homo sapiens
caggctcttccatcctgctgag

SEQ ID NO: 9130556 - DNA, 22 bp, Homo sapiens
caggctgaagtgcagtggtgtg

SEQ ID NO: 9130557 - DNA, 22 bp, Homo sapiens
caggctgacaactgagcatttt

SEQ ID NO: 9130558 - DNA, 22 bp, Homo sapiens
caggctcttttggtggcaagga

SEQ ID NO: 9130559 - DNA, 22 bp, Homo sapiens
cagggcaggatgctgtgattat

SEQ ID NO: 9130560 - DNA, 22 bp, Homo sapiens
cagggcaggatgctgtgattat

SEQ ID NO: 9130561 - DNA, 22 bp, Homo sapiens
cagggcaggatgctgtgattat

SEQ ID NO: 9130562 - DNA, 22 bp, Homo sapiens
cagggatgtgatgagctgagcc

SEQ ID NO: 9130563 - DNA, 22 bp, Homo sapiens
cagggatgtgatgagctgagcc

SEQ ID NO: 9130564 - DNA, 22 bp, Homo sapiens
cagggcagtaacgggaacatct

SEQ ID NO: 9130565 - DNA, 22 bp, Homo sapiens
cagggcagtaacgggaacatct

SEQ ID NO: 9130566 - DNA, 22 bp, Homo sapiens
cagggcagtaacgggaacatct

SEQ ID NO: 9130567 - DNA, 22 bp, Homo sapiens
cagggcagggccacaccccctg

SEQ ID NO: 9130568 - DNA, 22 bp, Homo sapiens
cagggcagggccacaccccctg

SEQ ID NO: 9130569 - DNA, 22 bp, Homo sapiens
cagggcagggccacaccccctg

SEQ ID NO: 9130570 - DNA, 22 bp, Homo sapiens
cagggcagggagcttagaatga

SEQ ID NO: 9130571 - DNA, 22 bp, Homo sapiens
cagggcagggatgttgcggcag

SEQ ID NO: 9130572 - DNA, 22 bp, Homo sapiens
aggaagagctggaccagaggac

SEQ ID NO: 9130573 - DNA, 22 bp, Homo sapiens
aggaagagctggaccagaggac

SEQ ID NO: 9130574 - DNA, 22 bp, Homo sapiens
aggaagagctggaccagaggac

SEQ ID NO: 9130575 - DNA, 22 bp, Homo sapiens
aggaagagctggaccagaggac

SEQ ID NO: 9130576 - DNA, 22 bp, Homo sapiens
aggaagagctggaccagaggac

SEQ ID NO: 9130577 - DNA, 22 bp, Homo sapiens
aggaagagcccgggtgacataa

SEQ ID NO: 9130578 - DNA, 22 bp, Homo sapiens
aggaagagcccgggtgacataa

SEQ ID NO: 9130579 - DNA, 22 bp, Homo sapiens
aggaagagctggaccagaggac

SEQ ID NO: 9130580 - DNA, 22 bp, Homo sapiens
aggaagagcccgggtgacataa

SEQ ID NO: 9130581 - DNA, 22 bp, Homo sapiens
cagggctgttagctgctgctct

SEQ ID NO: 9130582 - DNA, 18 bp, Homo sapiens
cagggctgtggggtcact

SEQ ID NO: 9130583 - DNA, 18 bp, Homo sapiens
cagggctgtggggtcact

SEQ ID NO: 9130584 - DNA, 18 bp, Homo sapiens
cagggctgtggggtcact

SEQ ID NO: 9130585 - DNA, 22 bp, Homo sapiens
aggaagagctggaccagaggac

SEQ ID NO: 9130586 - DNA, 22 bp, Homo sapiens
aggaaaggcctcagcagaaacc

SEQ ID NO: 9130587 - DNA, 22 bp, Homo sapiens
aggaaaggcctcagcagaaacc

SEQ ID NO: 9130588 - DNA, 21 bp, Homo sapiens
aggaaaggccagcacgtaggg

SEQ ID NO: 9130589 - DNA, 22 bp, Homo sapiens
aggaaaggattggcttctctgt

SEQ ID NO: 9130590 - DNA, 22 bp, Homo sapiens
aggaaaggcctttgcatttggt

SEQ ID NO: 9130591 - DNA, 22 bp, Homo sapiens
aggaagaaaactaattagatgg

SEQ ID NO: 9130592 - DNA, 19 bp, Homo sapiens
aggaaaggatcaaaatagc

SEQ ID NO: 9130593 - DNA, 22 bp, Homo sapiens
cagggctggctgtggcaatctc

SEQ ID NO: 9130594 - DNA, 22 bp, Homo sapiens
cagggctggcttccaagttgtt

SEQ ID NO: 9130595 - DNA, 23 bp, Homo sapiens
cagggctgggcttggtgttaggc

SEQ ID NO: 9130596 - DNA, 22 bp, Homo sapiens
cagggctgggttaaaagcaggg

SEQ ID NO: 9130597 - DNA, 23 bp, Homo sapiens
cagggctgggcttggtgttaggc

SEQ ID NO: 9130598 - DNA, 22 bp, Homo sapiens
cagtaaatgcagatatagatac

SEQ ID NO: 9130599 - DNA, 22 bp, Homo sapiens
cagtaaatataggaacgtggaa

SEQ ID NO: 9130600 - DNA, 22 bp, Homo sapiens
aggacagagggaccagagccca

SEQ ID NO: 9130601 - DNA, 22 bp, Homo sapiens
aggacagagggaccagagccca

SEQ ID NO: 9130602 - DNA, 21 bp, Homo sapiens
aggacagatgtaggaataaag

SEQ ID NO: 9130603 - DNA, 22 bp, Homo sapiens
cagtaaatacatatcagagaag

SEQ ID NO: 9130604 - DNA, 22 bp, Homo sapiens
cagtatttcctcttcttaactt

SEQ ID NO: 9130605 - DNA, 22 bp, Homo sapiens
cagtatttggaatatagctaag

SEQ ID NO: 9130606 - DNA, 22 bp, Homo sapiens
cagtatttgttacagcattagc

SEQ ID NO: 9130607 - DNA, 22 bp, Homo sapiens
cagtatttcattcagaattgtt

SEQ ID NO: 9130608 - DNA, 22 bp, Homo sapiens
cagtaaggatgcacataactag

SEQ ID NO: 9130609 - DNA, 22 bp, Homo sapiens
aggaagtggggttctctcactg

SEQ ID NO: 9130610 - DNA, 22 bp, Homo sapiens
aggaatatggatttgctcagct

SEQ ID NO: 9130611 - DNA, 22 bp, Homo sapiens
aggaatagctgttaaagtcaat

SEQ ID NO: 9130612 - DNA, 22 bp, Homo sapiens
aggacacatgcacaccctgcgt

SEQ ID NO: 9130613 - DNA, 22 bp, Homo sapiens
aggacagagccctagtttcata

SEQ ID NO: 9130614 - DNA, 20 bp, Homo sapiens
aggaagtgatgttttatctg

SEQ ID NO: 9130615 - DNA, 22 bp, Homo sapiens
aggaagtgaaagggaaggagtt

SEQ ID NO: 9130616 - DNA, 22 bp, Homo sapiens
caggtgtctaattctcaccccc

SEQ ID NO: 9130617 - DNA, 22 bp, Homo sapiens
aggaagtgctaagagaacatca

SEQ ID NO: 9130618 - DNA, 22 bp, Homo sapiens
aggaagtggataaaatagcttt

SEQ ID NO: 9130619 - DNA, 21 bp, Homo sapiens
aggaagtggccagattgggaa

SEQ ID NO: 9130620 - DNA, 21 bp, Homo sapiens
aggaagtggccagattgggaa

SEQ ID NO: 9130621 - DNA, 22 bp, Homo sapiens
caggtgtcaaaatactaagtgg

SEQ ID NO: 9130622 - DNA, 22 bp, Homo sapiens
caggtgtataaactcagtgact

SEQ ID NO: 9130623 - DNA, 22 bp, Homo sapiens
caggtggttatgaggaaggtga

SEQ ID NO: 9130624 - DNA, 22 bp, Homo sapiens
caggtggttgagagctgtaggc

SEQ ID NO: 9130625 - DNA, 22 bp, Homo sapiens
caggtggttgagagctgtaggc

SEQ ID NO: 9130626 - DNA, 22 bp, Homo sapiens
cagggcttcgatggatggatgg

SEQ ID NO: 9130627 - DNA, 22 bp, Homo sapiens
cagggcttcgatggatggatgg

SEQ ID NO: 9130628 - DNA, 22 bp, Homo sapiens
cagggcttactggaggctgctt

SEQ ID NO: 9130629 - DNA, 22 bp, Homo sapiens
cagggcttcgtgtctcagtgct

SEQ ID NO: 9130630 - DNA, 22 bp, Homo sapiens
cagggcttcgtgtctcagtgct

SEQ ID NO: 9130631 - DNA, 22 bp, Homo sapiens
cagggcttcgctcctggtgcac

SEQ ID NO: 9130632 - DNA, 22 bp, Homo sapiens
cagggcttctataccaattcat

SEQ ID NO: 9130633 - DNA, 22 bp, Homo sapiens
cagggcttcttggcatttgctg

SEQ ID NO: 9130634 - DNA, 22 bp, Homo sapiens
cagggcttcgctcctggtgcac

SEQ ID NO: 9130635 - DNA, 22 bp, Homo sapiens
caggtggtgcctccaggctggt

SEQ ID NO: 9130636 - DNA, 16 bp, Homo sapiens
aggctcagaggctgga

SEQ ID NO: 9130637 - DNA, 22 bp, Homo sapiens
aggctcagaggtgagcatctgc

SEQ ID NO: 9130638 - DNA, 22 bp, Homo sapiens
aggctcagaggtgagcatctgc

SEQ ID NO: 9130639 - DNA, 20 bp, Homo sapiens
aggctcagatacccagggaa

SEQ ID NO: 9130640 - DNA, 22 bp, Homo sapiens
ccaggcacaggtgggcctcaga

SEQ ID NO: 9130641 - DNA, 18 bp, Homo sapiens
ccaggcacctttaaatat

SEQ ID NO: 9130642 - DNA, 22 bp, Homo sapiens
ccaggcactgctcgaggtgcta

SEQ ID NO: 9130643 - DNA, 22 bp, Homo sapiens
aggctagaggcttctggcttca

SEQ ID NO: 9130644 - DNA, 22 bp, Homo sapiens
aggctcagagatgagtaagcac

SEQ ID NO: 9130645 - DNA, 21 bp, Homo sapiens
aggctcagagatcaaacagta

SEQ ID NO: 9130646 - DNA, 22 bp, Homo sapiens
aggcctgggtctcgtgcctacc

SEQ ID NO: 9130647 - DNA, 22 bp, Homo sapiens
aggcctgggtctcgtgcctacc

SEQ ID NO: 9130648 - DNA, 22 bp, Homo sapiens
aggcctgggtctcgtgcctacc

SEQ ID NO: 9130649 - DNA, 19 bp, Homo sapiens
aggcctggggttttgcact

SEQ ID NO: 9130650 - DNA, 22 bp, Homo sapiens
aggcctgggcaagaaggggcgt

SEQ ID NO: 9130651 - DNA, 22 bp, Homo sapiens
aggcctgggcaagaaggggcgt

SEQ ID NO: 9130652 - DNA, 22 bp, Homo sapiens
aggcctgggtctcgtgcctacc

SEQ ID NO: 9130653 - DNA, 23 bp, Homo sapiens
ccagctcccaggtctgaggactg

SEQ ID NO: 9130654 - DNA, 22 bp, Homo sapiens
ccagctcccattcttcacctgt

SEQ ID NO: 9130655 - DNA, 22 bp, Homo sapiens
ccagctccgggagttgctgctg

SEQ ID NO: 9130656 - DNA, 22 bp, Homo sapiens
ccagctccctgaagcctggtct

SEQ ID NO: 9130657 - DNA, 22 bp, Homo sapiens
ccagctccctgaagcctggtct

SEQ ID NO: 9130658 - DNA, 22 bp, Homo sapiens
ccagctccctgaagcctggtct

SEQ ID NO: 9130659 - DNA, 22 bp, Homo sapiens
ccagctccaggactgggagctg

SEQ ID NO: 9130660 - DNA, 22 bp, Homo sapiens
ccagctccaggtagatgggcag

SEQ ID NO: 9130661 - DNA, 22 bp, Homo sapiens
ccagctccattgcttagtgtaa

SEQ ID NO: 9130662 - DNA, 22 bp, Homo sapiens
ccagctccattgcttagtgtaa

SEQ ID NO: 9130663 - DNA, 22 bp, Homo sapiens
ccagctccaggtagatgggcag

SEQ ID NO: 9130664 - DNA, 22 bp, Homo sapiens
ccaggaggtggaggttgcggtg

SEQ ID NO: 9130665 - DNA, 22 bp, Homo sapiens
ccaggaggtggagattgcagtg

SEQ ID NO: 9130666 - DNA, 22 bp, Homo sapiens
ccaggaggtgctggaagaaagc

SEQ ID NO: 9130667 - DNA, 22 bp, Homo sapiens
ccaggaggtggagattgcagtg

SEQ ID NO: 9130668 - DNA, 22 bp, Homo sapiens
ccaggaggtggcaggacttgcc

SEQ ID NO: 9130669 - DNA, 22 bp, Homo sapiens
ccaggaggtggcaggacttgcc

SEQ ID NO: 9130670 - DNA, 22 bp, Homo sapiens
ccaggaggttgaggctgcagtg

SEQ ID NO: 9130671 - DNA, 22 bp, Homo sapiens
ccaggagggaggagttcctgag

SEQ ID NO: 9130672 - DNA, 22 bp, Homo sapiens
ccaggagggaggagttcctgag

SEQ ID NO: 9130673 - DNA, 22 bp, Homo sapiens
ccaggaggggtctctgtctccc

SEQ ID NO: 9130674 - DNA, 22 bp, Homo sapiens
ccaggaggggtctctgtctccc

SEQ ID NO: 9130675 - DNA, 22 bp, Homo sapiens
ccaggaggatgaggggcataga

SEQ ID NO: 9130676 - DNA, 22 bp, Homo sapiens
ccagctccgggagttgctgctg

SEQ ID NO: 9130677 - DNA, 22 bp, Homo sapiens
ccaggaggtgaaacttcaccag

SEQ ID NO: 9130678 - DNA, 22 bp, Homo sapiens
ccaggaggtgaaacttcaccag

SEQ ID NO: 9130679 - DNA, 22 bp, Homo sapiens
ccaggaggtctgagtgtggaca

SEQ ID NO: 9130680 - DNA, 22 bp, Homo sapiens
ccaggagggtggttactcaatc

SEQ ID NO: 9130681 - DNA, 22 bp, Homo sapiens
ccagccactgggccactgccag

SEQ ID NO: 9130682 - DNA, 22 bp, Homo sapiens
ccagccagatgataagctctat

SEQ ID NO: 9130683 - DNA, 22 bp, Homo sapiens
ccagagtctatgagtcctcatt

SEQ ID NO: 9130684 - DNA, 22 bp, Homo sapiens
ccagagtcccttgcagctcagt

SEQ ID NO: 9130685 - DNA, 22 bp, Homo sapiens
ccagccagcaagctcccagttc

SEQ ID NO: 9130686 - DNA, 22 bp, Homo sapiens
ccagccagccttgatctgagta

SEQ ID NO: 9130687 - DNA, 22 bp, Homo sapiens
ccagccagctggttggacgcct

SEQ ID NO: 9130688 - DNA, 22 bp, Homo sapiens
ccagccagtatattccaaagcc

SEQ ID NO: 9130689 - DNA, 22 bp, Homo sapiens
ccagccaggctggctgtggagg

SEQ ID NO: 9130690 - DNA, 22 bp, Homo sapiens
ccagccaggctggctgtggagg

SEQ ID NO: 9130691 - DNA, 22 bp, Homo sapiens
ccagccagggaaactttttctt

SEQ ID NO: 9130692 - DNA, 22 bp, Homo sapiens
ccagccctgaaccctgctgcat

SEQ ID NO: 9130693 - DNA, 22 bp, Homo sapiens
ccagccctgattagagaatgtc

SEQ ID NO: 9130694 - DNA, 22 bp, Homo sapiens
ccagccctcggtagtcccatag

SEQ ID NO: 9130695 - DNA, 22 bp, Homo sapiens
ccagccctcggtagtcccatag

SEQ ID NO: 9130696 - DNA, 22 bp, Homo sapiens
ccagccctcggtagtcccatag

SEQ ID NO: 9130697 - DNA, 22 bp, Homo sapiens
ccagccctgaaccctgctgcat

SEQ ID NO: 9130698 - DNA, 22 bp, Homo sapiens
ccagccctcggtagtcccatag

SEQ ID NO: 9130699 - DNA, 23 bp, Homo sapiens
ccagccctccaccagctctaggc

SEQ ID NO: 9130700 - DNA, 22 bp, Homo sapiens
ccagccctcactgaggcctctc

SEQ ID NO: 9130701 - DNA, 17 bp, Homo sapiens
ccagccctcgcgctttt

SEQ ID NO: 9130702 - DNA, 18 bp, Homo sapiens
ccagccctgcagcacctg

SEQ ID NO: 9130703 - DNA, 18 bp, Homo sapiens
ccagccctgcagcacctg

SEQ ID NO: 9130704 - DNA, 22 bp, Homo sapiens
ccagccctgattagagaatgtc

SEQ ID NO: 9130705 - DNA, 18 bp, Homo sapiens
ccagccctgcagcacctg

SEQ ID NO: 9130706 - DNA, 22 bp, Homo sapiens
aggccctgcggaaatgatcatt

SEQ ID NO: 9130707 - DNA, 22 bp, Homo sapiens
aggcaggtcacatgcttggcga

SEQ ID NO: 9130708 - DNA, 22 bp, Homo sapiens
ccactcccttccggtccagggc

SEQ ID NO: 9130709 - DNA, 22 bp, Homo sapiens
aggcaggtagaaggatctttat

SEQ ID NO: 9130710 - DNA, 19 bp, Homo sapiens
ccagaggcagcttctgtaa

SEQ ID NO: 9130711 - DNA, 22 bp, Homo sapiens
ccagaggatgctggtcagcctc

SEQ ID NO: 9130712 - DNA, 19 bp, Homo sapiens
ccagaggcagcttctgtaa

SEQ ID NO: 9130713 - DNA, 19 bp, Homo sapiens
ccagaggcagcttctgtaa

SEQ ID NO: 9130714 - DNA, 22 bp, Homo sapiens
ccagaggcatgttcaaagcaat

SEQ ID NO: 9130715 - DNA, 20 bp, Homo sapiens
ccagagctgatggctgcccg

SEQ ID NO: 9130716 - DNA, 21 bp, Homo sapiens
ccagaggcctctcttggccac

SEQ ID NO: 9130717 - DNA, 18 bp, Homo sapiens
ccagaggcccgggcaggc

SEQ ID NO: 9130718 - DNA, 18 bp, Homo sapiens
ccagaggcccgggcaggc

SEQ ID NO: 9130719 - DNA, 21 bp, Homo sapiens
ccagaggcctctcttggccac

SEQ ID NO: 9130720 - DNA, 21 bp, Homo sapiens
ccagaggcctctcttggccac

SEQ ID NO: 9130721 - DNA, 16 bp, Homo sapiens
ccagaggcctggcctc

SEQ ID NO: 9130722 - DNA, 22 bp, Homo sapiens
ccagaggctggcaagggctcct

SEQ ID NO: 9130723 - DNA, 22 bp, Homo sapiens
ccagaggctggcaagggctcct

SEQ ID NO: 9130724 - DNA, 20 bp, Homo sapiens
ccagaggctgacagactttg

SEQ ID NO: 9130725 - DNA, 22 bp, Homo sapiens
ccagaggcggaggtttgcagtg

SEQ ID NO: 9130726 - DNA, 22 bp, Homo sapiens
ccagaggctggcaagggctcct

SEQ ID NO: 9130727 - DNA, 20 bp, Homo sapiens
ccagaggctgacagactttg

SEQ ID NO: 9130728 - DNA, 22 bp, Homo sapiens
ccagaggtggtgggtgctacag

SEQ ID NO: 9130729 - DNA, 19 bp, Homo sapiens
ccagagtcatgtctccccc

SEQ ID NO: 9130730 - DNA, 22 bp, Homo sapiens
ccagagtcaggagctcatgtga

SEQ ID NO: 9130731 - DNA, 22 bp, Homo sapiens
aggctcagcatctgattcatat

SEQ ID NO: 9130732 - DNA, 22 bp, Homo sapiens
aggctcagcccctgggaggaga

SEQ ID NO: 9130733 - DNA, 20 bp, Homo sapiens
aggctctgcctgcaggccca

SEQ ID NO: 9130734 - DNA, 22 bp, Homo sapiens
aggctctgcttttctggatata

SEQ ID NO: 9130735 - DNA, 22 bp, Homo sapiens
aggctctgggaagcagtgagtt

SEQ ID NO: 9130736 - DNA, 19 bp, Homo sapiens
aggctctgtaggagagggc

SEQ ID NO: 9130737 - DNA, 22 bp, Homo sapiens
aggctctgggaagcagtgagtt

SEQ ID NO: 9130738 - DNA, 22 bp, Homo sapiens
ccaggcctttcttcttggtctg

SEQ ID NO: 9130739 - DNA, 22 bp, Homo sapiens
ccaggcctttcttcttggtctg

SEQ ID NO: 9130740 - DNA, 22 bp, Homo sapiens
ccaggccttctgaggacactct

SEQ ID NO: 9130741 - DNA, 22 bp, Homo sapiens
ccaggccttccagtacgcagaa

SEQ ID NO: 9130742 - DNA, 22 bp, Homo sapiens
ccaggccttccagtacgcagaa

SEQ ID NO: 9130743 - DNA, 22 bp, Homo sapiens
ccaggccttctgaggacactct

SEQ ID NO: 9130744 - DNA, 20 bp, Homo sapiens
ccaggcctgggcctgctcta

SEQ ID NO: 9130745 - DNA, 20 bp, Homo sapiens
ccaggcctgggcctgctcta

SEQ ID NO: 9130746 - DNA, 20 bp, Homo sapiens
ccaggcctgggcctgctcta

SEQ ID NO: 9130747 - DNA, 22 bp, Homo sapiens
ccaggcctcacctgcccaccta

SEQ ID NO: 9130748 - DNA, 22 bp, Homo sapiens
ccaggcctgtgttgtgtggagg

SEQ ID NO: 9130749 - DNA, 22 bp, Homo sapiens
ccaggcctgtgcaaggagggag

SEQ ID NO: 9130750 - DNA, 22 bp, Homo sapiens
ccaggttggagttcagtggcgc

SEQ ID NO: 9130751 - DNA, 22 bp, Homo sapiens
ccaggtgtttggcctgcatgat

SEQ ID NO: 9130752 - DNA, 23 bp, Homo sapiens
ccagtagcacagttacccagtgg

SEQ ID NO: 9130753 - DNA, 22 bp, Homo sapiens
aggctgagtgctcccctagatg

SEQ ID NO: 9130754 - DNA, 20 bp, Homo sapiens
ccaggtggtgcctggagagg

SEQ ID NO: 9130755 - DNA, 18 bp, Homo sapiens
ccaggtggtgacagagat

SEQ ID NO: 9130756 - DNA, 22 bp, Homo sapiens
ccaggtggtgaaagtgggccct

SEQ ID NO: 9130757 - DNA, 22 bp, Homo sapiens
ccaggtgttctttgtccctgtt

SEQ ID NO: 9130758 - DNA, 22 bp, Homo sapiens
aggctctgtcaggcggagcagc

SEQ ID NO: 9130759 - DNA, 22 bp, Homo sapiens
ccagggcacttaggcccagccc

SEQ ID NO: 9130760 - DNA, 22 bp, Homo sapiens
ccagggcacttaggcccagccc

SEQ ID NO: 9130761 - DNA, 22 bp, Homo sapiens
ccagggcagaaaaagagggaat

SEQ ID NO: 9130762 - DNA, 22 bp, Homo sapiens
ccagggcagaaaaagagggaat

SEQ ID NO: 9130763 - DNA, 22 bp, Homo sapiens
ccagggcagcagaattggggca

SEQ ID NO: 9130764 - DNA, 22 bp, Homo sapiens
ccagggcagaaaaagagggaat

SEQ ID NO: 9130765 - DNA, 22 bp, Homo sapiens
ccagggcagcagaattggggca

SEQ ID NO: 9130766 - DNA, 22 bp, Homo sapiens
ccaggtgcaaactcccagcagg

SEQ ID NO: 9130767 - DNA, 22 bp, Homo sapiens
ccagggcagccaacccagatgc

SEQ ID NO: 9130768 - DNA, 22 bp, Homo sapiens
ccaggtgcactcaagacctgct

SEQ ID NO: 9130769 - DNA, 18 bp, Homo sapiens
cccacacagcagtagctc

SEQ ID NO: 9130770 - DNA, 20 bp, Homo sapiens
cccacacccttcccacttgg

SEQ ID NO: 9130771 - DNA, 22 bp, Homo sapiens
cccacacatttttcacttaccg

SEQ ID NO: 9130772 - DNA, 22 bp, Homo sapiens
cccacacactggctgctgccaa

SEQ ID NO: 9130773 - DNA, 22 bp, Homo sapiens
cccacacactggctgctgccaa

SEQ ID NO: 9130774 - DNA, 22 bp, Homo sapiens
cccacacacatttatgatagga

SEQ ID NO: 9130775 - DNA, 22 bp, Homo sapiens
cccacacacatttatgatagga

SEQ ID NO: 9130776 - DNA, 22 bp, Homo sapiens
cccacacaaatcatggggagaa

SEQ ID NO: 9130777 - DNA, 22 bp, Homo sapiens
ccagtgtattatttgagaaatt

SEQ ID NO: 9130778 - DNA, 22 bp, Homo sapiens
ccagtgtcttcagagtaaatct

SEQ ID NO: 9130779 - DNA, 22 bp, Homo sapiens
ccattttattagtgacatttag

SEQ ID NO: 9130780 - DNA, 22 bp, Homo sapiens
ccagtgtgcaatctctggctta

SEQ ID NO: 9130781 - DNA, 22 bp, Homo sapiens
cccaagttaaaattcagtgctc

SEQ ID NO: 9130782 - DNA, 22 bp, Homo sapiens
cccaagttaatttgtagctgaa

SEQ ID NO: 9130783 - DNA, 22 bp, Homo sapiens
cccaagttgcttgttccaagac

SEQ ID NO: 9130784 - DNA, 22 bp, Homo sapiens
ccattttgtctcctgaaatcta

SEQ ID NO: 9130785 - DNA, 22 bp, Homo sapiens
ccattttgtctgacttcttgct

SEQ ID NO: 9130786 - DNA, 22 bp, Homo sapiens
aggctgcaggtctgggtcatgt

SEQ ID NO: 9130787 - DNA, 22 bp, Homo sapiens
aggctgcaggtctgggtcatgt

SEQ ID NO: 9130788 - DNA, 22 bp, Homo sapiens
aggctgcagcttgtctcgtggg

SEQ ID NO: 9130789 - DNA, 22 bp, Homo sapiens
aggctgcagcttgtctcgtggg

SEQ ID NO: 9130790 - DNA, 22 bp, Homo sapiens
aggctgcagaggtgctgccaga

SEQ ID NO: 9130791 - DNA, 23 bp, Homo sapiens
aggctgcagaagaatagggtcat

SEQ ID NO: 9130792 - DNA, 23 bp, Homo sapiens
aggctgcagaagaatagggtcat

SEQ ID NO: 9130793 - DNA, 21 bp, Homo sapiens
aggctgcatgcatgagtgtgg

SEQ ID NO: 9130794 - DNA, 22 bp, Homo sapiens
aggctgcatcccactttgtgta

SEQ ID NO: 9130795 - DNA, 22 bp, Homo sapiens
aggctgcatcccactttgtgta

SEQ ID NO: 9130796 - DNA, 21 bp, Homo sapiens
aggctgcatgcatgagtgtgg

SEQ ID NO: 9130797 - DNA, 21 bp, Homo sapiens
aggctgcatttatatggtgtg

SEQ ID NO: 9130798 - DNA, 23 bp, Homo sapiens
aggctgccagaaattgggtaagg

SEQ ID NO: 9130799 - DNA, 22 bp, Homo sapiens
aggctgccgcagccaatggttg

SEQ ID NO: 9130800 - DNA, 22 bp, Homo sapiens
aggctgccatagggaactgcat

SEQ ID NO: 9130801 - DNA, 22 bp, Homo sapiens
aggctgccctgccgccagtggg

SEQ ID NO: 9130802 - DNA, 22 bp, Homo sapiens
cccactccctacgacacgctcc

SEQ ID NO: 9130803 - DNA, 22 bp, Homo sapiens
cccactccctgcacgcctgccg

SEQ ID NO: 9130804 - DNA, 22 bp, Homo sapiens
cccactccctgcacgcctgccg

SEQ ID NO: 9130805 - DNA, 22 bp, Homo sapiens
cccacgtcgaacttgctccaga

SEQ ID NO: 9130806 - DNA, 22 bp, Homo sapiens
cccacgtcgaacttgctccaga

SEQ ID NO: 9130807 - DNA, 22 bp, Homo sapiens
cccacactcagttccccttggg

SEQ ID NO: 9130808 - DNA, 22 bp, Homo sapiens
cccaccctgggaagctaggcag

SEQ ID NO: 9130809 - DNA, 22 bp, Homo sapiens
cccacctctcagagagccttgc

SEQ ID NO: 9130810 - DNA, 22 bp, Homo sapiens
cccacgacttgtctgcatttgg

SEQ ID NO: 9130811 - DNA, 22 bp, Homo sapiens
cccaccctgggctacacatcca

SEQ ID NO: 9130812 - DNA, 22 bp, Homo sapiens
cccaccctgggctacacatcca

SEQ ID NO: 9130813 - DNA, 22 bp, Homo sapiens
cccactcctggagctagggctc

SEQ ID NO: 9130814 - DNA, 22 bp, Homo sapiens
cccactccctgcacgcctgccg

SEQ ID NO: 9130815 - DNA, 22 bp, Homo sapiens
cccactccctgcacgcctgccg

SEQ ID NO: 9130816 - DNA, 22 bp, Homo sapiens
cccactgctgcgccgggcgccg

SEQ ID NO: 9130817 - DNA, 22 bp, Homo sapiens
aggctgtgacagggtcatggag

SEQ ID NO: 9130818 - DNA, 22 bp, Homo sapiens
cccactgcatgagttggtatta

SEQ ID NO: 9130819 - DNA, 22 bp, Homo sapiens
aggctgtgcattttggagggcc

SEQ ID NO: 9130820 - DNA, 22 bp, Homo sapiens
aggctgtgcacagggcacctgc

SEQ ID NO: 9130821 - DNA, 22 bp, Homo sapiens
aggctgtgcacagggcacctgc

SEQ ID NO: 9130822 - DNA, 22 bp, Homo sapiens
aggctgtgcacagggcacctgc

SEQ ID NO: 9130823 - DNA, 22 bp, Homo sapiens
aggctgtgactacgcagggaag

SEQ ID NO: 9130824 - DNA, 22 bp, Homo sapiens
aggctgtgacagggtcatggag

SEQ ID NO: 9130825 - DNA, 22 bp, Homo sapiens
aggctgtggccctggtctagca

SEQ ID NO: 9130826 - DNA, 22 bp, Homo sapiens
aggctgtgggaatggctgcttg

SEQ ID NO: 9130827 - DNA, 22 bp, Homo sapiens
aggctgtgggagttgagagtct

SEQ ID NO: 9130828 - DNA, 22 bp, Homo sapiens
cccagaggtgacatcccattct

SEQ ID NO: 9130829 - DNA, 22 bp, Homo sapiens
cccagaggtgaaggaggtggga

SEQ ID NO: 9130830 - DNA, 22 bp, Homo sapiens
cccagaggtgaaggaggtggga

SEQ ID NO: 9130831 - DNA, 22 bp, Homo sapiens
cccagaggtgcttcagaggtgc

SEQ ID NO: 9130832 - DNA, 22 bp, Homo sapiens
cccagaggtgcttcagaggtgc

SEQ ID NO: 9130833 - DNA, 22 bp, Homo sapiens
cccagaggttccttagggacca

SEQ ID NO: 9130834 - DNA, 22 bp, Homo sapiens
cccagaggttccttagggacca

SEQ ID NO: 9130835 - DNA, 18 bp, Homo sapiens
aggggcagcttgtgtgga

SEQ ID NO: 9130836 - DNA, 18 bp, Homo sapiens
aggggcagcttgtgtgga

SEQ ID NO: 9130837 - DNA, 22 bp, Homo sapiens
aggggcctggttggcctctgtt

SEQ ID NO: 9130838 - DNA, 22 bp, Homo sapiens
aggggcctggttggcctctgtt

SEQ ID NO: 9130839 - DNA, 22 bp, Homo sapiens
aggggcgggacatgcactgagc

SEQ ID NO: 9130840 - DNA, 22 bp, Homo sapiens
aggggcgtgctcttccccgacg

SEQ ID NO: 9130841 - DNA, 22 bp, Homo sapiens
aggggctcagttactttggcag

SEQ ID NO: 9130842 - DNA, 22 bp, Homo sapiens
aggggctgcctggcttggcact

SEQ ID NO: 9130843 - DNA, 22 bp, Homo sapiens
aggggctcctttgtgctgcgtc

SEQ ID NO: 9130844 - DNA, 22 bp, Homo sapiens
aggggaatgggtagactgttga

SEQ ID NO: 9130845 - DNA, 22 bp, Homo sapiens
aggggaatgggtagactgttga

SEQ ID NO: 9130846 - DNA, 21 bp, Homo sapiens
aggggaagtagagttttgatt

SEQ ID NO: 9130847 - DNA, 22 bp, Homo sapiens
aggggaaggccagcctgtagag

SEQ ID NO: 9130848 - DNA, 22 bp, Homo sapiens
aggggaaggccagcctgtagag

SEQ ID NO: 9130849 - DNA, 22 bp, Homo sapiens
cctcctggtgggcgcttctggc

SEQ ID NO: 9130850 - DNA, 22 bp, Homo sapiens
cctccttctggggccttctgct

SEQ ID NO: 9130851 - DNA, 22 bp, Homo sapiens
cctccttctctttttgcagagc

SEQ ID NO: 9130852 - DNA, 22 bp, Homo sapiens
cctccttcctgggacagagctg

SEQ ID NO: 9130853 - DNA, 22 bp, Homo sapiens
cctgagtcccctcattcactct

SEQ ID NO: 9130854 - DNA, 21 bp, Homo sapiens
cctgagtccctgttacagaca

SEQ ID NO: 9130855 - DNA, 22 bp, Homo sapiens
cctgagtctgtgttttcctaag

SEQ ID NO: 9130856 - DNA, 22 bp, Homo sapiens
aggggtgaaagagggccctcaa

SEQ ID NO: 9130857 - DNA, 22 bp, Homo sapiens
cctgagtcccataatgttgcca

SEQ ID NO: 9130858 - DNA, 22 bp, Homo sapiens
aggggtcagtgaccattgagga

SEQ ID NO: 9130859 - DNA, 22 bp, Homo sapiens
agggggtgtctctgattgggtt

SEQ ID NO: 9130860 - DNA, 22 bp, Homo sapiens
agggggtgtctctgattgggtt

SEQ ID NO: 9130861 - DNA, 22 bp, Homo sapiens
agggggtgtctctgattgggtt

SEQ ID NO: 9130862 - DNA, 22 bp, Homo sapiens
agggggtgtctctgattgggtt

SEQ ID NO: 9130863 - DNA, 22 bp, Homo sapiens
agggggtgggaagtctagaatc

SEQ ID NO: 9130864 - DNA, 22 bp, Homo sapiens
agggggtgcccagatgaaggat

SEQ ID NO: 9130865 - DNA, 22 bp, Homo sapiens
agggggtgcccagatgaaggat

SEQ ID NO: 9130866 - DNA, 22 bp, Homo sapiens
agggggtgatcaaggtgcggcg

SEQ ID NO: 9130867 - DNA, 22 bp, Homo sapiens
agggggtgatcaaggtgcggcg

SEQ ID NO: 9130868 - DNA, 22 bp, Homo sapiens
agggggctccttggtgtgcaga

SEQ ID NO: 9130869 - DNA, 22 bp, Homo sapiens
agggggctggagacacctcctc

SEQ ID NO: 9130870 - DNA, 22 bp, Homo sapiens
agggggctgccaaggaatgtaa

SEQ ID NO: 9130871 - DNA, 22 bp, Homo sapiens
aggggggtggatcacctgaggt

SEQ ID NO: 9130872 - DNA, 22 bp, Homo sapiens
agggggtcgtccggaagacctg

SEQ ID NO: 9130873 - DNA, 22 bp, Homo sapiens
agggggtctcctatcatggaag

SEQ ID NO: 9130874 - DNA, 22 bp, Homo sapiens
agggggtctcctatcatggaag

SEQ ID NO: 9130875 - DNA, 22 bp, Homo sapiens
agggggtgaatgtctgtctaca

SEQ ID NO: 9130876 - DNA, 22 bp, Homo sapiens
agggggtgatcaaggtgcggcg

SEQ ID NO: 9130877 - DNA, 22 bp, Homo sapiens
agggggtgatcaaggtgcggcg

SEQ ID NO: 9130878 - DNA, 22 bp, Homo sapiens
cctctgtgtctccaagaggcct

SEQ ID NO: 9130879 - DNA, 22 bp, Homo sapiens
cctctgtgtgtgcatgcatgcg

SEQ ID NO: 9130880 - DNA, 20 bp, Homo sapiens
cctctgtgtcctgtgtcata

SEQ ID NO: 9130881 - DNA, 20 bp, Homo sapiens
cctctgtgtcctgtgtcata

SEQ ID NO: 9130882 - DNA, 22 bp, Homo sapiens
cctcagggttcggatgagaaca

SEQ ID NO: 9130883 - DNA, 22 bp, Homo sapiens
cctcagtctatttccagcaggt

SEQ ID NO: 9130884 - DNA, 22 bp, Homo sapiens
agggctgggctgcttgttgtca

SEQ ID NO: 9130885 - DNA, 22 bp, Homo sapiens
agggctttgatggcattctcat

SEQ ID NO: 9130886 - DNA, 22 bp, Homo sapiens
agggctgggctgcttgttgtca

SEQ ID NO: 9130887 - DNA, 22 bp, Homo sapiens
agggctttggccccctgctgca

SEQ ID NO: 9130888 - DNA, 22 bp, Homo sapiens
agggctttgcaatgcacagtgg

SEQ ID NO: 9130889 - DNA, 18 bp, Homo sapiens
cctcaggggacctggcag

SEQ ID NO: 9130890 - DNA, 22 bp, Homo sapiens
cctcaggggcttttcgttgttg

SEQ ID NO: 9130891 - DNA, 22 bp, Homo sapiens
cctcaggggtcactgtgaggag

SEQ ID NO: 9130892 - DNA, 23 bp, Homo sapiens
cctcaggggacctgtgagcctga

SEQ ID NO: 9130893 - DNA, 22 bp, Homo sapiens
cctcaggggtcactgtgaggag

SEQ ID NO: 9130894 - DNA, 22 bp, Homo sapiens
cctcagggtctctcacagcacc

SEQ ID NO: 9130895 - DNA, 22 bp, Homo sapiens
cctcagggtcatcctagtaata

SEQ ID NO: 9130896 - DNA, 22 bp, Homo sapiens
agggctgagactaaggccagat

SEQ ID NO: 9130897 - DNA, 22 bp, Homo sapiens
agggctgagaatgacagggccg

SEQ ID NO: 9130898 - DNA, 20 bp, Homo sapiens
agggctgagaagggactagc

SEQ ID NO: 9130899 - DNA, 22 bp, Homo sapiens
agggctgacctaagctccactt

SEQ ID NO: 9130900 - DNA, 22 bp, Homo sapiens
agggctgagcccaggcatgtag

SEQ ID NO: 9130901 - DNA, 22 bp, Homo sapiens
cctacataacactgccaaactg

SEQ ID NO: 9130902 - DNA, 22 bp, Homo sapiens
cctactctgagcgcctccgcat

SEQ ID NO: 9130903 - DNA, 22 bp, Homo sapiens
agggctcttcctttgcctctca

SEQ ID NO: 9130904 - DNA, 22 bp, Homo sapiens
agggctctttaggccgaggcca

SEQ ID NO: 9130905 - DNA, 22 bp, Homo sapiens
agggctgacagtggcgtggcgt

SEQ ID NO: 9130906 - DNA, 22 bp, Homo sapiens
agggctgacctaagctccactt

SEQ ID NO: 9130907 - DNA, 22 bp, Homo sapiens
agggctgacagtggcgtggcgt

SEQ ID NO: 9130908 - DNA, 22 bp, Homo sapiens
agggcctggcttcactttctca

SEQ ID NO: 9130909 - DNA, 22 bp, Homo sapiens
ccctggcataaaacttctccag

SEQ ID NO: 9130910 - DNA, 22 bp, Homo sapiens
ccctggcataaaacttctccag

SEQ ID NO: 9130911 - DNA, 19 bp, Homo sapiens
ccctggcaggcaagcctgg

SEQ ID NO: 9130912 - DNA, 22 bp, Homo sapiens
ccctggcactagcgacggccat

SEQ ID NO: 9130913 - DNA, 17 bp, Homo sapiens
ccctggcaaagaatggc

SEQ ID NO: 9130914 - DNA, 22 bp, Homo sapiens
agggccccatagtcactgcccg

SEQ ID NO: 9130915 - DNA, 22 bp, Homo sapiens
agggcccagtggagagctgagc

SEQ ID NO: 9130916 - DNA, 21 bp, Homo sapiens
agggcctgtgctctccaggtc

SEQ ID NO: 9130917 - DNA, 21 bp, Homo sapiens
agggcctgtgctctccaggtc

SEQ ID NO: 9130918 - DNA, 22 bp, Homo sapiens
agggcctgtgaattctccctgc

SEQ ID NO: 9130919 - DNA, 22 bp, Homo sapiens
agggcctgtcagcggtgtcctg

SEQ ID NO: 9130920 - DNA, 22 bp, Homo sapiens
agggcctgtccgctcccgcccg

SEQ ID NO: 9130921 - DNA, 22 bp, Homo sapiens
agggcctggcttcactttctca

SEQ ID NO: 9130922 - DNA, 22 bp, Homo sapiens
agggcctgtctgtagaactgaa

SEQ ID NO: 9130923 - DNA, 22 bp, Homo sapiens
agggcctgtccgctcccgcccg

SEQ ID NO: 9130924 - DNA, 22 bp, Homo sapiens
cctaattatctcccaaagatcc

SEQ ID NO: 9130925 - DNA, 22 bp, Homo sapiens
cctacaggaaattgtatcaaaa

SEQ ID NO: 9130926 - DNA, 22 bp, Homo sapiens
agggcctgtgcttcctgagata

SEQ ID NO: 9130927 - DNA, 22 bp, Homo sapiens
agggcctgtgctgagtagacga

SEQ ID NO: 9130928 - DNA, 22 bp, Homo sapiens
agggcctgtgcttcctgagata

SEQ ID NO: 9130929 - DNA, 22 bp, Homo sapiens
agggaaaggtagtgaggtcaca

SEQ ID NO: 9130930 - DNA, 22 bp, Homo sapiens
agggaaaggctgatgctgtggg

SEQ ID NO: 9130931 - DNA, 21 bp, Homo sapiens
agggaaagaaaatgagctaat

SEQ ID NO: 9130932 - DNA, 22 bp, Homo sapiens
agggaaaggctgatgctgtggg

SEQ ID NO: 9130933 - DNA, 22 bp, Homo sapiens
aggctttgttttatctcattta

SEQ ID NO: 9130934 - DNA, 22 bp, Homo sapiens
aggcttttctccagaatgtact

SEQ ID NO: 9130935 - DNA, 22 bp, Homo sapiens
aggcttttatacattgctgacc

SEQ ID NO: 9130936 - DNA, 22 bp, Homo sapiens
aggcttttagaatcttatttct

SEQ ID NO: 9130937 - DNA, 22 bp, Homo sapiens
agggaaactagactgcctttct

SEQ ID NO: 9130938 - DNA, 21 bp, Homo sapiens
agggaaaaggctgagtgaggg

SEQ ID NO: 9130939 - DNA, 21 bp, Homo sapiens
agggaaaaggctgagtgaggg

SEQ ID NO: 9130940 - DNA, 22 bp, Homo sapiens
aggcttttggagaagcatatgc

SEQ ID NO: 9130941 - DNA, 22 bp, Homo sapiens
aggcttttgctctggctcctct

SEQ ID NO: 9130942 - DNA, 22 bp, Homo sapiens
aggcttttgtggtgtggaatgg

SEQ ID NO: 9130943 - DNA, 22 bp, Homo sapiens
cccagagtggagggtgcagaat

SEQ ID NO: 9130944 - DNA, 20 bp, Homo sapiens
cccagaggttgcggcaggag

SEQ ID NO: 9130945 - DNA, 22 bp, Homo sapiens
cccaggaagttgagactgcagt

SEQ ID NO: 9130946 - DNA, 22 bp, Homo sapiens
cccaggaagtggaggttgcagt

SEQ ID NO: 9130947 - DNA, 22 bp, Homo sapiens
cccaggaagggatgccaaggaa

SEQ ID NO: 9130948 - DNA, 22 bp, Homo sapiens
cccaggaagggatgccaaggaa

SEQ ID NO: 9130949 - DNA, 22 bp, Homo sapiens
cccaggaagggatgccaaggaa

SEQ ID NO: 9130950 - DNA, 22 bp, Homo sapiens
cccaggaagttgatgcagagga

SEQ ID NO: 9130951 - DNA, 22 bp, Homo sapiens
cccaggaagttgatgcagagga

SEQ ID NO: 9130952 - DNA, 22 bp, Homo sapiens
cccaggaagggatgccaaggaa

SEQ ID NO: 9130953 - DNA, 22 bp, Homo sapiens
cccaggaagagtgagtggcatt

SEQ ID NO: 9130954 - DNA, 22 bp, Homo sapiens
cccaggaagagtgagtggcatt

SEQ ID NO: 9130955 - DNA, 22 bp, Homo sapiens
cccaggaagaggggtcaggtgt

SEQ ID NO: 9130956 - DNA, 22 bp, Homo sapiens
cccaggaagaggggtcaggtgt

SEQ ID NO: 9130957 - DNA, 23 bp, Homo sapiens
agggaaagtagtaatggcctttg

SEQ ID NO: 9130958 - DNA, 22 bp, Homo sapiens
agggaaagtaagcatttcatta

SEQ ID NO: 9130959 - DNA, 22 bp, Homo sapiens
cccaggaacctaccagctcgag

SEQ ID NO: 9130960 - DNA, 22 bp, Homo sapiens
cccaggaacctaccagctcgag

SEQ ID NO: 9130961 - DNA, 22 bp, Homo sapiens
cccaggaacagggctcagaccc

SEQ ID NO: 9130962 - DNA, 22 bp, Homo sapiens
cccaggaactccagagctcctc

SEQ ID NO: 9130963 - DNA, 22 bp, Homo sapiens
cccaggaacagcacagaacagc

SEQ ID NO: 9130964 - DNA, 22 bp, Homo sapiens
cccaggaacagcacagaacagc

SEQ ID NO: 9130965 - DNA, 22 bp, Homo sapiens
cccaggaacagcacagaacagc

SEQ ID NO: 9130966 - DNA, 22 bp, Homo sapiens
cccaggccccagggcttgtcag

SEQ ID NO: 9130967 - DNA, 22 bp, Homo sapiens
agggacctcttcttgcagctga

SEQ ID NO: 9130968 - DNA, 22 bp, Homo sapiens
agggacagtctactgttcactg

SEQ ID NO: 9130969 - DNA, 22 bp, Homo sapiens
agggaatggatgatggcaggtt

SEQ ID NO: 9130970 - DNA, 22 bp, Homo sapiens
cccaggaatgagcaggcagggg

SEQ ID NO: 9130971 - DNA, 22 bp, Homo sapiens
agggagccttcctggctgtggt

SEQ ID NO: 9130972 - DNA, 17 bp, Homo sapiens
cccaggccgccgggagc

SEQ ID NO: 9130973 - DNA, 17 bp, Homo sapiens
cccaggccgccgggagc

SEQ ID NO: 9130974 - DNA, 17 bp, Homo sapiens
cccaggccgccgggagc

SEQ ID NO: 9130975 - DNA, 22 bp, Homo sapiens
cccaggcctggtctgggccagt

SEQ ID NO: 9130976 - DNA, 22 bp, Homo sapiens
agggagcttccgaactacagct

SEQ ID NO: 9130977 - DNA, 21 bp, Homo sapiens
agggagctggccacacagcct

SEQ ID NO: 9130978 - DNA, 21 bp, Homo sapiens
agggagctgcgtcttgaaaga

SEQ ID NO: 9130979 - DNA, 22 bp, Homo sapiens
agggagctgagctgtgagcagc

SEQ ID NO: 9130980 - DNA, 22 bp, Homo sapiens
agggccacctctctgggttccc

SEQ ID NO: 9130981 - DNA, 22 bp, Homo sapiens
agggccacctctctgggttccc

SEQ ID NO: 9130982 - DNA, 22 bp, Homo sapiens
agggccactggctgacggctgc

SEQ ID NO: 9130983 - DNA, 23 bp, Homo sapiens
agggccactgggaaggattactg

SEQ ID NO: 9130984 - DNA, 19 bp, Homo sapiens
agggccacggggaggtatt

SEQ ID NO: 9130985 - DNA, 22 bp, Homo sapiens
agggccaccagagcagggcagt

SEQ ID NO: 9130986 - DNA, 22 bp, Homo sapiens
agggccacagtggggcctgaga

SEQ ID NO: 9130987 - DNA, 22 bp, Homo sapiens
agggccaccagagcagggcagt

SEQ ID NO: 9130988 - DNA, 22 bp, Homo sapiens
agggccaccagagcagggcagt

SEQ ID NO: 9130989 - DNA, 22 bp, Homo sapiens
agggccacagtaatgctgagta

SEQ ID NO: 9130990 - DNA, 22 bp, Homo sapiens
agggccacagtggggcctgaga

SEQ ID NO: 9130991 - DNA, 22 bp, Homo sapiens
agggcattggcacagatctgct

SEQ ID NO: 9130992 - DNA, 20 bp, Homo sapiens
ccccttcatctacagcctga

SEQ ID NO: 9130993 - DNA, 22 bp, Homo sapiens
cccctgttatagaaccacctca

SEQ ID NO: 9130994 - DNA, 22 bp, Homo sapiens
agggcagctgtgagccactgtg

SEQ ID NO: 9130995 - DNA, 22 bp, Homo sapiens
agggcagctgtgagccactgtg

SEQ ID NO: 9130996 - DNA, 22 bp, Homo sapiens
agggcatggggttaacctggga

SEQ ID NO: 9130997 - DNA, 22 bp, Homo sapiens
agggcatggggttaacctggga

SEQ ID NO: 9130998 - DNA, 22 bp, Homo sapiens
agggcatgtgggagaggagcct

SEQ ID NO: 9130999 - DNA, 22 bp, Homo sapiens
agggcatgtgggagaggagcct

SEQ ID NO: 9131000 - DNA, 22 bp, Homo sapiens
agggcatgtgggagaggagcct

SEQ ID NO: 9131001 - DNA, 22 bp, Homo sapiens
agggcatgtgggagaggagcct

SEQ ID NO: 9131002 - DNA, 22 bp, Homo sapiens
ccctgagtcatcattgcggaag

SEQ ID NO: 9131003 - DNA, 22 bp, Homo sapiens
ccctgagttagtacagttgagt

SEQ ID NO: 9131004 - DNA, 22 bp, Homo sapiens
ccctgaggggagtggtgaggtg

SEQ ID NO: 9131005 - DNA, 22 bp, Homo sapiens
ccctgaggccctcctggggtct

SEQ ID NO: 9131006 - DNA, 22 bp, Homo sapiens
ccctgaggcaaaggctagagtt

SEQ ID NO: 9131007 - DNA, 19 bp, Homo sapiens
cccaggtgtttgaggctgc

SEQ ID NO: 9131008 - DNA, 22 bp, Homo sapiens
cccaggtgtttgtggcagaggt

SEQ ID NO: 9131009 - DNA, 22 bp, Homo sapiens
cccaggtgtttgtggcagaggt

SEQ ID NO: 9131010 - DNA, 20 bp, Homo sapiens
agggcacttttgctggagca

SEQ ID NO: 9131011 - DNA, 20 bp, Homo sapiens
agggcacttttgctggagca

SEQ ID NO: 9131012 - DNA, 20 bp, Homo sapiens
agggcacttttgctggagca

SEQ ID NO: 9131013 - DNA, 22 bp, Homo sapiens
agggatggtggaggttgcaagt

SEQ ID NO: 9131014 - DNA, 22 bp, Homo sapiens
agggatgggtctaacccagaac

SEQ ID NO: 9131015 - DNA, 22 bp, Homo sapiens
agggatggtggaggaatttcaa

SEQ ID NO: 9131016 - DNA, 22 bp, Homo sapiens
cccaggtgggcacctcgaggaa

SEQ ID NO: 9131017 - DNA, 21 bp, Homo sapiens
cccaggtgggatggttgcctc

SEQ ID NO: 9131018 - DNA, 22 bp, Homo sapiens
cccaggtggcagaagctgcagt

SEQ ID NO: 9131019 - DNA, 21 bp, Homo sapiens
agggagctttaggtagaagtt

SEQ ID NO: 9131020 - DNA, 22 bp, Homo sapiens
agggagctttaccccagatcac

SEQ ID NO: 9131021 - DNA, 22 bp, Homo sapiens
cccaggtgctgaaggaggccgc

SEQ ID NO: 9131022 - DNA, 22 bp, Homo sapiens
cccaggtgctgaaggaggccgc

SEQ ID NO: 9131023 - DNA, 22 bp, Homo sapiens
cccctgccagctatccctgaac

SEQ ID NO: 9131024 - DNA, 22 bp, Homo sapiens
cccctgccagctatccctgaac

SEQ ID NO: 9131025 - DNA, 22 bp, Homo sapiens
cccctgctggcctgctggtttc

SEQ ID NO: 9131026 - DNA, 22 bp, Homo sapiens
cccctgccatagtcaaatctaa

SEQ ID NO: 9131027 - DNA, 22 bp, Homo sapiens
cccctgccatagtcaaatctaa

SEQ ID NO: 9131028 - DNA, 22 bp, Homo sapiens
cccctgcgaggacagtgggaca

SEQ ID NO: 9131029 - DNA, 21 bp, Homo sapiens
cccctgggagccctgtcagta

SEQ ID NO: 9131030 - DNA, 21 bp, Homo sapiens
cccctgggagccctgtcagta

SEQ ID NO: 9131031 - DNA, 21 bp, Homo sapiens
cccctgggagccctgtcagta

SEQ ID NO: 9131032 - DNA, 22 bp, Homo sapiens
cccctgccagctatccctgaac

SEQ ID NO: 9131033 - DNA, 22 bp, Homo sapiens
cccctgccagctatccctgaac

SEQ ID NO: 9131034 - DNA, 22 bp, Homo sapiens
cccctgccagctatccctgaac

SEQ ID NO: 9131035 - DNA, 22 bp, Homo sapiens
agggcagagaaatgtagttgag

SEQ ID NO: 9131036 - DNA, 22 bp, Homo sapiens
agggcagagaaatgtagttgag

SEQ ID NO: 9131037 - DNA, 22 bp, Homo sapiens
cccctgaagacaatggagaggt

SEQ ID NO: 9131038 - DNA, 22 bp, Homo sapiens
cccctgaagacaatggagaggt

SEQ ID NO: 9131039 - DNA, 22 bp, Homo sapiens
cccctgaagacaatggagaggt

SEQ ID NO: 9131040 - DNA, 22 bp, Homo sapiens
agggcagaccacgtgcaaggat

SEQ ID NO: 9131041 - DNA, 22 bp, Homo sapiens
agggcagaccacgtgcaaggat

SEQ ID NO: 9131042 - DNA, 22 bp, Homo sapiens
agggcagactaggatggaagtg

SEQ ID NO: 9131043 - DNA, 22 bp, Homo sapiens
agggcagactaggatggaagtg

SEQ ID NO: 9131044 - DNA, 22 bp, Homo sapiens
agggcagactaggatggaagtg

SEQ ID NO: 9131045 - DNA, 22 bp, Homo sapiens
agggcagaagtacagacactta

SEQ ID NO: 9131046 - DNA, 22 bp, Homo sapiens
cgggctccgggtctttgcagtc

SEQ ID NO: 9131047 - DNA, 22 bp, Homo sapiens
cgggcgcactccgggcagctgt

SEQ ID NO: 9131048 - DNA, 22 bp, Homo sapiens
cgggcgcactccgggcagctgt

SEQ ID NO: 9131049 - DNA, 18 bp, Homo sapiens
cgggcgggcgcctggccc

SEQ ID NO: 9131050 - DNA, 22 bp, Homo sapiens
cgggcgcactccgggcagctgt

SEQ ID NO: 9131051 - DNA, 22 bp, Homo sapiens
cgggcgcactccgggcagctgt

SEQ ID NO: 9131052 - DNA, 22 bp, Homo sapiens
cgggcagatcacacagggcttg

SEQ ID NO: 9131053 - DNA, 22 bp, Homo sapiens
cgggcagcggcgtggccatggt

SEQ ID NO: 9131054 - DNA, 22 bp, Homo sapiens
cgggcacacacttgacaggttc

SEQ ID NO: 9131055 - DNA, 22 bp, Homo sapiens
cgggcacacacttgacaggttc

SEQ ID NO: 9131056 - DNA, 22 bp, Homo sapiens
cgggcaaggcgagactaggccc

SEQ ID NO: 9131057 - DNA, 17 bp, Homo sapiens
cgggcatggagggcagg

SEQ ID NO: 9131058 - DNA, 17 bp, Homo sapiens
cgggcatggagggcagg

SEQ ID NO: 9131059 - DNA, 22 bp, Homo sapiens
cgggcagtgtggctccagagtc

SEQ ID NO: 9131060 - DNA, 22 bp, Homo sapiens
cgggcagtgtggctccagagtc

SEQ ID NO: 9131061 - DNA, 17 bp, Homo sapiens
cgggcatggagggcagg

SEQ ID NO: 9131062 - DNA, 22 bp, Homo sapiens
ctaagcaagaatgagtgcaaca

SEQ ID NO: 9131063 - DNA, 22 bp, Homo sapiens
ctaagaaatgttgtgaatgcca

SEQ ID NO: 9131064 - DNA, 22 bp, Homo sapiens
ctaaacttcatatgttgcttta

SEQ ID NO: 9131065 - DNA, 22 bp, Homo sapiens
ctaaacttcttggcaattttat

SEQ ID NO: 9131066 - DNA, 22 bp, Homo sapiens
agtacagggagtttgttgtgtt

SEQ ID NO: 9131067 - DNA, 22 bp, Homo sapiens
agtacagcccaggccaggctgg

SEQ ID NO: 9131068 - DNA, 22 bp, Homo sapiens
agtacaattatatttagatggt

SEQ ID NO: 9131069 - DNA, 22 bp, Homo sapiens
agtacaatttaatgaagatagc

SEQ ID NO: 9131070 - DNA, 22 bp, Homo sapiens
cgcagggatttcaaggggcctt

SEQ ID NO: 9131071 - DNA, 22 bp, Homo sapiens
aggtttctgcactgtcactggt

SEQ ID NO: 9131072 - DNA, 22 bp, Homo sapiens
aggtttctgcaatgtgtgtaca

SEQ ID NO: 9131073 - DNA, 22 bp, Homo sapiens
aggtttctgcagcatagtggca

SEQ ID NO: 9131074 - DNA, 22 bp, Homo sapiens
aggtttctgctgtcctccttct

SEQ ID NO: 9131075 - DNA, 22 bp, Homo sapiens
aggtttctgcagcatagtggca

SEQ ID NO: 9131076 - DNA, 22 bp, Homo sapiens
aggtttctgcactgtcactggt

SEQ ID NO: 9131077 - DNA, 22 bp, Homo sapiens
agtaaaaagttcagaatggttg

SEQ ID NO: 9131078 - DNA, 18 bp, Homo sapiens
aggttttcagagtttcca

SEQ ID NO: 9131079 - DNA, 22 bp, Homo sapiens
aggtttgttaaaccagattgct

SEQ ID NO: 9131080 - DNA, 22 bp, Homo sapiens
aggtttcttcttaggaatatgt

SEQ ID NO: 9131081 - DNA, 22 bp, Homo sapiens
aggtttctttatgctgctagaa

SEQ ID NO: 9131082 - DNA, 22 bp, Homo sapiens
aggtttctttatgctgctagaa

SEQ ID NO: 9131083 - DNA, 22 bp, Homo sapiens
aggtttctggatttattatggc

SEQ ID NO: 9131084 - DNA, 22 bp, Homo sapiens
aggtttctggatttattatggc

SEQ ID NO: 9131085 - DNA, 19 bp, Homo sapiens
cgcaggagccgaggtgacc

SEQ ID NO: 9131086 - DNA, 22 bp, Homo sapiens
cgcaggcaagagagtacagtta

SEQ ID NO: 9131087 - DNA, 22 bp, Homo sapiens
cctgttgtttactgcagtgagt

SEQ ID NO: 9131088 - DNA, 22 bp, Homo sapiens
cctgttgtggaaaaagcctgat

SEQ ID NO: 9131089 - DNA, 20 bp, Homo sapiens
cctgttggatgaggtccaga

SEQ ID NO: 9131090 - DNA, 22 bp, Homo sapiens
cctgttcactgcacagtttccg

SEQ ID NO: 9131091 - DNA, 22 bp, Homo sapiens
cctgttcacggtgtgttgttag

SEQ ID NO: 9131092 - DNA, 22 bp, Homo sapiens
cctgttcactttgacttctcca

SEQ ID NO: 9131093 - DNA, 20 bp, Homo sapiens
cctgttcactgcgcagtttc

SEQ ID NO: 9131094 - DNA, 22 bp, Homo sapiens
cctgttcatttgtatttgtctt

SEQ ID NO: 9131095 - DNA, 22 bp, Homo sapiens
cctgttcaatattcttccttgt

SEQ ID NO: 9131096 - DNA, 17 bp, Homo sapiens
cctgtgtttgctccttc

SEQ ID NO: 9131097 - DNA, 22 bp, Homo sapiens
agtatttcagttactttaaaat

SEQ ID NO: 9131098 - DNA, 22 bp, Homo sapiens
agtatttcctggcttatctgct

SEQ ID NO: 9131099 - DNA, 22 bp, Homo sapiens
agtatttcctggcttatctgct

SEQ ID NO: 9131100 - DNA, 22 bp, Homo sapiens
agtattcagcaaacgtgaacag

SEQ ID NO: 9131101 - DNA, 23 bp, Homo sapiens
agtattcaaaaggcaagctatat

SEQ ID NO: 9131102 - DNA, 22 bp, Homo sapiens
agtatgtgtccccccaggagcc

SEQ ID NO: 9131103 - DNA, 22 bp, Homo sapiens
agtattaccctcagaacttgat

SEQ ID NO: 9131104 - DNA, 22 bp, Homo sapiens
ctaaggaacagatgtcagcaga

SEQ ID NO: 9131105 - DNA, 22 bp, Homo sapiens
ctaaggaatcctaaaacagctg

SEQ ID NO: 9131106 - DNA, 22 bp, Homo sapiens
agtatgtggcacagaatttctt

SEQ ID NO: 9131107 - DNA, 22 bp, Homo sapiens
agtatgtcagagtgaaaatggt

SEQ ID NO: 9131108 - DNA, 22 bp, Homo sapiens
agtatgggtgtagattctgcaa

SEQ ID NO: 9131109 - DNA, 22 bp, Homo sapiens
ctagaaatgctcaagagaaagt

SEQ ID NO: 9131110 - DNA, 22 bp, Homo sapiens
ctagaaattctgattcagtagg

SEQ ID NO: 9131111 - DNA, 22 bp, Homo sapiens
ctagaaatgtagattcttagtg

SEQ ID NO: 9131112 - DNA, 22 bp, Homo sapiens
ctacccagcacctaggctgcct

SEQ ID NO: 9131113 - DNA, 22 bp, Homo sapiens
ctacccacaaggctttgggcac

SEQ ID NO: 9131114 - DNA, 22 bp, Homo sapiens
ctaccagcttctttgtctggga

SEQ ID NO: 9131115 - DNA, 22 bp, Homo sapiens
ctaccacacacacgtcttagga

SEQ ID NO: 9131116 - DNA, 22 bp, Homo sapiens
ctaccactggctctgtgacttt

SEQ ID NO: 9131117 - DNA, 22 bp, Homo sapiens
ctacatttgttcaaataagctg

SEQ ID NO: 9131118 - DNA, 22 bp, Homo sapiens
ctagggtcaggggcctgcgtcg

SEQ ID NO: 9131119 - DNA, 22 bp, Homo sapiens
ctaggtgatccactgctctctt

SEQ ID NO: 9131120 - DNA, 22 bp, Homo sapiens
ctagggtggatttgtgcagagt

SEQ ID NO: 9131121 - DNA, 19 bp, Homo sapiens
agtccatgaatggaggatg

SEQ ID NO: 9131122 - DNA, 22 bp, Homo sapiens
ctaggtgatccactgctctctt

SEQ ID NO: 9131123 - DNA, 22 bp, Homo sapiens
ctagtaaatcagaagctgtggg

SEQ ID NO: 9131124 - DNA, 23 bp, Homo sapiens
ctagtaaatcctgaatagcaggc

SEQ ID NO: 9131125 - DNA, 22 bp, Homo sapiens
agtcccagctactcaagaggct

SEQ ID NO: 9131126 - DNA, 22 bp, Homo sapiens
agtcccagctactcaagaggct

SEQ ID NO: 9131127 - DNA, 22 bp, Homo sapiens
ctagaaggtctgggcctgggaa

SEQ ID NO: 9131128 - DNA, 22 bp, Homo sapiens
ctagaaggaagcccagcacttc

SEQ ID NO: 9131129 - DNA, 22 bp, Homo sapiens
ctagaaggtctgggcctgggaa

SEQ ID NO: 9131130 - DNA, 22 bp, Homo sapiens
agtccaggtggaccttggccag

SEQ ID NO: 9131131 - DNA, 22 bp, Homo sapiens
agtccaggtggaccttggccag

SEQ ID NO: 9131132 - DNA, 22 bp, Homo sapiens
agtccagggagcccaggctttg

SEQ ID NO: 9131133 - DNA, 22 bp, Homo sapiens
agtccaggctcttcctgaagaa

SEQ ID NO: 9131134 - DNA, 22 bp, Homo sapiens
agtccagggctctctgtgggat

SEQ ID NO: 9131135 - DNA, 22 bp, Homo sapiens
agtccagggctctctgtgggat

SEQ ID NO: 9131136 - DNA, 22 bp, Homo sapiens
agtccagggcttagtcagcggg

SEQ ID NO: 9131137 - DNA, 22 bp, Homo sapiens
agtccaggtctctgagtcacaa

SEQ ID NO: 9131138 - DNA, 22 bp, Homo sapiens
aggtaggatagataggaagacc

SEQ ID NO: 9131139 - DNA, 22 bp, Homo sapiens
aggtaggatgggtggagatgat

SEQ ID NO: 9131140 - DNA, 22 bp, Homo sapiens
cctgccagctgtgggccagcct

SEQ ID NO: 9131141 - DNA, 22 bp, Homo sapiens
cctgccagctgggtaccttcat

SEQ ID NO: 9131142 - DNA, 21 bp, Homo sapiens
cctgccaggaaactgagtgtc

SEQ ID NO: 9131143 - DNA, 21 bp, Homo sapiens
cctgccaggaaactgagtgtc

SEQ ID NO: 9131144 - DNA, 22 bp, Homo sapiens
aggtagggggtttgggaactgc

SEQ ID NO: 9131145 - DNA, 22 bp, Homo sapiens
aggtagggttaatggagatata

SEQ ID NO: 9131146 - DNA, 22 bp, Homo sapiens
aggtagggaagaaggcatgaaa

SEQ ID NO: 9131147 - DNA, 22 bp, Homo sapiens
aggtagggaagaaggcatgaaa

SEQ ID NO: 9131148 - DNA, 22 bp, Homo sapiens
aggtagggaagaaggcatgaaa

SEQ ID NO: 9131149 - DNA, 22 bp, Homo sapiens
aggtagggaagaaggcatgaaa

SEQ ID NO: 9131150 - DNA, 22 bp, Homo sapiens
cctgccagcatcttcagcccct

SEQ ID NO: 9131151 - DNA, 22 bp, Homo sapiens
cctgccagcatggcttatctcc

SEQ ID NO: 9131152 - DNA, 22 bp, Homo sapiens
cctgccagatcccctgagctga

SEQ ID NO: 9131153 - DNA, 22 bp, Homo sapiens
cctgccagcatcttcagcccct

SEQ ID NO: 9131154 - DNA, 22 bp, Homo sapiens
cctgccagatcccctgagctga

SEQ ID NO: 9131155 - DNA, 23 bp, Homo sapiens
cctgcagctgctggggctccacc

SEQ ID NO: 9131156 - DNA, 23 bp, Homo sapiens
cctgcagctgccacgccctgctc

SEQ ID NO: 9131157 - DNA, 22 bp, Homo sapiens
cctgcagctccggatttctggg

SEQ ID NO: 9131158 - DNA, 22 bp, Homo sapiens
cctgcagcagctgaaatcacag

SEQ ID NO: 9131159 - DNA, 21 bp, Homo sapiens
cctgcagcaccagaaggagat

SEQ ID NO: 9131160 - DNA, 21 bp, Homo sapiens
cctgcagcaccagaaggagat

SEQ ID NO: 9131161 - DNA, 18 bp, Homo sapiens
cctgcagcccaggaggcc

SEQ ID NO: 9131162 - DNA, 18 bp, Homo sapiens
cctgcagcccaggaggcc

SEQ ID NO: 9131163 - DNA, 22 bp, Homo sapiens
cctgcagagggactggcaggaa

SEQ ID NO: 9131164 - DNA, 22 bp, Homo sapiens
cctgcagaccacactcagtcct

SEQ ID NO: 9131165 - DNA, 22 bp, Homo sapiens
cctgagtcttcccaaaactcct

SEQ ID NO: 9131166 - DNA, 22 bp, Homo sapiens
aggtcccaggcatagctggtct

SEQ ID NO: 9131167 - DNA, 21 bp, Homo sapiens
aggtcccaggtttgggcagca

SEQ ID NO: 9131168 - DNA, 22 bp, Homo sapiens
aggtccctaatcatttcacttt

SEQ ID NO: 9131169 - DNA, 22 bp, Homo sapiens
aggtccctaatcatttcacttt

SEQ ID NO: 9131170 - DNA, 21 bp, Homo sapiens
aggtccctaattaattgacct

SEQ ID NO: 9131171 - DNA, 21 bp, Homo sapiens
aggtccctaattaattgacct

SEQ ID NO: 9131172 - DNA, 22 bp, Homo sapiens
aggtccctacttatctgaaggc

SEQ ID NO: 9131173 - DNA, 22 bp, Homo sapiens
aggtccctaggagagtaggaag

SEQ ID NO: 9131174 - DNA, 21 bp, Homo sapiens
aggtcccaggtttgggcagca

SEQ ID NO: 9131175 - DNA, 22 bp, Homo sapiens
aggtccctgcagcagactgcca

SEQ ID NO: 9131176 - DNA, 22 bp, Homo sapiens
aggtccctgcagcagactgcca

SEQ ID NO: 9131177 - DNA, 22 bp, Homo sapiens
aggtccctgcaaagctattcag

SEQ ID NO: 9131178 - DNA, 23 bp, Homo sapiens
aggtccctgagtcttcaaaggat

SEQ ID NO: 9131179 - DNA, 22 bp, Homo sapiens
aggtccctggctagcactggaa

SEQ ID NO: 9131180 - DNA, 22 bp, Homo sapiens
aggtccctggctagcactggaa

SEQ ID NO: 9131181 - DNA, 22 bp, Homo sapiens
aggtccctggctagcactggaa

SEQ ID NO: 9131182 - DNA, 22 bp, Homo sapiens
aggtccctggtaattgacacac

SEQ ID NO: 9131183 - DNA, 22 bp, Homo sapiens
aggtccctgggacagggcgatt

SEQ ID NO: 9131184 - DNA, 22 bp, Homo sapiens
aggtccctgggacagggcgatt

SEQ ID NO: 9131185 - DNA, 22 bp, Homo sapiens
aggtccctcgcacatgcagggt

SEQ ID NO: 9131186 - DNA, 22 bp, Homo sapiens
aggtccctgagtcagcggcgct

SEQ ID NO: 9131187 - DNA, 22 bp, Homo sapiens
aggtccctgagtcagcggcgct

SEQ ID NO: 9131188 - DNA, 22 bp, Homo sapiens
aggtccctcgcacatgcagggt

SEQ ID NO: 9131189 - DNA, 22 bp, Homo sapiens
aggtccctcgcacatgcagggt

SEQ ID NO: 9131190 - DNA, 22 bp, Homo sapiens
aggtccctaggagagtaggaag

SEQ ID NO: 9131191 - DNA, 22 bp, Homo sapiens
aggtccctcagaggcctcaccg

SEQ ID NO: 9131192 - DNA, 19 bp, Homo sapiens
aggtccctccctcgaggct

SEQ ID NO: 9131193 - DNA, 19 bp, Homo sapiens
aggtccctgtcacctctca

SEQ ID NO: 9131194 - DNA, 22 bp, Homo sapiens
aggtcctgaagattttactaga

SEQ ID NO: 9131195 - DNA, 22 bp, Homo sapiens
aggtcctgacgccctttgaaat

SEQ ID NO: 9131196 - DNA, 22 bp, Homo sapiens
aggtcctgactccacgttctag

SEQ ID NO: 9131197 - DNA, 22 bp, Homo sapiens
aggtcctgactccacgttctag

SEQ ID NO: 9131198 - DNA, 22 bp, Homo sapiens
aggtcctgagggttcgtctgca

SEQ ID NO: 9131199 - DNA, 19 bp, Homo sapiens
cctggctctgagcccagcc

SEQ ID NO: 9131200 - DNA, 22 bp, Homo sapiens
cctggctctgcagccactccag

SEQ ID NO: 9131201 - DNA, 22 bp, Homo sapiens
cctggctctgcagccactccag

SEQ ID NO: 9131202 - DNA, 22 bp, Homo sapiens
cctggctctgcagccactccag

SEQ ID NO: 9131203 - DNA, 22 bp, Homo sapiens
cctggctctgaggtatgcctgg

SEQ ID NO: 9131204 - DNA, 22 bp, Homo sapiens
cctggctctgccacttactgcc

SEQ ID NO: 9131205 - DNA, 22 bp, Homo sapiens
cctggctctgcagccactccag

SEQ ID NO: 9131206 - DNA, 22 bp, Homo sapiens
cctggctctgccgtaaccacca

SEQ ID NO: 9131207 - DNA, 22 bp, Homo sapiens
cctggctctgccgtaaccacca

SEQ ID NO: 9131208 - DNA, 22 bp, Homo sapiens
cctggctctgccgtaaccacca

SEQ ID NO: 9131209 - DNA, 22 bp, Homo sapiens
cctggattataggccctctgaa

SEQ ID NO: 9131210 - DNA, 22 bp, Homo sapiens
cctggattcaagtctttctttc

SEQ ID NO: 9131211 - DNA, 22 bp, Homo sapiens
cctggattctgctggccacttt

SEQ ID NO: 9131212 - DNA, 22 bp, Homo sapiens
cctggattctcactggactcca

SEQ ID NO: 9131213 - DNA, 22 bp, Homo sapiens
cctggattcaagtgtctattcc

SEQ ID NO: 9131214 - DNA, 22 bp, Homo sapiens
cctggattggctgcccatgctc

SEQ ID NO: 9131215 - DNA, 18 bp, Homo sapiens
cctggcacactggctcat

SEQ ID NO: 9131216 - DNA, 19 bp, Homo sapiens
cctggagtcgcgctgcctc

SEQ ID NO: 9131217 - DNA, 19 bp, Homo sapiens
cctggagtcgcgctgcctc

SEQ ID NO: 9131218 - DNA, 19 bp, Homo sapiens
cctggagtcgcgctgcctc

SEQ ID NO: 9131219 - DNA, 22 bp, Homo sapiens
cctggagtctgtgactttcctc

SEQ ID NO: 9131220 - DNA, 22 bp, Homo sapiens
cctggagtctgtgactttcctc

SEQ ID NO: 9131221 - DNA, 22 bp, Homo sapiens
cctggagtaccgtggccatcca

SEQ ID NO: 9131222 - DNA, 23 bp, Homo sapiens
cctggagtactaaggggatggaa

SEQ ID NO: 9131223 - DNA, 23 bp, Homo sapiens
cctggagtactaaggggatggaa

SEQ ID NO: 9131224 - DNA, 22 bp, Homo sapiens
cctggaggtggaggttgcagtg

SEQ ID NO: 9131225 - DNA, 22 bp, Homo sapiens
cctggaggtggaggttgcagtg

SEQ ID NO: 9131226 - DNA, 22 bp, Homo sapiens
cctggaggtggaggttgcagtg

SEQ ID NO: 9131227 - DNA, 18 bp, Homo sapiens
cctggagtgtgttaggct

SEQ ID NO: 9131228 - DNA, 22 bp, Homo sapiens
cctggagttgaaggaaggtggg

SEQ ID NO: 9131229 - DNA, 22 bp, Homo sapiens
cctggagtgacaggtgtagcct

SEQ ID NO: 9131230 - DNA, 22 bp, Homo sapiens
cctggagtggggtccgtgcatg

SEQ ID NO: 9131231 - DNA, 22 bp, Homo sapiens
cctggagttttttggttgactc

SEQ ID NO: 9131232 - DNA, 22 bp, Homo sapiens
cctggatagctactggccaggc

SEQ ID NO: 9131233 - DNA, 22 bp, Homo sapiens
aggtggggccaaatgctacagt

SEQ ID NO: 9131234 - DNA, 21 bp, Homo sapiens
aggtggggctgcacctctgct

SEQ ID NO: 9131235 - DNA, 21 bp, Homo sapiens
aggtggggctgcacctctgct

SEQ ID NO: 9131236 - DNA, 21 bp, Homo sapiens
aggtggggctgcacctctgct

SEQ ID NO: 9131237 - DNA, 22 bp, Homo sapiens
aggtggggaggagtgtctcttt

SEQ ID NO: 9131238 - DNA, 22 bp, Homo sapiens
aggtggggaggagtgtctcttt

SEQ ID NO: 9131239 - DNA, 22 bp, Homo sapiens
aggtggggaggagtgtctcttt

SEQ ID NO: 9131240 - DNA, 22 bp, Homo sapiens
cctgtgcattgaccacactctc

SEQ ID NO: 9131241 - DNA, 20 bp, Homo sapiens
cctgtctcctcttacctggc

SEQ ID NO: 9131242 - DNA, 22 bp, Homo sapiens
cctgtgaggtcttgcatgtgaa

SEQ ID NO: 9131243 - DNA, 22 bp, Homo sapiens
cctgtgagagggcgagtgtaga

SEQ ID NO: 9131244 - DNA, 22 bp, Homo sapiens
cctgtcccccaggcctgtacca

SEQ ID NO: 9131245 - DNA, 22 bp, Homo sapiens
cctgtcatatacatacctcctc

SEQ ID NO: 9131246 - DNA, 20 bp, Homo sapiens
cctgtcatcccagcattttg

SEQ ID NO: 9131247 - DNA, 22 bp, Homo sapiens
cctgtccagggactgagggaga

SEQ ID NO: 9131248 - DNA, 20 bp, Homo sapiens
cctgtctcacgttccgcccc

SEQ ID NO: 9131249 - DNA, 22 bp, Homo sapiens
cctgtctccctggcatggctca

SEQ ID NO: 9131250 - DNA, 20 bp, Homo sapiens
cctgtctcacgttccgcccc

SEQ ID NO: 9131251 - DNA, 22 bp, Homo sapiens
cctgggctcacagccaaggctc

SEQ ID NO: 9131252 - DNA, 22 bp, Homo sapiens
cctgggctcaccatgccttgga

SEQ ID NO: 9131253 - DNA, 22 bp, Homo sapiens
cctgggctcacagccaaggctc

SEQ ID NO: 9131254 - DNA, 22 bp, Homo sapiens
cctgggctcaagtgatggtccc

SEQ ID NO: 9131255 - DNA, 22 bp, Homo sapiens
cctgggctcaagtgatggtccc

SEQ ID NO: 9131256 - DNA, 22 bp, Homo sapiens
cctgggctccactccaagagca

SEQ ID NO: 9131257 - DNA, 22 bp, Homo sapiens
cctgggctccactccaagagca

SEQ ID NO: 9131258 - DNA, 22 bp, Homo sapiens
cctgggctcaccatgccttgga

SEQ ID NO: 9131259 - DNA, 22 bp, Homo sapiens
cctgggctcaggcttgggcagc

SEQ ID NO: 9131260 - DNA, 22 bp, Homo sapiens
cctgggctcaggcttgggcagc

SEQ ID NO: 9131261 - DNA, 22 bp, Homo sapiens
cctgggctcaggcttgggcagc

SEQ ID NO: 9131262 - DNA, 22 bp, Homo sapiens
cctggctctgcgtgcagctccg

SEQ ID NO: 9131263 - DNA, 22 bp, Homo sapiens
cctggctctgcgtgcagctccg

SEQ ID NO: 9131264 - DNA, 22 bp, Homo sapiens
cctggctctggtgaggagaagt

SEQ ID NO: 9131265 - DNA, 22 bp, Homo sapiens
cctggctctggttccctcagct

SEQ ID NO: 9131266 - DNA, 22 bp, Homo sapiens
cctggctctggggcggacagct

SEQ ID NO: 9131267 - DNA, 22 bp, Homo sapiens
cctggctctgggatcttcgctt

SEQ ID NO: 9131268 - DNA, 22 bp, Homo sapiens
cctggctctggttccctcagct

SEQ ID NO: 9131269 - DNA, 22 bp, Homo sapiens
cctggctctggttccctcagct

SEQ ID NO: 9131270 - DNA, 22 bp, Homo sapiens
cctggctctggttccctcagct

SEQ ID NO: 9131271 - DNA, 22 bp, Homo sapiens
cctgggctttcaaaaccagcct

SEQ ID NO: 9131272 - DNA, 22 bp, Homo sapiens
cctgggctttcggcggcttcct

SEQ ID NO: 9131273 - DNA, 22 bp, Homo sapiens
cctgggctttcggcggcttcct

SEQ ID NO: 9131274 - DNA, 22 bp, Homo sapiens
cctgggctttcggcggcttcct

SEQ ID NO: 9131275 - DNA, 22 bp, Homo sapiens
cctgtcagggtttgcctcagaa

SEQ ID NO: 9131276 - DNA, 22 bp, Homo sapiens
cctgtcagttgctgtcagggat

SEQ ID NO: 9131277 - DNA, 22 bp, Homo sapiens
cctgtcagggtttgcctcagaa

SEQ ID NO: 9131278 - DNA, 22 bp, Homo sapiens
cctgggcttggttgttgagaac

SEQ ID NO: 9131279 - DNA, 22 bp, Homo sapiens
cctgggcttggttgttgagaac

SEQ ID NO: 9131280 - DNA, 22 bp, Homo sapiens
cctgggcttggttgttgagaac

SEQ ID NO: 9131281 - DNA, 22 bp, Homo sapiens
cctgggcttgcatctgtgctgg

SEQ ID NO: 9131282 - DNA, 22 bp, Homo sapiens
cctgggcttctgtctagatgtt

SEQ ID NO: 9131283 - DNA, 22 bp, Homo sapiens
cctgggcttctgtctagatgtt

SEQ ID NO: 9131284 - DNA, 22 bp, Homo sapiens
cctgggctcgcgcacttcaccc

SEQ ID NO: 9131285 - DNA, 22 bp, Homo sapiens
cctgggcttctgtctagatgtt

SEQ ID NO: 9131286 - DNA, 20 bp, Homo sapiens
cctgggctccaggagccccg

SEQ ID NO: 9131287 - DNA, 22 bp, Homo sapiens
ctgaaatatagatgtgaacagt

SEQ ID NO: 9131288 - DNA, 22 bp, Homo sapiens
ctgaaatatagatgtgaacagt

SEQ ID NO: 9131289 - DNA, 23 bp, Homo sapiens
ctgaaataccagaaaatcagtgt

SEQ ID NO: 9131290 - DNA, 22 bp, Homo sapiens
ctgaaatagtttcatagaactt

SEQ ID NO: 9131291 - DNA, 22 bp, Homo sapiens
ctgaaatattttaatctcagga

SEQ ID NO: 9131292 - DNA, 22 bp, Homo sapiens
ctgaaatattttaatctcagga

SEQ ID NO: 9131293 - DNA, 17 bp, Homo sapiens
ctgaaatattatgataa

SEQ ID NO: 9131294 - DNA, 17 bp, Homo sapiens
ctgaaatattatgataa

SEQ ID NO: 9131295 - DNA, 22 bp, Homo sapiens
ctgaaatgacggtttggggcaa

SEQ ID NO: 9131296 - DNA, 22 bp, Homo sapiens
ctgaaatgggcaaaagtagatt

SEQ ID NO: 9131297 - DNA, 22 bp, Homo sapiens
ctgaaatgggcaaaagtagatt

SEQ ID NO: 9131298 - DNA, 23 bp, Homo sapiens
ctgaaataccagaaaatcagtgt

SEQ ID NO: 9131299 - DNA, 22 bp, Homo sapiens
ctgaaataaagttgctaaaatt

SEQ ID NO: 9131300 - DNA, 22 bp, Homo sapiens
ctgaaataaagttgctaaaatt

SEQ ID NO: 9131301 - DNA, 23 bp, Homo sapiens
ctgaaataccagaaaatcagtgt

SEQ ID NO: 9131302 - DNA, 23 bp, Homo sapiens
ctgaaataccagaaaatcagtgt

SEQ ID NO: 9131303 - DNA, 22 bp, Homo sapiens
ctgaaaggcagtgggtagtgtg

SEQ ID NO: 9131304 - DNA, 22 bp, Homo sapiens
ctctggggtggaggaggctgac

SEQ ID NO: 9131305 - DNA, 22 bp, Homo sapiens
ctctggggtggaggaggctgac

SEQ ID NO: 9131306 - DNA, 22 bp, Homo sapiens
ctctggggtggaggaggctgac

SEQ ID NO: 9131307 - DNA, 22 bp, Homo sapiens
ctctttggttaatcacacagat

SEQ ID NO: 9131308 - DNA, 22 bp, Homo sapiens
ctctggggttaagcttccatgg

SEQ ID NO: 9131309 - DNA, 22 bp, Homo sapiens
ctctgggcttgttgacctgcac

SEQ ID NO: 9131310 - DNA, 22 bp, Homo sapiens
ctctggggaagcagccagctgg

SEQ ID NO: 9131311 - DNA, 22 bp, Homo sapiens
ctctggggaagcagccagctgg

SEQ ID NO: 9131312 - DNA, 22 bp, Homo sapiens
ctctgggaagggctgagcactg

SEQ ID NO: 9131313 - DNA, 22 bp, Homo sapiens
ctctgggaattctgagcaagca

SEQ ID NO: 9131314 - DNA, 22 bp, Homo sapiens
ctctgggaagtggagacttcag

SEQ ID NO: 9131315 - DNA, 22 bp, Homo sapiens
ctctggctttcccagggaggag

SEQ ID NO: 9131316 - DNA, 22 bp, Homo sapiens
ctctgggctgccttttagctct

SEQ ID NO: 9131317 - DNA, 19 bp, Homo sapiens
ctctgggctgcatcttggt

SEQ ID NO: 9131318 - DNA, 22 bp, Homo sapiens
ctctgggcttacctgcttcctg

SEQ ID NO: 9131319 - DNA, 22 bp, Homo sapiens
ctctgggcttacctgcttcctg

SEQ ID NO: 9131320 - DNA, 20 bp, Homo sapiens
ctctgggctgcgttgcaaac

SEQ ID NO: 9131321 - DNA, 22 bp, Homo sapiens
ctctgggcttcctttgtgggtt

SEQ ID NO: 9131322 - DNA, 22 bp, Homo sapiens
ctctgggcttcaagtcagattt

SEQ ID NO: 9131323 - DNA, 22 bp, Homo sapiens
ctctgggactagaaccccaggg

SEQ ID NO: 9131324 - DNA, 22 bp, Homo sapiens
ctctgcctgtctcatcctgcaa

SEQ ID NO: 9131325 - DNA, 22 bp, Homo sapiens
ctctgcctgccactgttcaggc

SEQ ID NO: 9131326 - DNA, 22 bp, Homo sapiens
ctctgcagtgtaacagcgcttg

SEQ ID NO: 9131327 - DNA, 22 bp, Homo sapiens
ctctggattgctgtgagatgct

SEQ ID NO: 9131328 - DNA, 22 bp, Homo sapiens
ctctggatctgccctgacgcca

SEQ ID NO: 9131329 - DNA, 22 bp, Homo sapiens
ctctgctgatctcagctgggct

SEQ ID NO: 9131330 - DNA, 22 bp, Homo sapiens
ctctgctgatctcagctgggct

SEQ ID NO: 9131331 - DNA, 22 bp, Homo sapiens
ctctgctgatctcagctgggct

SEQ ID NO: 9131332 - DNA, 21 bp, Homo sapiens
ctctgctgagtcctaggattc

SEQ ID NO: 9131333 - DNA, 21 bp, Homo sapiens
ctctgctgagtcctaggattc

SEQ ID NO: 9131334 - DNA, 22 bp, Homo sapiens
ctctgctcaccagccatgtgat

SEQ ID NO: 9131335 - DNA, 22 bp, Homo sapiens
ctctgctgagccagagtcccca

SEQ ID NO: 9131336 - DNA, 22 bp, Homo sapiens
ctctgcgccaccctcgcctgct

SEQ ID NO: 9131337 - DNA, 22 bp, Homo sapiens
ctctcaggcttgggtcgtggca

SEQ ID NO: 9131338 - DNA, 22 bp, Homo sapiens
ctctcaggcttgggtcgtggca

SEQ ID NO: 9131339 - DNA, 22 bp, Homo sapiens
ctctcagggtccctgcggagga

SEQ ID NO: 9131340 - DNA, 17 bp, Homo sapiens
ctctgcagtgcatggct

SEQ ID NO: 9131341 - DNA, 17 bp, Homo sapiens
ctctgcagtgcatggct

SEQ ID NO: 9131342 - DNA, 22 bp, Homo sapiens
ctctgcaggccttgagtgtggt

SEQ ID NO: 9131343 - DNA, 22 bp, Homo sapiens
ctctgcaggggaggcatgcact

SEQ ID NO: 9131344 - DNA, 21 bp, Homo sapiens
ctctgcagccctgcttccagg

SEQ ID NO: 9131345 - DNA, 22 bp, Homo sapiens
ctctgcaggcctgtgaagggtg

SEQ ID NO: 9131346 - DNA, 22 bp, Homo sapiens
ctctgcaggcacccagggtggg

SEQ ID NO: 9131347 - DNA, 22 bp, Homo sapiens
ctctgcaggcacccagggtggg

SEQ ID NO: 9131348 - DNA, 22 bp, Homo sapiens
agtgtctgctttgagtcaggtg

SEQ ID NO: 9131349 - DNA, 22 bp, Homo sapiens
agtgtctgctttgagtcaggtg

SEQ ID NO: 9131350 - DNA, 22 bp, Homo sapiens
agtgtctgcttatcagttcttg

SEQ ID NO: 9131351 - DNA, 22 bp, Homo sapiens
ctgaagctttacttcaaataca

SEQ ID NO: 9131352 - DNA, 22 bp, Homo sapiens
ctgaatgaggaaaagagtgagg

SEQ ID NO: 9131353 - DNA, 22 bp, Homo sapiens
ctgaatgaaatcaaggactgag

SEQ ID NO: 9131354 - DNA, 22 bp, Homo sapiens
agtgtctgctaggttcatcaac

SEQ ID NO: 9131355 - DNA, 22 bp, Homo sapiens
agtgtctgcctgggaggagcat

SEQ ID NO: 9131356 - DNA, 22 bp, Homo sapiens
ctgaaattctgcctctgcacaa

SEQ ID NO: 9131357 - DNA, 22 bp, Homo sapiens
ctgaaatgttaaatacttggct

SEQ ID NO: 9131358 - DNA, 22 bp, Homo sapiens
ctgaaatggttgcctggagaat

SEQ ID NO: 9131359 - DNA, 22 bp, Homo sapiens
ctgaaatggttgcctggagaat

SEQ ID NO: 9131360 - DNA, 22 bp, Homo sapiens
ctgaaatggttgcctggagaat

SEQ ID NO: 9131361 - DNA, 22 bp, Homo sapiens
ctgagaaaagacatttctagat

SEQ ID NO: 9131362 - DNA, 22 bp, Homo sapiens
ctgacttttttcagccacagtg

SEQ ID NO: 9131363 - DNA, 22 bp, Homo sapiens
ctgagaaaagctttcttataca

SEQ ID NO: 9131364 - DNA, 22 bp, Homo sapiens
ctgagaaaagtatgagctctgg

SEQ ID NO: 9131365 - DNA, 22 bp, Homo sapiens
ctgactttgacttggtcattga

SEQ ID NO: 9131366 - DNA, 22 bp, Homo sapiens
ctgactttagaacccaaaaagt

SEQ ID NO: 9131367 - DNA, 22 bp, Homo sapiens
ctgactttagaacccaaaaagt

SEQ ID NO: 9131368 - DNA, 22 bp, Homo sapiens
ctgacttttccaaataatactt

SEQ ID NO: 9131369 - DNA, 22 bp, Homo sapiens
ctgactttgctcataggtcaaa

SEQ ID NO: 9131370 - DNA, 22 bp, Homo sapiens
ctgactttgacttggtcattga

SEQ ID NO: 9131371 - DNA, 22 bp, Homo sapiens
ctgacttgcctaggtcattgtg

SEQ ID NO: 9131372 - DNA, 22 bp, Homo sapiens
ctgactttgctcataggtcaaa

SEQ ID NO: 9131373 - DNA, 22 bp, Homo sapiens
ctgacttttttcagccacagtg

SEQ ID NO: 9131374 - DNA, 22 bp, Homo sapiens
ctgactttgctcataggtcaaa

SEQ ID NO: 9131375 - DNA, 22 bp, Homo sapiens
ctgacttttccaaataatactt

SEQ ID NO: 9131376 - DNA, 22 bp, Homo sapiens
ctgacaaaccactgctccagct

SEQ ID NO: 9131377 - DNA, 22 bp, Homo sapiens
ctgacaaaggcaaggcaggggg

SEQ ID NO: 9131378 - DNA, 22 bp, Homo sapiens
ctgacaaaggcaaggcaggggg

SEQ ID NO: 9131379 - DNA, 22 bp, Homo sapiens
ctgaatgatataagatctttct

SEQ ID NO: 9131380 - DNA, 22 bp, Homo sapiens
ctgaattaatacacagaatggc

SEQ ID NO: 9131381 - DNA, 18 bp, Homo sapiens
ctgaattatctcatcatt

SEQ ID NO: 9131382 - DNA, 22 bp, Homo sapiens
ctgaggagagatcacgtggtgt

SEQ ID NO: 9131383 - DNA, 22 bp, Homo sapiens
ctgaggagagatcacgtggtgt

SEQ ID NO: 9131384 - DNA, 22 bp, Homo sapiens
ctgaggagacagaagccaaata

SEQ ID NO: 9131385 - DNA, 22 bp, Homo sapiens
ctgaggagacagaagccaaata

SEQ ID NO: 9131386 - DNA, 22 bp, Homo sapiens
ctgaggagaccatcaactaatt

SEQ ID NO: 9131387 - DNA, 22 bp, Homo sapiens
ctgaggagaccatcaactaatt

SEQ ID NO: 9131388 - DNA, 22 bp, Homo sapiens
ctgaggagaggtggcctgtgtt

SEQ ID NO: 9131389 - DNA, 22 bp, Homo sapiens
ctgaggagaggtggcctgtgtt

SEQ ID NO: 9131390 - DNA, 22 bp, Homo sapiens
ctgagctgggactcagtagcaa

SEQ ID NO: 9131391 - DNA, 22 bp, Homo sapiens
ctgagcagccccaccagccatt

SEQ ID NO: 9131392 - DNA, 22 bp, Homo sapiens
ctgaggagaacaatgagatcaa

SEQ ID NO: 9131393 - DNA, 22 bp, Homo sapiens
ctgaggagaacaatgagatcaa

SEQ ID NO: 9131394 - DNA, 22 bp, Homo sapiens
ctgaggagaacaatgagatcaa

SEQ ID NO: 9131395 - DNA, 17 bp, Homo sapiens
ctgaggagaacagaaag

SEQ ID NO: 9131396 - DNA, 17 bp, Homo sapiens
ctgaggagaacagaaag

SEQ ID NO: 9131397 - DNA, 17 bp, Homo sapiens
ctgaggagaacagaaag

SEQ ID NO: 9131398 - DNA, 22 bp, Homo sapiens
ctgagcagcaattgctggccca

SEQ ID NO: 9131399 - DNA, 22 bp, Homo sapiens
ctgagcagcaacccagagcctc

SEQ ID NO: 9131400 - DNA, 22 bp, Homo sapiens
ctgagcagcacagggcgccagg

SEQ ID NO: 9131401 - DNA, 22 bp, Homo sapiens
ctgagcagcaccttcaagaaac

SEQ ID NO: 9131402 - DNA, 22 bp, Homo sapiens
ctgagcagcaacccagagcctc

SEQ ID NO: 9131403 - DNA, 22 bp, Homo sapiens
ctgagcagaggtcaagatactt

SEQ ID NO: 9131404 - DNA, 22 bp, Homo sapiens
agttatataactatctagatgc

SEQ ID NO: 9131405 - DNA, 22 bp, Homo sapiens
agttagtatgcattaccctcca

SEQ ID NO: 9131406 - DNA, 22 bp, Homo sapiens
agttataatctgctactgatat

SEQ ID NO: 9131407 - DNA, 22 bp, Homo sapiens
agttatataactatctagatgc

SEQ ID NO: 9131408 - DNA, 22 bp, Homo sapiens
agttagaatggatgttgagagc

SEQ ID NO: 9131409 - DNA, 21 bp, Homo sapiens
agttagcagatttctgtctcc

SEQ ID NO: 9131410 - DNA, 22 bp, Homo sapiens
agttagcagcttattagaaaca

SEQ ID NO: 9131411 - DNA, 22 bp, Homo sapiens
agttagcaaataccacaatctg

SEQ ID NO: 9131412 - DNA, 22 bp, Homo sapiens
agttagagacacatgcacatgc

SEQ ID NO: 9131413 - DNA, 22 bp, Homo sapiens
agttagagacacatgcacatgc

SEQ ID NO: 9131414 - DNA, 22 bp, Homo sapiens
agttagtacaagaaagatgaac

SEQ ID NO: 9131415 - DNA, 20 bp, Homo sapiens
agttagcaggtgctggtgtc

SEQ ID NO: 9131416 - DNA, 22 bp, Homo sapiens
agttagcgatgtaaaataacaa

SEQ ID NO: 9131417 - DNA, 22 bp, Homo sapiens
agttagcatctcctccagtcta

SEQ ID NO: 9131418 - DNA, 22 bp, Homo sapiens
agttaactcattttataatgcc

SEQ ID NO: 9131419 - DNA, 22 bp, Homo sapiens
agttaaggataccaggccaaaa

SEQ ID NO: 9131420 - DNA, 22 bp, Homo sapiens
agttaaggatggctggaggcgt

SEQ ID NO: 9131421 - DNA, 22 bp, Homo sapiens
agtcttaggctccattagtaga

SEQ ID NO: 9131422 - DNA, 22 bp, Homo sapiens
agtcttatggttaaatagatgc

SEQ ID NO: 9131423 - DNA, 22 bp, Homo sapiens
agtcttatggttaaatagatgc

SEQ ID NO: 9131424 - DNA, 22 bp, Homo sapiens
agtcttatggttaaatagatgc

SEQ ID NO: 9131425 - DNA, 22 bp, Homo sapiens
agtcttatatcactatgctctg

SEQ ID NO: 9131426 - DNA, 22 bp, Homo sapiens
agtcttatgtttgtgaagaact

SEQ ID NO: 9131427 - DNA, 22 bp, Homo sapiens
agtcttcagagaaattaactct

SEQ ID NO: 9131428 - DNA, 22 bp, Homo sapiens
ctccagagatccattgaatgta

SEQ ID NO: 9131429 - DNA, 22 bp, Homo sapiens
ctccagagagtccagctctggg

SEQ ID NO: 9131430 - DNA, 22 bp, Homo sapiens
ctccagagccagtgcttttcca

SEQ ID NO: 9131431 - DNA, 22 bp, Homo sapiens
ctccagctcttaactgcggaag

SEQ ID NO: 9131432 - DNA, 22 bp, Homo sapiens
ctccagctcttaactgcggaag

SEQ ID NO: 9131433 - DNA, 22 bp, Homo sapiens
ctccagctcgcgagctctgctc

SEQ ID NO: 9131434 - DNA, 22 bp, Homo sapiens
ctccagctcgcgagctctgctc

SEQ ID NO: 9131435 - DNA, 20 bp, Homo sapiens
agtcttcccccagaagaggg

SEQ ID NO: 9131436 - DNA, 22 bp, Homo sapiens
agtcttcccagaggaggtgcca

SEQ ID NO: 9131437 - DNA, 22 bp, Homo sapiens
ctccagcttccctcagctgtgg

SEQ ID NO: 9131438 - DNA, 22 bp, Homo sapiens
ctccagcttccctcagctgtgg

SEQ ID NO: 9131439 - DNA, 22 bp, Homo sapiens
ctccagctgctggtctgagact

SEQ ID NO: 9131440 - DNA, 22 bp, Homo sapiens
ctccagctgccaccagatgttt

SEQ ID NO: 9131441 - DNA, 22 bp, Homo sapiens
ctccagctgccaccagatgttt

SEQ ID NO: 9131442 - DNA, 22 bp, Homo sapiens
ctccaggaaagcctgaggcccg

SEQ ID NO: 9131443 - DNA, 22 bp, Homo sapiens
ctccaggaaagcctgaggcccg

SEQ ID NO: 9131444 - DNA, 22 bp, Homo sapiens
ctccaggaaagcctgaggcccg

SEQ ID NO: 9131445 - DNA, 22 bp, Homo sapiens
ctccagctttttcccagttggc

SEQ ID NO: 9131446 - DNA, 22 bp, Homo sapiens
ctccagctttttcccagttggc

SEQ ID NO: 9131447 - DNA, 22 bp, Homo sapiens
ctccagctttagctctccaggg

SEQ ID NO: 9131448 - DNA, 22 bp, Homo sapiens
ctccagctttagctctccaggg

SEQ ID NO: 9131449 - DNA, 22 bp, Homo sapiens
ctccaggctcgtccaagatcga

SEQ ID NO: 9131450 - DNA, 22 bp, Homo sapiens
ctccaggctggggtgcaggttg

SEQ ID NO: 9131451 - DNA, 22 bp, Homo sapiens
ctccaggctggggtgcaggttg

SEQ ID NO: 9131452 - DNA, 22 bp, Homo sapiens
ctccaggctggggtgcaggttg

SEQ ID NO: 9131453 - DNA, 22 bp, Homo sapiens
ctccaggctggggtgcaggttg

SEQ ID NO: 9131454 - DNA, 22 bp, Homo sapiens
ctccaggaacagcaccctgctg

SEQ ID NO: 9131455 - DNA, 22 bp, Homo sapiens
ctccaggaacagcaccctgctg

SEQ ID NO: 9131456 - DNA, 22 bp, Homo sapiens
agtccctggattgtctctgtca

SEQ ID NO: 9131457 - DNA, 22 bp, Homo sapiens
agtccctggattgtctctgtca

SEQ ID NO: 9131458 - DNA, 22 bp, Homo sapiens
agtccctccaacacagtattag

SEQ ID NO: 9131459 - DNA, 22 bp, Homo sapiens
agtccccctctgagcccaggga

SEQ ID NO: 9131460 - DNA, 22 bp, Homo sapiens
agtccgtttctccttgaaggca

SEQ ID NO: 9131461 - DNA, 22 bp, Homo sapiens
agtccctgtactttccactgcc

SEQ ID NO: 9131462 - DNA, 22 bp, Homo sapiens
agtcccttgagggagtactgtt

SEQ ID NO: 9131463 - DNA, 22 bp, Homo sapiens
agtccctgtactttccactgcc

SEQ ID NO: 9131464 - DNA, 22 bp, Homo sapiens
agtcctgatgctctggcaggag

SEQ ID NO: 9131465 - DNA, 22 bp, Homo sapiens
agtcctgatgctctggcaggag

SEQ ID NO: 9131466 - DNA, 22 bp, Homo sapiens
agtcctggcatataggtcctca

SEQ ID NO: 9131467 - DNA, 22 bp, Homo sapiens
ctcattgcccagatccccacag

SEQ ID NO: 9131468 - DNA, 22 bp, Homo sapiens
ctcattgcaacctccgcctccc

SEQ ID NO: 9131469 - DNA, 22 bp, Homo sapiens
ctcatggcagagtcacctgtcc

SEQ ID NO: 9131470 - DNA, 20 bp, Homo sapiens
ctcatgtggcaccaggcact

SEQ ID NO: 9131471 - DNA, 22 bp, Homo sapiens
ctcatgtcggcaggactcgccc

SEQ ID NO: 9131472 - DNA, 22 bp, Homo sapiens
ctcatgcccagagccactgttg

SEQ ID NO: 9131473 - DNA, 22 bp, Homo sapiens
agtcctggctctacgggcttca

SEQ ID NO: 9131474 - DNA, 19 bp, Homo sapiens
agtcctggcctgggggacc

SEQ ID NO: 9131475 - DNA, 22 bp, Homo sapiens
ctcctggctttcccagaccagg

SEQ ID NO: 9131476 - DNA, 18 bp, Homo sapiens
ctcctggctgatggtgag

SEQ ID NO: 9131477 - DNA, 22 bp, Homo sapiens
ctcctggcttctgaaatcgtgg

SEQ ID NO: 9131478 - DNA, 22 bp, Homo sapiens
ctcctgggaaaggctggacaca

SEQ ID NO: 9131479 - DNA, 22 bp, Homo sapiens
ctcctggctttcccagaccagg

SEQ ID NO: 9131480 - DNA, 22 bp, Homo sapiens
ctcctgggaaatgaaggggcag

SEQ ID NO: 9131481 - DNA, 22 bp, Homo sapiens
ctcctgggaaaggctggacaca

SEQ ID NO: 9131482 - DNA, 22 bp, Homo sapiens
ctcctgggaaaggctggacaca

SEQ ID NO: 9131483 - DNA, 22 bp, Homo sapiens
ctcctgggaatttagttgtgag

SEQ ID NO: 9131484 - DNA, 22 bp, Homo sapiens
ctcctgggtcattgccagcaaa

SEQ ID NO: 9131485 - DNA, 22 bp, Homo sapiens
ctcctgggggacagcggcaggg

SEQ ID NO: 9131486 - DNA, 22 bp, Homo sapiens
ctcctgggggacagcggcaggg

SEQ ID NO: 9131487 - DNA, 22 bp, Homo sapiens
ctcctgggggacagcggcaggg

SEQ ID NO: 9131488 - DNA, 22 bp, Homo sapiens
ctcctggggccatggaaggaac

SEQ ID NO: 9131489 - DNA, 22 bp, Homo sapiens
ctcctgggcttcgaaggctccc

SEQ ID NO: 9131490 - DNA, 22 bp, Homo sapiens
ctcctgggcttcgaaggctccc

SEQ ID NO: 9131491 - DNA, 20 bp, Homo sapiens
ctcctgggactgctggttat

SEQ ID NO: 9131492 - DNA, 22 bp, Homo sapiens
agtggcagagtgcactcaggca

SEQ ID NO: 9131493 - DNA, 22 bp, Homo sapiens
agtggcagagtcagggtttgga

SEQ ID NO: 9131494 - DNA, 22 bp, Homo sapiens
agtggcagagtgcactcaggca

SEQ ID NO: 9131495 - DNA, 22 bp, Homo sapiens
agtggcagagtcagggtttgga

SEQ ID NO: 9131496 - DNA, 22 bp, Homo sapiens
agtggcagaggttgactgcagt

SEQ ID NO: 9131497 - DNA, 22 bp, Homo sapiens
agtggcagagctgtgtcttgaa

SEQ ID NO: 9131498 - DNA, 22 bp, Homo sapiens
agtggcagaggttgactgcagt

SEQ ID NO: 9131499 - DNA, 22 bp, Homo sapiens
ctcctgggtcattgccagcaaa

SEQ ID NO: 9131500 - DNA, 22 bp, Homo sapiens
agtggcagaggttgactgcagt

SEQ ID NO: 9131501 - DNA, 22 bp, Homo sapiens
agtggcagagtgcactcaggca

SEQ ID NO: 9131502 - DNA, 22 bp, Homo sapiens
agtggcagatctctggtctgga

SEQ ID NO: 9131503 - DNA, 22 bp, Homo sapiens
agtggcagatctctggtctgga

SEQ ID NO: 9131504 - DNA, 19 bp, Homo sapiens
agtggcagatctggaagta

SEQ ID NO: 9131505 - DNA, 19 bp, Homo sapiens
agtggcagatctggaagta

SEQ ID NO: 9131506 - DNA, 22 bp, Homo sapiens
ctctcagaagtagcacgtgggc

SEQ ID NO: 9131507 - DNA, 19 bp, Homo sapiens
agtggcagatctggaagta

SEQ ID NO: 9131508 - DNA, 19 bp, Homo sapiens
agtggcagatctggaagta

SEQ ID NO: 9131509 - DNA, 18 bp, Homo sapiens
ctccagggaactcagtca

SEQ ID NO: 9131510 - DNA, 18 bp, Homo sapiens
ctccagggaactcagtca

SEQ ID NO: 9131511 - DNA, 20 bp, Homo sapiens
ctccagggaacagactggag

SEQ ID NO: 9131512 - DNA, 20 bp, Homo sapiens
ctccagggaacagactggag

SEQ ID NO: 9131513 - DNA, 20 bp, Homo sapiens
ctccagggaacagactggag

SEQ ID NO: 9131514 - DNA, 20 bp, Homo sapiens
ctccagggaacagactggag

SEQ ID NO: 9131515 - DNA, 20 bp, Homo sapiens
ctccagggaacagactggag

SEQ ID NO: 9131516 - DNA, 22 bp, Homo sapiens
ctccagggaaaggggcgtccgc

SEQ ID NO: 9131517 - DNA, 22 bp, Homo sapiens
ctccagggaaaggggcgtccgc

SEQ ID NO: 9131518 - DNA, 22 bp, Homo sapiens
ctcccaggttgattctttccct

SEQ ID NO: 9131519 - DNA, 22 bp, Homo sapiens
ctcccaggttgattctttccct

SEQ ID NO: 9131520 - DNA, 22 bp, Homo sapiens
ctccctcagaggagcacctgtt

SEQ ID NO: 9131521 - DNA, 22 bp, Homo sapiens
ctccctccctacgtgagctcac

SEQ ID NO: 9131522 - DNA, 22 bp, Homo sapiens
ctccctcctcaaatatctttgt

SEQ ID NO: 9131523 - DNA, 22 bp, Homo sapiens
ctccctctcaccggagccctgg

SEQ ID NO: 9131524 - DNA, 22 bp, Homo sapiens
ctccctctcaccggagccctgg

SEQ ID NO: 9131525 - DNA, 22 bp, Homo sapiens
ctccctcatatacccagcgaga

SEQ ID NO: 9131526 - DNA, 22 bp, Homo sapiens
ctccctcagaggagcacctgtt

SEQ ID NO: 9131527 - DNA, 22 bp, Homo sapiens
ctccctcatatacccagcgaga

SEQ ID NO: 9131528 - DNA, 22 bp, Homo sapiens
ctccctcatatacccagcgaga

SEQ ID NO: 9131529 - DNA, 22 bp, Homo sapiens
ctcctggctctgccacttacta

SEQ ID NO: 9131530 - DNA, 18 bp, Homo sapiens
ctcctggctgatggtgag

SEQ ID NO: 9131531 - DNA, 19 bp, Homo sapiens
ctcctggctctgtcatttt

SEQ ID NO: 9131532 - DNA, 22 bp, Homo sapiens
ctcctggctctctgtttagtgt

SEQ ID NO: 9131533 - DNA, 22 bp, Homo sapiens
ctcctggctctgccacttacta

SEQ ID NO: 9131534 - DNA, 22 bp, Homo sapiens
ctcctcagaagagggtaacaca

SEQ ID NO: 9131535 - DNA, 22 bp, Homo sapiens
ctcctcagactttccttgtccg

SEQ ID NO: 9131536 - DNA, 22 bp, Homo sapiens
ctcctgccaccgcggtgtcctg

SEQ ID NO: 9131537 - DNA, 22 bp, Homo sapiens
ctccctctgtccgaggccggct

SEQ ID NO: 9131538 - DNA, 22 bp, Homo sapiens
ctccctctctaaggcaaagaga

SEQ ID NO: 9131539 - DNA, 21 bp, Homo sapiens
ctccggagtgagctgtgggta

SEQ ID NO: 9131540 - DNA, 22 bp, Homo sapiens
ctccgtttttgaccggcactga

SEQ ID NO: 9131541 - DNA, 22 bp, Homo sapiens
ctccgttttgtgggacacggat

SEQ ID NO: 9131542 - DNA, 22 bp, Homo sapiens
ctcctaggtgctcactggggtc

SEQ ID NO: 9131543 - DNA, 23 bp, Homo sapiens
ataagaaaacagtaggctcagag

SEQ ID NO: 9131544 - DNA, 22 bp, Homo sapiens
ataacttgatgttatttgtcca

SEQ ID NO: 9131545 - DNA, 22 bp, Homo sapiens
ataacttcagggctgtgacaga

SEQ ID NO: 9131546 - DNA, 22 bp, Homo sapiens
ataacttcagggctgtgacaga

SEQ ID NO: 9131547 - DNA, 23 bp, Homo sapiens
ataagaaaacagtaggctcagag

SEQ ID NO: 9131548 - DNA, 22 bp, Homo sapiens
ataagacacgcaaataggtacg

SEQ ID NO: 9131549 - DNA, 22 bp, Homo sapiens
atacaaagctaaatatggtttc

SEQ ID NO: 9131550 - DNA, 22 bp, Homo sapiens
atacaaagctttctgtctggta

SEQ ID NO: 9131551 - DNA, 22 bp, Homo sapiens
ataatttactaagctctacctt

SEQ ID NO: 9131552 - DNA, 22 bp, Homo sapiens
ataatttactaagctctacctt

SEQ ID NO: 9131553 - DNA, 22 bp, Homo sapiens
ataatttactaagctctacctt

SEQ ID NO: 9131554 - DNA, 22 bp, Homo sapiens
ataatttactaagctctacctt

SEQ ID NO: 9131555 - DNA, 20 bp, Homo sapiens
ataatttaccctgcaccact

SEQ ID NO: 9131556 - DNA, 22 bp, Homo sapiens
atacaacagaaaatgattattc

SEQ ID NO: 9131557 - DNA, 22 bp, Homo sapiens
atacaaatttatagatgcattt

SEQ ID NO: 9131558 - DNA, 22 bp, Homo sapiens
atacaaatttatagatgcattt

SEQ ID NO: 9131559 - DNA, 22 bp, Homo sapiens
atacaaagtattgatcctgagt

SEQ ID NO: 9131560 - DNA, 22 bp, Homo sapiens
atacaaatcctctgggatggta

SEQ ID NO: 9131561 - DNA, 22 bp, Homo sapiens
atacaaattataggccccatcc

SEQ ID NO: 9131562 - DNA, 22 bp, Homo sapiens
atacaaagctttctgtctggta

SEQ ID NO: 9131563 - DNA, 22 bp, Homo sapiens
atacaaagtattaatcctggat

SEQ ID NO: 9131564 - DNA, 22 bp, Homo sapiens
atacaaagtattaatcctggat

SEQ ID NO: 9131565 - DNA, 22 bp, Homo sapiens
atacaactgctctcagataagt

SEQ ID NO: 9131566 - DNA, 22 bp, Homo sapiens
ctgctgaggccttccctgtcct

SEQ ID NO: 9131567 - DNA, 22 bp, Homo sapiens
ctgctgaggggaggaaagacgg

SEQ ID NO: 9131568 - DNA, 22 bp, Homo sapiens
ctgctgaggtatactatgtgac

SEQ ID NO: 9131569 - DNA, 22 bp, Homo sapiens
ctgctgaggtggagattgcagt

SEQ ID NO: 9131570 - DNA, 22 bp, Homo sapiens
ctgctgaggtccttgctcagac

SEQ ID NO: 9131571 - DNA, 22 bp, Homo sapiens
ctgctgaggtccttgctcagac

SEQ ID NO: 9131572 - DNA, 22 bp, Homo sapiens
ctgctgatcagggcaaagcaaa

SEQ ID NO: 9131573 - DNA, 22 bp, Homo sapiens
ctgctgatgtaagccatgctct

SEQ ID NO: 9131574 - DNA, 22 bp, Homo sapiens
ataacattttgacaactggtga

SEQ ID NO: 9131575 - DNA, 22 bp, Homo sapiens
ataacatggagtttgtcattta

SEQ ID NO: 9131576 - DNA, 22 bp, Homo sapiens
ataacattttgacaactggtga

SEQ ID NO: 9131577 - DNA, 20 bp, Homo sapiens
ataacctgcccagaggatga

SEQ ID NO: 9131578 - DNA, 22 bp, Homo sapiens
ataacatgacctgtgcttcaca

SEQ ID NO: 9131579 - DNA, 22 bp, Homo sapiens
ataacatggagtttgtcattta

SEQ ID NO: 9131580 - DNA, 22 bp, Homo sapiens
ataaatgtgaattagagctttg

SEQ ID NO: 9131581 - DNA, 23 bp, Homo sapiens
ataaattactatctccctagagc

SEQ ID NO: 9131582 - DNA, 22 bp, Homo sapiens
ataaatgattcagcaggaaata

SEQ ID NO: 9131583 - DNA, 22 bp, Homo sapiens
ataaatgattcagcaggaaata

SEQ ID NO: 9131584 - DNA, 22 bp, Homo sapiens
ataaatgcctcagaatcatccc

SEQ ID NO: 9131585 - DNA, 22 bp, Homo sapiens
ataaatgtgaaatgagcagtta

SEQ ID NO: 9131586 - DNA, 22 bp, Homo sapiens
ataaatggctttcattcctagg

SEQ ID NO: 9131587 - DNA, 22 bp, Homo sapiens
ataaatgattcagcaggaaata

SEQ ID NO: 9131588 - DNA, 22 bp, Homo sapiens
ctgcctctcagcctgaccgcca

SEQ ID NO: 9131589 - DNA, 20 bp, Homo sapiens
ctgccgaccacagccatgga

SEQ ID NO: 9131590 - DNA, 22 bp, Homo sapiens
ctgccctttgaaagaacgtctt

SEQ ID NO: 9131591 - DNA, 22 bp, Homo sapiens
ctgcctctcaggtccctgagat

SEQ ID NO: 9131592 - DNA, 23 bp, Homo sapiens
ctgcagagaactgagggacagcc

SEQ ID NO: 9131593 - DNA, 22 bp, Homo sapiens
ctgcagagaattgtggggcttc

SEQ ID NO: 9131594 - DNA, 22 bp, Homo sapiens
ctgcagagaattgtggggcttc

SEQ ID NO: 9131595 - DNA, 22 bp, Homo sapiens
ctgcagagacctaggtcaggtt

SEQ ID NO: 9131596 - DNA, 22 bp, Homo sapiens
ctgcagagacctaggtcaggtt

SEQ ID NO: 9131597 - DNA, 22 bp, Homo sapiens
ctgcagagaattgtggggcttc

SEQ ID NO: 9131598 - DNA, 22 bp, Homo sapiens
ctgcagagacctaggtcaggtt

SEQ ID NO: 9131599 - DNA, 22 bp, Homo sapiens
ctgcagagagtaactgaaatat

SEQ ID NO: 9131600 - DNA, 22 bp, Homo sapiens
ctgcagagagtgccgggcagcc

SEQ ID NO: 9131601 - DNA, 22 bp, Homo sapiens
ctgcagagagtgccgggcagcc

SEQ ID NO: 9131602 - DNA, 22 bp, Homo sapiens
ctgcagagagtaactgaaatat

SEQ ID NO: 9131603 - DNA, 22 bp, Homo sapiens
ctgcagagagtgccgggcagcc

SEQ ID NO: 9131604 - DNA, 22 bp, Homo sapiens
ctgcagagatgaagaaggtggc

SEQ ID NO: 9131605 - DNA, 22 bp, Homo sapiens
ctgcagagatgaagaaggtggc

SEQ ID NO: 9131606 - DNA, 22 bp, Homo sapiens
ctgcagggagaggggacagcct

SEQ ID NO: 9131607 - DNA, 22 bp, Homo sapiens
ctgcagagcaagtaacatcctc

SEQ ID NO: 9131608 - DNA, 22 bp, Homo sapiens
ctgcagagcaagtaacatcctc

SEQ ID NO: 9131609 - DNA, 22 bp, Homo sapiens
ctgcagggtgacgttgcccacc

SEQ ID NO: 9131610 - DNA, 22 bp, Homo sapiens
ctgcaggggtgtcctgtattgg

SEQ ID NO: 9131611 - DNA, 20 bp, Homo sapiens
ctgcagggttagaggctcca

SEQ ID NO: 9131612 - DNA, 20 bp, Homo sapiens
ctgcagggtgagtgggcgat

SEQ ID NO: 9131613 - DNA, 20 bp, Homo sapiens
ctgcagggtgagtgggcgat

SEQ ID NO: 9131614 - DNA, 22 bp, Homo sapiens
ctgcagggttcggagagttccc

SEQ ID NO: 9131615 - DNA, 22 bp, Homo sapiens
ctgcagggtttcgccagttgtg

SEQ ID NO: 9131616 - DNA, 20 bp, Homo sapiens
ctgcagggttagaggctcca

SEQ ID NO: 9131617 - DNA, 20 bp, Homo sapiens
ctgcagggttagaggctcca

SEQ ID NO: 9131618 - DNA, 22 bp, Homo sapiens
ctgcagggttcggagagttccc

SEQ ID NO: 9131619 - DNA, 22 bp, Homo sapiens
ctgcagggttcggagagttccc

SEQ ID NO: 9131620 - DNA, 22 bp, Homo sapiens
ctgcagggttttaacaatggac

SEQ ID NO: 9131621 - DNA, 22 bp, Homo sapiens
ctgcagggtttcgccagttgtg

SEQ ID NO: 9131622 - DNA, 22 bp, Homo sapiens
ctgcagggtttcgccagttgtg

SEQ ID NO: 9131623 - DNA, 22 bp, Homo sapiens
ctgcatcctaacctccatgcag

SEQ ID NO: 9131624 - DNA, 22 bp, Homo sapiens
ctgcatccatgttgctgcaaag

SEQ ID NO: 9131625 - DNA, 22 bp, Homo sapiens
ctgcatccatgttgctgcaaag

SEQ ID NO: 9131626 - DNA, 22 bp, Homo sapiens
ctgcatctctgtgccagagggc

SEQ ID NO: 9131627 - DNA, 19 bp, Homo sapiens
ctgcatgtagagcatcgtt

SEQ ID NO: 9131628 - DNA, 22 bp, Homo sapiens
ctgcatgtggtgcaggtgcccc

SEQ ID NO: 9131629 - DNA, 22 bp, Homo sapiens
agttatcccaaatgcaaaatgg

SEQ ID NO: 9131630 - DNA, 22 bp, Homo sapiens
agttatctgttagtattccagg

SEQ ID NO: 9131631 - DNA, 22 bp, Homo sapiens
agttattactctttaacatatt

SEQ ID NO: 9131632 - DNA, 22 bp, Homo sapiens
agttatcaggtgttttcatgga

SEQ ID NO: 9131633 - DNA, 22 bp, Homo sapiens
agttatcaggtgttttcatgga

SEQ ID NO: 9131634 - DNA, 22 bp, Homo sapiens
agttatcatcccttacactttg

SEQ ID NO: 9131635 - DNA, 22 bp, Homo sapiens
agttatattccatagattcaga

SEQ ID NO: 9131636 - DNA, 22 bp, Homo sapiens
agttatttaaaatgattgtcct

SEQ ID NO: 9131637 - DNA, 19 bp, Homo sapiens
agttattgatctattcagg

SEQ ID NO: 9131638 - DNA, 22 bp, Homo sapiens
agttattgtcctcctcacctta

SEQ ID NO: 9131639 - DNA, 22 bp, Homo sapiens
agttattgttcagtacaatgtc

SEQ ID NO: 9131640 - DNA, 22 bp, Homo sapiens
agttattgggttaaaattgcat

SEQ ID NO: 9131641 - DNA, 22 bp, Homo sapiens
agttattgaggtcccttccagt

SEQ ID NO: 9131642 - DNA, 22 bp, Homo sapiens
agttattgagtatctataatgt

SEQ ID NO: 9131643 - DNA, 22 bp, Homo sapiens
agttattcatttattctgtaca

SEQ ID NO: 9131644 - DNA, 22 bp, Homo sapiens
ctgaggagcaaccccgtgccct

SEQ ID NO: 9131645 - DNA, 22 bp, Homo sapiens
ctgaggagcaaccccgtgccct

SEQ ID NO: 9131646 - DNA, 22 bp, Homo sapiens
ctgaggagcagctggcccgcta

SEQ ID NO: 9131647 - DNA, 22 bp, Homo sapiens
ctgaggagcagctggcccgcta

SEQ ID NO: 9131648 - DNA, 22 bp, Homo sapiens
ctgaggagatccccccagaagt

SEQ ID NO: 9131649 - DNA, 22 bp, Homo sapiens
ctgaggagatccccccagaagt

SEQ ID NO: 9131650 - DNA, 22 bp, Homo sapiens
ctgaggagatgataatgtcatt

SEQ ID NO: 9131651 - DNA, 22 bp, Homo sapiens
ctgaggagatgggctttttagg

SEQ ID NO: 9131652 - DNA, 22 bp, Homo sapiens
ctgaggagatgggctttttagg

SEQ ID NO: 9131653 - DNA, 22 bp, Homo sapiens
ctgaggagatgataatgtcatt

SEQ ID NO: 9131654 - DNA, 22 bp, Homo sapiens
ctgaggagccccctctcagcat

SEQ ID NO: 9131655 - DNA, 22 bp, Homo sapiens
ctgaggagccccctctcagcat

SEQ ID NO: 9131656 - DNA, 22 bp, Homo sapiens
ctgaggagcgttggtcacgtgt

SEQ ID NO: 9131657 - DNA, 22 bp, Homo sapiens
ctgaggagcgttggtcacgtgt

SEQ ID NO: 9131658 - DNA, 22 bp, Homo sapiens
ctgaggagccccctctcagcat

SEQ ID NO: 9131659 - DNA, 22 bp, Homo sapiens
ctgaggagctgaaggccctcca

SEQ ID NO: 9131660 - DNA, 22 bp, Homo sapiens
ctgaggagctgaaggccctcca

SEQ ID NO: 9131661 - DNA, 22 bp, Homo sapiens
ctgcaaatccctactgggcaca

SEQ ID NO: 9131662 - DNA, 22 bp, Homo sapiens
ctgcaaatgccgtgagagcagg

SEQ ID NO: 9131663 - DNA, 23 bp, Homo sapiens
ctgcaactcagtctggagcagtt

SEQ ID NO: 9131664 - DNA, 22 bp, Homo sapiens
ctgatcatgtgggaggatatgt

SEQ ID NO: 9131665 - DNA, 22 bp, Homo sapiens
agttatttactcctttgtctct

SEQ ID NO: 9131666 - DNA, 22 bp, Homo sapiens
ctgcaatgcatgaattataaat

SEQ ID NO: 9131667 - DNA, 22 bp, Homo sapiens
ctgcaaggtcatgactctctgg

SEQ ID NO: 9131668 - DNA, 22 bp, Homo sapiens
ctgcaagggatcttcaggtagc

SEQ ID NO: 9131669 - DNA, 23 bp, Homo sapiens
ctgcaaggtacaagatgctggat

SEQ ID NO: 9131670 - DNA, 22 bp, Homo sapiens
ctgcaagattggaagatgcaat

SEQ ID NO: 9131671 - DNA, 22 bp, Homo sapiens
ctgcaagattggaagatgcaat

SEQ ID NO: 9131672 - DNA, 22 bp, Homo sapiens
ctgcaactctctccagaggctg

SEQ ID NO: 9131673 - DNA, 22 bp, Homo sapiens
ctgcaactctagtccagggctg

SEQ ID NO: 9131674 - DNA, 20 bp, Homo sapiens
ctgcaagcaggttattccag

SEQ ID NO: 9131675 - DNA, 22 bp, Homo sapiens
ctgcaagccaagctgagagcct

SEQ ID NO: 9131676 - DNA, 22 bp, Homo sapiens
ctgcaaggagttgacattgtct

SEQ ID NO: 9131677 - DNA, 22 bp, Homo sapiens
atacagtataactaataaaccc

SEQ ID NO: 9131678 - DNA, 20 bp, Homo sapiens
atacagtaggtgctcaatat

SEQ ID NO: 9131679 - DNA, 22 bp, Homo sapiens
atacatagctgaaaacttgtag

SEQ ID NO: 9131680 - DNA, 22 bp, Homo sapiens
atacatagcagggtagtagatc

SEQ ID NO: 9131681 - DNA, 22 bp, Homo sapiens
atacatagatagataatctggc

SEQ ID NO: 9131682 - DNA, 22 bp, Homo sapiens
atacatacgtacatacgtatgt

SEQ ID NO: 9131683 - DNA, 22 bp, Homo sapiens
atacataattacttccgatgtt

SEQ ID NO: 9131684 - DNA, 17 bp, Homo sapiens
atacagtttattttaca

SEQ ID NO: 9131685 - DNA, 22 bp, Homo sapiens
atacatacatgtacacataaat

SEQ ID NO: 9131686 - DNA, 22 bp, Homo sapiens
atacatacatgtacacataaat

SEQ ID NO: 9131687 - DNA, 22 bp, Homo sapiens
atacctttaggcattttgcatc

SEQ ID NO: 9131688 - DNA, 22 bp, Homo sapiens
atacctgtgtatccacaagcgt

SEQ ID NO: 9131689 - DNA, 22 bp, Homo sapiens
ataccttatttcctggtgacat

SEQ ID NO: 9131690 - DNA, 21 bp, Homo sapiens
atacattctattaagcattta

SEQ ID NO: 9131691 - DNA, 22 bp, Homo sapiens
atacataggagaataacttcag

SEQ ID NO: 9131692 - DNA, 22 bp, Homo sapiens
atacatgtgtgtgcatacatgt

SEQ ID NO: 9131693 - DNA, 22 bp, Homo sapiens
atacattcaaaggaaggataga

SEQ ID NO: 9131694 - DNA, 22 bp, Homo sapiens
atacatgttcgtgtacatgttc

SEQ ID NO: 9131695 - DNA, 22 bp, Homo sapiens
atacatgtgtgtgcatacatgt

SEQ ID NO: 9131696 - DNA, 22 bp, Homo sapiens
atacatgtgtgtgcatacatgt

SEQ ID NO: 9131697 - DNA, 22 bp, Homo sapiens
atacatgttcgtgtacatgttc

SEQ ID NO: 9131698 - DNA, 22 bp, Homo sapiens
ctggagaagaggtagtatgtag

SEQ ID NO: 9131699 - DNA, 22 bp, Homo sapiens
ctggagaagcattcaaataatt

SEQ ID NO: 9131700 - DNA, 22 bp, Homo sapiens
ctggagaagccaaactagtcac

SEQ ID NO: 9131701 - DNA, 22 bp, Homo sapiens
ctggagaagccaaactagtcac

SEQ ID NO: 9131702 - DNA, 17 bp, Homo sapiens
ctggagaagcctgtgga

SEQ ID NO: 9131703 - DNA, 22 bp, Homo sapiens
ctggagaattctatgaaatatt

SEQ ID NO: 9131704 - DNA, 22 bp, Homo sapiens
ctggagaagtactgagacattt

SEQ ID NO: 9131705 - DNA, 22 bp, Homo sapiens
ctggagacctctcctgagagtg

SEQ ID NO: 9131706 - DNA, 22 bp, Homo sapiens
ctggagagaaatgacaaagcta

SEQ ID NO: 9131707 - DNA, 22 bp, Homo sapiens
ctggagagaatgtggaatgatt

SEQ ID NO: 9131708 - DNA, 22 bp, Homo sapiens
ctggagagaatgttcattgcag

SEQ ID NO: 9131709 - DNA, 22 bp, Homo sapiens
ctggagagaatgtggaatgatt

SEQ ID NO: 9131710 - DNA, 22 bp, Homo sapiens
ctggagagaatgttcattgcag

SEQ ID NO: 9131711 - DNA, 22 bp, Homo sapiens
atacagtaatttgtaactcatc

SEQ ID NO: 9131712 - DNA, 22 bp, Homo sapiens
atacagtaatttgtaactcatc

SEQ ID NO: 9131713 - DNA, 22 bp, Homo sapiens
atacagtaatttgtaactcatc

SEQ ID NO: 9131714 - DNA, 22 bp, Homo sapiens
atacagtaattgcataggcttc

SEQ ID NO: 9131715 - DNA, 22 bp, Homo sapiens
atacagtagacaatctcatgaa

SEQ ID NO: 9131716 - DNA, 19 bp, Homo sapiens
ctggaatgagaacatgccc

SEQ ID NO: 9131717 - DNA, 22 bp, Homo sapiens
ctggaatgctggtaaaatagca

SEQ ID NO: 9131718 - DNA, 22 bp, Homo sapiens
ctggaagtggggttggcttgaa

SEQ ID NO: 9131719 - DNA, 22 bp, Homo sapiens
ctggaagtggggttggcttgaa

SEQ ID NO: 9131720 - DNA, 22 bp, Homo sapiens
ctgctgccattagggcacagac

SEQ ID NO: 9131721 - DNA, 22 bp, Homo sapiens
ctgctgcagatgacagacccaa

SEQ ID NO: 9131722 - DNA, 22 bp, Homo sapiens
ctgctgcaattatctgggtgtg

SEQ ID NO: 9131723 - DNA, 22 bp, Homo sapiens
ctgctgcaggatgggcactctg

SEQ ID NO: 9131724 - DNA, 22 bp, Homo sapiens
ctgctgccaagggtgccacagg

SEQ ID NO: 9131725 - DNA, 22 bp, Homo sapiens
atagcaaagcctggcacaatga

SEQ ID NO: 9131726 - DNA, 22 bp, Homo sapiens
atagcaaagcctggcacaatga

SEQ ID NO: 9131727 - DNA, 22 bp, Homo sapiens
atagcaaagatgtcaattcccc

SEQ ID NO: 9131728 - DNA, 22 bp, Homo sapiens
atagcaaagatcacttccttga

SEQ ID NO: 9131729 - DNA, 22 bp, Homo sapiens
atagcaaaggacaatagtcagt

SEQ ID NO: 9131730 - DNA, 22 bp, Homo sapiens
atagcaaaggacaatagtcagt

SEQ ID NO: 9131731 - DNA, 22 bp, Homo sapiens
atagcaaaaggcaccagagtga

SEQ ID NO: 9131732 - DNA, 22 bp, Homo sapiens
atagcaaaagcatgtgcaatac

SEQ ID NO: 9131733 - DNA, 22 bp, Homo sapiens
atagcaaaacccactgcattac

SEQ ID NO: 9131734 - DNA, 22 bp, Homo sapiens
atagcaaaaatgaacaaagctt

SEQ ID NO: 9131735 - DNA, 22 bp, Homo sapiens
atagcaaaaatgaacaaagctt

SEQ ID NO: 9131736 - DNA, 22 bp, Homo sapiens
atagcaaactggcagcttgtgg

SEQ ID NO: 9131737 - DNA, 22 bp, Homo sapiens
atagcaaactggagcttgcttt

SEQ ID NO: 9131738 - DNA, 22 bp, Homo sapiens
ctggcccatggtgagctctggg

SEQ ID NO: 9131739 - DNA, 22 bp, Homo sapiens
ctggcccatggtgagctctggg

SEQ ID NO: 9131740 - DNA, 20 bp, Homo sapiens
ctggcccatctaccgctctg

SEQ ID NO: 9131741 - DNA, 22 bp, Homo sapiens
ctggcccatggtgagctctggg

SEQ ID NO: 9131742 - DNA, 22 bp, Homo sapiens
ctggcccatggtgagctctggg

SEQ ID NO: 9131743 - DNA, 22 bp, Homo sapiens
ctggccccagagtttcacttgg

SEQ ID NO: 9131744 - DNA, 22 bp, Homo sapiens
ctggccccaggcagcctgctgg

SEQ ID NO: 9131745 - DNA, 22 bp, Homo sapiens
ctggccccaggcagcctgctgg

SEQ ID NO: 9131746 - DNA, 22 bp, Homo sapiens
ctggccccaggcagcctgctgg

SEQ ID NO: 9131747 - DNA, 22 bp, Homo sapiens
ctggccccatctggagtctgag

SEQ ID NO: 9131748 - DNA, 22 bp, Homo sapiens
ctggccccaggcagcctgctgg

SEQ ID NO: 9131749 - DNA, 22 bp, Homo sapiens
ctggccccatctggagtctgag

SEQ ID NO: 9131750 - DNA, 22 bp, Homo sapiens
ctggcccccacacctgtcaggg

SEQ ID NO: 9131751 - DNA, 22 bp, Homo sapiens
ctggccccggttcctaaaaacc

SEQ ID NO: 9131752 - DNA, 22 bp, Homo sapiens
ctggcccccacacctgtcaggg

SEQ ID NO: 9131753 - DNA, 22 bp, Homo sapiens
atagatgtgtgtaagtacataa

SEQ ID NO: 9131754 - DNA, 22 bp, Homo sapiens
atagatgttcaatcagatattt

SEQ ID NO: 9131755 - DNA, 22 bp, Homo sapiens
atagattagccctatagtttta

SEQ ID NO: 9131756 - DNA, 22 bp, Homo sapiens
atagattatttgctcattactt

SEQ ID NO: 9131757 - DNA, 22 bp, Homo sapiens
atagatgttttagtaatactgt

SEQ ID NO: 9131758 - DNA, 22 bp, Homo sapiens
ctggctccatcactgggtgatg

SEQ ID NO: 9131759 - DNA, 22 bp, Homo sapiens
ctggctccatcactgggtgatg

SEQ ID NO: 9131760 - DNA, 22 bp, Homo sapiens
ctggctccagtgacaagtcgat

SEQ ID NO: 9131761 - DNA, 22 bp, Homo sapiens
ctggcccctgtggctaaaatca

SEQ ID NO: 9131762 - DNA, 22 bp, Homo sapiens
ctggctcacaggtgagatgcat

SEQ ID NO: 9131763 - DNA, 22 bp, Homo sapiens
ctggctccatcctaggcaaatg

SEQ ID NO: 9131764 - DNA, 22 bp, Homo sapiens
ctggctccatccttgagctctg

SEQ ID NO: 9131765 - DNA, 22 bp, Homo sapiens
ctggctccatccttgagctctg

SEQ ID NO: 9131766 - DNA, 22 bp, Homo sapiens
ctggctccatccttgagctctg

SEQ ID NO: 9131767 - DNA, 22 bp, Homo sapiens
ctggctccattactcagcatct

SEQ ID NO: 9131768 - DNA, 22 bp, Homo sapiens
ctggctccatctttgcttcctg

SEQ ID NO: 9131769 - DNA, 22 bp, Homo sapiens
ctggctccatctttgcttcctg

SEQ ID NO: 9131770 - DNA, 22 bp, Homo sapiens
ctggctccattactcagcatct

SEQ ID NO: 9131771 - DNA, 22 bp, Homo sapiens
ctggctccattactcagcatct

SEQ ID NO: 9131772 - DNA, 22 bp, Homo sapiens
ctggctccattactcagcatct

SEQ ID NO: 9131773 - DNA, 22 bp, Homo sapiens
ctggctcccagctttcagggag

SEQ ID NO: 9131774 - DNA, 22 bp, Homo sapiens
ctggctcccagctttcagggag

SEQ ID NO: 9131775 - DNA, 22 bp, Homo sapiens
ctggctcccgaagccctcagtg

SEQ ID NO: 9131776 - DNA, 22 bp, Homo sapiens
ctggctcccatgagctctcacg

SEQ ID NO: 9131777 - DNA, 22 bp, Homo sapiens
ctggctcccatgagctctcacg

SEQ ID NO: 9131778 - DNA, 22 bp, Homo sapiens
ctggctcccctacttcttattg

SEQ ID NO: 9131779 - DNA, 22 bp, Homo sapiens
ctggctcccatgagctctcacg

SEQ ID NO: 9131780 - DNA, 22 bp, Homo sapiens
ctggctcccgaagccctcagtg

SEQ ID NO: 9131781 - DNA, 22 bp, Homo sapiens
ctggctcccgtctggtggccat

SEQ ID NO: 9131782 - DNA, 22 bp, Homo sapiens
ctggctcccggggatcgagcac

SEQ ID NO: 9131783 - DNA, 22 bp, Homo sapiens
ctggctcccgaagccctcagtg

SEQ ID NO: 9131784 - DNA, 22 bp, Homo sapiens
ctggctcccgaagccctcagtg

SEQ ID NO: 9131785 - DNA, 22 bp, Homo sapiens
ctggctcccgaagccctcagtg

SEQ ID NO: 9131786 - DNA, 22 bp, Homo sapiens
atagcaaaggacaatagtcagt

SEQ ID NO: 9131787 - DNA, 22 bp, Homo sapiens
atagcaaatattttaatgagca

SEQ ID NO: 9131788 - DNA, 22 bp, Homo sapiens
atagcaaagtgcaggggcagca

SEQ ID NO: 9131789 - DNA, 22 bp, Homo sapiens
ctggctcccgtctggtggccat

SEQ ID NO: 9131790 - DNA, 22 bp, Homo sapiens
ctggctcccgttgtccttgaag

SEQ ID NO: 9131791 - DNA, 22 bp, Homo sapiens
atagcaaattctttaggtgctt

SEQ ID NO: 9131792 - DNA, 22 bp, Homo sapiens
atagcaatggcaacaactaagc

SEQ ID NO: 9131793 - DNA, 22 bp, Homo sapiens
atagcaatcagtgtatttgaaa

SEQ ID NO: 9131794 - DNA, 22 bp, Homo sapiens
atagcagaaaccaagcttcttc

SEQ ID NO: 9131795 - DNA, 22 bp, Homo sapiens
atagcactggtttttcttggtt

SEQ ID NO: 9131796 - DNA, 22 bp, Homo sapiens
atagcagcatcagtttatctcc

SEQ ID NO: 9131797 - DNA, 22 bp, Homo sapiens
atagcacctcctcagggaagtc

SEQ ID NO: 9131798 - DNA, 22 bp, Homo sapiens
atagcacctgtgatgggatgag

SEQ ID NO: 9131799 - DNA, 22 bp, Homo sapiens
atagcaccatgactaaacaatt

SEQ ID NO: 9131800 - DNA, 22 bp, Homo sapiens
atagcaattaagctccagaatt

SEQ ID NO: 9131801 - DNA, 22 bp, Homo sapiens
atagcaatttgcccaattacct

SEQ ID NO: 9131802 - DNA, 19 bp, Homo sapiens
ctggctgcaatgccagggt

SEQ ID NO: 9131803 - DNA, 19 bp, Homo sapiens
atagcagctatacccagat

SEQ ID NO: 9131804 - DNA, 22 bp, Homo sapiens
atagcagggatgtcagcaagta

SEQ ID NO: 9131805 - DNA, 22 bp, Homo sapiens
ctggctggcaagtagaacacaa

SEQ ID NO: 9131806 - DNA, 22 bp, Homo sapiens
ctggctggcaagtagaacacaa

SEQ ID NO: 9131807 - DNA, 22 bp, Homo sapiens
ctggctgcagctccgaggaaga

SEQ ID NO: 9131808 - DNA, 22 bp, Homo sapiens
ctggctggagtgcaggtgagtg

SEQ ID NO: 9131809 - DNA, 22 bp, Homo sapiens
ctggctggagtgcaggtgagtg

SEQ ID NO: 9131810 - DNA, 22 bp, Homo sapiens
ctggctggagtgcaggtgagtg

SEQ ID NO: 9131811 - DNA, 22 bp, Homo sapiens
ctggctggcagatgctcttgct

SEQ ID NO: 9131812 - DNA, 22 bp, Homo sapiens
ctggctggcagatgctcttgct

SEQ ID NO: 9131813 - DNA, 22 bp, Homo sapiens
ctggctggcagatgctcttgct

SEQ ID NO: 9131814 - DNA, 22 bp, Homo sapiens
ctggctggccatgcagcgccag

SEQ ID NO: 9131815 - DNA, 22 bp, Homo sapiens
ctggctggccatgtagagatga

SEQ ID NO: 9131816 - DNA, 22 bp, Homo sapiens
atattgaaccctacagactgta

SEQ ID NO: 9131817 - DNA, 22 bp, Homo sapiens
atattcttgtgattataaagta

SEQ ID NO: 9131818 - DNA, 21 bp, Homo sapiens
atattgtaggtaaagtgcagg

SEQ ID NO: 9131819 - DNA, 22 bp, Homo sapiens
atattgtactagggttacatgt

SEQ ID NO: 9131820 - DNA, 21 bp, Homo sapiens
atattggtatctttttaaatc

SEQ ID NO: 9131821 - DNA, 22 bp, Homo sapiens
atattggtaaagtggattaaca

SEQ ID NO: 9131822 - DNA, 21 bp, Homo sapiens
atattgtaggtaaagtgcagg

SEQ ID NO: 9131823 - DNA, 22 bp, Homo sapiens
atattgttgactataagagtaa

SEQ ID NO: 9131824 - DNA, 22 bp, Homo sapiens
atatttaaacagggtaccaata

SEQ ID NO: 9131825 - DNA, 22 bp, Homo sapiens
atattttggcaaatgtctagat

SEQ ID NO: 9131826 - DNA, 22 bp, Homo sapiens
atatttaactggtcccaatata

SEQ ID NO: 9131827 - DNA, 22 bp, Homo sapiens
atatttaaacagggtaccaata

SEQ ID NO: 9131828 - DNA, 22 bp, Homo sapiens
atatttaaacagggtaccaata

SEQ ID NO: 9131829 - DNA, 22 bp, Homo sapiens
atattttggggtgatgtgcatc

SEQ ID NO: 9131830 - DNA, 22 bp, Homo sapiens
atcaaaatgctccagtgatggt

SEQ ID NO: 9131831 - DNA, 22 bp, Homo sapiens
atcaaaatggaagaatttggct

SEQ ID NO: 9131832 - DNA, 22 bp, Homo sapiens
atcaaagaatgtgactgaaata

SEQ ID NO: 9131833 - DNA, 22 bp, Homo sapiens
atcaaagaatgtgactgaaata

SEQ ID NO: 9131834 - DNA, 19 bp, Homo sapiens
atcaaagactgcaggattt

SEQ ID NO: 9131835 - DNA, 22 bp, Homo sapiens
atcaaagaatgtgactgaaata

SEQ ID NO: 9131836 - DNA, 22 bp, Homo sapiens
atcaaagttcgtaactgataac

SEQ ID NO: 9131837 - DNA, 22 bp, Homo sapiens
atcaaagtccatcagaaggtag

SEQ ID NO: 9131838 - DNA, 22 bp, Homo sapiens
atcaacatactgctcaggcatt

SEQ ID NO: 9131839 - DNA, 22 bp, Homo sapiens
atcaacatgaatttctctgaag

SEQ ID NO: 9131840 - DNA, 22 bp, Homo sapiens
atcacattgccagtgattaccc

SEQ ID NO: 9131841 - DNA, 22 bp, Homo sapiens
atcacattctttcaaagcagtc

SEQ ID NO: 9131842 - DNA, 22 bp, Homo sapiens
atcagaaaaacataatgttatt

SEQ ID NO: 9131843 - DNA, 22 bp, Homo sapiens
atcaaatacaaagggcataagg

SEQ ID NO: 9131844 - DNA, 22 bp, Homo sapiens
atcaaatacaaagggcataagg

SEQ ID NO: 9131845 - DNA, 22 bp, Homo sapiens
atcaaagtttcccagaagttgt

SEQ ID NO: 9131846 - DNA, 22 bp, Homo sapiens
atcagaaaggtgggcaagcaga

SEQ ID NO: 9131847 - DNA, 22 bp, Homo sapiens
atcagaaagttcatcatgtttg

SEQ ID NO: 9131848 - DNA, 22 bp, Homo sapiens
atcagaaagttcatcatgtttg

SEQ ID NO: 9131849 - DNA, 22 bp, Homo sapiens
atcagaaactcttagagcaggg

SEQ ID NO: 9131850 - DNA, 22 bp, Homo sapiens
atcagaaatctaggattcagaa

SEQ ID NO: 9131851 - DNA, 22 bp, Homo sapiens
atcagaaatctaggattcagaa

SEQ ID NO: 9131852 - DNA, 22 bp, Homo sapiens
atcagaaatagtcatgttactt

SEQ ID NO: 9131853 - DNA, 21 bp, Homo sapiens
atcagaaaatgtaatggagca

SEQ ID NO: 9131854 - DNA, 21 bp, Homo sapiens
atcagaaaatgtaatggagca

SEQ ID NO: 9131855 - DNA, 22 bp, Homo sapiens
atcagaaaatacccagtgttta

SEQ ID NO: 9131856 - DNA, 22 bp, Homo sapiens
atcagaaaatacccagtgttta

SEQ ID NO: 9131857 - DNA, 22 bp, Homo sapiens
atcagaaaatacccagtgttta

SEQ ID NO: 9131858 - DNA, 22 bp, Homo sapiens
atcagaaaaacataatgttatt

SEQ ID NO: 9131859 - DNA, 22 bp, Homo sapiens
atcagaatcatttcatccctat

SEQ ID NO: 9131860 - DNA, 22 bp, Homo sapiens
atcagaataattagatttcaga

SEQ ID NO: 9131861 - DNA, 22 bp, Homo sapiens
atcagaataattagatttcaga

SEQ ID NO: 9131862 - DNA, 22 bp, Homo sapiens
atcagaacaaaagaacagttta

SEQ ID NO: 9131863 - DNA, 22 bp, Homo sapiens
atcagaaattgctaccagtgga

SEQ ID NO: 9131864 - DNA, 22 bp, Homo sapiens
atcagaagaaatggatgtgact

SEQ ID NO: 9131865 - DNA, 22 bp, Homo sapiens
atcagaaattgcccagctgttt

SEQ ID NO: 9131866 - DNA, 22 bp, Homo sapiens
atcagaagcttgtagtctctct

SEQ ID NO: 9131867 - DNA, 22 bp, Homo sapiens
atatgcagtctcttgcccttct

SEQ ID NO: 9131868 - DNA, 22 bp, Homo sapiens
atatgcagtctcttgcccttct

SEQ ID NO: 9131869 - DNA, 22 bp, Homo sapiens
atatgcatatgtcaaaacttat

SEQ ID NO: 9131870 - DNA, 22 bp, Homo sapiens
atatgcataccctcaccaacta

SEQ ID NO: 9131871 - DNA, 22 bp, Homo sapiens
atatgcatataaagcttttagt

SEQ ID NO: 9131872 - DNA, 22 bp, Homo sapiens
ctgggctcagatgagaggaagg

SEQ ID NO: 9131873 - DNA, 22 bp, Homo sapiens
ctgggctcacctgtggctggca

SEQ ID NO: 9131874 - DNA, 22 bp, Homo sapiens
ctgggctcacctgtggctggca

SEQ ID NO: 9131875 - DNA, 20 bp, Homo sapiens
ctggcttcgggaactagttt

SEQ ID NO: 9131876 - DNA, 20 bp, Homo sapiens
ctggcttcgggaactagttt

SEQ ID NO: 9131877 - DNA, 22 bp, Homo sapiens
ctgggctcaagaagtcttccct

SEQ ID NO: 9131878 - DNA, 20 bp, Homo sapiens
ctgggctcaagtgatcctcc

SEQ ID NO: 9131879 - DNA, 22 bp, Homo sapiens
ctgggctcaagtgatccaccca

SEQ ID NO: 9131880 - DNA, 20 bp, Homo sapiens
ctgggctcaagtgatcctcc

SEQ ID NO: 9131881 - DNA, 20 bp, Homo sapiens
ctgggctcaagtgagcctcc

SEQ ID NO: 9131882 - DNA, 20 bp, Homo sapiens
ctgggctcaagtgagcctcc

SEQ ID NO: 9131883 - DNA, 21 bp, Homo sapiens
ctgggctcaagcaatcctttc

SEQ ID NO: 9131884 - DNA, 22 bp, Homo sapiens
ctggctgggagcgagctgctca

SEQ ID NO: 9131885 - DNA, 22 bp, Homo sapiens
ctggctgggagcgagctgctca

SEQ ID NO: 9131886 - DNA, 22 bp, Homo sapiens
ctggctgggaagtagagtaggt

SEQ ID NO: 9131887 - DNA, 22 bp, Homo sapiens
ctggctgggaagtagagtaggt

SEQ ID NO: 9131888 - DNA, 22 bp, Homo sapiens
ctggctgtgtccacagagtaag

SEQ ID NO: 9131889 - DNA, 22 bp, Homo sapiens
ctggctgggagcgagctgctca

SEQ ID NO: 9131890 - DNA, 22 bp, Homo sapiens
ctggctggctcatttttcattg

SEQ ID NO: 9131891 - DNA, 22 bp, Homo sapiens
ctggctggccggaggcatccct

SEQ ID NO: 9131892 - DNA, 22 bp, Homo sapiens
ctggctggccggaggcatccct

SEQ ID NO: 9131893 - DNA, 22 bp, Homo sapiens
ctggctggccggaggcatccct

SEQ ID NO: 9131894 - DNA, 22 bp, Homo sapiens
ctggctggcgttttccaaaagc

SEQ ID NO: 9131895 - DNA, 22 bp, Homo sapiens
ctggctggctgtgcccctgccg

SEQ ID NO: 9131896 - DNA, 22 bp, Homo sapiens
ctggctggccggagcgaggcgg

SEQ ID NO: 9131897 - DNA, 22 bp, Homo sapiens
ctggctggccggagcgaggcgg

SEQ ID NO: 9131898 - DNA, 22 bp, Homo sapiens
ctggctggccggagcgaggcgg

SEQ ID NO: 9131899 - DNA, 22 bp, Homo sapiens
ctggctgtttctcctttgtcta

SEQ ID NO: 9131900 - DNA, 19 bp, Homo sapiens
ctggcttcaagcagtcctc

SEQ ID NO: 9131901 - DNA, 22 bp, Homo sapiens
ctggcttcagctgccatcaatg

SEQ ID NO: 9131902 - DNA, 22 bp, Homo sapiens
ctggctgtgtgtcttcattcag

SEQ ID NO: 9131903 - DNA, 22 bp, Homo sapiens
ctggcttccctgtcttatggaa

SEQ ID NO: 9131904 - DNA, 22 bp, Homo sapiens
ctggcttcctcaggagcagtgg

SEQ ID NO: 9131905 - DNA, 22 bp, Homo sapiens
ctggcttcctgagtccattacc

SEQ ID NO: 9131906 - DNA, 22 bp, Homo sapiens
ctggcttcctcaggagcagtgg

SEQ ID NO: 9131907 - DNA, 22 bp, Homo sapiens
ctggcttccaccatggcccctg

SEQ ID NO: 9131908 - DNA, 22 bp, Homo sapiens
ctggcttccatgctgtagtggc

SEQ ID NO: 9131909 - DNA, 22 bp, Homo sapiens
ctggcttccatgctgtagtggc

SEQ ID NO: 9131910 - DNA, 19 bp, Homo sapiens
ctgggctgaggtctgcctt

SEQ ID NO: 9131911 - DNA, 22 bp, Homo sapiens
ctgggctgagcctgggctgtgt

SEQ ID NO: 9131912 - DNA, 22 bp, Homo sapiens
ctgggctgagcctgggctgtgt

SEQ ID NO: 9131913 - DNA, 22 bp, Homo sapiens
ctgggctgaaggctccccacac

SEQ ID NO: 9131914 - DNA, 22 bp, Homo sapiens
ctgggctgagcctgggctgtgt

SEQ ID NO: 9131915 - DNA, 22 bp, Homo sapiens
atattcactgggtactaaaaag

SEQ ID NO: 9131916 - DNA, 22 bp, Homo sapiens
atattcactgagcataaagcca

SEQ ID NO: 9131917 - DNA, 22 bp, Homo sapiens
atattcactgggtactaaaaag

SEQ ID NO: 9131918 - DNA, 19 bp, Homo sapiens
ctgggctgaggtctgcctt

SEQ ID NO: 9131919 - DNA, 22 bp, Homo sapiens
atattcactgggtactaaaaag

SEQ ID NO: 9131920 - DNA, 22 bp, Homo sapiens
atattcttcttgttcagactat

SEQ ID NO: 9131921 - DNA, 22 bp, Homo sapiens
ctgggctcttctcaccctgttt

SEQ ID NO: 9131922 - DNA, 22 bp, Homo sapiens
ctgggctgaaagtgttccttga

SEQ ID NO: 9131923 - DNA, 22 bp, Homo sapiens
ctgggctcttcccagatccaga

SEQ ID NO: 9131924 - DNA, 22 bp, Homo sapiens
ctgggctctgtgtttcagtttc

SEQ ID NO: 9131925 - DNA, 22 bp, Homo sapiens
ctgggctctggggtcccggtgc

SEQ ID NO: 9131926 - DNA, 22 bp, Homo sapiens
ctgggctctgcggtgtcgctct

SEQ ID NO: 9131927 - DNA, 22 bp, Homo sapiens
atattatagacagagtcttctg

SEQ ID NO: 9131928 - DNA, 22 bp, Homo sapiens
atattaggagttaaatgtatta

SEQ ID NO: 9131929 - DNA, 22 bp, Homo sapiens
atattacataaacatgagtgaa

SEQ ID NO: 9131930 - DNA, 22 bp, Homo sapiens
atattagggtctctaaattcta

SEQ ID NO: 9131931 - DNA, 22 bp, Homo sapiens
atattaggcaaggagattattt

SEQ ID NO: 9131932 - DNA, 22 bp, Homo sapiens
atattaggtgctcaatacatgc

SEQ ID NO: 9131933 - DNA, 22 bp, Homo sapiens
atattaaaactatggttttcag

SEQ ID NO: 9131934 - DNA, 22 bp, Homo sapiens
atatgctatgttgaataatttg

SEQ ID NO: 9131935 - DNA, 20 bp, Homo sapiens
atatgctaatttttagtggg

SEQ ID NO: 9131936 - DNA, 22 bp, Homo sapiens
atatgctacaaataaactttta

SEQ ID NO: 9131937 - DNA, 22 bp, Homo sapiens
atatgctatgtatgtaaatgag

SEQ ID NO: 9131938 - DNA, 22 bp, Homo sapiens
atatgctagtgtgcttatactt

SEQ ID NO: 9131939 - DNA, 22 bp, Homo sapiens
atatgctaattagagggcatta

SEQ ID NO: 9131940 - DNA, 22 bp, Homo sapiens
atatgcattcatacttagtgga

SEQ ID NO: 9131941 - DNA, 22 bp, Homo sapiens
atatgcatctgtgtgcgtgtct

SEQ ID NO: 9131942 - DNA, 22 bp, Homo sapiens
atatgcatatgtcaaaacttat

SEQ ID NO: 9131943 - DNA, 20 bp, Homo sapiens
atatgcatgtgttttcactt

SEQ ID NO: 9131944 - DNA, 22 bp, Homo sapiens
atatgcattaacattgtaggag

SEQ ID NO: 9131945 - DNA, 22 bp, Homo sapiens
ctgtgtgctgaaatgcagtgag

SEQ ID NO: 9131946 - DNA, 22 bp, Homo sapiens
ctgtgtgctgaaatgcagtgag

SEQ ID NO: 9131947 - DNA, 22 bp, Homo sapiens
atcctgggcaagtcaatgtccc

SEQ ID NO: 9131948 - DNA, 19 bp, Homo sapiens
atcctgggtcctccagctg

SEQ ID NO: 9131949 - DNA, 22 bp, Homo sapiens
atcctgtcatcatagtacttga

SEQ ID NO: 9131950 - DNA, 22 bp, Homo sapiens
atccagttcttggaagcacagg

SEQ ID NO: 9131951 - DNA, 22 bp, Homo sapiens
atccagttcttggaagcacagg

SEQ ID NO: 9131952 - DNA, 22 bp, Homo sapiens
atccagttccaaagatcattta

SEQ ID NO: 9131953 - DNA, 22 bp, Homo sapiens
ctgtgtgcagggcacaatggaa

SEQ ID NO: 9131954 - DNA, 22 bp, Homo sapiens
ctgtgtgcatagttgtgctcaa

SEQ ID NO: 9131955 - DNA, 22 bp, Homo sapiens
atccagtcaaaattagtaaggt

SEQ ID NO: 9131956 - DNA, 22 bp, Homo sapiens
atccagggtgtggagagagctc

SEQ ID NO: 9131957 - DNA, 22 bp, Homo sapiens
atccagggtgtggagagagctc

SEQ ID NO: 9131958 - DNA, 22 bp, Homo sapiens
atccaccctgtggtggctttct

SEQ ID NO: 9131959 - DNA, 22 bp, Homo sapiens
atccaccctgtggtggctttct

SEQ ID NO: 9131960 - DNA, 22 bp, Homo sapiens
atccactcctggaggtgcccca

SEQ ID NO: 9131961 - DNA, 22 bp, Homo sapiens
atccactccctaacaccatgtt

SEQ ID NO: 9131962 - DNA, 22 bp, Homo sapiens
atccactcggagggaatgttta

SEQ ID NO: 9131963 - DNA, 22 bp, Homo sapiens
atccagggataaaagtaaggtt

SEQ ID NO: 9131964 - DNA, 22 bp, Homo sapiens
atccagggataaaagtaaggtt

SEQ ID NO: 9131965 - DNA, 23 bp, Homo sapiens
ctgtggccctgcttcatgcagcc

SEQ ID NO: 9131966 - DNA, 22 bp, Homo sapiens
ctgtggagtgtagatgctgggt

SEQ ID NO: 9131967 - DNA, 23 bp, Homo sapiens
ctgtggccctgcttcatgcagcc

SEQ ID NO: 9131968 - DNA, 21 bp, Homo sapiens
ctgtggcctggctagcaccgt

SEQ ID NO: 9131969 - DNA, 22 bp, Homo sapiens
ctgtggccttggaccagcatct

SEQ ID NO: 9131970 - DNA, 22 bp, Homo sapiens
ctgtggccttggaccagcatct

SEQ ID NO: 9131971 - DNA, 22 bp, Homo sapiens
ctgtggcctttgttggaggtcc

SEQ ID NO: 9131972 - DNA, 22 bp, Homo sapiens
ctgtggcgccgctgagagcaga

SEQ ID NO: 9131973 - DNA, 22 bp, Homo sapiens
ctgtggagtggggagtactggt

SEQ ID NO: 9131974 - DNA, 22 bp, Homo sapiens
ctgtggagtggggagtactggt

SEQ ID NO: 9131975 - DNA, 22 bp, Homo sapiens
atcagagaccggtcaagtcatg

SEQ ID NO: 9131976 - DNA, 22 bp, Homo sapiens
atcagagacaaaaccagcactt

SEQ ID NO: 9131977 - DNA, 20 bp, Homo sapiens
atcagacttttaggaacata

SEQ ID NO: 9131978 - DNA, 22 bp, Homo sapiens
atcagagaagtttcactggcat

SEQ ID NO: 9131979 - DNA, 22 bp, Homo sapiens
atcagaatcttctgaacagtgg

SEQ ID NO: 9131980 - DNA, 22 bp, Homo sapiens
ctgtggctttggggcggaggac

SEQ ID NO: 9131981 - DNA, 22 bp, Homo sapiens
ctgtggctttggggcggaggac

SEQ ID NO: 9131982 - DNA, 22 bp, Homo sapiens
ctgtggctcaattgcctactga

SEQ ID NO: 9131983 - DNA, 22 bp, Homo sapiens
ctgtggctttgcagggcttgtt

SEQ ID NO: 9131984 - DNA, 22 bp, Homo sapiens
ctgtggctttgcagggcttgtt

SEQ ID NO: 9131985 - DNA, 22 bp, Homo sapiens
ctgtggctcaaaatcccatgat

SEQ ID NO: 9131986 - DNA, 22 bp, Homo sapiens
ctgtggctcaaaatcccatgat

SEQ ID NO: 9131987 - DNA, 22 bp, Homo sapiens
ctgtggctatggtgtacatact

SEQ ID NO: 9131988 - DNA, 22 bp, Homo sapiens
ctgtggctaggaagctgtggga

SEQ ID NO: 9131989 - DNA, 23 bp, Homo sapiens
ctgtgggaagtcggggagcgcgc

SEQ ID NO: 9131990 - DNA, 22 bp, Homo sapiens
ctgtgggaacactgaggacttc

SEQ ID NO: 9131991 - DNA, 22 bp, Homo sapiens
cttccagtggttctggagggag

SEQ ID NO: 9131992 - DNA, 22 bp, Homo sapiens
cttccagtcttttcagtggagt

SEQ ID NO: 9131993 - DNA, 22 bp, Homo sapiens
cttccagtgcataggtagatca

SEQ ID NO: 9131994 - DNA, 22 bp, Homo sapiens
cttccagtctagagctatctgt

SEQ ID NO: 9131995 - DNA, 22 bp, Homo sapiens
cttccaggttctggttgggaag

SEQ ID NO: 9131996 - DNA, 22 bp, Homo sapiens
cttccaggtgctggcctggcct

SEQ ID NO: 9131997 - DNA, 22 bp, Homo sapiens
cttccaggtgctggcctggcct

SEQ ID NO: 9131998 - DNA, 22 bp, Homo sapiens
cttccagtctagagctatctgt

SEQ ID NO: 9131999 - DNA, 22 bp, Homo sapiens
cttccagtagtatcattctcat

SEQ ID NO: 9132000 - DNA, 23 bp, Homo sapiens
cttccagtactgcacactcaagg

SEQ ID NO: 9132001 - DNA, 17 bp, Homo sapiens
cttcccaccatctcctg

SEQ ID NO: 9132002 - DNA, 17 bp, Homo sapiens
cttcccaccatctcctg

SEQ ID NO: 9132003 - DNA, 22 bp, Homo sapiens
cttcccacagaattcaatcagt

SEQ ID NO: 9132004 - DNA, 22 bp, Homo sapiens
cttcctagcttcagagtctgtt

SEQ ID NO: 9132005 - DNA, 22 bp, Homo sapiens
cttcctagagccggcagtgagg

SEQ ID NO: 9132006 - DNA, 22 bp, Homo sapiens
cttcccactagtatcacagagc

SEQ ID NO: 9132007 - DNA, 22 bp, Homo sapiens
cttcccactagtatcacagagc

SEQ ID NO: 9132008 - DNA, 20 bp, Homo sapiens
cttagaaatttttaccctgg

SEQ ID NO: 9132009 - DNA, 22 bp, Homo sapiens
atcctgtgcaatgactgcatct

SEQ ID NO: 9132010 - DNA, 22 bp, Homo sapiens
atcctgtgcaatgactgcatct

SEQ ID NO: 9132011 - DNA, 22 bp, Homo sapiens
atcctgtggggcggctgcaggg

SEQ ID NO: 9132012 - DNA, 22 bp, Homo sapiens
atcctgtgtccactgctctgtg

SEQ ID NO: 9132013 - DNA, 22 bp, Homo sapiens
atcctgttttagataagcttat

SEQ ID NO: 9132014 - DNA, 22 bp, Homo sapiens
atcctgtttgtcactagaaaat

SEQ ID NO: 9132015 - DNA, 22 bp, Homo sapiens
cttagaaattgttactcattca

SEQ ID NO: 9132016 - DNA, 22 bp, Homo sapiens
atcctgttagcaccttcaaact

SEQ ID NO: 9132017 - DNA, 22 bp, Homo sapiens
atcctgttgctggctcattttg

SEQ ID NO: 9132018 - DNA, 23 bp, Homo sapiens
atcctgttgtaggcagtaattag

SEQ ID NO: 9132019 - DNA, 22 bp, Homo sapiens
cttagagcttaggctagccatt

SEQ ID NO: 9132020 - DNA, 22 bp, Homo sapiens
cttagagccttactcttcttgt

SEQ ID NO: 9132021 - DNA, 22 bp, Homo sapiens
cttccaggtgctggcctggcct

SEQ ID NO: 9132022 - DNA, 22 bp, Homo sapiens
cttagaatgtctactcttacca

SEQ ID NO: 9132023 - DNA, 22 bp, Homo sapiens
cttagaattttgcctactacaa

SEQ ID NO: 9132024 - DNA, 22 bp, Homo sapiens
cttagagatgggttttacttag

SEQ ID NO: 9132025 - DNA, 22 bp, Homo sapiens
cttagagatgggttttacttag

SEQ ID NO: 9132026 - DNA, 22 bp, Homo sapiens
cttagagatgggttttacttag

SEQ ID NO: 9132027 - DNA, 22 bp, Homo sapiens
cttagagatgggttttacttag

SEQ ID NO: 9132028 - DNA, 21 bp, Homo sapiens
atctgaaatgtcaaagcagat

SEQ ID NO: 9132029 - DNA, 22 bp, Homo sapiens
atctgaaatagtcttatctgag

SEQ ID NO: 9132030 - DNA, 22 bp, Homo sapiens
atctgaaagctaggagttctca

SEQ ID NO: 9132031 - DNA, 22 bp, Homo sapiens
atctgaaagctaggagttctca

SEQ ID NO: 9132032 - DNA, 22 bp, Homo sapiens
atctgaaatagtcttatctgag

SEQ ID NO: 9132033 - DNA, 22 bp, Homo sapiens
atctgaaagtttagaattcttg

SEQ ID NO: 9132034 - DNA, 21 bp, Homo sapiens
atctgaaaggttagtgttgag

SEQ ID NO: 9132035 - DNA, 19 bp, Homo sapiens
atctgaagtaggtgcagct

SEQ ID NO: 9132036 - DNA, 22 bp, Homo sapiens
atctgaagtccttataatctga

SEQ ID NO: 9132037 - DNA, 22 bp, Homo sapiens
atctgaagggaagtggaaggca

SEQ ID NO: 9132038 - DNA, 22 bp, Homo sapiens
atctgaagctatctgcacttca

SEQ ID NO: 9132039 - DNA, 22 bp, Homo sapiens
atctgaaaagctttaatgagct

SEQ ID NO: 9132040 - DNA, 22 bp, Homo sapiens
atctgaaaagcctcttactcct

SEQ ID NO: 9132041 - DNA, 23 bp, Homo sapiens
atctgaaaagcatttgcagtttg

SEQ ID NO: 9132042 - DNA, 22 bp, Homo sapiens
atctgaaaaatctcctttgtca

SEQ ID NO: 9132043 - DNA, 22 bp, Homo sapiens
atctctttgatggctcctgtga

SEQ ID NO: 9132044 - DNA, 22 bp, Homo sapiens
atctgaaactctgacattgtct

SEQ ID NO: 9132045 - DNA, 22 bp, Homo sapiens
atctgaaactctgacattgtct

SEQ ID NO: 9132046 - DNA, 23 bp, Homo sapiens
atctgaaaaggcattttcttccc

SEQ ID NO: 9132047 - DNA, 22 bp, Homo sapiens
cttcctctagcctagtaatgcc

SEQ ID NO: 9132048 - DNA, 22 bp, Homo sapiens
atctgcaggaatgtgtgcagag

SEQ ID NO: 9132049 - DNA, 22 bp, Homo sapiens
atctgcagaggacaggcgagga

SEQ ID NO: 9132050 - DNA, 22 bp, Homo sapiens
atctgatttgtaattttagaaa

SEQ ID NO: 9132051 - DNA, 22 bp, Homo sapiens
atctgacaaggccacatattct

SEQ ID NO: 9132052 - DNA, 22 bp, Homo sapiens
cttcttgtatctgccgccgagc

SEQ ID NO: 9132053 - DNA, 22 bp, Homo sapiens
cttcttatcaagtggcaaatct

SEQ ID NO: 9132054 - DNA, 22 bp, Homo sapiens
cttcttaatgcataaactgtgt

SEQ ID NO: 9132055 - DNA, 22 bp, Homo sapiens
cttcttgattgctttcaaacca

SEQ ID NO: 9132056 - DNA, 22 bp, Homo sapiens
cttcttgcaattttcatcttat

SEQ ID NO: 9132057 - DNA, 22 bp, Homo sapiens
cttcttaatgacagattaaaat

SEQ ID NO: 9132058 - DNA, 22 bp, Homo sapiens
atctgcagtttgttttctcttg

SEQ ID NO: 9132059 - DNA, 22 bp, Homo sapiens
cagaaatacccagcatttggag

SEQ ID NO: 9132060 - DNA, 22 bp, Homo sapiens
cagaaataaagtggacagagta

SEQ ID NO: 9132061 - DNA, 22 bp, Homo sapiens
cagaaataaagtggacagagta

SEQ ID NO: 9132062 - DNA, 22 bp, Homo sapiens
cagaaataaagtggacagagta

SEQ ID NO: 9132063 - DNA, 23 bp, Homo sapiens
cagaaataaactggtttgtagat

SEQ ID NO: 9132064 - DNA, 22 bp, Homo sapiens
cagaaataaacttctcacatcg

SEQ ID NO: 9132065 - DNA, 22 bp, Homo sapiens
cagaaataaacttctcacatcg

SEQ ID NO: 9132066 - DNA, 22 bp, Homo sapiens
cagaaagcttggtacaatatgc

SEQ ID NO: 9132067 - DNA, 22 bp, Homo sapiens
cagaaagcttaggcaagttgga

SEQ ID NO: 9132068 - DNA, 22 bp, Homo sapiens
cagaaaggtatgtgtgcctttg

SEQ ID NO: 9132069 - DNA, 18 bp, Homo sapiens
cagaaagttatttactct

SEQ ID NO: 9132070 - DNA, 23 bp, Homo sapiens
cagaaagtttgagaagatacatc

SEQ ID NO: 9132071 - DNA, 23 bp, Homo sapiens
cagaaagtttgagaagatacatc

SEQ ID NO: 9132072 - DNA, 22 bp, Homo sapiens
ggctggtgttacagtcggcagc

SEQ ID NO: 9132073 - DNA, 22 bp, Homo sapiens
ggctggtgttgagtgcctgtag

SEQ ID NO: 9132074 - DNA, 22 bp, Homo sapiens
ggctggtgttgagtgcctgtag

SEQ ID NO: 9132075 - DNA, 22 bp, Homo sapiens
ggctgtcagggtgagctggctt

SEQ ID NO: 9132076 - DNA, 22 bp, Homo sapiens
ggctgtcaattcataggtcaga

SEQ ID NO: 9132077 - DNA, 22 bp, Homo sapiens
ggctgtataaagttaaaggctt

SEQ ID NO: 9132078 - DNA, 22 bp, Homo sapiens
ggctgtatcctggttttggaga

SEQ ID NO: 9132079 - DNA, 22 bp, Homo sapiens
ggctgtatatactgtatacagt

SEQ ID NO: 9132080 - DNA, 19 bp, Homo sapiens
ggctgtctacgaaccagtc

SEQ ID NO: 9132081 - DNA, 22 bp, Homo sapiens
ggctgtgaaccctggcagtgtg

SEQ ID NO: 9132082 - DNA, 22 bp, Homo sapiens
ggctgtgaaccctggcagtgtg

SEQ ID NO: 9132083 - DNA, 22 bp, Homo sapiens
ggctgtctctgtgactgccacc

SEQ ID NO: 9132084 - DNA, 19 bp, Homo sapiens
ggctgtctcggcccagcca

SEQ ID NO: 9132085 - DNA, 22 bp, Homo sapiens
ggctgtttttatagagtccata

SEQ ID NO: 9132086 - DNA, 22 bp, Homo sapiens
ggcttaaagttttctagaataa

SEQ ID NO: 9132087 - DNA, 17 bp, Homo sapiens
ggctgtttttaggctgt

SEQ ID NO: 9132088 - DNA, 22 bp, Homo sapiens
ggctgttgacagacataggttt

SEQ ID NO: 9132089 - DNA, 22 bp, Homo sapiens
ggctgtgtttctgtttgacatt

SEQ ID NO: 9132090 - DNA, 22 bp, Homo sapiens
ggctgtgttccaagtgtcagga

SEQ ID NO: 9132091 - DNA, 22 bp, Homo sapiens
ggctgtgttccaagtgtcagga

SEQ ID NO: 9132092 - DNA, 20 bp, Homo sapiens
cagaaagcatgttccagggc

SEQ ID NO: 9132093 - DNA, 22 bp, Homo sapiens
cagaaagccctatgtacagtgg

SEQ ID NO: 9132094 - DNA, 22 bp, Homo sapiens
cagaaagccctatgtacagtgg

SEQ ID NO: 9132095 - DNA, 22 bp, Homo sapiens
cagaaagccaactccaactgtc

SEQ ID NO: 9132096 - DNA, 23 bp, Homo sapiens
cagaaagccctttccccacagta

SEQ ID NO: 9132097 - DNA, 22 bp, Homo sapiens
cagaaagccctatgtacagtgg

SEQ ID NO: 9132098 - DNA, 22 bp, Homo sapiens
cagaaagcgggatgcagcatgt

SEQ ID NO: 9132099 - DNA, 22 bp, Homo sapiens
cagaaagccgacttacaatgga

SEQ ID NO: 9132100 - DNA, 22 bp, Homo sapiens
ggctgccctgggaggcaagggt

SEQ ID NO: 9132101 - DNA, 22 bp, Homo sapiens
ggctgcctaacccttaagtgtc

SEQ ID NO: 9132102 - DNA, 22 bp, Homo sapiens
ggctgccctcggggtcgcaggc

SEQ ID NO: 9132103 - DNA, 22 bp, Homo sapiens
ggctgccctcggggtcgcaggc

SEQ ID NO: 9132104 - DNA, 22 bp, Homo sapiens
ggctgccctagagctggcaagg

SEQ ID NO: 9132105 - DNA, 22 bp, Homo sapiens
ggctgccctcggggtcgcaggc

SEQ ID NO: 9132106 - DNA, 22 bp, Homo sapiens
cagaaagacctgggctcaagag

SEQ ID NO: 9132107 - DNA, 22 bp, Homo sapiens
cactttaactcacatttcagct

SEQ ID NO: 9132108 - DNA, 22 bp, Homo sapiens
cactttggtagctgttttggga

SEQ ID NO: 9132109 - DNA, 22 bp, Homo sapiens
cagaaaacctgactctagaact

SEQ ID NO: 9132110 - DNA, 23 bp, Homo sapiens
cagaaaacccagagctcagtccc

SEQ ID NO: 9132111 - DNA, 23 bp, Homo sapiens
cagaaaacccagagctcagtccc

SEQ ID NO: 9132112 - DNA, 22 bp, Homo sapiens
cagaaaacaaacctatcctgag

SEQ ID NO: 9132113 - DNA, 22 bp, Homo sapiens
cagaaaagggtgtttgttcagg

SEQ ID NO: 9132114 - DNA, 22 bp, Homo sapiens
cagaaaagggtgtttgttcagg

SEQ ID NO: 9132115 - DNA, 22 bp, Homo sapiens
ggctgccccagtgctcatggct

SEQ ID NO: 9132116 - DNA, 22 bp, Homo sapiens
ggctgccataacagagtaccac

SEQ ID NO: 9132117 - DNA, 22 bp, Homo sapiens
ggctgccccatgggctgggctg

SEQ ID NO: 9132118 - DNA, 22 bp, Homo sapiens
ggctgccccatgggctgggctg

SEQ ID NO: 9132119 - DNA, 22 bp, Homo sapiens
ggctgccctagagctggcaagg

SEQ ID NO: 9132120 - DNA, 22 bp, Homo sapiens
ggctccaggtgcatgccaggct

SEQ ID NO: 9132121 - DNA, 22 bp, Homo sapiens
ggctccaggtgcatgccaggct

SEQ ID NO: 9132122 - DNA, 22 bp, Homo sapiens
ggctccaggtgcatgccaggct

SEQ ID NO: 9132123 - DNA, 22 bp, Homo sapiens
ggctctggtcagtgaggggcct

SEQ ID NO: 9132124 - DNA, 22 bp, Homo sapiens
ggctctggaatgtgtagtcagg

SEQ ID NO: 9132125 - DNA, 22 bp, Homo sapiens
ggctctgggttctgcaatgcgt

SEQ ID NO: 9132126 - DNA, 22 bp, Homo sapiens
ggctctgggttctgcaatgcgt

SEQ ID NO: 9132127 - DNA, 22 bp, Homo sapiens
ggctccagggtctctccttgtg

SEQ ID NO: 9132128 - DNA, 22 bp, Homo sapiens
ggctccaggtacgtatgggagg

SEQ ID NO: 9132129 - DNA, 22 bp, Homo sapiens
ggctcaggttgggtcacatgac

SEQ ID NO: 9132130 - DNA, 22 bp, Homo sapiens
ggctcaggttgggtcacatgac

SEQ ID NO: 9132131 - DNA, 22 bp, Homo sapiens
ggctgaggcggcgatgcccttg

SEQ ID NO: 9132132 - DNA, 22 bp, Homo sapiens
ggctgaggcggcgatgcccttg

SEQ ID NO: 9132133 - DNA, 22 bp, Homo sapiens
ggctgagcgtggctgccgtggg

SEQ ID NO: 9132134 - DNA, 22 bp, Homo sapiens
ggctgagcgtggctgccgtggg

SEQ ID NO: 9132135 - DNA, 22 bp, Homo sapiens
ggctgagcgtggctgccgtggg

SEQ ID NO: 9132136 - DNA, 22 bp, Homo sapiens
ggctgagcctggagcatctggt

SEQ ID NO: 9132137 - DNA, 22 bp, Homo sapiens
ggctgagccccctctgcgtagg

SEQ ID NO: 9132138 - DNA, 22 bp, Homo sapiens
ggctctggtgagggtaggagat

SEQ ID NO: 9132139 - DNA, 22 bp, Homo sapiens
ggctctggtgccctggctccca

SEQ ID NO: 9132140 - DNA, 22 bp, Homo sapiens
ggctctggtgccctggctccca

SEQ ID NO: 9132141 - DNA, 22 bp, Homo sapiens
ggctctggtgagggtaggagat

SEQ ID NO: 9132142 - DNA, 22 bp, Homo sapiens
ggctctggtgagggtaggagat

SEQ ID NO: 9132143 - DNA, 22 bp, Homo sapiens
ggctctggtgggaaggttagat

SEQ ID NO: 9132144 - DNA, 22 bp, Homo sapiens
ggctgagccccctctgcgtagg

SEQ ID NO: 9132145 - DNA, 22 bp, Homo sapiens
ggctctggtggcaattgactgg

SEQ ID NO: 9132146 - DNA, 22 bp, Homo sapiens
ggctctggtgccctggctccca

SEQ ID NO: 9132147 - DNA, 22 bp, Homo sapiens
ggctctggtgccctggctccca

SEQ ID NO: 9132148 - DNA, 22 bp, Homo sapiens
ggcctctctccctggcttgcag

SEQ ID NO: 9132149 - DNA, 18 bp, Homo sapiens
ggcctgaggatttcagca

SEQ ID NO: 9132150 - DNA, 19 bp, Homo sapiens
ggcctgaggccacagatcc

SEQ ID NO: 9132151 - DNA, 22 bp, Homo sapiens
ggcctgtgcacatgtgcaggaa

SEQ ID NO: 9132152 - DNA, 22 bp, Homo sapiens
ggcctgtccagcctgcctggct

SEQ ID NO: 9132153 - DNA, 22 bp, Homo sapiens
ggcctgaggccaccagcagccc

SEQ ID NO: 9132154 - DNA, 19 bp, Homo sapiens
ggcctgaggccacagatcc

SEQ ID NO: 9132155 - DNA, 22 bp, Homo sapiens
ggcctgaggccaccagcagccc

SEQ ID NO: 9132156 - DNA, 22 bp, Homo sapiens
ggcctgaggcgtcccagctgtg

SEQ ID NO: 9132157 - DNA, 22 bp, Homo sapiens
ggcctgaggccaccagcagccc

SEQ ID NO: 9132158 - DNA, 22 bp, Homo sapiens
ggctcaatgcaacttctgcctc

SEQ ID NO: 9132159 - DNA, 22 bp, Homo sapiens
ggcctgtgtctgtgcctgtcct

SEQ ID NO: 9132160 - DNA, 22 bp, Homo sapiens
ggcctgtgtcctccttgccctg

SEQ ID NO: 9132161 - DNA, 22 bp, Homo sapiens
ggcctgtgctgagaacctggct

SEQ ID NO: 9132162 - DNA, 22 bp, Homo sapiens
ggcctgtggcaaggtgagaatg

SEQ ID NO: 9132163 - DNA, 22 bp, Homo sapiens
ggcctgtggctttggcgtctaa

SEQ ID NO: 9132164 - DNA, 22 bp, Homo sapiens
ggcctgtggtttctagtaggtt

SEQ ID NO: 9132165 - DNA, 22 bp, Homo sapiens
ggctcagggaatgaggaagaat

SEQ ID NO: 9132166 - DNA, 19 bp, Homo sapiens
ggctcagggcgctgccgcc

SEQ ID NO: 9132167 - DNA, 22 bp, Homo sapiens
ggctcaggcctgtaatcctagc

SEQ ID NO: 9132168 - DNA, 22 bp, Homo sapiens
cacagttttatcttatactgat

SEQ ID NO: 9132169 - DNA, 22 bp, Homo sapiens
cacataagtgggttccattgca

SEQ ID NO: 9132170 - DNA, 22 bp, Homo sapiens
cacataagaaatgaatatgaga

SEQ ID NO: 9132171 - DNA, 22 bp, Homo sapiens
cacatacaaggcacactggagg

SEQ ID NO: 9132172 - DNA, 22 bp, Homo sapiens
cacatacattcatgttactcta

SEQ ID NO: 9132173 - DNA, 22 bp, Homo sapiens
cacatactgagaatcacaccca

SEQ ID NO: 9132174 - DNA, 22 bp, Homo sapiens
cacatacatacgtatgtataca

SEQ ID NO: 9132175 - DNA, 22 bp, Homo sapiens
cacatacatacgtatgtataca

SEQ ID NO: 9132176 - DNA, 22 bp, Homo sapiens
cacatacatacgtatgtataca

SEQ ID NO: 9132177 - DNA, 22 bp, Homo sapiens
ggaggtgcagagtagggttggt

SEQ ID NO: 9132178 - DNA, 22 bp, Homo sapiens
ggaggtggagctggaagttcca

SEQ ID NO: 9132179 - DNA, 22 bp, Homo sapiens
ggaggtggaggttgcaatgagc

SEQ ID NO: 9132180 - DNA, 22 bp, Homo sapiens
cacagtgttccagagcagtggt

SEQ ID NO: 9132181 - DNA, 22 bp, Homo sapiens
ggaggtggaggttgcagtgagc

SEQ ID NO: 9132182 - DNA, 22 bp, Homo sapiens
ggaggtggaggttgcagtgagc

SEQ ID NO: 9132183 - DNA, 22 bp, Homo sapiens
ggcaggcagtgtggtgtgaaac

SEQ ID NO: 9132184 - DNA, 22 bp, Homo sapiens
ggcaggcagtgtggtgtgaaac

SEQ ID NO: 9132185 - DNA, 22 bp, Homo sapiens
ggcaggcaggagctctgtctcc

SEQ ID NO: 9132186 - DNA, 22 bp, Homo sapiens
ggcaggcaggagcgtgcttggg

SEQ ID NO: 9132187 - DNA, 20 bp, Homo sapiens
ggcagggagggatactgagg

SEQ ID NO: 9132188 - DNA, 22 bp, Homo sapiens
ggcagggaggaggtgaaagtga

SEQ ID NO: 9132189 - DNA, 22 bp, Homo sapiens
ggcagggagagcatgctgataa

SEQ ID NO: 9132190 - DNA, 22 bp, Homo sapiens
ggcagggagagcatgctgataa

SEQ ID NO: 9132191 - DNA, 22 bp, Homo sapiens
ggcagggagagcatgctgataa

SEQ ID NO: 9132192 - DNA, 22 bp, Homo sapiens
ggcaggcatggggtctgccatt

SEQ ID NO: 9132193 - DNA, 22 bp, Homo sapiens
ggcaggcatggggtctgccatt

SEQ ID NO: 9132194 - DNA, 22 bp, Homo sapiens
ggcaggcatcatcagttgatca

SEQ ID NO: 9132195 - DNA, 22 bp, Homo sapiens
ggcaggcatggccactccctag

SEQ ID NO: 9132196 - DNA, 22 bp, Homo sapiens
cacatttagaggttagcatggt

SEQ ID NO: 9132197 - DNA, 22 bp, Homo sapiens
cacatttagaggttagcatggt

SEQ ID NO: 9132198 - DNA, 22 bp, Homo sapiens
cacatttagaggttagcatggt

SEQ ID NO: 9132199 - DNA, 22 bp, Homo sapiens
cacatttacatataaaactttc

SEQ ID NO: 9132200 - DNA, 22 bp, Homo sapiens
cacatagaaaacttagcaggga

SEQ ID NO: 9132201 - DNA, 22 bp, Homo sapiens
cacatacttgtgtgtacatatg

SEQ ID NO: 9132202 - DNA, 22 bp, Homo sapiens
ggccgccctttccacggtttct

SEQ ID NO: 9132203 - DNA, 22 bp, Homo sapiens
ggcccttcctcttgtgctggca

SEQ ID NO: 9132204 - DNA, 21 bp, Homo sapiens
ggccctggttacgcctcctct

SEQ ID NO: 9132205 - DNA, 22 bp, Homo sapiens
ggccactgctctccagcctggg

SEQ ID NO: 9132206 - DNA, 22 bp, Homo sapiens
ggccactgctctccagcctggg

SEQ ID NO: 9132207 - DNA, 22 bp, Homo sapiens
ggccactgctctccagcctggg

SEQ ID NO: 9132208 - DNA, 22 bp, Homo sapiens
ggccactgtcctctagcccaga

SEQ ID NO: 9132209 - DNA, 22 bp, Homo sapiens
ggccactgtttcctgggcagtt

SEQ ID NO: 9132210 - DNA, 22 bp, Homo sapiens
ggccactgctgctctggtggag

SEQ ID NO: 9132211 - DNA, 22 bp, Homo sapiens
ggccactgacctacatctgggg

SEQ ID NO: 9132212 - DNA, 22 bp, Homo sapiens
ggccactgccctggctacaccg

SEQ ID NO: 9132213 - DNA, 22 bp, Homo sapiens
ggccactgcctccgccatggct

SEQ ID NO: 9132214 - DNA, 22 bp, Homo sapiens
ggccactgcctccgccatggct

SEQ ID NO: 9132215 - DNA, 22 bp, Homo sapiens
ggccactgcctccgccatggct

SEQ ID NO: 9132216 - DNA, 22 bp, Homo sapiens
ggccactgcctccgccatggct

SEQ ID NO: 9132217 - DNA, 23 bp, Homo sapiens
ggccactgaattttctgcatctt

SEQ ID NO: 9132218 - DNA, 23 bp, Homo sapiens
ggccactgaattttctgcatctt

SEQ ID NO: 9132219 - DNA, 22 bp, Homo sapiens
ggccactgacctacatctgggg

SEQ ID NO: 9132220 - DNA, 22 bp, Homo sapiens
ggccactgacctacatctgggg

SEQ ID NO: 9132221 - DNA, 22 bp, Homo sapiens
ggccactgccctggctacaccg

SEQ ID NO: 9132222 - DNA, 22 bp, Homo sapiens
cacgactgttaccggacccatg

SEQ ID NO: 9132223 - DNA, 22 bp, Homo sapiens
cacgagaacctctcatttgatt

SEQ ID NO: 9132224 - DNA, 22 bp, Homo sapiens
cacgaggccatctccttctgga

SEQ ID NO: 9132225 - DNA, 22 bp, Homo sapiens
cacgagggcacacgtgggaggg

SEQ ID NO: 9132226 - DNA, 20 bp, Homo sapiens
caccttcaaatttcctggca

SEQ ID NO: 9132227 - DNA, 22 bp, Homo sapiens
caccttcagaatgctccaggca

SEQ ID NO: 9132228 - DNA, 22 bp, Homo sapiens
caccttgtggcccagtcaggtt

SEQ ID NO: 9132229 - DNA, 21 bp, Homo sapiens
caccttggaaggtggagagtt

SEQ ID NO: 9132230 - DNA, 22 bp, Homo sapiens
cacctgggtcattgctggtgtt

SEQ ID NO: 9132231 - DNA, 20 bp, Homo sapiens
ggccggggagctctccaggg

SEQ ID NO: 9132232 - DNA, 22 bp, Homo sapiens
ggccggcttactgggtagggtg

SEQ ID NO: 9132233 - DNA, 22 bp, Homo sapiens
ggccgctgcgcctccaaccgag

SEQ ID NO: 9132234 - DNA, 21 bp, Homo sapiens
ggccgccgccttgtgctctgc

SEQ ID NO: 9132235 - DNA, 21 bp, Homo sapiens
ggccgccgccttgtgctctgc

SEQ ID NO: 9132236 - DNA, 22 bp, Homo sapiens
ggcaggtgatctagagtcaata

SEQ ID NO: 9132237 - DNA, 22 bp, Homo sapiens
ggcaggtgcacctgagccatct

SEQ ID NO: 9132238 - DNA, 22 bp, Homo sapiens
ggcaggtgccagttggcttggg

SEQ ID NO: 9132239 - DNA, 22 bp, Homo sapiens
ggcaggtgcccagagagcacga

SEQ ID NO: 9132240 - DNA, 22 bp, Homo sapiens
ggcagggagtggagactcccta

SEQ ID NO: 9132241 - DNA, 22 bp, Homo sapiens
ggcagggagtggagactcccta

SEQ ID NO: 9132242 - DNA, 20 bp, Homo sapiens
ggcagggagggatactgagg

SEQ ID NO: 9132243 - DNA, 22 bp, Homo sapiens
ggcagggcaggaaagtcaggaa

SEQ ID NO: 9132244 - DNA, 22 bp, Homo sapiens
ggcatcaggatctgtcttgctt

SEQ ID NO: 9132245 - DNA, 22 bp, Homo sapiens
ggcattaggtgaatgctcagca

SEQ ID NO: 9132246 - DNA, 22 bp, Homo sapiens
ggcatcaggacagggtttctag

SEQ ID NO: 9132247 - DNA, 22 bp, Homo sapiens
ggcaggtgcccagagagcacga

SEQ ID NO: 9132248 - DNA, 22 bp, Homo sapiens
ggcattgttctaggtggttgga

SEQ ID NO: 9132249 - DNA, 22 bp, Homo sapiens
ggcatttgagccattggcctgt

SEQ ID NO: 9132250 - DNA, 22 bp, Homo sapiens
ggccaagatggaaggagagatg

SEQ ID NO: 9132251 - DNA, 22 bp, Homo sapiens
ggccaagatggaaggagagatg

SEQ ID NO: 9132252 - DNA, 22 bp, Homo sapiens
ggccaagaatgataggctcagt

SEQ ID NO: 9132253 - DNA, 22 bp, Homo sapiens
ggcatttgagccattggcctgt

SEQ ID NO: 9132254 - DNA, 22 bp, Homo sapiens
ggccactcggccacccctgccg

SEQ ID NO: 9132255 - DNA, 22 bp, Homo sapiens
ggccactcggccacccctgccg

SEQ ID NO: 9132256 - DNA, 23 bp, Homo sapiens
ggccactgaattttctgcatctt

SEQ ID NO: 9132257 - DNA, 22 bp, Homo sapiens
ggccaccttcctgtggtctctg

SEQ ID NO: 9132258 - DNA, 22 bp, Homo sapiens
ggccaccttcctgtggtctctg

SEQ ID NO: 9132259 - DNA, 22 bp, Homo sapiens
ggccaaggatggtggctctggt

SEQ ID NO: 9132260 - DNA, 22 bp, Homo sapiens
ggccaaggatggtggctctggt

SEQ ID NO: 9132261 - DNA, 22 bp, Homo sapiens
cacagaactggttaatagcaga

SEQ ID NO: 9132262 - DNA, 22 bp, Homo sapiens
ggaaggggccttgagcaaactg

SEQ ID NO: 9132263 - DNA, 22 bp, Homo sapiens
ggaaggggccttgagcaaactg

SEQ ID NO: 9132264 - DNA, 22 bp, Homo sapiens
ggaaggggagctggaaagggta

SEQ ID NO: 9132265 - DNA, 22 bp, Homo sapiens
ggaaggggagctggaaagggta

SEQ ID NO: 9132266 - DNA, 22 bp, Homo sapiens
ggaaggggagctggaaagggta

SEQ ID NO: 9132267 - DNA, 22 bp, Homo sapiens
ggaaggggagctggaaagggta

SEQ ID NO: 9132268 - DNA, 22 bp, Homo sapiens
ggaaggggagctggaaagggta

SEQ ID NO: 9132269 - DNA, 20 bp, Homo sapiens
ggaaggggcaaagtgtgtga

SEQ ID NO: 9132270 - DNA, 20 bp, Homo sapiens
ggaaggggcaaagtgtgtga

SEQ ID NO: 9132271 - DNA, 21 bp, Homo sapiens
ggaagggctctgaggacggct

SEQ ID NO: 9132272 - DNA, 22 bp, Homo sapiens
ggaagggcctcgggcgtgggac

SEQ ID NO: 9132273 - DNA, 22 bp, Homo sapiens
ggaaggggagctggaaagggta

SEQ ID NO: 9132274 - DNA, 22 bp, Homo sapiens
ggaaggggagctaaatctactg

SEQ ID NO: 9132275 - DNA, 22 bp, Homo sapiens
cacacagacagctctctgaaga

SEQ ID NO: 9132276 - DNA, 22 bp, Homo sapiens
cacacagacagctctctgaaga

SEQ ID NO: 9132277 - DNA, 15 bp, Homo sapiens
cacacagacagcttg

SEQ ID NO: 9132278 - DNA, 22 bp, Homo sapiens
cacacagatggtaagggaggga

SEQ ID NO: 9132279 - DNA, 22 bp, Homo sapiens
cacacagcaacaagaatagcca

SEQ ID NO: 9132280 - DNA, 22 bp, Homo sapiens
cacaattttaatacacagtcaa

SEQ ID NO: 9132281 - DNA, 22 bp, Homo sapiens
cacacagctcaggggcactgcc

SEQ ID NO: 9132282 - DNA, 22 bp, Homo sapiens
cacacagctagtgacaggagaa

SEQ ID NO: 9132283 - DNA, 22 bp, Homo sapiens
cacacaggagagtgctggaggt

SEQ ID NO: 9132284 - DNA, 22 bp, Homo sapiens
cacacaggaaaattggaattaa

SEQ ID NO: 9132285 - DNA, 22 bp, Homo sapiens
ggaagggcctcgggcgtgggac

SEQ ID NO: 9132286 - DNA, 22 bp, Homo sapiens
cacacaggagagtgctggaggt

SEQ ID NO: 9132287 - DNA, 22 bp, Homo sapiens
cacagaggatgcccaagcgatc

SEQ ID NO: 9132288 - DNA, 22 bp, Homo sapiens
cacagaggatttttagggcagt

SEQ ID NO: 9132289 - DNA, 22 bp, Homo sapiens
cacagaggcatgaccctgccct

SEQ ID NO: 9132290 - DNA, 22 bp, Homo sapiens
cacagaggcatgaccctgccct

SEQ ID NO: 9132291 - DNA, 21 bp, Homo sapiens
cacagaggcgctgtatggctg

SEQ ID NO: 9132292 - DNA, 21 bp, Homo sapiens
cacagaggcgctgtatggctg

SEQ ID NO: 9132293 - DNA, 22 bp, Homo sapiens
cacagaggctcaaagccaggtg

SEQ ID NO: 9132294 - DNA, 22 bp, Homo sapiens
cacagagctggaaaggctgggc

SEQ ID NO: 9132295 - DNA, 22 bp, Homo sapiens
cacagagctcaagtcttagaaa

SEQ ID NO: 9132296 - DNA, 22 bp, Homo sapiens
cacagagctgaacctgggtcat

SEQ ID NO: 9132297 - DNA, 22 bp, Homo sapiens
cacagaggactgtagcggggag

SEQ ID NO: 9132298 - DNA, 22 bp, Homo sapiens
cacagaggaatgcatcagcaga

SEQ ID NO: 9132299 - DNA, 22 bp, Homo sapiens
cacagaggactgtagcggggag

SEQ ID NO: 9132300 - DNA, 22 bp, Homo sapiens
cacagaggaaaggcagttggta

SEQ ID NO: 9132301 - DNA, 22 bp, Homo sapiens
cacagaggaaatgactttctta

SEQ ID NO: 9132302 - DNA, 22 bp, Homo sapiens
cacagaattttctctttacaat

SEQ ID NO: 9132303 - DNA, 20 bp, Homo sapiens
cacagactgtatgggcacca

SEQ ID NO: 9132304 - DNA, 22 bp, Homo sapiens
ggactgggcatgggtgctctgc

SEQ ID NO: 9132305 - DNA, 22 bp, Homo sapiens
ggactgggcatgggtgctctgc

SEQ ID NO: 9132306 - DNA, 22 bp, Homo sapiens
ggactgggcatgggtgctctgc

SEQ ID NO: 9132307 - DNA, 22 bp, Homo sapiens
ggactgggccaggggttggact

SEQ ID NO: 9132308 - DNA, 22 bp, Homo sapiens
ggactgggattctggatctgct

SEQ ID NO: 9132309 - DNA, 22 bp, Homo sapiens
ggactgggagaatggaggcaag

SEQ ID NO: 9132310 - DNA, 22 bp, Homo sapiens
ggactgggattctggatctgct

SEQ ID NO: 9132311 - DNA, 22 bp, Homo sapiens
ggactgggcatgggtgctctgc

SEQ ID NO: 9132312 - DNA, 17 bp, Homo sapiens
ggactgggcggggcagg

SEQ ID NO: 9132313 - DNA, 22 bp, Homo sapiens
ggagctggcagcgcaacccaga

SEQ ID NO: 9132314 - DNA, 22 bp, Homo sapiens
ggagctggagagtacagagttt

SEQ ID NO: 9132315 - DNA, 22 bp, Homo sapiens
ggagctggcagcgcaacccaga

SEQ ID NO: 9132316 - DNA, 22 bp, Homo sapiens
ggagctgcttcttgctgtgggt

SEQ ID NO: 9132317 - DNA, 22 bp, Homo sapiens
ggagctggagagctagcctagg

SEQ ID NO: 9132318 - DNA, 22 bp, Homo sapiens
ggagcctgacagtgcccagcat

SEQ ID NO: 9132319 - DNA, 22 bp, Homo sapiens
ggagcctgacagtgcccagcat

SEQ ID NO: 9132320 - DNA, 22 bp, Homo sapiens
ggagcctgaaaagtctgcattt

SEQ ID NO: 9132321 - DNA, 22 bp, Homo sapiens
ggagcctgagcggcccagggcc

SEQ ID NO: 9132322 - DNA, 22 bp, Homo sapiens
ggagcctgagcggcccagggcc

SEQ ID NO: 9132323 - DNA, 22 bp, Homo sapiens
ggagcctgagggccctcttgga

SEQ ID NO: 9132324 - DNA, 23 bp, Homo sapiens
ggagctgctgttgggggagctgc

SEQ ID NO: 9132325 - DNA, 19 bp, Homo sapiens
ggagcctggagcacgtgcc

SEQ ID NO: 9132326 - DNA, 22 bp, Homo sapiens
ggagcctgcgggagctcccatt

SEQ ID NO: 9132327 - DNA, 22 bp, Homo sapiens
ggagcctgcgggagctcccatt

SEQ ID NO: 9132328 - DNA, 19 bp, Homo sapiens
ggagcctggagcacgtgcc

SEQ ID NO: 9132329 - DNA, 22 bp, Homo sapiens
ggagcctgcgggagctcccatt

SEQ ID NO: 9132330 - DNA, 22 bp, Homo sapiens
cacagagtggaggcttggcctg

SEQ ID NO: 9132331 - DNA, 22 bp, Homo sapiens
cacagagttgaatattgacatt

SEQ ID NO: 9132332 - DNA, 22 bp, Homo sapiens
cacagaggctcaaagccaggtg

SEQ ID NO: 9132333 - DNA, 22 bp, Homo sapiens
cacagaggtctgggcccagcag

SEQ ID NO: 9132334 - DNA, 22 bp, Homo sapiens
cacagaggtctgggcccagcag

SEQ ID NO: 9132335 - DNA, 22 bp, Homo sapiens
cacagatagaccttatgagatt

SEQ ID NO: 9132336 - DNA, 22 bp, Homo sapiens
cacagataaggatgttaatttt

SEQ ID NO: 9132337 - DNA, 22 bp, Homo sapiens
cacagataaggatgttaatttt

SEQ ID NO: 9132338 - DNA, 19 bp, Homo sapiens
ggagccgccgcccttcatt

SEQ ID NO: 9132339 - DNA, 19 bp, Homo sapiens
ggagccgccgcccttcatt

SEQ ID NO: 9132340 - DNA, 22 bp, Homo sapiens
ggagccctccatcccttgcggc

SEQ ID NO: 9132341 - DNA, 22 bp, Homo sapiens
ggagcaggcagggccgtgtctg

SEQ ID NO: 9132342 - DNA, 22 bp, Homo sapiens
ggagcaggcagggccgtgtctg

SEQ ID NO: 9132343 - DNA, 22 bp, Homo sapiens
cacaggaataagtcaaacttca

SEQ ID NO: 9132344 - DNA, 18 bp, Homo sapiens
cacaggaaggggaatatc

SEQ ID NO: 9132345 - DNA, 22 bp, Homo sapiens
cacaggaaggccttctcacaat

SEQ ID NO: 9132346 - DNA, 22 bp, Homo sapiens
cacaggaagtggtcagtgccag

SEQ ID NO: 9132347 - DNA, 22 bp, Homo sapiens
cacaggaagtggtcagtgccag

SEQ ID NO: 9132348 - DNA, 20 bp, Homo sapiens
ggagctggcatccagcctct

SEQ ID NO: 9132349 - DNA, 22 bp, Homo sapiens
cacaggaaggccttctcacaat

SEQ ID NO: 9132350 - DNA, 22 bp, Homo sapiens
cacaggaatgaacagggaaaga

SEQ ID NO: 9132351 - DNA, 22 bp, Homo sapiens
cacaggagaaaggggaagctcg

SEQ ID NO: 9132352 - DNA, 22 bp, Homo sapiens
ggaggcagaatagagtgtgggt

SEQ ID NO: 9132353 - DNA, 22 bp, Homo sapiens
ggaggcagaatagagtgtgggt

SEQ ID NO: 9132354 - DNA, 22 bp, Homo sapiens
cacaggcttccagtccccagct

SEQ ID NO: 9132355 - DNA, 22 bp, Homo sapiens
ggaggccaaggagggcggatca

SEQ ID NO: 9132356 - DNA, 22 bp, Homo sapiens
ggaggccaaggcaggcggatca

SEQ ID NO: 9132357 - DNA, 22 bp, Homo sapiens
ggaggccaaggcaggtggatca

SEQ ID NO: 9132358 - DNA, 22 bp, Homo sapiens
ggaggcaggaaagacaggttca

SEQ ID NO: 9132359 - DNA, 22 bp, Homo sapiens
ggaggcaggaaagacaggttca

SEQ ID NO: 9132360 - DNA, 22 bp, Homo sapiens
ggaggcatctctgtggctgtct

SEQ ID NO: 9132361 - DNA, 22 bp, Homo sapiens
ggaggccaaagtgtgggcggct

SEQ ID NO: 9132362 - DNA, 22 bp, Homo sapiens
ggaggccaaggaggagcttgcc

SEQ ID NO: 9132363 - DNA, 22 bp, Homo sapiens
caaggtctggttcctctgggtg

SEQ ID NO: 9132364 - DNA, 22 bp, Homo sapiens
caaggtgcagcgttgtcaagct

SEQ ID NO: 9132365 - DNA, 22 bp, Homo sapiens
caaggtgccatgctgggcgggg

SEQ ID NO: 9132366 - DNA, 22 bp, Homo sapiens
caaggtgccatgctgggcgggg

SEQ ID NO: 9132367 - DNA, 22 bp, Homo sapiens
caaggtgccatgctgggcgggg

SEQ ID NO: 9132368 - DNA, 22 bp, Homo sapiens
caagtatatttgaacatgtaaa

SEQ ID NO: 9132369 - DNA, 22 bp, Homo sapiens
caagtacaaaatgatatttagt

SEQ ID NO: 9132370 - DNA, 22 bp, Homo sapiens
caagtacaaaatgatatttagt

SEQ ID NO: 9132371 - DNA, 22 bp, Homo sapiens
caagtaacttgattaaggtaag

SEQ ID NO: 9132372 - DNA, 22 bp, Homo sapiens
caagtaatggttttataatagt

SEQ ID NO: 9132373 - DNA, 22 bp, Homo sapiens
caagtaaagaatcacatttctt

SEQ ID NO: 9132374 - DNA, 22 bp, Homo sapiens
caagtaaatgtgaactggaagg

SEQ ID NO: 9132375 - DNA, 22 bp, Homo sapiens
caagtaaagaatcacatttctt

SEQ ID NO: 9132376 - DNA, 22 bp, Homo sapiens
gctgttctttcagcccagggct

SEQ ID NO: 9132377 - DNA, 22 bp, Homo sapiens
gctgttctgcgtcccaggctgg

SEQ ID NO: 9132378 - DNA, 22 bp, Homo sapiens
gctgtggcctggcgcagagctg

SEQ ID NO: 9132379 - DNA, 22 bp, Homo sapiens
caagtcaagcatgcccttattt

SEQ ID NO: 9132380 - DNA, 22 bp, Homo sapiens
gctgtggcctggcgcagagctg

SEQ ID NO: 9132381 - DNA, 22 bp, Homo sapiens
caagtcaatacctgtggacaaa

SEQ ID NO: 9132382 - DNA, 22 bp, Homo sapiens
gctgtgttttatgttaggttaa

SEQ ID NO: 9132383 - DNA, 22 bp, Homo sapiens
gctttgaagtctgtgtcttttg

SEQ ID NO: 9132384 - DNA, 22 bp, Homo sapiens
gctttgacactcgcccagccct

SEQ ID NO: 9132385 - DNA, 22 bp, Homo sapiens
gctttgcacagtgctgtgttaa

SEQ ID NO: 9132386 - DNA, 22 bp, Homo sapiens
gctttgaagacttttccagggt

SEQ ID NO: 9132387 - DNA, 22 bp, Homo sapiens
gctttgccttgaactctcatgt

SEQ ID NO: 9132388 - DNA, 22 bp, Homo sapiens
gctttgccttgaactctcatgt

SEQ ID NO: 9132389 - DNA, 22 bp, Homo sapiens
gctttgcctgtagcattggcct

SEQ ID NO: 9132390 - DNA, 22 bp, Homo sapiens
gctttgcctcttctccttccag

SEQ ID NO: 9132391 - DNA, 22 bp, Homo sapiens
gctttgcctgccatatggggtc

SEQ ID NO: 9132392 - DNA, 22 bp, Homo sapiens
gctttgcctcttctccttccag

SEQ ID NO: 9132393 - DNA, 22 bp, Homo sapiens
gctttgcattgtgatgggatgc

SEQ ID NO: 9132394 - DNA, 22 bp, Homo sapiens
gctttgccacattcttcacatt

SEQ ID NO: 9132395 - DNA, 22 bp, Homo sapiens
gctttgccacattcttcacatt

SEQ ID NO: 9132396 - DNA, 22 bp, Homo sapiens
gctttgcctccaaagaaaaagt

SEQ ID NO: 9132397 - DNA, 22 bp, Homo sapiens
gctttgcccctttagtgggtgc

SEQ ID NO: 9132398 - DNA, 22 bp, Homo sapiens
gctttgcccaagggccctaccc

SEQ ID NO: 9132399 - DNA, 22 bp, Homo sapiens
gctttgcccaagggccctaccc

SEQ ID NO: 9132400 - DNA, 22 bp, Homo sapiens
gctttgcattcttgtgtgatca

SEQ ID NO: 9132401 - DNA, 22 bp, Homo sapiens
gctttgcactccagctgtggcc

SEQ ID NO: 9132402 - DNA, 22 bp, Homo sapiens
caatgtcagagaagctcatatc

SEQ ID NO: 9132403 - DNA, 22 bp, Homo sapiens
caatgtctagtttcccaaatcc

SEQ ID NO: 9132404 - DNA, 22 bp, Homo sapiens
caatgtctgaccgttttgccca

SEQ ID NO: 9132405 - DNA, 22 bp, Homo sapiens
caatgtatcaagaagcatcagt

SEQ ID NO: 9132406 - DNA, 22 bp, Homo sapiens
caatgtcttctatagttactca

SEQ ID NO: 9132407 - DNA, 21 bp, Homo sapiens
caatgtctgctctctgcctag

SEQ ID NO: 9132408 - DNA, 22 bp, Homo sapiens
caatgtctgggagacctgtgat

SEQ ID NO: 9132409 - DNA, 22 bp, Homo sapiens
gctttcttagtgtgttaattgg

SEQ ID NO: 9132410 - DNA, 22 bp, Homo sapiens
gctttctggtttgtgctacagg

SEQ ID NO: 9132411 - DNA, 22 bp, Homo sapiens
gcttggggagctcagtgtcctt

SEQ ID NO: 9132412 - DNA, 22 bp, Homo sapiens
gcttggggagctcagtgtcctt

SEQ ID NO: 9132413 - DNA, 22 bp, Homo sapiens
gcttggggagctcagtgtcctt

SEQ ID NO: 9132414 - DNA, 22 bp, Homo sapiens
gcttggggtcatgaggctgctg

SEQ ID NO: 9132415 - DNA, 22 bp, Homo sapiens
caagttttagaaatatctggat

SEQ ID NO: 9132416 - DNA, 22 bp, Homo sapiens
caagtttgtgttctatcattct

SEQ ID NO: 9132417 - DNA, 22 bp, Homo sapiens
caagtttggattatgaaaaagt

SEQ ID NO: 9132418 - DNA, 22 bp, Homo sapiens
caagttttgattttgcagtaaa

SEQ ID NO: 9132419 - DNA, 22 bp, Homo sapiens
caataactagtaattattccgg

SEQ ID NO: 9132420 - DNA, 22 bp, Homo sapiens
caagccagagagcaactgttct

SEQ ID NO: 9132421 - DNA, 22 bp, Homo sapiens
caagccagctcctgccacagag

SEQ ID NO: 9132422 - DNA, 22 bp, Homo sapiens
caagccagtcagctcagtagat

SEQ ID NO: 9132423 - DNA, 22 bp, Homo sapiens
caagccagtgacagccagggaa

SEQ ID NO: 9132424 - DNA, 22 bp, Homo sapiens
caagccagtgatgtttgctgcc

SEQ ID NO: 9132425 - DNA, 22 bp, Homo sapiens
caagccagtttgtagttctctc

SEQ ID NO: 9132426 - DNA, 22 bp, Homo sapiens
caaatgtataaatgtactttct

SEQ ID NO: 9132427 - DNA, 22 bp, Homo sapiens
caaatgtaattgcggtttttgc

SEQ ID NO: 9132428 - DNA, 22 bp, Homo sapiens
caaatgtaaattcttttgaagc

SEQ ID NO: 9132429 - DNA, 22 bp, Homo sapiens
caaatgtaatggcaggttttgc

SEQ ID NO: 9132430 - DNA, 22 bp, Homo sapiens
caagattatcttcttcttgtta

SEQ ID NO: 9132431 - DNA, 22 bp, Homo sapiens
caaatgtattctcacttcaggg

SEQ ID NO: 9132432 - DNA, 22 bp, Homo sapiens
caaatgtattctcacttcaggg

SEQ ID NO: 9132433 - DNA, 22 bp, Homo sapiens
caagcagccccaacatgaggat

SEQ ID NO: 9132434 - DNA, 22 bp, Homo sapiens
caagcaggatgaagcccaggga

SEQ ID NO: 9132435 - DNA, 22 bp, Homo sapiens
caagcaggaggagaagtttctg

SEQ ID NO: 9132436 - DNA, 21 bp, Homo sapiens
gctggctgtcccagggaagca

SEQ ID NO: 9132437 - DNA, 22 bp, Homo sapiens
gctggctgtatcacctggccag

SEQ ID NO: 9132438 - DNA, 22 bp, Homo sapiens
gctggctggtccagcaggggct

SEQ ID NO: 9132439 - DNA, 22 bp, Homo sapiens
gctggctgtatcacctggccag

SEQ ID NO: 9132440 - DNA, 22 bp, Homo sapiens
gctggctgggtccctgagaggc

SEQ ID NO: 9132441 - DNA, 22 bp, Homo sapiens
gctggctgggtccctgagaggc

SEQ ID NO: 9132442 - DNA, 22 bp, Homo sapiens
gctggctggctgtgcaaaggca

SEQ ID NO: 9132443 - DNA, 22 bp, Homo sapiens
gctggctggctgtgcaaaggca

SEQ ID NO: 9132444 - DNA, 20 bp, Homo sapiens
caaggcctggatctagttgc

SEQ ID NO: 9132445 - DNA, 22 bp, Homo sapiens
caaggccttcgtctcctagctt

SEQ ID NO: 9132446 - DNA, 22 bp, Homo sapiens
caaggcctgactgcttgtctaa

SEQ ID NO: 9132447 - DNA, 22 bp, Homo sapiens
caaggcctatgcacacctagga

SEQ ID NO: 9132448 - DNA, 22 bp, Homo sapiens
caaggcctaatcatactgctaa

SEQ ID NO: 9132449 - DNA, 22 bp, Homo sapiens
caaggcctaatcatactgctaa

SEQ ID NO: 9132450 - DNA, 22 bp, Homo sapiens
caaggccacgttctgcatgcgg

SEQ ID NO: 9132451 - DNA, 22 bp, Homo sapiens
gctggaggcagttcagacacca

SEQ ID NO: 9132452 - DNA, 22 bp, Homo sapiens
gctggaggcagttcagacacca

SEQ ID NO: 9132453 - DNA, 22 bp, Homo sapiens
gctggaggctggagtgcagtgg

SEQ ID NO: 9132454 - DNA, 22 bp, Homo sapiens
cagccctcaggtcctcagcagc

SEQ ID NO: 9132455 - DNA, 22 bp, Homo sapiens
cagccctcaggtcctcagcagc

SEQ ID NO: 9132456 - DNA, 22 bp, Homo sapiens
cagccctcaggtcctcagcagc

SEQ ID NO: 9132457 - DNA, 22 bp, Homo sapiens
gtctgtaattattaaagaaagg

SEQ ID NO: 9132458 - DNA, 22 bp, Homo sapiens
gtctgtagtcacacaggtgaca

SEQ ID NO: 9132459 - DNA, 22 bp, Homo sapiens
gtctgtggcaggggagaagttt

SEQ ID NO: 9132460 - DNA, 22 bp, Homo sapiens
gtctgtggcaggggagaagttt

SEQ ID NO: 9132461 - DNA, 22 bp, Homo sapiens
gtctgtggcaggggagaagttt

SEQ ID NO: 9132462 - DNA, 22 bp, Homo sapiens
gtctgtggagttgcttgctgga

SEQ ID NO: 9132463 - DNA, 22 bp, Homo sapiens
gtctgtgcttattcagcagggg

SEQ ID NO: 9132464 - DNA, 22 bp, Homo sapiens
gtctgtggtccctgctggggac

SEQ ID NO: 9132465 - DNA, 22 bp, Homo sapiens
cagcccctcacagagctgtcct

SEQ ID NO: 9132466 - DNA, 22 bp, Homo sapiens
cagcccctcacagagctgtcct

SEQ ID NO: 9132467 - DNA, 22 bp, Homo sapiens
cagccctcaaaccacttccagg

SEQ ID NO: 9132468 - DNA, 22 bp, Homo sapiens
cagccccttcctggcatctgga

SEQ ID NO: 9132469 - DNA, 22 bp, Homo sapiens
cagccccttgtccggtagccac

SEQ ID NO: 9132470 - DNA, 22 bp, Homo sapiens
cagccccttcctggcatctgga

SEQ ID NO: 9132471 - DNA, 22 bp, Homo sapiens
cagccccttcctggcatctgga

SEQ ID NO: 9132472 - DNA, 22 bp, Homo sapiens
cagccccttcctggcatctgga

SEQ ID NO: 9132473 - DNA, 22 bp, Homo sapiens
cagccaggttagtgctaattgt

SEQ ID NO: 9132474 - DNA, 22 bp, Homo sapiens
cagccaggtatgggcgtgcggg

SEQ ID NO: 9132475 - DNA, 22 bp, Homo sapiens
cagccaggtatgggcgtgcggg

SEQ ID NO: 9132476 - DNA, 22 bp, Homo sapiens
cagcccaggccgacagttcctc

SEQ ID NO: 9132477 - DNA, 22 bp, Homo sapiens
cagcccaggctcagatgttggg

SEQ ID NO: 9132478 - DNA, 22 bp, Homo sapiens
cagccagggtcaggcagcttct

SEQ ID NO: 9132479 - DNA, 22 bp, Homo sapiens
cagccagggagggcaaatgaga

SEQ ID NO: 9132480 - DNA, 22 bp, Homo sapiens
cagccagggtcaggcagcttct

SEQ ID NO: 9132481 - DNA, 22 bp, Homo sapiens
cagccaggggctggcgtgttga

SEQ ID NO: 9132482 - DNA, 22 bp, Homo sapiens
cagccaggggctggcgtgttga

SEQ ID NO: 9132483 - DNA, 22 bp, Homo sapiens
cagccaggggctggcgtgttga

SEQ ID NO: 9132484 - DNA, 22 bp, Homo sapiens
gtcccagggaagaaggcagcac

SEQ ID NO: 9132485 - DNA, 22 bp, Homo sapiens
gtcccaggcttatgtggagctt

SEQ ID NO: 9132486 - DNA, 22 bp, Homo sapiens
gtcccaggctccatggcagcca

SEQ ID NO: 9132487 - DNA, 22 bp, Homo sapiens
gtcccaggcttatgtggagctt

SEQ ID NO: 9132488 - DNA, 22 bp, Homo sapiens
gtccctgggcgcctccgtgctc

SEQ ID NO: 9132489 - DNA, 22 bp, Homo sapiens
gtccctggggaatcagctggag

SEQ ID NO: 9132490 - DNA, 22 bp, Homo sapiens
gtccctgggaaaggagagggca

SEQ ID NO: 9132491 - DNA, 19 bp, Homo sapiens
gtccctgggcagaggcacc

SEQ ID NO: 9132492 - DNA, 22 bp, Homo sapiens
gtccctgggtctaaggcagtaa

SEQ ID NO: 9132493 - DNA, 22 bp, Homo sapiens
gtccctggtttgcccaggacca

SEQ ID NO: 9132494 - DNA, 22 bp, Homo sapiens
gtccctgggtagctcagtggct

SEQ ID NO: 9132495 - DNA, 22 bp, Homo sapiens
gtccctgggggtttaggactca

SEQ ID NO: 9132496 - DNA, 22 bp, Homo sapiens
gtccctgggggtttaggactca

SEQ ID NO: 9132497 - DNA, 22 bp, Homo sapiens
gtccctgggggtttaggactca

SEQ ID NO: 9132498 - DNA, 22 bp, Homo sapiens
gtccctggtttgcccaggacca

SEQ ID NO: 9132499 - DNA, 19 bp, Homo sapiens
gtcccttcactcctgctgg

SEQ ID NO: 9132500 - DNA, 22 bp, Homo sapiens
gtctcttttatggtgagttgat

SEQ ID NO: 9132501 - DNA, 22 bp, Homo sapiens
gtctggaaccaagacgtgtagc

SEQ ID NO: 9132502 - DNA, 22 bp, Homo sapiens
gtctggaaaggggcttttatct

SEQ ID NO: 9132503 - DNA, 22 bp, Homo sapiens
gtctggaaattaagaggaggtt

SEQ ID NO: 9132504 - DNA, 22 bp, Homo sapiens
gtctggaaattcaatttaatgc

SEQ ID NO: 9132505 - DNA, 22 bp, Homo sapiens
gtctggaagagcaggaataaac

SEQ ID NO: 9132506 - DNA, 22 bp, Homo sapiens
gtctggaaggaggagatggagc

SEQ ID NO: 9132507 - DNA, 22 bp, Homo sapiens
gtctggaagggagtgcattttc

SEQ ID NO: 9132508 - DNA, 22 bp, Homo sapiens
gtctggaagtgtcttgttaagt

SEQ ID NO: 9132509 - DNA, 22 bp, Homo sapiens
cagccaggcctggtgaccaaag

SEQ ID NO: 9132510 - DNA, 22 bp, Homo sapiens
cagccagggagcaaagagttga

SEQ ID NO: 9132511 - DNA, 22 bp, Homo sapiens
cagccagggagcaaagagttga

SEQ ID NO: 9132512 - DNA, 22 bp, Homo sapiens
cagccagggagcaaagagttga

SEQ ID NO: 9132513 - DNA, 22 bp, Homo sapiens
cagccaggcccccgagtcgttg

SEQ ID NO: 9132514 - DNA, 22 bp, Homo sapiens
gtctggagacttgggtcatcaa

SEQ ID NO: 9132515 - DNA, 22 bp, Homo sapiens
gtctggagacttgggtcatcaa

SEQ ID NO: 9132516 - DNA, 22 bp, Homo sapiens
gtctggagacttgggtcatcaa

SEQ ID NO: 9132517 - DNA, 22 bp, Homo sapiens
gtctggagagctgagcagagtt

SEQ ID NO: 9132518 - DNA, 22 bp, Homo sapiens
gtctggagccaccctaagcatt

SEQ ID NO: 9132519 - DNA, 22 bp, Homo sapiens
gtctggagccactgctgctgct

SEQ ID NO: 9132520 - DNA, 22 bp, Homo sapiens
gtctggagagctgagcagagtt

SEQ ID NO: 9132521 - DNA, 22 bp, Homo sapiens
gtctggagccaccctaagcatt

SEQ ID NO: 9132522 - DNA, 22 bp, Homo sapiens
gtctggagccccagtcaatgag

SEQ ID NO: 9132523 - DNA, 22 bp, Homo sapiens
gtctggagccactgctgctgct

SEQ ID NO: 9132524 - DNA, 22 bp, Homo sapiens
gtctggagccccagtcaatgag

SEQ ID NO: 9132525 - DNA, 22 bp, Homo sapiens
cagcaggaaagacatctgagca

SEQ ID NO: 9132526 - DNA, 22 bp, Homo sapiens
cagcaggaaagacatctgagca

SEQ ID NO: 9132527 - DNA, 22 bp, Homo sapiens
cagcaggaaggtttcccctgca

SEQ ID NO: 9132528 - DNA, 22 bp, Homo sapiens
cagcaggaaagacatctgagca

SEQ ID NO: 9132529 - DNA, 22 bp, Homo sapiens
cagcaggaaacttaaaggtaat

SEQ ID NO: 9132530 - DNA, 22 bp, Homo sapiens
cagcaggaaaatcaattctgtg

SEQ ID NO: 9132531 - DNA, 20 bp, Homo sapiens
cagcaggaaaagtgcctcag

SEQ ID NO: 9132532 - DNA, 20 bp, Homo sapiens
cagcaggaaaagtgcctcag

SEQ ID NO: 9132533 - DNA, 20 bp, Homo sapiens
cagcaggaaaagtgcctcag

SEQ ID NO: 9132534 - DNA, 22 bp, Homo sapiens
gtcagcgtgctcagcctattat

SEQ ID NO: 9132535 - DNA, 22 bp, Homo sapiens
cagcaggacatggaggagtaaa

SEQ ID NO: 9132536 - DNA, 22 bp, Homo sapiens
cagcaggaagtactagctttga

SEQ ID NO: 9132537 - DNA, 22 bp, Homo sapiens
cagcaggaagtactagctttga

SEQ ID NO: 9132538 - DNA, 22 bp, Homo sapiens
cagcagcttttgcattctcatt

SEQ ID NO: 9132539 - DNA, 22 bp, Homo sapiens
cagcagctttgccaagtcagcc

SEQ ID NO: 9132540 - DNA, 22 bp, Homo sapiens
cagcagcttctgttgatcagaa

SEQ ID NO: 9132541 - DNA, 22 bp, Homo sapiens
cagcagctggtgagacacagcc

SEQ ID NO: 9132542 - DNA, 22 bp, Homo sapiens
cagcagctggttatacctgtgg

SEQ ID NO: 9132543 - DNA, 22 bp, Homo sapiens
cagcagctggttgaatccttct

SEQ ID NO: 9132544 - DNA, 22 bp, Homo sapiens
cagcagctgtttacggaacacc

SEQ ID NO: 9132545 - DNA, 22 bp, Homo sapiens
cagcagctgtttacggaacacc

SEQ ID NO: 9132546 - DNA, 22 bp, Homo sapiens
cagcacctacccatcctgagtc

SEQ ID NO: 9132547 - DNA, 22 bp, Homo sapiens
cagcaccattttcctggtcagc

SEQ ID NO: 9132548 - DNA, 22 bp, Homo sapiens
cagcaccctcggaggctgccgt

SEQ ID NO: 9132549 - DNA, 22 bp, Homo sapiens
cagcaccctcggaggctgccgt

SEQ ID NO: 9132550 - DNA, 22 bp, Homo sapiens
cagcacctgttagcattaaata

SEQ ID NO: 9132551 - DNA, 22 bp, Homo sapiens
cagcaccttccttaactccagg

SEQ ID NO: 9132552 - DNA, 22 bp, Homo sapiens
cagcaccttcctatccaggaga

SEQ ID NO: 9132553 - DNA, 22 bp, Homo sapiens
cagcagctacttggagcagcag

SEQ ID NO: 9132554 - DNA, 22 bp, Homo sapiens
cagcagctacttggagcagcag

SEQ ID NO: 9132555 - DNA, 22 bp, Homo sapiens
cagcagctagaggaagggcaga

SEQ ID NO: 9132556 - DNA, 22 bp, Homo sapiens
cagcagctgcctcagctgggga

SEQ ID NO: 9132557 - DNA, 22 bp, Homo sapiens
cagcagctgcctcagctgggga

SEQ ID NO: 9132558 - DNA, 23 bp, Homo sapiens
cagcagctgcctggttttttggt

SEQ ID NO: 9132559 - DNA, 22 bp, Homo sapiens
cagcagctgcaaatggaaacag

SEQ ID NO: 9132560 - DNA, 22 bp, Homo sapiens
cagcagctgatggggaagtgat

SEQ ID NO: 9132561 - DNA, 22 bp, Homo sapiens
cagcagctgatggggaagtgat

SEQ ID NO: 9132562 - DNA, 22 bp, Homo sapiens
cagcagctgatggggaagtgat

SEQ ID NO: 9132563 - DNA, 22 bp, Homo sapiens
cagcagctgcaaatggaaacag

SEQ ID NO: 9132564 - DNA, 22 bp, Homo sapiens
cagcagctgggaaggaggctga

SEQ ID NO: 9132565 - DNA, 22 bp, Homo sapiens
cagcagctgggaaggaggctga

SEQ ID NO: 9132566 - DNA, 22 bp, Homo sapiens
cagcagctgcgtgcccaggccg

SEQ ID NO: 9132567 - DNA, 22 bp, Homo sapiens
gtcccagaaacatattgctggt

SEQ ID NO: 9132568 - DNA, 22 bp, Homo sapiens
gtcccagaaacatattgctggt

SEQ ID NO: 9132569 - DNA, 22 bp, Homo sapiens
cagcaggctctgagtggctgcc

SEQ ID NO: 9132570 - DNA, 22 bp, Homo sapiens
cagcaggctctgagtggctgcc

SEQ ID NO: 9132571 - DNA, 22 bp, Homo sapiens
cagcaggctctgagtggctgcc

SEQ ID NO: 9132572 - DNA, 22 bp, Homo sapiens
gtcccaggaacattctggctag

SEQ ID NO: 9132573 - DNA, 22 bp, Homo sapiens
gtcccaggaacattctggctag

SEQ ID NO: 9132574 - DNA, 22 bp, Homo sapiens
gtcccagaggctttggccacag

SEQ ID NO: 9132575 - DNA, 22 bp, Homo sapiens
gtcccagaggctttggccacag

SEQ ID NO: 9132576 - DNA, 22 bp, Homo sapiens
gtcccagatgtctggaactccc

SEQ ID NO: 9132577 - DNA, 22 bp, Homo sapiens
gtcccagatgtctggaactccc

SEQ ID NO: 9132578 - DNA, 22 bp, Homo sapiens
gtcccagaggacagggtcacat

SEQ ID NO: 9132579 - DNA, 22 bp, Homo sapiens
gtcccagaggacagggtcacat

SEQ ID NO: 9132580 - DNA, 22 bp, Homo sapiens
gtcccagagagcactagtccat

SEQ ID NO: 9132581 - DNA, 22 bp, Homo sapiens
gtcccagagagcactagtccat

SEQ ID NO: 9132582 - DNA, 22 bp, Homo sapiens
gtcccaggagttgctgggcctt

SEQ ID NO: 9132583 - DNA, 22 bp, Homo sapiens
gtcccaggcagagtcaggaggg

SEQ ID NO: 9132584 - DNA, 22 bp, Homo sapiens
gtcccaggcagagtcaggaggg

SEQ ID NO: 9132585 - DNA, 22 bp, Homo sapiens
gtcccaggcaggccactggcag

SEQ ID NO: 9132586 - DNA, 22 bp, Homo sapiens
gtcatataggtaggattcagct

SEQ ID NO: 9132587 - DNA, 22 bp, Homo sapiens
gtcataggttcaaaaggcagat

SEQ ID NO: 9132588 - DNA, 22 bp, Homo sapiens
gtcataggttcaaaaggcagat

SEQ ID NO: 9132589 - DNA, 22 bp, Homo sapiens
gtcatagtagtggaacagcagc

SEQ ID NO: 9132590 - DNA, 22 bp, Homo sapiens
gtcatatacactgcatgtaatc

SEQ ID NO: 9132591 - DNA, 22 bp, Homo sapiens
gtcataggtagggggaaggatg

SEQ ID NO: 9132592 - DNA, 22 bp, Homo sapiens
gtcatagaggcctatataattt

SEQ ID NO: 9132593 - DNA, 22 bp, Homo sapiens
gtcatggaggattgtgagtggt

SEQ ID NO: 9132594 - DNA, 22 bp, Homo sapiens
gtcatgcatgggctctgaagaa

SEQ ID NO: 9132595 - DNA, 22 bp, Homo sapiens
gtcattaaaggttttaaatgct

SEQ ID NO: 9132596 - DNA, 22 bp, Homo sapiens
gtcattattctgggattctata

SEQ ID NO: 9132597 - DNA, 20 bp, Homo sapiens
cagcaggctatggggcaccc

SEQ ID NO: 9132598 - DNA, 22 bp, Homo sapiens
cagccctggcccaggtgcctta

SEQ ID NO: 9132599 - DNA, 22 bp, Homo sapiens
cagccctggcagctttcagggt

SEQ ID NO: 9132600 - DNA, 23 bp, Homo sapiens
cagccctggagatgtgggaggca

SEQ ID NO: 9132601 - DNA, 23 bp, Homo sapiens
cagccctggagatgtgggaggca

SEQ ID NO: 9132602 - DNA, 22 bp, Homo sapiens
cagccctgcttccccgctagtt

SEQ ID NO: 9132603 - DNA, 22 bp, Homo sapiens
cagccctgccatggagcctcct

SEQ ID NO: 9132604 - DNA, 22 bp, Homo sapiens
cagccctgccatggagcctcct

SEQ ID NO: 9132605 - DNA, 22 bp, Homo sapiens
cagccctgaaacaacctcctct

SEQ ID NO: 9132606 - DNA, 23 bp, Homo sapiens
cagccctgaaatcgaggtgacac

SEQ ID NO: 9132607 - DNA, 22 bp, Homo sapiens
cagccctgcagccatggcctgt

SEQ ID NO: 9132608 - DNA, 22 bp, Homo sapiens
cagccctgcagctggatctcac

SEQ ID NO: 9132609 - DNA, 22 bp, Homo sapiens
cagccctgctggcaatgatgag

SEQ ID NO: 9132610 - DNA, 22 bp, Homo sapiens
cagccctgctcttagtgtctcc

SEQ ID NO: 9132611 - DNA, 22 bp, Homo sapiens
cagctactcctcccatgacttc

SEQ ID NO: 9132612 - DNA, 22 bp, Homo sapiens
cagctagaaagtctgttaggga

SEQ ID NO: 9132613 - DNA, 22 bp, Homo sapiens
cagctacagttccactgagcat

SEQ ID NO: 9132614 - DNA, 22 bp, Homo sapiens
cagctacaggacgggcatctgc

SEQ ID NO: 9132615 - DNA, 22 bp, Homo sapiens
cagctagagggatgctgtgtga

SEQ ID NO: 9132616 - DNA, 22 bp, Homo sapiens
cagctaggaaaccagagggcag

SEQ ID NO: 9132617 - DNA, 22 bp, Homo sapiens
cagctaatcctctctatccaag

SEQ ID NO: 9132618 - DNA, 22 bp, Homo sapiens
cagctaaggctccttctaggta

SEQ ID NO: 9132619 - DNA, 22 bp, Homo sapiens
cagcctgtggcagaggtctaat

SEQ ID NO: 9132620 - DNA, 22 bp, Homo sapiens
cagctacaaatacttttgtatg

SEQ ID NO: 9132621 - DNA, 22 bp, Homo sapiens
cagctacaggacctgatgcacc

SEQ ID NO: 9132622 - DNA, 22 bp, Homo sapiens
cagctacagaggccacatggct

SEQ ID NO: 9132623 - DNA, 22 bp, Homo sapiens
cagctagggagtggcagagctt

SEQ ID NO: 9132624 - DNA, 22 bp, Homo sapiens
cagctaggaagtccttggcgaa

SEQ ID NO: 9132625 - DNA, 22 bp, Homo sapiens
cagcctggacagcgaccagagt

SEQ ID NO: 9132626 - DNA, 22 bp, Homo sapiens
cagcctggagccacagcccagg

SEQ ID NO: 9132627 - DNA, 22 bp, Homo sapiens
cagcctggagccacagcccagg

SEQ ID NO: 9132628 - DNA, 22 bp, Homo sapiens
cagcctgctagggcaatgcctt

SEQ ID NO: 9132629 - DNA, 22 bp, Homo sapiens
cagcctggacagcgaccagagt

SEQ ID NO: 9132630 - DNA, 22 bp, Homo sapiens
cagcctgtctgggcagagtgga

SEQ ID NO: 9132631 - DNA, 22 bp, Homo sapiens
cagcctgtagtctggtccaggt

SEQ ID NO: 9132632 - DNA, 22 bp, Homo sapiens
cagcctgtagtctggtccaggt

SEQ ID NO: 9132633 - DNA, 22 bp, Homo sapiens
cagcctgtcggctccttcattc

SEQ ID NO: 9132634 - DNA, 22 bp, Homo sapiens
cagcctgtagaatacagtaaat

SEQ ID NO: 9132635 - DNA, 22 bp, Homo sapiens
cagcctggtccccggctcaccc

SEQ ID NO: 9132636 - DNA, 22 bp, Homo sapiens
cagcctggattgcagaatgcta

SEQ ID NO: 9132637 - DNA, 22 bp, Homo sapiens
cagcctggcctgggactgctga

SEQ ID NO: 9132638 - DNA, 22 bp, Homo sapiens
gtgcccctggcaaatttccctg

SEQ ID NO: 9132639 - DNA, 22 bp, Homo sapiens
gtgcccctggcaaatttccctg

SEQ ID NO: 9132640 - DNA, 22 bp, Homo sapiens
gtgctgagtagaatgaatgcct

SEQ ID NO: 9132641 - DNA, 20 bp, Homo sapiens
gtgcccagttggtgacagac

SEQ ID NO: 9132642 - DNA, 22 bp, Homo sapiens
gtgctgtgtgatccatgctggc

SEQ ID NO: 9132643 - DNA, 22 bp, Homo sapiens
gtgctgtgtctatcaggaataa

SEQ ID NO: 9132644 - DNA, 22 bp, Homo sapiens
gtgctgtgcgctttttctgtat

SEQ ID NO: 9132645 - DNA, 18 bp, Homo sapiens
gtgctgtgggcagtggcc

SEQ ID NO: 9132646 - DNA, 22 bp, Homo sapiens
gtgctgttgcctggctgcacgg

SEQ ID NO: 9132647 - DNA, 22 bp, Homo sapiens
cagagacaggaatcagctgcag

SEQ ID NO: 9132648 - DNA, 22 bp, Homo sapiens
cagagacagcctgggagggaca

SEQ ID NO: 9132649 - DNA, 22 bp, Homo sapiens
gggcagcatgtcactagcatgg

SEQ ID NO: 9132650 - DNA, 22 bp, Homo sapiens
gggcagcatgtcactagcatgg

SEQ ID NO: 9132651 - DNA, 22 bp, Homo sapiens
gggcagcattctgtgggcaggt

SEQ ID NO: 9132652 - DNA, 22 bp, Homo sapiens
gggcagcattctgtgggcaggt

SEQ ID NO: 9132653 - DNA, 22 bp, Homo sapiens
gggcagcattctgtgggcaggt

SEQ ID NO: 9132654 - DNA, 22 bp, Homo sapiens
gggcagcatttgaaaaacagat

SEQ ID NO: 9132655 - DNA, 21 bp, Homo sapiens
gggcagcagcagcaacaaggg

SEQ ID NO: 9132656 - DNA, 22 bp, Homo sapiens
gggcagcagagccctgccgagt

SEQ ID NO: 9132657 - DNA, 22 bp, Homo sapiens
gggcagcagcaggaggtctctg

SEQ ID NO: 9132658 - DNA, 22 bp, Homo sapiens
gggcagcagcaggaggtctctg

SEQ ID NO: 9132659 - DNA, 22 bp, Homo sapiens
gggcagcagcaggaggtctctg

SEQ ID NO: 9132660 - DNA, 22 bp, Homo sapiens
gggcagcagcaggaggtctctg

SEQ ID NO: 9132661 - DNA, 22 bp, Homo sapiens
gggcagcagccactcatttagc

SEQ ID NO: 9132662 - DNA, 22 bp, Homo sapiens
gggcagcagccactcatttagc

SEQ ID NO: 9132663 - DNA, 22 bp, Homo sapiens
gggcagcaggctccacgttcct

SEQ ID NO: 9132664 - DNA, 22 bp, Homo sapiens
gggcagcatcaggaggggcttt

SEQ ID NO: 9132665 - DNA, 22 bp, Homo sapiens
gggcagcatgaggaccctcatc

SEQ ID NO: 9132666 - DNA, 22 bp, Homo sapiens
gggcagcaggctccacgttcct

SEQ ID NO: 9132667 - DNA, 22 bp, Homo sapiens
gggcagcaggctccacgttcct

SEQ ID NO: 9132668 - DNA, 22 bp, Homo sapiens
gggcagcagttgccctaatcaa

SEQ ID NO: 9132669 - DNA, 22 bp, Homo sapiens
gggcagcatcaggaggggcttt

SEQ ID NO: 9132670 - DNA, 22 bp, Homo sapiens
gggcagcataacaatcactgaa

SEQ ID NO: 9132671 - DNA, 22 bp, Homo sapiens
cagagacaggagtgctcccagt

SEQ ID NO: 9132672 - DNA, 22 bp, Homo sapiens
cagagacaggaatcagctgcag

SEQ ID NO: 9132673 - DNA, 22 bp, Homo sapiens
cagagacagggcagggagtgtg

SEQ ID NO: 9132674 - DNA, 22 bp, Homo sapiens
cagagacagtttcacagggtct

SEQ ID NO: 9132675 - DNA, 22 bp, Homo sapiens
gggcagtggttacacagctgag

SEQ ID NO: 9132676 - DNA, 22 bp, Homo sapiens
gggcagtgggtggctgcagcct

SEQ ID NO: 9132677 - DNA, 22 bp, Homo sapiens
gggcagtggtccaggctacagc

SEQ ID NO: 9132678 - DNA, 22 bp, Homo sapiens
gggcagtggctcacgcctgtaa

SEQ ID NO: 9132679 - DNA, 22 bp, Homo sapiens
gggcagtgggaccaggcaccag

SEQ ID NO: 9132680 - DNA, 22 bp, Homo sapiens
gggcagtgggtggctgcagcct

SEQ ID NO: 9132681 - DNA, 22 bp, Homo sapiens
gggcagtgggtggctgcagcct

SEQ ID NO: 9132682 - DNA, 22 bp, Homo sapiens
ggcttcaccaggtgcatgcatg

SEQ ID NO: 9132683 - DNA, 22 bp, Homo sapiens
ggcttagcaactcctgaggctc

SEQ ID NO: 9132684 - DNA, 22 bp, Homo sapiens
ggcttagcaactcctgaggctc

SEQ ID NO: 9132685 - DNA, 22 bp, Homo sapiens
ggcttaataaataacatgtcat

SEQ ID NO: 9132686 - DNA, 22 bp, Homo sapiens
ggcttcagctggttatttcctt

SEQ ID NO: 9132687 - DNA, 22 bp, Homo sapiens
ggcttcagctggttatttcctt

SEQ ID NO: 9132688 - DNA, 21 bp, Homo sapiens
cagaccctctagaggccacct

SEQ ID NO: 9132689 - DNA, 22 bp, Homo sapiens
cagaccctgggccacagaggag

SEQ ID NO: 9132690 - DNA, 22 bp, Homo sapiens
cagacccttttctgagaggacc

SEQ ID NO: 9132691 - DNA, 22 bp, Homo sapiens
cagaccccgagtttgcagagtt

SEQ ID NO: 9132692 - DNA, 22 bp, Homo sapiens
cagaccatcttgaagcaaactg

SEQ ID NO: 9132693 - DNA, 22 bp, Homo sapiens
cagaccagtagggctcatccca

SEQ ID NO: 9132694 - DNA, 22 bp, Homo sapiens
cagacctctttttagcactccc

SEQ ID NO: 9132695 - DNA, 22 bp, Homo sapiens
cagacctctttttagcactccc

SEQ ID NO: 9132696 - DNA, 22 bp, Homo sapiens
cagacctgaggagcactgagcc

SEQ ID NO: 9132697 - DNA, 20 bp, Homo sapiens
cagacctgcacccacttcga

SEQ ID NO: 9132698 - DNA, 22 bp, Homo sapiens
cagacctggaaaacaggcttgc

SEQ ID NO: 9132699 - DNA, 19 bp, Homo sapiens
cagacctgtccagcctgtg

SEQ ID NO: 9132700 - DNA, 22 bp, Homo sapiens
cagacctgggtccctggcctgt

SEQ ID NO: 9132701 - DNA, 22 bp, Homo sapiens
cagacctggggcctgggagccc

SEQ ID NO: 9132702 - DNA, 22 bp, Homo sapiens
cagacctgggtccctggcctgt

SEQ ID NO: 9132703 - DNA, 22 bp, Homo sapiens
cagactgaaaatccctggtagt

SEQ ID NO: 9132704 - DNA, 19 bp, Homo sapiens
cagactggttaagtagtcc

SEQ ID NO: 9132705 - DNA, 22 bp, Homo sapiens
cagactgggctggtggaaagct

SEQ ID NO: 9132706 - DNA, 22 bp, Homo sapiens
cagactgggagtcaggaagaag

SEQ ID NO: 9132707 - DNA, 22 bp, Homo sapiens
gggcagtgtggtcgtgcctttg

SEQ ID NO: 9132708 - DNA, 22 bp, Homo sapiens
gggcagtgtctggcccccaggc

SEQ ID NO: 9132709 - DNA, 22 bp, Homo sapiens
gggccaccccactgcccacgct

SEQ ID NO: 9132710 - DNA, 22 bp, Homo sapiens
gggccacattgaagggtgggta

SEQ ID NO: 9132711 - DNA, 22 bp, Homo sapiens
gggccactcctggctgctgagt

SEQ ID NO: 9132712 - DNA, 22 bp, Homo sapiens
gggccacctggattccatgtgt

SEQ ID NO: 9132713 - DNA, 22 bp, Homo sapiens
gggccactgggtcctgctggcc

SEQ ID NO: 9132714 - DNA, 22 bp, Homo sapiens
gggccacttctagtgcctcaga

SEQ ID NO: 9132715 - DNA, 22 bp, Homo sapiens
gggctgaatttgttgcatgtaa

SEQ ID NO: 9132716 - DNA, 22 bp, Homo sapiens
gggctgacaaccatctgacaag

SEQ ID NO: 9132717 - DNA, 22 bp, Homo sapiens
gggctgaaaggccgcctcagat

SEQ ID NO: 9132718 - DNA, 22 bp, Homo sapiens
gggctgaaaggccgcctcagat

SEQ ID NO: 9132719 - DNA, 22 bp, Homo sapiens
gggctctgtttagatcagagat

SEQ ID NO: 9132720 - DNA, 22 bp, Homo sapiens
gggctgaccccacccctcactc

SEQ ID NO: 9132721 - DNA, 22 bp, Homo sapiens
gggctgaatttgttgcatgtaa

SEQ ID NO: 9132722 - DNA, 22 bp, Homo sapiens
gggctgaatttgttgcatgtaa

SEQ ID NO: 9132723 - DNA, 22 bp, Homo sapiens
gggctgacaatctctttactta

SEQ ID NO: 9132724 - DNA, 19 bp, Homo sapiens
cagagcctcagagctagaa

SEQ ID NO: 9132725 - DNA, 19 bp, Homo sapiens
cagagcctcagagctagaa

SEQ ID NO: 9132726 - DNA, 22 bp, Homo sapiens
cagagcctaaaacgactccact

SEQ ID NO: 9132727 - DNA, 22 bp, Homo sapiens
cagagcccttggctggagccca

SEQ ID NO: 9132728 - DNA, 22 bp, Homo sapiens
gggctgactcaaccttgcaaag

SEQ ID NO: 9132729 - DNA, 22 bp, Homo sapiens
gggctgagaagttgatcccaag

SEQ ID NO: 9132730 - DNA, 22 bp, Homo sapiens
cagaggattatggagatggtct

SEQ ID NO: 9132731 - DNA, 22 bp, Homo sapiens
cagaggatatatggtttgtatg

SEQ ID NO: 9132732 - DNA, 22 bp, Homo sapiens
gggctgagtgggcctcttactt

SEQ ID NO: 9132733 - DNA, 20 bp, Homo sapiens
cagaggcaaggagacttgga

SEQ ID NO: 9132734 - DNA, 22 bp, Homo sapiens
cagaggcaaaagaggtggaggt

SEQ ID NO: 9132735 - DNA, 22 bp, Homo sapiens
cagaggcaaaagaggtggaggt

SEQ ID NO: 9132736 - DNA, 22 bp, Homo sapiens
gggctgagtcatctggggcctc

SEQ ID NO: 9132737 - DNA, 22 bp, Homo sapiens
gggctgagtctgctgcctgtca

SEQ ID NO: 9132738 - DNA, 22 bp, Homo sapiens
gggctgagtgacctcaggccaa

SEQ ID NO: 9132739 - DNA, 22 bp, Homo sapiens
gggctgagtgacctcaggccaa

SEQ ID NO: 9132740 - DNA, 22 bp, Homo sapiens
gggctgagtctgctgcctgtca

SEQ ID NO: 9132741 - DNA, 22 bp, Homo sapiens
gggctgagtctgctgcctgtca

SEQ ID NO: 9132742 - DNA, 22 bp, Homo sapiens
gggctgagtcatctggggcctc

SEQ ID NO: 9132743 - DNA, 22 bp, Homo sapiens
cagagctggggactgttggatg

SEQ ID NO: 9132744 - DNA, 22 bp, Homo sapiens
gggctgaggggtatctcatggg

SEQ ID NO: 9132745 - DNA, 22 bp, Homo sapiens
cagagctgggtttgggaaacct

SEQ ID NO: 9132746 - DNA, 20 bp, Homo sapiens
cagagctgggatttgaacac

SEQ ID NO: 9132747 - DNA, 22 bp, Homo sapiens
cagagctgggtttgggaaacct

SEQ ID NO: 9132748 - DNA, 22 bp, Homo sapiens
cagagctgggcatggtgaaagg

SEQ ID NO: 9132749 - DNA, 22 bp, Homo sapiens
cagagctggggactgttggatg

SEQ ID NO: 9132750 - DNA, 23 bp, Homo sapiens
cagagctggcttcatgggtgtgc

SEQ ID NO: 9132751 - DNA, 22 bp, Homo sapiens
cagagctgggatcccatgggcg

SEQ ID NO: 9132752 - DNA, 23 bp, Homo sapiens
cagagctggcttcatgggtgtgc

SEQ ID NO: 9132753 - DNA, 22 bp, Homo sapiens
cagagctgggatcccatgggcg

SEQ ID NO: 9132754 - DNA, 22 bp, Homo sapiens
cagagcctgccacctttctccc

SEQ ID NO: 9132755 - DNA, 22 bp, Homo sapiens
cagagcctctgccctgggcact

SEQ ID NO: 9132756 - DNA, 22 bp, Homo sapiens
cagagcctctcagaggtcagac

SEQ ID NO: 9132757 - DNA, 22 bp, Homo sapiens
cagagcctctaaaatttctatc

SEQ ID NO: 9132758 - DNA, 22 bp, Homo sapiens
cagagcctgcctctggctgtgg

SEQ ID NO: 9132759 - DNA, 19 bp, Homo sapiens
cagagctgctggcctcgtc

SEQ ID NO: 9132760 - DNA, 19 bp, Homo sapiens
cagagctgctggcctcgtc

SEQ ID NO: 9132761 - DNA, 22 bp, Homo sapiens
cagagctggctctgcatgtaca

SEQ ID NO: 9132762 - DNA, 22 bp, Homo sapiens
cagcaccaggcagacctggagc

SEQ ID NO: 9132763 - DNA, 22 bp, Homo sapiens
cagcaccatttgcagcctcttt

SEQ ID NO: 9132764 - DNA, 22 bp, Homo sapiens
cagcacagtttgcttggcagag

SEQ ID NO: 9132765 - DNA, 22 bp, Homo sapiens
cagcacatctgattatatgact

SEQ ID NO: 9132766 - DNA, 22 bp, Homo sapiens
cagcacagtttcccccatgagc

SEQ ID NO: 9132767 - DNA, 22 bp, Homo sapiens
cagcacagtttctggcccgccg

SEQ ID NO: 9132768 - DNA, 22 bp, Homo sapiens
cagcacagtgcagatgctgact

SEQ ID NO: 9132769 - DNA, 22 bp, Homo sapiens
cagcacagtgcagatgctgact

SEQ ID NO: 9132770 - DNA, 22 bp, Homo sapiens
cagcacagtgttaggtaatttg

SEQ ID NO: 9132771 - DNA, 22 bp, Homo sapiens
cagcacagtgttaggtaatttg

SEQ ID NO: 9132772 - DNA, 22 bp, Homo sapiens
cagcacagtcctttgcttactg

SEQ ID NO: 9132773 - DNA, 22 bp, Homo sapiens
cagcacagtagagtagttgtaa

SEQ ID NO: 9132774 - DNA, 22 bp, Homo sapiens
cagcacagtgaccagacccact

SEQ ID NO: 9132775 - DNA, 22 bp, Homo sapiens
ggtgctgattcactgacttctg

SEQ ID NO: 9132776 - DNA, 22 bp, Homo sapiens
ggtgctgatgttattgatgctg

SEQ ID NO: 9132777 - DNA, 22 bp, Homo sapiens
ggtgctgattaagaactgtata

SEQ ID NO: 9132778 - DNA, 22 bp, Homo sapiens
ggtgctgatgagttaggagagg

SEQ ID NO: 9132779 - DNA, 22 bp, Homo sapiens
ggtgctgatgagttaggagagg

SEQ ID NO: 9132780 - DNA, 22 bp, Homo sapiens
ggtgctgatgaagatgtagcct

SEQ ID NO: 9132781 - DNA, 22 bp, Homo sapiens
ggtgctggacacgtggcactcc

SEQ ID NO: 9132782 - DNA, 22 bp, Homo sapiens
ggtgctgatttgttgctgagat

SEQ ID NO: 9132783 - DNA, 22 bp, Homo sapiens
cagcacacagtgactcgcacct

SEQ ID NO: 9132784 - DNA, 21 bp, Homo sapiens
cagcacagtactgggtcttgc

SEQ ID NO: 9132785 - DNA, 23 bp, Homo sapiens
cagcacagtacatttcctgtctc

SEQ ID NO: 9132786 - DNA, 22 bp, Homo sapiens
cagcacagtacaaggcacggat

SEQ ID NO: 9132787 - DNA, 22 bp, Homo sapiens
ggtgctgacttcacagtcttac

SEQ ID NO: 9132788 - DNA, 22 bp, Homo sapiens
ggtgctgacttcacagtcttac

SEQ ID NO: 9132789 - DNA, 22 bp, Homo sapiens
ggtgctgagagcctaggagggc

SEQ ID NO: 9132790 - DNA, 22 bp, Homo sapiens
ggtgctgactctgtcgtgagca

SEQ ID NO: 9132791 - DNA, 22 bp, Homo sapiens
ggtgctgactgaggatggcttg

SEQ ID NO: 9132792 - DNA, 22 bp, Homo sapiens
ggtgctgactgaggatggcttg

SEQ ID NO: 9132793 - DNA, 22 bp, Homo sapiens
ggtgctgatctaaatttaggac

SEQ ID NO: 9132794 - DNA, 22 bp, Homo sapiens
ggtgctgatattgttttggtga

SEQ ID NO: 9132795 - DNA, 22 bp, Homo sapiens
ggtgctgatagtaacaataata

SEQ ID NO: 9132796 - DNA, 22 bp, Homo sapiens
ggtgctgatagtaacaataata

SEQ ID NO: 9132797 - DNA, 22 bp, Homo sapiens
ggtgctgagtgagctagaggct

SEQ ID NO: 9132798 - DNA, 20 bp, Homo sapiens
ggtgctgataagaaagaagt

SEQ ID NO: 9132799 - DNA, 20 bp, Homo sapiens
ggtgctgataagaaagaagt

SEQ ID NO: 9132800 - DNA, 22 bp, Homo sapiens
ggtgctgaggccttggcaggga

SEQ ID NO: 9132801 - DNA, 22 bp, Homo sapiens
ggtgctgacattcagagtctgg

SEQ ID NO: 9132802 - DNA, 22 bp, Homo sapiens
ggtgctgacattcagagtctgg

SEQ ID NO: 9132803 - DNA, 22 bp, Homo sapiens
ggtgctgacattcagagtctgg

SEQ ID NO: 9132804 - DNA, 22 bp, Homo sapiens
cagcaaggactgggcatgtgaa

SEQ ID NO: 9132805 - DNA, 22 bp, Homo sapiens
ggtgctgaataaatactagtta

SEQ ID NO: 9132806 - DNA, 22 bp, Homo sapiens
ggtgctgaattctggaggaggc

SEQ ID NO: 9132807 - DNA, 19 bp, Homo sapiens
ggtgctgacatcatgcttt

SEQ ID NO: 9132808 - DNA, 22 bp, Homo sapiens
ggtgctgaattctggaggaggc

SEQ ID NO: 9132809 - DNA, 21 bp, Homo sapiens
cagcaaggaagtcgagtaggt

SEQ ID NO: 9132810 - DNA, 22 bp, Homo sapiens
cagcaaggactgggcatgtgaa

SEQ ID NO: 9132811 - DNA, 22 bp, Homo sapiens
ggtgctgaaggactataacggt

SEQ ID NO: 9132812 - DNA, 22 bp, Homo sapiens
ggtgacggggcccaggtttcct

SEQ ID NO: 9132813 - DNA, 22 bp, Homo sapiens
ggtgacggggcccaggtttcct

SEQ ID NO: 9132814 - DNA, 22 bp, Homo sapiens
cagcaaagtaagctgacatgta

SEQ ID NO: 9132815 - DNA, 22 bp, Homo sapiens
cagcaagacaaggaacaaactg

SEQ ID NO: 9132816 - DNA, 21 bp, Homo sapiens
cagcaagacatgtttatcaag

SEQ ID NO: 9132817 - DNA, 22 bp, Homo sapiens
cagcaagacaggattcccgtgg

SEQ ID NO: 9132818 - DNA, 22 bp, Homo sapiens
cagcaagacagtttcctaagtg

SEQ ID NO: 9132819 - DNA, 22 bp, Homo sapiens
cagcaagatttttaaagcaagg

SEQ ID NO: 9132820 - DNA, 22 bp, Homo sapiens
cagcaagattaagggcagaaaa

SEQ ID NO: 9132821 - DNA, 22 bp, Homo sapiens
cagcaagatggtgaatgagacg

SEQ ID NO: 9132822 - DNA, 22 bp, Homo sapiens
cagcaagattaagggcagaaaa

SEQ ID NO: 9132823 - DNA, 22 bp, Homo sapiens
cagcaagagaggcagggcaaat

SEQ ID NO: 9132824 - DNA, 22 bp, Homo sapiens
cagcaagagactgttctctaag

SEQ ID NO: 9132825 - DNA, 22 bp, Homo sapiens
cagcaagacttcagggcttggt

SEQ ID NO: 9132826 - DNA, 22 bp, Homo sapiens
cagcaagagactgttctctaag

SEQ ID NO: 9132827 - DNA, 22 bp, Homo sapiens
cagcaagacttcagggcttggt

SEQ ID NO: 9132828 - DNA, 22 bp, Homo sapiens
cagcaagagaggcagggcaaat

SEQ ID NO: 9132829 - DNA, 22 bp, Homo sapiens
cagcaagagggtaaggttgaag

SEQ ID NO: 9132830 - DNA, 22 bp, Homo sapiens
cagcaagagggtaaggttgaag

SEQ ID NO: 9132831 - DNA, 22 bp, Homo sapiens
cagcaagagttggggttgttgg

SEQ ID NO: 9132832 - DNA, 18 bp, Homo sapiens
ggtctgagatcgtttttc

SEQ ID NO: 9132833 - DNA, 22 bp, Homo sapiens
ggtctgagctctaaaactaact

SEQ ID NO: 9132834 - DNA, 18 bp, Homo sapiens
ggtctgagatcgtttttc

SEQ ID NO: 9132835 - DNA, 22 bp, Homo sapiens
ggtctgagcttgagcccatgct

SEQ ID NO: 9132836 - DNA, 22 bp, Homo sapiens
ggtgacatctagagacatccaa

SEQ ID NO: 9132837 - DNA, 22 bp, Homo sapiens
ggtgacatagttacttcaggct

SEQ ID NO: 9132838 - DNA, 22 bp, Homo sapiens
ggtgacctcacctggtcccacc

SEQ ID NO: 9132839 - DNA, 22 bp, Homo sapiens
ggtctggaagcgcagtaggctg

SEQ ID NO: 9132840 - DNA, 22 bp, Homo sapiens
ggtctggaagcgtcccaaaggt

SEQ ID NO: 9132841 - DNA, 22 bp, Homo sapiens
ggtctggaacgaggtctaagcc

SEQ ID NO: 9132842 - DNA, 22 bp, Homo sapiens
ggtctggaacccctcaagtgac

SEQ ID NO: 9132843 - DNA, 22 bp, Homo sapiens
cagagggctcttggctgcctgc

SEQ ID NO: 9132844 - DNA, 22 bp, Homo sapiens
cagagggctgtgtaaggatgtt

SEQ ID NO: 9132845 - DNA, 22 bp, Homo sapiens
cagagggcttcaggttcaggat

SEQ ID NO: 9132846 - DNA, 22 bp, Homo sapiens
cagagggctgtgtaaggatgtt

SEQ ID NO: 9132847 - DNA, 22 bp, Homo sapiens
cagagggctcggcggccgctcc

SEQ ID NO: 9132848 - DNA, 22 bp, Homo sapiens
cagagggctcggcggccgctcc

SEQ ID NO: 9132849 - DNA, 22 bp, Homo sapiens
cagagggctcagtcctgctgga

SEQ ID NO: 9132850 - DNA, 22 bp, Homo sapiens
cagagggctcagtcctgctgga

SEQ ID NO: 9132851 - DNA, 22 bp, Homo sapiens
cagagggaaaaggggagtaata

SEQ ID NO: 9132852 - DNA, 22 bp, Homo sapiens
cagaggctttgccctggaaacc

SEQ ID NO: 9132853 - DNA, 22 bp, Homo sapiens
cagaggggtgtagagatcactg

SEQ ID NO: 9132854 - DNA, 22 bp, Homo sapiens
cagagggcttcaggttcaggat

SEQ ID NO: 9132855 - DNA, 22 bp, Homo sapiens
cagaggggataacaggtgtaga

SEQ ID NO: 9132856 - DNA, 21 bp, Homo sapiens
cagaggggctagcctggctgc

SEQ ID NO: 9132857 - DNA, 21 bp, Homo sapiens
cagaggggctagcctggctgc

SEQ ID NO: 9132858 - DNA, 22 bp, Homo sapiens
cagaggcacagtgcgggccact

SEQ ID NO: 9132859 - DNA, 22 bp, Homo sapiens
cagaggcacaagaaagcaaggc

SEQ ID NO: 9132860 - DNA, 22 bp, Homo sapiens
cagaggcacaagaaagcaaggc

SEQ ID NO: 9132861 - DNA, 22 bp, Homo sapiens
cagaggcacagcttcttttaat

SEQ ID NO: 9132862 - DNA, 22 bp, Homo sapiens
cagaggcacagcttcttttaat

SEQ ID NO: 9132863 - DNA, 22 bp, Homo sapiens
cagaggcacagcttcttttaat

SEQ ID NO: 9132864 - DNA, 19 bp, Homo sapiens
cagaggcaccaggtataga

SEQ ID NO: 9132865 - DNA, 19 bp, Homo sapiens
cagaggcaccaggtataga

SEQ ID NO: 9132866 - DNA, 16 bp, Homo sapiens
cagaggcacctggctc

SEQ ID NO: 9132867 - DNA, 22 bp, Homo sapiens
ggggagagtcctttccagttcc

SEQ ID NO: 9132868 - DNA, 22 bp, Homo sapiens
ggggagcagaagcagcaacaac

SEQ ID NO: 9132869 - DNA, 22 bp, Homo sapiens
ggggagcaatagttgaggtgtg

SEQ ID NO: 9132870 - DNA, 22 bp, Homo sapiens
ggggagctgagacactgccctc

SEQ ID NO: 9132871 - DNA, 22 bp, Homo sapiens
ggggagctgggaggtgagttac

SEQ ID NO: 9132872 - DNA, 21 bp, Homo sapiens
ggtcagtggctttcttgcacc

SEQ ID NO: 9132873 - DNA, 22 bp, Homo sapiens
ggtcagtggcagggggtacttc

SEQ ID NO: 9132874 - DNA, 22 bp, Homo sapiens
ggtcagtgtttcatctgtgaaa

SEQ ID NO: 9132875 - DNA, 22 bp, Homo sapiens
ggtcagtgtacacatgtgcagg

SEQ ID NO: 9132876 - DNA, 22 bp, Homo sapiens
ggtcagtgcgatttcccactcc

SEQ ID NO: 9132877 - DNA, 23 bp, Homo sapiens
ggtcagtgagttcgtttctctgg

SEQ ID NO: 9132878 - DNA, 23 bp, Homo sapiens
ggtcagtgagttcgtttctctgg

SEQ ID NO: 9132879 - DNA, 22 bp, Homo sapiens
ggtcagtgacttttttctgtgg

SEQ ID NO: 9132880 - DNA, 22 bp, Homo sapiens
ggtcagtgacttttttctgtgg

SEQ ID NO: 9132881 - DNA, 22 bp, Homo sapiens
ggtcacaggggagaagagtgat

SEQ ID NO: 9132882 - DNA, 22 bp, Homo sapiens
ggtcattgaaatcagaagggtt

SEQ ID NO: 9132883 - DNA, 22 bp, Homo sapiens
ggtccacctccaagctggggac

SEQ ID NO: 9132884 - DNA, 22 bp, Homo sapiens
ggtcatggatagctggagcctt

SEQ ID NO: 9132885 - DNA, 23 bp, Homo sapiens
cagagtcagggggccccacctct

SEQ ID NO: 9132886 - DNA, 19 bp, Homo sapiens
cagagtccttgaccagtcc

SEQ ID NO: 9132887 - DNA, 22 bp, Homo sapiens
cagagtctctgggaggctgggt

SEQ ID NO: 9132888 - DNA, 22 bp, Homo sapiens
cagagtctctgggaggctgggt

SEQ ID NO: 9132889 - DNA, 17 bp, Homo sapiens
cagagtctgtctgcatc

SEQ ID NO: 9132890 - DNA, 17 bp, Homo sapiens
cagagtctgtctgcatc

SEQ ID NO: 9132891 - DNA, 22 bp, Homo sapiens
cagagtctggactgcaggctcc

SEQ ID NO: 9132892 - DNA, 22 bp, Homo sapiens
cagagtcttgtgtgttcagccc

SEQ ID NO: 9132893 - DNA, 17 bp, Homo sapiens
cagagtctgtctgcatc

SEQ ID NO: 9132894 - DNA, 22 bp, Homo sapiens
cagagtctggactgcaggctcc

SEQ ID NO: 9132895 - DNA, 22 bp, Homo sapiens
cagagtctggactgcaggctcc

SEQ ID NO: 9132896 - DNA, 22 bp, Homo sapiens
cagagtctggactgcaggctcc

SEQ ID NO: 9132897 - DNA, 22 bp, Homo sapiens
ggtcctgggaagatgctcatga

SEQ ID NO: 9132898 - DNA, 19 bp, Homo sapiens
gaattttaggacttcagca

SEQ ID NO: 9132899 - DNA, 22 bp, Homo sapiens
gaattttatcttattacttgca

SEQ ID NO: 9132900 - DNA, 22 bp, Homo sapiens
gaattttatcttattacttgca

SEQ ID NO: 9132901 - DNA, 22 bp, Homo sapiens
gaattttatcttattacttgca

SEQ ID NO: 9132902 - DNA, 22 bp, Homo sapiens
gacaatggtggatacatgtcat

SEQ ID NO: 9132903 - DNA, 22 bp, Homo sapiens
gacaatcagccatatccagggt

SEQ ID NO: 9132904 - DNA, 22 bp, Homo sapiens
gacaataaagtgatacatggga

SEQ ID NO: 9132905 - DNA, 22 bp, Homo sapiens
gaatacaaataataccaaggtg

SEQ ID NO: 9132906 - DNA, 22 bp, Homo sapiens
gaatatttttaaagggactaat

SEQ ID NO: 9132907 - DNA, 22 bp, Homo sapiens
gaatatttttaaagggactaat

SEQ ID NO: 9132908 - DNA, 22 bp, Homo sapiens
gaatatttttaaagggactaat

SEQ ID NO: 9132909 - DNA, 22 bp, Homo sapiens
gaatcaaatcaagttcttttga

SEQ ID NO: 9132910 - DNA, 22 bp, Homo sapiens
gaataatcatatcgtctcacat

SEQ ID NO: 9132911 - DNA, 22 bp, Homo sapiens
gaataatcatgaaattcagtga

SEQ ID NO: 9132912 - DNA, 22 bp, Homo sapiens
gaataattgtgatgcttgaagt

SEQ ID NO: 9132913 - DNA, 22 bp, Homo sapiens
gaataattttgatcagaaggga

SEQ ID NO: 9132914 - DNA, 22 bp, Homo sapiens
gaatacaaagcagaactcatac

SEQ ID NO: 9132915 - DNA, 22 bp, Homo sapiens
gaatacaaagcagaactcatac

SEQ ID NO: 9132916 - DNA, 23 bp, Homo sapiens
gaatacaaagcagatggtccagc

SEQ ID NO: 9132917 - DNA, 22 bp, Homo sapiens
gaatacaaagcagaactcatac

SEQ ID NO: 9132918 - DNA, 22 bp, Homo sapiens
gaatacaaacttaaggctttac

SEQ ID NO: 9132919 - DNA, 22 bp, Homo sapiens
gaataatagcagaaattagcag

SEQ ID NO: 9132920 - DNA, 22 bp, Homo sapiens
gaataatattgactttgcaggc

SEQ ID NO: 9132921 - DNA, 22 bp, Homo sapiens
gaataatattgactttgcaggc

SEQ ID NO: 9132922 - DNA, 22 bp, Homo sapiens
gaataactaaatggcagttctt

SEQ ID NO: 9132923 - DNA, 22 bp, Homo sapiens
gaagtcttgaaacacaaactag

SEQ ID NO: 9132924 - DNA, 22 bp, Homo sapiens
gaagtcttcattctctctgaga

SEQ ID NO: 9132925 - DNA, 22 bp, Homo sapiens
atgcacagtaatgagctggttg

SEQ ID NO: 9132926 - DNA, 22 bp, Homo sapiens
gaaggctgctgggaagtgtggt

SEQ ID NO: 9132927 - DNA, 22 bp, Homo sapiens
gaaggcaagatctcagtggagg

SEQ ID NO: 9132928 - DNA, 22 bp, Homo sapiens
gaaggctggctttctgagagca

SEQ ID NO: 9132929 - DNA, 22 bp, Homo sapiens
gaaggctggctttctgagagca

SEQ ID NO: 9132930 - DNA, 22 bp, Homo sapiens
gaaggctggctttctgagagca

SEQ ID NO: 9132931 - DNA, 22 bp, Homo sapiens
gaaggctggaaggcaagtagga

SEQ ID NO: 9132932 - DNA, 22 bp, Homo sapiens
gaaggctggaaggcaagtagga

SEQ ID NO: 9132933 - DNA, 22 bp, Homo sapiens
gaacaaatcccttcctgtctcc

SEQ ID NO: 9132934 - DNA, 22 bp, Homo sapiens
gaacaaattctcatcaacttgt

SEQ ID NO: 9132935 - DNA, 22 bp, Homo sapiens
gaacaaattctcatcaacttgt

SEQ ID NO: 9132936 - DNA, 22 bp, Homo sapiens
gaacaaattggagaaatcagga

SEQ ID NO: 9132937 - DNA, 22 bp, Homo sapiens
gaacaaattggagaaatcagga

SEQ ID NO: 9132938 - DNA, 22 bp, Homo sapiens
gaacaaagacatggaggaggat

SEQ ID NO: 9132939 - DNA, 22 bp, Homo sapiens
gaacaaacatttttggcagtat

SEQ ID NO: 9132940 - DNA, 22 bp, Homo sapiens
gaacaaacagtcaggacagtct

SEQ ID NO: 9132941 - DNA, 22 bp, Homo sapiens
gaaggctgtcagagaggagggc

SEQ ID NO: 9132942 - DNA, 22 bp, Homo sapiens
gaaggctgtggctggtctcagt

SEQ ID NO: 9132943 - DNA, 22 bp, Homo sapiens
gaaggctgtttctggtagtgat

SEQ ID NO: 9132944 - DNA, 22 bp, Homo sapiens
gaaggctgtttctggtagtgat

SEQ ID NO: 9132945 - DNA, 22 bp, Homo sapiens
atgcacacacattatgtctgtg

SEQ ID NO: 9132946 - DNA, 22 bp, Homo sapiens
atgcacagaacaattttaagag

SEQ ID NO: 9132947 - DNA, 22 bp, Homo sapiens
atgcacaggaagtgtccccatt

SEQ ID NO: 9132948 - DNA, 22 bp, Homo sapiens
atgcacaggacagcctctactc

SEQ ID NO: 9132949 - DNA, 22 bp, Homo sapiens
atgcacagctgaacactctaaa

SEQ ID NO: 9132950 - DNA, 22 bp, Homo sapiens
atgcacagatcctggcacttag

SEQ ID NO: 9132951 - DNA, 22 bp, Homo sapiens
atgcacagcagtgagttcagtg

SEQ ID NO: 9132952 - DNA, 22 bp, Homo sapiens
gacaccaggaatagttctgtct

SEQ ID NO: 9132953 - DNA, 22 bp, Homo sapiens
gacaccagtaaatattcaaaag

SEQ ID NO: 9132954 - DNA, 22 bp, Homo sapiens
gacactaaagtatagggtatct

SEQ ID NO: 9132955 - DNA, 22 bp, Homo sapiens
gacaccagaagacataagcaga

SEQ ID NO: 9132956 - DNA, 22 bp, Homo sapiens
gacaccagagactgatgaggcc

SEQ ID NO: 9132957 - DNA, 22 bp, Homo sapiens
gacacatgtcagacggacaccc

SEQ ID NO: 9132958 - DNA, 18 bp, Homo sapiens
gacacatccccaggcctc

SEQ ID NO: 9132959 - DNA, 22 bp, Homo sapiens
gacacatagatctatctcactc

SEQ ID NO: 9132960 - DNA, 22 bp, Homo sapiens
gacacatatgcgtatagtttag

SEQ ID NO: 9132961 - DNA, 22 bp, Homo sapiens
gacaattaggttaagagcaaga

SEQ ID NO: 9132962 - DNA, 22 bp, Homo sapiens
gacacactgtttggactagggt

SEQ ID NO: 9132963 - DNA, 22 bp, Homo sapiens
gaccacagagcacggcctgctt

SEQ ID NO: 9132964 - DNA, 22 bp, Homo sapiens
atgctatgtaactggcagatag

SEQ ID NO: 9132965 - DNA, 22 bp, Homo sapiens
gacataatcctcctcacctact

SEQ ID NO: 9132966 - DNA, 22 bp, Homo sapiens
gacactccagcttttggctcaa

SEQ ID NO: 9132967 - DNA, 22 bp, Homo sapiens
gacatttattagaaaactatca

SEQ ID NO: 9132968 - DNA, 22 bp, Homo sapiens
gacatttattagaaaactatca

SEQ ID NO: 9132969 - DNA, 22 bp, Homo sapiens
gacatttattagaaaactatca

SEQ ID NO: 9132970 - DNA, 22 bp, Homo sapiens
gacatttattggattttacgag

SEQ ID NO: 9132971 - DNA, 22 bp, Homo sapiens
gacatttattggattttacgag

SEQ ID NO: 9132972 - DNA, 22 bp, Homo sapiens
gacgagagactccatccaccac

SEQ ID NO: 9132973 - DNA, 22 bp, Homo sapiens
gacgccgtgtcccggcactctt

SEQ ID NO: 9132974 - DNA, 22 bp, Homo sapiens
gacgcctcttccctgctgcact

SEQ ID NO: 9132975 - DNA, 22 bp, Homo sapiens
gactgggagggttcagctgggt

SEQ ID NO: 9132976 - DNA, 22 bp, Homo sapiens
gactggatttatagatatcata

SEQ ID NO: 9132977 - DNA, 22 bp, Homo sapiens
gactggctcactccactcctat

SEQ ID NO: 9132978 - DNA, 22 bp, Homo sapiens
gactggatacccttttctgcat

SEQ ID NO: 9132979 - DNA, 22 bp, Homo sapiens
gactggatggaggcttagaagg

SEQ ID NO: 9132980 - DNA, 22 bp, Homo sapiens
gactggatattgagtactgcaa

SEQ ID NO: 9132981 - DNA, 22 bp, Homo sapiens
gactggatgtttaatcaacaga

SEQ ID NO: 9132982 - DNA, 22 bp, Homo sapiens
gactggattctgctttggctgt

SEQ ID NO: 9132983 - DNA, 22 bp, Homo sapiens
gactggatgttttgaacatgag

SEQ ID NO: 9132984 - DNA, 22 bp, Homo sapiens
gactggatttaaggacttctga

SEQ ID NO: 9132985 - DNA, 21 bp, Homo sapiens
gactggataatgtataaacag

SEQ ID NO: 9132986 - DNA, 22 bp, Homo sapiens
atgctcagcctgaggtggggag

SEQ ID NO: 9132987 - DNA, 22 bp, Homo sapiens
atgctcagggcacactctggac

SEQ ID NO: 9132988 - DNA, 22 bp, Homo sapiens
atgctcagggcacactctggac

SEQ ID NO: 9132989 - DNA, 22 bp, Homo sapiens
atgctcagacaccgggcggggg

SEQ ID NO: 9132990 - DNA, 22 bp, Homo sapiens
atgctcagggcacactctggac

SEQ ID NO: 9132991 - DNA, 22 bp, Homo sapiens
atgctcaggttttgcccaagac

SEQ ID NO: 9132992 - DNA, 22 bp, Homo sapiens
atgctattccagaatgtaaatt

SEQ ID NO: 9132993 - DNA, 22 bp, Homo sapiens
atgctcagtagctggctgaccc

SEQ ID NO: 9132994 - DNA, 22 bp, Homo sapiens
atgctcaggttttgcccaagac

SEQ ID NO: 9132995 - DNA, 22 bp, Homo sapiens
atgctccttggcttcaaagcca

SEQ ID NO: 9132996 - DNA, 18 bp, Homo sapiens
atgatcttagcaaatatt

SEQ ID NO: 9132997 - DNA, 22 bp, Homo sapiens
atgatccaaagccacaggggca

SEQ ID NO: 9132998 - DNA, 22 bp, Homo sapiens
gaaatttattatctacatcatt

SEQ ID NO: 9132999 - DNA, 22 bp, Homo sapiens
gaaatttattatctacatcatt

SEQ ID NO: 9133000 - DNA, 19 bp, Homo sapiens
atgatgcagagctgactca

SEQ ID NO: 9133001 - DNA, 22 bp, Homo sapiens
atgatgcataatttatacatgc

SEQ ID NO: 9133002 - DNA, 22 bp, Homo sapiens
atgatgaattttaaaagcacca

SEQ ID NO: 9133003 - DNA, 22 bp, Homo sapiens
atgatatttgcaatgtgcttgc

SEQ ID NO: 9133004 - DNA, 22 bp, Homo sapiens
atgatattttagtaaagtgata

SEQ ID NO: 9133005 - DNA, 22 bp, Homo sapiens
gaaatagtacagcatagttctt

SEQ ID NO: 9133006 - DNA, 19 bp, Homo sapiens
atgatacaggtgaaaattg

SEQ ID NO: 9133007 - DNA, 19 bp, Homo sapiens
atgatacaggtgaaaattg

SEQ ID NO: 9133008 - DNA, 22 bp, Homo sapiens
gaaatagatctctgggatgcaa

SEQ ID NO: 9133009 - DNA, 22 bp, Homo sapiens
gaaatagacactttctatgaat

SEQ ID NO: 9133010 - DNA, 22 bp, Homo sapiens
gaaatagatctctgggatgcaa

SEQ ID NO: 9133011 - DNA, 22 bp, Homo sapiens
gaaatagaggacagctggatca

SEQ ID NO: 9133012 - DNA, 22 bp, Homo sapiens
gaaatacagttgggaggaggta

SEQ ID NO: 9133013 - DNA, 22 bp, Homo sapiens
gaaatactgcacaccctgtaag

SEQ ID NO: 9133014 - DNA, 21 bp, Homo sapiens
gaaatactgccttaggagctg

SEQ ID NO: 9133015 - DNA, 21 bp, Homo sapiens
gaaatactgccttaggagctg

SEQ ID NO: 9133016 - DNA, 20 bp, Homo sapiens
gaaatacttacccaactgtt

SEQ ID NO: 9133017 - DNA, 22 bp, Homo sapiens
gaaatactgtaaagttattatt

SEQ ID NO: 9133018 - DNA, 22 bp, Homo sapiens
gaaaggttgtaacaagactctt

SEQ ID NO: 9133019 - DNA, 22 bp, Homo sapiens
gaaagtatttaagtccatattt

SEQ ID NO: 9133020 - DNA, 22 bp, Homo sapiens
gaaagtatttacattaacatct

SEQ ID NO: 9133021 - DNA, 20 bp, Homo sapiens
gaaaccagaacgcagccctg

SEQ ID NO: 9133022 - DNA, 21 bp, Homo sapiens
atgacagatgctgcagatcgt

SEQ ID NO: 9133023 - DNA, 21 bp, Homo sapiens
atgacagatgctgcagatcgt

SEQ ID NO: 9133024 - DNA, 22 bp, Homo sapiens
atgacagatgctgtggggaggt

SEQ ID NO: 9133025 - DNA, 22 bp, Homo sapiens
gaaagcagtatttagttctgtt

SEQ ID NO: 9133026 - DNA, 22 bp, Homo sapiens
atgacatgacctggtagagaca

SEQ ID NO: 9133027 - DNA, 22 bp, Homo sapiens
gaaagcagtatttagttctgtt

SEQ ID NO: 9133028 - DNA, 22 bp, Homo sapiens
atgacataagtgaaaaacatca

SEQ ID NO: 9133029 - DNA, 22 bp, Homo sapiens
atgacagttctacacttaatct

SEQ ID NO: 9133030 - DNA, 22 bp, Homo sapiens
gaaacagctttaagtgatactg

SEQ ID NO: 9133031 - DNA, 22 bp, Homo sapiens
gaaacaggtggcaggctagatt

SEQ ID NO: 9133032 - DNA, 22 bp, Homo sapiens
gaaacaggtggcaggctagatt

SEQ ID NO: 9133033 - DNA, 22 bp, Homo sapiens
gaaacaggccaggttccaggcc

SEQ ID NO: 9133034 - DNA, 22 bp, Homo sapiens
gaaacagggagtagtaatttac

SEQ ID NO: 9133035 - DNA, 22 bp, Homo sapiens
ctttcttcatctgtaatatgga

SEQ ID NO: 9133036 - DNA, 22 bp, Homo sapiens
gaaacatgtctgacaatttacc

SEQ ID NO: 9133037 - DNA, 22 bp, Homo sapiens
gaaacattcagtcaacagtgtt

SEQ ID NO: 9133038 - DNA, 20 bp, Homo sapiens
gaaacattggcagcaactga

SEQ ID NO: 9133039 - DNA, 22 bp, Homo sapiens
atgaacagcattgaaatccagc

SEQ ID NO: 9133040 - DNA, 22 bp, Homo sapiens
atgaacagaggaatagaattct

SEQ ID NO: 9133041 - DNA, 22 bp, Homo sapiens
atgaacagtatgcaacatgatt

SEQ ID NO: 9133042 - DNA, 22 bp, Homo sapiens
atgaaacagagtacttaatata

SEQ ID NO: 9133043 - DNA, 22 bp, Homo sapiens
atgaaacagagtacttaatata

SEQ ID NO: 9133044 - DNA, 22 bp, Homo sapiens
atgaaaatactgtggttgatag

SEQ ID NO: 9133045 - DNA, 22 bp, Homo sapiens
atgaaacaaacctctatggagt

SEQ ID NO: 9133046 - DNA, 22 bp, Homo sapiens
atgaaacaagggtattttctct

SEQ ID NO: 9133047 - DNA, 22 bp, Homo sapiens
atgaaccttgatttgttcatct

SEQ ID NO: 9133048 - DNA, 23 bp, Homo sapiens
atgaacattagtttcagatattg

SEQ ID NO: 9133049 - DNA, 22 bp, Homo sapiens
atgaagaaaaatccagctgtcc

SEQ ID NO: 9133050 - DNA, 22 bp, Homo sapiens
atgaagaaactgttctgggtgg

SEQ ID NO: 9133051 - DNA, 22 bp, Homo sapiens
atgaactgcagtataaacttgg

SEQ ID NO: 9133052 - DNA, 22 bp, Homo sapiens
atgaactgagcttaattgctga

SEQ ID NO: 9133053 - DNA, 22 bp, Homo sapiens
atgaactgtccaatcttagagg

SEQ ID NO: 9133054 - DNA, 22 bp, Homo sapiens
atgaacttatttctgaactttt

SEQ ID NO: 9133055 - DNA, 22 bp, Homo sapiens
ctttctgattttaagctctaat

SEQ ID NO: 9133056 - DNA, 22 bp, Homo sapiens
ctttctggacaagacagaggga

SEQ ID NO: 9133057 - DNA, 22 bp, Homo sapiens
ctttctggacaagacagaggga

SEQ ID NO: 9133058 - DNA, 22 bp, Homo sapiens
ctttctggcacagccgcgggat

SEQ ID NO: 9133059 - DNA, 22 bp, Homo sapiens
ctttctggagtggaaaggtatt

SEQ ID NO: 9133060 - DNA, 22 bp, Homo sapiens
ctttcttcaacctcattctgca

SEQ ID NO: 9133061 - DNA, 22 bp, Homo sapiens
ctttctggctgaagtgatgaat

SEQ ID NO: 9133062 - DNA, 22 bp, Homo sapiens
ctttctcttgagcaagagctgt

SEQ ID NO: 9133063 - DNA, 22 bp, Homo sapiens
ctttctcttgagcaagagctgt

SEQ ID NO: 9133064 - DNA, 22 bp, Homo sapiens
ctttctcttcgaaaacctgccc

SEQ ID NO: 9133065 - DNA, 22 bp, Homo sapiens
ctttctcttcgaaaacctgccc

SEQ ID NO: 9133066 - DNA, 22 bp, Homo sapiens
atctggattctagatctagatc

SEQ ID NO: 9133067 - DNA, 22 bp, Homo sapiens
atctggagtttcagttttctgg

SEQ ID NO: 9133068 - DNA, 22 bp, Homo sapiens
atctggagtttcagttttctgg

SEQ ID NO: 9133069 - DNA, 22 bp, Homo sapiens
atctggagtgggacacagaaat

SEQ ID NO: 9133070 - DNA, 22 bp, Homo sapiens
atctggagtgggacacagaaat

SEQ ID NO: 9133071 - DNA, 23 bp, Homo sapiens
atctggagtgttgagtaggtact

SEQ ID NO: 9133072 - DNA, 23 bp, Homo sapiens
atctggagtgttgagtaggtact

SEQ ID NO: 9133073 - DNA, 22 bp, Homo sapiens
atctggaggcctgtcttatccc

SEQ ID NO: 9133074 - DNA, 22 bp, Homo sapiens
atctggaggcattactctgtct

SEQ ID NO: 9133075 - DNA, 22 bp, Homo sapiens
atctggaggcattactctgtct

SEQ ID NO: 9133076 - DNA, 22 bp, Homo sapiens
atctggaggcctgtcttatccc

SEQ ID NO: 9133077 - DNA, 22 bp, Homo sapiens
atctggaggcaaaggggcgtga

SEQ ID NO: 9133078 - DNA, 22 bp, Homo sapiens
atctggaggcattactctgtct

SEQ ID NO: 9133079 - DNA, 22 bp, Homo sapiens
atctggagtagaaaaatcgctt

SEQ ID NO: 9133080 - DNA, 22 bp, Homo sapiens
atctggagtagaaaaatcgctt

SEQ ID NO: 9133081 - DNA, 22 bp, Homo sapiens
atctggaggctaagtcatttgc

SEQ ID NO: 9133082 - DNA, 22 bp, Homo sapiens
atctggaggtcatcgtttgttc

SEQ ID NO: 9133083 - DNA, 22 bp, Homo sapiens
atctggaggctaagtcatttgc

SEQ ID NO: 9133084 - DNA, 22 bp, Homo sapiens
atctggaggtcatcgtttgttc

SEQ ID NO: 9133085 - DNA, 22 bp, Homo sapiens
atctggaggcaaaggggcgtga

SEQ ID NO: 9133086 - DNA, 22 bp, Homo sapiens
atctggaggattctgggacttg

SEQ ID NO: 9133087 - DNA, 22 bp, Homo sapiens
atctggaggattctgggacttg

SEQ ID NO: 9133088 - DNA, 22 bp, Homo sapiens
atctggagcttgttagatgttt

SEQ ID NO: 9133089 - DNA, 22 bp, Homo sapiens
atctggagcttaagcttatata

SEQ ID NO: 9133090 - DNA, 22 bp, Homo sapiens
atctggagcttgttagatgttt

SEQ ID NO: 9133091 - DNA, 22 bp, Homo sapiens
atctggagctctgcacacctgg

SEQ ID NO: 9133092 - DNA, 22 bp, Homo sapiens
atctggagctctgcacacctgg

SEQ ID NO: 9133093 - DNA, 22 bp, Homo sapiens
atctggagcttaagcttatata

SEQ ID NO: 9133094 - DNA, 22 bp, Homo sapiens
atctggagctctgcacacctgg

SEQ ID NO: 9133095 - DNA, 22 bp, Homo sapiens
atctggagatctgaattttgtg

SEQ ID NO: 9133096 - DNA, 22 bp, Homo sapiens
atctggagatcagctggtggca

SEQ ID NO: 9133097 - DNA, 22 bp, Homo sapiens
atctggagatctgaattttgtg

SEQ ID NO: 9133098 - DNA, 22 bp, Homo sapiens
atctggagatgggtctgtcacc

SEQ ID NO: 9133099 - DNA, 22 bp, Homo sapiens
atctggagatttcttttcaata

SEQ ID NO: 9133100 - DNA, 22 bp, Homo sapiens
atctggagcaagattaagagat

SEQ ID NO: 9133101 - DNA, 22 bp, Homo sapiens
atctggagatgggtctgtcacc

SEQ ID NO: 9133102 - DNA, 22 bp, Homo sapiens
atctggagatttcttttcaata

SEQ ID NO: 9133103 - DNA, 22 bp, Homo sapiens
atctggagcagggccacaaggc

SEQ ID NO: 9133104 - DNA, 22 bp, Homo sapiens
atctggagcagggccacaaggc

SEQ ID NO: 9133105 - DNA, 22 bp, Homo sapiens
atctggagcaagattaagagat

SEQ ID NO: 9133106 - DNA, 22 bp, Homo sapiens
cttctttaccaagagatagagt

SEQ ID NO: 9133107 - DNA, 22 bp, Homo sapiens
cttctttaccaagagatagagt

SEQ ID NO: 9133108 - DNA, 22 bp, Homo sapiens
atctggagagctggcagcccag

SEQ ID NO: 9133109 - DNA, 22 bp, Homo sapiens
atctggagatcagctggtggca

SEQ ID NO: 9133110 - DNA, 22 bp, Homo sapiens
atctggagagatcttcacaaaa

SEQ ID NO: 9133111 - DNA, 22 bp, Homo sapiens
atctggagagctggcagcccag

SEQ ID NO: 9133112 - DNA, 22 bp, Homo sapiens
cttctttactttctagaaataa

SEQ ID NO: 9133113 - DNA, 22 bp, Homo sapiens
atctggagaataaatgtccaag

SEQ ID NO: 9133114 - DNA, 22 bp, Homo sapiens
atctggagaatgtttgtctccg

SEQ ID NO: 9133115 - DNA, 22 bp, Homo sapiens
atctggagagatcttcacaaaa

SEQ ID NO: 9133116 - DNA, 22 bp, Homo sapiens
atctggagaatgtttgtctccg

SEQ ID NO: 9133117 - DNA, 22 bp, Homo sapiens
cttctttaatgtatacaaaaga

SEQ ID NO: 9133118 - DNA, 22 bp, Homo sapiens
cttctttaatgtatacaaaaga

SEQ ID NO: 9133119 - DNA, 22 bp, Homo sapiens
atgaaaagttcgatctagaagg

SEQ ID NO: 9133120 - DNA, 22 bp, Homo sapiens
ctttcctagaaatatatactta

SEQ ID NO: 9133121 - DNA, 22 bp, Homo sapiens
ctttcccttagccccattctat

SEQ ID NO: 9133122 - DNA, 22 bp, Homo sapiens
ctttcccttagccccattctat

SEQ ID NO: 9133123 - DNA, 22 bp, Homo sapiens
ctttcccttagccccattctat

SEQ ID NO: 9133124 - DNA, 22 bp, Homo sapiens
ctttcccacgcagtggatgaga

SEQ ID NO: 9133125 - DNA, 22 bp, Homo sapiens
ctttcccacgcagtggatgaga

SEQ ID NO: 9133126 - DNA, 22 bp, Homo sapiens
ctttccagtttctaagtacagt

SEQ ID NO: 9133127 - DNA, 19 bp, Homo sapiens
ctttccagctcgagcaatt

SEQ ID NO: 9133128 - DNA, 22 bp, Homo sapiens
ctttcaaaacgctctgtatgca

SEQ ID NO: 9133129 - DNA, 22 bp, Homo sapiens
ctttcaaaacgctctgtatgca

SEQ ID NO: 9133130 - DNA, 22 bp, Homo sapiens
atctggctattgacatgttata

SEQ ID NO: 9133131 - DNA, 22 bp, Homo sapiens
ctttccaggtctaaaggcaggg

SEQ ID NO: 9133132 - DNA, 22 bp, Homo sapiens
ctttccagtaccaggaagcgga

SEQ ID NO: 9133133 - DNA, 22 bp, Homo sapiens
ctttccaggtctaaaggcaggg

SEQ ID NO: 9133134 - DNA, 22 bp, Homo sapiens
atgtagaatggtgattggcagg

SEQ ID NO: 9133135 - DNA, 22 bp, Homo sapiens
atgtagagctccttgatcctcc

SEQ ID NO: 9133136 - DNA, 22 bp, Homo sapiens
atgtagagggtttggccaggag

SEQ ID NO: 9133137 - DNA, 22 bp, Homo sapiens
atgtagagtagaatagtacaac

SEQ ID NO: 9133138 - DNA, 22 bp, Homo sapiens
atgtagagcagtgttgtccaat

SEQ ID NO: 9133139 - DNA, 22 bp, Homo sapiens
gaggcagcgggtcaggaccgtg

SEQ ID NO: 9133140 - DNA, 22 bp, Homo sapiens
gaggcagcggctcacagagaaa

SEQ ID NO: 9133141 - DNA, 22 bp, Homo sapiens
gaggcagcggctcacagagaaa

SEQ ID NO: 9133142 - DNA, 22 bp, Homo sapiens
atgtcatttaaatgtttgtata

SEQ ID NO: 9133143 - DNA, 22 bp, Homo sapiens
atgtcatttaaatgtttgtata

SEQ ID NO: 9133144 - DNA, 22 bp, Homo sapiens
atgtcattgccaagatgctaat

SEQ ID NO: 9133145 - DNA, 22 bp, Homo sapiens
atgtccctgagggtctctctga

SEQ ID NO: 9133146 - DNA, 22 bp, Homo sapiens
atgtcccagctgagagacaact

SEQ ID NO: 9133147 - DNA, 22 bp, Homo sapiens
atgtccctcactcctcattcag

SEQ ID NO: 9133148 - DNA, 22 bp, Homo sapiens
atgtcatgaaatgctactaact

SEQ ID NO: 9133149 - DNA, 22 bp, Homo sapiens
atgtctctcaggtttaacttta

SEQ ID NO: 9133150 - DNA, 22 bp, Homo sapiens
atgtctctcatgaccaaagaag

SEQ ID NO: 9133151 - DNA, 22 bp, Homo sapiens
atgtctctctctgagtgccaga

SEQ ID NO: 9133152 - DNA, 22 bp, Homo sapiens
atgtctctgccccagagagctt

SEQ ID NO: 9133153 - DNA, 22 bp, Homo sapiens
atgtctctgctgtggttagctt

SEQ ID NO: 9133154 - DNA, 22 bp, Homo sapiens
atgtctctgccccagagagctt

SEQ ID NO: 9133155 - DNA, 22 bp, Homo sapiens
atgtctctgctgtggttagctt

SEQ ID NO: 9133156 - DNA, 23 bp, Homo sapiens
atgtctctgggcagtagggcttg

SEQ ID NO: 9133157 - DNA, 19 bp, Homo sapiens
atgtctctgtagcacatac

SEQ ID NO: 9133158 - DNA, 22 bp, Homo sapiens
atgtcgataggagtgccatcgg

SEQ ID NO: 9133159 - DNA, 21 bp, Homo sapiens
atgtctatgacatatttcctt

SEQ ID NO: 9133160 - DNA, 22 bp, Homo sapiens
atgtctatggaatttccacaca

SEQ ID NO: 9133161 - DNA, 22 bp, Homo sapiens
atgtccttttatttaaagcagg

SEQ ID NO: 9133162 - DNA, 22 bp, Homo sapiens
atgtccttttatttaaagcagg

SEQ ID NO: 9133163 - DNA, 22 bp, Homo sapiens
atgtccttttatttaaagcagg

SEQ ID NO: 9133164 - DNA, 22 bp, Homo sapiens
atgtcctttgtgtgtagctctc

SEQ ID NO: 9133165 - DNA, 22 bp, Homo sapiens
atgtcctttgtatccctaggca

SEQ ID NO: 9133166 - DNA, 22 bp, Homo sapiens
atgtcctgttttggcttgctct

SEQ ID NO: 9133167 - DNA, 20 bp, Homo sapiens
atgtcctgttgctgccccag

SEQ ID NO: 9133168 - DNA, 22 bp, Homo sapiens
atgtcctggtcctccaccatgg

SEQ ID NO: 9133169 - DNA, 23 bp, Homo sapiens
atgtcctgtgatgcttaatgacc

SEQ ID NO: 9133170 - DNA, 22 bp, Homo sapiens
atgtcctggggtcttctcttca

SEQ ID NO: 9133171 - DNA, 22 bp, Homo sapiens
atgtcctggggtcttctcttca

SEQ ID NO: 9133172 - DNA, 23 bp, Homo sapiens
atgtcctgcatagttgcttctgt

SEQ ID NO: 9133173 - DNA, 22 bp, Homo sapiens
atgtcctgctgattcacattat

SEQ ID NO: 9133174 - DNA, 22 bp, Homo sapiens
atgtcctgctgattcacattat

SEQ ID NO: 9133175 - DNA, 20 bp, Homo sapiens
atgtcctgcttctcctcacc

SEQ ID NO: 9133176 - DNA, 22 bp, Homo sapiens
atgtcctggagcagaggcaagg

SEQ ID NO: 9133177 - DNA, 22 bp, Homo sapiens
atgtccttcgtaggggcagcag

SEQ ID NO: 9133178 - DNA, 22 bp, Homo sapiens
atgtccttcctgagatccctgt

SEQ ID NO: 9133179 - DNA, 22 bp, Homo sapiens
atgtccttgagaccctcctcgg

SEQ ID NO: 9133180 - DNA, 22 bp, Homo sapiens
atgtgagatgcacataattata

SEQ ID NO: 9133181 - DNA, 22 bp, Homo sapiens
atgtgagatgcacataattata

SEQ ID NO: 9133182 - DNA, 22 bp, Homo sapiens
atgtgactagcccttcatgacc

SEQ ID NO: 9133183 - DNA, 22 bp, Homo sapiens
atgtgagactaaaaagatgtgc

SEQ ID NO: 9133184 - DNA, 18 bp, Homo sapiens
atgtgagagaatcttctt

SEQ ID NO: 9133185 - DNA, 22 bp, Homo sapiens
atgtgagaactcaggaaatact

SEQ ID NO: 9133186 - DNA, 22 bp, Homo sapiens
atgtgagaataactcaaaacaa

SEQ ID NO: 9133187 - DNA, 22 bp, Homo sapiens
gaggtagggcagaggctgaatg

SEQ ID NO: 9133188 - DNA, 20 bp, Homo sapiens
gaggtagggcttaaggcaag

SEQ ID NO: 9133189 - DNA, 22 bp, Homo sapiens
gaggtggatgttgcagtgagct

SEQ ID NO: 9133190 - DNA, 20 bp, Homo sapiens
atgtgaaagatcagttgtct

SEQ ID NO: 9133191 - DNA, 22 bp, Homo sapiens
atgtgaaatagctggatatgaa

SEQ ID NO: 9133192 - DNA, 22 bp, Homo sapiens
atgtgaaagaggtgttcagtgg

SEQ ID NO: 9133193 - DNA, 22 bp, Homo sapiens
atgtgaaactgaagcatccata

SEQ ID NO: 9133194 - DNA, 22 bp, Homo sapiens
gagggctgaagattgtggcccc

SEQ ID NO: 9133195 - DNA, 22 bp, Homo sapiens
gagggctgaagattgtggcccc

SEQ ID NO: 9133196 - DNA, 22 bp, Homo sapiens
atgtgaaatattaagccgagga

SEQ ID NO: 9133197 - DNA, 22 bp, Homo sapiens
atgtgaaatattaagccgagga

SEQ ID NO: 9133198 - DNA, 21 bp, Homo sapiens
atgtgaaatatcatcagagca

SEQ ID NO: 9133199 - DNA, 22 bp, Homo sapiens
atgtgaagcttgtgctaacata

SEQ ID NO: 9133200 - DNA, 22 bp, Homo sapiens
atgtctctttagagcaacagta

SEQ ID NO: 9133201 - DNA, 22 bp, Homo sapiens
atgtctctttactcttagaacc

SEQ ID NO: 9133202 - DNA, 22 bp, Homo sapiens
atgtctctttagagcaacagta

SEQ ID NO: 9133203 - DNA, 19 bp, Homo sapiens
atgtctctgtagcacatac

SEQ ID NO: 9133204 - DNA, 19 bp, Homo sapiens
atgtctctgtagcacatac

SEQ ID NO: 9133205 - DNA, 22 bp, Homo sapiens
atgtctgctattcatagggaaa

SEQ ID NO: 9133206 - DNA, 22 bp, Homo sapiens
gagggctcaactactactaggc

SEQ ID NO: 9133207 - DNA, 22 bp, Homo sapiens
gagggcgttcagtcagtgtctc

SEQ ID NO: 9133208 - DNA, 19 bp, Homo sapiens
gagggctcatttgaacaat

SEQ ID NO: 9133209 - DNA, 22 bp, Homo sapiens
gagggctccacacgggcccagc

SEQ ID NO: 9133210 - DNA, 20 bp, Homo sapiens
gagggctcgtggatggataa

SEQ ID NO: 9133211 - DNA, 22 bp, Homo sapiens
gagggctctactcaccaccctg

SEQ ID NO: 9133212 - DNA, 22 bp, Homo sapiens
gagggctctgaaaggaggtcac

SEQ ID NO: 9133213 - DNA, 23 bp, Homo sapiens
gagggctctgagtgcttgggcca

SEQ ID NO: 9133214 - DNA, 22 bp, Homo sapiens
gagggctctgtctggaagggaa

SEQ ID NO: 9133215 - DNA, 22 bp, Homo sapiens
atgtttaatcggctgcctttcc

SEQ ID NO: 9133216 - DNA, 22 bp, Homo sapiens
gagttcagtgtttctagtagtg

SEQ ID NO: 9133217 - DNA, 20 bp, Homo sapiens
gataatatttactaggtact

SEQ ID NO: 9133218 - DNA, 22 bp, Homo sapiens
gataatattagaagatacaaat

SEQ ID NO: 9133219 - DNA, 22 bp, Homo sapiens
gataatccactctgctgacttt

SEQ ID NO: 9133220 - DNA, 22 bp, Homo sapiens
gataatccaagattgcctcact

SEQ ID NO: 9133221 - DNA, 22 bp, Homo sapiens
gataatgatgacaatgacaacc

SEQ ID NO: 9133222 - DNA, 22 bp, Homo sapiens
atgtttaaagggttgagaaata

SEQ ID NO: 9133223 - DNA, 22 bp, Homo sapiens
atgtttaaatttatagacagtg

SEQ ID NO: 9133224 - DNA, 22 bp, Homo sapiens
atgttgttttttcataaagtat

SEQ ID NO: 9133225 - DNA, 22 bp, Homo sapiens
atgttggagtcgtaaggcatgg

SEQ ID NO: 9133226 - DNA, 22 bp, Homo sapiens
atgttggagtcgtaaggcatgg

SEQ ID NO: 9133227 - DNA, 22 bp, Homo sapiens
atgttgggaaggccgcaggcac

SEQ ID NO: 9133228 - DNA, 22 bp, Homo sapiens
atgttgtagcatatgaaatata

SEQ ID NO: 9133229 - DNA, 22 bp, Homo sapiens
gatatattttccatggtctgca

SEQ ID NO: 9133230 - DNA, 22 bp, Homo sapiens
gatacaaattcatgtctgaatt

SEQ ID NO: 9133231 - DNA, 22 bp, Homo sapiens
gatacaagactaataggaaaca

SEQ ID NO: 9133232 - DNA, 22 bp, Homo sapiens
gatatgaagtggcattgtgaag

SEQ ID NO: 9133233 - DNA, 18 bp, Homo sapiens
gatatggaaggccatgcc

SEQ ID NO: 9133234 - DNA, 22 bp, Homo sapiens
gataatgatgacaatgacaacc

SEQ ID NO: 9133235 - DNA, 22 bp, Homo sapiens
gatacaaaatataaatggagag

SEQ ID NO: 9133236 - DNA, 22 bp, Homo sapiens
atgttgactcagagtgagggta

SEQ ID NO: 9133237 - DNA, 22 bp, Homo sapiens
atgttctttggaatttatgaaa

SEQ ID NO: 9133238 - DNA, 22 bp, Homo sapiens
atgttctttgtgattctgagct

SEQ ID NO: 9133239 - DNA, 22 bp, Homo sapiens
atgttcttgttcaaatgtcagt

SEQ ID NO: 9133240 - DNA, 22 bp, Homo sapiens
atgttctttcagccagtgcatc

SEQ ID NO: 9133241 - DNA, 22 bp, Homo sapiens
atgttctttgaaatattttaga

SEQ ID NO: 9133242 - DNA, 22 bp, Homo sapiens
atgttctgttttgtaattcata

SEQ ID NO: 9133243 - DNA, 20 bp, Homo sapiens
atgttcttcatttaatgttc

SEQ ID NO: 9133244 - DNA, 22 bp, Homo sapiens
atgttcttcctctgcacagcta

SEQ ID NO: 9133245 - DNA, 22 bp, Homo sapiens
atgttcttctatctttattaaa

SEQ ID NO: 9133246 - DNA, 22 bp, Homo sapiens
atgttcttggatgttgtgtata

SEQ ID NO: 9133247 - DNA, 20 bp, Homo sapiens
atgttctgtggctgtcatgg

SEQ ID NO: 9133248 - DNA, 19 bp, Homo sapiens
atgttctgaattactgtaa

SEQ ID NO: 9133249 - DNA, 22 bp, Homo sapiens
atgttctgaataatgtgcatta

SEQ ID NO: 9133250 - DNA, 22 bp, Homo sapiens
atgttctgaataatgtgcatta

SEQ ID NO: 9133251 - DNA, 22 bp, Homo sapiens
atgttattttggaaaatacaaa

SEQ ID NO: 9133252 - DNA, 22 bp, Homo sapiens
atgttattttggaaaatacaaa

SEQ ID NO: 9133253 - DNA, 22 bp, Homo sapiens
atgtgtctggttattgacatgc

SEQ ID NO: 9133254 - DNA, 22 bp, Homo sapiens
atgtgtctgaccactgtattgg

SEQ ID NO: 9133255 - DNA, 20 bp, Homo sapiens
atgtgtctgcctctgtgttc

SEQ ID NO: 9133256 - DNA, 22 bp, Homo sapiens
gaggtggcgcgccatccctgcc

SEQ ID NO: 9133257 - DNA, 22 bp, Homo sapiens
atgtgtccttataagaagaaga

SEQ ID NO: 9133258 - DNA, 22 bp, Homo sapiens
atgtgtccttgttcccattcca

SEQ ID NO: 9133259 - DNA, 22 bp, Homo sapiens
gaggtggcactgtgaggagcac

SEQ ID NO: 9133260 - DNA, 22 bp, Homo sapiens
gaggtggccagagtcaagagcc

SEQ ID NO: 9133261 - DNA, 22 bp, Homo sapiens
gaggtggccagagtcaagagcc

SEQ ID NO: 9133262 - DNA, 22 bp, Homo sapiens
atgggaagtgttagaagatttt

SEQ ID NO: 9133263 - DNA, 22 bp, Homo sapiens
atgggaagtgaagtcagggagg

SEQ ID NO: 9133264 - DNA, 22 bp, Homo sapiens
atgggaaggttttgagagcggg

SEQ ID NO: 9133265 - DNA, 22 bp, Homo sapiens
atgggaaggttttgagagcggg

SEQ ID NO: 9133266 - DNA, 22 bp, Homo sapiens
atgggaagctgacctgcatgga

SEQ ID NO: 9133267 - DNA, 19 bp, Homo sapiens
atgggaagcggccagcgga

SEQ ID NO: 9133268 - DNA, 22 bp, Homo sapiens
atgggaagctgacctgcatgga

SEQ ID NO: 9133269 - DNA, 22 bp, Homo sapiens
atgggaagctgacctgcatgga

SEQ ID NO: 9133270 - DNA, 22 bp, Homo sapiens
atgggacaggcatgggacttag

SEQ ID NO: 9133271 - DNA, 22 bp, Homo sapiens
atgggacagggctggctggtcc

SEQ ID NO: 9133272 - DNA, 22 bp, Homo sapiens
atgggacaggtactagaaaggg

SEQ ID NO: 9133273 - DNA, 22 bp, Homo sapiens
atgggacatagatccttgaggt

SEQ ID NO: 9133274 - DNA, 22 bp, Homo sapiens
atgggacaaacctttgatttga

SEQ ID NO: 9133275 - DNA, 22 bp, Homo sapiens
atgggaagtgttagaagatttt

SEQ ID NO: 9133276 - DNA, 22 bp, Homo sapiens
atgggacaatttgaacacagtg

SEQ ID NO: 9133277 - DNA, 22 bp, Homo sapiens
atgggacacagtccgccctcta

SEQ ID NO: 9133278 - DNA, 22 bp, Homo sapiens
atgggacacacaaggaagtaaa

SEQ ID NO: 9133279 - DNA, 22 bp, Homo sapiens
atgggacacgttttaaggaaaa

SEQ ID NO: 9133280 - DNA, 22 bp, Homo sapiens
atgggacagcatcttggtatta

SEQ ID NO: 9133281 - DNA, 22 bp, Homo sapiens
atgggagaaacatcatgaggca

SEQ ID NO: 9133282 - DNA, 22 bp, Homo sapiens
atgggagaaacatcatgaggca

SEQ ID NO: 9133283 - DNA, 18 bp, Homo sapiens
atgggcaggtaagatcca

SEQ ID NO: 9133284 - DNA, 22 bp, Homo sapiens
atgggctgacccagtcgtggca

SEQ ID NO: 9133285 - DNA, 22 bp, Homo sapiens
atgggctgacaagacatgcata

SEQ ID NO: 9133286 - DNA, 22 bp, Homo sapiens
atgggctgaggaagctcctgag

SEQ ID NO: 9133287 - DNA, 22 bp, Homo sapiens
atggggagagaagggctgagct

SEQ ID NO: 9133288 - DNA, 22 bp, Homo sapiens
atggggagagaagggctgagct

SEQ ID NO: 9133289 - DNA, 22 bp, Homo sapiens
atggggagagcctctgtcccca

SEQ ID NO: 9133290 - DNA, 22 bp, Homo sapiens
atggggagctcaccacctgttt

SEQ ID NO: 9133291 - DNA, 22 bp, Homo sapiens
atggggcagaggttaaaggtgg

SEQ ID NO: 9133292 - DNA, 22 bp, Homo sapiens
atgggctgcttggcttccaccc

SEQ ID NO: 9133293 - DNA, 22 bp, Homo sapiens
atgggctggcctttcccgctct

SEQ ID NO: 9133294 - DNA, 22 bp, Homo sapiens
atgggctgggaatacacagggg

SEQ ID NO: 9133295 - DNA, 22 bp, Homo sapiens
atgggctgtgaggtccggcagg

SEQ ID NO: 9133296 - DNA, 22 bp, Homo sapiens
atgggctgtccattgctggctg

SEQ ID NO: 9133297 - DNA, 20 bp, Homo sapiens
atgggctggttaggaagtgt

SEQ ID NO: 9133298 - DNA, 20 bp, Homo sapiens
atgggctggttaggaagtgt

SEQ ID NO: 9133299 - DNA, 22 bp, Homo sapiens
atgggctggggaagctcactcc

SEQ ID NO: 9133300 - DNA, 22 bp, Homo sapiens
gaggagaagctattggaaggac

SEQ ID NO: 9133301 - DNA, 22 bp, Homo sapiens
gaggagaagctaagaaacacag

SEQ ID NO: 9133302 - DNA, 22 bp, Homo sapiens
gaggagaagctaagaaacacag

SEQ ID NO: 9133303 - DNA, 22 bp, Homo sapiens
gaggagaagctattggaaggac

SEQ ID NO: 9133304 - DNA, 22 bp, Homo sapiens
gaggaaggctaaggggcttaga

SEQ ID NO: 9133305 - DNA, 22 bp, Homo sapiens
gaggagaagctaagaaacacag

SEQ ID NO: 9133306 - DNA, 22 bp, Homo sapiens
gaggagaaatttggggacctga

SEQ ID NO: 9133307 - DNA, 22 bp, Homo sapiens
gaggagaaatttggggacctga

SEQ ID NO: 9133308 - DNA, 22 bp, Homo sapiens
atggtcttgggcttaggcagag

SEQ ID NO: 9133309 - DNA, 22 bp, Homo sapiens
atggtcttagggtaggcagctg

SEQ ID NO: 9133310 - DNA, 22 bp, Homo sapiens
atggtctttttgttatgagaga

SEQ ID NO: 9133311 - DNA, 22 bp, Homo sapiens
atggtggactcttgattcaggc

SEQ ID NO: 9133312 - DNA, 22 bp, Homo sapiens
atggtggatttgtgattcagct

SEQ ID NO: 9133313 - DNA, 22 bp, Homo sapiens
gaggcacatatatacagagccc

SEQ ID NO: 9133314 - DNA, 22 bp, Homo sapiens
gaggcagcattcgcatagacag

SEQ ID NO: 9133315 - DNA, 22 bp, Homo sapiens
gaggcagcattcgcatagacag

SEQ ID NO: 9133316 - DNA, 22 bp, Homo sapiens
gaggcagcattcgcatagacag

SEQ ID NO: 9133317 - DNA, 22 bp, Homo sapiens
gaggcagcattcgcatagacag

SEQ ID NO: 9133318 - DNA, 22 bp, Homo sapiens
gaggcagcatggtaccttggag

SEQ ID NO: 9133319 - DNA, 22 bp, Homo sapiens
gaggcagcatctatggtgggaa

SEQ ID NO: 9133320 - DNA, 22 bp, Homo sapiens
gaggcagccagaggttctcatt

SEQ ID NO: 9133321 - DNA, 22 bp, Homo sapiens
gaggcagcctcagtggacctcg

SEQ ID NO: 9133322 - DNA, 22 bp, Homo sapiens
gaggcagcctcagtggacctcg

SEQ ID NO: 9133323 - DNA, 22 bp, Homo sapiens
gaggcagcggctcacagagaaa

SEQ ID NO: 9133324 - DNA, 22 bp, Homo sapiens
atggagggtggtaagacagaga

SEQ ID NO: 9133325 - DNA, 22 bp, Homo sapiens
atggagggaaaagtggagagcc

SEQ ID NO: 9133326 - DNA, 21 bp, Homo sapiens
atggagggaccagggaagcag

SEQ ID NO: 9133327 - DNA, 21 bp, Homo sapiens
atggagggaccagggaagcag

SEQ ID NO: 9133328 - DNA, 22 bp, Homo sapiens
gagatggccagtgccaggacaa

SEQ ID NO: 9133329 - DNA, 21 bp, Homo sapiens
gagatggcccagtagcgggcc

SEQ ID NO: 9133330 - DNA, 20 bp, Homo sapiens
gagatggctaagtgctgaac

SEQ ID NO: 9133331 - DNA, 22 bp, Homo sapiens
gagatggccctggcatgtagct

SEQ ID NO: 9133332 - DNA, 22 bp, Homo sapiens
gagatggctctcagatctttga

SEQ ID NO: 9133333 - DNA, 23 bp, Homo sapiens
gagatggctggttgtcctctgaa

SEQ ID NO: 9133334 - DNA, 22 bp, Homo sapiens
gagatggcttgctctcacgtgg

SEQ ID NO: 9133335 - DNA, 22 bp, Homo sapiens
gagatggccagtgccaggacaa

SEQ ID NO: 9133336 - DNA, 22 bp, Homo sapiens
gagatggcaggtgtgtgggaca

SEQ ID NO: 9133337 - DNA, 17 bp, Homo sapiens
gagatggcattggcagc

SEQ ID NO: 9133338 - DNA, 22 bp, Homo sapiens
gagagtcatacagaccaatata

SEQ ID NO: 9133339 - DNA, 22 bp, Homo sapiens
gagatggagtctttttctgtca

SEQ ID NO: 9133340 - DNA, 22 bp, Homo sapiens
gagagtccaggtctgggtcctt

SEQ ID NO: 9133341 - DNA, 22 bp, Homo sapiens
gagaggttcctccctgctttac

SEQ ID NO: 9133342 - DNA, 22 bp, Homo sapiens
gagagtcactgtctgcatttcc

SEQ ID NO: 9133343 - DNA, 22 bp, Homo sapiens
gagagagaggtgctgccaggca

SEQ ID NO: 9133344 - DNA, 22 bp, Homo sapiens
gagagagaggtgctgccaggca

SEQ ID NO: 9133345 - DNA, 22 bp, Homo sapiens
gagagagagctaatattaagct

SEQ ID NO: 9133346 - DNA, 22 bp, Homo sapiens
gagagagagctaatattaagct

SEQ ID NO: 9133347 - DNA, 22 bp, Homo sapiens
gactgggccaaggtcagcagct

SEQ ID NO: 9133348 - DNA, 22 bp, Homo sapiens
gactggggctctagccaggcct

SEQ ID NO: 9133349 - DNA, 21 bp, Homo sapiens
gactgggctgacttgtgctgg

SEQ ID NO: 9133350 - DNA, 22 bp, Homo sapiens
gactggggctctagccaggcct

SEQ ID NO: 9133351 - DNA, 22 bp, Homo sapiens
gagacatcataatgaagtttcc

SEQ ID NO: 9133352 - DNA, 23 bp, Homo sapiens
gagagagattgctaaaccactcc

SEQ ID NO: 9133353 - DNA, 22 bp, Homo sapiens
gagagaggcctccatgtactga

SEQ ID NO: 9133354 - DNA, 22 bp, Homo sapiens
gagagaggcctccatgtactga

SEQ ID NO: 9133355 - DNA, 22 bp, Homo sapiens
gagagaggcctccatgtactga

SEQ ID NO: 9133356 - DNA, 22 bp, Homo sapiens
gagagcacggtcttgggcatgg

SEQ ID NO: 9133357 - DNA, 22 bp, Homo sapiens
gagagcaatggggacgggcagg

SEQ ID NO: 9133358 - DNA, 22 bp, Homo sapiens
atggcttctgtcttggaaattt

SEQ ID NO: 9133359 - DNA, 22 bp, Homo sapiens
atggcttctgtcttggaaactt

SEQ ID NO: 9133360 - DNA, 22 bp, Homo sapiens
atggcttgcttttagagagatc

SEQ ID NO: 9133361 - DNA, 22 bp, Homo sapiens
atggcttggcaccatctccttg

SEQ ID NO: 9133362 - DNA, 21 bp, Homo sapiens
atggcttttttaaagcttgtg

SEQ ID NO: 9133363 - DNA, 22 bp, Homo sapiens
atggctgtttagcttctctgct

SEQ ID NO: 9133364 - DNA, 22 bp, Homo sapiens
atggctggcatccaggtgggct

SEQ ID NO: 9133365 - DNA, 22 bp, Homo sapiens
atggcttcgagtatatacatag

SEQ ID NO: 9133366 - DNA, 22 bp, Homo sapiens
atggcttcctctggattggatt

SEQ ID NO: 9133367 - DNA, 22 bp, Homo sapiens
atggcttctagcattgtcacaa

SEQ ID NO: 9133368 - DNA, 21 bp, Homo sapiens
atggccactatggtgcagcag

SEQ ID NO: 9133369 - DNA, 21 bp, Homo sapiens
atggccactatggtgcagcag

SEQ ID NO: 9133370 - DNA, 22 bp, Homo sapiens
atggccagagaaggcagggtca

SEQ ID NO: 9133371 - DNA, 22 bp, Homo sapiens
atggccacatttagtaactggt

SEQ ID NO: 9133372 - DNA, 22 bp, Homo sapiens
atggccaaggggcctaggcagg

SEQ ID NO: 9133373 - DNA, 22 bp, Homo sapiens
atggccaccatttaatgaagct

SEQ ID NO: 9133374 - DNA, 22 bp, Homo sapiens
atggccaccatctctaaaacac

SEQ ID NO: 9133375 - DNA, 22 bp, Homo sapiens
atggccaccatctctaaaacac

SEQ ID NO: 9133376 - DNA, 22 bp, Homo sapiens
atggccaaagccacagcagagg

SEQ ID NO: 9133377 - DNA, 22 bp, Homo sapiens
gagatggggaataggagcaagc

SEQ ID NO: 9133378 - DNA, 22 bp, Homo sapiens
gagatgggcgagaaggtggact

SEQ ID NO: 9133379 - DNA, 22 bp, Homo sapiens
gagatggggtcagctgggacat

SEQ ID NO: 9133380 - DNA, 22 bp, Homo sapiens
gagatggggaataggagcaagc

SEQ ID NO: 9133381 - DNA, 22 bp, Homo sapiens
gagatggggtcttgctatgttg

SEQ ID NO: 9133382 - DNA, 22 bp, Homo sapiens
gagatggggtcagctgggacat

SEQ ID NO: 9133383 - DNA, 22 bp, Homo sapiens
gagatggtagcctcagaagagt

SEQ ID NO: 9133384 - DNA, 22 bp, Homo sapiens
attcacatgcccaagcagcacc

SEQ ID NO: 9133385 - DNA, 22 bp, Homo sapiens
attcacccagcacagtggcagc

SEQ ID NO: 9133386 - DNA, 22 bp, Homo sapiens
attcacatttacaaagcactca

SEQ ID NO: 9133387 - DNA, 21 bp, Homo sapiens
attcagaaagggaataaactc

SEQ ID NO: 9133388 - DNA, 22 bp, Homo sapiens
attcagaaactctgggcagaac

SEQ ID NO: 9133389 - DNA, 22 bp, Homo sapiens
attcagaaagatatgcctggtt

SEQ ID NO: 9133390 - DNA, 22 bp, Homo sapiens
attcagaaagggttgcctggtt

SEQ ID NO: 9133391 - DNA, 22 bp, Homo sapiens
attcagaaagttgtcatatttg

SEQ ID NO: 9133392 - DNA, 22 bp, Homo sapiens
attcactgtggtgactgatata

SEQ ID NO: 9133393 - DNA, 22 bp, Homo sapiens
attcactgtggtgtctgatata

SEQ ID NO: 9133394 - DNA, 22 bp, Homo sapiens
attcacttattctcaaagtcct

SEQ ID NO: 9133395 - DNA, 22 bp, Homo sapiens
attcactaggttgcaaaactgt

SEQ ID NO: 9133396 - DNA, 22 bp, Homo sapiens
gcacctggggtacacagctaca

SEQ ID NO: 9133397 - DNA, 22 bp, Homo sapiens
gcacggcaagacggggcctcct

SEQ ID NO: 9133398 - DNA, 22 bp, Homo sapiens
gcacggctaatttttgtatttt

SEQ ID NO: 9133399 - DNA, 22 bp, Homo sapiens
gcacctttctatattcagtggc

SEQ ID NO: 9133400 - DNA, 22 bp, Homo sapiens
gcacctggtttatataatcata

SEQ ID NO: 9133401 - DNA, 18 bp, Homo sapiens
gcaccttaccaattctac

SEQ ID NO: 9133402 - DNA, 22 bp, Homo sapiens
gcactaaaccaacatgtaataa

SEQ ID NO: 9133403 - DNA, 22 bp, Homo sapiens
gcactagagcagctctcagaga

SEQ ID NO: 9133404 - DNA, 22 bp, Homo sapiens
gcactagatactgttcaggaaa

SEQ ID NO: 9133405 - DNA, 22 bp, Homo sapiens
gcactagaatcccttcaagaag

SEQ ID NO: 9133406 - DNA, 20 bp, Homo sapiens
attcacatataccagggagg

SEQ ID NO: 9133407 - DNA, 23 bp, Homo sapiens
attcagaattgtgtgtttgtata

SEQ ID NO: 9133408 - DNA, 22 bp, Homo sapiens
attcagaattgtgggcagtaca

SEQ ID NO: 9133409 - DNA, 22 bp, Homo sapiens
attcagaatggcaaacttctag

SEQ ID NO: 9133410 - DNA, 22 bp, Homo sapiens
attcagaagcaatcacagtgag

SEQ ID NO: 9133411 - DNA, 20 bp, Homo sapiens
attcagaataggcatgtaaa

SEQ ID NO: 9133412 - DNA, 22 bp, Homo sapiens
gcagcagaggccctactctttg

SEQ ID NO: 9133413 - DNA, 22 bp, Homo sapiens
gcagcagaggccctactctttg

SEQ ID NO: 9133414 - DNA, 22 bp, Homo sapiens
gcagcagagctttgtcctggct

SEQ ID NO: 9133415 - DNA, 22 bp, Homo sapiens
gcagcagagctttgtcctggct

SEQ ID NO: 9133416 - DNA, 22 bp, Homo sapiens
gcagcagagctttgtcctggct

SEQ ID NO: 9133417 - DNA, 17 bp, Homo sapiens
gcagcagagagaccctc

SEQ ID NO: 9133418 - DNA, 17 bp, Homo sapiens
gcagcagagagaccctc

SEQ ID NO: 9133419 - DNA, 21 bp, Homo sapiens
gcagcagaggcttgacagaca

SEQ ID NO: 9133420 - DNA, 21 bp, Homo sapiens
gcagcagaggcttgacagaca

SEQ ID NO: 9133421 - DNA, 21 bp, Homo sapiens
gcagcagaggcttgacagaca

SEQ ID NO: 9133422 - DNA, 22 bp, Homo sapiens
gcagcagagaccccaggaagga

SEQ ID NO: 9133423 - DNA, 22 bp, Homo sapiens
gcagcagagaccccaggaagga

SEQ ID NO: 9133424 - DNA, 22 bp, Homo sapiens
gcagcagagaccccaggaagga

SEQ ID NO: 9133425 - DNA, 22 bp, Homo sapiens
gcagcagagaccccaggaagga

SEQ ID NO: 9133426 - DNA, 22 bp, Homo sapiens
gcagcagagaccccaggaagga

SEQ ID NO: 9133427 - DNA, 17 bp, Homo sapiens
gcagcagagagaccctc

SEQ ID NO: 9133428 - DNA, 22 bp, Homo sapiens
gcagcagagaacacaatgatgg

SEQ ID NO: 9133429 - DNA, 20 bp, Homo sapiens
gcagcagacagacaggggac

SEQ ID NO: 9133430 - DNA, 22 bp, Homo sapiens
gcagcagagaacacaatgatgg

SEQ ID NO: 9133431 - DNA, 20 bp, Homo sapiens
gcagcagacagacaggggac

SEQ ID NO: 9133432 - DNA, 21 bp, Homo sapiens
attcagtttgacatctagcag

SEQ ID NO: 9133433 - DNA, 22 bp, Homo sapiens
gcagcagagtagacagagccct

SEQ ID NO: 9133434 - DNA, 22 bp, Homo sapiens
gcagcagagtagacagagccct

SEQ ID NO: 9133435 - DNA, 22 bp, Homo sapiens
gcagcagagtagacagagccct

SEQ ID NO: 9133436 - DNA, 22 bp, Homo sapiens
gcagcagagtttgggagatggt

SEQ ID NO: 9133437 - DNA, 22 bp, Homo sapiens
gcagcagagtttgggagatggt

SEQ ID NO: 9133438 - DNA, 22 bp, Homo sapiens
gcagcagatgctttcatggaca

SEQ ID NO: 9133439 - DNA, 22 bp, Homo sapiens
gcagcagatgctttcatggaca

SEQ ID NO: 9133440 - DNA, 22 bp, Homo sapiens
gcagcagatgctttcatggaca

SEQ ID NO: 9133441 - DNA, 22 bp, Homo sapiens
attcagttctggctgccttcct

SEQ ID NO: 9133442 - DNA, 22 bp, Homo sapiens
attcagtttcaatcattgtagt

SEQ ID NO: 9133443 - DNA, 23 bp, Homo sapiens
attcagttgtgagagaagacaca

SEQ ID NO: 9133444 - DNA, 22 bp, Homo sapiens
attcagttgtctactactgcct

SEQ ID NO: 9133445 - DNA, 22 bp, Homo sapiens
attaggtcatggggaggcccta

SEQ ID NO: 9133446 - DNA, 22 bp, Homo sapiens
attagtagctgtaataactggg

SEQ ID NO: 9133447 - DNA, 22 bp, Homo sapiens
attagtcagtatttgtttgcca

SEQ ID NO: 9133448 - DNA, 22 bp, Homo sapiens
attaggcattctgaatgaggtc

SEQ ID NO: 9133449 - DNA, 22 bp, Homo sapiens
attaggcattatggggataagg

SEQ ID NO: 9133450 - DNA, 22 bp, Homo sapiens
attaggtaatctttagatacac

SEQ ID NO: 9133451 - DNA, 22 bp, Homo sapiens
attaggcaattctgggcatctc

SEQ ID NO: 9133452 - DNA, 22 bp, Homo sapiens
attaggcactagaatgtcaatt

SEQ ID NO: 9133453 - DNA, 22 bp, Homo sapiens
attaggaaattatatgtcctcc

SEQ ID NO: 9133454 - DNA, 22 bp, Homo sapiens
attaggaagtaagtatcacaag

SEQ ID NO: 9133455 - DNA, 22 bp, Homo sapiens
attatttccttgctttgaggaa

SEQ ID NO: 9133456 - DNA, 22 bp, Homo sapiens
attcaaatgtcaaatccaccag

SEQ ID NO: 9133457 - DNA, 22 bp, Homo sapiens
attcaaattaagttaattcagc

SEQ ID NO: 9133458 - DNA, 22 bp, Homo sapiens
attcaaattaagttaattcagc

SEQ ID NO: 9133459 - DNA, 22 bp, Homo sapiens
attcaaattaagttaattcagc

SEQ ID NO: 9133460 - DNA, 22 bp, Homo sapiens
attcaacatattctgagtaaaa

SEQ ID NO: 9133461 - DNA, 22 bp, Homo sapiens
attactcctagaatgcatttag

SEQ ID NO: 9133462 - DNA, 22 bp, Homo sapiens
attaccactgcagttttgcatt

SEQ ID NO: 9133463 - DNA, 22 bp, Homo sapiens
attacccagtctgtggtattct

SEQ ID NO: 9133464 - DNA, 22 bp, Homo sapiens
attaccgctgagtcctatggag

SEQ ID NO: 9133465 - DNA, 22 bp, Homo sapiens
attacccagggtaggaattcct

SEQ ID NO: 9133466 - DNA, 22 bp, Homo sapiens
attacatatgttggcaacattt

SEQ ID NO: 9133467 - DNA, 22 bp, Homo sapiens
attacagttctacacatccttt

SEQ ID NO: 9133468 - DNA, 23 bp, Homo sapiens
attacagttaattacaacatctt

SEQ ID NO: 9133469 - DNA, 22 bp, Homo sapiens
attacagttaatttaccttctt

SEQ ID NO: 9133470 - DNA, 22 bp, Homo sapiens
gatattcaaagattactgatat

SEQ ID NO: 9133471 - DNA, 22 bp, Homo sapiens
gatattcaagtggaattattct

SEQ ID NO: 9133472 - DNA, 22 bp, Homo sapiens
attacagtgggtaaacagaatt

SEQ ID NO: 9133473 - DNA, 22 bp, Homo sapiens
attacaatcgagagaaacaaat

SEQ ID NO: 9133474 - DNA, 22 bp, Homo sapiens
attacaatcgagagaaacaaat

SEQ ID NO: 9133475 - DNA, 22 bp, Homo sapiens
attacaatcgagagaaacaaat

SEQ ID NO: 9133476 - DNA, 22 bp, Homo sapiens
gatatttaactctcacaggtcc

SEQ ID NO: 9133477 - DNA, 22 bp, Homo sapiens
gatttcgagaggtgtgaggcct

SEQ ID NO: 9133478 - DNA, 22 bp, Homo sapiens
attagagctgttagtgaagtgc

SEQ ID NO: 9133479 - DNA, 22 bp, Homo sapiens
gatttctcactgtggatttcct

SEQ ID NO: 9133480 - DNA, 23 bp, Homo sapiens
attagaaaggctttctggtgaaa

SEQ ID NO: 9133481 - DNA, 22 bp, Homo sapiens
attagaaaccaagaggcaggct

SEQ ID NO: 9133482 - DNA, 22 bp, Homo sapiens
attagaaaccaagaggcaggct

SEQ ID NO: 9133483 - DNA, 22 bp, Homo sapiens
attagaaaaactcaagggctct

SEQ ID NO: 9133484 - DNA, 22 bp, Homo sapiens
gatttcagaagcaagaggaggt

SEQ ID NO: 9133485 - DNA, 22 bp, Homo sapiens
gatttcagagtttattaggtta

SEQ ID NO: 9133486 - DNA, 22 bp, Homo sapiens
gatttcagccctgggggtcatt

SEQ ID NO: 9133487 - DNA, 22 bp, Homo sapiens
gatttcagccccgctcccagct

SEQ ID NO: 9133488 - DNA, 22 bp, Homo sapiens
gatttcactggctttaagcaca

SEQ ID NO: 9133489 - DNA, 22 bp, Homo sapiens
gatttcacctgatcttgtcatc

SEQ ID NO: 9133490 - DNA, 23 bp, Homo sapiens
attagaaaggctttctggtgaaa

SEQ ID NO: 9133491 - DNA, 23 bp, Homo sapiens
attagaaaggctttctggtgaaa

SEQ ID NO: 9133492 - DNA, 22 bp, Homo sapiens
gatttcagggtgtcttccagct

SEQ ID NO: 9133493 - DNA, 22 bp, Homo sapiens
gatttcagggtgcagatgatga

SEQ ID NO: 9133494 - DNA, 22 bp, Homo sapiens
gatttcaggctatctatgcaga

SEQ ID NO: 9133495 - DNA, 22 bp, Homo sapiens
gatttcagtggctgtctcaaat

SEQ ID NO: 9133496 - DNA, 22 bp, Homo sapiens
gccacagggcagatgcgcagag

SEQ ID NO: 9133497 - DNA, 22 bp, Homo sapiens
gccacagggattgttttgtgag

SEQ ID NO: 9133498 - DNA, 22 bp, Homo sapiens
gccacagggaggcgttttcagg

SEQ ID NO: 9133499 - DNA, 20 bp, Homo sapiens
gccaacgcgctggggctgcc

SEQ ID NO: 9133500 - DNA, 22 bp, Homo sapiens
gccaagagtttccagctgcaag

SEQ ID NO: 9133501 - DNA, 22 bp, Homo sapiens
gccaagcctgggaagagcccat

SEQ ID NO: 9133502 - DNA, 22 bp, Homo sapiens
gccaagcctgggaagagcccat

SEQ ID NO: 9133503 - DNA, 22 bp, Homo sapiens
gccaaatcttgcacactcttgt

SEQ ID NO: 9133504 - DNA, 22 bp, Homo sapiens
gccaacaggccttgctctgctc

SEQ ID NO: 9133505 - DNA, 22 bp, Homo sapiens
gccaagaaatgtgtcgggcagc

SEQ ID NO: 9133506 - DNA, 22 bp, Homo sapiens
gccaaaggacctgtgggtgaca

SEQ ID NO: 9133507 - DNA, 22 bp, Homo sapiens
gccaaaggattctatggagata

SEQ ID NO: 9133508 - DNA, 22 bp, Homo sapiens
gccaaaggcccttctgaaggca

SEQ ID NO: 9133509 - DNA, 22 bp, Homo sapiens
gccaaagctggaggtggaggtg

SEQ ID NO: 9133510 - DNA, 22 bp, Homo sapiens
gccaaagcccaggagacagcca

SEQ ID NO: 9133511 - DNA, 22 bp, Homo sapiens
gccaaaggttggcctgtgagtt

SEQ ID NO: 9133512 - DNA, 22 bp, Homo sapiens
attgtgagctcaagagtaccca

SEQ ID NO: 9133513 - DNA, 22 bp, Homo sapiens
attgtgaatttcagttagagcc

SEQ ID NO: 9133514 - DNA, 22 bp, Homo sapiens
gccaaagcccaggagacagcca

SEQ ID NO: 9133515 - DNA, 22 bp, Homo sapiens
gccaaagcagtcttgcctctgc

SEQ ID NO: 9133516 - DNA, 22 bp, Homo sapiens
gccaaagcagtcttgcctctgc

SEQ ID NO: 9133517 - DNA, 22 bp, Homo sapiens
gcattctctctctaaatgttgt

SEQ ID NO: 9133518 - DNA, 22 bp, Homo sapiens
attgtcttaaacaaatgtgttt

SEQ ID NO: 9133519 - DNA, 22 bp, Homo sapiens
attgtcttctgtcttatagttc

SEQ ID NO: 9133520 - DNA, 22 bp, Homo sapiens
attgtcttggcattcaaattag

SEQ ID NO: 9133521 - DNA, 22 bp, Homo sapiens
attgtcttctgtcttaggtgat

SEQ ID NO: 9133522 - DNA, 22 bp, Homo sapiens
attgtctttccactgagaagtt

SEQ ID NO: 9133523 - DNA, 22 bp, Homo sapiens
attgtctttaaaaatatacaac

SEQ ID NO: 9133524 - DNA, 22 bp, Homo sapiens
attgtcttgtacgtttgcctgt

SEQ ID NO: 9133525 - DNA, 22 bp, Homo sapiens
gcatacaaaggtttacaactga

SEQ ID NO: 9133526 - DNA, 21 bp, Homo sapiens
gcagtgcttcgagactgtggt

SEQ ID NO: 9133527 - DNA, 22 bp, Homo sapiens
gcagtgcttgctcaggcttcat

SEQ ID NO: 9133528 - DNA, 22 bp, Homo sapiens
gcagtgcttgaagaggtggcca

SEQ ID NO: 9133529 - DNA, 22 bp, Homo sapiens
gcagtgtgaccgagcttgcttc

SEQ ID NO: 9133530 - DNA, 22 bp, Homo sapiens
gcagtgtgtctcttggcttcct

SEQ ID NO: 9133531 - DNA, 22 bp, Homo sapiens
gcagtgtgtctggagtacatgg

SEQ ID NO: 9133532 - DNA, 22 bp, Homo sapiens
gcagtgtgtctggagtacatgg

SEQ ID NO: 9133533 - DNA, 22 bp, Homo sapiens
gcagtgtggccccagtatcacg

SEQ ID NO: 9133534 - DNA, 22 bp, Homo sapiens
gcatatgatcacgtgtgtcggt

SEQ ID NO: 9133535 - DNA, 22 bp, Homo sapiens
gcatatgatcacgtgtgtcggt

SEQ ID NO: 9133536 - DNA, 22 bp, Homo sapiens
gcatatcatgacttctatctta

SEQ ID NO: 9133537 - DNA, 22 bp, Homo sapiens
gcatagctttgatgctgcctta

SEQ ID NO: 9133538 - DNA, 15 bp, Homo sapiens
gcatatcacattcat

SEQ ID NO: 9133539 - DNA, 22 bp, Homo sapiens
gcatatcagcatcaaaacacag

SEQ ID NO: 9133540 - DNA, 17 bp, Homo sapiens
gcatcacagataacacg

SEQ ID NO: 9133541 - DNA, 22 bp, Homo sapiens
attgtcaggggttgtggagttt

SEQ ID NO: 9133542 - DNA, 22 bp, Homo sapiens
attgtcatcgatgttagccagt

SEQ ID NO: 9133543 - DNA, 22 bp, Homo sapiens
attgtcagctcgaaatgcatca

SEQ ID NO: 9133544 - DNA, 22 bp, Homo sapiens
attgtcatcgatgttagccagt

SEQ ID NO: 9133545 - DNA, 22 bp, Homo sapiens
attgtatttgtacaagacatgt

SEQ ID NO: 9133546 - DNA, 22 bp, Homo sapiens
attgtatttgtacaagacatgt

SEQ ID NO: 9133547 - DNA, 22 bp, Homo sapiens
attgtcctgtgtaattcaatgg

SEQ ID NO: 9133548 - DNA, 22 bp, Homo sapiens
attgtcctgtgtaattcaatgg

SEQ ID NO: 9133549 - DNA, 22 bp, Homo sapiens
attgtctctttcaataacttgt

SEQ ID NO: 9133550 - DNA, 22 bp, Homo sapiens
attgtcattccagtcattgtta

SEQ ID NO: 9133551 - DNA, 22 bp, Homo sapiens
gcagcgagtgcggctgccacag

SEQ ID NO: 9133552 - DNA, 22 bp, Homo sapiens
gcagctgcctattcagggcttg

SEQ ID NO: 9133553 - DNA, 22 bp, Homo sapiens
gcagctgccttcagctggatgg

SEQ ID NO: 9133554 - DNA, 22 bp, Homo sapiens
gcagctgccttcagctggatgg

SEQ ID NO: 9133555 - DNA, 22 bp, Homo sapiens
gcagctgctggagggaggcagg

SEQ ID NO: 9133556 - DNA, 22 bp, Homo sapiens
gcagctgcgaagaagtctatct

SEQ ID NO: 9133557 - DNA, 22 bp, Homo sapiens
gcagctggacccacacggctta

SEQ ID NO: 9133558 - DNA, 22 bp, Homo sapiens
gcagctggaagtgacactctgt

SEQ ID NO: 9133559 - DNA, 22 bp, Homo sapiens
gcagctgctgtggcatcaagct

SEQ ID NO: 9133560 - DNA, 22 bp, Homo sapiens
gcagctgctgtggcatcaagct

SEQ ID NO: 9133561 - DNA, 22 bp, Homo sapiens
gcagctgctggagggaggcagg

SEQ ID NO: 9133562 - DNA, 19 bp, Homo sapiens
attcttgttaagtgtcatc

SEQ ID NO: 9133563 - DNA, 22 bp, Homo sapiens
attcttgtttaatttgcatccc

SEQ ID NO: 9133564 - DNA, 22 bp, Homo sapiens
attcttgtaaattttgtgtgaa

SEQ ID NO: 9133565 - DNA, 22 bp, Homo sapiens
attctttacattggcttcttcc

SEQ ID NO: 9133566 - DNA, 22 bp, Homo sapiens
attcttcttgagtcttggactc

SEQ ID NO: 9133567 - DNA, 22 bp, Homo sapiens
attcttcagtatgtgtggattg

SEQ ID NO: 9133568 - DNA, 22 bp, Homo sapiens
attcttcttgagtcttggactc

SEQ ID NO: 9133569 - DNA, 22 bp, Homo sapiens
attcttggagcagtcaaagaag

SEQ ID NO: 9133570 - DNA, 22 bp, Homo sapiens
attgatttctgcttactcactg

SEQ ID NO: 9133571 - DNA, 22 bp, Homo sapiens
attgatttaggcttgttatgac

SEQ ID NO: 9133572 - DNA, 22 bp, Homo sapiens
attgattgaagtaaaataacct

SEQ ID NO: 9133573 - DNA, 22 bp, Homo sapiens
attgcaaagcattgtgagcgca

SEQ ID NO: 9133574 - DNA, 22 bp, Homo sapiens
attgcaaaattgtcctgtggaa

SEQ ID NO: 9133575 - DNA, 22 bp, Homo sapiens
attgatttgtagtgcctgcact

SEQ ID NO: 9133576 - DNA, 22 bp, Homo sapiens
attgattttcagactatgcgag

SEQ ID NO: 9133577 - DNA, 22 bp, Homo sapiens
gcagggctgcagagggcactgt

SEQ ID NO: 9133578 - DNA, 22 bp, Homo sapiens
gcagggctgcagagggcactgt

SEQ ID NO: 9133579 - DNA, 22 bp, Homo sapiens
gcagggctgctgaaacttgttt

SEQ ID NO: 9133580 - DNA, 22 bp, Homo sapiens
gcagggctgagtcatgtgtgcc

SEQ ID NO: 9133581 - DNA, 22 bp, Homo sapiens
gcagggctgatggcttccctca

SEQ ID NO: 9133582 - DNA, 22 bp, Homo sapiens
gcagggctgatggcttccctca

SEQ ID NO: 9133583 - DNA, 22 bp, Homo sapiens
gcagggctgatggcttccctca

SEQ ID NO: 9133584 - DNA, 22 bp, Homo sapiens
gcaggcctgggagtcatcttgt

SEQ ID NO: 9133585 - DNA, 22 bp, Homo sapiens
gcaggcctgcccagcaggatgg

SEQ ID NO: 9133586 - DNA, 19 bp, Homo sapiens
gcaggcctcttgggaatta

SEQ ID NO: 9133587 - DNA, 22 bp, Homo sapiens
gcaggcctgcaggtatggccgg

SEQ ID NO: 9133588 - DNA, 22 bp, Homo sapiens
gcaggcctgactgtagggggca

SEQ ID NO: 9133589 - DNA, 22 bp, Homo sapiens
gcaggccttggcaatgagcctg

SEQ ID NO: 9133590 - DNA, 22 bp, Homo sapiens
gcaggcctgtcttgctcgccct

SEQ ID NO: 9133591 - DNA, 22 bp, Homo sapiens
gcaggcctggtttacatggtag

SEQ ID NO: 9133592 - DNA, 22 bp, Homo sapiens
gcaggcctgtaatgaagggaca

SEQ ID NO: 9133593 - DNA, 22 bp, Homo sapiens
attgatatcagtttgctgattg

SEQ ID NO: 9133594 - DNA, 22 bp, Homo sapiens
gcaggcctttatccctgcctca

SEQ ID NO: 9133595 - DNA, 22 bp, Homo sapiens
gcaggcctttatccctgcctca

SEQ ID NO: 9133596 - DNA, 22 bp, Homo sapiens
attgacccagtggacttgatgg

SEQ ID NO: 9133597 - DNA, 22 bp, Homo sapiens
attttagagctccaagtacagc

SEQ ID NO: 9133598 - DNA, 22 bp, Homo sapiens
attttagagaaacaaacgtagg

SEQ ID NO: 9133599 - DNA, 22 bp, Homo sapiens
attttagagaaacaaacgtagg

SEQ ID NO: 9133600 - DNA, 22 bp, Homo sapiens
attttagagctccaagtacagc

SEQ ID NO: 9133601 - DNA, 22 bp, Homo sapiens
atttttcaactttggaaatggc

SEQ ID NO: 9133602 - DNA, 22 bp, Homo sapiens
atttttccaattaggataaaga

SEQ ID NO: 9133603 - DNA, 22 bp, Homo sapiens
atttttccatgatacttatctg

SEQ ID NO: 9133604 - DNA, 22 bp, Homo sapiens
atttttatgacaaaccatcctc

SEQ ID NO: 9133605 - DNA, 22 bp, Homo sapiens
atttttatgacaaaccatcctc

SEQ ID NO: 9133606 - DNA, 22 bp, Homo sapiens
attttgctttatgtaaatatgt

SEQ ID NO: 9133607 - DNA, 22 bp, Homo sapiens
attttgtttcctttggagtaga

SEQ ID NO: 9133608 - DNA, 22 bp, Homo sapiens
atttttgtatccccagctcctg

SEQ ID NO: 9133609 - DNA, 22 bp, Homo sapiens
attttttagaacctggcctgat

SEQ ID NO: 9133610 - DNA, 22 bp, Homo sapiens
caaaataccacgacttgtttta

SEQ ID NO: 9133611 - DNA, 22 bp, Homo sapiens
caaaataccacgacttgtttta

SEQ ID NO: 9133612 - DNA, 22 bp, Homo sapiens
atttttgagctgtgaacatagc

SEQ ID NO: 9133613 - DNA, 22 bp, Homo sapiens
atttttctctccactccattaa

SEQ ID NO: 9133614 - DNA, 22 bp, Homo sapiens
atttttctctccactccattaa

SEQ ID NO: 9133615 - DNA, 22 bp, Homo sapiens
atttttcctgggtgctttagtt

SEQ ID NO: 9133616 - DNA, 23 bp, Homo sapiens
atttttcctggaacagtcaccca

SEQ ID NO: 9133617 - DNA, 18 bp, Homo sapiens
atttttcccagatggata

SEQ ID NO: 9133618 - DNA, 22 bp, Homo sapiens
atttttcctgctggatctgctc

SEQ ID NO: 9133619 - DNA, 22 bp, Homo sapiens
atttttccattctctgttagta

SEQ ID NO: 9133620 - DNA, 22 bp, Homo sapiens
caaaattagaaatgcagctgtt

SEQ ID NO: 9133621 - DNA, 22 bp, Homo sapiens
caaaattagggagtgagctgga

SEQ ID NO: 9133622 - DNA, 22 bp, Homo sapiens
caaaattagggagtgagctgga

SEQ ID NO: 9133623 - DNA, 22 bp, Homo sapiens
caaaattagaaatgcagctgtt

SEQ ID NO: 9133624 - DNA, 22 bp, Homo sapiens
caaaattagggagtgagctgga

SEQ ID NO: 9133625 - DNA, 22 bp, Homo sapiens
caaaattctgcatttctaataa

SEQ ID NO: 9133626 - DNA, 22 bp, Homo sapiens
caaaatgttctggcacctttaa

SEQ ID NO: 9133627 - DNA, 22 bp, Homo sapiens
caaaatgtgagtcccacctcaa

SEQ ID NO: 9133628 - DNA, 22 bp, Homo sapiens
caaaatgtgagtcccacctcaa

SEQ ID NO: 9133629 - DNA, 22 bp, Homo sapiens
caaaatgttctggcacctttaa

SEQ ID NO: 9133630 - DNA, 22 bp, Homo sapiens
caaaattagaaatgcagctgtt

SEQ ID NO: 9133631 - DNA, 22 bp, Homo sapiens
caaagcagagccagagcttgtc

SEQ ID NO: 9133632 - DNA, 22 bp, Homo sapiens
caaagcaggaagaatattgaaa

SEQ ID NO: 9133633 - DNA, 22 bp, Homo sapiens
caaagcagagaactgtctcatt

SEQ ID NO: 9133634 - DNA, 22 bp, Homo sapiens
caaagaggttttgagggcagct

SEQ ID NO: 9133635 - DNA, 22 bp, Homo sapiens
caaacattccgcttctcccagg

SEQ ID NO: 9133636 - DNA, 22 bp, Homo sapiens
caaagcaggcttgtcaaattgc

SEQ ID NO: 9133637 - DNA, 22 bp, Homo sapiens
caaagcagtattggattcttta

SEQ ID NO: 9133638 - DNA, 22 bp, Homo sapiens
caaagcagtgatccttaaagga

SEQ ID NO: 9133639 - DNA, 22 bp, Homo sapiens
caaagcagtgatccttaaagga

SEQ ID NO: 9133640 - DNA, 22 bp, Homo sapiens
caaagccatagagtagataaga

SEQ ID NO: 9133641 - DNA, 22 bp, Homo sapiens
caaagccaggctttctaatgta

SEQ ID NO: 9133642 - DNA, 21 bp, Homo sapiens
caaagccaggcaactctctcc

SEQ ID NO: 9133643 - DNA, 22 bp, Homo sapiens
caaagcagtgatccttaaagga

SEQ ID NO: 9133644 - DNA, 22 bp, Homo sapiens
caaagccaggctttctaatgta

SEQ ID NO: 9133645 - DNA, 21 bp, Homo sapiens
caaagccaggcaactctctcc

SEQ ID NO: 9133646 - DNA, 21 bp, Homo sapiens
caaagccaggcaactctctcc

SEQ ID NO: 9133647 - DNA, 22 bp, Homo sapiens
gctgactgatggacacagcacc

SEQ ID NO: 9133648 - DNA, 22 bp, Homo sapiens
gctgactcagatgcagctggat

SEQ ID NO: 9133649 - DNA, 23 bp, Homo sapiens
gctgacgtttatccataaatata

SEQ ID NO: 9133650 - DNA, 22 bp, Homo sapiens
caaatgcatagtttataagaag

SEQ ID NO: 9133651 - DNA, 22 bp, Homo sapiens
caaatgcatagtttataagaag

SEQ ID NO: 9133652 - DNA, 22 bp, Homo sapiens
caaatgcatagtttataagaag

SEQ ID NO: 9133653 - DNA, 22 bp, Homo sapiens
caaatgaatttccctgcaaatg

SEQ ID NO: 9133654 - DNA, 21 bp, Homo sapiens
caaatgctggctggatgagga

SEQ ID NO: 9133655 - DNA, 22 bp, Homo sapiens
caaatggctggcatccttctac

SEQ ID NO: 9133656 - DNA, 22 bp, Homo sapiens
caaatggcaacaagaacactgg

SEQ ID NO: 9133657 - DNA, 22 bp, Homo sapiens
caaatgcatgagaaataagagg

SEQ ID NO: 9133658 - DNA, 22 bp, Homo sapiens
caaatgctactaataggcaagt

SEQ ID NO: 9133659 - DNA, 22 bp, Homo sapiens
gctctttaattcattcatggat

SEQ ID NO: 9133660 - DNA, 22 bp, Homo sapiens
gctctttactgtgagggtggtc

SEQ ID NO: 9133661 - DNA, 22 bp, Homo sapiens
gctctttagacatagtctgaag

SEQ ID NO: 9133662 - DNA, 22 bp, Homo sapiens
gctctttagacatagtctgaag

SEQ ID NO: 9133663 - DNA, 22 bp, Homo sapiens
gctctttctgtccgcagggcct

SEQ ID NO: 9133664 - DNA, 18 bp, Homo sapiens
gctctttctgtctccagc

SEQ ID NO: 9133665 - DNA, 16 bp, Homo sapiens
gctctttagagggagg

SEQ ID NO: 9133666 - DNA, 22 bp, Homo sapiens
gctctttagcgggggccaggcc

SEQ ID NO: 9133667 - DNA, 22 bp, Homo sapiens
gctctttagtccaagccatgtc

SEQ ID NO: 9133668 - DNA, 22 bp, Homo sapiens
gctctttagttgatggcctgcc

SEQ ID NO: 9133669 - DNA, 18 bp, Homo sapiens
gctctggttccttcaacc

SEQ ID NO: 9133670 - DNA, 22 bp, Homo sapiens
caaatagaactcacagacaaga

SEQ ID NO: 9133671 - DNA, 22 bp, Homo sapiens
gctgacccctacaggttgtgtt

SEQ ID NO: 9133672 - DNA, 22 bp, Homo sapiens
gctgacattccctgtgaaactt

SEQ ID NO: 9133673 - DNA, 22 bp, Homo sapiens
gctgacaggctctgtgtatgct

SEQ ID NO: 9133674 - DNA, 22 bp, Homo sapiens
gctgaaaggggtgacattcttt

SEQ ID NO: 9133675 - DNA, 22 bp, Homo sapiens
gctgaaaaatagtgtcgtgttt

SEQ ID NO: 9133676 - DNA, 22 bp, Homo sapiens
gctctttgtattttggaatcaa

SEQ ID NO: 9133677 - DNA, 23 bp, Homo sapiens
gctctttgttcatgtggatgcct

SEQ ID NO: 9133678 - DNA, 22 bp, Homo sapiens
gctgaaatgcagatccctcact

SEQ ID NO: 9133679 - DNA, 22 bp, Homo sapiens
gctgaaatgaaaacacaggtcg

SEQ ID NO: 9133680 - DNA, 22 bp, Homo sapiens
gctgaaatgaaaacacaggtcg

SEQ ID NO: 9133681 - DNA, 22 bp, Homo sapiens
gctgaaatcccagcattcccca

SEQ ID NO: 9133682 - DNA, 19 bp, Homo sapiens
gctgaaatcaaatttggaa

SEQ ID NO: 9133683 - DNA, 22 bp, Homo sapiens
gctgaaatcccagcattcccca

SEQ ID NO: 9133684 - DNA, 22 bp, Homo sapiens
caaaggaagctccttgatggcg

SEQ ID NO: 9133685 - DNA, 22 bp, Homo sapiens
caaaggaagctccttgatggcg

SEQ ID NO: 9133686 - DNA, 22 bp, Homo sapiens
caaatactacgattcttgcagt

SEQ ID NO: 9133687 - DNA, 22 bp, Homo sapiens
caaatactacgattcttgcagt

SEQ ID NO: 9133688 - DNA, 22 bp, Homo sapiens
caaatactaaacataagatttt

SEQ ID NO: 9133689 - DNA, 22 bp, Homo sapiens
caaatacaaatacgggcagctt

SEQ ID NO: 9133690 - DNA, 22 bp, Homo sapiens
caaagctgacgaggtcagcatc

SEQ ID NO: 9133691 - DNA, 22 bp, Homo sapiens
caaagctataaattcagacaga

SEQ ID NO: 9133692 - DNA, 22 bp, Homo sapiens
caaagctataaattcagacaga

SEQ ID NO: 9133693 - DNA, 22 bp, Homo sapiens
caaaggaaatactaatctggaa

SEQ ID NO: 9133694 - DNA, 22 bp, Homo sapiens
caaagcttcatctgttgttttg

SEQ ID NO: 9133695 - DNA, 22 bp, Homo sapiens
caaagcttcatctgttgttttg

SEQ ID NO: 9133696 - DNA, 22 bp, Homo sapiens
caaagctggaaaaggaggctgg

SEQ ID NO: 9133697 - DNA, 22 bp, Homo sapiens
caaagctggactgctcagttca

SEQ ID NO: 9133698 - DNA, 21 bp, Homo sapiens
caaatacttagaaacttaaga

SEQ ID NO: 9133699 - DNA, 21 bp, Homo sapiens
caaatacttagaaacttaaga

SEQ ID NO: 9133700 - DNA, 22 bp, Homo sapiens
caaatactttatatacttcaaa

SEQ ID NO: 9133701 - DNA, 22 bp, Homo sapiens
caaatactttatatacttcaaa

SEQ ID NO: 9133702 - DNA, 22 bp, Homo sapiens
caaatacttttagcctattgag

SEQ ID NO: 9133703 - DNA, 22 bp, Homo sapiens
caaatagaactcacagacaaga

SEQ ID NO: 9133704 - DNA, 22 bp, Homo sapiens
caaatagaaggtactcagagaa

SEQ ID NO: 9133705 - DNA, 22 bp, Homo sapiens
caaatagacaagatggcaggaa

SEQ ID NO: 9133706 - DNA, 22 bp, Homo sapiens
caaatactgtactgaacactgt

SEQ ID NO: 9133707 - DNA, 22 bp, Homo sapiens
caaatactgtactgaacactgt

SEQ ID NO: 9133708 - DNA, 22 bp, Homo sapiens
caaatactgggtaagttaattt

SEQ ID NO: 9133709 - DNA, 22 bp, Homo sapiens
caaatacttactgaacctgtgc

SEQ ID NO: 9133710 - DNA, 22 bp, Homo sapiens
caaatacttactgaacctgtgc

SEQ ID NO: 9133711 - DNA, 18 bp, Homo sapiens
caaatactgttgtcttat

SEQ ID NO: 9133712 - DNA, 22 bp, Homo sapiens
caaatactgggtaagttaattt

SEQ ID NO: 9133713 - DNA, 22 bp, Homo sapiens
caaatactgagtttattttcaa

SEQ ID NO: 9133714 - DNA, 22 bp, Homo sapiens
caaatactgagtttattttcaa

SEQ ID NO: 9133715 - DNA, 22 bp, Homo sapiens
caaatactgagcacgcaatcaa

SEQ ID NO: 9133716 - DNA, 22 bp, Homo sapiens
caaatactacgattcttgcagt

SEQ ID NO: 9133717 - DNA, 22 bp, Homo sapiens
caaatactctggatgtgtttgt

SEQ ID NO: 9133718 - DNA, 22 bp, Homo sapiens
gccccctcaaagaggaagctct

SEQ ID NO: 9133719 - DNA, 22 bp, Homo sapiens
gcccccgtagtagatgaggcgc

SEQ ID NO: 9133720 - DNA, 22 bp, Homo sapiens
gcccccaggtgacttatccaca

SEQ ID NO: 9133721 - DNA, 22 bp, Homo sapiens
gcccccaggtgacttatccaca

SEQ ID NO: 9133722 - DNA, 22 bp, Homo sapiens
gcccccagacctcagtgggctg

SEQ ID NO: 9133723 - DNA, 22 bp, Homo sapiens
gcccccagctctcaagctcaaa

SEQ ID NO: 9133724 - DNA, 18 bp, Homo sapiens
gcccccagatgctactga

SEQ ID NO: 9133725 - DNA, 22 bp, Homo sapiens
gcccccagaagggccacagatt

SEQ ID NO: 9133726 - DNA, 22 bp, Homo sapiens
gccccctctttggagccagcca

SEQ ID NO: 9133727 - DNA, 22 bp, Homo sapiens
gccccctctttggagccagcca

SEQ ID NO: 9133728 - DNA, 22 bp, Homo sapiens
atttggaaaatctggttataga

SEQ ID NO: 9133729 - DNA, 22 bp, Homo sapiens
gcctaggagacaagcgtgaaag

SEQ ID NO: 9133730 - DNA, 22 bp, Homo sapiens
gcctaggatcaaccacatgaaa

SEQ ID NO: 9133731 - DNA, 22 bp, Homo sapiens
gcctaggattgtaaaagagctt

SEQ ID NO: 9133732 - DNA, 22 bp, Homo sapiens
atttggaacttataataagttt

SEQ ID NO: 9133733 - DNA, 22 bp, Homo sapiens
atttggaacaaatattagtaaa

SEQ ID NO: 9133734 - DNA, 22 bp, Homo sapiens
gcctcaaaagtgttgtagaggg

SEQ ID NO: 9133735 - DNA, 22 bp, Homo sapiens
gcctcaaatgtggagcactatt

SEQ ID NO: 9133736 - DNA, 19 bp, Homo sapiens
gcctctgagggcaggacac

SEQ ID NO: 9133737 - DNA, 22 bp, Homo sapiens
gcctgaagaacagctgtgagga

SEQ ID NO: 9133738 - DNA, 22 bp, Homo sapiens
gcctgaagaacagctgtgagga

SEQ ID NO: 9133739 - DNA, 22 bp, Homo sapiens
gcctagggtgctcagggacgag

SEQ ID NO: 9133740 - DNA, 22 bp, Homo sapiens
gcctcaaaagtgttgtagaggg

SEQ ID NO: 9133741 - DNA, 19 bp, Homo sapiens
gcctatgtcttcaaatcat

SEQ ID NO: 9133742 - DNA, 22 bp, Homo sapiens
atttggaagcttgaagattatt

SEQ ID NO: 9133743 - DNA, 22 bp, Homo sapiens
gcctgaagtttcatgcctctat

SEQ ID NO: 9133744 - DNA, 22 bp, Homo sapiens
gcctgagaaggataggaagcga

SEQ ID NO: 9133745 - DNA, 22 bp, Homo sapiens
gcctgacttgtgtattttacat

SEQ ID NO: 9133746 - DNA, 22 bp, Homo sapiens
gcctgagaaggacacagcaggt

SEQ ID NO: 9133747 - DNA, 22 bp, Homo sapiens
gcctgagaaggacacagcaggt

SEQ ID NO: 9133748 - DNA, 22 bp, Homo sapiens
gcctgagagtctccagaccttg

SEQ ID NO: 9133749 - DNA, 22 bp, Homo sapiens
gcctgagagttgaagttcagtg

SEQ ID NO: 9133750 - DNA, 22 bp, Homo sapiens
gcctggcaatggcctcaggaag

SEQ ID NO: 9133751 - DNA, 22 bp, Homo sapiens
attttactactccaattaatga

SEQ ID NO: 9133752 - DNA, 22 bp, Homo sapiens
gcctggaggaatgtagctgagg

SEQ ID NO: 9133753 - DNA, 22 bp, Homo sapiens
gcctggattccttgtttctcag

SEQ ID NO: 9133754 - DNA, 22 bp, Homo sapiens
gcctggattccttgtttctcag

SEQ ID NO: 9133755 - DNA, 23 bp, Homo sapiens
gcctggattaaggcagtgacttc

SEQ ID NO: 9133756 - DNA, 22 bp, Homo sapiens
gcctggattccttgtttctcag

SEQ ID NO: 9133757 - DNA, 22 bp, Homo sapiens
gcctggattccttgtttctcag

SEQ ID NO: 9133758 - DNA, 22 bp, Homo sapiens
gcctggagttgtggtgaagcca

SEQ ID NO: 9133759 - DNA, 22 bp, Homo sapiens
gcctggagttgaaactattatt

SEQ ID NO: 9133760 - DNA, 22 bp, Homo sapiens
gcctggatcccagggagtcagg

SEQ ID NO: 9133761 - DNA, 22 bp, Homo sapiens
gcctggagttgtggtgaagcca

SEQ ID NO: 9133762 - DNA, 22 bp, Homo sapiens
atttctggactgaaaaggaagt

SEQ ID NO: 9133763 - DNA, 22 bp, Homo sapiens
atttctgtagtccacattcttt

SEQ ID NO: 9133764 - DNA, 22 bp, Homo sapiens
atttctcagtgtgatcaggcct

SEQ ID NO: 9133765 - DNA, 22 bp, Homo sapiens
gcccacctaacctgctcacctt

SEQ ID NO: 9133766 - DNA, 22 bp, Homo sapiens
atttctgtggcttcattctcct

SEQ ID NO: 9133767 - DNA, 22 bp, Homo sapiens
atttctgtggcttcattctcct

SEQ ID NO: 9133768 - DNA, 22 bp, Homo sapiens
atttctgttatacctttctcag

SEQ ID NO: 9133769 - DNA, 22 bp, Homo sapiens
atttctgttatacctttctcag

SEQ ID NO: 9133770 - DNA, 22 bp, Homo sapiens
atttctgtatcctgctgtcaga

SEQ ID NO: 9133771 - DNA, 22 bp, Homo sapiens
atttctgtgcagtaaatggtga

SEQ ID NO: 9133772 - DNA, 22 bp, Homo sapiens
atttctgtgcagtaaatggtga

SEQ ID NO: 9133773 - DNA, 17 bp, Homo sapiens
gcccccagaaatctcag

SEQ ID NO: 9133774 - DNA, 22 bp, Homo sapiens
gccccaggttgcctgtcccagg

SEQ ID NO: 9133775 - DNA, 22 bp, Homo sapiens
atttctgttgcttataaattac

SEQ ID NO: 9133776 - DNA, 22 bp, Homo sapiens
atttccagtgcactgaatagaa

SEQ ID NO: 9133777 - DNA, 22 bp, Homo sapiens
atttccatgaagtttagttata

SEQ ID NO: 9133778 - DNA, 22 bp, Homo sapiens
atttccatgtcggtattttata

SEQ ID NO: 9133779 - DNA, 22 bp, Homo sapiens
atttccatgtccaaaaattagt

SEQ ID NO: 9133780 - DNA, 22 bp, Homo sapiens
atttcccaatacgctaagtgga

SEQ ID NO: 9133781 - DNA, 21 bp, Homo sapiens
gcccacagtgaggaggatccc

SEQ ID NO: 9133782 - DNA, 21 bp, Homo sapiens
gcccacagtgaggaggatccc

SEQ ID NO: 9133783 - DNA, 22 bp, Homo sapiens
gcccacagtgtagcaggtactc

SEQ ID NO: 9133784 - DNA, 22 bp, Homo sapiens
gcccacagttagtttgcatggc

SEQ ID NO: 9133785 - DNA, 22 bp, Homo sapiens
gcccacatttttggcttagagg

SEQ ID NO: 9133786 - DNA, 22 bp, Homo sapiens
atttccaggagaaaggatttta

SEQ ID NO: 9133787 - DNA, 22 bp, Homo sapiens
gccaggtggctgagcagctgca

SEQ ID NO: 9133788 - DNA, 22 bp, Homo sapiens
gccaggtggaggttgcagtgag

SEQ ID NO: 9133789 - DNA, 22 bp, Homo sapiens
atttcatgttaactgaacagaa

SEQ ID NO: 9133790 - DNA, 19 bp, Homo sapiens
gccaggtcttgggtccagg

SEQ ID NO: 9133791 - DNA, 22 bp, Homo sapiens
gccaggctggtgcaaggatatt

SEQ ID NO: 9133792 - DNA, 22 bp, Homo sapiens
gccaggctggtgcaaggatatt

SEQ ID NO: 9133793 - DNA, 22 bp, Homo sapiens
gccaggtgatttcaaagtcctt

SEQ ID NO: 9133794 - DNA, 22 bp, Homo sapiens
gccaggtgcacctgccctggcc

SEQ ID NO: 9133795 - DNA, 22 bp, Homo sapiens
gccaggtgcatggctgagtctc

SEQ ID NO: 9133796 - DNA, 22 bp, Homo sapiens
gccaggtgcatggctgagtctc

SEQ ID NO: 9133797 - DNA, 22 bp, Homo sapiens
gccaggtggaggttgcagtgag

SEQ ID NO: 9133798 - DNA, 22 bp, Homo sapiens
gccaggtgcatattagaagcat

SEQ ID NO: 9133799 - DNA, 22 bp, Homo sapiens
gccaggtgcacctgccctggcc

SEQ ID NO: 9133800 - DNA, 22 bp, Homo sapiens
gccacagggcgagcggaggcca

SEQ ID NO: 9133801 - DNA, 22 bp, Homo sapiens
gccacaggtactatgggagaga

SEQ ID NO: 9133802 - DNA, 22 bp, Homo sapiens
gccacaggtactatgggagaga

SEQ ID NO: 9133803 - DNA, 22 bp, Homo sapiens
gccacaggtcggctagagggtc

SEQ ID NO: 9133804 - DNA, 22 bp, Homo sapiens
gccacaggtcggctagagggtc

SEQ ID NO: 9133805 - DNA, 22 bp, Homo sapiens
gccacaggtaggaacctacctc

SEQ ID NO: 9133806 - DNA, 22 bp, Homo sapiens
gccacaggtaggaacctacctc

SEQ ID NO: 9133807 - DNA, 22 bp, Homo sapiens
gccaggctgctggctgctgtcc

SEQ ID NO: 9133808 - DNA, 22 bp, Homo sapiens
gccacaggtggaattaagaaat

SEQ ID NO: 9133809 - DNA, 22 bp, Homo sapiens
gccacaggtgggctctgggaaa

SEQ ID NO: 9133810 - DNA, 22 bp, Homo sapiens
gccaggctgctggctgctgtcc

SEQ ID NO: 9133811 - DNA, 22 bp, Homo sapiens
gccaggctggaaagaacagaca

SEQ ID NO: 9133812 - DNA, 22 bp, Homo sapiens
gccaggctggaaagaacagaca

SEQ ID NO: 9133813 - DNA, 22 bp, Homo sapiens
gccaggctggcaaaaggaaacc

SEQ ID NO: 9133814 - DNA, 22 bp, Homo sapiens
gccaggctggccagcaccttct

SEQ ID NO: 9133815 - DNA, 22 bp, Homo sapiens
gccaggctggtcttgaactcct

SEQ ID NO: 9133816 - DNA, 22 bp, Homo sapiens
gccaggctggggggagatgtct

SEQ ID NO: 9133817 - DNA, 22 bp, Homo sapiens
gccaggctggccagcaccttct

SEQ ID NO: 9133818 - DNA, 22 bp, Homo sapiens
gccaggctggtcttgaactcct

SEQ ID NO: 9133819 - DNA, 20 bp, Homo sapiens
atacaaagagattgatgtat

SEQ ID NO: 9133820 - DNA, 20 bp, Homo sapiens
atacaaagagattgatgtat

SEQ ID NO: 9133821 - DNA, 22 bp, Homo sapiens
atacaaagacaaatctcaatct

SEQ ID NO: 9133822 - DNA, 22 bp, Homo sapiens
atacaaagacaaatctcaatct

SEQ ID NO: 9133823 - DNA, 20 bp, Homo sapiens
ataaggctgtgatagtctga

SEQ ID NO: 9133824 - DNA, 22 bp, Homo sapiens
ataaggtataaggcctattttt

SEQ ID NO: 9133825 - DNA, 22 bp, Homo sapiens
ataaggcagaaatagggaaagt

SEQ ID NO: 9133826 - DNA, 22 bp, Homo sapiens
ataaggacttgaattagacatt

SEQ ID NO: 9133827 - DNA, 22 bp, Homo sapiens
ataaggcacacatagatagggt

SEQ ID NO: 9133828 - DNA, 22 bp, Homo sapiens
ataaggcacacatagatagggt

SEQ ID NO: 9133829 - DNA, 22 bp, Homo sapiens
ataaggaatttagaatagggaa

SEQ ID NO: 9133830 - DNA, 22 bp, Homo sapiens
ataaggaatgatgtatcagttt

SEQ ID NO: 9133831 - DNA, 22 bp, Homo sapiens
ataaggaatgatgtatcagttt

SEQ ID NO: 9133832 - DNA, 22 bp, Homo sapiens
ataaggaagatgtcctcatctg

SEQ ID NO: 9133833 - DNA, 22 bp, Homo sapiens
ataaggaagttgcagaagtgga

SEQ ID NO: 9133834 - DNA, 22 bp, Homo sapiens
ataaggaaatgaaactctaata

SEQ ID NO: 9133835 - DNA, 22 bp, Homo sapiens
ataaggaacctgggcttaagag

SEQ ID NO: 9133836 - DNA, 22 bp, Homo sapiens
ataaggaaatgaaactctaata

SEQ ID NO: 9133837 - DNA, 22 bp, Homo sapiens
ataaggaaaattggagaaattg

SEQ ID NO: 9133838 - DNA, 22 bp, Homo sapiens
ataaggaaaattggagaaattg

SEQ ID NO: 9133839 - DNA, 19 bp, Homo sapiens
atacactaatataaaccac

SEQ ID NO: 9133840 - DNA, 22 bp, Homo sapiens
atacacactgctatcctttttt

SEQ ID NO: 9133841 - DNA, 22 bp, Homo sapiens
atacaatccagccattgccaca

SEQ ID NO: 9133842 - DNA, 22 bp, Homo sapiens
atacaatctagtctgtcagcaa

SEQ ID NO: 9133843 - DNA, 22 bp, Homo sapiens
agttgaaattaagagagagttt

SEQ ID NO: 9133844 - DNA, 22 bp, Homo sapiens
agttgaaattaagagagagttt

SEQ ID NO: 9133845 - DNA, 22 bp, Homo sapiens
agttgaaattagagtcctggct

SEQ ID NO: 9133846 - DNA, 22 bp, Homo sapiens
agttgaaggttggctgatccat

SEQ ID NO: 9133847 - DNA, 22 bp, Homo sapiens
agttcttttgtgaacatatgct

SEQ ID NO: 9133848 - DNA, 22 bp, Homo sapiens
agttctttgtgagtaatacaga

SEQ ID NO: 9133849 - DNA, 22 bp, Homo sapiens
agttcagaggttaatttatttg

SEQ ID NO: 9133850 - DNA, 22 bp, Homo sapiens
agttcagcaaataaaacatagt

SEQ ID NO: 9133851 - DNA, 22 bp, Homo sapiens
agttcagagtaaatgttgaagg

SEQ ID NO: 9133852 - DNA, 22 bp, Homo sapiens
agttcagaaatgtctttgcaaa

SEQ ID NO: 9133853 - DNA, 19 bp, Homo sapiens
ataaataaaaagtgggaga

SEQ ID NO: 9133854 - DNA, 22 bp, Homo sapiens
agttgcagacgcagagatgttg

SEQ ID NO: 9133855 - DNA, 22 bp, Homo sapiens
agttgactctcaagatcctgtt

SEQ ID NO: 9133856 - DNA, 22 bp, Homo sapiens
agttgcactttctagatactgt

SEQ ID NO: 9133857 - DNA, 22 bp, Homo sapiens
agttgcagacgcagagatgttg

SEQ ID NO: 9133858 - DNA, 22 bp, Homo sapiens
agttgcagacgcagagatgttg

SEQ ID NO: 9133859 - DNA, 22 bp, Homo sapiens
ataaattgtgcttttgacatct

SEQ ID NO: 9133860 - DNA, 22 bp, Homo sapiens
ataaattttcttgctgtactta

SEQ ID NO: 9133861 - DNA, 22 bp, Homo sapiens
ataaatttataattgtttcctg

SEQ ID NO: 9133862 - DNA, 22 bp, Homo sapiens
ataaatttataattgtttcctg

SEQ ID NO: 9133863 - DNA, 22 bp, Homo sapiens
ataaattttcttgctgtactta

SEQ ID NO: 9133864 - DNA, 22 bp, Homo sapiens
ataacaatagtggtagtgctgg

SEQ ID NO: 9133865 - DNA, 22 bp, Homo sapiens
ataacactaaatgtatgtaaca

SEQ ID NO: 9133866 - DNA, 22 bp, Homo sapiens
ataacagaataagtcattaccg

SEQ ID NO: 9133867 - DNA, 22 bp, Homo sapiens
ataacagacttagagttacaag

SEQ ID NO: 9133868 - DNA, 22 bp, Homo sapiens
ataacagactgatttttaaatg

SEQ ID NO: 9133869 - DNA, 22 bp, Homo sapiens
atactgtgtgtgctcaaggaat

SEQ ID NO: 9133870 - DNA, 22 bp, Homo sapiens
atagaacagaaacagatgcaca

SEQ ID NO: 9133871 - DNA, 22 bp, Homo sapiens
atagaactcgggctttggaatc

SEQ ID NO: 9133872 - DNA, 22 bp, Homo sapiens
atacttaatgtcagtttgatgt

SEQ ID NO: 9133873 - DNA, 22 bp, Homo sapiens
atacacttgacctggagtgaag

SEQ ID NO: 9133874 - DNA, 20 bp, Homo sapiens
atacacttgcccagcttgtg

SEQ ID NO: 9133875 - DNA, 22 bp, Homo sapiens
atacacttcatgttttcatctg

SEQ ID NO: 9133876 - DNA, 22 bp, Homo sapiens
atacacttccaaatattgatta

SEQ ID NO: 9133877 - DNA, 22 bp, Homo sapiens
atacacttcatgttttcatctg

SEQ ID NO: 9133878 - DNA, 22 bp, Homo sapiens
atacactggtttatgatattgt

SEQ ID NO: 9133879 - DNA, 22 bp, Homo sapiens
atagaataaggcacagattctt

SEQ ID NO: 9133880 - DNA, 22 bp, Homo sapiens
atagaataaggcacagattctt

SEQ ID NO: 9133881 - DNA, 22 bp, Homo sapiens
atagaatagcatagaaaattga

SEQ ID NO: 9133882 - DNA, 22 bp, Homo sapiens
atagaatagcatagaaaattga

SEQ ID NO: 9133883 - DNA, 22 bp, Homo sapiens
actttactacatccacagatgg

SEQ ID NO: 9133884 - DNA, 22 bp, Homo sapiens
actttacatttgatctctctaa

SEQ ID NO: 9133885 - DNA, 22 bp, Homo sapiens
actttactacatccacagatgg

SEQ ID NO: 9133886 - DNA, 20 bp, Homo sapiens
actttacagagaagactgac

SEQ ID NO: 9133887 - DNA, 22 bp, Homo sapiens
actttacagatggtttcctgac

SEQ ID NO: 9133888 - DNA, 22 bp, Homo sapiens
actttacaggcacttcaagtat

SEQ ID NO: 9133889 - DNA, 22 bp, Homo sapiens
atagatgtcattgtcatccatc

SEQ ID NO: 9133890 - DNA, 22 bp, Homo sapiens
atagatccagaaaatttattat

SEQ ID NO: 9133891 - DNA, 20 bp, Homo sapiens
atagatcctggttctttgca

SEQ ID NO: 9133892 - DNA, 22 bp, Homo sapiens
atagatgtacgtatgtaaatca

SEQ ID NO: 9133893 - DNA, 22 bp, Homo sapiens
actttactcaacaaatatttat

SEQ ID NO: 9133894 - DNA, 22 bp, Homo sapiens
actttactccccaacataaatg

SEQ ID NO: 9133895 - DNA, 20 bp, Homo sapiens
actttactgagctgtaattc

SEQ ID NO: 9133896 - DNA, 22 bp, Homo sapiens
actttactcttcatatgtgaca

SEQ ID NO: 9133897 - DNA, 22 bp, Homo sapiens
actttagaaaaggaacagagga

SEQ ID NO: 9133898 - DNA, 22 bp, Homo sapiens
agaaaagcggtcaggaccctca

SEQ ID NO: 9133899 - DNA, 22 bp, Homo sapiens
agaaaagaggctttctaagcat

SEQ ID NO: 9133900 - DNA, 22 bp, Homo sapiens
agaaaaggattgatggatcaga

SEQ ID NO: 9133901 - DNA, 22 bp, Homo sapiens
agaaaaggattgatggatcaga

SEQ ID NO: 9133902 - DNA, 20 bp, Homo sapiens
agaaaaagtgtggaaatttc

SEQ ID NO: 9133903 - DNA, 20 bp, Homo sapiens
agaaaaagtgtggaaatttc

SEQ ID NO: 9133904 - DNA, 17 bp, Homo sapiens
agaaaagagaccagcag

SEQ ID NO: 9133905 - DNA, 22 bp, Homo sapiens
agaaaacttgtcacagctctca

SEQ ID NO: 9133906 - DNA, 22 bp, Homo sapiens
agaaaacttgtcacagctctca

SEQ ID NO: 9133907 - DNA, 22 bp, Homo sapiens
atagttacaaagactttttaaa

SEQ ID NO: 9133908 - DNA, 22 bp, Homo sapiens
atagtgttagagccagtatgtt

SEQ ID NO: 9133909 - DNA, 22 bp, Homo sapiens
ataggaaagaaaattatgtagg

SEQ ID NO: 9133910 - DNA, 22 bp, Homo sapiens
ataggaaatcgctattaaccta

SEQ ID NO: 9133911 - DNA, 22 bp, Homo sapiens
ataggaaatcgctattaaccta

SEQ ID NO: 9133912 - DNA, 22 bp, Homo sapiens
ataggaatttcttcagcactga

SEQ ID NO: 9133913 - DNA, 22 bp, Homo sapiens
ataggaaagaatggagggtggg

SEQ ID NO: 9133914 - DNA, 20 bp, Homo sapiens
ataggaaagggaggggcttt

SEQ ID NO: 9133915 - DNA, 22 bp, Homo sapiens
ataggaaagaaaattatgtagg

SEQ ID NO: 9133916 - DNA, 22 bp, Homo sapiens
atagctttttgtcatagagtct

SEQ ID NO: 9133917 - DNA, 19 bp, Homo sapiens
atagcttgtcagctgctcc

SEQ ID NO: 9133918 - DNA, 22 bp, Homo sapiens
agaaatatgctgattagatgaa

SEQ ID NO: 9133919 - DNA, 22 bp, Homo sapiens
agaaatatgctgattagatgaa

SEQ ID NO: 9133920 - DNA, 22 bp, Homo sapiens
agaaatatgctgattagatgaa

SEQ ID NO: 9133921 - DNA, 22 bp, Homo sapiens
atattaattatttacacatgag

SEQ ID NO: 9133922 - DNA, 22 bp, Homo sapiens
atattacacacggtatcacggg

SEQ ID NO: 9133923 - DNA, 22 bp, Homo sapiens
agaaagtttgtttttatccata

SEQ ID NO: 9133924 - DNA, 22 bp, Homo sapiens
agaaagttttgtgctatatatg

SEQ ID NO: 9133925 - DNA, 22 bp, Homo sapiens
agaaatcacaggaggcagaagg

SEQ ID NO: 9133926 - DNA, 22 bp, Homo sapiens
agaaatcacttagaggaagtga

SEQ ID NO: 9133927 - DNA, 22 bp, Homo sapiens
atcaatatcagatcagacagga

SEQ ID NO: 9133928 - DNA, 22 bp, Homo sapiens
atcaagagttatatttcatagt

SEQ ID NO: 9133929 - DNA, 22 bp, Homo sapiens
atcaagcagtgaaaaatgctag

SEQ ID NO: 9133930 - DNA, 22 bp, Homo sapiens
agaaatgcagtttcaagacaaa

SEQ ID NO: 9133931 - DNA, 22 bp, Homo sapiens
agaaatgcagtttcaagacaaa

SEQ ID NO: 9133932 - DNA, 22 bp, Homo sapiens
agaaatgcagtttcaagacaaa

SEQ ID NO: 9133933 - DNA, 22 bp, Homo sapiens
agaaatgcagtttcaagacaaa

SEQ ID NO: 9133934 - DNA, 22 bp, Homo sapiens
agaaatgcagtctcgtcaaaag

SEQ ID NO: 9133935 - DNA, 22 bp, Homo sapiens
agaaatgctcttcctgaccaga

SEQ ID NO: 9133936 - DNA, 22 bp, Homo sapiens
agaaatgcattagcacatatag

SEQ ID NO: 9133937 - DNA, 22 bp, Homo sapiens
agaaatcttatcaagaaatgcc

SEQ ID NO: 9133938 - DNA, 22 bp, Homo sapiens
agaaatgacacacatgagacat

SEQ ID NO: 9133939 - DNA, 22 bp, Homo sapiens
atcaattcttaggaaaatagct

SEQ ID NO: 9133940 - DNA, 22 bp, Homo sapiens
atatagttgggtttcattctac

SEQ ID NO: 9133941 - DNA, 22 bp, Homo sapiens
agaaactgtgttactagaatgt

SEQ ID NO: 9133942 - DNA, 22 bp, Homo sapiens
agaaactgcagctcagagaagt

SEQ ID NO: 9133943 - DNA, 22 bp, Homo sapiens
agaaacttcagctattcttttg

SEQ ID NO: 9133944 - DNA, 22 bp, Homo sapiens
agaaaagggcaggagggataca

SEQ ID NO: 9133945 - DNA, 22 bp, Homo sapiens
atatagaaggtgctatttacat

SEQ ID NO: 9133946 - DNA, 22 bp, Homo sapiens
agaaagaacgttggttatctta

SEQ ID NO: 9133947 - DNA, 22 bp, Homo sapiens
agaaagacaaaatgcagtggct

SEQ ID NO: 9133948 - DNA, 22 bp, Homo sapiens
agaaagaacgttggttatctta

SEQ ID NO: 9133949 - DNA, 22 bp, Homo sapiens
agaaagaacgcacttgtgctgc

SEQ ID NO: 9133950 - DNA, 22 bp, Homo sapiens
agaaagaacgcacttgtgctgc

SEQ ID NO: 9133951 - DNA, 22 bp, Homo sapiens
agaaagaacgcacttgtgctgc

SEQ ID NO: 9133952 - DNA, 22 bp, Homo sapiens
agaaagacgtgatgaagaagta

SEQ ID NO: 9133953 - DNA, 17 bp, Homo sapiens
agaaagaggatccacag

SEQ ID NO: 9133954 - DNA, 22 bp, Homo sapiens
agaaagaggatgcagatctcat

SEQ ID NO: 9133955 - DNA, 22 bp, Homo sapiens
atattaattatttacacatgag

SEQ ID NO: 9133956 - DNA, 22 bp, Homo sapiens
atattaatgagcaagtaagtga

SEQ ID NO: 9133957 - DNA, 22 bp, Homo sapiens
atattaatgagcaagtaagtga

SEQ ID NO: 9133958 - DNA, 22 bp, Homo sapiens
agaagcagttattttttgcaca

SEQ ID NO: 9133959 - DNA, 22 bp, Homo sapiens
agaagcagttattttttgcaca

SEQ ID NO: 9133960 - DNA, 22 bp, Homo sapiens
agaagccaaatgccagtgacct

SEQ ID NO: 9133961 - DNA, 22 bp, Homo sapiens
agaagccaacagggcaggagag

SEQ ID NO: 9133962 - DNA, 22 bp, Homo sapiens
agaagccaaatgccagtgacct

SEQ ID NO: 9133963 - DNA, 22 bp, Homo sapiens
agaaatgttgaatacatcagga

SEQ ID NO: 9133964 - DNA, 22 bp, Homo sapiens
agaagcacctgtcagctacatg

SEQ ID NO: 9133965 - DNA, 22 bp, Homo sapiens
agaagcagggcagggaaaagca

SEQ ID NO: 9133966 - DNA, 22 bp, Homo sapiens
agaagcaggcctcacagatctg

SEQ ID NO: 9133967 - DNA, 22 bp, Homo sapiens
agaagcaggcagatttcagctc

SEQ ID NO: 9133968 - DNA, 22 bp, Homo sapiens
agaaatgtggatcgttttaaaa

SEQ ID NO: 9133969 - DNA, 22 bp, Homo sapiens
agaaatgttacagttgttattt

SEQ ID NO: 9133970 - DNA, 22 bp, Homo sapiens
agaaatgttgaatacacaaaat

SEQ ID NO: 9133971 - DNA, 22 bp, Homo sapiens
agaaatgttgaatacacaaaat

SEQ ID NO: 9133972 - DNA, 22 bp, Homo sapiens
agaaatgtgaatttcatttcct

SEQ ID NO: 9133973 - DNA, 22 bp, Homo sapiens
agaaatgtggaggaacagggct

SEQ ID NO: 9133974 - DNA, 22 bp, Homo sapiens
agaaatgtggaggaacagggct

SEQ ID NO: 9133975 - DNA, 20 bp, Homo sapiens
agaaatgtgaaaggctgagt

SEQ ID NO: 9133976 - DNA, 22 bp, Homo sapiens
agaaatgtgaatttcatttcct

SEQ ID NO: 9133977 - DNA, 22 bp, Homo sapiens
agaaatgtccagggctaggatc

SEQ ID NO: 9133978 - DNA, 22 bp, Homo sapiens
agaaatggtgagtgagagcccc

SEQ ID NO: 9133979 - DNA, 22 bp, Homo sapiens
agaaatgtaattgcaactgtct

SEQ ID NO: 9133980 - DNA, 22 bp, Homo sapiens
agaaatgtaattgcaactgtct

SEQ ID NO: 9133981 - DNA, 22 bp, Homo sapiens
agaaatgtatagtgaatttttc

SEQ ID NO: 9133982 - DNA, 22 bp, Homo sapiens
agaaatgtatagtgaatttttc

SEQ ID NO: 9133983 - DNA, 22 bp, Homo sapiens
agaaatgtattctgtatgtttt

SEQ ID NO: 9133984 - DNA, 22 bp, Homo sapiens
agaaatgtcaggaaagaagtcc

SEQ ID NO: 9133985 - DNA, 22 bp, Homo sapiens
agaagccatgtttagtaggatg

SEQ ID NO: 9133986 - DNA, 22 bp, Homo sapiens
agaagccatgtttagtaggatg

SEQ ID NO: 9133987 - DNA, 22 bp, Homo sapiens
agaagccattccctgtaggctc

SEQ ID NO: 9133988 - DNA, 22 bp, Homo sapiens
agaagccattctcagttcctga

SEQ ID NO: 9133989 - DNA, 22 bp, Homo sapiens
agaagccattccctgtaggctc

SEQ ID NO: 9133990 - DNA, 21 bp, Homo sapiens
agaagccatttgttaggactt

SEQ ID NO: 9133991 - DNA, 22 bp, Homo sapiens
agaagccattgaagcagacctc

SEQ ID NO: 9133992 - DNA, 22 bp, Homo sapiens
agaagccattgaagcagacctc

SEQ ID NO: 9133993 - DNA, 19 bp, Homo sapiens
agaagcccagatcccagcc

SEQ ID NO: 9133994 - DNA, 19 bp, Homo sapiens
agaagcccagatcccagcc

SEQ ID NO: 9133995 - DNA, 20 bp, Homo sapiens
agaagctgatactgatggaa

SEQ ID NO: 9133996 - DNA, 22 bp, Homo sapiens
agaagctgcgtttatttaaatc

SEQ ID NO: 9133997 - DNA, 20 bp, Homo sapiens
atctgcttgcctgtcctcgg

SEQ ID NO: 9133998 - DNA, 22 bp, Homo sapiens
agaagctgagaatgaattaaga

SEQ ID NO: 9133999 - DNA, 22 bp, Homo sapiens
agaagctgacagatgcagcagg

SEQ ID NO: 9134000 - DNA, 22 bp, Homo sapiens
agaagctgacagatgcagcagg

SEQ ID NO: 9134001 - DNA, 22 bp, Homo sapiens
agaagctaggctagacaagtga

SEQ ID NO: 9134002 - DNA, 21 bp, Homo sapiens
agaagctagtcactaaatcca

SEQ ID NO: 9134003 - DNA, 22 bp, Homo sapiens
agaagctataacaacaattata

SEQ ID NO: 9134004 - DNA, 22 bp, Homo sapiens
agaagccatagtctgggaggca

SEQ ID NO: 9134005 - DNA, 22 bp, Homo sapiens
agaagccatagtatctcagggt

SEQ ID NO: 9134006 - DNA, 22 bp, Homo sapiens
agaagccaccagctgaggaaga

SEQ ID NO: 9134007 - DNA, 22 bp, Homo sapiens
agaagccatggtatgcaactac

SEQ ID NO: 9134008 - DNA, 21 bp, Homo sapiens
agaagccatgtggtggagaac

SEQ ID NO: 9134009 - DNA, 22 bp, Homo sapiens
agaagccatggtatgcaactac

SEQ ID NO: 9134010 - DNA, 22 bp, Homo sapiens
agaagccatggggtcaccagag

SEQ ID NO: 9134011 - DNA, 22 bp, Homo sapiens
agaagccatatttagggaggag

SEQ ID NO: 9134012 - DNA, 22 bp, Homo sapiens
agaagccatagtctgggaggca

SEQ ID NO: 9134013 - DNA, 22 bp, Homo sapiens
agaagccatagtatctcagggt

SEQ ID NO: 9134014 - DNA, 22 bp, Homo sapiens
agaagccatagtatctcagggt

SEQ ID NO: 9134015 - DNA, 22 bp, Homo sapiens
atcctgcagggggttttattca

SEQ ID NO: 9134016 - DNA, 22 bp, Homo sapiens
atcctggacagtttcccctatt

SEQ ID NO: 9134017 - DNA, 22 bp, Homo sapiens
atcctggaggctggaggcttgc

SEQ ID NO: 9134018 - DNA, 22 bp, Homo sapiens
atcctgaggaaggtgcagagat

SEQ ID NO: 9134019 - DNA, 22 bp, Homo sapiens
atcctgagctacacctgctcct

SEQ ID NO: 9134020 - DNA, 22 bp, Homo sapiens
atcctgagttctcagagtctcc

SEQ ID NO: 9134021 - DNA, 22 bp, Homo sapiens
atcctgcagggggttttattca

SEQ ID NO: 9134022 - DNA, 22 bp, Homo sapiens
atcctgagttcctgcctctaaa

SEQ ID NO: 9134023 - DNA, 22 bp, Homo sapiens
atcctgagttcctgcctctaaa

SEQ ID NO: 9134024 - DNA, 22 bp, Homo sapiens
agttcaaactctataagaactt

SEQ ID NO: 9134025 - DNA, 19 bp, Homo sapiens
agttatttctaaatttacc

SEQ ID NO: 9134026 - DNA, 22 bp, Homo sapiens
agttaccccacacactgagaaa

SEQ ID NO: 9134027 - DNA, 22 bp, Homo sapiens
agttaccatatatcaaacatgg

SEQ ID NO: 9134028 - DNA, 20 bp, Homo sapiens
agttacgctattactctcct

SEQ ID NO: 9134029 - DNA, 22 bp, Homo sapiens
agttacaagctattttacttaa

SEQ ID NO: 9134030 - DNA, 22 bp, Homo sapiens
agttacaactgtttgaatgtca

SEQ ID NO: 9134031 - DNA, 22 bp, Homo sapiens
agttacaaccatgacacaagca

SEQ ID NO: 9134032 - DNA, 22 bp, Homo sapiens
agttacaaccatgacacaagca

SEQ ID NO: 9134033 - DNA, 21 bp, Homo sapiens
agttacatgtatagataaagt

SEQ ID NO: 9134034 - DNA, 22 bp, Homo sapiens
agttacagcactcaaagttttc

SEQ ID NO: 9134035 - DNA, 22 bp, Homo sapiens
agttacagtaagccagccagca

SEQ ID NO: 9134036 - DNA, 22 bp, Homo sapiens
agttacagtgttctattactct

SEQ ID NO: 9134037 - DNA, 22 bp, Homo sapiens
agttacagtgaccatttattta

SEQ ID NO: 9134038 - DNA, 22 bp, Homo sapiens
actggtaacaatggaagcttct

SEQ ID NO: 9134039 - DNA, 22 bp, Homo sapiens
actggtgttgatttggaagggg

SEQ ID NO: 9134040 - DNA, 22 bp, Homo sapiens
agttaataatggaaagacacat

SEQ ID NO: 9134041 - DNA, 22 bp, Homo sapiens
agttaataatggaaagacacat

SEQ ID NO: 9134042 - DNA, 22 bp, Homo sapiens
agttaatataagttttactgtt

SEQ ID NO: 9134043 - DNA, 23 bp, Homo sapiens
agttaatgtgcatgaagtgctgc

SEQ ID NO: 9134044 - DNA, 22 bp, Homo sapiens
agttaatgagcattttggaatg

SEQ ID NO: 9134045 - DNA, 22 bp, Homo sapiens
agttacaaacactatcagttct

SEQ ID NO: 9134046 - DNA, 22 bp, Homo sapiens
agttacaaacactatcagttct

SEQ ID NO: 9134047 - DNA, 22 bp, Homo sapiens
actgggtgtattagtggtgttt

SEQ ID NO: 9134048 - DNA, 22 bp, Homo sapiens
actggggtttaggcctgggcaa

SEQ ID NO: 9134049 - DNA, 23 bp, Homo sapiens
actgggtctatctccagagaaga

SEQ ID NO: 9134050 - DNA, 22 bp, Homo sapiens
actggggtgaaattggagtgtc

SEQ ID NO: 9134051 - DNA, 22 bp, Homo sapiens
actggggtttaggcctgggcaa

SEQ ID NO: 9134052 - DNA, 22 bp, Homo sapiens
actggggcctcctccatgctct

SEQ ID NO: 9134053 - DNA, 22 bp, Homo sapiens
actggggctgatgcgttcgtgt

SEQ ID NO: 9134054 - DNA, 22 bp, Homo sapiens
actggggcctcctccatgctct

SEQ ID NO: 9134055 - DNA, 22 bp, Homo sapiens
actggggcagtgggcagtggtt

SEQ ID NO: 9134056 - DNA, 22 bp, Homo sapiens
actggggcaggaaagtatgctg

SEQ ID NO: 9134057 - DNA, 23 bp, Homo sapiens
actgggctgaaatttttcatggc

SEQ ID NO: 9134058 - DNA, 23 bp, Homo sapiens
actgggctgaaattaaaggtgtc

SEQ ID NO: 9134059 - DNA, 22 bp, Homo sapiens
agtgtgtacataattgtacgcc

SEQ ID NO: 9134060 - DNA, 22 bp, Homo sapiens
agtgtcttactccctcaggcac

SEQ ID NO: 9134061 - DNA, 20 bp, Homo sapiens
agtgtctggtgcagggcctc

SEQ ID NO: 9134062 - DNA, 22 bp, Homo sapiens
agtgtctgtgttttctattgct

SEQ ID NO: 9134063 - DNA, 22 bp, Homo sapiens
agtgtctgttgagtttcaaaag

SEQ ID NO: 9134064 - DNA, 22 bp, Homo sapiens
agtggggtctcctccagccccc

SEQ ID NO: 9134065 - DNA, 22 bp, Homo sapiens
agtggggtccatcccttccctc

SEQ ID NO: 9134066 - DNA, 22 bp, Homo sapiens
agtgggggccaacgagggcagc

SEQ ID NO: 9134067 - DNA, 22 bp, Homo sapiens
agtgggggccaacgagggcagc

SEQ ID NO: 9134068 - DNA, 22 bp, Homo sapiens
agtgggggccaacgagggcagc

SEQ ID NO: 9134069 - DNA, 22 bp, Homo sapiens
agtgggggccaacgagggcagc

SEQ ID NO: 9134070 - DNA, 22 bp, Homo sapiens
agtgggggcagagcctctctcg

SEQ ID NO: 9134071 - DNA, 22 bp, Homo sapiens
agtgagccataagggctgccac

SEQ ID NO: 9134072 - DNA, 17 bp, Homo sapiens
agtgaggagattggaag

SEQ ID NO: 9134073 - DNA, 17 bp, Homo sapiens
agtgaggagattggaag

SEQ ID NO: 9134074 - DNA, 22 bp, Homo sapiens
agtgaggataccaatgtgtaga

SEQ ID NO: 9134075 - DNA, 22 bp, Homo sapiens
agtgaggcaaagtgagaggcag

SEQ ID NO: 9134076 - DNA, 23 bp, Homo sapiens
agtgagcagctgtagggcaagga

SEQ ID NO: 9134077 - DNA, 22 bp, Homo sapiens
agtgagcattcgtttggaaccc

SEQ ID NO: 9134078 - DNA, 17 bp, Homo sapiens
agtgagaatgtcatgta

SEQ ID NO: 9134079 - DNA, 19 bp, Homo sapiens
agtgagaacatgtgcacac

SEQ ID NO: 9134080 - DNA, 22 bp, Homo sapiens
agtgagagtattaatgtgaact

SEQ ID NO: 9134081 - DNA, 22 bp, Homo sapiens
agtgaatgtccccgcgggtcag

SEQ ID NO: 9134082 - DNA, 22 bp, Homo sapiens
agtcctttgggaaaaatgacta

SEQ ID NO: 9134083 - DNA, 22 bp, Homo sapiens
agtcctttgggaaaaatgacta

SEQ ID NO: 9134084 - DNA, 22 bp, Homo sapiens
agtccttttgttttgagatgag

SEQ ID NO: 9134085 - DNA, 22 bp, Homo sapiens
agtcctttgctgaactgtcaca

SEQ ID NO: 9134086 - DNA, 22 bp, Homo sapiens
agtgcaacagcagttctcttta

SEQ ID NO: 9134087 - DNA, 23 bp, Homo sapiens
agtgctgaattgaaagctccagg

SEQ ID NO: 9134088 - DNA, 22 bp, Homo sapiens
agtgctgaagactggctaggga

SEQ ID NO: 9134089 - DNA, 22 bp, Homo sapiens
agtgctgtcagttttatagata

SEQ ID NO: 9134090 - DNA, 22 bp, Homo sapiens
agtgctgtccagtttcacaggt

SEQ ID NO: 9134091 - DNA, 22 bp, Homo sapiens
agtgctgtctccttcccccggg

SEQ ID NO: 9134092 - DNA, 15 bp, Homo sapiens
agtgattttggactc

SEQ ID NO: 9134093 - DNA, 22 bp, Homo sapiens
agtgattttgtagctatgagat

SEQ ID NO: 9134094 - DNA, 22 bp, Homo sapiens
agtgattttcaagtggagcaca

SEQ ID NO: 9134095 - DNA, 20 bp, Homo sapiens
agtgattttgatatggtctt

SEQ ID NO: 9134096 - DNA, 22 bp, Homo sapiens
agtgcaaaattcagaagcaatt

SEQ ID NO: 9134097 - DNA, 22 bp, Homo sapiens
agtgattttgtcagcttctgca

SEQ ID NO: 9134098 - DNA, 22 bp, Homo sapiens
agtgcaaaattcagaagcaatt

SEQ ID NO: 9134099 - DNA, 22 bp, Homo sapiens
agtgatttggggatgggaaagg

SEQ ID NO: 9134100 - DNA, 22 bp, Homo sapiens
agtgatttgcagtatttactaa

SEQ ID NO: 9134101 - DNA, 22 bp, Homo sapiens
agtgatttggttcatacttcca

SEQ ID NO: 9134102 - DNA, 22 bp, Homo sapiens
agtgattttatcaatttactca

SEQ ID NO: 9134103 - DNA, 22 bp, Homo sapiens
agtgattttatcaatttactca

SEQ ID NO: 9134104 - DNA, 22 bp, Homo sapiens
agtgattttaacttccagcaat

SEQ ID NO: 9134105 - DNA, 20 bp, Homo sapiens
agtgatttgttagtacattg

SEQ ID NO: 9134106 - DNA, 22 bp, Homo sapiens
agtggctggaattgcaggtgcg

SEQ ID NO: 9134107 - DNA, 22 bp, Homo sapiens
agtggcagagccaagtagagcc

SEQ ID NO: 9134108 - DNA, 22 bp, Homo sapiens
agtggcagagcaggtgctggaa

SEQ ID NO: 9134109 - DNA, 22 bp, Homo sapiens
agtggcagagcaggtgctggaa

SEQ ID NO: 9134110 - DNA, 22 bp, Homo sapiens
agtggcagagccaagatatgat

SEQ ID NO: 9134111 - DNA, 22 bp, Homo sapiens
agtggcagagccaagatatgat

SEQ ID NO: 9134112 - DNA, 22 bp, Homo sapiens
agtggcagagccaagtagagcc

SEQ ID NO: 9134113 - DNA, 20 bp, Homo sapiens
agtgggagagggcagactgc

SEQ ID NO: 9134114 - DNA, 20 bp, Homo sapiens
agtgggagagggcagactgc

SEQ ID NO: 9134115 - DNA, 22 bp, Homo sapiens
agtgggagccagcagcttgggg

SEQ ID NO: 9134116 - DNA, 22 bp, Homo sapiens
agtgggagcggcagtcggggac

SEQ ID NO: 9134117 - DNA, 22 bp, Homo sapiens
agtgggaggaagtggtgatatt

SEQ ID NO: 9134118 - DNA, 22 bp, Homo sapiens
agtgggagcggcagtcggggac

SEQ ID NO: 9134119 - DNA, 22 bp, Homo sapiens
agtgggagccagcagcttgggg

SEQ ID NO: 9134120 - DNA, 22 bp, Homo sapiens
agtgggagccagcagcttgggg

SEQ ID NO: 9134121 - DNA, 22 bp, Homo sapiens
agtgggagcggcagtcggggac

SEQ ID NO: 9134122 - DNA, 22 bp, Homo sapiens
agtgggaggcggctgacgggcg

SEQ ID NO: 9134123 - DNA, 22 bp, Homo sapiens
agtgggaggcggctgacgggcg

SEQ ID NO: 9134124 - DNA, 22 bp, Homo sapiens
agtgggagggccatatggtgaa

SEQ ID NO: 9134125 - DNA, 22 bp, Homo sapiens
agtgggaggcggctgacgggcg

SEQ ID NO: 9134126 - DNA, 22 bp, Homo sapiens
agtgggaggcggctgacgggcg

SEQ ID NO: 9134127 - DNA, 22 bp, Homo sapiens
agtgctttggtatagaactatt

SEQ ID NO: 9134128 - DNA, 22 bp, Homo sapiens
agtggcagacacaatgtgggca

SEQ ID NO: 9134129 - DNA, 22 bp, Homo sapiens
agtggcagaagtcactgggtag

SEQ ID NO: 9134130 - DNA, 22 bp, Homo sapiens
agtgctttgagcgtttgaaaag

SEQ ID NO: 9134131 - DNA, 22 bp, Homo sapiens
agtgctttgaacgaaaggctga

SEQ ID NO: 9134132 - DNA, 22 bp, Homo sapiens
agtgctttcttgctccatcagt

SEQ ID NO: 9134133 - DNA, 22 bp, Homo sapiens
agtgctttgaacgaaaggctga

SEQ ID NO: 9134134 - DNA, 22 bp, Homo sapiens
agtggcagagcaggtgctggaa

SEQ ID NO: 9134135 - DNA, 22 bp, Homo sapiens
agtggcagacacaatgtgggca

SEQ ID NO: 9134136 - DNA, 22 bp, Homo sapiens
agtggcagacagagacagtacc

SEQ ID NO: 9134137 - DNA, 22 bp, Homo sapiens
agtggcagacagagacagtacc

SEQ ID NO: 9134138 - DNA, 22 bp, Homo sapiens
agtgctttccctgaaaccttcc

SEQ ID NO: 9134139 - DNA, 22 bp, Homo sapiens
agtgctttccctgaaaccttcc

SEQ ID NO: 9134140 - DNA, 22 bp, Homo sapiens
agtgctttccctgaaaccttcc

SEQ ID NO: 9134141 - DNA, 22 bp, Homo sapiens
agtgctttccttcttgtgacat

SEQ ID NO: 9134142 - DNA, 22 bp, Homo sapiens
agtgctttccttcttgtgacat

SEQ ID NO: 9134143 - DNA, 22 bp, Homo sapiens
agtgctttcttgctccatcagt

SEQ ID NO: 9134144 - DNA, 22 bp, Homo sapiens
agtgctttcagtgtgctctttt

SEQ ID NO: 9134145 - DNA, 22 bp, Homo sapiens
agtgctttcagtgtgctctttt

SEQ ID NO: 9134146 - DNA, 22 bp, Homo sapiens
agtgctttatgttgttgtgcaa

SEQ ID NO: 9134147 - DNA, 22 bp, Homo sapiens
agtgctttatgttgttgtgcaa

SEQ ID NO: 9134148 - DNA, 22 bp, Homo sapiens
agtgctttagagaaatggtgct

SEQ ID NO: 9134149 - DNA, 22 bp, Homo sapiens
agtgctttagcatccaactgtc

SEQ ID NO: 9134150 - DNA, 22 bp, Homo sapiens
agtgcttgtgaaatactagagg

SEQ ID NO: 9134151 - DNA, 22 bp, Homo sapiens
agtgctttacctagataatgtt

SEQ ID NO: 9134152 - DNA, 22 bp, Homo sapiens
agtgcttggttcaatgaaggtt

SEQ ID NO: 9134153 - DNA, 22 bp, Homo sapiens
agtgctgttaggttaatatagt

SEQ ID NO: 9134154 - DNA, 22 bp, Homo sapiens
agtgctgtccagtttcacaggt

SEQ ID NO: 9134155 - DNA, 22 bp, Homo sapiens
agtcagtgacttttgctgagag

SEQ ID NO: 9134156 - DNA, 23 bp, Homo sapiens
agtcagtgcgggatggtcagggg

SEQ ID NO: 9134157 - DNA, 23 bp, Homo sapiens
agtcagtgcgggatggtcagggg

SEQ ID NO: 9134158 - DNA, 23 bp, Homo sapiens
agtcagtgcgggatggtcagggg

SEQ ID NO: 9134159 - DNA, 22 bp, Homo sapiens
agtcagtgaatctgaaggctaa

SEQ ID NO: 9134160 - DNA, 22 bp, Homo sapiens
agtcagtgaatctgaaggctaa

SEQ ID NO: 9134161 - DNA, 22 bp, Homo sapiens
agtcagtggatttaccatgcgt

SEQ ID NO: 9134162 - DNA, 22 bp, Homo sapiens
agtcagtgggagaagtgtgaag

SEQ ID NO: 9134163 - DNA, 22 bp, Homo sapiens
agtcagtggctccgagcctggt

SEQ ID NO: 9134164 - DNA, 22 bp, Homo sapiens
agtcagtgggcttggcacagaa

SEQ ID NO: 9134165 - DNA, 22 bp, Homo sapiens
agtcagtggtatttaggggaat

SEQ ID NO: 9134166 - DNA, 22 bp, Homo sapiens
agtaagtgcagaaaagatgtgg

SEQ ID NO: 9134167 - DNA, 21 bp, Homo sapiens
agtaagggaggaaagaaattg

SEQ ID NO: 9134168 - DNA, 17 bp, Homo sapiens
agtaagtgtgtcacttc

SEQ ID NO: 9134169 - DNA, 22 bp, Homo sapiens
agtaagttccagtttcattatg

SEQ ID NO: 9134170 - DNA, 22 bp, Homo sapiens
agtaataaactctttttatctc

SEQ ID NO: 9134171 - DNA, 19 bp, Homo sapiens
agtcaggtggctggtgcca

SEQ ID NO: 9134172 - DNA, 22 bp, Homo sapiens
agtaacatgagtttttctaatg

SEQ ID NO: 9134173 - DNA, 23 bp, Homo sapiens
agtaacatgcaaataacagtctg

SEQ ID NO: 9134174 - DNA, 23 bp, Homo sapiens
agtaacatgcaaataacagtctg

SEQ ID NO: 9134175 - DNA, 22 bp, Homo sapiens
agtaacatctttgacatttgtt

SEQ ID NO: 9134176 - DNA, 22 bp, Homo sapiens
agtaactctcctttgacatatt

SEQ ID NO: 9134177 - DNA, 22 bp, Homo sapiens
agtaactcatgtaaacctcaca

SEQ ID NO: 9134178 - DNA, 20 bp, Homo sapiens
agtaacttgcctaaggtcag

SEQ ID NO: 9134179 - DNA, 22 bp, Homo sapiens
agtccaggactgtttcagctga

SEQ ID NO: 9134180 - DNA, 22 bp, Homo sapiens
agtccaggaaaataagctaggt

SEQ ID NO: 9134181 - DNA, 22 bp, Homo sapiens
agtccaggaagcatcatggtct

SEQ ID NO: 9134182 - DNA, 22 bp, Homo sapiens
agtccaggaaaataagctaggt

SEQ ID NO: 9134183 - DNA, 22 bp, Homo sapiens
agtccaggagttgggtgacatt

SEQ ID NO: 9134184 - DNA, 22 bp, Homo sapiens
agtccaggagttgggtgacatt

SEQ ID NO: 9134185 - DNA, 21 bp, Homo sapiens
agtccaggagtcacccaagcc

SEQ ID NO: 9134186 - DNA, 22 bp, Homo sapiens
agtccaggcaagttgttgtgta

SEQ ID NO: 9134187 - DNA, 21 bp, Homo sapiens
agtccaggaggaggccaggtt

SEQ ID NO: 9134188 - DNA, 22 bp, Homo sapiens
actctgggattgtttctggtat

SEQ ID NO: 9134189 - DNA, 22 bp, Homo sapiens
actctgggattgtttctggtat

SEQ ID NO: 9134190 - DNA, 22 bp, Homo sapiens
actctgggatgagaaaagggtt

SEQ ID NO: 9134191 - DNA, 22 bp, Homo sapiens
actctgggcccaccctcagagt

SEQ ID NO: 9134192 - DNA, 22 bp, Homo sapiens
actctgggatcttgaaaagagt

SEQ ID NO: 9134193 - DNA, 22 bp, Homo sapiens
actctgggagaggacaaacaaa

SEQ ID NO: 9134194 - DNA, 18 bp, Homo sapiens
actctgggacctgttatt

SEQ ID NO: 9134195 - DNA, 21 bp, Homo sapiens
agtccaggcctgcccacttcc

SEQ ID NO: 9134196 - DNA, 22 bp, Homo sapiens
agtccaggcctccctctcctgc

SEQ ID NO: 9134197 - DNA, 22 bp, Homo sapiens
agtccaggcctcctcttttcct

SEQ ID NO: 9134198 - DNA, 22 bp, Homo sapiens
agtccaggcattccagccattc

SEQ ID NO: 9134199 - DNA, 22 bp, Homo sapiens
actctgggttctttcacttgac

SEQ ID NO: 9134200 - DNA, 20 bp, Homo sapiens
actctggggctcattagggg

SEQ ID NO: 9134201 - DNA, 22 bp, Homo sapiens
actctgggtcctgccattcact

SEQ ID NO: 9134202 - DNA, 22 bp, Homo sapiens
actctggggtgatgtctctgag

SEQ ID NO: 9134203 - DNA, 22 bp, Homo sapiens
actctgggctttgatttgttac

SEQ ID NO: 9134204 - DNA, 22 bp, Homo sapiens
actctgggctttgatttgttac

SEQ ID NO: 9134205 - DNA, 22 bp, Homo sapiens
actctgggctgttaggagctgt

SEQ ID NO: 9134206 - DNA, 22 bp, Homo sapiens
actctggggcgctactccaact

SEQ ID NO: 9134207 - DNA, 22 bp, Homo sapiens
actctgggccccaggtggagct

SEQ ID NO: 9134208 - DNA, 22 bp, Homo sapiens
agtcctgttggttccagaggtg

SEQ ID NO: 9134209 - DNA, 22 bp, Homo sapiens
agtcctgttggttccagaggtg

SEQ ID NO: 9134210 - DNA, 22 bp, Homo sapiens
agtcctggtgacactcctcttc

SEQ ID NO: 9134211 - DNA, 22 bp, Homo sapiens
agtcctgggtgtgcaaggcaga

SEQ ID NO: 9134212 - DNA, 22 bp, Homo sapiens
aggtggaaatggctttcctagg

SEQ ID NO: 9134213 - DNA, 22 bp, Homo sapiens
aggtgccagatgcacagctgaa

SEQ ID NO: 9134214 - DNA, 22 bp, Homo sapiens
aggtgccacctctggtgctgtc

SEQ ID NO: 9134215 - DNA, 23 bp, Homo sapiens
aggtgccaactgagagctgagag

SEQ ID NO: 9134216 - DNA, 22 bp, Homo sapiens
aggtgcagtgtttaaaagtagc

SEQ ID NO: 9134217 - DNA, 22 bp, Homo sapiens
aggtgcagtggctcatgcctgt

SEQ ID NO: 9134218 - DNA, 22 bp, Homo sapiens
aggtgcagtgaaggaaaaggaa

SEQ ID NO: 9134219 - DNA, 22 bp, Homo sapiens
agggtgcagtcacaggaaatgt

SEQ ID NO: 9134220 - DNA, 22 bp, Homo sapiens
agggtgcagtcacaggaaatgt

SEQ ID NO: 9134221 - DNA, 22 bp, Homo sapiens
agggtgcatgtttgcaagagtg

SEQ ID NO: 9134222 - DNA, 21 bp, Homo sapiens
aggtgcaggcctcaagcccca

SEQ ID NO: 9134223 - DNA, 22 bp, Homo sapiens
aggtgcaggagctgtgcaggga

SEQ ID NO: 9134224 - DNA, 22 bp, Homo sapiens
agggtcccgtccctctgcaccc

SEQ ID NO: 9134225 - DNA, 18 bp, Homo sapiens
agggtcagtgtcactggc

SEQ ID NO: 9134226 - DNA, 22 bp, Homo sapiens
agggtcagttctgtgaggtgtt

SEQ ID NO: 9134227 - DNA, 22 bp, Homo sapiens
agggtcagttctgtgaggtgtt

SEQ ID NO: 9134228 - DNA, 22 bp, Homo sapiens
agggtcagttctgtgaggtgtt

SEQ ID NO: 9134229 - DNA, 22 bp, Homo sapiens
agggtgcaggtgtggagtctag

SEQ ID NO: 9134230 - DNA, 22 bp, Homo sapiens
agggtgcagaaggagcctagga

SEQ ID NO: 9134231 - DNA, 22 bp, Homo sapiens
agggtgcaaaagcaaggacagt

SEQ ID NO: 9134232 - DNA, 22 bp, Homo sapiens
agggtgcaaaagcaaggacagt

SEQ ID NO: 9134233 - DNA, 22 bp, Homo sapiens
agggtgagggtctggccttgag

SEQ ID NO: 9134234 - DNA, 22 bp, Homo sapiens
agggtcctaagcctcagataag

SEQ ID NO: 9134235 - DNA, 22 bp, Homo sapiens
actcacagtccctgtaggagtg

SEQ ID NO: 9134236 - DNA, 22 bp, Homo sapiens
actcaccacacccttgcacttg

SEQ ID NO: 9134237 - DNA, 22 bp, Homo sapiens
actcaccacacccttgcacttg

SEQ ID NO: 9134238 - DNA, 22 bp, Homo sapiens
aggttcttgactctaccttcca

SEQ ID NO: 9134239 - DNA, 22 bp, Homo sapiens
aggttctgttttaaaagagctc

SEQ ID NO: 9134240 - DNA, 22 bp, Homo sapiens
aggttctgttttaaaagagctc

SEQ ID NO: 9134241 - DNA, 22 bp, Homo sapiens
aggttctgtttggctgaggatc

SEQ ID NO: 9134242 - DNA, 22 bp, Homo sapiens
aggttctggtaagctgttgctt

SEQ ID NO: 9134243 - DNA, 22 bp, Homo sapiens
aggttctggagaacttggaggt

SEQ ID NO: 9134244 - DNA, 22 bp, Homo sapiens
aggttctggcattgctcagtaa

SEQ ID NO: 9134245 - DNA, 22 bp, Homo sapiens
aggttcttggtgagcatttggt

SEQ ID NO: 9134246 - DNA, 22 bp, Homo sapiens
aggttccttatggggatggcta

SEQ ID NO: 9134247 - DNA, 21 bp, Homo sapiens
aggttcctgagtcatgcctta

SEQ ID NO: 9134248 - DNA, 18 bp, Homo sapiens
aggttctgacagtccaaa

SEQ ID NO: 9134249 - DNA, 23 bp, Homo sapiens
aggttctcttatcatctctgccc

SEQ ID NO: 9134250 - DNA, 22 bp, Homo sapiens
aggttctgatttgttggggagg

SEQ ID NO: 9134251 - DNA, 18 bp, Homo sapiens
aggttctgacagtccaaa

SEQ ID NO: 9134252 - DNA, 22 bp, Homo sapiens
aggttctgattctctgggtatg

SEQ ID NO: 9134253 - DNA, 22 bp, Homo sapiens
aggttctggagcttagagggag

SEQ ID NO: 9134254 - DNA, 21 bp, Homo sapiens
aggttccagcagccagagaat

SEQ ID NO: 9134255 - DNA, 20 bp, Homo sapiens
aggttccagccacaaccagc

SEQ ID NO: 9134256 - DNA, 22 bp, Homo sapiens
aggttccagggattaggatgtg

SEQ ID NO: 9134257 - DNA, 22 bp, Homo sapiens
aggttccaggtctgggttatgt

SEQ ID NO: 9134258 - DNA, 22 bp, Homo sapiens
aggttcctcttcctctggcctg

SEQ ID NO: 9134259 - DNA, 22 bp, Homo sapiens
aggttcctcttcctctggcctg

SEQ ID NO: 9134260 - DNA, 22 bp, Homo sapiens
aggttccaggttcgaatcccat

SEQ ID NO: 9134261 - DNA, 22 bp, Homo sapiens
aggttccatcacctgcagtgga

SEQ ID NO: 9134262 - DNA, 22 bp, Homo sapiens
aggtgtcatttctctgcaggtg

SEQ ID NO: 9134263 - DNA, 22 bp, Homo sapiens
aggtggtgatgacagaagacag

SEQ ID NO: 9134264 - DNA, 22 bp, Homo sapiens
aggtggagacccagagaaggcg

SEQ ID NO: 9134265 - DNA, 22 bp, Homo sapiens
aggtggagacccagagaaggcg

SEQ ID NO: 9134266 - DNA, 22 bp, Homo sapiens
aggtggagaagagatgggcagt

SEQ ID NO: 9134267 - DNA, 22 bp, Homo sapiens
aggtggagaagagatgggcagt

SEQ ID NO: 9134268 - DNA, 22 bp, Homo sapiens
aggtggaaatggctttcctagg

SEQ ID NO: 9134269 - DNA, 22 bp, Homo sapiens
aggtggaaatggctttcctagg

SEQ ID NO: 9134270 - DNA, 22 bp, Homo sapiens
aggtggaacgttcaggtgctag

SEQ ID NO: 9134271 - DNA, 22 bp, Homo sapiens
aggtggaacgttcaggtgctag

SEQ ID NO: 9134272 - DNA, 22 bp, Homo sapiens
aggtggggttcagtctcagccg

SEQ ID NO: 9134273 - DNA, 22 bp, Homo sapiens
aggtggggaggagtgtctcttt

SEQ ID NO: 9134274 - DNA, 22 bp, Homo sapiens
aggtgggtgcctatgtatgtat

SEQ ID NO: 9134275 - DNA, 19 bp, Homo sapiens
aggtgggtaagcagttctc

SEQ ID NO: 9134276 - DNA, 17 bp, Homo sapiens
aggtgggtggatcacct

SEQ ID NO: 9134277 - DNA, 22 bp, Homo sapiens
aggtgggttccgcggcggcccg

SEQ ID NO: 9134278 - DNA, 18 bp, Homo sapiens
acatttctctctgcgtga

SEQ ID NO: 9134279 - DNA, 22 bp, Homo sapiens
aggctggctggggatgcgtctt

SEQ ID NO: 9134280 - DNA, 23 bp, Homo sapiens
aggctggcttcaggagcctctcc

SEQ ID NO: 9134281 - DNA, 23 bp, Homo sapiens
aggctggcttcaggagcctctcc

SEQ ID NO: 9134282 - DNA, 22 bp, Homo sapiens
acatttctcctacttgttattt

SEQ ID NO: 9134283 - DNA, 18 bp, Homo sapiens
acatttctccttctgacc

SEQ ID NO: 9134284 - DNA, 22 bp, Homo sapiens
acatttctccctgcatgcctgc

SEQ ID NO: 9134285 - DNA, 22 bp, Homo sapiens
acatttctcaggtaagtcattt

SEQ ID NO: 9134286 - DNA, 22 bp, Homo sapiens
acatttctcaggtaagtcattt

SEQ ID NO: 9134287 - DNA, 17 bp, Homo sapiens
aggctgctgggccaggg

SEQ ID NO: 9134288 - DNA, 21 bp, Homo sapiens
aggctgctggctcagggtcct

SEQ ID NO: 9134289 - DNA, 22 bp, Homo sapiens
aggctgctggcaggcgtggacg

SEQ ID NO: 9134290 - DNA, 22 bp, Homo sapiens
aggctgctgccttggagagtgt

SEQ ID NO: 9134291 - DNA, 23 bp, Homo sapiens
aggctgctgagatgggtgtgtca

SEQ ID NO: 9134292 - DNA, 22 bp, Homo sapiens
aggctgctctgcgaagtcagct

SEQ ID NO: 9134293 - DNA, 22 bp, Homo sapiens
aggctgcagaacagtcaggtgc

SEQ ID NO: 9134294 - DNA, 22 bp, Homo sapiens
aggctctggagttagccaggca

SEQ ID NO: 9134295 - DNA, 22 bp, Homo sapiens
aggctctggcaacagctggtgt

SEQ ID NO: 9134296 - DNA, 19 bp, Homo sapiens
accactggccacacactcc

SEQ ID NO: 9134297 - DNA, 22 bp, Homo sapiens
accactggcctggtggggacca

SEQ ID NO: 9134298 - DNA, 22 bp, Homo sapiens
accactggatatcagagatgta

SEQ ID NO: 9134299 - DNA, 22 bp, Homo sapiens
accactgcccatggtgaaaact

SEQ ID NO: 9134300 - DNA, 22 bp, Homo sapiens
accactgggcgggcagcctgct

SEQ ID NO: 9134301 - DNA, 22 bp, Homo sapiens
accactggctcaggagctggga

SEQ ID NO: 9134302 - DNA, 22 bp, Homo sapiens
accacaggacccatgagtcagt

SEQ ID NO: 9134303 - DNA, 22 bp, Homo sapiens
accacaggacccatgagtcagt

SEQ ID NO: 9134304 - DNA, 22 bp, Homo sapiens
accacaggacccatgagtcagt

SEQ ID NO: 9134305 - DNA, 22 bp, Homo sapiens
accacaggacccatgagtcagt

SEQ ID NO: 9134306 - DNA, 22 bp, Homo sapiens
aggctgtgatgagcctcatgga

SEQ ID NO: 9134307 - DNA, 22 bp, Homo sapiens
accactgtctacacattgactc

SEQ ID NO: 9134308 - DNA, 22 bp, Homo sapiens
accactggggcaagtcttcaaa

SEQ ID NO: 9134309 - DNA, 22 bp, Homo sapiens
accactggttttgcagaggcgc

SEQ ID NO: 9134310 - DNA, 22 bp, Homo sapiens
accactgtactatttgagtggc

SEQ ID NO: 9134311 - DNA, 22 bp, Homo sapiens
accagaaaggaataatagaatt

SEQ ID NO: 9134312 - DNA, 22 bp, Homo sapiens
accagaaaggatgcctccttcc

SEQ ID NO: 9134313 - DNA, 22 bp, Homo sapiens
accagaaaggaataatagaatt

SEQ ID NO: 9134314 - DNA, 22 bp, Homo sapiens
accagaaaggaataatagaatt

SEQ ID NO: 9134315 - DNA, 19 bp, Homo sapiens
aggctgtgagggaggactc

SEQ ID NO: 9134316 - DNA, 19 bp, Homo sapiens
aggctgtgagggaggactc

SEQ ID NO: 9134317 - DNA, 19 bp, Homo sapiens
aggctgtgaggggaaggaa

SEQ ID NO: 9134318 - DNA, 22 bp, Homo sapiens
aggctgtgagcaagaacaccta

SEQ ID NO: 9134319 - DNA, 22 bp, Homo sapiens
aggctgtgagcaagaacaccta

SEQ ID NO: 9134320 - DNA, 19 bp, Homo sapiens
aggctgtgagggaggactc

SEQ ID NO: 9134321 - DNA, 22 bp, Homo sapiens
aggctgggaaacctgaagttgt

SEQ ID NO: 9134322 - DNA, 22 bp, Homo sapiens
aggctggcttggctctcctgtg

SEQ ID NO: 9134323 - DNA, 22 bp, Homo sapiens
aggctgggaaatgtagtcttcc

SEQ ID NO: 9134324 - DNA, 22 bp, Homo sapiens
aggctgggaaatgtattccagc

SEQ ID NO: 9134325 - DNA, 22 bp, Homo sapiens
aggctgggaaatgtattccagc

SEQ ID NO: 9134326 - DNA, 22 bp, Homo sapiens
aggctgggaaatgtattccagc

SEQ ID NO: 9134327 - DNA, 22 bp, Homo sapiens
aggctgggaaatgtagtcttcc

SEQ ID NO: 9134328 - DNA, 22 bp, Homo sapiens
aggctgggaaacctgaagttgt

SEQ ID NO: 9134329 - DNA, 22 bp, Homo sapiens
aggctgggaaatgtagtcttcc

SEQ ID NO: 9134330 - DNA, 22 bp, Homo sapiens
aggctcaggtctcaggtctggc

SEQ ID NO: 9134331 - DNA, 22 bp, Homo sapiens
aggctcaggtctcaggtctggc

SEQ ID NO: 9134332 - DNA, 19 bp, Homo sapiens
acatgttttgcagaacagc

SEQ ID NO: 9134333 - DNA, 22 bp, Homo sapiens
acattaaacttgcttggctgta

SEQ ID NO: 9134334 - DNA, 22 bp, Homo sapiens
aggctccagtctcctctggcag

SEQ ID NO: 9134335 - DNA, 22 bp, Homo sapiens
aggctccttgttcatcatccat

SEQ ID NO: 9134336 - DNA, 22 bp, Homo sapiens
aggctcctttaccattctggag

SEQ ID NO: 9134337 - DNA, 22 bp, Homo sapiens
aggctctgacccatgggaccca

SEQ ID NO: 9134338 - DNA, 22 bp, Homo sapiens
aggctctgaaggagaacctgtt

SEQ ID NO: 9134339 - DNA, 21 bp, Homo sapiens
aggctctcatccagggaccca

SEQ ID NO: 9134340 - DNA, 22 bp, Homo sapiens
aggctctgacccatgggaccca

SEQ ID NO: 9134341 - DNA, 22 bp, Homo sapiens
aggctctgacccatgggaccca

SEQ ID NO: 9134342 - DNA, 22 bp, Homo sapiens
aggctctgacgtcacacgtggc

SEQ ID NO: 9134343 - DNA, 22 bp, Homo sapiens
aggctctggagttagccaggca

SEQ ID NO: 9134344 - DNA, 22 bp, Homo sapiens
aggctctggagttagccaggca

SEQ ID NO: 9134345 - DNA, 22 bp, Homo sapiens
aggctctggagtgtggtgctgg

SEQ ID NO: 9134346 - DNA, 22 bp, Homo sapiens
aggctctggagtgtggtgctgg

SEQ ID NO: 9134347 - DNA, 22 bp, Homo sapiens
aggctctggacagtgaggagtt

SEQ ID NO: 9134348 - DNA, 22 bp, Homo sapiens
aggctcagctggtggtgatcgc

SEQ ID NO: 9134349 - DNA, 22 bp, Homo sapiens
acatgtgcagacagcaagcagg

SEQ ID NO: 9134350 - DNA, 20 bp, Homo sapiens
aggctcactcaccttgtgga

SEQ ID NO: 9134351 - DNA, 22 bp, Homo sapiens
acatgtgaggtgtgagtgatac

SEQ ID NO: 9134352 - DNA, 22 bp, Homo sapiens
acatgtcttttaaagtctaata

SEQ ID NO: 9134353 - DNA, 22 bp, Homo sapiens
acatggcgggagtttcagatac

SEQ ID NO: 9134354 - DNA, 22 bp, Homo sapiens
aggcagtgtgtagctggaagag

SEQ ID NO: 9134355 - DNA, 22 bp, Homo sapiens
aggcagtgtgtagctggaagag

SEQ ID NO: 9134356 - DNA, 22 bp, Homo sapiens
aggcagtgtgtagctggaagag

SEQ ID NO: 9134357 - DNA, 22 bp, Homo sapiens
acatggctaaattagctttact

SEQ ID NO: 9134358 - DNA, 22 bp, Homo sapiens
acatgtaaaagataaattaaca

SEQ ID NO: 9134359 - DNA, 22 bp, Homo sapiens
acatgtaaaagataaattaaca

SEQ ID NO: 9134360 - DNA, 22 bp, Homo sapiens
acatgtaaaagataaattaaca

SEQ ID NO: 9134361 - DNA, 22 bp, Homo sapiens
acatgtaaaaggaacatgcatg

SEQ ID NO: 9134362 - DNA, 22 bp, Homo sapiens
acatgtaaacatttacagtatt

SEQ ID NO: 9134363 - DNA, 22 bp, Homo sapiens
acatgtaagactagcttaaagt

SEQ ID NO: 9134364 - DNA, 21 bp, Homo sapiens
acatgtaagagagtttcaaga

SEQ ID NO: 9134365 - DNA, 22 bp, Homo sapiens
acatgtaacatatatgtagcat

SEQ ID NO: 9134366 - DNA, 22 bp, Homo sapiens
acatgtaggagagtcacaatgc

SEQ ID NO: 9134367 - DNA, 22 bp, Homo sapiens
acatgtatacaatgtgtaatga

SEQ ID NO: 9134368 - DNA, 22 bp, Homo sapiens
acatgtaagactagcttaaagt

SEQ ID NO: 9134369 - DNA, 22 bp, Homo sapiens
acatgtctccacccatcttaaa

SEQ ID NO: 9134370 - DNA, 22 bp, Homo sapiens
acatgtattgacattatattct

SEQ ID NO: 9134371 - DNA, 20 bp, Homo sapiens
accagagacctgaatcagtt

SEQ ID NO: 9134372 - DNA, 22 bp, Homo sapiens
accagagaaaacacagcaggct

SEQ ID NO: 9134373 - DNA, 22 bp, Homo sapiens
agggaggatctgctccttgtct

SEQ ID NO: 9134374 - DNA, 22 bp, Homo sapiens
agggaggcaggaaagttgtctg

SEQ ID NO: 9134375 - DNA, 22 bp, Homo sapiens
agggaggatagtagtcagttta

SEQ ID NO: 9134376 - DNA, 22 bp, Homo sapiens
accagagctcttcagcacagga

SEQ ID NO: 9134377 - DNA, 22 bp, Homo sapiens
agggagctgactggctgccatt

SEQ ID NO: 9134378 - DNA, 20 bp, Homo sapiens
accagagctctcagtatgtg

SEQ ID NO: 9134379 - DNA, 22 bp, Homo sapiens
accagagcgctcaagccttccc

SEQ ID NO: 9134380 - DNA, 22 bp, Homo sapiens
accagagcagactactggaggt

SEQ ID NO: 9134381 - DNA, 22 bp, Homo sapiens
agggatgtggtgggagagaaag

SEQ ID NO: 9134382 - DNA, 22 bp, Homo sapiens
agggatgttagttgtgagctca

SEQ ID NO: 9134383 - DNA, 22 bp, Homo sapiens
agggatgttcattttgtggctg

SEQ ID NO: 9134384 - DNA, 22 bp, Homo sapiens
agggatgtgcagcatccagaca

SEQ ID NO: 9134385 - DNA, 22 bp, Homo sapiens
agggatgtgggaactgcaggtt

SEQ ID NO: 9134386 - DNA, 22 bp, Homo sapiens
agggatgttgtcaaggatgtgg

SEQ ID NO: 9134387 - DNA, 20 bp, Homo sapiens
agggcaaaatccaaaagtct

SEQ ID NO: 9134388 - DNA, 22 bp, Homo sapiens
agggcaatccagccagctgatc

SEQ ID NO: 9134389 - DNA, 22 bp, Homo sapiens
agggcacaggctccgggtccag

SEQ ID NO: 9134390 - DNA, 22 bp, Homo sapiens
agggcacatctgctgggaatgg

SEQ ID NO: 9134391 - DNA, 21 bp, Homo sapiens
agggcacccccgctgcctacc

SEQ ID NO: 9134392 - DNA, 21 bp, Homo sapiens
agggcacccccgctgcctacc

SEQ ID NO: 9134393 - DNA, 22 bp, Homo sapiens
agggcacatctgctgggaatgg

SEQ ID NO: 9134394 - DNA, 22 bp, Homo sapiens
agggaggcattagctactgcga

SEQ ID NO: 9134395 - DNA, 19 bp, Homo sapiens
agggaggtagcattggaaa

SEQ ID NO: 9134396 - DNA, 19 bp, Homo sapiens
agggaggtagcattggaaa

SEQ ID NO: 9134397 - DNA, 22 bp, Homo sapiens
agggaggtctttgaggggctta

SEQ ID NO: 9134398 - DNA, 22 bp, Homo sapiens
agggaggtggttccccagtgga

SEQ ID NO: 9134399 - DNA, 22 bp, Homo sapiens
agggatgtgacattacagaagc

SEQ ID NO: 9134400 - DNA, 20 bp, Homo sapiens
agggaggtgctgggcctgag

SEQ ID NO: 9134401 - DNA, 22 bp, Homo sapiens
agggcactccttggcagctctg

SEQ ID NO: 9134402 - DNA, 22 bp, Homo sapiens
agggcactgaacagctgtagca

SEQ ID NO: 9134403 - DNA, 22 bp, Homo sapiens
agggcactgaacagctgtagca

SEQ ID NO: 9134404 - DNA, 23 bp, Homo sapiens
agggcactgaagctggaattggg

SEQ ID NO: 9134405 - DNA, 23 bp, Homo sapiens
agggcactgaagctggaattggg

SEQ ID NO: 9134406 - DNA, 23 bp, Homo sapiens
agggcactgttgggtgttgagga

SEQ ID NO: 9134407 - DNA, 22 bp, Homo sapiens
agggcatgctggaggagagaca

SEQ ID NO: 9134408 - DNA, 22 bp, Homo sapiens
agggccagcactcctggcagga

SEQ ID NO: 9134409 - DNA, 22 bp, Homo sapiens
agggccagcccataatgccaaa

SEQ ID NO: 9134410 - DNA, 22 bp, Homo sapiens
agggccagcactcctggcagga

SEQ ID NO: 9134411 - DNA, 22 bp, Homo sapiens
agggccagcactcctggcagga

SEQ ID NO: 9134412 - DNA, 22 bp, Homo sapiens
agggccagcactcctggcagga

SEQ ID NO: 9134413 - DNA, 22 bp, Homo sapiens
agggccagtaccaggtgggtgg

SEQ ID NO: 9134414 - DNA, 22 bp, Homo sapiens
agggccagtgggttgaaaggca

SEQ ID NO: 9134415 - DNA, 22 bp, Homo sapiens
agggccagttcagaggacatgg

SEQ ID NO: 9134416 - DNA, 22 bp, Homo sapiens
agggccagttcagaggacatgg

SEQ ID NO: 9134417 - DNA, 22 bp, Homo sapiens
agggctcaatggtgggcatgta

SEQ ID NO: 9134418 - DNA, 22 bp, Homo sapiens
aggggagcccctggtcctggtg

SEQ ID NO: 9134419 - DNA, 22 bp, Homo sapiens
aggggagccagggctgcgagtt

SEQ ID NO: 9134420 - DNA, 22 bp, Homo sapiens
aggggagcaaggccgtggtgta

SEQ ID NO: 9134421 - DNA, 22 bp, Homo sapiens
agggctttgagaatagtggaac

SEQ ID NO: 9134422 - DNA, 22 bp, Homo sapiens
aggggaggagcttttcttgcct

SEQ ID NO: 9134423 - DNA, 22 bp, Homo sapiens
aggggcaggtgctgcacttaga

SEQ ID NO: 9134424 - DNA, 22 bp, Homo sapiens
aggggcaggtgctgcacttaga

SEQ ID NO: 9134425 - DNA, 22 bp, Homo sapiens
aggggcagttccaagttttgtg

SEQ ID NO: 9134426 - DNA, 22 bp, Homo sapiens
aggggcagttccaagttttgtg

SEQ ID NO: 9134427 - DNA, 22 bp, Homo sapiens
agggctgaagggaggtgctcat

SEQ ID NO: 9134428 - DNA, 22 bp, Homo sapiens
agggctgaaacataatccttct

SEQ ID NO: 9134429 - DNA, 22 bp, Homo sapiens
agggctgacaaatggcagtgac

SEQ ID NO: 9134430 - DNA, 22 bp, Homo sapiens
agggctgacaaatggcagtgac

SEQ ID NO: 9134431 - DNA, 23 bp, Homo sapiens
agggctgaatgcagagaagcaga

SEQ ID NO: 9134432 - DNA, 22 bp, Homo sapiens
agggctgaagttatggctgagc

SEQ ID NO: 9134433 - DNA, 22 bp, Homo sapiens
agggctgacagtgaggagtcaa

SEQ ID NO: 9134434 - DNA, 22 bp, Homo sapiens
agggctgacagtaaaagtatga

SEQ ID NO: 9134435 - DNA, 22 bp, Homo sapiens
agggctgacacaccttatcctc

SEQ ID NO: 9134436 - DNA, 22 bp, Homo sapiens
agggctcaccactgtgcactcc

SEQ ID NO: 9134437 - DNA, 22 bp, Homo sapiens
agggctcagcctcctcctcagc

SEQ ID NO: 9134438 - DNA, 22 bp, Homo sapiens
aggggccattgttctgcccgct

SEQ ID NO: 9134439 - DNA, 22 bp, Homo sapiens
aggggccatgtaagtgtatcac

SEQ ID NO: 9134440 - DNA, 22 bp, Homo sapiens
aggggcatcagttgcacatttt

SEQ ID NO: 9134441 - DNA, 22 bp, Homo sapiens
aggggcctcgcaggaccgctcc

SEQ ID NO: 9134442 - DNA, 20 bp, Homo sapiens
aggggcctggaacaggcctt

SEQ ID NO: 9134443 - DNA, 20 bp, Homo sapiens
aggggcctggaacaggcctt

SEQ ID NO: 9134444 - DNA, 18 bp, Homo sapiens
accctttccaaactgcag

SEQ ID NO: 9134445 - DNA, 22 bp, Homo sapiens
accctttcttactcacacgctc

SEQ ID NO: 9134446 - DNA, 22 bp, Homo sapiens
acctcaagtgatccactcacct

SEQ ID NO: 9134447 - DNA, 22 bp, Homo sapiens
acctcagctatttcaaaacaga

SEQ ID NO: 9134448 - DNA, 22 bp, Homo sapiens
acctcagattgtggctccgctg

SEQ ID NO: 9134449 - DNA, 22 bp, Homo sapiens
acctcatctggtttgtaaggca

SEQ ID NO: 9134450 - DNA, 22 bp, Homo sapiens
acctcatctgagaagagcatac

SEQ ID NO: 9134451 - DNA, 22 bp, Homo sapiens
agggtcagtgatgagggagccc

SEQ ID NO: 9134452 - DNA, 22 bp, Homo sapiens
agggtcagtgatgagggagccc

SEQ ID NO: 9134453 - DNA, 22 bp, Homo sapiens
agggtcagtgatgagggagccc

SEQ ID NO: 9134454 - DNA, 22 bp, Homo sapiens
agggtcagtgatgagggagccc

SEQ ID NO: 9134455 - DNA, 22 bp, Homo sapiens
agggtcagtagtgatgcgtgaa

SEQ ID NO: 9134456 - DNA, 22 bp, Homo sapiens
agggtcagtagtgatgcgtgaa

SEQ ID NO: 9134457 - DNA, 22 bp, Homo sapiens
agggtcagtagtgatgcgtgaa

SEQ ID NO: 9134458 - DNA, 22 bp, Homo sapiens
agggtaagtttcatgtggctaa

SEQ ID NO: 9134459 - DNA, 22 bp, Homo sapiens
agggtagctacccaactccaga

SEQ ID NO: 9134460 - DNA, 22 bp, Homo sapiens
aggggtgtgcatcctggaggat

SEQ ID NO: 9134461 - DNA, 22 bp, Homo sapiens
aggggttggacataagacagaa

SEQ ID NO: 9134462 - DNA, 22 bp, Homo sapiens
acctcccagctctgagcttggg

SEQ ID NO: 9134463 - DNA, 22 bp, Homo sapiens
aggggtgatttgggacaggaca

SEQ ID NO: 9134464 - DNA, 22 bp, Homo sapiens
acagcttctcctcgatgtcatg

SEQ ID NO: 9134465 - DNA, 22 bp, Homo sapiens
acaggaagtgctggcacttaca

SEQ ID NO: 9134466 - DNA, 22 bp, Homo sapiens
acaggaagctggagacccttga

SEQ ID NO: 9134467 - DNA, 22 bp, Homo sapiens
acaggaagaaagtgcagtagat

SEQ ID NO: 9134468 - DNA, 22 bp, Homo sapiens
acaggaagaaagtgcagtagat

SEQ ID NO: 9134469 - DNA, 22 bp, Homo sapiens
acaggaagaaagtgcagtagat

SEQ ID NO: 9134470 - DNA, 22 bp, Homo sapiens
acaggaagtgggaagaaacagg

SEQ ID NO: 9134471 - DNA, 22 bp, Homo sapiens
acaggaagtgggaagaaacagg

SEQ ID NO: 9134472 - DNA, 22 bp, Homo sapiens
acaggaagtgggaagaaacagg

SEQ ID NO: 9134473 - DNA, 22 bp, Homo sapiens
acaggaagtgggaagaaacagg

SEQ ID NO: 9134474 - DNA, 22 bp, Homo sapiens
acaggaagtttggaaagcctca

SEQ ID NO: 9134475 - DNA, 22 bp, Homo sapiens
acaggaagtttggaaagcctca

SEQ ID NO: 9134476 - DNA, 22 bp, Homo sapiens
acaggacaaaaatctggatggc

SEQ ID NO: 9134477 - DNA, 22 bp, Homo sapiens
acaggacaactcagcagccagc

SEQ ID NO: 9134478 - DNA, 22 bp, Homo sapiens
acaggacaatttataatgggca

SEQ ID NO: 9134479 - DNA, 22 bp, Homo sapiens
acaggacaaggggaagaagata

SEQ ID NO: 9134480 - DNA, 22 bp, Homo sapiens
acagccagaggagccaggctgg

SEQ ID NO: 9134481 - DNA, 22 bp, Homo sapiens
acagccaaggaattaggaaggg

SEQ ID NO: 9134482 - DNA, 22 bp, Homo sapiens
acagccaacgtctttcttactt

SEQ ID NO: 9134483 - DNA, 22 bp, Homo sapiens
acagccaagtcttctatttcag

SEQ ID NO: 9134484 - DNA, 22 bp, Homo sapiens
acagcattcaataaataataac

SEQ ID NO: 9134485 - DNA, 21 bp, Homo sapiens
acagcatgtttgtgtgtttgc

SEQ ID NO: 9134486 - DNA, 22 bp, Homo sapiens
acagcatttaaagaaaatgaac

SEQ ID NO: 9134487 - DNA, 22 bp, Homo sapiens
acagcatttaaagaaaatgaac

SEQ ID NO: 9134488 - DNA, 22 bp, Homo sapiens
acagcagtttagaggacagcca

SEQ ID NO: 9134489 - DNA, 22 bp, Homo sapiens
acagcagtggtgcactgagcca

SEQ ID NO: 9134490 - DNA, 22 bp, Homo sapiens
acaggatgggcgcacagagcta

SEQ ID NO: 9134491 - DNA, 22 bp, Homo sapiens
acaggatggagataatagaaaa

SEQ ID NO: 9134492 - DNA, 21 bp, Homo sapiens
acaggatgatttttccttatg

SEQ ID NO: 9134493 - DNA, 22 bp, Homo sapiens
acaggatcgccctgttgcccag

SEQ ID NO: 9134494 - DNA, 22 bp, Homo sapiens
acaggatgataaaggatggcca

SEQ ID NO: 9134495 - DNA, 19 bp, Homo sapiens
agcttctttggaaacattt

SEQ ID NO: 9134496 - DNA, 22 bp, Homo sapiens
agcttctttgtgggctccagaa

SEQ ID NO: 9134497 - DNA, 22 bp, Homo sapiens
acaggatcgccctgttgcccag

SEQ ID NO: 9134498 - DNA, 22 bp, Homo sapiens
acaggatcgccctgttgcccag

SEQ ID NO: 9134499 - DNA, 22 bp, Homo sapiens
acaggatgagaatatcatattt

SEQ ID NO: 9134500 - DNA, 22 bp, Homo sapiens
agcttctttaattcagcatgat

SEQ ID NO: 9134501 - DNA, 22 bp, Homo sapiens
agcttctttaattcagcatgat

SEQ ID NO: 9134502 - DNA, 22 bp, Homo sapiens
agcttctttaattcagcatgat

SEQ ID NO: 9134503 - DNA, 22 bp, Homo sapiens
acaggcaaggccagtgagaaat

SEQ ID NO: 9134504 - DNA, 22 bp, Homo sapiens
acaggcaagaggaaagcaagta

SEQ ID NO: 9134505 - DNA, 22 bp, Homo sapiens
acaggcaagtacacaggctcat

SEQ ID NO: 9134506 - DNA, 22 bp, Homo sapiens
acaggatttcaccatgttggcc

SEQ ID NO: 9134507 - DNA, 18 bp, Homo sapiens
aggaaagaaaggcaggtg

SEQ ID NO: 9134508 - DNA, 18 bp, Homo sapiens
aggaaagaaaggcaggtg

SEQ ID NO: 9134509 - DNA, 22 bp, Homo sapiens
acaggcacaccttcctgcaggc

SEQ ID NO: 9134510 - DNA, 22 bp, Homo sapiens
acaggactctctgaaaatgtac

SEQ ID NO: 9134511 - DNA, 22 bp, Homo sapiens
acaggactagatgataaaatgt

SEQ ID NO: 9134512 - DNA, 22 bp, Homo sapiens
acaggacatgtaccaggtggtc

SEQ ID NO: 9134513 - DNA, 22 bp, Homo sapiens
acaggacatggcttctgtgacg

SEQ ID NO: 9134514 - DNA, 22 bp, Homo sapiens
acaggacagtctagtaacagta

SEQ ID NO: 9134515 - DNA, 22 bp, Homo sapiens
acaggacaggctgggctagact

SEQ ID NO: 9134516 - DNA, 22 bp, Homo sapiens
acaggacaggctgggctagact

SEQ ID NO: 9134517 - DNA, 22 bp, Homo sapiens
acaggacagggaattcgaaatt

SEQ ID NO: 9134518 - DNA, 22 bp, Homo sapiens
acaggacaggtaggattcgcag

SEQ ID NO: 9134519 - DNA, 22 bp, Homo sapiens
acaggacagggaattcgaaatt

SEQ ID NO: 9134520 - DNA, 22 bp, Homo sapiens
acaggacagggaattcgaaatt

SEQ ID NO: 9134521 - DNA, 22 bp, Homo sapiens
agcttccaatttctccaagaga

SEQ ID NO: 9134522 - DNA, 22 bp, Homo sapiens
agcttccacatctgtcttcagt

SEQ ID NO: 9134523 - DNA, 22 bp, Homo sapiens
agcttccacatctgtcttcagt

SEQ ID NO: 9134524 - DNA, 21 bp, Homo sapiens
agcttccagagcacattccat

SEQ ID NO: 9134525 - DNA, 22 bp, Homo sapiens
agcttcttcaaagcaggaggcc

SEQ ID NO: 9134526 - DNA, 22 bp, Homo sapiens
agcttcttctattttggggcca

SEQ ID NO: 9134527 - DNA, 22 bp, Homo sapiens
agcttcttgaccaagcctgtaa

SEQ ID NO: 9134528 - DNA, 22 bp, Homo sapiens
agcttcttcttggtctttccca

SEQ ID NO: 9134529 - DNA, 22 bp, Homo sapiens
agcttcttcttggtctttccca

SEQ ID NO: 9134530 - DNA, 22 bp, Homo sapiens
agcttcttgaccaagcctgtaa

SEQ ID NO: 9134531 - DNA, 22 bp, Homo sapiens
aggaaaggtgagagcggccgcg

SEQ ID NO: 9134532 - DNA, 19 bp, Homo sapiens
aggaaaggtggccttagca

SEQ ID NO: 9134533 - DNA, 22 bp, Homo sapiens
aggaaaggttcagtgattgaaa

SEQ ID NO: 9134534 - DNA, 22 bp, Homo sapiens
aggaaaggttcagtgattgaaa

SEQ ID NO: 9134535 - DNA, 19 bp, Homo sapiens
aggaaaggtggccttagca

SEQ ID NO: 9134536 - DNA, 22 bp, Homo sapiens
aggaaaggtagcgtgccagcag

SEQ ID NO: 9134537 - DNA, 22 bp, Homo sapiens
aggaaaggtagcgtgccagcag

SEQ ID NO: 9134538 - DNA, 22 bp, Homo sapiens
aggaaaggtagcgtgccagcag

SEQ ID NO: 9134539 - DNA, 22 bp, Homo sapiens
aggaaaggtagcgtgccagcag

SEQ ID NO: 9134540 - DNA, 22 bp, Homo sapiens
aggaaaggggtaggtgtggacg

SEQ ID NO: 9134541 - DNA, 22 bp, Homo sapiens
aggaaaggggtaggtgtggacg

SEQ ID NO: 9134542 - DNA, 22 bp, Homo sapiens
acaggccttaggagagatgggg

SEQ ID NO: 9134543 - DNA, 21 bp, Homo sapiens
acaggccttaggggccattca

SEQ ID NO: 9134544 - DNA, 22 bp, Homo sapiens
acaggcctgtgtgcacacgagg

SEQ ID NO: 9134545 - DNA, 22 bp, Homo sapiens
acaggccttggtcctgacctaa

SEQ ID NO: 9134546 - DNA, 22 bp, Homo sapiens
acaggccttggcaggcatgtga

SEQ ID NO: 9134547 - DNA, 22 bp, Homo sapiens
acaggcctggtgctgctgacag

SEQ ID NO: 9134548 - DNA, 22 bp, Homo sapiens
aggaaataagggacaagacaaa

SEQ ID NO: 9134549 - DNA, 22 bp, Homo sapiens
aggaaataagggcacttcagat

SEQ ID NO: 9134550 - DNA, 19 bp, Homo sapiens
acagggcagcaataggata

SEQ ID NO: 9134551 - DNA, 22 bp, Homo sapiens
acagggcacctgaggtaggaag

SEQ ID NO: 9134552 - DNA, 22 bp, Homo sapiens
acagggcaggtggctactggtc

SEQ ID NO: 9134553 - DNA, 22 bp, Homo sapiens
acagggcatgtgcaagagacat

SEQ ID NO: 9134554 - DNA, 22 bp, Homo sapiens
acagggcatgtgcaagagacat

SEQ ID NO: 9134555 - DNA, 22 bp, Homo sapiens
acagggcatgtgcaagagacat

SEQ ID NO: 9134556 - DNA, 22 bp, Homo sapiens
acagggccttatatccagaagg

SEQ ID NO: 9134557 - DNA, 23 bp, Homo sapiens
acagggctagctgacagtggtat

SEQ ID NO: 9134558 - DNA, 22 bp, Homo sapiens
acagggctatattcctcagagc

SEQ ID NO: 9134559 - DNA, 22 bp, Homo sapiens
aggacacagtggtggggaaaag

SEQ ID NO: 9134560 - DNA, 22 bp, Homo sapiens
aggacacaggtaagccagtgga

SEQ ID NO: 9134561 - DNA, 22 bp, Homo sapiens
aggacagggattcaaactccca

SEQ ID NO: 9134562 - DNA, 22 bp, Homo sapiens
aggacaggattgagctgaactg

SEQ ID NO: 9134563 - DNA, 22 bp, Homo sapiens
acagggcctcagccagggcaga

SEQ ID NO: 9134564 - DNA, 22 bp, Homo sapiens
acagggcctggctccaaaagat

SEQ ID NO: 9134565 - DNA, 22 bp, Homo sapiens
acagggccagcctgggacctgg

SEQ ID NO: 9134566 - DNA, 22 bp, Homo sapiens
acagggccattggaggattata

SEQ ID NO: 9134567 - DNA, 22 bp, Homo sapiens
aggactgattgggatgccatgt

SEQ ID NO: 9134568 - DNA, 22 bp, Homo sapiens
aggacaggtgtagtgggctctg

SEQ ID NO: 9134569 - DNA, 22 bp, Homo sapiens
aggacagtccggggtcctccac

SEQ ID NO: 9134570 - DNA, 22 bp, Homo sapiens
aggacagttaaaaatagatggc

SEQ ID NO: 9134571 - DNA, 22 bp, Homo sapiens
aggacagtgtggaagagggtgc

SEQ ID NO: 9134572 - DNA, 22 bp, Homo sapiens
aggacatgaagaaagggcaagg

SEQ ID NO: 9134573 - DNA, 22 bp, Homo sapiens
aggacagtggacactagtccct

SEQ ID NO: 9134574 - DNA, 22 bp, Homo sapiens
aggacagtggcaaggcaggaca

SEQ ID NO: 9134575 - DNA, 22 bp, Homo sapiens
aggacagtggcaaggcaggaca

SEQ ID NO: 9134576 - DNA, 22 bp, Homo sapiens
aggcagagaaaaaccagatatg

SEQ ID NO: 9134577 - DNA, 22 bp, Homo sapiens
aggcagagaaaaaccagatatg

SEQ ID NO: 9134578 - DNA, 22 bp, Homo sapiens
aggcagatgtttggcattgctt

SEQ ID NO: 9134579 - DNA, 22 bp, Homo sapiens
aggcagatggtaactgtgatat

SEQ ID NO: 9134580 - DNA, 22 bp, Homo sapiens
aggcagaatgttggaaaggaag

SEQ ID NO: 9134581 - DNA, 22 bp, Homo sapiens
aggcaggttggggaaaagcact

SEQ ID NO: 9134582 - DNA, 22 bp, Homo sapiens
acatagttagcttagagatact

SEQ ID NO: 9134583 - DNA, 22 bp, Homo sapiens
aggcaggtgttgggagacacca

SEQ ID NO: 9134584 - DNA, 22 bp, Homo sapiens
aggcaggtgggtcacttgagtc

SEQ ID NO: 9134585 - DNA, 22 bp, Homo sapiens
aggcaggtgcttatgacttgct

SEQ ID NO: 9134586 - DNA, 22 bp, Homo sapiens
aggcagcaatgaatgaaatgga

SEQ ID NO: 9134587 - DNA, 22 bp, Homo sapiens
aggcagcaatgaatgaaatgga

SEQ ID NO: 9134588 - DNA, 22 bp, Homo sapiens
aggcaggggagctggaagggta

SEQ ID NO: 9134589 - DNA, 22 bp, Homo sapiens
aggcagcaatgaatgaaatgga

SEQ ID NO: 9134590 - DNA, 22 bp, Homo sapiens
aggcagcaaatgtctggaacag

SEQ ID NO: 9134591 - DNA, 22 bp, Homo sapiens
aggcagcaaagaaatgatgctg

SEQ ID NO: 9134592 - DNA, 22 bp, Homo sapiens
aggcagcaaagaaatgatgctg

SEQ ID NO: 9134593 - DNA, 22 bp, Homo sapiens
aggcagcaaatgtctggaacag

SEQ ID NO: 9134594 - DNA, 22 bp, Homo sapiens
aggcagcaagattatttaatcc

SEQ ID NO: 9134595 - DNA, 22 bp, Homo sapiens
aggcagcaaagaaatgatgctg

SEQ ID NO: 9134596 - DNA, 22 bp, Homo sapiens
aggcagcaaagaaatgatgctg

SEQ ID NO: 9134597 - DNA, 20 bp, Homo sapiens
aggcagtgtagagatgagta

SEQ ID NO: 9134598 - DNA, 22 bp, Homo sapiens
aggcagtgtattgctagcggct

SEQ ID NO: 9134599 - DNA, 22 bp, Homo sapiens
aggcagtgtgtagctggaagag

SEQ ID NO: 9134600 - DNA, 22 bp, Homo sapiens
aggcagtggtgtttgctggtgg

SEQ ID NO: 9134601 - DNA, 22 bp, Homo sapiens
acatctttatactagtccttga

SEQ ID NO: 9134602 - DNA, 22 bp, Homo sapiens
acatctttatactagtccttga

SEQ ID NO: 9134603 - DNA, 22 bp, Homo sapiens
acatcttcccacacttgcaaaa

SEQ ID NO: 9134604 - DNA, 22 bp, Homo sapiens
acatctgtttgagaaaaagaag

SEQ ID NO: 9134605 - DNA, 22 bp, Homo sapiens
acatcttcaaagtgctttgcaa

SEQ ID NO: 9134606 - DNA, 22 bp, Homo sapiens
acatatatgtaaagtactttgt

SEQ ID NO: 9134607 - DNA, 22 bp, Homo sapiens
acatataagggatcagtgacag

SEQ ID NO: 9134608 - DNA, 22 bp, Homo sapiens
acatagttcagagcagcagacc

SEQ ID NO: 9134609 - DNA, 22 bp, Homo sapiens
acatataagggatcagtgacag

SEQ ID NO: 9134610 - DNA, 22 bp, Homo sapiens
acatatatgtaaagtactttgt

SEQ ID NO: 9134611 - DNA, 22 bp, Homo sapiens
acatctgacatgatcttcagta

SEQ ID NO: 9134612 - DNA, 22 bp, Homo sapiens
acatctcttcttaaggctccag

SEQ ID NO: 9134613 - DNA, 22 bp, Homo sapiens
acatctgattacatgagaatat

SEQ ID NO: 9134614 - DNA, 22 bp, Homo sapiens
acatctgaggagaccagcctct

SEQ ID NO: 9134615 - DNA, 22 bp, Homo sapiens
acagtggctcatgcctgtcatc

SEQ ID NO: 9134616 - DNA, 22 bp, Homo sapiens
acagtggctcatgcctgtcatc

SEQ ID NO: 9134617 - DNA, 22 bp, Homo sapiens
acagtggcttttgtgtctgcag

SEQ ID NO: 9134618 - DNA, 22 bp, Homo sapiens
acagtgggacagtgacggggga

SEQ ID NO: 9134619 - DNA, 22 bp, Homo sapiens
aggcacagcacacctggccccc

SEQ ID NO: 9134620 - DNA, 22 bp, Homo sapiens
acagtggatgtgatgtccaggt

SEQ ID NO: 9134621 - DNA, 22 bp, Homo sapiens
acagtggatgtgatgtccaggt

SEQ ID NO: 9134622 - DNA, 22 bp, Homo sapiens
acagtggatgacatccttttgc

SEQ ID NO: 9134623 - DNA, 22 bp, Homo sapiens
acagtggaggccatatggtcct

SEQ ID NO: 9134624 - DNA, 22 bp, Homo sapiens
acagtggagctcagatgaaaat

SEQ ID NO: 9134625 - DNA, 22 bp, Homo sapiens
acagtggagttggggtagccct

SEQ ID NO: 9134626 - DNA, 22 bp, Homo sapiens
acagtggatatattaaatgaga

SEQ ID NO: 9134627 - DNA, 22 bp, Homo sapiens
acagtggagaagcaaatgcagt

SEQ ID NO: 9134628 - DNA, 22 bp, Homo sapiens
acagtggagaaggcatgaggct

SEQ ID NO: 9134629 - DNA, 22 bp, Homo sapiens
acagtggaatggtgggcctgca

SEQ ID NO: 9134630 - DNA, 22 bp, Homo sapiens
acagtggaatttgtagatgtgt

SEQ ID NO: 9134631 - DNA, 22 bp, Homo sapiens
acagtggaaatgtgggagggga

SEQ ID NO: 9134632 - DNA, 20 bp, Homo sapiens
acagtggaaattgatgtctg

SEQ ID NO: 9134633 - DNA, 22 bp, Homo sapiens
acagtggaagaagcactgaact

SEQ ID NO: 9134634 - DNA, 22 bp, Homo sapiens
acagtggaagcatgatgctatc

SEQ ID NO: 9134635 - DNA, 22 bp, Homo sapiens
aggcagaaaatagtcatccaaa

SEQ ID NO: 9134636 - DNA, 22 bp, Homo sapiens
aggcactttgaaatttggagct

SEQ ID NO: 9134637 - DNA, 22 bp, Homo sapiens
acagtgttcaaaccactaggct

SEQ ID NO: 9134638 - DNA, 22 bp, Homo sapiens
aggcaccttgagagcaggagct

SEQ ID NO: 9134639 - DNA, 20 bp, Homo sapiens
aggcacctgtcacaggtgag

SEQ ID NO: 9134640 - DNA, 22 bp, Homo sapiens
aggcactagagttcaaagatga

SEQ ID NO: 9134641 - DNA, 22 bp, Homo sapiens
aggcactaatggtagtggactg

SEQ ID NO: 9134642 - DNA, 22 bp, Homo sapiens
aggcactaatccctactatgag

SEQ ID NO: 9134643 - DNA, 22 bp, Homo sapiens
acagtgcagggcgggaagaagg

SEQ ID NO: 9134644 - DNA, 22 bp, Homo sapiens
acagtgcagggtgggaagaagg

SEQ ID NO: 9134645 - DNA, 17 bp, Homo sapiens
aggaggccctggcgttt

SEQ ID NO: 9134646 - DNA, 22 bp, Homo sapiens
acagtgcttctgatatgatgcc

SEQ ID NO: 9134647 - DNA, 22 bp, Homo sapiens
acagtggaaagaaacgaattag

SEQ ID NO: 9134648 - DNA, 22 bp, Homo sapiens
acagtggaaagaacatggattt

SEQ ID NO: 9134649 - DNA, 22 bp, Homo sapiens
aggaggccaggccctcaagcct

SEQ ID NO: 9134650 - DNA, 21 bp, Homo sapiens
aggaggccagtactgctgaac

SEQ ID NO: 9134651 - DNA, 19 bp, Homo sapiens
aggaggccatgccactaga

SEQ ID NO: 9134652 - DNA, 22 bp, Homo sapiens
aggaggccatcagttccttcct

SEQ ID NO: 9134653 - DNA, 22 bp, Homo sapiens
aggaggccatgtactaggttcc

SEQ ID NO: 9134654 - DNA, 22 bp, Homo sapiens
aggaggccctagagctctagag

SEQ ID NO: 9134655 - DNA, 22 bp, Homo sapiens
aggaggcaggaagtctatggga

SEQ ID NO: 9134656 - DNA, 22 bp, Homo sapiens
acagtgagcggtagtgattgct

SEQ ID NO: 9134657 - DNA, 22 bp, Homo sapiens
acagtgacgtttatttgagacg

SEQ ID NO: 9134658 - DNA, 21 bp, Homo sapiens
acagtgagaaataaatggaaa

SEQ ID NO: 9134659 - DNA, 22 bp, Homo sapiens
aggacttcaaatggaaacaaaa

SEQ ID NO: 9134660 - DNA, 22 bp, Homo sapiens
acagtctggaggctgcttcatt

SEQ ID NO: 9134661 - DNA, 22 bp, Homo sapiens
acagtgaaaagaatattagaat

SEQ ID NO: 9134662 - DNA, 22 bp, Homo sapiens
agagccaggatgtcttctgggg

SEQ ID NO: 9134663 - DNA, 22 bp, Homo sapiens
agagccaggaagtggcgtgggg

SEQ ID NO: 9134664 - DNA, 22 bp, Homo sapiens
atgtgcatgtgcacacatgcgt

SEQ ID NO: 9134665 - DNA, 22 bp, Homo sapiens
agagccagcatttgggccctgc

SEQ ID NO: 9134666 - DNA, 22 bp, Homo sapiens
agagccagcatttgacactggc

SEQ ID NO: 9134667 - DNA, 22 bp, Homo sapiens
agagccagcatttgggccctgc

SEQ ID NO: 9134668 - DNA, 22 bp, Homo sapiens
agagccagccttctcagcttac

SEQ ID NO: 9134669 - DNA, 22 bp, Homo sapiens
agagccaggaagtggcgtgggg

SEQ ID NO: 9134670 - DNA, 22 bp, Homo sapiens
agagccagcatttgacactggc

SEQ ID NO: 9134671 - DNA, 18 bp, Homo sapiens
agagatggtgtagagttt

SEQ ID NO: 9134672 - DNA, 18 bp, Homo sapiens
agagatggtgtagagttt

SEQ ID NO: 9134673 - DNA, 22 bp, Homo sapiens
agagatggtagaacagtcataa

SEQ ID NO: 9134674 - DNA, 22 bp, Homo sapiens
agagatgtcgccttgcccaggg

SEQ ID NO: 9134675 - DNA, 22 bp, Homo sapiens
atgtcttgttaatctgaagcaa

SEQ ID NO: 9134676 - DNA, 22 bp, Homo sapiens
atgtgattcccactgaatcact

SEQ ID NO: 9134677 - DNA, 22 bp, Homo sapiens
atgtgcatactcttggccagct

SEQ ID NO: 9134678 - DNA, 22 bp, Homo sapiens
atgttcctttaaaatatagatt

SEQ ID NO: 9134679 - DNA, 19 bp, Homo sapiens
atgttctatcctccaagtt

SEQ ID NO: 9134680 - DNA, 22 bp, Homo sapiens
atgttctatatcattattgtga

SEQ ID NO: 9134681 - DNA, 22 bp, Homo sapiens
agagcggggatagttaatattc

SEQ ID NO: 9134682 - DNA, 22 bp, Homo sapiens
agagctaaatcagactttcttt

SEQ ID NO: 9134683 - DNA, 22 bp, Homo sapiens
agagctagcaaatagagcttca

SEQ ID NO: 9134684 - DNA, 22 bp, Homo sapiens
agagctagaaggaagcatttct

SEQ ID NO: 9134685 - DNA, 22 bp, Homo sapiens
agagctaagaaacagaattgct

SEQ ID NO: 9134686 - DNA, 22 bp, Homo sapiens
agagctaagaaacagaattgct

SEQ ID NO: 9134687 - DNA, 22 bp, Homo sapiens
agagctaagaaacagaattgct

SEQ ID NO: 9134688 - DNA, 22 bp, Homo sapiens
atgttcagtgcagtggcctgag

SEQ ID NO: 9134689 - DNA, 22 bp, Homo sapiens
atgttcagcattctataaatat

SEQ ID NO: 9134690 - DNA, 22 bp, Homo sapiens
atgttcaaactttttacacacc

SEQ ID NO: 9134691 - DNA, 22 bp, Homo sapiens
atgttcattttcttaatgtgcc

SEQ ID NO: 9134692 - DNA, 22 bp, Homo sapiens
atgttcccagcactgagtaaca

SEQ ID NO: 9134693 - DNA, 22 bp, Homo sapiens
atgttcctcattcttgcaaccc

SEQ ID NO: 9134694 - DNA, 22 bp, Homo sapiens
agagctctggcctattggggcc

SEQ ID NO: 9134695 - DNA, 22 bp, Homo sapiens
agagctccgtgcctggctgcca

SEQ ID NO: 9134696 - DNA, 22 bp, Homo sapiens
agagctccgtgcctggctgcca

SEQ ID NO: 9134697 - DNA, 21 bp, Homo sapiens
agagctcaaggcaaaaataat

SEQ ID NO: 9134698 - DNA, 22 bp, Homo sapiens
agagctctgtgtctctttgggt

SEQ ID NO: 9134699 - DNA, 22 bp, Homo sapiens
attaaggtgtcaatgtatttgg

SEQ ID NO: 9134700 - DNA, 22 bp, Homo sapiens
attaagtgactaaagtaatgct

SEQ ID NO: 9134701 - DNA, 22 bp, Homo sapiens
attaaggaggtaaactatggtt

SEQ ID NO: 9134702 - DNA, 22 bp, Homo sapiens
attaaggaatgtaggcaagaag

SEQ ID NO: 9134703 - DNA, 18 bp, Homo sapiens
attaaggaattctttaga

SEQ ID NO: 9134704 - DNA, 22 bp, Homo sapiens
agagatgggaaggcagacttca

SEQ ID NO: 9134705 - DNA, 22 bp, Homo sapiens
agagatgggaaggcagacttca

SEQ ID NO: 9134706 - DNA, 22 bp, Homo sapiens
agagatgggcgggggcttctgc

SEQ ID NO: 9134707 - DNA, 22 bp, Homo sapiens
agagatggcgtctcagagcctg

SEQ ID NO: 9134708 - DNA, 22 bp, Homo sapiens
atgtatatgtgaaagatgttta

SEQ ID NO: 9134709 - DNA, 22 bp, Homo sapiens
atgtagttagaagattcaaaca

SEQ ID NO: 9134710 - DNA, 19 bp, Homo sapiens
agagactgccaccagctgt

SEQ ID NO: 9134711 - DNA, 19 bp, Homo sapiens
agagactgccaccagctgt

SEQ ID NO: 9134712 - DNA, 22 bp, Homo sapiens
agagactggagatgggcagtgt

SEQ ID NO: 9134713 - DNA, 22 bp, Homo sapiens
agagactggagttacgagttca

SEQ ID NO: 9134714 - DNA, 22 bp, Homo sapiens
agagactgcaaatcataagaat

SEQ ID NO: 9134715 - DNA, 22 bp, Homo sapiens
agagactgcaatgagtggtagg

SEQ ID NO: 9134716 - DNA, 22 bp, Homo sapiens
agagactgatggagctcactct

SEQ ID NO: 9134717 - DNA, 22 bp, Homo sapiens
agagacttctgccttagcaaga

SEQ ID NO: 9134718 - DNA, 22 bp, Homo sapiens
agagactttgtctattttgttc

SEQ ID NO: 9134719 - DNA, 21 bp, Homo sapiens
agagactgtcactgcagtacc

SEQ ID NO: 9134720 - DNA, 22 bp, Homo sapiens
agagactgtgccagccccatgc

SEQ ID NO: 9134721 - DNA, 21 bp, Homo sapiens
agagactgtcactgcagtacc

SEQ ID NO: 9134722 - DNA, 22 bp, Homo sapiens
agagactgtacgtggcaagtat

SEQ ID NO: 9134723 - DNA, 22 bp, Homo sapiens
agagactgtcacataacagagg

SEQ ID NO: 9134724 - DNA, 22 bp, Homo sapiens
atgtagggaactaaattcactg

SEQ ID NO: 9134725 - DNA, 22 bp, Homo sapiens
atgtacatagcatcatctagga

SEQ ID NO: 9134726 - DNA, 17 bp, Homo sapiens
agagagaaaagggccat

SEQ ID NO: 9134727 - DNA, 22 bp, Homo sapiens
agagagaacaccctcggcatgg

SEQ ID NO: 9134728 - DNA, 22 bp, Homo sapiens
atggaatttctccggctccacc

SEQ ID NO: 9134729 - DNA, 22 bp, Homo sapiens
atggacaaatgtaaggcataat

SEQ ID NO: 9134730 - DNA, 22 bp, Homo sapiens
agagaacatgacgtaatagtgg

SEQ ID NO: 9134731 - DNA, 22 bp, Homo sapiens
agagaacattagcaaaaacagc

SEQ ID NO: 9134732 - DNA, 22 bp, Homo sapiens
agagaactactttttatatgtg

SEQ ID NO: 9134733 - DNA, 22 bp, Homo sapiens
agagaactgtttctggggtctt

SEQ ID NO: 9134734 - DNA, 22 bp, Homo sapiens
agagaagacttacagccacagt

SEQ ID NO: 9134735 - DNA, 22 bp, Homo sapiens
agagaacagcattgcagctttg

SEQ ID NO: 9134736 - DNA, 22 bp, Homo sapiens
agagaacagcctcctagagaaa

SEQ ID NO: 9134737 - DNA, 22 bp, Homo sapiens
agagaacagtgttttgaaggag

SEQ ID NO: 9134738 - DNA, 22 bp, Homo sapiens
agagaacatattttgtatgatt

SEQ ID NO: 9134739 - DNA, 22 bp, Homo sapiens
atggacaggaactcccttggca

SEQ ID NO: 9134740 - DNA, 22 bp, Homo sapiens
atggacagggcacaggcgcaga

SEQ ID NO: 9134741 - DNA, 22 bp, Homo sapiens
atgggcagtaacagtggcagtc

SEQ ID NO: 9134742 - DNA, 23 bp, Homo sapiens
atgggccaagcaagacccatgac

SEQ ID NO: 9134743 - DNA, 22 bp, Homo sapiens
atgggccaggcttgggatgaca

SEQ ID NO: 9134744 - DNA, 22 bp, Homo sapiens
atgggccacacacgattgggtg

SEQ ID NO: 9134745 - DNA, 22 bp, Homo sapiens
atgggccaagtaaacattctca

SEQ ID NO: 9134746 - DNA, 22 bp, Homo sapiens
atgggcagtgtattggaaggaa

SEQ ID NO: 9134747 - DNA, 22 bp, Homo sapiens
atgggcagtgtattggaaggaa

SEQ ID NO: 9134748 - DNA, 22 bp, Homo sapiens
atgggcagttaggaggccagga

SEQ ID NO: 9134749 - DNA, 22 bp, Homo sapiens
atgggcagtaacagtggcagtc

SEQ ID NO: 9134750 - DNA, 22 bp, Homo sapiens
atgcaaatgtttaagttactat

SEQ ID NO: 9134751 - DNA, 22 bp, Homo sapiens
atgattttctgataaagaactg

SEQ ID NO: 9134752 - DNA, 22 bp, Homo sapiens
atgattgaccatctgctgggct

SEQ ID NO: 9134753 - DNA, 17 bp, Homo sapiens
atgattccatcaggatt

SEQ ID NO: 9134754 - DNA, 22 bp, Homo sapiens
atgattctcattttataaactt

SEQ ID NO: 9134755 - DNA, 22 bp, Homo sapiens
atgattgaaaatgacattgcca

SEQ ID NO: 9134756 - DNA, 22 bp, Homo sapiens
atgattgaaaatgacattgcca

SEQ ID NO: 9134757 - DNA, 22 bp, Homo sapiens
atgattgaccatctgctgggct

SEQ ID NO: 9134758 - DNA, 22 bp, Homo sapiens
atgaggagtcaaggagtcggag

SEQ ID NO: 9134759 - DNA, 22 bp, Homo sapiens
atgactttcctggcaaaagttg

SEQ ID NO: 9134760 - DNA, 22 bp, Homo sapiens
atgacttttaaaagctggtact

SEQ ID NO: 9134761 - DNA, 22 bp, Homo sapiens
atgactttgttgttttccagcg

SEQ ID NO: 9134762 - DNA, 22 bp, Homo sapiens
atgagaaaattgaggcccatag

SEQ ID NO: 9134763 - DNA, 22 bp, Homo sapiens
atgacttttaggagcagtgctc

SEQ ID NO: 9134764 - DNA, 22 bp, Homo sapiens
atgactttcctggcaaaagttg

SEQ ID NO: 9134765 - DNA, 22 bp, Homo sapiens
atgaggagctccttgaaatgag

SEQ ID NO: 9134766 - DNA, 22 bp, Homo sapiens
atgaggagccctcatttaggtt

SEQ ID NO: 9134767 - DNA, 22 bp, Homo sapiens
atgaccaatgggcagagctaga

SEQ ID NO: 9134768 - DNA, 22 bp, Homo sapiens
atgaccagtttccccactgtcc

SEQ ID NO: 9134769 - DNA, 22 bp, Homo sapiens
atgaccagccgagataaacaga

SEQ ID NO: 9134770 - DNA, 22 bp, Homo sapiens
atgacctacaacctagcatgat

SEQ ID NO: 9134771 - DNA, 22 bp, Homo sapiens
atgacctgaggccttactctag

SEQ ID NO: 9134772 - DNA, 22 bp, Homo sapiens
atgacccccaagggcagcgtga

SEQ ID NO: 9134773 - DNA, 23 bp, Homo sapiens
atcttagcatagacttgagtccc

SEQ ID NO: 9134774 - DNA, 23 bp, Homo sapiens
atcttagcatagacttgagtccc

SEQ ID NO: 9134775 - DNA, 22 bp, Homo sapiens
atgacaatacttcaataagctg

SEQ ID NO: 9134776 - DNA, 22 bp, Homo sapiens
atcttaatcgagtccatgaaaa

SEQ ID NO: 9134777 - DNA, 22 bp, Homo sapiens
atcttaaacagaggaatgactt

SEQ ID NO: 9134778 - DNA, 22 bp, Homo sapiens
atctgttgtttgtttgctaaag

SEQ ID NO: 9134779 - DNA, 22 bp, Homo sapiens
atctgggctcgaatcctagctc

SEQ ID NO: 9134780 - DNA, 22 bp, Homo sapiens
atctgggcgtataggtgcaagt

SEQ ID NO: 9134781 - DNA, 22 bp, Homo sapiens
atctgggtcacagtggcatcta

SEQ ID NO: 9134782 - DNA, 22 bp, Homo sapiens
atctgggcctgttccctcacct

SEQ ID NO: 9134783 - DNA, 22 bp, Homo sapiens
atctgggccagccccaagagac

SEQ ID NO: 9134784 - DNA, 22 bp, Homo sapiens
atctgggccaatcctagtacca

SEQ ID NO: 9134785 - DNA, 22 bp, Homo sapiens
atctgggcatggaggaaagaga

SEQ ID NO: 9134786 - DNA, 23 bp, Homo sapiens
atctgggcatctggagtggtcct

SEQ ID NO: 9134787 - DNA, 22 bp, Homo sapiens
atctgggcagggcagcaaggcg

SEQ ID NO: 9134788 - DNA, 20 bp, Homo sapiens
atctgggcatcaattttgtg

SEQ ID NO: 9134789 - DNA, 22 bp, Homo sapiens
atgccactgacatggacaattt

SEQ ID NO: 9134790 - DNA, 22 bp, Homo sapiens
atgccacttctctaagtcatgt

SEQ ID NO: 9134791 - DNA, 22 bp, Homo sapiens
atgccagaaaatgatggctgca

SEQ ID NO: 9134792 - DNA, 22 bp, Homo sapiens
atgccaggaacaaacagtggtg

SEQ ID NO: 9134793 - DNA, 22 bp, Homo sapiens
atgccaggaacaaacagtggtg

SEQ ID NO: 9134794 - DNA, 22 bp, Homo sapiens
atgccaggagatggagcagagt

SEQ ID NO: 9134795 - DNA, 22 bp, Homo sapiens
atgcaaattgccataaagtggg

SEQ ID NO: 9134796 - DNA, 22 bp, Homo sapiens
atgccagggtcacagtcatatt

SEQ ID NO: 9134797 - DNA, 22 bp, Homo sapiens
atgccagggtcacagtcatatt

SEQ ID NO: 9134798 - DNA, 22 bp, Homo sapiens
atgccagggtcccttcagagat

SEQ ID NO: 9134799 - DNA, 22 bp, Homo sapiens
agacagtgtgagttcagggtgg

SEQ ID NO: 9134800 - DNA, 20 bp, Homo sapiens
agacagtgtggagattcctt

SEQ ID NO: 9134801 - DNA, 20 bp, Homo sapiens
agacagtggggagctcctag

SEQ ID NO: 9134802 - DNA, 22 bp, Homo sapiens
agacagttgatatactataaaa

SEQ ID NO: 9134803 - DNA, 22 bp, Homo sapiens
agacagtgtgtgtatatatggt

SEQ ID NO: 9134804 - DNA, 22 bp, Homo sapiens
agacataagcgagcatcacagg

SEQ ID NO: 9134805 - DNA, 22 bp, Homo sapiens
agacataagtgctatgacattg

SEQ ID NO: 9134806 - DNA, 22 bp, Homo sapiens
agacataagtgctatgacattg

SEQ ID NO: 9134807 - DNA, 22 bp, Homo sapiens
agacataattaattagttctac

SEQ ID NO: 9134808 - DNA, 22 bp, Homo sapiens
atgcttctgaagaagaaaagac

SEQ ID NO: 9134809 - DNA, 18 bp, Homo sapiens
atgcttctgatagaagca

SEQ ID NO: 9134810 - DNA, 22 bp, Homo sapiens
atgcttctgctcatatttcatt

SEQ ID NO: 9134811 - DNA, 22 bp, Homo sapiens
atgcttcagtgctaccttcaaa

SEQ ID NO: 9134812 - DNA, 22 bp, Homo sapiens
agagaacagcattgcagctttg

SEQ ID NO: 9134813 - DNA, 22 bp, Homo sapiens
agagaacagacagatgcaatga

SEQ ID NO: 9134814 - DNA, 22 bp, Homo sapiens
agagaacacgtgcatctgcaat

SEQ ID NO: 9134815 - DNA, 22 bp, Homo sapiens
agagaaacaggtcagctgggag

SEQ ID NO: 9134816 - DNA, 22 bp, Homo sapiens
atgcttgaaagttatttcattt

SEQ ID NO: 9134817 - DNA, 22 bp, Homo sapiens
atgcttcttgtatttggctgac

SEQ ID NO: 9134818 - DNA, 22 bp, Homo sapiens
atgcttgaaaaccccatgaata

SEQ ID NO: 9134819 - DNA, 22 bp, Homo sapiens
atgcttctgttgcttaggaggt

SEQ ID NO: 9134820 - DNA, 22 bp, Homo sapiens
atgcttctggtataagaaaaat

SEQ ID NO: 9134821 - DNA, 22 bp, Homo sapiens
atgctgagactggagcagctgg

SEQ ID NO: 9134822 - DNA, 22 bp, Homo sapiens
atgctgcacaagccacatgtag

SEQ ID NO: 9134823 - DNA, 22 bp, Homo sapiens
atgctgatgaggtcaggaagac

SEQ ID NO: 9134824 - DNA, 22 bp, Homo sapiens
atgctgaaggtgaattgacaat

SEQ ID NO: 9134825 - DNA, 22 bp, Homo sapiens
atgctgaagtgtgtttgaagta

SEQ ID NO: 9134826 - DNA, 22 bp, Homo sapiens
atgctgaagagttcatgattat

SEQ ID NO: 9134827 - DNA, 22 bp, Homo sapiens
atgctgaaggccatcctgcatc

SEQ ID NO: 9134828 - DNA, 22 bp, Homo sapiens
atgctgaagagtgcacaggcta

SEQ ID NO: 9134829 - DNA, 22 bp, Homo sapiens
atgctgaagagagaactactca

SEQ ID NO: 9134830 - DNA, 22 bp, Homo sapiens
atgctgaagagtgcacaggcta

SEQ ID NO: 9134831 - DNA, 22 bp, Homo sapiens
atgctgaatagttcactcttct

SEQ ID NO: 9134832 - DNA, 22 bp, Homo sapiens
atgctgaatattagcctcatga

SEQ ID NO: 9134833 - DNA, 21 bp, Homo sapiens
atgctgaatcttgttgtgctc

SEQ ID NO: 9134834 - DNA, 22 bp, Homo sapiens
atgctgaatgaaagaaattagt

SEQ ID NO: 9134835 - DNA, 22 bp, Homo sapiens
atgctgaattgatgcgagggag

SEQ ID NO: 9134836 - DNA, 22 bp, Homo sapiens
atgctgaattgatgcgagggag

SEQ ID NO: 9134837 - DNA, 22 bp, Homo sapiens
agacatatattgcaattcactg

SEQ ID NO: 9134838 - DNA, 22 bp, Homo sapiens
atgctgaactgagatgtaactt

SEQ ID NO: 9134839 - DNA, 22 bp, Homo sapiens
atgctgaaccttaacttggagc

SEQ ID NO: 9134840 - DNA, 22 bp, Homo sapiens
atgctgaagaatcacagggact

SEQ ID NO: 9134841 - DNA, 22 bp, Homo sapiens
atgctgaaatttattggtaagg

SEQ ID NO: 9134842 - DNA, 22 bp, Homo sapiens
atgctgaaccttaacttggagc

SEQ ID NO: 9134843 - DNA, 22 bp, Homo sapiens
atgctgaaaattggatttgaat

SEQ ID NO: 9134844 - DNA, 22 bp, Homo sapiens
agatacaagaggcctgacgtgt

SEQ ID NO: 9134845 - DNA, 22 bp, Homo sapiens
agatacaactgtttaaacatta

SEQ ID NO: 9134846 - DNA, 22 bp, Homo sapiens
agatacagaagtttttccctat

SEQ ID NO: 9134847 - DNA, 22 bp, Homo sapiens
agatacacagccctgccatcac

SEQ ID NO: 9134848 - DNA, 22 bp, Homo sapiens
agatacaaaaagggagaagatt

SEQ ID NO: 9134849 - DNA, 22 bp, Homo sapiens
agataatttgagtaaattaatt

SEQ ID NO: 9134850 - DNA, 22 bp, Homo sapiens
agataaattcctaagatttcag

SEQ ID NO: 9134851 - DNA, 22 bp, Homo sapiens
agataaattcctaagatttcag

SEQ ID NO: 9134852 - DNA, 22 bp, Homo sapiens
agataaattcctaagatttcag

SEQ ID NO: 9134853 - DNA, 22 bp, Homo sapiens
attgtggtgtcagttataggca

SEQ ID NO: 9134854 - DNA, 22 bp, Homo sapiens
attgtgtcctcattgaccttca

SEQ ID NO: 9134855 - DNA, 22 bp, Homo sapiens
attgttaataactattacattg

SEQ ID NO: 9134856 - DNA, 22 bp, Homo sapiens
attgttaaactgaagcattact

SEQ ID NO: 9134857 - DNA, 22 bp, Homo sapiens
attgttaaagtaataaccatgg

SEQ ID NO: 9134858 - DNA, 22 bp, Homo sapiens
attgttaaagtaataaccatgg

SEQ ID NO: 9134859 - DNA, 22 bp, Homo sapiens
attgttaaactgaagcattact

SEQ ID NO: 9134860 - DNA, 22 bp, Homo sapiens
attgtatttccagcttgaatgt

SEQ ID NO: 9134861 - DNA, 22 bp, Homo sapiens
attgtattagcacaatacaatt

SEQ ID NO: 9134862 - DNA, 22 bp, Homo sapiens
attgtattataattaggccaaa

SEQ ID NO: 9134863 - DNA, 22 bp, Homo sapiens
attgagaatccatttgagatga

SEQ ID NO: 9134864 - DNA, 22 bp, Homo sapiens
attgagaatgaagggacatttt

SEQ ID NO: 9134865 - DNA, 22 bp, Homo sapiens
attgagaatctgagagcctagg

SEQ ID NO: 9134866 - DNA, 22 bp, Homo sapiens
attgagaatgcaatctactatg

SEQ ID NO: 9134867 - DNA, 22 bp, Homo sapiens
attgagatctgcatcataagct

SEQ ID NO: 9134868 - DNA, 22 bp, Homo sapiens
attgtataattgtattgccaaa

SEQ ID NO: 9134869 - DNA, 22 bp, Homo sapiens
attgtataatcagttactggaa

SEQ ID NO: 9134870 - DNA, 22 bp, Homo sapiens
attgtatcttgtcattatgcat

SEQ ID NO: 9134871 - DNA, 22 bp, Homo sapiens
attgtataagtctatttacaat

SEQ ID NO: 9134872 - DNA, 22 bp, Homo sapiens
attgtataagtctatttacaat

SEQ ID NO: 9134873 - DNA, 22 bp, Homo sapiens
attgagaaatataatctggaaa

SEQ ID NO: 9134874 - DNA, 22 bp, Homo sapiens
attgaaatccctacctcagagg

SEQ ID NO: 9134875 - DNA, 22 bp, Homo sapiens
attgaaaggttttgagcagata

SEQ ID NO: 9134876 - DNA, 22 bp, Homo sapiens
attgaaaggcaaagtaggaagc

SEQ ID NO: 9134877 - DNA, 22 bp, Homo sapiens
attgaaagcatggatttggatt

SEQ ID NO: 9134878 - DNA, 22 bp, Homo sapiens
attgaaaatgacatttgtgccc

SEQ ID NO: 9134879 - DNA, 22 bp, Homo sapiens
attgaaagagaatgtagctctt

SEQ ID NO: 9134880 - DNA, 22 bp, Homo sapiens
attgaaaatataattctaggag

SEQ ID NO: 9134881 - DNA, 22 bp, Homo sapiens
attgaaaatgacatttgtgccc

SEQ ID NO: 9134882 - DNA, 22 bp, Homo sapiens
attgaaaataaggccagaaaca

SEQ ID NO: 9134883 - DNA, 22 bp, Homo sapiens
attgaaaaattcacaattctgg

SEQ ID NO: 9134884 - DNA, 23 bp, Homo sapiens
agagcttagggaattcacatgag

SEQ ID NO: 9134885 - DNA, 22 bp, Homo sapiens
attaataaaataccactttgtt

SEQ ID NO: 9134886 - DNA, 22 bp, Homo sapiens
agagctttgggacatttgctag

SEQ ID NO: 9134887 - DNA, 23 bp, Homo sapiens
agagctttctaaaatgtaaatct

SEQ ID NO: 9134888 - DNA, 22 bp, Homo sapiens
agagctttgtttgattgtcaga

SEQ ID NO: 9134889 - DNA, 22 bp, Homo sapiens
agagcttttgggaattcaggta

SEQ ID NO: 9134890 - DNA, 22 bp, Homo sapiens
agaggccctctctgctcagtct

SEQ ID NO: 9134891 - DNA, 21 bp, Homo sapiens
agaggaagaagagtgtattat

SEQ ID NO: 9134892 - DNA, 22 bp, Homo sapiens
agagcttttgggaattcaggta

SEQ ID NO: 9134893 - DNA, 22 bp, Homo sapiens
agaggaaaatgagttccagaat

SEQ ID NO: 9134894 - DNA, 22 bp, Homo sapiens
agaggccctggctagagcagct

SEQ ID NO: 9134895 - DNA, 22 bp, Homo sapiens
agaggccctgggctggtgtgct

SEQ ID NO: 9134896 - DNA, 22 bp, Homo sapiens
agaggccctggctagagcagct

SEQ ID NO: 9134897 - DNA, 22 bp, Homo sapiens
agaggccggccgagcccatggg

SEQ ID NO: 9134898 - DNA, 22 bp, Homo sapiens
agaggccggccgagcccatggg

SEQ ID NO: 9134899 - DNA, 22 bp, Homo sapiens
agaggcctaaccaagatgtcct

SEQ ID NO: 9134900 - DNA, 22 bp, Homo sapiens
agaggcctaaccaagatgtcct

SEQ ID NO: 9134901 - DNA, 22 bp, Homo sapiens
agaggcctcaaaccagacctga

SEQ ID NO: 9134902 - DNA, 19 bp, Homo sapiens
agaggcctcagcagctggc

SEQ ID NO: 9134903 - DNA, 19 bp, Homo sapiens
agaggcctcagcagctggc

SEQ ID NO: 9134904 - DNA, 19 bp, Homo sapiens
agaggcctcagcagctggc

SEQ ID NO: 9134905 - DNA, 19 bp, Homo sapiens
agaggcctcagcagctggc

SEQ ID NO: 9134906 - DNA, 22 bp, Homo sapiens
agaggcctccctcccagctggt

SEQ ID NO: 9134907 - DNA, 22 bp, Homo sapiens
attatttctcactcacataata

SEQ ID NO: 9134908 - DNA, 22 bp, Homo sapiens
agaggcctctagggcccctcag

SEQ ID NO: 9134909 - DNA, 22 bp, Homo sapiens
attattttatgtgcggcctgat

SEQ ID NO: 9134910 - DNA, 22 bp, Homo sapiens
attatttgtgtccacagaatac

SEQ ID NO: 9134911 - DNA, 22 bp, Homo sapiens
attctctggtcattgagtataa

SEQ ID NO: 9134912 - DNA, 20 bp, Homo sapiens
attctctgctcaagtggcac

SEQ ID NO: 9134913 - DNA, 22 bp, Homo sapiens
attctctgctgcactgataaca

SEQ ID NO: 9134914 - DNA, 22 bp, Homo sapiens
attctctgaagtctttcagggc

SEQ ID NO: 9134915 - DNA, 22 bp, Homo sapiens
attctctgaagtcaatggaaat

SEQ ID NO: 9134916 - DNA, 22 bp, Homo sapiens
attctctgaagtctttcagggc

SEQ ID NO: 9134917 - DNA, 22 bp, Homo sapiens
attctctgatgcaggtggaaga

SEQ ID NO: 9134918 - DNA, 22 bp, Homo sapiens
attctctgtgcagatttaagac

SEQ ID NO: 9134919 - DNA, 19 bp, Homo sapiens
attcttctcttcctgctgt

SEQ ID NO: 9134920 - DNA, 22 bp, Homo sapiens
attcttctgcctactttcatcc

SEQ ID NO: 9134921 - DNA, 22 bp, Homo sapiens
attgaaaaatgactattgctta

SEQ ID NO: 9134922 - DNA, 22 bp, Homo sapiens
attctacaacccaataataatt

SEQ ID NO: 9134923 - DNA, 20 bp, Homo sapiens
attctacaagaataagcatg

SEQ ID NO: 9134924 - DNA, 22 bp, Homo sapiens
attctccacacatccagacctt

SEQ ID NO: 9134925 - DNA, 22 bp, Homo sapiens
attctctcttctgctgcccgtg

SEQ ID NO: 9134926 - DNA, 22 bp, Homo sapiens
attctctcatttatctgtccta

SEQ ID NO: 9134927 - DNA, 22 bp, Homo sapiens
attctctagtctcttccataaa

SEQ ID NO: 9134928 - DNA, 22 bp, Homo sapiens
attctccctgttcctcgacacc

SEQ ID NO: 9134929 - DNA, 20 bp, Homo sapiens
attctccctatactcacttt

SEQ ID NO: 9134930 - DNA, 22 bp, Homo sapiens
attcaaaagaccatgcagactc

SEQ ID NO: 9134931 - DNA, 22 bp, Homo sapiens
attcaaaagaccatgcagactc

SEQ ID NO: 9134932 - DNA, 22 bp, Homo sapiens
attctaaatgtaatttagaatt

SEQ ID NO: 9134933 - DNA, 22 bp, Homo sapiens
attctaaatcagagagctctgt

SEQ ID NO: 9134934 - DNA, 22 bp, Homo sapiens
attctaaagcttgtggagctta

SEQ ID NO: 9134935 - DNA, 22 bp, Homo sapiens
attctaaagcttgtggagctta

SEQ ID NO: 9134936 - DNA, 22 bp, Homo sapiens
attctaagtgcttgtggtggtt

SEQ ID NO: 9134937 - DNA, 22 bp, Homo sapiens
atttgaatggcttaacacaacg

SEQ ID NO: 9134938 - DNA, 22 bp, Homo sapiens
atttgaagaaagttttctagat

SEQ ID NO: 9134939 - DNA, 22 bp, Homo sapiens
atttgaaatctgggttactctg

SEQ ID NO: 9134940 - DNA, 19 bp, Homo sapiens
atttgaaagctgtgcttgc

SEQ ID NO: 9134941 - DNA, 22 bp, Homo sapiens
atttgaaatcccttctactgta

SEQ ID NO: 9134942 - DNA, 22 bp, Homo sapiens
agatgagaatttttagagtgct

SEQ ID NO: 9134943 - DNA, 22 bp, Homo sapiens
agatgacacacacgcacccgga

SEQ ID NO: 9134944 - DNA, 22 bp, Homo sapiens
agatgaggggtagaaaggactt

SEQ ID NO: 9134945 - DNA, 22 bp, Homo sapiens
agatgagaatttttagagtgct

SEQ ID NO: 9134946 - DNA, 23 bp, Homo sapiens
atttacagctgtgtgagcaagtt

SEQ ID NO: 9134947 - DNA, 22 bp, Homo sapiens
atttacagccttgaaaacagca

SEQ ID NO: 9134948 - DNA, 23 bp, Homo sapiens
atttgaaactttcttgtttccag

SEQ ID NO: 9134949 - DNA, 22 bp, Homo sapiens
atttctttctggccacggtttt

SEQ ID NO: 9134950 - DNA, 22 bp, Homo sapiens
atttctttctggccacggtttt

SEQ ID NO: 9134951 - DNA, 22 bp, Homo sapiens
atttctcttagcaagacattac

SEQ ID NO: 9134952 - DNA, 22 bp, Homo sapiens
atttctcttagcaagacattac

SEQ ID NO: 9134953 - DNA, 22 bp, Homo sapiens
atttctcttcctcctagggttg

SEQ ID NO: 9134954 - DNA, 22 bp, Homo sapiens
atttctcttcctcctagggttg

SEQ ID NO: 9134955 - DNA, 21 bp, Homo sapiens
attttctgtgatagctgtctc

SEQ ID NO: 9134956 - DNA, 21 bp, Homo sapiens
attttgtacatagaatttgtc

SEQ ID NO: 9134957 - DNA, 21 bp, Homo sapiens
attttgtacatagaatttgtc

SEQ ID NO: 9134958 - DNA, 22 bp, Homo sapiens
agatttcaatggatattgcaag

SEQ ID NO: 9134959 - DNA, 22 bp, Homo sapiens
agatttatgtggtcacactcag

SEQ ID NO: 9134960 - DNA, 22 bp, Homo sapiens
agatttatgtggtcacactcag

SEQ ID NO: 9134961 - DNA, 22 bp, Homo sapiens
agatttaaatttgctacaattc

SEQ ID NO: 9134962 - DNA, 22 bp, Homo sapiens
agatttaaatttgctacaattc

SEQ ID NO: 9134963 - DNA, 23 bp, Homo sapiens
agattgttattcccagttcatgt

SEQ ID NO: 9134964 - DNA, 18 bp, Homo sapiens
agattgtgtctacaaatc

SEQ ID NO: 9134965 - DNA, 22 bp, Homo sapiens
agatgatgataattgaaaggca

SEQ ID NO: 9134966 - DNA, 22 bp, Homo sapiens
agatgtttgtaaacacactgct

SEQ ID NO: 9134967 - DNA, 22 bp, Homo sapiens
agattcaggactggccacagcc

SEQ ID NO: 9134968 - DNA, 22 bp, Homo sapiens
agattgggctccagttaaaacg

SEQ ID NO: 9134969 - DNA, 23 bp, Homo sapiens
agattgaagtattgaccagagct

SEQ ID NO: 9134970 - DNA, 22 bp, Homo sapiens
agattgaataaccacctttttc

SEQ ID NO: 9134971 - DNA, 22 bp, Homo sapiens
agattgaatatagagattcttg

SEQ ID NO: 9134972 - DNA, 22 bp, Homo sapiens
agattggtgaatgaaaagtaga

SEQ ID NO: 9134973 - DNA, 23 bp, Homo sapiens
agattggtgtgtgcatcaaattg

SEQ ID NO: 9134974 - DNA, 22 bp, Homo sapiens
agattggttatttgataaggaa

SEQ ID NO: 9134975 - DNA, 22 bp, Homo sapiens
agattggtgttgcagaaccatg

SEQ ID NO: 9134976 - DNA, 22 bp, Homo sapiens
agattggtttcccacatagctg

SEQ ID NO: 9134977 - DNA, 22 bp, Homo sapiens
agattgaagactggtggagctg

SEQ ID NO: 9134978 - DNA, 23 bp, Homo sapiens
agattgaagtattgaccagagct

SEQ ID NO: 9134979 - DNA, 22 bp, Homo sapiens
agattgaagactggtggagctg

SEQ ID NO: 9134980 - DNA, 22 bp, Homo sapiens
attttgttatagaactctgtga

SEQ ID NO: 9134981 - DNA, 22 bp, Homo sapiens
attttgttataggagctgaaat

SEQ ID NO: 9134982 - DNA, 22 bp, Homo sapiens
attttgttataggagctgaaat

SEQ ID NO: 9134983 - DNA, 22 bp, Homo sapiens
attttgttgaggtaattgtcaa

SEQ ID NO: 9134984 - DNA, 22 bp, Homo sapiens
attttgttgaggtaattgtcaa

SEQ ID NO: 9134985 - DNA, 22 bp, Homo sapiens
attttgttatcagggctttgca

SEQ ID NO: 9134986 - DNA, 22 bp, Homo sapiens
attttgtgaaccctcaagcaat

SEQ ID NO: 9134987 - DNA, 22 bp, Homo sapiens
attttgttaatgtcaccgtgct

SEQ ID NO: 9134988 - DNA, 22 bp, Homo sapiens
attttttatataccaaggtggg

SEQ ID NO: 9134989 - DNA, 22 bp, Homo sapiens
attttttagccaagactctgca

SEQ ID NO: 9134990 - DNA, 22 bp, Homo sapiens
attttttatataccaaggtggg

SEQ ID NO: 9134991 - DNA, 22 bp, Homo sapiens
attttgttgatggtggagtagc

SEQ ID NO: 9134992 - DNA, 20 bp, Homo sapiens
attttgtttatgttcctctc

SEQ ID NO: 9134993 - DNA, 22 bp, Homo sapiens
attttttagaacctggcctgat

SEQ ID NO: 9134994 - DNA, 22 bp, Homo sapiens
attttttagccaagactctgca

SEQ ID NO: 9134995 - DNA, 22 bp, Homo sapiens
attttttagccaagactctgca

SEQ ID NO: 9134996 - DNA, 22 bp, Homo sapiens
attttttagccaagactctgca

SEQ ID NO: 9134997 - DNA, 22 bp, Homo sapiens
agcaagatgaaggattcaagac

SEQ ID NO: 9134998 - DNA, 22 bp, Homo sapiens
agcaagatgcaaacatccgtcc

SEQ ID NO: 9134999 - DNA, 22 bp, Homo sapiens
agcaagatgcaaacatccgtcc

SEQ ID NO: 9135000 - DNA, 22 bp, Homo sapiens
agcaagatgcaaacatccgtcc

SEQ ID NO: 9135001 - DNA, 22 bp, Homo sapiens
agcaagatgcattatttcttat

SEQ ID NO: 9135002 - DNA, 22 bp, Homo sapiens
agcaagatgcattatttcttat

SEQ ID NO: 9135003 - DNA, 22 bp, Homo sapiens
agcaagatgaaggattcaagac

SEQ ID NO: 9135004 - DNA, 22 bp, Homo sapiens
agcaagatgaaggattcaagac

SEQ ID NO: 9135005 - DNA, 20 bp, Homo sapiens
agcaagagtgtacctggcca

SEQ ID NO: 9135006 - DNA, 23 bp, Homo sapiens
attttttgtctttgtaactagat

SEQ ID NO: 9135007 - DNA, 23 bp, Homo sapiens
attttttgtctttgtaactagat

SEQ ID NO: 9135008 - DNA, 23 bp, Homo sapiens
attttttgtctttgtaactagat

SEQ ID NO: 9135009 - DNA, 22 bp, Homo sapiens
agcaataaccactctaatttat

SEQ ID NO: 9135010 - DNA, 22 bp, Homo sapiens
caaataattactatcctcactt

SEQ ID NO: 9135011 - DNA, 22 bp, Homo sapiens
agcaatgaccagtgatcttgta

SEQ ID NO: 9135012 - DNA, 22 bp, Homo sapiens
agcaatgctaccgggtgattcg

SEQ ID NO: 9135013 - DNA, 22 bp, Homo sapiens
caaagttttagtaaacatatat

SEQ ID NO: 9135014 - DNA, 22 bp, Homo sapiens
caaataagaaccacaggggagt

SEQ ID NO: 9135015 - DNA, 22 bp, Homo sapiens
caaataagcaattccattcttc

SEQ ID NO: 9135016 - DNA, 22 bp, Homo sapiens
caaataagcaattccattcttc

SEQ ID NO: 9135017 - DNA, 22 bp, Homo sapiens
caaataagcaattccattcttc

SEQ ID NO: 9135018 - DNA, 22 bp, Homo sapiens
caaataagaaccacaggggagt

SEQ ID NO: 9135019 - DNA, 22 bp, Homo sapiens
caaagttatgaatgataagatt

SEQ ID NO: 9135020 - DNA, 22 bp, Homo sapiens
caaagttatcaactgcaacatt

SEQ ID NO: 9135021 - DNA, 22 bp, Homo sapiens
caaacattttgagtggtttctg

SEQ ID NO: 9135022 - DNA, 22 bp, Homo sapiens
caaacattttctacttccagga

SEQ ID NO: 9135023 - DNA, 22 bp, Homo sapiens
caaacatttgacttctctcagg

SEQ ID NO: 9135024 - DNA, 22 bp, Homo sapiens
caatgatgtttagataaaatcc

SEQ ID NO: 9135025 - DNA, 22 bp, Homo sapiens
caatgtttttccttccttaata

SEQ ID NO: 9135026 - DNA, 22 bp, Homo sapiens
caatgtttttccttccttaata

SEQ ID NO: 9135027 - DNA, 22 bp, Homo sapiens
caagtctgacctctgggtgaag

SEQ ID NO: 9135028 - DNA, 22 bp, Homo sapiens
caagtgaagatatacagaaaat

SEQ ID NO: 9135029 - DNA, 22 bp, Homo sapiens
caagtccttagatggttctttg

SEQ ID NO: 9135030 - DNA, 22 bp, Homo sapiens
caagtcctcaaagggctctgct

SEQ ID NO: 9135031 - DNA, 22 bp, Homo sapiens
caagtcctcgcttctagctgtg

SEQ ID NO: 9135032 - DNA, 22 bp, Homo sapiens
caagtccttttcttggctcagg

SEQ ID NO: 9135033 - DNA, 22 bp, Homo sapiens
caattacatttattgagcattc

SEQ ID NO: 9135034 - DNA, 22 bp, Homo sapiens
caattacatttattgagcattc

SEQ ID NO: 9135035 - DNA, 21 bp, Homo sapiens
caattactatgaaccagttga

SEQ ID NO: 9135036 - DNA, 22 bp, Homo sapiens
caattaccagtaattgaggttt

SEQ ID NO: 9135037 - DNA, 21 bp, Homo sapiens
caattactatgaaccagttga

SEQ ID NO: 9135038 - DNA, 22 bp, Homo sapiens
caattatatttagaatgataca

SEQ ID NO: 9135039 - DNA, 22 bp, Homo sapiens
caattatatttagaatgataca

SEQ ID NO: 9135040 - DNA, 22 bp, Homo sapiens
caattagaggaggaagctcata

SEQ ID NO: 9135041 - DNA, 22 bp, Homo sapiens
caattactggtccacagaaatt

SEQ ID NO: 9135042 - DNA, 21 bp, Homo sapiens
caattactatgaaccagttga

SEQ ID NO: 9135043 - DNA, 22 bp, Homo sapiens
caattacttttgcaccaatata

SEQ ID NO: 9135044 - DNA, 22 bp, Homo sapiens
caagtcatcatagaagttcccc

SEQ ID NO: 9135045 - DNA, 22 bp, Homo sapiens
caagtcattactgaaatgtcac

SEQ ID NO: 9135046 - DNA, 22 bp, Homo sapiens
caagtccaacagtttttcagac

SEQ ID NO: 9135047 - DNA, 22 bp, Homo sapiens
caagtccatcagataagcaaga

SEQ ID NO: 9135048 - DNA, 22 bp, Homo sapiens
caagggctcacggtctgctggg

SEQ ID NO: 9135049 - DNA, 22 bp, Homo sapiens
caagggagttactgagggcggg

SEQ ID NO: 9135050 - DNA, 22 bp, Homo sapiens
caagggagttgctgcatgcagg

SEQ ID NO: 9135051 - DNA, 22 bp, Homo sapiens
caaggaaaaagcgagctcgggg

SEQ ID NO: 9135052 - DNA, 22 bp, Homo sapiens
caagcttaagacagaagaggca

SEQ ID NO: 9135053 - DNA, 22 bp, Homo sapiens
caagctggtatcagctagagcg

SEQ ID NO: 9135054 - DNA, 22 bp, Homo sapiens
caaggaaaacagatgatcaaca

SEQ ID NO: 9135055 - DNA, 22 bp, Homo sapiens
caaggaaaacagatgatcaaca

SEQ ID NO: 9135056 - DNA, 22 bp, Homo sapiens
caaggaaacatgaaatgcattg

SEQ ID NO: 9135057 - DNA, 22 bp, Homo sapiens
caaggaaaagaagtatttcaga

SEQ ID NO: 9135058 - DNA, 22 bp, Homo sapiens
caagctggaggttggagctact

SEQ ID NO: 9135059 - DNA, 22 bp, Homo sapiens
caagctgggtgcgggcagtata

SEQ ID NO: 9135060 - DNA, 22 bp, Homo sapiens
agcaattttctaagcaaaatac

SEQ ID NO: 9135061 - DNA, 21 bp, Homo sapiens
agcaatttttcctcctctgca

SEQ ID NO: 9135062 - DNA, 22 bp, Homo sapiens
agcaattttcccttagtctttg

SEQ ID NO: 9135063 - DNA, 22 bp, Homo sapiens
agcaattggaatttagacaaga

SEQ ID NO: 9135064 - DNA, 22 bp, Homo sapiens
agcaatttctcgcaccagacgc

SEQ ID NO: 9135065 - DNA, 22 bp, Homo sapiens
agcaatttcccatctcttctgc

SEQ ID NO: 9135066 - DNA, 22 bp, Homo sapiens
agcaatttcccatctcttctgc

SEQ ID NO: 9135067 - DNA, 21 bp, Homo sapiens
agcaatttcatttggtttaac

SEQ ID NO: 9135068 - DNA, 21 bp, Homo sapiens
agcagacagcccaagaaaatc

SEQ ID NO: 9135069 - DNA, 21 bp, Homo sapiens
agcagacagatgcacgcacac

SEQ ID NO: 9135070 - DNA, 22 bp, Homo sapiens
agcagacatatctcatgtcaca

SEQ ID NO: 9135071 - DNA, 22 bp, Homo sapiens
caaggaaggagagatgatgggt

SEQ ID NO: 9135072 - DNA, 22 bp, Homo sapiens
caaggaagacccacgcagatat

SEQ ID NO: 9135073 - DNA, 22 bp, Homo sapiens
caaggaagttttaggagaggaa

SEQ ID NO: 9135074 - DNA, 22 bp, Homo sapiens
caaggaagttttaggagaggaa

SEQ ID NO: 9135075 - DNA, 22 bp, Homo sapiens
caagggaaggctaagggcaaca

SEQ ID NO: 9135076 - DNA, 22 bp, Homo sapiens
caaggcatttcgcttagagaga

SEQ ID NO: 9135077 - DNA, 22 bp, Homo sapiens
agcagagacatgaaatatgctt

SEQ ID NO: 9135078 - DNA, 22 bp, Homo sapiens
agcagacatggcttggatgtgg

SEQ ID NO: 9135079 - DNA, 22 bp, Homo sapiens
agcagaccaggagtgcacaggt

SEQ ID NO: 9135080 - DNA, 22 bp, Homo sapiens
agcagagaagacacaggcttca

SEQ ID NO: 9135081 - DNA, 22 bp, Homo sapiens
agcagagaagacacaggcttca

SEQ ID NO: 9135082 - DNA, 22 bp, Homo sapiens
caatttttgtacttatagtact

SEQ ID NO: 9135083 - DNA, 22 bp, Homo sapiens
cacacagaaccgctcgccactt

SEQ ID NO: 9135084 - DNA, 22 bp, Homo sapiens
cacacatcaacctagacattgt

SEQ ID NO: 9135085 - DNA, 22 bp, Homo sapiens
cacacatcttatcccagttatt

SEQ ID NO: 9135086 - DNA, 22 bp, Homo sapiens
caatttttgtacttatagtact

SEQ ID NO: 9135087 - DNA, 22 bp, Homo sapiens
caatttttgtacttatagtact

SEQ ID NO: 9135088 - DNA, 22 bp, Homo sapiens
caattttactcttcctcttcca

SEQ ID NO: 9135089 - DNA, 18 bp, Homo sapiens
caattttacccagtccct

SEQ ID NO: 9135090 - DNA, 22 bp, Homo sapiens
caattttattggtccaaataca

SEQ ID NO: 9135091 - DNA, 22 bp, Homo sapiens
caattcaacttgcctttgtagc

SEQ ID NO: 9135092 - DNA, 22 bp, Homo sapiens
caattcaagttgagtacagctt

SEQ ID NO: 9135093 - DNA, 22 bp, Homo sapiens
caattcaatggcaaagtattgt

SEQ ID NO: 9135094 - DNA, 22 bp, Homo sapiens
caatttctggaactaattctga

SEQ ID NO: 9135095 - DNA, 22 bp, Homo sapiens
caatttctgggcctcacacaag

SEQ ID NO: 9135096 - DNA, 22 bp, Homo sapiens
caatttcttgttaattctcagg

SEQ ID NO: 9135097 - DNA, 22 bp, Homo sapiens
cacacttttggcatgtttggtt

SEQ ID NO: 9135098 - DNA, 22 bp, Homo sapiens
cacagaaaaaggcttgaaaatc

SEQ ID NO: 9135099 - DNA, 22 bp, Homo sapiens
cacagaaaaaggcttgaaaatc

SEQ ID NO: 9135100 - DNA, 22 bp, Homo sapiens
cacacatgtctctccatgctct

SEQ ID NO: 9135101 - DNA, 22 bp, Homo sapiens
cacacatgtctctccatgctct

SEQ ID NO: 9135102 - DNA, 22 bp, Homo sapiens
cacaggaaaataaaagatctaa

SEQ ID NO: 9135103 - DNA, 22 bp, Homo sapiens
cacaggaaagtcagccagaaga

SEQ ID NO: 9135104 - DNA, 22 bp, Homo sapiens
cacaggaaagtcagccagaaga

SEQ ID NO: 9135105 - DNA, 20 bp, Homo sapiens
cacaggaaagctactcagtt

SEQ ID NO: 9135106 - DNA, 22 bp, Homo sapiens
cacagctggggaagctgaggcc

SEQ ID NO: 9135107 - DNA, 22 bp, Homo sapiens
cacagctggggaagctgaggcc

SEQ ID NO: 9135108 - DNA, 22 bp, Homo sapiens
cacagctgcttgttagaatagc

SEQ ID NO: 9135109 - DNA, 22 bp, Homo sapiens
cacaggaaatgattctgcagca

SEQ ID NO: 9135110 - DNA, 22 bp, Homo sapiens
cacaggaacttactggccactt

SEQ ID NO: 9135111 - DNA, 22 bp, Homo sapiens
cacaggaagatctcccagaggt

SEQ ID NO: 9135112 - DNA, 22 bp, Homo sapiens
cacagcagcgttcctccgtgtg

SEQ ID NO: 9135113 - DNA, 22 bp, Homo sapiens
cacagcagcgttcctccgtgtg

SEQ ID NO: 9135114 - DNA, 22 bp, Homo sapiens
cacagctgaccaccctgctccc

SEQ ID NO: 9135115 - DNA, 22 bp, Homo sapiens
cacagaaatattgtgtcccttg

SEQ ID NO: 9135116 - DNA, 22 bp, Homo sapiens
cacagctgccctactccatgtg

SEQ ID NO: 9135117 - DNA, 22 bp, Homo sapiens
cacagctggaatggggtacctg

SEQ ID NO: 9135118 - DNA, 22 bp, Homo sapiens
cacagctgccctactccatgtg

SEQ ID NO: 9135119 - DNA, 22 bp, Homo sapiens
cacagctgccctaactgtactc

SEQ ID NO: 9135120 - DNA, 22 bp, Homo sapiens
cacagctgccatgcagtcagtg

SEQ ID NO: 9135121 - DNA, 22 bp, Homo sapiens
cacagctgccatgcagtcagtg

SEQ ID NO: 9135122 - DNA, 22 bp, Homo sapiens
cacagctgccatggctgcactt

SEQ ID NO: 9135123 - DNA, 22 bp, Homo sapiens
cacagctgccatgcagtcagtg

SEQ ID NO: 9135124 - DNA, 20 bp, Homo sapiens
cagaaagaaggtagattttt

SEQ ID NO: 9135125 - DNA, 22 bp, Homo sapiens
cagaaactttggccctcaagcc

SEQ ID NO: 9135126 - DNA, 22 bp, Homo sapiens
cagaaactttctttactgagca

SEQ ID NO: 9135127 - DNA, 22 bp, Homo sapiens
cagaaactgtggattcattaaa

SEQ ID NO: 9135128 - DNA, 22 bp, Homo sapiens
cagaaactgcttgtggtcatct

SEQ ID NO: 9135129 - DNA, 22 bp, Homo sapiens
cagaaacttctggtgtcaaata

SEQ ID NO: 9135130 - DNA, 22 bp, Homo sapiens
cagaaactatgtaagaaagtga

SEQ ID NO: 9135131 - DNA, 22 bp, Homo sapiens
cagaaactgctcccctggtagg

SEQ ID NO: 9135132 - DNA, 22 bp, Homo sapiens
cagaaactagatttagacacaa

SEQ ID NO: 9135133 - DNA, 22 bp, Homo sapiens
cagaaacatgtataaagttgta

SEQ ID NO: 9135134 - DNA, 22 bp, Homo sapiens
cagaaaccaaatgggatgggga

SEQ ID NO: 9135135 - DNA, 22 bp, Homo sapiens
cagaaacctgtctggagtggga

SEQ ID NO: 9135136 - DNA, 20 bp, Homo sapiens
agccaaaggagaacagtgct

SEQ ID NO: 9135137 - DNA, 20 bp, Homo sapiens
agccaaaggagaacagtgct

SEQ ID NO: 9135138 - DNA, 22 bp, Homo sapiens
agccaaaggcaccagagacact

SEQ ID NO: 9135139 - DNA, 22 bp, Homo sapiens
agccaaagatcagtgtgcaagt

SEQ ID NO: 9135140 - DNA, 22 bp, Homo sapiens
agccaaagatcagtgtgcaagt

SEQ ID NO: 9135141 - DNA, 22 bp, Homo sapiens
agccaactaattaaacaacttt

SEQ ID NO: 9135142 - DNA, 22 bp, Homo sapiens
agccaaagtggtatatagggaa

SEQ ID NO: 9135143 - DNA, 22 bp, Homo sapiens
cagaaagacctgggctcaagag

SEQ ID NO: 9135144 - DNA, 22 bp, Homo sapiens
cagaaagacctgggctcaagag

SEQ ID NO: 9135145 - DNA, 22 bp, Homo sapiens
cagaaagacctgattggcagtt

SEQ ID NO: 9135146 - DNA, 22 bp, Homo sapiens
cagaaagacctgattggcagtt

SEQ ID NO: 9135147 - DNA, 20 bp, Homo sapiens
cagaaagaaggtagattttt

SEQ ID NO: 9135148 - DNA, 22 bp, Homo sapiens
cagaaagacctgattggcagtt

SEQ ID NO: 9135149 - DNA, 22 bp, Homo sapiens
cagaaagacctgattggcagtt

SEQ ID NO: 9135150 - DNA, 22 bp, Homo sapiens
cactgggcaattctgagcctaa

SEQ ID NO: 9135151 - DNA, 22 bp, Homo sapiens
cactgggcaattctgagcctaa

SEQ ID NO: 9135152 - DNA, 17 bp, Homo sapiens
agcatttgtgttaacag

SEQ ID NO: 9135153 - DNA, 22 bp, Homo sapiens
cactgggcgtgtcctgggtgag

SEQ ID NO: 9135154 - DNA, 23 bp, Homo sapiens
cactgggcccagggtgtggaggc

SEQ ID NO: 9135155 - DNA, 22 bp, Homo sapiens
cactgggctgataccaggcttc

SEQ ID NO: 9135156 - DNA, 20 bp, Homo sapiens
cactgggctggagtcagggc

SEQ ID NO: 9135157 - DNA, 22 bp, Homo sapiens
cactggtagcagttaagttagg

SEQ ID NO: 9135158 - DNA, 22 bp, Homo sapiens
cactggtagtttcagcaaccag

SEQ ID NO: 9135159 - DNA, 22 bp, Homo sapiens
cactggtcagtcggtcagtctc

SEQ ID NO: 9135160 - DNA, 22 bp, Homo sapiens
cactggtatttgaaaatagatg

SEQ ID NO: 9135161 - DNA, 22 bp, Homo sapiens
cactttgcagggtggtgggagg

SEQ ID NO: 9135162 - DNA, 22 bp, Homo sapiens
cactggtacgtaggttggggca

SEQ ID NO: 9135163 - DNA, 21 bp, Homo sapiens
cactggtagatggcccgcagg

SEQ ID NO: 9135164 - DNA, 22 bp, Homo sapiens
cactggtagagagaagacaagg

SEQ ID NO: 9135165 - DNA, 22 bp, Homo sapiens
cactggtacactgaatggcgtt

SEQ ID NO: 9135166 - DNA, 22 bp, Homo sapiens
cactgggtaaatttgaggctga

SEQ ID NO: 9135167 - DNA, 22 bp, Homo sapiens
cactggggtgggcctggtagag

SEQ ID NO: 9135168 - DNA, 22 bp, Homo sapiens
cactgcaacctccacctcctgg

SEQ ID NO: 9135169 - DNA, 22 bp, Homo sapiens
cactgcaacctccacctcctgg

SEQ ID NO: 9135170 - DNA, 22 bp, Homo sapiens
cactgcaacctccacctcctgg

SEQ ID NO: 9135171 - DNA, 22 bp, Homo sapiens
cactgcactccatcctgggaaa

SEQ ID NO: 9135172 - DNA, 22 bp, Homo sapiens
cactgcactccatcctgggaaa

SEQ ID NO: 9135173 - DNA, 22 bp, Homo sapiens
cactgcactccagcccgggcaa

SEQ ID NO: 9135174 - DNA, 22 bp, Homo sapiens
cactgcactccagcccgggcaa

SEQ ID NO: 9135175 - DNA, 22 bp, Homo sapiens
cactgcactccagcccgggcaa

SEQ ID NO: 9135176 - DNA, 22 bp, Homo sapiens
agcatttatttcttagaaattg

SEQ ID NO: 9135177 - DNA, 22 bp, Homo sapiens
agcatttgaaaactatttaatt

SEQ ID NO: 9135178 - DNA, 20 bp, Homo sapiens
agcatttgaaatatgactat

SEQ ID NO: 9135179 - DNA, 22 bp, Homo sapiens
agcatttatgactaatgtaaaa

SEQ ID NO: 9135180 - DNA, 22 bp, Homo sapiens
agcatttaggagaatttgagaa

SEQ ID NO: 9135181 - DNA, 22 bp, Homo sapiens
agcatttagtctttattgcagc

SEQ ID NO: 9135182 - DNA, 22 bp, Homo sapiens
cactgcacttcagcctgggtga

SEQ ID NO: 9135183 - DNA, 22 bp, Homo sapiens
cactgcactccatcctgggaaa

SEQ ID NO: 9135184 - DNA, 22 bp, Homo sapiens
cactgcacttcagcctgggtga

SEQ ID NO: 9135185 - DNA, 20 bp, Homo sapiens
agcatttagcctttatccac

SEQ ID NO: 9135186 - DNA, 22 bp, Homo sapiens
cacattgaacttgtctggtggg

SEQ ID NO: 9135187 - DNA, 22 bp, Homo sapiens
cacattgctaggctcttcctca

SEQ ID NO: 9135188 - DNA, 22 bp, Homo sapiens
cacattgtagagattagaaaga

SEQ ID NO: 9135189 - DNA, 22 bp, Homo sapiens
cactacaggggtccacagctga

SEQ ID NO: 9135190 - DNA, 22 bp, Homo sapiens
agcaggtggccacgaggaggag

SEQ ID NO: 9135191 - DNA, 22 bp, Homo sapiens
agcaggtgggcatgaaagctga

SEQ ID NO: 9135192 - DNA, 22 bp, Homo sapiens
cactaagttggtgttaattagt

SEQ ID NO: 9135193 - DNA, 22 bp, Homo sapiens
agcaggtggacagaggaagaaa

SEQ ID NO: 9135194 - DNA, 22 bp, Homo sapiens
cacatggaagagatacagtgag

SEQ ID NO: 9135195 - DNA, 23 bp, Homo sapiens
cacatggaatcttcagagtcacc

SEQ ID NO: 9135196 - DNA, 22 bp, Homo sapiens
cacatgggtggatggatgcatg

SEQ ID NO: 9135197 - DNA, 19 bp, Homo sapiens
agcaggctaggctgcctct

SEQ ID NO: 9135198 - DNA, 19 bp, Homo sapiens
agcaggctaggctgcctct

SEQ ID NO: 9135199 - DNA, 21 bp, Homo sapiens
agcaggcccaatggagggggc

SEQ ID NO: 9135200 - DNA, 22 bp, Homo sapiens
agcaggcctcatgcaccagcta

SEQ ID NO: 9135201 - DNA, 18 bp, Homo sapiens
agcaggcgttgcctggga

SEQ ID NO: 9135202 - DNA, 22 bp, Homo sapiens
cagagtgaacagtgggatgtgc

SEQ ID NO: 9135203 - DNA, 22 bp, Homo sapiens
cagaggagtgggccgttatggt

SEQ ID NO: 9135204 - DNA, 22 bp, Homo sapiens
cagaggagtgggccgttatggt

SEQ ID NO: 9135205 - DNA, 22 bp, Homo sapiens
cagaggaggcggtatacactgc

SEQ ID NO: 9135206 - DNA, 20 bp, Homo sapiens
cagaggagtacatatgttca

SEQ ID NO: 9135207 - DNA, 20 bp, Homo sapiens
cagaggagtacatatgttca

SEQ ID NO: 9135208 - DNA, 22 bp, Homo sapiens
cagagtgaaataggggatcaag

SEQ ID NO: 9135209 - DNA, 22 bp, Homo sapiens
cagaggaggcggtatacactgc

SEQ ID NO: 9135210 - DNA, 17 bp, Homo sapiens
cagaggagctttggggg

SEQ ID NO: 9135211 - DNA, 22 bp, Homo sapiens
cagaggaggccaccgcataggc

SEQ ID NO: 9135212 - DNA, 18 bp, Homo sapiens
cagaggagagacattcag

SEQ ID NO: 9135213 - DNA, 18 bp, Homo sapiens
cagaggagagacattcag

SEQ ID NO: 9135214 - DNA, 18 bp, Homo sapiens
cagaggagagacattcag

SEQ ID NO: 9135215 - DNA, 18 bp, Homo sapiens
cagaggagagacattcag

SEQ ID NO: 9135216 - DNA, 22 bp, Homo sapiens
cagaggagaattgcgggatcat

SEQ ID NO: 9135217 - DNA, 22 bp, Homo sapiens
cagagcttaaaactccatggaa

SEQ ID NO: 9135218 - DNA, 22 bp, Homo sapiens
cagaggagaattgcgggatcat

SEQ ID NO: 9135219 - DNA, 22 bp, Homo sapiens
agccctcgtttctgcatcctgt

SEQ ID NO: 9135220 - DNA, 18 bp, Homo sapiens
cagagtgggccaagagac

SEQ ID NO: 9135221 - DNA, 22 bp, Homo sapiens
agccctcttcccagatgcctca

SEQ ID NO: 9135222 - DNA, 22 bp, Homo sapiens
agccctgggctgtagataagca

SEQ ID NO: 9135223 - DNA, 22 bp, Homo sapiens
agcccttagtacatttctcaag

SEQ ID NO: 9135224 - DNA, 22 bp, Homo sapiens
agcccttggtattttccgatcc

SEQ ID NO: 9135225 - DNA, 22 bp, Homo sapiens
agcccttgagtgtatctcaaat

SEQ ID NO: 9135226 - DNA, 22 bp, Homo sapiens
agcctaatgcttttcccaaagt

SEQ ID NO: 9135227 - DNA, 22 bp, Homo sapiens
agcctagggggtcctgggccac

SEQ ID NO: 9135228 - DNA, 22 bp, Homo sapiens
agcctagaagaagtggctactt

SEQ ID NO: 9135229 - DNA, 22 bp, Homo sapiens
agcctaggaggttggggctgca

SEQ ID NO: 9135230 - DNA, 22 bp, Homo sapiens
agcctaggtctgggtctagcag

SEQ ID NO: 9135231 - DNA, 22 bp, Homo sapiens
agcctgcttcctcagggaacaa

SEQ ID NO: 9135232 - DNA, 22 bp, Homo sapiens
cagatctgtggtatctctattt

SEQ ID NO: 9135233 - DNA, 22 bp, Homo sapiens
agcctggacagctacggagaac

SEQ ID NO: 9135234 - DNA, 22 bp, Homo sapiens
agcctggaggccaggagacagt

SEQ ID NO: 9135235 - DNA, 22 bp, Homo sapiens
agcctggaggccaggagacagt

SEQ ID NO: 9135236 - DNA, 22 bp, Homo sapiens
agcctggaggaggagttgagca

SEQ ID NO: 9135237 - DNA, 18 bp, Homo sapiens
agcctggagggttgaagt

SEQ ID NO: 9135238 - DNA, 22 bp, Homo sapiens
cagcactgctgctgtacacaca

SEQ ID NO: 9135239 - DNA, 22 bp, Homo sapiens
cagagcagtagaaaacagcctt

SEQ ID NO: 9135240 - DNA, 18 bp, Homo sapiens
cagagcagtatgaatgtt

SEQ ID NO: 9135241 - DNA, 22 bp, Homo sapiens
cagagcagtagaaaacagcctt

SEQ ID NO: 9135242 - DNA, 22 bp, Homo sapiens
cagagcagtctggagatccagc

SEQ ID NO: 9135243 - DNA, 22 bp, Homo sapiens
cagagcagtctggagatccagc

SEQ ID NO: 9135244 - DNA, 22 bp, Homo sapiens
cagagccagggctaggaactgg

SEQ ID NO: 9135245 - DNA, 22 bp, Homo sapiens
cagagccagggttgcacccctg

SEQ ID NO: 9135246 - DNA, 20 bp, Homo sapiens
cagagccagggttttgtttt

SEQ ID NO: 9135247 - DNA, 22 bp, Homo sapiens
cagagccagtcagtcagaaact

SEQ ID NO: 9135248 - DNA, 22 bp, Homo sapiens
cagagccaggtggtgttggggc

SEQ ID NO: 9135249 - DNA, 22 bp, Homo sapiens
cagagccaggtctaggagtctc

SEQ ID NO: 9135250 - DNA, 22 bp, Homo sapiens
cagagccaggtctaggagtctc

SEQ ID NO: 9135251 - DNA, 20 bp, Homo sapiens
cagagctgttatggatgatg

SEQ ID NO: 9135252 - DNA, 22 bp, Homo sapiens
cagagctgttactattcatgaa

SEQ ID NO: 9135253 - DNA, 20 bp, Homo sapiens
cagagctgttatggatgatg

SEQ ID NO: 9135254 - DNA, 22 bp, Homo sapiens
cagagctgttgcggggcttggc

SEQ ID NO: 9135255 - DNA, 22 bp, Homo sapiens
cagagctgtccaaaccctgaca

SEQ ID NO: 9135256 - DNA, 22 bp, Homo sapiens
cagagctgtccaaaccctgaca

SEQ ID NO: 9135257 - DNA, 22 bp, Homo sapiens
cagagctgtgataaatagatat

SEQ ID NO: 9135258 - DNA, 22 bp, Homo sapiens
cagagctgttactattcatgaa

SEQ ID NO: 9135259 - DNA, 22 bp, Homo sapiens
cagagctgttactattcatgaa

SEQ ID NO: 9135260 - DNA, 22 bp, Homo sapiens
cagagctgtgataaatagatat

SEQ ID NO: 9135261 - DNA, 22 bp, Homo sapiens
cagagccatccaggtgcctgtt

SEQ ID NO: 9135262 - DNA, 23 bp, Homo sapiens
cagagctggctcagagctgcctg

SEQ ID NO: 9135263 - DNA, 21 bp, Homo sapiens
cagagctgtccaaaccctgac

SEQ ID NO: 9135264 - DNA, 21 bp, Homo sapiens
cagagctgtccaaaccctgac

SEQ ID NO: 9135265 - DNA, 21 bp, Homo sapiens
cagagctgtccaaaccctgac

SEQ ID NO: 9135266 - DNA, 22 bp, Homo sapiens
agccaagcactcaactcctgga

SEQ ID NO: 9135267 - DNA, 22 bp, Homo sapiens
agccaactccctctcattgagc

SEQ ID NO: 9135268 - DNA, 22 bp, Homo sapiens
agccaggctgcagttggctggc

SEQ ID NO: 9135269 - DNA, 22 bp, Homo sapiens
agccaggctgcagttggctggc

SEQ ID NO: 9135270 - DNA, 16 bp, Homo sapiens
agccaggctgcctcgg

SEQ ID NO: 9135271 - DNA, 22 bp, Homo sapiens
agccagggacgctgcaggctac

SEQ ID NO: 9135272 - DNA, 22 bp, Homo sapiens
agccagggatggcagtgcccag

SEQ ID NO: 9135273 - DNA, 22 bp, Homo sapiens
agccagggacgctgcaggctac

SEQ ID NO: 9135274 - DNA, 22 bp, Homo sapiens
agccagggacgctgcaggctac

SEQ ID NO: 9135275 - DNA, 22 bp, Homo sapiens
agccagggacgctgcaggctac

SEQ ID NO: 9135276 - DNA, 22 bp, Homo sapiens
agccagggaggtggaggttgca

SEQ ID NO: 9135277 - DNA, 22 bp, Homo sapiens
agccagggaggtggaggttgca

SEQ ID NO: 9135278 - DNA, 22 bp, Homo sapiens
agccaggggagtcagctgctgg

SEQ ID NO: 9135279 - DNA, 22 bp, Homo sapiens
agccagggctgcaggttccttg

SEQ ID NO: 9135280 - DNA, 22 bp, Homo sapiens
agccagggctgcgagcagacag

SEQ ID NO: 9135281 - DNA, 19 bp, Homo sapiens
cagcccagggtgctaccaa

SEQ ID NO: 9135282 - DNA, 22 bp, Homo sapiens
cagcccaggtctctcttccagt

SEQ ID NO: 9135283 - DNA, 19 bp, Homo sapiens
cagcccagggtgctaccaa

SEQ ID NO: 9135284 - DNA, 22 bp, Homo sapiens
cagcccaggtctctcttccagt

SEQ ID NO: 9135285 - DNA, 22 bp, Homo sapiens
cagcccaggtctctcttccagt

SEQ ID NO: 9135286 - DNA, 22 bp, Homo sapiens
cagcccaggtctctcttccagt

SEQ ID NO: 9135287 - DNA, 22 bp, Homo sapiens
cagcccaggtctctcttccagt

SEQ ID NO: 9135288 - DNA, 22 bp, Homo sapiens
cagcccagtaccaagcagttgg

SEQ ID NO: 9135289 - DNA, 22 bp, Homo sapiens
cagcccatggtttgtggccagt

SEQ ID NO: 9135290 - DNA, 23 bp, Homo sapiens
cagcccatggcattttttacagt

SEQ ID NO: 9135291 - DNA, 22 bp, Homo sapiens
cagcccatctagctttagagat

SEQ ID NO: 9135292 - DNA, 22 bp, Homo sapiens
cagcccatccaaggcttggcat

SEQ ID NO: 9135293 - DNA, 22 bp, Homo sapiens
cagcccataccagaagtggagt

SEQ ID NO: 9135294 - DNA, 22 bp, Homo sapiens
cagcccattcctgccatgccgc

SEQ ID NO: 9135295 - DNA, 22 bp, Homo sapiens
cagcccatttctgggacctgag

SEQ ID NO: 9135296 - DNA, 22 bp, Homo sapiens
cagcccattccttcctgggggt

SEQ ID NO: 9135297 - DNA, 22 bp, Homo sapiens
cagcctcctgggacactcaccg

SEQ ID NO: 9135298 - DNA, 22 bp, Homo sapiens
cagcctctaagcacagcctctc

SEQ ID NO: 9135299 - DNA, 22 bp, Homo sapiens
cagcccagagaaggggcccgtg

SEQ ID NO: 9135300 - DNA, 22 bp, Homo sapiens
cagcccagagatgttatctagt

SEQ ID NO: 9135301 - DNA, 19 bp, Homo sapiens
cagcccagggtgctaccaa

SEQ ID NO: 9135302 - DNA, 22 bp, Homo sapiens
cagcccagaactcacgtctcca

SEQ ID NO: 9135303 - DNA, 22 bp, Homo sapiens
cagcccagacaccatcattcta

SEQ ID NO: 9135304 - DNA, 22 bp, Homo sapiens
cagccagctggcactgtgagta

SEQ ID NO: 9135305 - DNA, 22 bp, Homo sapiens
cagccagtggttgaagatgcag

SEQ ID NO: 9135306 - DNA, 22 bp, Homo sapiens
cagccagtggttgaagatgcag

SEQ ID NO: 9135307 - DNA, 22 bp, Homo sapiens
cagccagctggcactgtgagta

SEQ ID NO: 9135308 - DNA, 22 bp, Homo sapiens
cagccagtgtgaccgaggagga

SEQ ID NO: 9135309 - DNA, 22 bp, Homo sapiens
cagccatactgacatcaacaaa

SEQ ID NO: 9135310 - DNA, 22 bp, Homo sapiens
cagcccacgtcagggccactca

SEQ ID NO: 9135311 - DNA, 22 bp, Homo sapiens
cagcccacgtcagggccactca

SEQ ID NO: 9135312 - DNA, 22 bp, Homo sapiens
cagcccactgcctctgtggtag

SEQ ID NO: 9135313 - DNA, 22 bp, Homo sapiens
cagcccaaagccccaggctaga

SEQ ID NO: 9135314 - DNA, 22 bp, Homo sapiens
cagcactgtgataactgagcca

SEQ ID NO: 9135315 - DNA, 22 bp, Homo sapiens
cagcactggggggattcggagc

SEQ ID NO: 9135316 - DNA, 22 bp, Homo sapiens
cagcactggggccactggagtt

SEQ ID NO: 9135317 - DNA, 22 bp, Homo sapiens
cagcactgggaccactagaaca

SEQ ID NO: 9135318 - DNA, 22 bp, Homo sapiens
cagcactttagcggaggcatca

SEQ ID NO: 9135319 - DNA, 22 bp, Homo sapiens
cagcacttggtgccattgagtg

SEQ ID NO: 9135320 - DNA, 22 bp, Homo sapiens
cagcactgttcccagaccactg

SEQ ID NO: 9135321 - DNA, 22 bp, Homo sapiens
cagcacttcagcattcagattt

SEQ ID NO: 9135322 - DNA, 22 bp, Homo sapiens
cagcactgtgataactgagcca

SEQ ID NO: 9135323 - DNA, 22 bp, Homo sapiens
cagcatggcttgagtgtttcct

SEQ ID NO: 9135324 - DNA, 22 bp, Homo sapiens
cagcatggagacaaagtgggca

SEQ ID NO: 9135325 - DNA, 22 bp, Homo sapiens
cagcatggccatttctcgctgc

SEQ ID NO: 9135326 - DNA, 22 bp, Homo sapiens
cagcatggggatcactgtaggc

SEQ ID NO: 9135327 - DNA, 22 bp, Homo sapiens
cagcatggggatcactgtaggc

SEQ ID NO: 9135328 - DNA, 22 bp, Homo sapiens
cagcatggacccatcgctgagt

SEQ ID NO: 9135329 - DNA, 22 bp, Homo sapiens
cagcatggagacaaagtgggca

SEQ ID NO: 9135330 - DNA, 22 bp, Homo sapiens
cagcatggacccatcgctgagt

SEQ ID NO: 9135331 - DNA, 22 bp, Homo sapiens
cagcatggagacaaagtgggca

SEQ ID NO: 9135332 - DNA, 22 bp, Homo sapiens
cagcagaaaatacctgtaactc

SEQ ID NO: 9135333 - DNA, 22 bp, Homo sapiens
cagcagaaaatacctgtaactc

SEQ ID NO: 9135334 - DNA, 22 bp, Homo sapiens
cagcagaaaatgtgggtgattt

SEQ ID NO: 9135335 - DNA, 22 bp, Homo sapiens
cagcatggacaggggtggcgtt

SEQ ID NO: 9135336 - DNA, 22 bp, Homo sapiens
agcgaggtgagtcctccagctc

SEQ ID NO: 9135337 - DNA, 22 bp, Homo sapiens
agcgccactgcactccagcctg

SEQ ID NO: 9135338 - DNA, 22 bp, Homo sapiens
cagcatgggttccgggggcctg

SEQ ID NO: 9135339 - DNA, 22 bp, Homo sapiens
cagcatgggttccgggggcctg

SEQ ID NO: 9135340 - DNA, 22 bp, Homo sapiens
cagcatggtgccagtgagtcca

SEQ ID NO: 9135341 - DNA, 22 bp, Homo sapiens
cagcatggggcttggagtcagc

SEQ ID NO: 9135342 - DNA, 22 bp, Homo sapiens
cagcatgggggcaattcaggtg

SEQ ID NO: 9135343 - DNA, 22 bp, Homo sapiens
cagcatggggcttggagtcagc

SEQ ID NO: 9135344 - DNA, 22 bp, Homo sapiens
cagcatggtgccagtgagtcca

SEQ ID NO: 9135345 - DNA, 22 bp, Homo sapiens
cagcatggttgggttctgggga

SEQ ID NO: 9135346 - DNA, 22 bp, Homo sapiens
cagcatggtggagctgctcttt

SEQ ID NO: 9135347 - DNA, 22 bp, Homo sapiens
agcgaaattatttcaggtttgg

SEQ ID NO: 9135348 - DNA, 22 bp, Homo sapiens
agcgacagaaaccaaggacaag

SEQ ID NO: 9135349 - DNA, 22 bp, Homo sapiens
cagcctttgggtcagaagattc

SEQ ID NO: 9135350 - DNA, 22 bp, Homo sapiens
cagcctttgtgaacatcaggtg

SEQ ID NO: 9135351 - DNA, 22 bp, Homo sapiens
cagccttttaggactatttgtg

SEQ ID NO: 9135352 - DNA, 22 bp, Homo sapiens
cagcgctggggtaggagcacct

SEQ ID NO: 9135353 - DNA, 22 bp, Homo sapiens
cagcgtctcgttgtgggcctcg

SEQ ID NO: 9135354 - DNA, 22 bp, Homo sapiens
cagcggggcctgtgctggggag

SEQ ID NO: 9135355 - DNA, 22 bp, Homo sapiens
cagccttgatggatgaggaagt

SEQ ID NO: 9135356 - DNA, 22 bp, Homo sapiens
cagcctttatctcctgggctca

SEQ ID NO: 9135357 - DNA, 22 bp, Homo sapiens
cagcctttatggaaaggcctgg

SEQ ID NO: 9135358 - DNA, 22 bp, Homo sapiens
cagcctctgtggctgccacacc

SEQ ID NO: 9135359 - DNA, 18 bp, Homo sapiens
cagcctctgattggttgc

SEQ ID NO: 9135360 - DNA, 22 bp, Homo sapiens
cagctgccagcttctctccatc

SEQ ID NO: 9135361 - DNA, 22 bp, Homo sapiens
cagctgccatgacatgtcctgc

SEQ ID NO: 9135362 - DNA, 18 bp, Homo sapiens
cagctgccagctcatgga

SEQ ID NO: 9135363 - DNA, 22 bp, Homo sapiens
agctctggacctgacatctggt

SEQ ID NO: 9135364 - DNA, 22 bp, Homo sapiens
agctctggacctgacatctggt

SEQ ID NO: 9135365 - DNA, 21 bp, Homo sapiens
agctctggagcagcaatcaag

SEQ ID NO: 9135366 - DNA, 22 bp, Homo sapiens
cagctgggtggctcttctgctc

SEQ ID NO: 9135367 - DNA, 22 bp, Homo sapiens
cagctgggtgatcttgggcagg

SEQ ID NO: 9135368 - DNA, 22 bp, Homo sapiens
cagctgggtgatcttgggcagg

SEQ ID NO: 9135369 - DNA, 22 bp, Homo sapiens
cagctggcagccctggccctgc

SEQ ID NO: 9135370 - DNA, 22 bp, Homo sapiens
cagctggatgggagaccatgtt

SEQ ID NO: 9135371 - DNA, 22 bp, Homo sapiens
cagctggatccctgcagaactt

SEQ ID NO: 9135372 - DNA, 22 bp, Homo sapiens
cagctggacttttgatagaagt

SEQ ID NO: 9135373 - DNA, 22 bp, Homo sapiens
cagctggaggagcagcttccag

SEQ ID NO: 9135374 - DNA, 22 bp, Homo sapiens
cagctggatccctgcagaactt

SEQ ID NO: 9135375 - DNA, 22 bp, Homo sapiens
cagctggatctgcctcgagcca

SEQ ID NO: 9135376 - DNA, 22 bp, Homo sapiens
cagctggatctgcctcgagcca

SEQ ID NO: 9135377 - DNA, 22 bp, Homo sapiens
cagctggatctgcctcgagcca

SEQ ID NO: 9135378 - DNA, 22 bp, Homo sapiens
cagctggatctgcctcgagcca

SEQ ID NO: 9135379 - DNA, 19 bp, Homo sapiens
cagctggaatcatctgagg

SEQ ID NO: 9135380 - DNA, 22 bp, Homo sapiens
cagctgctttcagcaggaggga

SEQ ID NO: 9135381 - DNA, 22 bp, Homo sapiens
cagctgctttagttttccatcc

SEQ ID NO: 9135382 - DNA, 22 bp, Homo sapiens
cagctgctttcagcaggaggga

SEQ ID NO: 9135383 - DNA, 20 bp, Homo sapiens
agctgaggcacctgaggtta

SEQ ID NO: 9135384 - DNA, 22 bp, Homo sapiens
agctctggctaagctgataaat

SEQ ID NO: 9135385 - DNA, 18 bp, Homo sapiens
agctctggcatacttgaa

SEQ ID NO: 9135386 - DNA, 23 bp, Homo sapiens
agctctggcgttggggaggtagt

SEQ ID NO: 9135387 - DNA, 19 bp, Homo sapiens
agctctggattaaatttct

SEQ ID NO: 9135388 - DNA, 22 bp, Homo sapiens
agctctggcactggcgcgggat

SEQ ID NO: 9135389 - DNA, 22 bp, Homo sapiens
agctctgggattctcaggccac

SEQ ID NO: 9135390 - DNA, 22 bp, Homo sapiens
agctgaggacgtgaagggcggc

SEQ ID NO: 9135391 - DNA, 22 bp, Homo sapiens
agctgaggacgtgaagggcggc

SEQ ID NO: 9135392 - DNA, 22 bp, Homo sapiens
agctgaggaataataacaaggt

SEQ ID NO: 9135393 - DNA, 22 bp, Homo sapiens
agctgaggaggaatgatgggta

SEQ ID NO: 9135394 - DNA, 23 bp, Homo sapiens
aaatgatgtgtgttgtcccattc

SEQ ID NO: 9135395 - DNA, 22 bp, Homo sapiens
aaatgatggtactcatgtttag

SEQ ID NO: 9135396 - DNA, 22 bp, Homo sapiens
aaatgatggtactcatgtttag

SEQ ID NO: 9135397 - DNA, 22 bp, Homo sapiens
aaatgatggtactcatgtttag

SEQ ID NO: 9135398 - DNA, 20 bp, Homo sapiens
aaatgatgggaataatctat

SEQ ID NO: 9135399 - DNA, 22 bp, Homo sapiens
aaatgatgctcacagattagtg

SEQ ID NO: 9135400 - DNA, 22 bp, Homo sapiens
aaatgatgctacagttttccca

SEQ ID NO: 9135401 - DNA, 22 bp, Homo sapiens
aaatgcaaggattttgttaggc

SEQ ID NO: 9135402 - DNA, 22 bp, Homo sapiens
aaatgcaaggccatgtgaagga

SEQ ID NO: 9135403 - DNA, 22 bp, Homo sapiens
aaatgattgtcaaagttctgtt

SEQ ID NO: 9135404 - DNA, 22 bp, Homo sapiens
aaatgcacagaaaggatgtgga

SEQ ID NO: 9135405 - DNA, 22 bp, Homo sapiens
aaatgcacaataaagtaaaggc

SEQ ID NO: 9135406 - DNA, 22 bp, Homo sapiens
aaatgcaattcaggaagacaag

SEQ ID NO: 9135407 - DNA, 20 bp, Homo sapiens
aaatgctgtaatgtttggga

SEQ ID NO: 9135408 - DNA, 18 bp, Homo sapiens
aaatgctgctcaaattcc

SEQ ID NO: 9135409 - DNA, 22 bp, Homo sapiens
aaatgctgagtgtttagagatc

SEQ ID NO: 9135410 - DNA, 22 bp, Homo sapiens
aaatgctgtcagtgttattgga

SEQ ID NO: 9135411 - DNA, 19 bp, Homo sapiens
aaatgctgtggagggctcc

SEQ ID NO: 9135412 - DNA, 19 bp, Homo sapiens
aaatggaaaactttgggaa

SEQ ID NO: 9135413 - DNA, 20 bp, Homo sapiens
aaatgcttttgacacatatt

SEQ ID NO: 9135414 - DNA, 22 bp, Homo sapiens
aaatgcttcacctcattaaact

SEQ ID NO: 9135415 - DNA, 23 bp, Homo sapiens
aaatattcttttttagtaagtgc

SEQ ID NO: 9135416 - DNA, 23 bp, Homo sapiens
aaatattcttttttagtaagtgc

SEQ ID NO: 9135417 - DNA, 22 bp, Homo sapiens
aaatattggtaggatgcttgtt

SEQ ID NO: 9135418 - DNA, 22 bp, Homo sapiens
aaatattgttttggtaagcttc

SEQ ID NO: 9135419 - DNA, 22 bp, Homo sapiens
aaatatttgtctgaggcggttg

SEQ ID NO: 9135420 - DNA, 22 bp, Homo sapiens
aaatcaaaagacatgtgtttta

SEQ ID NO: 9135421 - DNA, 22 bp, Homo sapiens
aaatcacagggtctctaagtat

SEQ ID NO: 9135422 - DNA, 22 bp, Homo sapiens
aaatcaaggagggattatattt

SEQ ID NO: 9135423 - DNA, 23 bp, Homo sapiens
aaatgacatatggtttctgaagg

SEQ ID NO: 9135424 - DNA, 23 bp, Homo sapiens
aaatgacatatggtttctgaagg

SEQ ID NO: 9135425 - DNA, 23 bp, Homo sapiens
aaatgacatatggtttctgaagg

SEQ ID NO: 9135426 - DNA, 22 bp, Homo sapiens
aaatgaccagaatacaggcttc

SEQ ID NO: 9135427 - DNA, 22 bp, Homo sapiens
aaatgaggttaatacagtgctt

SEQ ID NO: 9135428 - DNA, 22 bp, Homo sapiens
aaatgaggccagatcatgcaga

SEQ ID NO: 9135429 - DNA, 22 bp, Homo sapiens
aaatgaggttaatacagtgctt

SEQ ID NO: 9135430 - DNA, 22 bp, Homo sapiens
aaatgaaatgagtgcctggagg

SEQ ID NO: 9135431 - DNA, 22 bp, Homo sapiens
aaatgaacagttgcattctctg

SEQ ID NO: 9135432 - DNA, 22 bp, Homo sapiens
aaatgaacagttgcattctctg

SEQ ID NO: 9135433 - DNA, 22 bp, Homo sapiens
aaatcagagtctgattttaagg

SEQ ID NO: 9135434 - DNA, 22 bp, Homo sapiens
aaatcagacttgaattttcatc

SEQ ID NO: 9135435 - DNA, 22 bp, Homo sapiens
aaatcagaggcaacaactactt

SEQ ID NO: 9135436 - DNA, 22 bp, Homo sapiens
aaatcagaggcaacaactactt

SEQ ID NO: 9135437 - DNA, 22 bp, Homo sapiens
aaatcagacttgaattttcatc

SEQ ID NO: 9135438 - DNA, 22 bp, Homo sapiens
aaatatagtgacacttatagtc

SEQ ID NO: 9135439 - DNA, 22 bp, Homo sapiens
aaatatagtaaatgcatagttc

SEQ ID NO: 9135440 - DNA, 22 bp, Homo sapiens
aaatatagtaaatgcatagttc

SEQ ID NO: 9135441 - DNA, 22 bp, Homo sapiens
aaatatagtgacacttatagtc

SEQ ID NO: 9135442 - DNA, 22 bp, Homo sapiens
aagagtttctgattcagtaggt

SEQ ID NO: 9135443 - DNA, 22 bp, Homo sapiens
aagagtttctttattaaccttt

SEQ ID NO: 9135444 - DNA, 22 bp, Homo sapiens
aagagtttctgggtcaaggatt

SEQ ID NO: 9135445 - DNA, 22 bp, Homo sapiens
aagagtttcttactggcatcta

SEQ ID NO: 9135446 - DNA, 22 bp, Homo sapiens
aagagtttcttactggcatcta

SEQ ID NO: 9135447 - DNA, 22 bp, Homo sapiens
aagagttttctataatcttggc

SEQ ID NO: 9135448 - DNA, 22 bp, Homo sapiens
aagagttttagacaaactgatt

SEQ ID NO: 9135449 - DNA, 22 bp, Homo sapiens
aagagtttgggcaagtcataaa

SEQ ID NO: 9135450 - DNA, 22 bp, Homo sapiens
aagagtttgtcagatctgcacg

SEQ ID NO: 9135451 - DNA, 22 bp, Homo sapiens
aagagtttgacctgtgccatcc

SEQ ID NO: 9135452 - DNA, 22 bp, Homo sapiens
aagagtttgggcaagtcataaa

SEQ ID NO: 9135453 - DNA, 22 bp, Homo sapiens
aagagtttttaatgggtactgg

SEQ ID NO: 9135454 - DNA, 22 bp, Homo sapiens
aagagtttttggagtgtgagtt

SEQ ID NO: 9135455 - DNA, 22 bp, Homo sapiens
aagagttttctctgatggcatt

SEQ ID NO: 9135456 - DNA, 22 bp, Homo sapiens
aaatatgagagtaggagtttgg

SEQ ID NO: 9135457 - DNA, 22 bp, Homo sapiens
aaatataatttctgcctcaata

SEQ ID NO: 9135458 - DNA, 22 bp, Homo sapiens
aaatagtcctgggaatagtact

SEQ ID NO: 9135459 - DNA, 22 bp, Homo sapiens
aaatataatttctgcctcaata

SEQ ID NO: 9135460 - DNA, 22 bp, Homo sapiens
aaatatagcaattatgcctact

SEQ ID NO: 9135461 - DNA, 22 bp, Homo sapiens
aagagagaccatgggggacagg

SEQ ID NO: 9135462 - DNA, 22 bp, Homo sapiens
aagagagacaataggtagcatt

SEQ ID NO: 9135463 - DNA, 22 bp, Homo sapiens
aagagagacaataggtagcatt

SEQ ID NO: 9135464 - DNA, 22 bp, Homo sapiens
aagagagacaataggtagcatt

SEQ ID NO: 9135465 - DNA, 22 bp, Homo sapiens
aagagagaagtctctctggttc

SEQ ID NO: 9135466 - DNA, 22 bp, Homo sapiens
aagagagagcattcttctgtta

SEQ ID NO: 9135467 - DNA, 22 bp, Homo sapiens
aagagagagtgcgctcacagaa

SEQ ID NO: 9135468 - DNA, 22 bp, Homo sapiens
aagagagagttcctaggcaaaa

SEQ ID NO: 9135469 - DNA, 22 bp, Homo sapiens
aagagagagttcctaggcaaaa

SEQ ID NO: 9135470 - DNA, 22 bp, Homo sapiens
aagaaggaagtgtggacatcac

SEQ ID NO: 9135471 - DNA, 22 bp, Homo sapiens
aagaagctatacataatttggg

SEQ ID NO: 9135472 - DNA, 22 bp, Homo sapiens
aagaagctgatgcagagggttc

SEQ ID NO: 9135473 - DNA, 22 bp, Homo sapiens
aagaagctgcgtggtatgtgaa

SEQ ID NO: 9135474 - DNA, 22 bp, Homo sapiens
aagaaggcggaccagaagggag

SEQ ID NO: 9135475 - DNA, 22 bp, Homo sapiens
aagaaggcggaccagaagggag

SEQ ID NO: 9135476 - DNA, 22 bp, Homo sapiens
aagaagcaggtcacagacaggg

SEQ ID NO: 9135477 - DNA, 22 bp, Homo sapiens
aaagttctttgcatctttgctc

SEQ ID NO: 9135478 - DNA, 22 bp, Homo sapiens
aaatacatacactgtacgtggc

SEQ ID NO: 9135479 - DNA, 22 bp, Homo sapiens
aaatacatacactgtacgtggc

SEQ ID NO: 9135480 - DNA, 22 bp, Homo sapiens
aagagagaactcccttcgccag

SEQ ID NO: 9135481 - DNA, 22 bp, Homo sapiens
aaatacattagacggagagtta

SEQ ID NO: 9135482 - DNA, 22 bp, Homo sapiens
aagagagaactcccttcgccag

SEQ ID NO: 9135483 - DNA, 22 bp, Homo sapiens
aaatacagtggcagcagataat

SEQ ID NO: 9135484 - DNA, 22 bp, Homo sapiens
aaatacataaaggttgtaccag

SEQ ID NO: 9135485 - DNA, 22 bp, Homo sapiens
aaatacataaaggttgtaccag

SEQ ID NO: 9135486 - DNA, 22 bp, Homo sapiens
aaatacagtgtgtgttctttga

SEQ ID NO: 9135487 - DNA, 22 bp, Homo sapiens
aaatacagtgtgtgttctttga

SEQ ID NO: 9135488 - DNA, 22 bp, Homo sapiens
aagaaggtgtggaaagatgctc

SEQ ID NO: 9135489 - DNA, 22 bp, Homo sapiens
aagaagtggtccttttctttct

SEQ ID NO: 9135490 - DNA, 22 bp, Homo sapiens
aagaagtggttggaagaagcat

SEQ ID NO: 9135491 - DNA, 22 bp, Homo sapiens
aaatacaaaaattagccaggca

SEQ ID NO: 9135492 - DNA, 22 bp, Homo sapiens
aaatacaaaaattagccaggca

SEQ ID NO: 9135493 - DNA, 22 bp, Homo sapiens
aagaagttaaataaatggacca

SEQ ID NO: 9135494 - DNA, 22 bp, Homo sapiens
aacatgaaagttgctaagtgca

SEQ ID NO: 9135495 - DNA, 23 bp, Homo sapiens
aaaggcacagcattgtctagcag

SEQ ID NO: 9135496 - DNA, 23 bp, Homo sapiens
aaaggcacagcattgtctagcag

SEQ ID NO: 9135497 - DNA, 22 bp, Homo sapiens
aaaggcactagaagttaccttt

SEQ ID NO: 9135498 - DNA, 20 bp, Homo sapiens
aaaggcacagcaacagagct

SEQ ID NO: 9135499 - DNA, 22 bp, Homo sapiens
aaaggcactggatagctgggga

SEQ ID NO: 9135500 - DNA, 22 bp, Homo sapiens
aaaggcactggatagctgggga

SEQ ID NO: 9135501 - DNA, 22 bp, Homo sapiens
aaaggcactggatagctgggga

SEQ ID NO: 9135502 - DNA, 22 bp, Homo sapiens
aaaggcactgatcttatccagt

SEQ ID NO: 9135503 - DNA, 22 bp, Homo sapiens
aaaggaatattcaaaacagtca

SEQ ID NO: 9135504 - DNA, 22 bp, Homo sapiens
aaaggcacaaattcagcatttt

SEQ ID NO: 9135505 - DNA, 22 bp, Homo sapiens
aaaggcacacactccttgttat

SEQ ID NO: 9135506 - DNA, 22 bp, Homo sapiens
aaaggcacagaagggaaaccaa

SEQ ID NO: 9135507 - DNA, 22 bp, Homo sapiens
aaagcattgtttcaagattaac

SEQ ID NO: 9135508 - DNA, 22 bp, Homo sapiens
aaagcattgtttcaagattaac

SEQ ID NO: 9135509 - DNA, 22 bp, Homo sapiens
aaagcattgtttcaagattaac

SEQ ID NO: 9135510 - DNA, 20 bp, Homo sapiens
aaagcatttacttgtgattg

SEQ ID NO: 9135511 - DNA, 20 bp, Homo sapiens
aaagcatttacttgtgattg

SEQ ID NO: 9135512 - DNA, 22 bp, Homo sapiens
aaagccaaatgaaagatggttc

SEQ ID NO: 9135513 - DNA, 22 bp, Homo sapiens
aaagccaaatgaaagatggttc

SEQ ID NO: 9135514 - DNA, 22 bp, Homo sapiens
aaagcatagaattagagttagg

SEQ ID NO: 9135515 - DNA, 22 bp, Homo sapiens
aaagcatcagatctgacacttc

SEQ ID NO: 9135516 - DNA, 22 bp, Homo sapiens
aaagcagtctcagacttaagca

SEQ ID NO: 9135517 - DNA, 22 bp, Homo sapiens
aaagcagtgcaccttaattgat

SEQ ID NO: 9135518 - DNA, 20 bp, Homo sapiens
aaagcagtatgcaagtagag

SEQ ID NO: 9135519 - DNA, 22 bp, Homo sapiens
aaagcagtatagtggaagggct

SEQ ID NO: 9135520 - DNA, 22 bp, Homo sapiens
aaagcagtataagtaacggaag

SEQ ID NO: 9135521 - DNA, 22 bp, Homo sapiens
aaagcagtagttttcaaatagt

SEQ ID NO: 9135522 - DNA, 22 bp, Homo sapiens
aaagcaggttatgaccatggcc

SEQ ID NO: 9135523 - DNA, 22 bp, Homo sapiens
aaattgtcagttatctgggata

SEQ ID NO: 9135524 - DNA, 22 bp, Homo sapiens
aaattgtaggatcacatgacct

SEQ ID NO: 9135525 - DNA, 22 bp, Homo sapiens
aaattgtaatgacttcacttga

SEQ ID NO: 9135526 - DNA, 22 bp, Homo sapiens
aaattccagaaactcagtatat

SEQ ID NO: 9135527 - DNA, 22 bp, Homo sapiens
aaattccagcaacaccttttta

SEQ ID NO: 9135528 - DNA, 22 bp, Homo sapiens
aaattccagttcttttacctgc

SEQ ID NO: 9135529 - DNA, 22 bp, Homo sapiens
aaattccattatgataatttcg

SEQ ID NO: 9135530 - DNA, 22 bp, Homo sapiens
aaattccattatgataatttcg

SEQ ID NO: 9135531 - DNA, 22 bp, Homo sapiens
aaattgctgtgaggtggtagta

SEQ ID NO: 9135532 - DNA, 22 bp, Homo sapiens
aaattgctgttgggtgactctt

SEQ ID NO: 9135533 - DNA, 22 bp, Homo sapiens
aaattgctgaccaagtatattc

SEQ ID NO: 9135534 - DNA, 22 bp, Homo sapiens
aaattgctgaccaagtatattc

SEQ ID NO: 9135535 - DNA, 22 bp, Homo sapiens
aaattgctctttaaaagtactg

SEQ ID NO: 9135536 - DNA, 22 bp, Homo sapiens
aaattgctgacacttgaccatt

SEQ ID NO: 9135537 - DNA, 22 bp, Homo sapiens
aaagggagcatggctgcaggga

SEQ ID NO: 9135538 - DNA, 22 bp, Homo sapiens
aaagtcacatataacaagggca

SEQ ID NO: 9135539 - DNA, 22 bp, Homo sapiens
aaagggagcatggctgcaggga

SEQ ID NO: 9135540 - DNA, 22 bp, Homo sapiens
aaagggaggggcgataagccgg

SEQ ID NO: 9135541 - DNA, 22 bp, Homo sapiens
aaaggctggaaactgaagataa

SEQ ID NO: 9135542 - DNA, 22 bp, Homo sapiens
aaaggcttaacagaagaccttt

SEQ ID NO: 9135543 - DNA, 22 bp, Homo sapiens
aaaggcttgcgattccttgtaa

SEQ ID NO: 9135544 - DNA, 22 bp, Homo sapiens
aaaggcttctttgctccatgtc

SEQ ID NO: 9135545 - DNA, 22 bp, Homo sapiens
aaaggctctaacaaggagagag

SEQ ID NO: 9135546 - DNA, 22 bp, Homo sapiens
aaaggctgacagggtcctaagt

SEQ ID NO: 9135547 - DNA, 18 bp, Homo sapiens
aaaggctgaatatagaag

SEQ ID NO: 9135548 - DNA, 22 bp, Homo sapiens
aaaggctcagaatcggcagacc

SEQ ID NO: 9135549 - DNA, 22 bp, Homo sapiens
aaaggctattcagggacttgcc

SEQ ID NO: 9135550 - DNA, 22 bp, Homo sapiens
aaaggctatgagatagaagata

SEQ ID NO: 9135551 - DNA, 22 bp, Homo sapiens
aaaggctatgagatagaagata

SEQ ID NO: 9135552 - DNA, 22 bp, Homo sapiens
aacatgaagttttctatagtga

SEQ ID NO: 9135553 - DNA, 22 bp, Homo sapiens
aacatgaagttttctatagtga

SEQ ID NO: 9135554 - DNA, 22 bp, Homo sapiens
aacatgatggggaagaacaaga

SEQ ID NO: 9135555 - DNA, 22 bp, Homo sapiens
aacatgatgacaaaggtatatt

SEQ ID NO: 9135556 - DNA, 22 bp, Homo sapiens
aaaggcatgattaattctgtgt

SEQ ID NO: 9135557 - DNA, 22 bp, Homo sapiens
aaaggcatgcctccatttctat

SEQ ID NO: 9135558 - DNA, 22 bp, Homo sapiens
aaaggcatgctgctgaatgatg

SEQ ID NO: 9135559 - DNA, 22 bp, Homo sapiens
aacatgatttcatgcatttaga

SEQ ID NO: 9135560 - DNA, 22 bp, Homo sapiens
aacatgatttagtataatgcag

SEQ ID NO: 9135561 - DNA, 22 bp, Homo sapiens
aaagttacacatctagtaagtg

SEQ ID NO: 9135562 - DNA, 22 bp, Homo sapiens
aacttctggatgtttcaaatgt

SEQ ID NO: 9135563 - DNA, 22 bp, Homo sapiens
aacttctgccaaacagctgtta

SEQ ID NO: 9135564 - DNA, 22 bp, Homo sapiens
aacttgaaaacctcatgaattg

SEQ ID NO: 9135565 - DNA, 22 bp, Homo sapiens
aaagtgtttttgagctgtagtt

SEQ ID NO: 9135566 - DNA, 22 bp, Homo sapiens
aacttgaaccacagaagctgcc

SEQ ID NO: 9135567 - DNA, 22 bp, Homo sapiens
aacttgaactgatgagtgttag

SEQ ID NO: 9135568 - DNA, 22 bp, Homo sapiens
aaagtctgaaagataagagtga

SEQ ID NO: 9135569 - DNA, 22 bp, Homo sapiens
aaagtctgagcagaatttctca

SEQ ID NO: 9135570 - DNA, 20 bp, Homo sapiens
aaagtctgtttatctctgga

SEQ ID NO: 9135571 - DNA, 22 bp, Homo sapiens
aaagtcttaatgtaagtttagt

SEQ ID NO: 9135572 - DNA, 22 bp, Homo sapiens
aaagtctttattttgtatcttt

SEQ ID NO: 9135573 - DNA, 22 bp, Homo sapiens
aacttccaccaaatagtatata

SEQ ID NO: 9135574 - DNA, 22 bp, Homo sapiens
aacttccagctttctgtctaat

SEQ ID NO: 9135575 - DNA, 22 bp, Homo sapiens
aaagtcctagcgatccacagaa

SEQ ID NO: 9135576 - DNA, 22 bp, Homo sapiens
aaagtcctagcgatccacagaa

SEQ ID NO: 9135577 - DNA, 22 bp, Homo sapiens
aaagtccagggaaagagcgtct

SEQ ID NO: 9135578 - DNA, 22 bp, Homo sapiens
aaagtcacgctgatgggaaatg

SEQ ID NO: 9135579 - DNA, 22 bp, Homo sapiens
aaagtcctgttaactgttaaca

SEQ ID NO: 9135580 - DNA, 22 bp, Homo sapiens
aaagtcctgtttgaaggacctg

SEQ ID NO: 9135581 - DNA, 22 bp, Homo sapiens
aaagtccttgcagtttcctctt

SEQ ID NO: 9135582 - DNA, 22 bp, Homo sapiens
aaagtcctttttgccatgcaag

SEQ ID NO: 9135583 - DNA, 22 bp, Homo sapiens
aaagtcctttttgccatgcaag

SEQ ID NO: 9135584 - DNA, 22 bp, Homo sapiens
aaaatctgcttccttttacaga

SEQ ID NO: 9135585 - DNA, 22 bp, Homo sapiens
aaaatactactgtcttcttccc

SEQ ID NO: 9135586 - DNA, 22 bp, Homo sapiens
aaaatactactgtcttcttccc

SEQ ID NO: 9135587 - DNA, 22 bp, Homo sapiens
aaaatactactgtcttcttccc

SEQ ID NO: 9135588 - DNA, 22 bp, Homo sapiens
aaaataacttctactatttgca

SEQ ID NO: 9135589 - DNA, 22 bp, Homo sapiens
aaaataacttctactatttgca

SEQ ID NO: 9135590 - DNA, 22 bp, Homo sapiens
aaaataacttctactatttgca

SEQ ID NO: 9135591 - DNA, 22 bp, Homo sapiens
aaaataacttctactatttgca

SEQ ID NO: 9135592 - DNA, 22 bp, Homo sapiens
aaaatacacatactaggggaaa

SEQ ID NO: 9135593 - DNA, 22 bp, Homo sapiens
aaaataagttggtcctgtcctt

SEQ ID NO: 9135594 - DNA, 22 bp, Homo sapiens
aaaatacacatactaggggaaa

SEQ ID NO: 9135595 - DNA, 22 bp, Homo sapiens
aaaatacacatactaggggaaa

SEQ ID NO: 9135596 - DNA, 22 bp, Homo sapiens
aaaatacacatactaggggaaa

SEQ ID NO: 9135597 - DNA, 18 bp, Homo sapiens
aaaataacaaagttggct

SEQ ID NO: 9135598 - DNA, 18 bp, Homo sapiens
aaaataacaaagttggct

SEQ ID NO: 9135599 - DNA, 18 bp, Homo sapiens
aaaataacaaagttggct

SEQ ID NO: 9135600 - DNA, 22 bp, Homo sapiens
aaaataacttctactatttgca

SEQ ID NO: 9135601 - DNA, 22 bp, Homo sapiens
aaaataacttctactatttgca

SEQ ID NO: 9135602 - DNA, 22 bp, Homo sapiens
aaaagctttgccagatgagttg

SEQ ID NO: 9135603 - DNA, 21 bp, Homo sapiens
aaaaggaaggtctgtttgggg

SEQ ID NO: 9135604 - DNA, 22 bp, Homo sapiens
aaaagctttgttaataggtttg

SEQ ID NO: 9135605 - DNA, 22 bp, Homo sapiens
aaaaggacaagctttggagtta

SEQ ID NO: 9135606 - DNA, 19 bp, Homo sapiens
aaaaggaatattctttggg

SEQ ID NO: 9135607 - DNA, 19 bp, Homo sapiens
aaaaggaatattctttggg

SEQ ID NO: 9135608 - DNA, 22 bp, Homo sapiens
aaaagttacctctgtaatataa

SEQ ID NO: 9135609 - DNA, 22 bp, Homo sapiens
aaaagtgttcaggaagaataat

SEQ ID NO: 9135610 - DNA, 22 bp, Homo sapiens
aaaagtttaagactcattctag

SEQ ID NO: 9135611 - DNA, 22 bp, Homo sapiens
aaaagtttaagactcattctag

SEQ ID NO: 9135612 - DNA, 22 bp, Homo sapiens
aaagcagctgtttgactttcca

SEQ ID NO: 9135613 - DNA, 22 bp, Homo sapiens
aaagcaggcagcaggctggatt

SEQ ID NO: 9135614 - DNA, 22 bp, Homo sapiens
aaagcagctttcggccctcggg

SEQ ID NO: 9135615 - DNA, 22 bp, Homo sapiens
aaagcagctgatctcagagcct

SEQ ID NO: 9135616 - DNA, 22 bp, Homo sapiens
aaagcagggtccaaggagatgt

SEQ ID NO: 9135617 - DNA, 22 bp, Homo sapiens
aaaattgtaggaactgaatcaa

SEQ ID NO: 9135618 - DNA, 22 bp, Homo sapiens
aaagcagggatgaggctagagg

SEQ ID NO: 9135619 - DNA, 22 bp, Homo sapiens
aaagcagggcgatgtcctcctc

SEQ ID NO: 9135620 - DNA, 22 bp, Homo sapiens
aaaatgtctgctgttggtttat

SEQ ID NO: 9135621 - DNA, 21 bp, Homo sapiens
aaaatgtagacttttccctga

SEQ ID NO: 9135622 - DNA, 22 bp, Homo sapiens
aaagcaatggatgagaatctgt

SEQ ID NO: 9135623 - DNA, 22 bp, Homo sapiens
aaagcaatggatgagaatctgt

SEQ ID NO: 9135624 - DNA, 22 bp, Homo sapiens
aaagcagccggttccctggtct

SEQ ID NO: 9135625 - DNA, 22 bp, Homo sapiens
aaagcagccactctctctgcct

SEQ ID NO: 9135626 - DNA, 22 bp, Homo sapiens
aaagcagcctgctcatcctgga

SEQ ID NO: 9135627 - DNA, 22 bp, Homo sapiens
aaagcagccggttccctggtct

SEQ ID NO: 9135628 - DNA, 22 bp, Homo sapiens
aaagcagccacagagagagcgt

SEQ ID NO: 9135629 - DNA, 22 bp, Homo sapiens
aaagcagcagaatctctcaggg

SEQ ID NO: 9135630 - DNA, 22 bp, Homo sapiens
aaagcagcagaatctctcaggg

SEQ ID NO: 9135631 - DNA, 22 bp, Homo sapiens
aaagcagcagcacctgcatttc

SEQ ID NO: 9135632 - DNA, 22 bp, Homo sapiens
aaagcagcagcacgtggaagag

SEQ ID NO: 9135633 - DNA, 22 bp, Homo sapiens
aaagcagcagcacgtggaagag

SEQ ID NO: 9135634 - DNA, 22 bp, Homo sapiens
aaaatgtaaagcttgagtgtag

SEQ ID NO: 9135635 - DNA, 22 bp, Homo sapiens
aaaatgcatgagaatgtgctcg

SEQ ID NO: 9135636 - DNA, 22 bp, Homo sapiens
aaaatgaggtcaatatcctttt

SEQ ID NO: 9135637 - DNA, 22 bp, Homo sapiens
aaaatgatgctgtaatttggca

SEQ ID NO: 9135638 - DNA, 22 bp, Homo sapiens
aaaatgatgctgtaatttggca

SEQ ID NO: 9135639 - DNA, 22 bp, Homo sapiens
aaaatgatgctgtaatttggca

SEQ ID NO: 9135640 - DNA, 22 bp, Homo sapiens
aaaagcagttatctgggaggaa

SEQ ID NO: 9135641 - DNA, 20 bp, Homo sapiens
aaaagcagccagagatggta

SEQ ID NO: 9135642 - DNA, 22 bp, Homo sapiens
aaaagcagagactctggagcta

SEQ ID NO: 9135643 - DNA, 20 bp, Homo sapiens
aaaagcagccagagatggta

SEQ ID NO: 9135644 - DNA, 22 bp, Homo sapiens
aaaagcaattgcagttcttgcc

SEQ ID NO: 9135645 - DNA, 22 bp, Homo sapiens
aaaagcaattgcagttcttgcc

SEQ ID NO: 9135646 - DNA, 22 bp, Homo sapiens
aaaagcaattgcgggttttgcc

SEQ ID NO: 9135647 - DNA, 22 bp, Homo sapiens
aaaagcaattgcgggttttgcc

SEQ ID NO: 9135648 - DNA, 22 bp, Homo sapiens
aaaagcaagttgcctaggttga

SEQ ID NO: 9135649 - DNA, 22 bp, Homo sapiens
aaaacactgcaaagctgattgg

SEQ ID NO: 9135650 - DNA, 22 bp, Homo sapiens
aaaacactgcaaagctgattgg

SEQ ID NO: 9135651 - DNA, 22 bp, Homo sapiens
aaaacagacagccagtgtagag

SEQ ID NO: 9135652 - DNA, 22 bp, Homo sapiens
aaaacagacagccagtgtagag

SEQ ID NO: 9135653 - DNA, 23 bp, Homo sapiens
aaaacagcttcctccagtggctc

SEQ ID NO: 9135654 - DNA, 22 bp, Homo sapiens
aaaacagaggtgcctgggccca

SEQ ID NO: 9135655 - DNA, 22 bp, Homo sapiens
aaaacagaggtgcctgggccca

SEQ ID NO: 9135656 - DNA, 22 bp, Homo sapiens
aaaagagcttggttgattttgc

SEQ ID NO: 9135657 - DNA, 22 bp, Homo sapiens
aaaacagtttaggcatcacagt

SEQ ID NO: 9135658 - DNA, 22 bp, Homo sapiens
aaaacagtttaggcatcacagt

SEQ ID NO: 9135659 - DNA, 22 bp, Homo sapiens
aaaacagtttaggcatcacagt

SEQ ID NO: 9135660 - DNA, 22 bp, Homo sapiens
aaaacagttataaacagagtca

SEQ ID NO: 9135661 - DNA, 22 bp, Homo sapiens
aaaacagttataaacagagtca

SEQ ID NO: 9135662 - DNA, 22 bp, Homo sapiens
aaaacaggtgtcagcaaactat

SEQ ID NO: 9135663 - DNA, 22 bp, Homo sapiens
aaaacaggagttttggtaggct

SEQ ID NO: 9135664 - DNA, 22 bp, Homo sapiens
aaaaatgaaacggctggttggc

SEQ ID NO: 9135665 - DNA, 22 bp, Homo sapiens
aaaaatgttatctactgtccga

SEQ ID NO: 9135666 - DNA, 22 bp, Homo sapiens
aaaaatgttatctactgtccga

SEQ ID NO: 9135667 - DNA, 22 bp, Homo sapiens
aaaaatgttatctactgtccga

SEQ ID NO: 9135668 - DNA, 22 bp, Homo sapiens
aaaaatttatggttcttctctg

SEQ ID NO: 9135669 - DNA, 22 bp, Homo sapiens
aaaaattgctgagaacggaatt

SEQ ID NO: 9135670 - DNA, 22 bp, Homo sapiens
aaaaattgctgagaacggaatt

SEQ ID NO: 9135671 - DNA, 22 bp, Homo sapiens
aaaaatttatggttcttctctg

SEQ ID NO: 9135672 - DNA, 22 bp, Homo sapiens
aaaagcaaggcagtctgtctga

SEQ ID NO: 9135673 - DNA, 22 bp, Homo sapiens
aaaagcaagaggctggattaaa

SEQ ID NO: 9135674 - DNA, 22 bp, Homo sapiens
aaaagcaaggcagtctgtctga

SEQ ID NO: 9135675 - DNA, 22 bp, Homo sapiens
aaaagcaaggcagtctgtctga

SEQ ID NO: 9135676 - DNA, 22 bp, Homo sapiens
aaaagcaaggcagtctgtctga

SEQ ID NO: 9135677 - DNA, 22 bp, Homo sapiens
aaaagcaaggcagtctgtctga

SEQ ID NO: 9135678 - DNA, 22 bp, Homo sapiens
aaaagcaaggcagtctgtctga

SEQ ID NO: 9135679 - DNA, 22 bp, Homo sapiens
aaaagcaagttgcctaggttga

SEQ ID NO: 9135680 - DNA, 22 bp, Homo sapiens
aaaagattgttagggagaatgt

SEQ ID NO: 9135681 - DNA, 22 bp, Homo sapiens
aaaagcaagaggctggattaaa

SEQ ID NO: 9135682 - DNA, 20 bp, Homo sapiens
aaaagagtgcttcaactgct

SEQ ID NO: 9135683 - DNA, 22 bp, Homo sapiens
aaaagagtgtttcaactttggc

SEQ ID NO: 9135684 - DNA, 22 bp, Homo sapiens
aaaacatgtccatacagaaact

SEQ ID NO: 9135685 - DNA, 22 bp, Homo sapiens
aaaacatgtccatacagaaact

SEQ ID NO: 9135686 - DNA, 22 bp, Homo sapiens
aaaacattctgtgaactctcaa

SEQ ID NO: 9135687 - DNA, 22 bp, Homo sapiens
aaaacattctgtgaactctcaa

SEQ ID NO: 9135688 - DNA, 22 bp, Homo sapiens
aaaacattctgtgaactctcaa

SEQ ID NO: 9135689 - DNA, 22 bp, Homo sapiens
aaaacattgaattgcacactat

SEQ ID NO: 9135690 - DNA, 22 bp, Homo sapiens
aaaaccacaatgacttttgcac

SEQ ID NO: 9135691 - DNA, 22 bp, Homo sapiens
aaaaccacaattacttttgcac

SEQ ID NO: 9135692 - DNA, 22 bp, Homo sapiens
aaaaccacaatgacttttgcag

SEQ ID NO: 9135693 - DNA, 22 bp, Homo sapiens
aaaaccacaattatttttgcac

SEQ ID NO: 9135694 - DNA, 22 bp, Homo sapiens
aaaaccacagttacttttgcac

SEQ ID NO: 9135695 - DNA, 22 bp, Homo sapiens
aaaaccaggcgtttcctattat

SEQ ID NO: 9135696 - DNA, 22 bp, Homo sapiens
aaaaccaggcgtttcctattat

SEQ ID NO: 9135697 - DNA, 22 bp, Homo sapiens
aaaaccaggcgtttcctattat

SEQ ID NO: 9135698 - DNA, 22 bp, Homo sapiens
aaaaccagacactgtttctggg

SEQ ID NO: 9135699 - DNA, 22 bp, Homo sapiens
aaaagagtcttaggcagtcata

SEQ ID NO: 9135700 - DNA, 22 bp, Homo sapiens
aaaagagtcttaggcagtcata

SEQ ID NO: 9135701 - DNA, 22 bp, Homo sapiens
aaatacaatttcaggctgtaat

SEQ ID NO: 9135702 - DNA, 22 bp, Homo sapiens
aaatacaatttcaggctgtaat

SEQ ID NO: 9135703 - DNA, 22 bp, Homo sapiens
aaataaaggaactgttttccca

SEQ ID NO: 9135704 - DNA, 22 bp, Homo sapiens
aaataaaggaactgttttccca

SEQ ID NO: 9135705 - DNA, 22 bp, Homo sapiens
aaataaaggaactgttttccca

SEQ ID NO: 9135706 - DNA, 22 bp, Homo sapiens
aaataaaggaactgttttccca

SEQ ID NO: 9135707 - DNA, 22 bp, Homo sapiens
aaataaaggtccactttagggc

SEQ ID NO: 9135708 - DNA, 22 bp, Homo sapiens
aaataacagtcagggacaacat

SEQ ID NO: 9135709 - DNA, 22 bp, Homo sapiens
aaataacagtcagggacaacat

SEQ ID NO: 9135710 - DNA, 21 bp, Homo sapiens
aaatacagatgcaaatctgtt

SEQ ID NO: 9135711 - DNA, 22 bp, Homo sapiens
aaatacagagttgcttaaaagc

SEQ ID NO: 9135712 - DNA, 22 bp, Homo sapiens
aaatccagtttgtcatttccca

SEQ ID NO: 9135713 - DNA, 22 bp, Homo sapiens
aaatccagtttgtcatttccca

SEQ ID NO: 9135714 - DNA, 22 bp, Homo sapiens
aaatgacaataaaagtccatgc

SEQ ID NO: 9135715 - DNA, 22 bp, Homo sapiens
aaatgacactaggctttttgca

SEQ ID NO: 9135716 - DNA, 22 bp, Homo sapiens
aaacttagatgtttttagagtt

SEQ ID NO: 9135717 - DNA, 23 bp, Homo sapiens
aaatgacatatggtttctgaagg

SEQ ID NO: 9135718 - DNA, 22 bp, Homo sapiens
aaactgttatagcagaaaggac

SEQ ID NO: 9135719 - DNA, 22 bp, Homo sapiens
aaatgacagagtaagctgttta

SEQ ID NO: 9135720 - DNA, 22 bp, Homo sapiens
aaatgacagttctctctgagta

SEQ ID NO: 9135721 - DNA, 22 bp, Homo sapiens
aaatgacagagtaagctgttta

SEQ ID NO: 9135722 - DNA, 22 bp, Homo sapiens
aaatgacactcattcagtgtca

SEQ ID NO: 9135723 - DNA, 22 bp, Homo sapiens
aaatgacagagctgggactagt

SEQ ID NO: 9135724 - DNA, 22 bp, Homo sapiens
aaacttcatggataatataaag

SEQ ID NO: 9135725 - DNA, 22 bp, Homo sapiens
aaacttcagtgaatgacttatg

SEQ ID NO: 9135726 - DNA, 22 bp, Homo sapiens
aaacttagttaagcatattatt

SEQ ID NO: 9135727 - DNA, 22 bp, Homo sapiens
aaacttagtagagttcatatta

SEQ ID NO: 9135728 - DNA, 22 bp, Homo sapiens
aaatgtctgtatgagaaagaga

SEQ ID NO: 9135729 - DNA, 22 bp, Homo sapiens
aaatgtctgtctcatgaggaaa

SEQ ID NO: 9135730 - DNA, 22 bp, Homo sapiens
aaatgtctgttagtcatatcat

SEQ ID NO: 9135731 - DNA, 22 bp, Homo sapiens
aaatgtctgtatgagaaagaga

SEQ ID NO: 9135732 - DNA, 23 bp, Homo sapiens
aaatgtcttctagctcttgagaa

SEQ ID NO: 9135733 - DNA, 22 bp, Homo sapiens
aaatgtctttatctcatgtaac

SEQ ID NO: 9135734 - DNA, 22 bp, Homo sapiens
aaatgtctttatctcatgtaac

SEQ ID NO: 9135735 - DNA, 22 bp, Homo sapiens
aaatgtctgtaggggctgcagg

SEQ ID NO: 9135736 - DNA, 22 bp, Homo sapiens
aaatgtctgtaggggctgcagg

SEQ ID NO: 9135737 - DNA, 22 bp, Homo sapiens
aaatgtctctattgcctctggt

SEQ ID NO: 9135738 - DNA, 22 bp, Homo sapiens
aaatgtctgagacttctgaact

SEQ ID NO: 9135739 - DNA, 22 bp, Homo sapiens
aaagacagatggcaaggatgat

SEQ ID NO: 9135740 - DNA, 22 bp, Homo sapiens
aaagacatatttctaagtttat

SEQ ID NO: 9135741 - DNA, 22 bp, Homo sapiens
aaagacatatttctaagtttat

SEQ ID NO: 9135742 - DNA, 22 bp, Homo sapiens
aaagacatcagaaccagctgag

SEQ ID NO: 9135743 - DNA, 22 bp, Homo sapiens
aaagacagtggattcaaaatcc

SEQ ID NO: 9135744 - DNA, 22 bp, Homo sapiens
aaagacacacagccagcaagtg

SEQ ID NO: 9135745 - DNA, 22 bp, Homo sapiens
aaatgtctttgagtttttataa

SEQ ID NO: 9135746 - DNA, 22 bp, Homo sapiens
aaatgtctttgagtatttctgc

SEQ ID NO: 9135747 - DNA, 22 bp, Homo sapiens
aaatgtctttcaatagagaaat

SEQ ID NO: 9135748 - DNA, 22 bp, Homo sapiens
aaatgtctttcaatagagaaat

SEQ ID NO: 9135749 - DNA, 22 bp, Homo sapiens
aaatgtctttcttctgctacgt

SEQ ID NO: 9135750 - DNA, 22 bp, Homo sapiens
aaagtacagatggtgaggttgg

SEQ ID NO: 9135751 - DNA, 22 bp, Homo sapiens
aaagtacagccacatccaagta

SEQ ID NO: 9135752 - DNA, 22 bp, Homo sapiens
aaagtacatgcaattcttctga

SEQ ID NO: 9135753 - DNA, 22 bp, Homo sapiens
aaagtacatgagattcaagggg

SEQ ID NO: 9135754 - DNA, 22 bp, Homo sapiens
aaagtacatagcatattccaac

SEQ ID NO: 9135755 - DNA, 22 bp, Homo sapiens
aaagtacatagcatattccaac

SEQ ID NO: 9135756 - DNA, 22 bp, Homo sapiens
aaagtcagttggccagatcact

SEQ ID NO: 9135757 - DNA, 22 bp, Homo sapiens
aaagtcagttggccagatcact

SEQ ID NO: 9135758 - DNA, 19 bp, Homo sapiens
aaagttttattctcatttg

SEQ ID NO: 9135759 - DNA, 19 bp, Homo sapiens
aaagttttattctcatttg

SEQ ID NO: 9135760 - DNA, 22 bp, Homo sapiens
aaataaactgaagcacagagag

SEQ ID NO: 9135761 - DNA, 22 bp, Homo sapiens
aaagttttctgccttcattaga

SEQ ID NO: 9135762 - DNA, 22 bp, Homo sapiens
aaagtcattggaatattaatga

SEQ ID NO: 9135763 - DNA, 22 bp, Homo sapiens
aaagtcattgtaatatatgcta

SEQ ID NO: 9135764 - DNA, 22 bp, Homo sapiens
aaagtcattgctgttatcaatg

SEQ ID NO: 9135765 - DNA, 22 bp, Homo sapiens
aaagtcatgtaatgatatgatt

SEQ ID NO: 9135766 - DNA, 22 bp, Homo sapiens
aaagtcatctaggagcagattt

SEQ ID NO: 9135767 - DNA, 22 bp, Homo sapiens
aaagtcatccaaatttttatgt

SEQ ID NO: 9135768 - DNA, 22 bp, Homo sapiens
aaagtcatcatttcttttcaaa

SEQ ID NO: 9135769 - DNA, 22 bp, Homo sapiens
aaagtcatgcagttgaactttt

SEQ ID NO: 9135770 - DNA, 22 bp, Homo sapiens
aaaggagagtgagtcagatgcc

SEQ ID NO: 9135771 - DNA, 22 bp, Homo sapiens
aaaggagagtaggttactccat

SEQ ID NO: 9135772 - DNA, 22 bp, Homo sapiens
aaaggagataaagggcccttca

SEQ ID NO: 9135773 - DNA, 22 bp, Homo sapiens
aaaggagacagtcttacctgga

SEQ ID NO: 9135774 - DNA, 22 bp, Homo sapiens
aaaggactgatgctgagtacct

SEQ ID NO: 9135775 - DNA, 22 bp, Homo sapiens
aaaggactgatgctgagtacct

SEQ ID NO: 9135776 - DNA, 22 bp, Homo sapiens
aaaggactggatattaaagagt

SEQ ID NO: 9135777 - DNA, 22 bp, Homo sapiens
aaaggactagtctttctaccat

SEQ ID NO: 9135778 - DNA, 22 bp, Homo sapiens
aaaggactcagactgaagggag

SEQ ID NO: 9135779 - DNA, 22 bp, Homo sapiens
aaaggactcagactgaagggag

SEQ ID NO: 9135780 - DNA, 22 bp, Homo sapiens
aaaggactaggtgttgccaaaa

SEQ ID NO: 9135781 - DNA, 22 bp, Homo sapiens
aaaggagaaaacatacaggact

SEQ ID NO: 9135782 - DNA, 22 bp, Homo sapiens
aaaggacacacaggaggtgtct

SEQ ID NO: 9135783 - DNA, 22 bp, Homo sapiens
aaaggacacacaggaggtgtct

SEQ ID NO: 9135784 - DNA, 22 bp, Homo sapiens
aaaggacatgtcaatatcaggc

SEQ ID NO: 9135785 - DNA, 22 bp, Homo sapiens
aaagctctcccactgtatgaag

SEQ ID NO: 9135786 - DNA, 22 bp, Homo sapiens
aaagctcacagtaatacaaggc

SEQ ID NO: 9135787 - DNA, 22 bp, Homo sapiens
aaagctcacagtaatacaaggc

SEQ ID NO: 9135788 - DNA, 22 bp, Homo sapiens
aaagctatttattacagagaat

SEQ ID NO: 9135789 - DNA, 22 bp, Homo sapiens
aaagctattttattgcagctct

SEQ ID NO: 9135790 - DNA, 22 bp, Homo sapiens
aaagccagggacagtgtgcatg

SEQ ID NO: 9135791 - DNA, 22 bp, Homo sapiens
aaagccagggacagtgtgcatg

SEQ ID NO: 9135792 - DNA, 22 bp, Homo sapiens
aaaatttccaccatctttgtgt

SEQ ID NO: 9135793 - DNA, 22 bp, Homo sapiens
aaaattgtcgaacagtagtaac

SEQ ID NO: 9135794 - DNA, 22 bp, Homo sapiens
aaaattgtcagaagttgatctt

SEQ ID NO: 9135795 - DNA, 22 bp, Homo sapiens
aaaattgtcgaacagtagtaac

SEQ ID NO: 9135796 - DNA, 22 bp, Homo sapiens
aaaattttcagcttgacttgat

SEQ ID NO: 9135797 - DNA, 22 bp, Homo sapiens
aaaattttactggtgtttcctt

SEQ ID NO: 9135798 - DNA, 22 bp, Homo sapiens
aaaatttccaccatctttgtgt

SEQ ID NO: 9135799 - DNA, 22 bp, Homo sapiens
aatatttctccttcgttatagc

SEQ ID NO: 9135800 - DNA, 22 bp, Homo sapiens
aatatttctgcagaatggtttt

SEQ ID NO: 9135801 - DNA, 22 bp, Homo sapiens
aatatttccaaggcctgtcagg

SEQ ID NO: 9135802 - DNA, 22 bp, Homo sapiens
aatatttctccttcgttatagc

SEQ ID NO: 9135803 - DNA, 22 bp, Homo sapiens
aatatttcgttgcgtggctaga

SEQ ID NO: 9135804 - DNA, 22 bp, Homo sapiens
aatatttcaaaaggaaacacag

SEQ ID NO: 9135805 - DNA, 22 bp, Homo sapiens
aatccactttgtgcccctctct

SEQ ID NO: 9135806 - DNA, 22 bp, Homo sapiens
aatatttctgtagctatgttct

SEQ ID NO: 9135807 - DNA, 22 bp, Homo sapiens
aatccactaatgaagaatgggc

SEQ ID NO: 9135808 - DNA, 22 bp, Homo sapiens
aatctcaagctgtaaatacctc

SEQ ID NO: 9135809 - DNA, 22 bp, Homo sapiens
aatatttctgtagctatgttct

SEQ ID NO: 9135810 - DNA, 22 bp, Homo sapiens
aatatcttctaaggatagaact

SEQ ID NO: 9135811 - DNA, 22 bp, Homo sapiens
aatatctgtggccatacaattt

SEQ ID NO: 9135812 - DNA, 22 bp, Homo sapiens
aatattgtttcaagatcacaga

SEQ ID NO: 9135813 - DNA, 22 bp, Homo sapiens
aatatttatgacaggaagtagc

SEQ ID NO: 9135814 - DNA, 22 bp, Homo sapiens
aatacatatggaattccatgtt

SEQ ID NO: 9135815 - DNA, 22 bp, Homo sapiens
aatacatatggaattccatgtt

SEQ ID NO: 9135816 - DNA, 19 bp, Homo sapiens
aatacagtgttatagaatt

SEQ ID NO: 9135817 - DNA, 19 bp, Homo sapiens
aatacagtgttatagaatt

SEQ ID NO: 9135818 - DNA, 22 bp, Homo sapiens
aatatctcaccatgacaaagca

SEQ ID NO: 9135819 - DNA, 22 bp, Homo sapiens
aatatccaggtagatgtcttct

SEQ ID NO: 9135820 - DNA, 22 bp, Homo sapiens
aatatccattgggagcaaatgg

SEQ ID NO: 9135821 - DNA, 22 bp, Homo sapiens
aatatccacttcaatacaggca

SEQ ID NO: 9135822 - DNA, 20 bp, Homo sapiens
aatataattctctgaattta

SEQ ID NO: 9135823 - DNA, 22 bp, Homo sapiens
aagttacagtcagaggttaaca

SEQ ID NO: 9135824 - DNA, 22 bp, Homo sapiens
aagttacagttacagaatggag

SEQ ID NO: 9135825 - DNA, 22 bp, Homo sapiens
aagttacagttatgaaactcac

SEQ ID NO: 9135826 - DNA, 22 bp, Homo sapiens
aagttacataaatgtcctctag

SEQ ID NO: 9135827 - DNA, 22 bp, Homo sapiens
aataagaacttgtctctggcag

SEQ ID NO: 9135828 - DNA, 22 bp, Homo sapiens
aagttacagttggaactgtgaa

SEQ ID NO: 9135829 - DNA, 22 bp, Homo sapiens
aagttacagttggaactgtgaa

SEQ ID NO: 9135830 - DNA, 22 bp, Homo sapiens
aagttacagttattatttaaaa

SEQ ID NO: 9135831 - DNA, 22 bp, Homo sapiens
aacagtttatgagatatgctat

SEQ ID NO: 9135832 - DNA, 22 bp, Homo sapiens
aacagtttatgagatatgctat

SEQ ID NO: 9135833 - DNA, 22 bp, Homo sapiens
aacagtttatgataaattctta

SEQ ID NO: 9135834 - DNA, 22 bp, Homo sapiens
aagttaacccagtatttctttt

SEQ ID NO: 9135835 - DNA, 22 bp, Homo sapiens
aagttacaagactaaatggaag

SEQ ID NO: 9135836 - DNA, 22 bp, Homo sapiens
aagttacaagactaaatggaag

SEQ ID NO: 9135837 - DNA, 22 bp, Homo sapiens
aagttacacattttcattgtaa

SEQ ID NO: 9135838 - DNA, 22 bp, Homo sapiens
aatacagatggcatgtgaagat

SEQ ID NO: 9135839 - DNA, 22 bp, Homo sapiens
aatacagaggggtcacaattca

SEQ ID NO: 9135840 - DNA, 22 bp, Homo sapiens
aatacagaggggtcacaattca

SEQ ID NO: 9135841 - DNA, 22 bp, Homo sapiens
aataatctccctttttgtatgt

SEQ ID NO: 9135842 - DNA, 22 bp, Homo sapiens
aataatcttgactactgaatca

SEQ ID NO: 9135843 - DNA, 22 bp, Homo sapiens
aataatatttgaagcttcaaag

SEQ ID NO: 9135844 - DNA, 22 bp, Homo sapiens
aataatatttgaagcttcaaag

SEQ ID NO: 9135845 - DNA, 22 bp, Homo sapiens
aataatcctgcccgtctctccg

SEQ ID NO: 9135846 - DNA, 22 bp, Homo sapiens
aataatatttgaagcttcaaag

SEQ ID NO: 9135847 - DNA, 22 bp, Homo sapiens
aagttacagttacagaatggag

SEQ ID NO: 9135848 - DNA, 22 bp, Homo sapiens
aataatgagcttgtctaattgt

SEQ ID NO: 9135849 - DNA, 22 bp, Homo sapiens
aataatgaacatttaaaacctg

SEQ ID NO: 9135850 - DNA, 18 bp, Homo sapiens
aatgaaatgtacaccttt

SEQ ID NO: 9135851 - DNA, 18 bp, Homo sapiens
aatgaaatgtacaccttt

SEQ ID NO: 9135852 - DNA, 18 bp, Homo sapiens
aatgaaatgtacaccttt

SEQ ID NO: 9135853 - DNA, 22 bp, Homo sapiens
aatgaaatgaagatatgatcag

SEQ ID NO: 9135854 - DNA, 18 bp, Homo sapiens
aatgaaatgtacaccttt

SEQ ID NO: 9135855 - DNA, 22 bp, Homo sapiens
aatgaaatgaagatatgatcag

SEQ ID NO: 9135856 - DNA, 22 bp, Homo sapiens
aatgaaatgtagcttatccata

SEQ ID NO: 9135857 - DNA, 22 bp, Homo sapiens
aatgaaatgtagcttatccata

SEQ ID NO: 9135858 - DNA, 22 bp, Homo sapiens
aatgcagaccagtatgaaaaac

SEQ ID NO: 9135859 - DNA, 22 bp, Homo sapiens
aatgaaatagttggctgtagag

SEQ ID NO: 9135860 - DNA, 22 bp, Homo sapiens
aatgaaatagttggctgtagag

SEQ ID NO: 9135861 - DNA, 22 bp, Homo sapiens
aatgaaatctgctgggtaaaga

SEQ ID NO: 9135862 - DNA, 22 bp, Homo sapiens
aatgaaagaatgaaacagccca

SEQ ID NO: 9135863 - DNA, 22 bp, Homo sapiens
aatgaaactcgaaataatcaca

SEQ ID NO: 9135864 - DNA, 22 bp, Homo sapiens
aatctgtaacattcaataaaga

SEQ ID NO: 9135865 - DNA, 22 bp, Homo sapiens
aatctgcttttgtcatttatga

SEQ ID NO: 9135866 - DNA, 22 bp, Homo sapiens
aatctggacacagttctcatgc

SEQ ID NO: 9135867 - DNA, 22 bp, Homo sapiens
aatctggagttaatgttttcgc

SEQ ID NO: 9135868 - DNA, 22 bp, Homo sapiens
aatctggacacagttctcatgc

SEQ ID NO: 9135869 - DNA, 22 bp, Homo sapiens
aatctgaagggagatacatgta

SEQ ID NO: 9135870 - DNA, 22 bp, Homo sapiens
aatctgaagggagatacatgta

SEQ ID NO: 9135871 - DNA, 22 bp, Homo sapiens
aatctgaatatttatgtgtatt

SEQ ID NO: 9135872 - DNA, 22 bp, Homo sapiens
aatctctttggctcaaggatcc

SEQ ID NO: 9135873 - DNA, 22 bp, Homo sapiens
aatctcttggttcagaagcctc

SEQ ID NO: 9135874 - DNA, 22 bp, Homo sapiens
aatctgaaagtatggagcagta

SEQ ID NO: 9135875 - DNA, 22 bp, Homo sapiens
aatctgcacccactgaaaatgc

SEQ ID NO: 9135876 - DNA, 22 bp, Homo sapiens
aatctgcacaattcagtttcag

SEQ ID NO: 9135877 - DNA, 22 bp, Homo sapiens
aatctgcttagagctttgagga

SEQ ID NO: 9135878 - DNA, 22 bp, Homo sapiens
aatctgcataagcacagttgga

SEQ ID NO: 9135879 - DNA, 22 bp, Homo sapiens
aatctcttgtatttcctttgac

SEQ ID NO: 9135880 - DNA, 22 bp, Homo sapiens
aatgtaaacagcaagagaaggg

SEQ ID NO: 9135881 - DNA, 22 bp, Homo sapiens
aatgtaaacagcaagagaaggg

SEQ ID NO: 9135882 - DNA, 22 bp, Homo sapiens
aatgtaaagttgggcacaaatg

SEQ ID NO: 9135883 - DNA, 22 bp, Homo sapiens
aatgtaaagttgggcacaaatg

SEQ ID NO: 9135884 - DNA, 22 bp, Homo sapiens
aatgtacaaaccttctttgtag

SEQ ID NO: 9135885 - DNA, 22 bp, Homo sapiens
aatgtaaagttgggcacaaatg

SEQ ID NO: 9135886 - DNA, 22 bp, Homo sapiens
aatgtaacagcaacaacaatgg

SEQ ID NO: 9135887 - DNA, 22 bp, Homo sapiens
aactttaaggctataaattatg

SEQ ID NO: 9135888 - DNA, 22 bp, Homo sapiens
aactttaaggctataaattatg

SEQ ID NO: 9135889 - DNA, 22 bp, Homo sapiens
aactttaaggctataaattatg

SEQ ID NO: 9135890 - DNA, 22 bp, Homo sapiens
aactttaaaaaatatgtctgtt

SEQ ID NO: 9135891 - DNA, 21 bp, Homo sapiens
aacttgtatttctccttattc

SEQ ID NO: 9135892 - DNA, 22 bp, Homo sapiens
aatgctgtccaataggaacata

SEQ ID NO: 9135893 - DNA, 22 bp, Homo sapiens
aatgctgtcttttctacttcat

SEQ ID NO: 9135894 - DNA, 22 bp, Homo sapiens
aatgctgtggagccgtggacag

SEQ ID NO: 9135895 - DNA, 22 bp, Homo sapiens
aatgctgttgagttgttcctgt

SEQ ID NO: 9135896 - DNA, 22 bp, Homo sapiens
aatgctgttctgagtctgcagg

SEQ ID NO: 9135897 - DNA, 22 bp, Homo sapiens
aatgctgttctgagtctgcagg

SEQ ID NO: 9135898 - DNA, 22 bp, Homo sapiens
aatgcttaattcaatactgtgt

SEQ ID NO: 9135899 - DNA, 22 bp, Homo sapiens
aatgctttagcagtgattagtg

SEQ ID NO: 9135900 - DNA, 22 bp, Homo sapiens
aatgctttcaaaaatgtgcagt

SEQ ID NO: 9135901 - DNA, 22 bp, Homo sapiens
aacttggttgttggcaatttgc

SEQ ID NO: 9135902 - DNA, 22 bp, Homo sapiens
aacttggttgttggcaatttgc

SEQ ID NO: 9135903 - DNA, 22 bp, Homo sapiens
aacttggctttgccatttatcg

SEQ ID NO: 9135904 - DNA, 22 bp, Homo sapiens
aacttggtaaattgtgtcagat

SEQ ID NO: 9135905 - DNA, 22 bp, Homo sapiens
aacttggtaccaccttctgaag

SEQ ID NO: 9135906 - DNA, 22 bp, Homo sapiens
aatgctttaattgcatgtagtg

SEQ ID NO: 9135907 - DNA, 22 bp, Homo sapiens
aatgctttaaatcctagtgtaa

SEQ ID NO: 9135908 - DNA, 22 bp, Homo sapiens
aagtaatatctggcaccaggaa

SEQ ID NO: 9135909 - DNA, 22 bp, Homo sapiens
aagtaatataattgttgttgtt

SEQ ID NO: 9135910 - DNA, 22 bp, Homo sapiens
aagtaatctggaatttggtttt

SEQ ID NO: 9135911 - DNA, 20 bp, Homo sapiens
aagtaatatttgtgtaactg

SEQ ID NO: 9135912 - DNA, 22 bp, Homo sapiens
aagtaatctggaatttggtttt

SEQ ID NO: 9135913 - DNA, 22 bp, Homo sapiens
aagtacaacgcatacagagaaa

SEQ ID NO: 9135914 - DNA, 22 bp, Homo sapiens
aagtccagtgatactggcagga

SEQ ID NO: 9135915 - DNA, 22 bp, Homo sapiens
aagtccagtgaaatagaatgca

SEQ ID NO: 9135916 - DNA, 22 bp, Homo sapiens
aagtctgagtgtcagtgcaagt

SEQ ID NO: 9135917 - DNA, 22 bp, Homo sapiens
aagtccaggtcctcattccatc

SEQ ID NO: 9135918 - DNA, 22 bp, Homo sapiens
aagtccagtatgagaaacctgc

SEQ ID NO: 9135919 - DNA, 22 bp, Homo sapiens
aagtaacatctgaacatgatgt

SEQ ID NO: 9135920 - DNA, 22 bp, Homo sapiens
aagtaactaaagatatccattt

SEQ ID NO: 9135921 - DNA, 22 bp, Homo sapiens
aagtaacatgggaacatctgaa

SEQ ID NO: 9135922 - DNA, 22 bp, Homo sapiens
aagtaactaaagatatccattt

SEQ ID NO: 9135923 - DNA, 22 bp, Homo sapiens
aagtaacttatttgcaaacagg

SEQ ID NO: 9135924 - DNA, 22 bp, Homo sapiens
aagtaagtcttacattcacatt

SEQ ID NO: 9135925 - DNA, 22 bp, Homo sapiens
aaggtgttcttcagtagaggtc

SEQ ID NO: 9135926 - DNA, 23 bp, Homo sapiens
aaggtgtttgttttcagaaagca

SEQ ID NO: 9135927 - DNA, 22 bp, Homo sapiens
aaggtgtggagtggtgcgactg

SEQ ID NO: 9135928 - DNA, 22 bp, Homo sapiens
aaggtgttatagctgaggaata

SEQ ID NO: 9135929 - DNA, 22 bp, Homo sapiens
aaggtgtgaactgattcattgg

SEQ ID NO: 9135930 - DNA, 22 bp, Homo sapiens
aaggtgtgaagagatgggaaga

SEQ ID NO: 9135931 - DNA, 22 bp, Homo sapiens
aaggtgtgagacatcctgccat

SEQ ID NO: 9135932 - DNA, 22 bp, Homo sapiens
aaggtgtgctgtgagacctggt

SEQ ID NO: 9135933 - DNA, 22 bp, Homo sapiens
aaggtgtgaagagatgggaaga

SEQ ID NO: 9135934 - DNA, 22 bp, Homo sapiens
aaggtgtcgggttagctcagcc

SEQ ID NO: 9135935 - DNA, 22 bp, Homo sapiens
aaggtgtcggcagagccgcttc

SEQ ID NO: 9135936 - DNA, 22 bp, Homo sapiens
aaggtctgtattagagtttcat

SEQ ID NO: 9135937 - DNA, 21 bp, Homo sapiens
aaggtctgtaaagtgacagga

SEQ ID NO: 9135938 - DNA, 21 bp, Homo sapiens
aaggtctgtaaagtgacagga

SEQ ID NO: 9135939 - DNA, 22 bp, Homo sapiens
aaggtctggatgatgggtgtgc

SEQ ID NO: 9135940 - DNA, 22 bp, Homo sapiens
aaggtctggatgatgggtgtgc

SEQ ID NO: 9135941 - DNA, 21 bp, Homo sapiens
aaggtctgtaaagtgacagga

SEQ ID NO: 9135942 - DNA, 22 bp, Homo sapiens
aagggctggaatatctcttaga

SEQ ID NO: 9135943 - DNA, 22 bp, Homo sapiens
aagggcagggagtttgtgtcta

SEQ ID NO: 9135944 - DNA, 22 bp, Homo sapiens
aagggcaggcagagatcatata

SEQ ID NO: 9135945 - DNA, 22 bp, Homo sapiens
aagggctgcaatccaaaacact

SEQ ID NO: 9135946 - DNA, 22 bp, Homo sapiens
aagggctgcaatccaaaacact

SEQ ID NO: 9135947 - DNA, 22 bp, Homo sapiens
aagggctgcatttgatgtgtca

SEQ ID NO: 9135948 - DNA, 22 bp, Homo sapiens
aagggctgccagggggtgccag

SEQ ID NO: 9135949 - DNA, 22 bp, Homo sapiens
aagggctgccagggggtgccag

SEQ ID NO: 9135950 - DNA, 22 bp, Homo sapiens
aagggctgcatttgatgtgtca

SEQ ID NO: 9135951 - DNA, 22 bp, Homo sapiens
aagggctgctgtagaagcagag

SEQ ID NO: 9135952 - DNA, 22 bp, Homo sapiens
aagggctggaatatctcttaga

SEQ ID NO: 9135953 - DNA, 22 bp, Homo sapiens
aagggctgctgtagaagcagag

SEQ ID NO: 9135954 - DNA, 22 bp, Homo sapiens
aagggctgctgtagaagcagag

SEQ ID NO: 9135955 - DNA, 22 bp, Homo sapiens
aagtgcttaggtcaaaggacat

SEQ ID NO: 9135956 - DNA, 22 bp, Homo sapiens
aagtgcttaaaagggtggtcta

SEQ ID NO: 9135957 - DNA, 22 bp, Homo sapiens
aagtgcttcaactagtgtggtc

SEQ ID NO: 9135958 - DNA, 22 bp, Homo sapiens
aagtgctcagtatcctcatgtg

SEQ ID NO: 9135959 - DNA, 22 bp, Homo sapiens
aagtgctgaatgaagacacaaa

SEQ ID NO: 9135960 - DNA, 22 bp, Homo sapiens
aagtgcctgacctagcctggag

SEQ ID NO: 9135961 - DNA, 22 bp, Homo sapiens
aagtgccatcatagcatggctg

SEQ ID NO: 9135962 - DNA, 22 bp, Homo sapiens
aagtctttttgaatctataact

SEQ ID NO: 9135963 - DNA, 22 bp, Homo sapiens
aagtgaaacatgtatctcttta

SEQ ID NO: 9135964 - DNA, 22 bp, Homo sapiens
aagtcttttgctaagagtaatg

SEQ ID NO: 9135965 - DNA, 22 bp, Homo sapiens
aagtcttttgctaagagtaatg

SEQ ID NO: 9135966 - DNA, 22 bp, Homo sapiens
aagtctttcataagtctcttat

SEQ ID NO: 9135967 - DNA, 22 bp, Homo sapiens
aagtctttcataagtctcttat

SEQ ID NO: 9135968 - DNA, 22 bp, Homo sapiens
aagtcttaggcattttatttct

SEQ ID NO: 9135969 - DNA, 22 bp, Homo sapiens
aagtcttatttgtcatgtatgt

SEQ ID NO: 9135970 - DNA, 22 bp, Homo sapiens
aagtcttaggaaatagcaaaga

SEQ ID NO: 9135971 - DNA, 22 bp, Homo sapiens
aagtctgtttgagtgtcacact

SEQ ID NO: 9135972 - DNA, 22 bp, Homo sapiens
aagtctgtttgagtgtcacact

SEQ ID NO: 9135973 - DNA, 22 bp, Homo sapiens
aagtcttaaccaaataaatgtt

SEQ ID NO: 9135974 - DNA, 22 bp, Homo sapiens
aagtcttaaccaaataaatgtt

SEQ ID NO: 9135975 - DNA, 22 bp, Homo sapiens
aagtctgcctaaccttcatgtt

SEQ ID NO: 9135976 - DNA, 22 bp, Homo sapiens
aaggatacttttagagcctgag

SEQ ID NO: 9135977 - DNA, 22 bp, Homo sapiens
aaggagtgtgaccttccagctc

SEQ ID NO: 9135978 - DNA, 22 bp, Homo sapiens
aaggagtggggcatatcacaga

SEQ ID NO: 9135979 - DNA, 22 bp, Homo sapiens
aaggagtgcatgactcagagta

SEQ ID NO: 9135980 - DNA, 22 bp, Homo sapiens
aaggagtgatatatgggtgcta

SEQ ID NO: 9135981 - DNA, 22 bp, Homo sapiens
aaggagtctgggccattcagag

SEQ ID NO: 9135982 - DNA, 22 bp, Homo sapiens
aaggagtctgggccattcagag

SEQ ID NO: 9135983 - DNA, 22 bp, Homo sapiens
aaggagggttcccaggtcctgg

SEQ ID NO: 9135984 - DNA, 22 bp, Homo sapiens
aaggcactagcagaattagtga

SEQ ID NO: 9135985 - DNA, 22 bp, Homo sapiens
aaggcactagcaagctgcctgg

SEQ ID NO: 9135986 - DNA, 22 bp, Homo sapiens
aaggcactcattcaaggagata

SEQ ID NO: 9135987 - DNA, 22 bp, Homo sapiens
aaggcactcattcaaggagata

SEQ ID NO: 9135988 - DNA, 22 bp, Homo sapiens
aaggcactgaaaaattgtgtgt

SEQ ID NO: 9135989 - DNA, 22 bp, Homo sapiens
aaatggaggcacgcagtggtta

SEQ ID NO: 9135990 - DNA, 22 bp, Homo sapiens
aaatggagatgataagagggtt

SEQ ID NO: 9135991 - DNA, 22 bp, Homo sapiens
aaatggaagtgtatttagtgtt

SEQ ID NO: 9135992 - DNA, 22 bp, Homo sapiens
aaatggaatgtgtttataattc

SEQ ID NO: 9135993 - DNA, 22 bp, Homo sapiens
aaatggaatgtgtttataattc

SEQ ID NO: 9135994 - DNA, 22 bp, Homo sapiens
aaatggactgtgatatttacat

SEQ ID NO: 9135995 - DNA, 22 bp, Homo sapiens
aaggagggaaagcagtgcttct

SEQ ID NO: 9135996 - DNA, 16 bp, Homo sapiens
aaggagggaagagaat

SEQ ID NO: 9135997 - DNA, 22 bp, Homo sapiens
aaggagggttcccaggtcctgg

SEQ ID NO: 9135998 - DNA, 22 bp, Homo sapiens
aaatggatgttgagttaaatgt

SEQ ID NO: 9135999 - DNA, 22 bp, Homo sapiens
aaatggatggaattgacattta

SEQ ID NO: 9136000 - DNA, 18 bp, Homo sapiens
aaatggcacacagacctg

SEQ ID NO: 9136001 - DNA, 22 bp, Homo sapiens
aaatggcactttgacagcctgc

SEQ ID NO: 9136002 - DNA, 22 bp, Homo sapiens
aagggcaggaaaagatggatgt

SEQ ID NO: 9136003 - DNA, 22 bp, Homo sapiens
aagggcaggaaaagatggatgt

SEQ ID NO: 9136004 - DNA, 22 bp, Homo sapiens
aagggcaggaaaagatggatgt

SEQ ID NO: 9136005 - DNA, 22 bp, Homo sapiens
aagggcaggagaagacggatat

SEQ ID NO: 9136006 - DNA, 22 bp, Homo sapiens
aagggcaggagaagacggatat

SEQ ID NO: 9136007 - DNA, 22 bp, Homo sapiens
aagggcaggagaagacggatat

SEQ ID NO: 9136008 - DNA, 22 bp, Homo sapiens
aagggcaggcagagatcatata

SEQ ID NO: 9136009 - DNA, 22 bp, Homo sapiens
aagggcaggcagagatcatata

SEQ ID NO: 9136010 - DNA, 22 bp, Homo sapiens
aagggcaggagaagacggatat

SEQ ID NO: 9136011 - DNA, 22 bp, Homo sapiens
aagggcaggcacccaccctcac

SEQ ID NO: 9136012 - DNA, 22 bp, Homo sapiens
aaggctgaccagtttacacttt

SEQ ID NO: 9136013 - DNA, 22 bp, Homo sapiens
aaggctgactcaacagggggcc

SEQ ID NO: 9136014 - DNA, 21 bp, Homo sapiens
aaggctgagacaactcaggag

SEQ ID NO: 9136015 - DNA, 22 bp, Homo sapiens
aaggctgacgtttgtgtttatt

SEQ ID NO: 9136016 - DNA, 22 bp, Homo sapiens
aaggctgagacagcacaggtcc

SEQ ID NO: 9136017 - DNA, 22 bp, Homo sapiens
aaggctgagagtcacagtccta

SEQ ID NO: 9136018 - DNA, 22 bp, Homo sapiens
aagggaggccagaggttttgca

SEQ ID NO: 9136019 - DNA, 22 bp, Homo sapiens
aaggccctcatgcgtcagagcc

SEQ ID NO: 9136020 - DNA, 22 bp, Homo sapiens
aaggccctgtctccaaatacag

SEQ ID NO: 9136021 - DNA, 22 bp, Homo sapiens
aaggccctggccccagcttctt

SEQ ID NO: 9136022 - DNA, 22 bp, Homo sapiens
aaggccctcatgcgtcagagcc

SEQ ID NO: 9136023 - DNA, 22 bp, Homo sapiens
aaggcccttccaccagtcctcg

SEQ ID NO: 9136024 - DNA, 22 bp, Homo sapiens
aaggctgaattcaagggtaggc

SEQ ID NO: 9136025 - DNA, 22 bp, Homo sapiens
aaggctgaattcaagggtaggc

SEQ ID NO: 9136026 - DNA, 22 bp, Homo sapiens
aaggctgaattcaagggtaggc

SEQ ID NO: 9136027 - DNA, 22 bp, Homo sapiens
aaggccaggtccctgcagtgca

SEQ ID NO: 9136028 - DNA, 22 bp, Homo sapiens
aaggccaggtccctgcagtgca

SEQ ID NO: 9136029 - DNA, 22 bp, Homo sapiens
aaggcactgctttgctgcgccc

SEQ ID NO: 9136030 - DNA, 22 bp, Homo sapiens
aaggcactgagccagccgtctc

SEQ ID NO: 9136031 - DNA, 22 bp, Homo sapiens
aaggccagactctggaatgaca

SEQ ID NO: 9136032 - DNA, 22 bp, Homo sapiens
aaggccagactctggaatgaca

SEQ ID NO: 9136033 - DNA, 22 bp, Homo sapiens
aagaatatctgttttatttagg

SEQ ID NO: 9136034 - DNA, 22 bp, Homo sapiens
aagaatatctgttttatttagg

SEQ ID NO: 9136035 - DNA, 22 bp, Homo sapiens
aagaatcatctgaactttgagg

SEQ ID NO: 9136036 - DNA, 22 bp, Homo sapiens
aagaatatttcctgcacttggg

SEQ ID NO: 9136037 - DNA, 22 bp, Homo sapiens
acaaaagcactgcagagtaagc

SEQ ID NO: 9136038 - DNA, 22 bp, Homo sapiens
acaaaagaataagatgagtcat

SEQ ID NO: 9136039 - DNA, 22 bp, Homo sapiens
acaaaagaataagatgagtcat

SEQ ID NO: 9136040 - DNA, 22 bp, Homo sapiens
acaaaaccagaaaatctctacc

SEQ ID NO: 9136041 - DNA, 22 bp, Homo sapiens
acaaaactcttgctgggatttt

SEQ ID NO: 9136042 - DNA, 22 bp, Homo sapiens
aagaatctatggtacatccaag

SEQ ID NO: 9136043 - DNA, 22 bp, Homo sapiens
aagaatctatggtacatccaag

SEQ ID NO: 9136044 - DNA, 22 bp, Homo sapiens
acaaatgaatcatacataatgt

SEQ ID NO: 9136045 - DNA, 22 bp, Homo sapiens
acaaatgaatcatacataatgt

SEQ ID NO: 9136046 - DNA, 22 bp, Homo sapiens
acaaatgaacatataagcttga

SEQ ID NO: 9136047 - DNA, 22 bp, Homo sapiens
acaaatccagtgaactccagtg

SEQ ID NO: 9136048 - DNA, 22 bp, Homo sapiens
aagaagatggttaactttcagt

SEQ ID NO: 9136049 - DNA, 22 bp, Homo sapiens
aagaagagaactggcatcctaa

SEQ ID NO: 9136050 - DNA, 22 bp, Homo sapiens
aagaagatggttaactttcagt

SEQ ID NO: 9136051 - DNA, 22 bp, Homo sapiens
acaaaaattagctgggcatggt

SEQ ID NO: 9136052 - DNA, 22 bp, Homo sapiens
aagaactgtttacaattttcac

SEQ ID NO: 9136053 - DNA, 22 bp, Homo sapiens
aagaactgtgctccaggctcca

SEQ ID NO: 9136054 - DNA, 22 bp, Homo sapiens
aagaactgtatcaagatgtagt

SEQ ID NO: 9136055 - DNA, 22 bp, Homo sapiens
aagaactgtatcaagatgtagt

SEQ ID NO: 9136056 - DNA, 22 bp, Homo sapiens
aagaactggttatgttatcttg

SEQ ID NO: 9136057 - DNA, 22 bp, Homo sapiens
aagaacttcctaatatattttc

SEQ ID NO: 9136058 - DNA, 22 bp, Homo sapiens
aagaacttgggctgagtgaaag

SEQ ID NO: 9136059 - DNA, 22 bp, Homo sapiens
aagaactttaaagcacttatga

SEQ ID NO: 9136060 - DNA, 22 bp, Homo sapiens
aagaagaattattccctaatca

SEQ ID NO: 9136061 - DNA, 22 bp, Homo sapiens
aagaacttttggcaagtgttat

SEQ ID NO: 9136062 - DNA, 23 bp, Homo sapiens
aagaactttggtcctgcagagtc

SEQ ID NO: 9136063 - DNA, 22 bp, Homo sapiens
aagaacatgttaaaagattcac

SEQ ID NO: 9136064 - DNA, 22 bp, Homo sapiens
aagaacattcgaactattttct

SEQ ID NO: 9136065 - DNA, 22 bp, Homo sapiens
aagaacattcgaactattttct

SEQ ID NO: 9136066 - DNA, 22 bp, Homo sapiens
aagaacattgatattgtctatg

SEQ ID NO: 9136067 - DNA, 22 bp, Homo sapiens
aagaacaggttctagaaccatt

SEQ ID NO: 9136068 - DNA, 22 bp, Homo sapiens
aagaacaggttctagaaccatt

SEQ ID NO: 9136069 - DNA, 22 bp, Homo sapiens
aatgtacaagggttccagtttt

SEQ ID NO: 9136070 - DNA, 22 bp, Homo sapiens
aatgtacaagggttccagtttt

SEQ ID NO: 9136071 - DNA, 22 bp, Homo sapiens
aagaactggttatgttatcttg

SEQ ID NO: 9136072 - DNA, 23 bp, Homo sapiens
aagaactgcgaatggagaaagta

SEQ ID NO: 9136073 - DNA, 22 bp, Homo sapiens
aagaactgagtacgttaataaa

SEQ ID NO: 9136074 - DNA, 18 bp, Homo sapiens
aagaactgaggtcctaga

SEQ ID NO: 9136075 - DNA, 22 bp, Homo sapiens
aagaactagtcttacagcctca

SEQ ID NO: 9136076 - DNA, 22 bp, Homo sapiens
aagaaccaaaatgaagctaggt

SEQ ID NO: 9136077 - DNA, 22 bp, Homo sapiens
aagaacattttgtagaatgaca

SEQ ID NO: 9136078 - DNA, 22 bp, Homo sapiens
aagaacatttatgatggcattt

SEQ ID NO: 9136079 - DNA, 22 bp, Homo sapiens
aagaacatttatgatggcattt

SEQ ID NO: 9136080 - DNA, 22 bp, Homo sapiens
aagaacattgatattgtctatg

SEQ ID NO: 9136081 - DNA, 22 bp, Homo sapiens
aagaacatttatgatggcattt

SEQ ID NO: 9136082 - DNA, 22 bp, Homo sapiens
aagatacaccaagagcctagta

SEQ ID NO: 9136083 - DNA, 22 bp, Homo sapiens
aagatacaaatgtcaatattgg

SEQ ID NO: 9136084 - DNA, 22 bp, Homo sapiens
aagataatgttctagctgtcag

SEQ ID NO: 9136085 - DNA, 22 bp, Homo sapiens
aagagtttccagttgtggctca

SEQ ID NO: 9136086 - DNA, 22 bp, Homo sapiens
aagagtttccatgctctgtgct

SEQ ID NO: 9136087 - DNA, 22 bp, Homo sapiens
aagataatattcattaactaga

SEQ ID NO: 9136088 - DNA, 22 bp, Homo sapiens
acacagccccacggtgagcaaa

SEQ ID NO: 9136089 - DNA, 22 bp, Homo sapiens
acacagcagaaggcccgtgtct

SEQ ID NO: 9136090 - DNA, 17 bp, Homo sapiens
acacagccaggttctcc

SEQ ID NO: 9136091 - DNA, 22 bp, Homo sapiens
acacagctagtgagtggcagag

SEQ ID NO: 9136092 - DNA, 22 bp, Homo sapiens
acacagctatggggtaggaaac

SEQ ID NO: 9136093 - DNA, 22 bp, Homo sapiens
acacagctcacaacgtgtgcat

SEQ ID NO: 9136094 - DNA, 22 bp, Homo sapiens
acacagctcacaacgtgtgcat

SEQ ID NO: 9136095 - DNA, 22 bp, Homo sapiens
acacagctatggggtaggaaac

SEQ ID NO: 9136096 - DNA, 22 bp, Homo sapiens
acacagcttcaaagtctaattc

SEQ ID NO: 9136097 - DNA, 22 bp, Homo sapiens
acacagctgtgcagttttttca

SEQ ID NO: 9136098 - DNA, 21 bp, Homo sapiens
acacagctgccggagacggat

SEQ ID NO: 9136099 - DNA, 22 bp, Homo sapiens
acacagctcagtgcctccaaga

SEQ ID NO: 9136100 - DNA, 22 bp, Homo sapiens
acacagaagctttttctattcc

SEQ ID NO: 9136101 - DNA, 22 bp, Homo sapiens
acacagaagatctcttaatgct

SEQ ID NO: 9136102 - DNA, 22 bp, Homo sapiens
acacacatgcctttcctaagta

SEQ ID NO: 9136103 - DNA, 22 bp, Homo sapiens
acaatgttctacatatacataa

SEQ ID NO: 9136104 - DNA, 22 bp, Homo sapiens
acacagcaacttgcagtatgga

SEQ ID NO: 9136105 - DNA, 22 bp, Homo sapiens
acacagagctggaactgcttca

SEQ ID NO: 9136106 - DNA, 22 bp, Homo sapiens
acacagagccaaaccatatcac

SEQ ID NO: 9136107 - DNA, 22 bp, Homo sapiens
acaaatttgtgtagttatggca

SEQ ID NO: 9136108 - DNA, 22 bp, Homo sapiens
acaaatttggtgagagtaaata

SEQ ID NO: 9136109 - DNA, 22 bp, Homo sapiens
acaacaaaatcactagtcttcc

SEQ ID NO: 9136110 - DNA, 21 bp, Homo sapiens
acaatagacataagcagagca

SEQ ID NO: 9136111 - DNA, 22 bp, Homo sapiens
acaatagagttctcataggaca

SEQ ID NO: 9136112 - DNA, 22 bp, Homo sapiens
acaatatacacatcctaatggg

SEQ ID NO: 9136113 - DNA, 20 bp, Homo sapiens
acaatagatttgagcaaagt

SEQ ID NO: 9136114 - DNA, 22 bp, Homo sapiens
acaatgtcacctctcatgtttt

SEQ ID NO: 9136115 - DNA, 22 bp, Homo sapiens
acaatatagtccatgagcatgc

SEQ ID NO: 9136116 - DNA, 22 bp, Homo sapiens
acaatatagtccatgagcatgc

SEQ ID NO: 9136117 - DNA, 22 bp, Homo sapiens
acaatatagtccatgagcatgc

SEQ ID NO: 9136118 - DNA, 22 bp, Homo sapiens
acaatatgggatatacatttta

SEQ ID NO: 9136119 - DNA, 20 bp, Homo sapiens
acaatatgtagatgaatagc

SEQ ID NO: 9136120 - DNA, 22 bp, Homo sapiens
acaatatttgggggcagtttgt

SEQ ID NO: 9136121 - DNA, 22 bp, Homo sapiens
aagatacatcaaagcaaattgg

SEQ ID NO: 9136122 - DNA, 22 bp, Homo sapiens
acacataagaaactacaaagag

SEQ ID NO: 9136123 - DNA, 22 bp, Homo sapiens
aagatacagacagagccaaaat

SEQ ID NO: 9136124 - DNA, 23 bp, Homo sapiens
aagatacaggtgtggaatggttt

SEQ ID NO: 9136125 - DNA, 22 bp, Homo sapiens
aagatacacgttgtattgaata

SEQ ID NO: 9136126 - DNA, 22 bp, Homo sapiens
acacatataccactgtaaatga

SEQ ID NO: 9136127 - DNA, 22 bp, Homo sapiens
acactggttctcaagactaggt

SEQ ID NO: 9136128 - DNA, 23 bp, Homo sapiens
acactggttagctaaagttagag

SEQ ID NO: 9136129 - DNA, 22 bp, Homo sapiens
acactggtgttaacttttggtt

SEQ ID NO: 9136130 - DNA, 22 bp, Homo sapiens
acacatatatacatatttgtgc

SEQ ID NO: 9136131 - DNA, 22 bp, Homo sapiens
acacatagaaaataaatagtta

SEQ ID NO: 9136132 - DNA, 22 bp, Homo sapiens
acacatataccactgtaaatga

SEQ ID NO: 9136133 - DNA, 22 bp, Homo sapiens
acacatacatggggaagatgag

SEQ ID NO: 9136134 - DNA, 22 bp, Homo sapiens
acacataagcctaatcatctcc

SEQ ID NO: 9136135 - DNA, 22 bp, Homo sapiens
acacttggagcaacacttatgg

SEQ ID NO: 9136136 - DNA, 22 bp, Homo sapiens
acacttgtggcctttctagtaa

SEQ ID NO: 9136137 - DNA, 22 bp, Homo sapiens
acacttgataggtcaaatcagt

SEQ ID NO: 9136138 - DNA, 20 bp, Homo sapiens
acagaaagctgccttgtccc

SEQ ID NO: 9136139 - DNA, 22 bp, Homo sapiens
acagaaagatgatttgaaatgg

SEQ ID NO: 9136140 - DNA, 22 bp, Homo sapiens
acactttaagcatttcacactg

SEQ ID NO: 9136141 - DNA, 21 bp, Homo sapiens
acacttcagtttttaaaggga

SEQ ID NO: 9136142 - DNA, 21 bp, Homo sapiens
acacttcagtttttaaaggga

SEQ ID NO: 9136143 - DNA, 22 bp, Homo sapiens
acacttcatttacattataggc

SEQ ID NO: 9136144 - DNA, 22 bp, Homo sapiens
acactggttgttaatagtaaca

SEQ ID NO: 9136145 - DNA, 22 bp, Homo sapiens
acactggttgaattgtataact

SEQ ID NO: 9136146 - DNA, 22 bp, Homo sapiens
acactggttggttgaatttact

SEQ ID NO: 9136147 - DNA, 23 bp, Homo sapiens
acactggttttaaagcagttaat

SEQ ID NO: 9136148 - DNA, 18 bp, Homo sapiens
acacttcctggtggtgtg

SEQ ID NO: 9136149 - DNA, 18 bp, Homo sapiens
acacttcctggtggtgtg

SEQ ID NO: 9136150 - DNA, 18 bp, Homo sapiens
acacttcctggtggtgtg

SEQ ID NO: 9136151 - DNA, 22 bp, Homo sapiens
acacttctattccctgcacaaa

SEQ ID NO: 9136152 - DNA, 22 bp, Homo sapiens
acacttctctttgaagaacaat

SEQ ID NO: 9136153 - DNA, 22 bp, Homo sapiens
acacttctctttgaagaacaat

SEQ ID NO: 9136154 - DNA, 18 bp, Homo sapiens
acagaaatagctgtgcct

SEQ ID NO: 9136155 - DNA, 22 bp, Homo sapiens
acagaaatatagaaggtaggaa

SEQ ID NO: 9136156 - DNA, 22 bp, Homo sapiens
acagaaataactttttatgttt

SEQ ID NO: 9136157 - DNA, 22 bp, Homo sapiens
acagaaataactttttatgttt

SEQ ID NO: 9136158 - DNA, 22 bp, Homo sapiens
acagaaataactttttatgttt

SEQ ID NO: 9136159 - DNA, 23 bp, Homo sapiens
acagaaagttctgctggacagag

SEQ ID NO: 9136160 - DNA, 23 bp, Homo sapiens
acagaaagttctgctggacagag

SEQ ID NO: 9136161 - DNA, 23 bp, Homo sapiens
acagaaatcatttgtaaggtacc

SEQ ID NO: 9136162 - DNA, 23 bp, Homo sapiens
acagaaatcatttgtaaggtacc

SEQ ID NO: 9136163 - DNA, 22 bp, Homo sapiens
acagaaatgatgtttggcaata

SEQ ID NO: 9136164 - DNA, 22 bp, Homo sapiens
acagaaatgatgtttggcaata

SEQ ID NO: 9136165 - DNA, 22 bp, Homo sapiens
acagaaatgatgtttggcaata

SEQ ID NO: 9136166 - DNA, 22 bp, Homo sapiens
acagaaatattcgtggtgcttg

SEQ ID NO: 9136167 - DNA, 19 bp, Homo sapiens
acagacatttgcaattagc

SEQ ID NO: 9136168 - DNA, 22 bp, Homo sapiens
acagacattttaagacacttta

SEQ ID NO: 9136169 - DNA, 22 bp, Homo sapiens
acagacattttaattattaaat

SEQ ID NO: 9136170 - DNA, 23 bp, Homo sapiens
acagacattccataatgtacacc

SEQ ID NO: 9136171 - DNA, 23 bp, Homo sapiens
acagacattgtacatcttgtttt

SEQ ID NO: 9136172 - DNA, 23 bp, Homo sapiens
acagacattccataatgtacacc

SEQ ID NO: 9136173 - DNA, 22 bp, Homo sapiens
acagagcaatgcgtgttctcta

SEQ ID NO: 9136174 - DNA, 22 bp, Homo sapiens
acagactggcctgtctcgcacc

SEQ ID NO: 9136175 - DNA, 22 bp, Homo sapiens
acagactaaaattgcacagtgg

SEQ ID NO: 9136176 - DNA, 22 bp, Homo sapiens
acagactccccaggttatctca

SEQ ID NO: 9136177 - DNA, 22 bp, Homo sapiens
acagactggagcccttttgccc

SEQ ID NO: 9136178 - DNA, 22 bp, Homo sapiens
acagactggaggagaatagttt

SEQ ID NO: 9136179 - DNA, 22 bp, Homo sapiens
acagacctggccccgcacggtg

SEQ ID NO: 9136180 - DNA, 22 bp, Homo sapiens
acagacctatggcagctgccat

SEQ ID NO: 9136181 - DNA, 23 bp, Homo sapiens
acagccaggatgggagcagaagc

SEQ ID NO: 9136182 - DNA, 22 bp, Homo sapiens
acagccaggaggaactcagtga

SEQ ID NO: 9136183 - DNA, 22 bp, Homo sapiens
aagccaggttccatggaggagc

SEQ ID NO: 9136184 - DNA, 22 bp, Homo sapiens
aagcccagatgtgagaactgag

SEQ ID NO: 9136185 - DNA, 22 bp, Homo sapiens
aagccaggttccatggaggagc

SEQ ID NO: 9136186 - DNA, 19 bp, Homo sapiens
acagcaggtgtggggataa

SEQ ID NO: 9136187 - DNA, 22 bp, Homo sapiens
acagcaggttacagtggcacag

SEQ ID NO: 9136188 - DNA, 22 bp, Homo sapiens
aagcccattcggctgccctgca

SEQ ID NO: 9136189 - DNA, 20 bp, Homo sapiens
aagcccattaccatgcttgg

SEQ ID NO: 9136190 - DNA, 22 bp, Homo sapiens
aagcccatgaaatggcctcaat

SEQ ID NO: 9136191 - DNA, 22 bp, Homo sapiens
aagcccataaaaagaggtccct

SEQ ID NO: 9136192 - DNA, 22 bp, Homo sapiens
aagcccagtttcacactgagac

SEQ ID NO: 9136193 - DNA, 22 bp, Homo sapiens
aagcccagtttcacactgagac

SEQ ID NO: 9136194 - DNA, 22 bp, Homo sapiens
aagcccaggtaagtggctcatg

SEQ ID NO: 9136195 - DNA, 19 bp, Homo sapiens
aagcccagtgtatgctctt

SEQ ID NO: 9136196 - DNA, 22 bp, Homo sapiens
aagcccagtaccttcagtgagg

SEQ ID NO: 9136197 - DNA, 22 bp, Homo sapiens
aagcccaggtaagtggctcatg

SEQ ID NO: 9136198 - DNA, 22 bp, Homo sapiens
acagctgctgcttctcactggg

SEQ ID NO: 9136199 - DNA, 22 bp, Homo sapiens
acagctgctgtttttgaaggac

SEQ ID NO: 9136200 - DNA, 21 bp, Homo sapiens
acagctggaaattacttgccc

SEQ ID NO: 9136201 - DNA, 22 bp, Homo sapiens
acagctggacaggggagagttt

SEQ ID NO: 9136202 - DNA, 22 bp, Homo sapiens
aagcccggttgggaacgtggtg

SEQ ID NO: 9136203 - DNA, 21 bp, Homo sapiens
aagcccgtagagccaggactc

SEQ ID NO: 9136204 - DNA, 22 bp, Homo sapiens
aagcccctcgggtgcgcacgcg

SEQ ID NO: 9136205 - DNA, 23 bp, Homo sapiens
aagccctgaaggtttcaggccct

SEQ ID NO: 9136206 - DNA, 22 bp, Homo sapiens
aagccctcattagccatagccc

SEQ ID NO: 9136207 - DNA, 22 bp, Homo sapiens
acagctgctctatatctcagcc

SEQ ID NO: 9136208 - DNA, 22 bp, Homo sapiens
acagctgctctacaggttattt

SEQ ID NO: 9136209 - DNA, 22 bp, Homo sapiens
aagcagggctagaccaagaaga

SEQ ID NO: 9136210 - DNA, 22 bp, Homo sapiens
aagcagggctccctggggactc

SEQ ID NO: 9136211 - DNA, 18 bp, Homo sapiens
aagcagggtccattgtgc

SEQ ID NO: 9136212 - DNA, 22 bp, Homo sapiens
aagcagggctttaagcggtttt

SEQ ID NO: 9136213 - DNA, 22 bp, Homo sapiens
aagcagggtcttcctcagttgg

SEQ ID NO: 9136214 - DNA, 22 bp, Homo sapiens
aagcagggtgtcttgacccatg

SEQ ID NO: 9136215 - DNA, 22 bp, Homo sapiens
aagcagggtttttccaccgcag

SEQ ID NO: 9136216 - DNA, 22 bp, Homo sapiens
aagcaggttacatacattatct

SEQ ID NO: 9136217 - DNA, 22 bp, Homo sapiens
aagcagggagaaatttttcttc

SEQ ID NO: 9136218 - DNA, 23 bp, Homo sapiens
aagcagggagattcttagctgag

SEQ ID NO: 9136219 - DNA, 21 bp, Homo sapiens
aagcagggactgcccaggtcc

SEQ ID NO: 9136220 - DNA, 21 bp, Homo sapiens
aagcaggacatatgatgccct

SEQ ID NO: 9136221 - DNA, 22 bp, Homo sapiens
aagcaggaaggagcccagggca

SEQ ID NO: 9136222 - DNA, 22 bp, Homo sapiens
acagagcaattcttgggtgttt

SEQ ID NO: 9136223 - DNA, 22 bp, Homo sapiens
acagagcacagtcgggatggga

SEQ ID NO: 9136224 - DNA, 22 bp, Homo sapiens
aagcaggacgtatttctatcct

SEQ ID NO: 9136225 - DNA, 22 bp, Homo sapiens
aagcagtgttcccagctggccc

SEQ ID NO: 9136226 - DNA, 22 bp, Homo sapiens
acagcaggaagctggagggaaa

SEQ ID NO: 9136227 - DNA, 22 bp, Homo sapiens
aagcagtttagataggcaaagg

SEQ ID NO: 9136228 - DNA, 22 bp, Homo sapiens
aagcagtttagataggcaaagg

SEQ ID NO: 9136229 - DNA, 22 bp, Homo sapiens
aagcagtttagataggcaaagg

SEQ ID NO: 9136230 - DNA, 22 bp, Homo sapiens
aagcagtttttcaactgtttag

SEQ ID NO: 9136231 - DNA, 21 bp, Homo sapiens
acagcagggctggcatgacag

SEQ ID NO: 9136232 - DNA, 22 bp, Homo sapiens
acagcagggggagctgttggac

SEQ ID NO: 9136233 - DNA, 21 bp, Homo sapiens
acagcagggctggcatgacag

SEQ ID NO: 9136234 - DNA, 22 bp, Homo sapiens
acagcagggggagctgttggac

SEQ ID NO: 9136235 - DNA, 22 bp, Homo sapiens
acagcagggtcacattccctct

SEQ ID NO: 9136236 - DNA, 22 bp, Homo sapiens
acagcaggggtggaataaacgt

SEQ ID NO: 9136237 - DNA, 22 bp, Homo sapiens
acagcaggtagctttgtgcctc

SEQ ID NO: 9136238 - DNA, 22 bp, Homo sapiens
acttttaaatgagtttcagttg

SEQ ID NO: 9136239 - DNA, 22 bp, Homo sapiens
actttgtttggctattagagtc

SEQ ID NO: 9136240 - DNA, 22 bp, Homo sapiens
actttgtttggctattagagtc

SEQ ID NO: 9136241 - DNA, 22 bp, Homo sapiens
actttgtttccatatttgtagc

SEQ ID NO: 9136242 - DNA, 22 bp, Homo sapiens
actttgttctaatagtatctct

SEQ ID NO: 9136243 - DNA, 22 bp, Homo sapiens
actttgcaaaaggaaatcacct

SEQ ID NO: 9136244 - DNA, 22 bp, Homo sapiens
actttgcaaaaggaaatcacct

SEQ ID NO: 9136245 - DNA, 22 bp, Homo sapiens
actttgttgaagaatatgttag

SEQ ID NO: 9136246 - DNA, 22 bp, Homo sapiens
actttgttgatgaaatagtttt

SEQ ID NO: 9136247 - DNA, 22 bp, Homo sapiens
aatcaagtattttccagtggca

SEQ ID NO: 9136248 - DNA, 22 bp, Homo sapiens
acttttatgataatcaatgttc

SEQ ID NO: 9136249 - DNA, 22 bp, Homo sapiens
aatagccactttagagcaggtg

SEQ ID NO: 9136250 - DNA, 22 bp, Homo sapiens
aatagcatgtaagtttaaaaga

SEQ ID NO: 9136251 - DNA, 22 bp, Homo sapiens
aatagctcactgatttctcttt

SEQ ID NO: 9136252 - DNA, 22 bp, Homo sapiens
aatagctgattaatgtactacc

SEQ ID NO: 9136253 - DNA, 22 bp, Homo sapiens
aataggaagcaccaaattctcc

SEQ ID NO: 9136254 - DNA, 22 bp, Homo sapiens
aataggaaaatatttaacaaga

SEQ ID NO: 9136255 - DNA, 22 bp, Homo sapiens
aataggaagcaccaaattctcc

SEQ ID NO: 9136256 - DNA, 22 bp, Homo sapiens
aataggaagtcacatcaaggga

SEQ ID NO: 9136257 - DNA, 22 bp, Homo sapiens
aataggcagcttagcaggggct

SEQ ID NO: 9136258 - DNA, 22 bp, Homo sapiens
aataggctcaaatgttcttctc

SEQ ID NO: 9136259 - DNA, 22 bp, Homo sapiens
aataggtagccagatatataaa

SEQ ID NO: 9136260 - DNA, 22 bp, Homo sapiens
aataggaaaatatttaacaaga

SEQ ID NO: 9136261 - DNA, 22 bp, Homo sapiens
aataggaaaatatttaacaaga

SEQ ID NO: 9136262 - DNA, 22 bp, Homo sapiens
aatagctttggtcaccatctgg

SEQ ID NO: 9136263 - DNA, 22 bp, Homo sapiens
aatagcttattgacagtgaatt

SEQ ID NO: 9136264 - DNA, 22 bp, Homo sapiens
aatagcttatgggatagatgtt

SEQ ID NO: 9136265 - DNA, 22 bp, Homo sapiens
aatcacagccagcttccgctat

SEQ ID NO: 9136266 - DNA, 22 bp, Homo sapiens
aatcacagttagtaagggagaa

SEQ ID NO: 9136267 - DNA, 22 bp, Homo sapiens
agaaactgacaggaaatgaatt

SEQ ID NO: 9136268 - DNA, 22 bp, Homo sapiens
agaaagctggagtcaagcagag

SEQ ID NO: 9136269 - DNA, 22 bp, Homo sapiens
agaaactgaacacaagagtcgg

SEQ ID NO: 9136270 - DNA, 22 bp, Homo sapiens
aatcacatctcattcaacagcc

SEQ ID NO: 9136271 - DNA, 22 bp, Homo sapiens
agaaagcttatgaatgggcaag

SEQ ID NO: 9136272 - DNA, 22 bp, Homo sapiens
agaaagcttatgaatgggcaag

SEQ ID NO: 9136273 - DNA, 22 bp, Homo sapiens
agaaagcttatgaatgggcaag

SEQ ID NO: 9136274 - DNA, 22 bp, Homo sapiens
agaaaggattagtttggtataa

SEQ ID NO: 9136275 - DNA, 22 bp, Homo sapiens
agaaaggcaatattaactacac

SEQ ID NO: 9136276 - DNA, 22 bp, Homo sapiens
aatctaagccaccagtagtttc

SEQ ID NO: 9136277 - DNA, 22 bp, Homo sapiens
aatctaccttattcgatattta

SEQ ID NO: 9136278 - DNA, 22 bp, Homo sapiens
aatcctgtagattctaattcct

SEQ ID NO: 9136279 - DNA, 22 bp, Homo sapiens
aatcctgtcttgccatccaata

SEQ ID NO: 9136280 - DNA, 22 bp, Homo sapiens
agaaagggatgaggtagctgct

SEQ ID NO: 9136281 - DNA, 22 bp, Homo sapiens
agaaagggatgaggtagctgct

SEQ ID NO: 9136282 - DNA, 22 bp, Homo sapiens
agaaaggcagggatgaggattg

SEQ ID NO: 9136283 - DNA, 22 bp, Homo sapiens
aatcgaaagctgagggagcatt

SEQ ID NO: 9136284 - DNA, 22 bp, Homo sapiens
aatcctgtgtgactctggggag

SEQ ID NO: 9136285 - DNA, 22 bp, Homo sapiens
aatcctgtcttgccatccaata

SEQ ID NO: 9136286 - DNA, 22 bp, Homo sapiens
aatcctgtagattctaattcct

SEQ ID NO: 9136287 - DNA, 22 bp, Homo sapiens
aatcctgtgtgactctggggag

SEQ ID NO: 9136288 - DNA, 22 bp, Homo sapiens
agaaagggagagccagcacacg

SEQ ID NO: 9136289 - DNA, 22 bp, Homo sapiens
agaaagggaactggcaaagcca

SEQ ID NO: 9136290 - DNA, 22 bp, Homo sapiens
agaaagggaactggcaaagcca

SEQ ID NO: 9136291 - DNA, 22 bp, Homo sapiens
agaaagggaactggcaaagcca

SEQ ID NO: 9136292 - DNA, 22 bp, Homo sapiens
agaagcagctttcaaggtgatt

SEQ ID NO: 9136293 - DNA, 22 bp, Homo sapiens
agaagccaccagctgaggaaga

SEQ ID NO: 9136294 - DNA, 18 bp, Homo sapiens
agaagccacgaggagtcc

SEQ ID NO: 9136295 - DNA, 22 bp, Homo sapiens
agaagccactggaggttgagat

SEQ ID NO: 9136296 - DNA, 18 bp, Homo sapiens
agaagccacgaggagtcc

SEQ ID NO: 9136297 - DNA, 22 bp, Homo sapiens
agaagccactgctcccagtgag

SEQ ID NO: 9136298 - DNA, 22 bp, Homo sapiens
agaagccagaatattcatggat

SEQ ID NO: 9136299 - DNA, 22 bp, Homo sapiens
agaagccagaatattcatggat

SEQ ID NO: 9136300 - DNA, 22 bp, Homo sapiens
agaagccagaggcagtgggtac

SEQ ID NO: 9136301 - DNA, 22 bp, Homo sapiens
aatgaagaaatggacatcttta

SEQ ID NO: 9136302 - DNA, 22 bp, Homo sapiens
aatgaagaaatggacatcttta

SEQ ID NO: 9136303 - DNA, 22 bp, Homo sapiens
aatgaagataaaatgggatgga

SEQ ID NO: 9136304 - DNA, 22 bp, Homo sapiens
aatgaagacacatctttctcat

SEQ ID NO: 9136305 - DNA, 22 bp, Homo sapiens
aatgaagattatggtgattaag

SEQ ID NO: 9136306 - DNA, 22 bp, Homo sapiens
aatgaataccgtttcactcagt

SEQ ID NO: 9136307 - DNA, 22 bp, Homo sapiens
aatgaataccgtttcactcagt

SEQ ID NO: 9136308 - DNA, 21 bp, Homo sapiens
aatgaagtggctattttgagg

SEQ ID NO: 9136309 - DNA, 22 bp, Homo sapiens
agaactgtgaagtatgtgaaat

SEQ ID NO: 9136310 - DNA, 22 bp, Homo sapiens
agaactgtccttggaggagagt

SEQ ID NO: 9136311 - DNA, 22 bp, Homo sapiens
agaactgtccccagagagcact

SEQ ID NO: 9136312 - DNA, 22 bp, Homo sapiens
agaacttttggagacttttagt

SEQ ID NO: 9136313 - DNA, 17 bp, Homo sapiens
agaactgtagtagctcc

SEQ ID NO: 9136314 - DNA, 19 bp, Homo sapiens
agaactgggtccatggctt

SEQ ID NO: 9136315 - DNA, 22 bp, Homo sapiens
agaactctcgctggatcagact

SEQ ID NO: 9136316 - DNA, 22 bp, Homo sapiens
agaactattgcaataacaagaa

SEQ ID NO: 9136317 - DNA, 22 bp, Homo sapiens
agaacgaatgcttcagctctag

SEQ ID NO: 9136318 - DNA, 21 bp, Homo sapiens
agaactaagactcagcagtac

SEQ ID NO: 9136319 - DNA, 22 bp, Homo sapiens
agaacgtggaatgtggctcctt

SEQ ID NO: 9136320 - DNA, 22 bp, Homo sapiens
agaaggaaggaagcattctgtt

SEQ ID NO: 9136321 - DNA, 22 bp, Homo sapiens
agaaggaaggctgagtgctgat

SEQ ID NO: 9136322 - DNA, 22 bp, Homo sapiens
agaaggaaggctgagtgctgat

SEQ ID NO: 9136323 - DNA, 18 bp, Homo sapiens
aatgcaatgtatttgcag

SEQ ID NO: 9136324 - DNA, 22 bp, Homo sapiens
agaaggaaggataactgcatta

SEQ ID NO: 9136325 - DNA, 22 bp, Homo sapiens
agaagcttcctacattgttctt

SEQ ID NO: 9136326 - DNA, 22 bp, Homo sapiens
agaaggaaacagctgtgctttg

SEQ ID NO: 9136327 - DNA, 22 bp, Homo sapiens
agaaggaaacagctgtgctttg

SEQ ID NO: 9136328 - DNA, 22 bp, Homo sapiens
agaaggaaaacctgtcttatgt

SEQ ID NO: 9136329 - DNA, 22 bp, Homo sapiens
agaagcttcaagatatttggta

SEQ ID NO: 9136330 - DNA, 22 bp, Homo sapiens
agaagcttcctacattgttctt

SEQ ID NO: 9136331 - DNA, 22 bp, Homo sapiens
agaagcttccacggatgtgtct

SEQ ID NO: 9136332 - DNA, 22 bp, Homo sapiens
agaagcttgaaggagcagtgac

SEQ ID NO: 9136333 - DNA, 22 bp, Homo sapiens
agaagccagcttcagctgcccg

SEQ ID NO: 9136334 - DNA, 22 bp, Homo sapiens
agaagccagtcgctctcccgca

SEQ ID NO: 9136335 - DNA, 22 bp, Homo sapiens
agaagccagcttcagctgcccg

SEQ ID NO: 9136336 - DNA, 22 bp, Homo sapiens
agaagccagaggcagtgggtac

SEQ ID NO: 9136337 - DNA, 22 bp, Homo sapiens
agaagccagattgtagtgggac

SEQ ID NO: 9136338 - DNA, 22 bp, Homo sapiens
agaagccagattgtagtgggac

SEQ ID NO: 9136339 - DNA, 22 bp, Homo sapiens
agaagccagccttgcctccttt

SEQ ID NO: 9136340 - DNA, 22 bp, Homo sapiens
agaagccagccttgcctccttt

SEQ ID NO: 9136341 - DNA, 21 bp, Homo sapiens
aatgcattaacataaagctga

SEQ ID NO: 9136342 - DNA, 22 bp, Homo sapiens
aatgcattccactgagatttgt

SEQ ID NO: 9136343 - DNA, 22 bp, Homo sapiens
aatgcattaaagttagagactt

SEQ ID NO: 9136344 - DNA, 22 bp, Homo sapiens
aatgcctggcgattagtgtagc

SEQ ID NO: 9136345 - DNA, 22 bp, Homo sapiens
aatgccgtgtttcttacgttca

SEQ ID NO: 9136346 - DNA, 22 bp, Homo sapiens
aatgccgtagacttttacttat

SEQ ID NO: 9136347 - DNA, 22 bp, Homo sapiens
aatgccaacttggatatacatt

SEQ ID NO: 9136348 - DNA, 22 bp, Homo sapiens
actgaaaaagtatgattcactg

SEQ ID NO: 9136349 - DNA, 22 bp, Homo sapiens
actgaaaaagacatcttggtaa

SEQ ID NO: 9136350 - DNA, 22 bp, Homo sapiens
actgaaaatgaattagaaacag

SEQ ID NO: 9136351 - DNA, 19 bp, Homo sapiens
actcttttccttttgaatc

SEQ ID NO: 9136352 - DNA, 22 bp, Homo sapiens
actctttgtctgttgccgctta

SEQ ID NO: 9136353 - DNA, 18 bp, Homo sapiens
actctttctgcccacagg

SEQ ID NO: 9136354 - DNA, 22 bp, Homo sapiens
actctttattgtttgtggctag

SEQ ID NO: 9136355 - DNA, 18 bp, Homo sapiens
actctttctgcccacagg

SEQ ID NO: 9136356 - DNA, 22 bp, Homo sapiens
actctttatggtaagccgacca

SEQ ID NO: 9136357 - DNA, 22 bp, Homo sapiens
actctttagaggtacatctctt

SEQ ID NO: 9136358 - DNA, 18 bp, Homo sapiens
actctttctgcccacagg

SEQ ID NO: 9136359 - DNA, 22 bp, Homo sapiens
aagttcaatcagatgaaaaagc

SEQ ID NO: 9136360 - DNA, 22 bp, Homo sapiens
actgcactccagcctgggtgac

SEQ ID NO: 9136361 - DNA, 22 bp, Homo sapiens
actgcactccagcctgggtgac

SEQ ID NO: 9136362 - DNA, 22 bp, Homo sapiens
actgcagccttgaactctgggc

SEQ ID NO: 9136363 - DNA, 18 bp, Homo sapiens
actgcaggagaggtgagg

SEQ ID NO: 9136364 - DNA, 22 bp, Homo sapiens
actgcaggagacacagctgctg

SEQ ID NO: 9136365 - DNA, 18 bp, Homo sapiens
actgcaggagaggtgagg

SEQ ID NO: 9136366 - DNA, 22 bp, Homo sapiens
actgcagcctttgggctcataa

SEQ ID NO: 9136367 - DNA, 22 bp, Homo sapiens
actgcagctggtggtggctctg

SEQ ID NO: 9136368 - DNA, 22 bp, Homo sapiens
actgcattatcaccaagatgta

SEQ ID NO: 9136369 - DNA, 22 bp, Homo sapiens
actgcatgctttacatgacatg

SEQ ID NO: 9136370 - DNA, 22 bp, Homo sapiens
actgcatgataataatagcaga

SEQ ID NO: 9136371 - DNA, 22 bp, Homo sapiens
actgcatgataataatagcaga

SEQ ID NO: 9136372 - DNA, 21 bp, Homo sapiens
actgcatctgaagtcccagga

SEQ ID NO: 9136373 - DNA, 22 bp, Homo sapiens
actgcagggcatcctggccaag

SEQ ID NO: 9136374 - DNA, 22 bp, Homo sapiens
actgcagtcatcatctccctgg

SEQ ID NO: 9136375 - DNA, 22 bp, Homo sapiens
actgcataatgattctgctgcc

SEQ ID NO: 9136376 - DNA, 22 bp, Homo sapiens
actgcatagaggtccctgcgtc

SEQ ID NO: 9136377 - DNA, 22 bp, Homo sapiens
actgcagtggcaggaacttatc

SEQ ID NO: 9136378 - DNA, 19 bp, Homo sapiens
actgcagggaggaggtgtg

SEQ ID NO: 9136379 - DNA, 19 bp, Homo sapiens
actgcagggaggaggtgtg

SEQ ID NO: 9136380 - DNA, 22 bp, Homo sapiens
actgcaggccttggtgccagca

SEQ ID NO: 9136381 - DNA, 22 bp, Homo sapiens
actgcaggccttggtgccagca

SEQ ID NO: 9136382 - DNA, 22 bp, Homo sapiens
aagtgtgggaagtaggtggcga

SEQ ID NO: 9136383 - DNA, 19 bp, Homo sapiens
aagtgtgttgagccaggat

SEQ ID NO: 9136384 - DNA, 22 bp, Homo sapiens
aagtgtgtgagcctgtcaggct

SEQ ID NO: 9136385 - DNA, 22 bp, Homo sapiens
aagtgtgtatttttcttcagtg

SEQ ID NO: 9136386 - DNA, 22 bp, Homo sapiens
aagtgtgtattgtttatgctgc

SEQ ID NO: 9136387 - DNA, 22 bp, Homo sapiens
aagtgtctttatatttgagaaa

SEQ ID NO: 9136388 - DNA, 22 bp, Homo sapiens
acctgcctcagtgcagctggat

SEQ ID NO: 9136389 - DNA, 22 bp, Homo sapiens
actctggcttgaggaccaggtc

SEQ ID NO: 9136390 - DNA, 22 bp, Homo sapiens
actctgggaatcctcaccttcc

SEQ ID NO: 9136391 - DNA, 22 bp, Homo sapiens
actcttcttgctgctcattaat

SEQ ID NO: 9136392 - DNA, 22 bp, Homo sapiens
aagtgtttcttggaatgttgcg

SEQ ID NO: 9136393 - DNA, 22 bp, Homo sapiens
aagtgtttccattgtgcaggct

SEQ ID NO: 9136394 - DNA, 22 bp, Homo sapiens
aagtgtttggggatcattttaa

SEQ ID NO: 9136395 - DNA, 22 bp, Homo sapiens
aagtgtttggggatcattttaa

SEQ ID NO: 9136396 - DNA, 22 bp, Homo sapiens
aagtgttttctccccaccaggc

SEQ ID NO: 9136397 - DNA, 22 bp, Homo sapiens
actctttaacagactttgatct

SEQ ID NO: 9136398 - DNA, 22 bp, Homo sapiens
actcttgtttgtagagcccacc

SEQ ID NO: 9136399 - DNA, 22 bp, Homo sapiens
actctttacttaaactctaagt

SEQ ID NO: 9136400 - DNA, 20 bp, Homo sapiens
actctttagaagggaaaaca

SEQ ID NO: 9136401 - DNA, 22 bp, Homo sapiens
actcttgactccatggtgttag

SEQ ID NO: 9136402 - DNA, 20 bp, Homo sapiens
actcttgagaaattctctgt

SEQ ID NO: 9136403 - DNA, 22 bp, Homo sapiens
actcttgattgatttagtcttt

SEQ ID NO: 9136404 - DNA, 22 bp, Homo sapiens
actcttgaaggtggtgggagtg

SEQ ID NO: 9136405 - DNA, 22 bp, Homo sapiens
actcttgacgggtgaggatatg

SEQ ID NO: 9136406 - DNA, 22 bp, Homo sapiens
actcttgaaaatagatccacat

SEQ ID NO: 9136407 - DNA, 22 bp, Homo sapiens
actcttgaactgattaagaatg

SEQ ID NO: 9136408 - DNA, 22 bp, Homo sapiens
aagtgtttaaattatttgcagg

SEQ ID NO: 9136409 - DNA, 22 bp, Homo sapiens
aagtgtttaaattatttgcagg

SEQ ID NO: 9136410 - DNA, 22 bp, Homo sapiens
aagtgtttattgattggtctag

SEQ ID NO: 9136411 - DNA, 22 bp, Homo sapiens
aagtgtttatggttattgttaa

SEQ ID NO: 9136412 - DNA, 22 bp, Homo sapiens
aagtgtttacttaaagtcatgg

SEQ ID NO: 9136413 - DNA, 22 bp, Homo sapiens
aagtgtttaggtttgcagtcga

SEQ ID NO: 9136414 - DNA, 22 bp, Homo sapiens
aatagaatgtaatctaatacat

SEQ ID NO: 9136415 - DNA, 22 bp, Homo sapiens
aatagaatgtaatctaatacat

SEQ ID NO: 9136416 - DNA, 22 bp, Homo sapiens
actgtctcctcatcatgcctgg

SEQ ID NO: 9136417 - DNA, 18 bp, Homo sapiens
actgtctctgagagtggt

SEQ ID NO: 9136418 - DNA, 22 bp, Homo sapiens
actgtcctggagctcacactct

SEQ ID NO: 9136419 - DNA, 22 bp, Homo sapiens
actgtccttttaatgcagccgt

SEQ ID NO: 9136420 - DNA, 22 bp, Homo sapiens
actgtctcctcatcatgcctgg

SEQ ID NO: 9136421 - DNA, 22 bp, Homo sapiens
actgtcctcagatattcttctg

SEQ ID NO: 9136422 - DNA, 22 bp, Homo sapiens
actgtcctagaacctgcagctc

SEQ ID NO: 9136423 - DNA, 22 bp, Homo sapiens
actgtcctagaacctgcagctc

SEQ ID NO: 9136424 - DNA, 22 bp, Homo sapiens
actgtcctagaacctgcagctc

SEQ ID NO: 9136425 - DNA, 22 bp, Homo sapiens
actgtcctcgaagtacctgtgc

SEQ ID NO: 9136426 - DNA, 22 bp, Homo sapiens
actgtcctgaatactgcatgac

SEQ ID NO: 9136427 - DNA, 22 bp, Homo sapiens
aatagcaaatgctcatttgaaa

SEQ ID NO: 9136428 - DNA, 22 bp, Homo sapiens
aatagcaattacatttgcacca

SEQ ID NO: 9136429 - DNA, 22 bp, Homo sapiens
aatagcaaagttatcaaattaa

SEQ ID NO: 9136430 - DNA, 22 bp, Homo sapiens
aatagcaaagttatcaaattaa

SEQ ID NO: 9136431 - DNA, 22 bp, Homo sapiens
aatagaatttaaatgcagtggc

SEQ ID NO: 9136432 - DNA, 22 bp, Homo sapiens
aatagcaaacagacatgcacaa

SEQ ID NO: 9136433 - DNA, 22 bp, Homo sapiens
aatagcatcctaaaacatactt

SEQ ID NO: 9136434 - DNA, 20 bp, Homo sapiens
aatagcacagctcaaacatt

SEQ ID NO: 9136435 - DNA, 22 bp, Homo sapiens
actgtaacctcaaactcctggg

SEQ ID NO: 9136436 - DNA, 22 bp, Homo sapiens
actgtaatggtggatccatgtc

SEQ ID NO: 9136437 - DNA, 22 bp, Homo sapiens
actgtacacacttctctgtctt

SEQ ID NO: 9136438 - DNA, 22 bp, Homo sapiens
actgtacaacctctgcccctgt

SEQ ID NO: 9136439 - DNA, 22 bp, Homo sapiens
actgtacaaatattgcaaaata

SEQ ID NO: 9136440 - DNA, 22 bp, Homo sapiens
actgtcccatttatgtagacat

SEQ ID NO: 9136441 - DNA, 22 bp, Homo sapiens
actgtccataatattggtgaac

SEQ ID NO: 9136442 - DNA, 22 bp, Homo sapiens
actgtcatgtgctaactgtcca

SEQ ID NO: 9136443 - DNA, 22 bp, Homo sapiens
actgtacatatggattctaaga

SEQ ID NO: 9136444 - DNA, 22 bp, Homo sapiens
actgtacacagtggtgtactgt

SEQ ID NO: 9136445 - DNA, 22 bp, Homo sapiens
aataatacatgagattaatgtt

SEQ ID NO: 9136446 - DNA, 22 bp, Homo sapiens
aataatactgcatgtaaggtgc

SEQ ID NO: 9136447 - DNA, 22 bp, Homo sapiens
aataatacttcgtaaagttgtt

SEQ ID NO: 9136448 - DNA, 22 bp, Homo sapiens
aataataagatactaagggagt

SEQ ID NO: 9136449 - DNA, 22 bp, Homo sapiens
aataataagatactaagggagt

SEQ ID NO: 9136450 - DNA, 22 bp, Homo sapiens
aataatacttcgtaaagttgtt

SEQ ID NO: 9136451 - DNA, 22 bp, Homo sapiens
actgggcaccatcatgagatag

SEQ ID NO: 9136452 - DNA, 22 bp, Homo sapiens
aataagccagcccatgtgaccc

SEQ ID NO: 9136453 - DNA, 22 bp, Homo sapiens
aataataagatactaagggagt

SEQ ID NO: 9136454 - DNA, 22 bp, Homo sapiens
actgggcaaggatatgatgggt

SEQ ID NO: 9136455 - DNA, 22 bp, Homo sapiens
actgggcaaggatatgatgggt

SEQ ID NO: 9136456 - DNA, 22 bp, Homo sapiens
actgggcaataaattcagagaa

SEQ ID NO: 9136457 - DNA, 22 bp, Homo sapiens
actgggcaccatcatgagatag

SEQ ID NO: 9136458 - DNA, 22 bp, Homo sapiens
actggctgagttgcttcagcaa

SEQ ID NO: 9136459 - DNA, 22 bp, Homo sapiens
actggctgagtttatgttcaca

SEQ ID NO: 9136460 - DNA, 22 bp, Homo sapiens
actgggagggtcttgaagaggg

SEQ ID NO: 9136461 - DNA, 22 bp, Homo sapiens
actgggagggtcttgaagaggg

SEQ ID NO: 9136462 - DNA, 22 bp, Homo sapiens
actgggagtcatgaggaaggag

SEQ ID NO: 9136463 - DNA, 22 bp, Homo sapiens
actgggagtcatgaggaaggag

SEQ ID NO: 9136464 - DNA, 22 bp, Homo sapiens
actgggagtcatgaggaaggag

SEQ ID NO: 9136465 - DNA, 22 bp, Homo sapiens
aataaaatgaactggtagagtt

SEQ ID NO: 9136466 - DNA, 20 bp, Homo sapiens
aataaaagaagccttcaccc

SEQ ID NO: 9136467 - DNA, 21 bp, Homo sapiens
aataaaacagttggtgtcaat

SEQ ID NO: 9136468 - DNA, 22 bp, Homo sapiens
aagtttttcacattgctgttgt

SEQ ID NO: 9136469 - DNA, 22 bp, Homo sapiens
aagtttttcacattgctgttgt

SEQ ID NO: 9136470 - DNA, 20 bp, Homo sapiens
aagttttctccaaatacagt

SEQ ID NO: 9136471 - DNA, 22 bp, Homo sapiens
aaggcaaatgtgttcttttagt

SEQ ID NO: 9136472 - DNA, 22 bp, Homo sapiens
aaggcaagttttagttttctgg

SEQ ID NO: 9136473 - DNA, 17 bp, Homo sapiens
aaggcacagggcactgg

SEQ ID NO: 9136474 - DNA, 18 bp, Homo sapiens
aaggcacaggagaacatt

SEQ ID NO: 9136475 - DNA, 22 bp, Homo sapiens
aaggcacagccacttgatcatc

SEQ ID NO: 9136476 - DNA, 22 bp, Homo sapiens
aaggcacagaggcagggcactt

SEQ ID NO: 9136477 - DNA, 22 bp, Homo sapiens
aaggcacaacacaagagggtga

SEQ ID NO: 9136478 - DNA, 22 bp, Homo sapiens
aaggcacacagttagatagagc

SEQ ID NO: 9136479 - DNA, 22 bp, Homo sapiens
aaggccagagtactagaggctg

SEQ ID NO: 9136480 - DNA, 22 bp, Homo sapiens
aaggccagattctctctagggg

SEQ ID NO: 9136481 - DNA, 22 bp, Homo sapiens
aaggccagccctaatgatgctc

SEQ ID NO: 9136482 - DNA, 22 bp, Homo sapiens
aaggccagccctaatgatgctc

SEQ ID NO: 9136483 - DNA, 22 bp, Homo sapiens
aaggccagcctgagagctaaca

SEQ ID NO: 9136484 - DNA, 22 bp, Homo sapiens
acatcccacagaaacatacata

SEQ ID NO: 9136485 - DNA, 22 bp, Homo sapiens
aaggccagagcgtgtcctgcct

SEQ ID NO: 9136486 - DNA, 22 bp, Homo sapiens
aaggccagagcagactggagtt

SEQ ID NO: 9136487 - DNA, 22 bp, Homo sapiens
aaggccagagcagactggagtt

SEQ ID NO: 9136488 - DNA, 22 bp, Homo sapiens
aaggcacatattttagagtcac

SEQ ID NO: 9136489 - DNA, 22 bp, Homo sapiens
aaggcacattcctgaaaacaat

SEQ ID NO: 9136490 - DNA, 23 bp, Homo sapiens
aaggccagagagaggctagtgtc

SEQ ID NO: 9136491 - DNA, 22 bp, Homo sapiens
acatgaaatgcagcctgtaacc

SEQ ID NO: 9136492 - DNA, 22 bp, Homo sapiens
acatgaaatgcagcctgtaacc

SEQ ID NO: 9136493 - DNA, 22 bp, Homo sapiens
acatgaaatgcagcctgtaacc

SEQ ID NO: 9136494 - DNA, 22 bp, Homo sapiens
acatgaacatgctcaaataact

SEQ ID NO: 9136495 - DNA, 22 bp, Homo sapiens
acatgaagcaagaaagatgcta

SEQ ID NO: 9136496 - DNA, 22 bp, Homo sapiens
acatctagaagatctgggagat

SEQ ID NO: 9136497 - DNA, 22 bp, Homo sapiens
acatgcataggagaagtcttta

SEQ ID NO: 9136498 - DNA, 22 bp, Homo sapiens
acatgcataggagaagtcttta

SEQ ID NO: 9136499 - DNA, 21 bp, Homo sapiens
acatgcatagagagatttctg

SEQ ID NO: 9136500 - DNA, 22 bp, Homo sapiens
acatgcatgaaatccataaaca

SEQ ID NO: 9136501 - DNA, 22 bp, Homo sapiens
acatgcatctccaggctcattt

SEQ ID NO: 9136502 - DNA, 22 bp, Homo sapiens
acatgcatctctgggacacatg

SEQ ID NO: 9136503 - DNA, 22 bp, Homo sapiens
acatgcatctctgggacacatg

SEQ ID NO: 9136504 - DNA, 22 bp, Homo sapiens
acatgcatatacttaaatatgt

SEQ ID NO: 9136505 - DNA, 19 bp, Homo sapiens
acatgcatatggacagttg

SEQ ID NO: 9136506 - DNA, 22 bp, Homo sapiens
acatgcatgtcatcagcccttt

SEQ ID NO: 9136507 - DNA, 22 bp, Homo sapiens
acatgcatgtctatgggcaggt

SEQ ID NO: 9136508 - DNA, 22 bp, Homo sapiens
acatgcatggggtaatggtatt

SEQ ID NO: 9136509 - DNA, 22 bp, Homo sapiens
acatgcatggtgttgggttgga

SEQ ID NO: 9136510 - DNA, 22 bp, Homo sapiens
acatgcatgctttggtgggtgt

SEQ ID NO: 9136511 - DNA, 22 bp, Homo sapiens
acatgcatggctgcttaaatta

SEQ ID NO: 9136512 - DNA, 22 bp, Homo sapiens
acatgcatggacatgtatatat

SEQ ID NO: 9136513 - DNA, 22 bp, Homo sapiens
acatgcatggagggaaaatgtc

SEQ ID NO: 9136514 - DNA, 22 bp, Homo sapiens
acatgacagggaatgaggtgaa

SEQ ID NO: 9136515 - DNA, 22 bp, Homo sapiens
acatgacagtgactttataaga

SEQ ID NO: 9136516 - DNA, 22 bp, Homo sapiens
acatgacacaggcctggccaat

SEQ ID NO: 9136517 - DNA, 22 bp, Homo sapiens
acatgacacctctggctgggtg

SEQ ID NO: 9136518 - DNA, 22 bp, Homo sapiens
acatgacaaaatgcacaggatt

SEQ ID NO: 9136519 - DNA, 19 bp, Homo sapiens
acatgacaacaggggaggc

SEQ ID NO: 9136520 - DNA, 22 bp, Homo sapiens
acatgacaaggtttataaggct

SEQ ID NO: 9136521 - DNA, 22 bp, Homo sapiens
acatgacagtgcttagcaaact

SEQ ID NO: 9136522 - DNA, 22 bp, Homo sapiens
acatgacatagtagaaaagccc

SEQ ID NO: 9136523 - DNA, 17 bp, Homo sapiens
acatgactgcacaaagt

SEQ ID NO: 9136524 - DNA, 22 bp, Homo sapiens
acatgcatacacgtacatacct

SEQ ID NO: 9136525 - DNA, 22 bp, Homo sapiens
acatgcatacacgtacatacct

SEQ ID NO: 9136526 - DNA, 22 bp, Homo sapiens
acatgcatactgctgccaacgc

SEQ ID NO: 9136527 - DNA, 22 bp, Homo sapiens
acatgcatacgtgtgtttaaaa

SEQ ID NO: 9136528 - DNA, 22 bp, Homo sapiens
aagctgttctccagtgactcag

SEQ ID NO: 9136529 - DNA, 22 bp, Homo sapiens
aagctgttgccctgctctttct

SEQ ID NO: 9136530 - DNA, 22 bp, Homo sapiens
aagctgttgttcatcctgaatt

SEQ ID NO: 9136531 - DNA, 22 bp, Homo sapiens
aagctgttgttcatcctgaatt

SEQ ID NO: 9136532 - DNA, 22 bp, Homo sapiens
aagcttatatcagaacaatgct

SEQ ID NO: 9136533 - DNA, 22 bp, Homo sapiens
aagcttcacattgaacttgggt

SEQ ID NO: 9136534 - DNA, 22 bp, Homo sapiens
aagcttcaatgagataattgtt

SEQ ID NO: 9136535 - DNA, 23 bp, Homo sapiens
aagcttattgccaccttggggag

SEQ ID NO: 9136536 - DNA, 22 bp, Homo sapiens
aagcttcagtgtgagcatgtaa

SEQ ID NO: 9136537 - DNA, 22 bp, Homo sapiens
aagcttcagttctggggcaatg

SEQ ID NO: 9136538 - DNA, 22 bp, Homo sapiens
aagcttcatatatgtgtgagtc

SEQ ID NO: 9136539 - DNA, 22 bp, Homo sapiens
aagcttcaggcccacccatgtc

SEQ ID NO: 9136540 - DNA, 22 bp, Homo sapiens
aagcttcagtggactgtagtgt

SEQ ID NO: 9136541 - DNA, 23 bp, Homo sapiens
aagcttctagggtgggcaagatg

SEQ ID NO: 9136542 - DNA, 23 bp, Homo sapiens
aagcttctatctctgcagaagga

SEQ ID NO: 9136543 - DNA, 23 bp, Homo sapiens
aagcttctatctctgcagaagga

SEQ ID NO: 9136544 - DNA, 23 bp, Homo sapiens
aagcttccttcacgtctcctggg

SEQ ID NO: 9136545 - DNA, 23 bp, Homo sapiens
aagcttccttcacgtctcctggg

SEQ ID NO: 9136546 - DNA, 23 bp, Homo sapiens
aagcttccttgactggcccctag

SEQ ID NO: 9136547 - DNA, 20 bp, Homo sapiens
aagcttccttgggcgcccgg

SEQ ID NO: 9136548 - DNA, 22 bp, Homo sapiens
aagcttcatttcaactcagggg

SEQ ID NO: 9136549 - DNA, 20 bp, Homo sapiens
aagcttccaggatctggtgt

SEQ ID NO: 9136550 - DNA, 21 bp, Homo sapiens
aagcttccctgctctccaggg

SEQ ID NO: 9136551 - DNA, 22 bp, Homo sapiens
aagcttcttagaatgcatgtgc

SEQ ID NO: 9136552 - DNA, 22 bp, Homo sapiens
aagcttctttacaggagagatt

SEQ ID NO: 9136553 - DNA, 22 bp, Homo sapiens
aaggaagaagggaagttactta

SEQ ID NO: 9136554 - DNA, 22 bp, Homo sapiens
aaggaagaagggaagttactta

SEQ ID NO: 9136555 - DNA, 22 bp, Homo sapiens
aaggaagaagggaagttactta

SEQ ID NO: 9136556 - DNA, 21 bp, Homo sapiens
aagctgtgttccactgatagc

SEQ ID NO: 9136557 - DNA, 22 bp, Homo sapiens
aagctgtgtgcagatgatctca

SEQ ID NO: 9136558 - DNA, 22 bp, Homo sapiens
aagctgtgtgcagatgatctca

SEQ ID NO: 9136559 - DNA, 22 bp, Homo sapiens
aagctgtgtattacagaatatt

SEQ ID NO: 9136560 - DNA, 22 bp, Homo sapiens
aagctgtgtgactatttctgag

SEQ ID NO: 9136561 - DNA, 22 bp, Homo sapiens
aagctgtgtgactatttctgag

SEQ ID NO: 9136562 - DNA, 22 bp, Homo sapiens
aagctgtgtcctagaggtgtaa

SEQ ID NO: 9136563 - DNA, 22 bp, Homo sapiens
aagctgtggtaaagggtagagg

SEQ ID NO: 9136564 - DNA, 22 bp, Homo sapiens
aagctgtgtaagttgcttggtt

SEQ ID NO: 9136565 - DNA, 22 bp, Homo sapiens
aagctgtgtaagttgcttggtt

SEQ ID NO: 9136566 - DNA, 22 bp, Homo sapiens
aagctgtgtaagttgcttggtt

SEQ ID NO: 9136567 - DNA, 22 bp, Homo sapiens
aagctgtgtattacagaatatt

SEQ ID NO: 9136568 - DNA, 22 bp, Homo sapiens
aagctgtgtattacagaatatt

SEQ ID NO: 9136569 - DNA, 22 bp, Homo sapiens
aagctgtgcctttgcctagaat

SEQ ID NO: 9136570 - DNA, 22 bp, Homo sapiens
aagctgtggcttggaggaaaca

SEQ ID NO: 9136571 - DNA, 22 bp, Homo sapiens
aagctgtggcttggaggaaaca

SEQ ID NO: 9136572 - DNA, 22 bp, Homo sapiens
aagctgtgcaggaactgcttgc

SEQ ID NO: 9136573 - DNA, 22 bp, Homo sapiens
aagctgtgcaggaactgcttgc

SEQ ID NO: 9136574 - DNA, 22 bp, Homo sapiens
aagctgtgagctggatgctcca

SEQ ID NO: 9136575 - DNA, 22 bp, Homo sapiens
aagctgtgagctggatgctcca

SEQ ID NO: 9136576 - DNA, 22 bp, Homo sapiens
aagctgtgaagagcaagtgagg

SEQ ID NO: 9136577 - DNA, 22 bp, Homo sapiens
aagctgtgagctggatgctcca

SEQ ID NO: 9136578 - DNA, 22 bp, Homo sapiens
aagctgtgaaatctctagtgca

SEQ ID NO: 9136579 - DNA, 22 bp, Homo sapiens
aagctgtgaagagcaagtgagg

SEQ ID NO: 9136580 - DNA, 22 bp, Homo sapiens
aagctgtgaaatctctagtgca

SEQ ID NO: 9136581 - DNA, 22 bp, Homo sapiens
acagctggaggccccattgtcc

SEQ ID NO: 9136582 - DNA, 22 bp, Homo sapiens
acagctggaggggctgcagagg

SEQ ID NO: 9136583 - DNA, 22 bp, Homo sapiens
acagctggaggccccattgtcc

SEQ ID NO: 9136584 - DNA, 22 bp, Homo sapiens
aagctggatgtaggatccccct

SEQ ID NO: 9136585 - DNA, 22 bp, Homo sapiens
aagctggatgccttcctcccaa

SEQ ID NO: 9136586 - DNA, 22 bp, Homo sapiens
aagctggaggctgagatcacca

SEQ ID NO: 9136587 - DNA, 22 bp, Homo sapiens
aagctggagtgcagtgcaatgg

SEQ ID NO: 9136588 - DNA, 22 bp, Homo sapiens
aagctggagagtttcacagatg

SEQ ID NO: 9136589 - DNA, 22 bp, Homo sapiens
aagctggaggctgagatcacca

SEQ ID NO: 9136590 - DNA, 22 bp, Homo sapiens
acagctggagtgaggatggagt

SEQ ID NO: 9136591 - DNA, 22 bp, Homo sapiens
acagctggagtgttggtgaggt

SEQ ID NO: 9136592 - DNA, 22 bp, Homo sapiens
aaggatcatagtaaacattgat

SEQ ID NO: 9136593 - DNA, 22 bp, Homo sapiens
aaggatcatgtatatgtttaag

SEQ ID NO: 9136594 - DNA, 23 bp, Homo sapiens
aaggatctctgagatcatggctt

SEQ ID NO: 9136595 - DNA, 22 bp, Homo sapiens
aaggcaaaagaggtgtcatcac

SEQ ID NO: 9136596 - DNA, 22 bp, Homo sapiens
aaggacaggagaaaacgggatc

SEQ ID NO: 9136597 - DNA, 22 bp, Homo sapiens
aaggacaggagaaaacgggatc

SEQ ID NO: 9136598 - DNA, 22 bp, Homo sapiens
aaggacagagagccattccaga

SEQ ID NO: 9136599 - DNA, 22 bp, Homo sapiens
aaggacagagagccattccaga

SEQ ID NO: 9136600 - DNA, 22 bp, Homo sapiens
aaggacagaaacagattgctgg

SEQ ID NO: 9136601 - DNA, 22 bp, Homo sapiens
aaggacacctgcagagggacca

SEQ ID NO: 9136602 - DNA, 22 bp, Homo sapiens
aaggacagaaacagattgctgg

SEQ ID NO: 9136603 - DNA, 22 bp, Homo sapiens
aaggacaagtagtatttgcatc

SEQ ID NO: 9136604 - DNA, 22 bp, Homo sapiens
aaggacaatgaagacagccaca

SEQ ID NO: 9136605 - DNA, 22 bp, Homo sapiens
aaggaaggtactcagtgattct

SEQ ID NO: 9136606 - DNA, 22 bp, Homo sapiens
aaggaaggttcatagtcaaaga

SEQ ID NO: 9136607 - DNA, 21 bp, Homo sapiens
aaggaagtgactttagtggtt

SEQ ID NO: 9136608 - DNA, 22 bp, Homo sapiens
aaggaattccctttctgacaga

SEQ ID NO: 9136609 - DNA, 17 bp, Homo sapiens
aaggaatgtcagaagtt

SEQ ID NO: 9136610 - DNA, 22 bp, Homo sapiens
aaggaatttgaggctgcagtga

SEQ ID NO: 9136611 - DNA, 22 bp, Homo sapiens
aaggaaggaattgatcatgcgc

SEQ ID NO: 9136612 - DNA, 22 bp, Homo sapiens
aaggaagggaaatagtgatgtc

SEQ ID NO: 9136613 - DNA, 22 bp, Homo sapiens
aaggaagggaaatagtgatgtc

SEQ ID NO: 9136614 - DNA, 22 bp, Homo sapiens
aaggaagggaaatagtgatgtc

SEQ ID NO: 9136615 - DNA, 22 bp, Homo sapiens
aaggaagatgaggtgctgctta

SEQ ID NO: 9136616 - DNA, 22 bp, Homo sapiens
aaggaagatgctggcctgggga

SEQ ID NO: 9136617 - DNA, 22 bp, Homo sapiens
accagagtaatgtgtggaaatt

SEQ ID NO: 9136618 - DNA, 22 bp, Homo sapiens
accagaggctctgccacctcca

SEQ ID NO: 9136619 - DNA, 22 bp, Homo sapiens
accagagcttacatgctagaaa

SEQ ID NO: 9136620 - DNA, 22 bp, Homo sapiens
accagagctggctctgagcacc

SEQ ID NO: 9136621 - DNA, 22 bp, Homo sapiens
accagagctggctctgagcacc

SEQ ID NO: 9136622 - DNA, 22 bp, Homo sapiens
aaggggaagagaccgcagagtc

SEQ ID NO: 9136623 - DNA, 22 bp, Homo sapiens
aaggggaaaaagtgttaggagt

SEQ ID NO: 9136624 - DNA, 19 bp, Homo sapiens
aaggggtgagggaagcaga

SEQ ID NO: 9136625 - DNA, 19 bp, Homo sapiens
aaggggtgagggaagcaga

SEQ ID NO: 9136626 - DNA, 22 bp, Homo sapiens
aaggggtgctgttggaaaccca

SEQ ID NO: 9136627 - DNA, 22 bp, Homo sapiens
aaggggtgctgttggaaaccca

SEQ ID NO: 9136628 - DNA, 22 bp, Homo sapiens
aaggggtcaagcggcagctaca

SEQ ID NO: 9136629 - DNA, 22 bp, Homo sapiens
aagggtgcgacctaggagtgag

SEQ ID NO: 9136630 - DNA, 23 bp, Homo sapiens
aagggtccatagctatcattaca

SEQ ID NO: 9136631 - DNA, 19 bp, Homo sapiens
aagggtcacaagcagcaga

SEQ ID NO: 9136632 - DNA, 22 bp, Homo sapiens
aagggtccaaggctttgcgttt

SEQ ID NO: 9136633 - DNA, 22 bp, Homo sapiens
aagggtccagcacctcggctcc

SEQ ID NO: 9136634 - DNA, 22 bp, Homo sapiens
aaggggtgggcattagagcagt

SEQ ID NO: 9136635 - DNA, 22 bp, Homo sapiens
aaggggtgggcattagagcagt

SEQ ID NO: 9136636 - DNA, 22 bp, Homo sapiens
aagggtgggccctggcagccat

SEQ ID NO: 9136637 - DNA, 22 bp, Homo sapiens
aagggtgggcaccgccaggtca

SEQ ID NO: 9136638 - DNA, 22 bp, Homo sapiens
aaggtaatccataatagttact

SEQ ID NO: 9136639 - DNA, 22 bp, Homo sapiens
aagggtttgtctccctcaaggc

SEQ ID NO: 9136640 - DNA, 22 bp, Homo sapiens
aagggttgaagataaataaggt

SEQ ID NO: 9136641 - DNA, 22 bp, Homo sapiens
aagggttgcaaggtcagaggaa

SEQ ID NO: 9136642 - DNA, 22 bp, Homo sapiens
aagggttgaagataaataaggt

SEQ ID NO: 9136643 - DNA, 22 bp, Homo sapiens
aagggctggatctctctgagca

SEQ ID NO: 9136644 - DNA, 22 bp, Homo sapiens
aagggctggagaggaaaggttg

SEQ ID NO: 9136645 - DNA, 22 bp, Homo sapiens
aagggctggatctctctgagca

SEQ ID NO: 9136646 - DNA, 22 bp, Homo sapiens
aagggctggccacattctgggt

SEQ ID NO: 9136647 - DNA, 22 bp, Homo sapiens
aagggctggccacattctgggt

SEQ ID NO: 9136648 - DNA, 22 bp, Homo sapiens
aagggctggccacattctgggt

SEQ ID NO: 9136649 - DNA, 22 bp, Homo sapiens
aagggctggccctgggaagagt

SEQ ID NO: 9136650 - DNA, 22 bp, Homo sapiens
aagggctggccctgggaagagt

SEQ ID NO: 9136651 - DNA, 18 bp, Homo sapiens
aagggctggcctttggag

SEQ ID NO: 9136652 - DNA, 22 bp, Homo sapiens
aagggctgggtctggttaaccc

SEQ ID NO: 9136653 - DNA, 19 bp, Homo sapiens
aagggctgggcacctcact

SEQ ID NO: 9136654 - DNA, 22 bp, Homo sapiens
acatttcagcgtgcatgacatg

SEQ ID NO: 9136655 - DNA, 22 bp, Homo sapiens
acatttcagcgtgcatgacatg

SEQ ID NO: 9136656 - DNA, 22 bp, Homo sapiens
acatttcagcgtgcatgacatg

SEQ ID NO: 9136657 - DNA, 22 bp, Homo sapiens
aagggctggagactgggtcttc

SEQ ID NO: 9136658 - DNA, 22 bp, Homo sapiens
aagggctggagactgggtcttc

SEQ ID NO: 9136659 - DNA, 22 bp, Homo sapiens
aagggctgcaatccaaaacact

SEQ ID NO: 9136660 - DNA, 22 bp, Homo sapiens
aagggctgatctcactttcttt

SEQ ID NO: 9136661 - DNA, 22 bp, Homo sapiens
acatttcagtgagctattgaag

SEQ ID NO: 9136662 - DNA, 20 bp, Homo sapiens
aagggcagagggaacagact

SEQ ID NO: 9136663 - DNA, 20 bp, Homo sapiens
aagggcagagggaacagact

SEQ ID NO: 9136664 - DNA, 20 bp, Homo sapiens
aagggcagagggaacagact

SEQ ID NO: 9136665 - DNA, 20 bp, Homo sapiens
aagggcagagggaacagact

SEQ ID NO: 9136666 - DNA, 22 bp, Homo sapiens
aagggcagaatagagaagatgg

SEQ ID NO: 9136667 - DNA, 22 bp, Homo sapiens
aagggcagaatagagaagatgg

SEQ ID NO: 9136668 - DNA, 22 bp, Homo sapiens
aagggcagagggaatcccacat

SEQ ID NO: 9136669 - DNA, 22 bp, Homo sapiens
acatttcagaatcacacagctt

SEQ ID NO: 9136670 - DNA, 22 bp, Homo sapiens
aagggaggggatgtaagcctgg

SEQ ID NO: 9136671 - DNA, 22 bp, Homo sapiens
aagggaggtaaagctatttaaa

SEQ ID NO: 9136672 - DNA, 20 bp, Homo sapiens
aagggagaataatgattgta

SEQ ID NO: 9136673 - DNA, 22 bp, Homo sapiens
acatgcatgttgtgtagggggg

SEQ ID NO: 9136674 - DNA, 22 bp, Homo sapiens
acatgcatgtgaatatggacac

SEQ ID NO: 9136675 - DNA, 22 bp, Homo sapiens
aagggcagaatagagaagatgg

SEQ ID NO: 9136676 - DNA, 22 bp, Homo sapiens
aagggcagaaagggacgctttg

SEQ ID NO: 9136677 - DNA, 22 bp, Homo sapiens
aagggcagaaagggacgctttg

SEQ ID NO: 9136678 - DNA, 22 bp, Homo sapiens
aagggatgcaggaaagaaggtt

SEQ ID NO: 9136679 - DNA, 22 bp, Homo sapiens
aagggatgtaaacatgaataag

SEQ ID NO: 9136680 - DNA, 22 bp, Homo sapiens
aagggcaagatcctaagcatcc

SEQ ID NO: 9136681 - DNA, 22 bp, Homo sapiens
aagggcacagggaaagagtgca

SEQ ID NO: 9136682 - DNA, 22 bp, Homo sapiens
aagtagttggaaataagacaga

SEQ ID NO: 9136683 - DNA, 22 bp, Homo sapiens
aagtagtgtgctccagcggtga

SEQ ID NO: 9136684 - DNA, 22 bp, Homo sapiens
aagtagttaggaacattctctc

SEQ ID NO: 9136685 - DNA, 22 bp, Homo sapiens
aagtagttagtccgcctgctct

SEQ ID NO: 9136686 - DNA, 22 bp, Homo sapiens
aagtatatactaaatgttaatc

SEQ ID NO: 9136687 - DNA, 22 bp, Homo sapiens
aagtataagctattcttcatga

SEQ ID NO: 9136688 - DNA, 23 bp, Homo sapiens
aagtagataacactgttctgaga

SEQ ID NO: 9136689 - DNA, 23 bp, Homo sapiens
aagtagatagctaaagttttgtt

SEQ ID NO: 9136690 - DNA, 22 bp, Homo sapiens
aagtagcattttcaaaatgtat

SEQ ID NO: 9136691 - DNA, 22 bp, Homo sapiens
aagtccagtgatactggcagga

SEQ ID NO: 9136692 - DNA, 22 bp, Homo sapiens
aagtatatactaaatgttaatc

SEQ ID NO: 9136693 - DNA, 22 bp, Homo sapiens
aagtatattttttgaagcatat

SEQ ID NO: 9136694 - DNA, 22 bp, Homo sapiens
aagtcctcaattttctctgcta

SEQ ID NO: 9136695 - DNA, 20 bp, Homo sapiens
aagtccctaagtctctggcc

SEQ ID NO: 9136696 - DNA, 22 bp, Homo sapiens
acctgcccttaacactgtgtgc

SEQ ID NO: 9136697 - DNA, 22 bp, Homo sapiens
acctgccctggaggaagatatt

SEQ ID NO: 9136698 - DNA, 22 bp, Homo sapiens
acctgcccggggacattccttt

SEQ ID NO: 9136699 - DNA, 22 bp, Homo sapiens
acctgcctatcagctgcctgct

SEQ ID NO: 9136700 - DNA, 22 bp, Homo sapiens
acctctggccaagactcgtgtt

SEQ ID NO: 9136701 - DNA, 22 bp, Homo sapiens
acctctgccaagatgtgctccc

SEQ ID NO: 9136702 - DNA, 22 bp, Homo sapiens
acctctgccactttctaactct

SEQ ID NO: 9136703 - DNA, 22 bp, Homo sapiens
acctctgcttcccgggttcaag

SEQ ID NO: 9136704 - DNA, 22 bp, Homo sapiens
acctctgctcaagacccctccg

SEQ ID NO: 9136705 - DNA, 22 bp, Homo sapiens
acctctgcaaccctggaatggg

SEQ ID NO: 9136706 - DNA, 22 bp, Homo sapiens
acctctgcaaccctggaatggg

SEQ ID NO: 9136707 - DNA, 22 bp, Homo sapiens
acctctctgggcctgcttcctg

SEQ ID NO: 9136708 - DNA, 20 bp, Homo sapiens
acctcctggaagcaggtgcc

SEQ ID NO: 9136709 - DNA, 22 bp, Homo sapiens
acctagtttttcagcaaataca

SEQ ID NO: 9136710 - DNA, 22 bp, Homo sapiens
aaggtgtcaccagattggcagg

SEQ ID NO: 9136711 - DNA, 22 bp, Homo sapiens
acctcgagttctttcaattcac

SEQ ID NO: 9136712 - DNA, 21 bp, Homo sapiens
acctcctggcatcctgttccc

SEQ ID NO: 9136713 - DNA, 22 bp, Homo sapiens
acccagggcagccagcggggag

SEQ ID NO: 9136714 - DNA, 22 bp, Homo sapiens
acccagggccacagcccgcagt

SEQ ID NO: 9136715 - DNA, 22 bp, Homo sapiens
acccagggccacagcccgcagt

SEQ ID NO: 9136716 - DNA, 22 bp, Homo sapiens
acccagggctcaagcgtaggca

SEQ ID NO: 9136717 - DNA, 22 bp, Homo sapiens
acccagggcagccagcggggag

SEQ ID NO: 9136718 - DNA, 22 bp, Homo sapiens
acccagggagtgctcctgttct

SEQ ID NO: 9136719 - DNA, 22 bp, Homo sapiens
acccaggccattggcaagagtc

SEQ ID NO: 9136720 - DNA, 22 bp, Homo sapiens
acccagggcttaaggcggtgca

SEQ ID NO: 9136721 - DNA, 22 bp, Homo sapiens
acccagggcttaaggcggtgca

SEQ ID NO: 9136722 - DNA, 22 bp, Homo sapiens
acccagggctcaagcgtaggca

SEQ ID NO: 9136723 - DNA, 21 bp, Homo sapiens
acccaggggaagcagaaactg

SEQ ID NO: 9136724 - DNA, 22 bp, Homo sapiens
acccaggggcagccttgctgtg

SEQ ID NO: 9136725 - DNA, 22 bp, Homo sapiens
acccaggggcagccttgctgtg

SEQ ID NO: 9136726 - DNA, 22 bp, Homo sapiens
acccaggggcgaagctggccac

SEQ ID NO: 9136727 - DNA, 19 bp, Homo sapiens
acccaggggtttatgtgtg

SEQ ID NO: 9136728 - DNA, 22 bp, Homo sapiens
acccaggggcgaagctggccac

SEQ ID NO: 9136729 - DNA, 22 bp, Homo sapiens
acccagggtagaacctcagagc

SEQ ID NO: 9136730 - DNA, 22 bp, Homo sapiens
agcacaggctttggtgtgaggg

SEQ ID NO: 9136731 - DNA, 22 bp, Homo sapiens
agcacaggctttggtgtgaggg

SEQ ID NO: 9136732 - DNA, 22 bp, Homo sapiens
agcacagggcccagcctaggcc

SEQ ID NO: 9136733 - DNA, 22 bp, Homo sapiens
agcacagggacaatgccaggtg

SEQ ID NO: 9136734 - DNA, 21 bp, Homo sapiens
agcacagctttaagccatgtg

SEQ ID NO: 9136735 - DNA, 22 bp, Homo sapiens
agcacagaatgaggtggaagtg

SEQ ID NO: 9136736 - DNA, 22 bp, Homo sapiens
agcacagaaagcacatttgaaa

SEQ ID NO: 9136737 - DNA, 23 bp, Homo sapiens
agcacacttgtacaatgccctag

SEQ ID NO: 9136738 - DNA, 22 bp, Homo sapiens
agcacactgacctgaagccttg

SEQ ID NO: 9136739 - DNA, 22 bp, Homo sapiens
agcacacatcacttctgctcat

SEQ ID NO: 9136740 - DNA, 22 bp, Homo sapiens
agcacacatcacttctgctcat

SEQ ID NO: 9136741 - DNA, 22 bp, Homo sapiens
agcacactggcattgggaagct

SEQ ID NO: 9136742 - DNA, 22 bp, Homo sapiens
agcacaatgtgaaaagagctct

SEQ ID NO: 9136743 - DNA, 22 bp, Homo sapiens
agcacaatgtgaaaagagctct

SEQ ID NO: 9136744 - DNA, 22 bp, Homo sapiens
agcacacagtattagccattgt

SEQ ID NO: 9136745 - DNA, 23 bp, Homo sapiens
agcacaaagtgttttccttgtag

SEQ ID NO: 9136746 - DNA, 22 bp, Homo sapiens
agcaaataaagacaattatgtc

SEQ ID NO: 9136747 - DNA, 19 bp, Homo sapiens
agcaaatacatcaaaattg

SEQ ID NO: 9136748 - DNA, 19 bp, Homo sapiens
agcaaatacatcaaaattg

SEQ ID NO: 9136749 - DNA, 22 bp, Homo sapiens
agcaaagcttccataaagcagc

SEQ ID NO: 9136750 - DNA, 22 bp, Homo sapiens
agcaaagctgattaagagcaca

SEQ ID NO: 9136751 - DNA, 22 bp, Homo sapiens
agcaaagctgattaagagcaca

SEQ ID NO: 9136752 - DNA, 23 bp, Homo sapiens
agcaaagttgttgctaacctcat

SEQ ID NO: 9136753 - DNA, 22 bp, Homo sapiens
agcaaaagatagattaacaaga

SEQ ID NO: 9136754 - DNA, 22 bp, Homo sapiens
acaataatgtattgccaaaagt

SEQ ID NO: 9136755 - DNA, 22 bp, Homo sapiens
acaatactattttcagtatcct

SEQ ID NO: 9136756 - DNA, 19 bp, Homo sapiens
agcaaatataatagtgttc

SEQ ID NO: 9136757 - DNA, 22 bp, Homo sapiens
acaagtttcattgtttagaacc

SEQ ID NO: 9136758 - DNA, 18 bp, Homo sapiens
agcaaatattaagtgcat

SEQ ID NO: 9136759 - DNA, 18 bp, Homo sapiens
agcaaatattaagtgcat

SEQ ID NO: 9136760 - DNA, 19 bp, Homo sapiens
acaataactcattgattgc

SEQ ID NO: 9136761 - DNA, 22 bp, Homo sapiens
agcaaatacttgaataaaaaga

SEQ ID NO: 9136762 - DNA, 22 bp, Homo sapiens
agcaaatacttgaataaaaaga

SEQ ID NO: 9136763 - DNA, 22 bp, Homo sapiens
agagttaagaggaatgtgaatt

SEQ ID NO: 9136764 - DNA, 22 bp, Homo sapiens
agagtgtgtctatggaaggggt

SEQ ID NO: 9136765 - DNA, 22 bp, Homo sapiens
agagtgtggaacttgaggagct

SEQ ID NO: 9136766 - DNA, 22 bp, Homo sapiens
agagtgtgtggggctgaggtca

SEQ ID NO: 9136767 - DNA, 22 bp, Homo sapiens
agagtgtgtggggctgaggtca

SEQ ID NO: 9136768 - DNA, 22 bp, Homo sapiens
agagtgtgaagaaagtgcaatg

SEQ ID NO: 9136769 - DNA, 22 bp, Homo sapiens
agagtgtggaacttgaggagct

SEQ ID NO: 9136770 - DNA, 22 bp, Homo sapiens
agagtgtggaaatgttcagagt

SEQ ID NO: 9136771 - DNA, 23 bp, Homo sapiens
aatttggttgatgaaagcattgt

SEQ ID NO: 9136772 - DNA, 22 bp, Homo sapiens
aatttggttttaagagcatcag

SEQ ID NO: 9136773 - DNA, 23 bp, Homo sapiens
aatttggtatatctgaaccactg

SEQ ID NO: 9136774 - DNA, 22 bp, Homo sapiens
aatttggtgtcttagtttccct

SEQ ID NO: 9136775 - DNA, 22 bp, Homo sapiens
aatttggtgtgttccaggaact

SEQ ID NO: 9136776 - DNA, 22 bp, Homo sapiens
aatttgtatacatgttacattt

SEQ ID NO: 9136777 - DNA, 22 bp, Homo sapiens
agagtgggttataggcagactt

SEQ ID NO: 9136778 - DNA, 22 bp, Homo sapiens
aatttgacccatcttggaattt

SEQ ID NO: 9136779 - DNA, 22 bp, Homo sapiens
aatttgacagcaatagaagatt

SEQ ID NO: 9136780 - DNA, 18 bp, Homo sapiens
aatttctttgacaactta

SEQ ID NO: 9136781 - DNA, 18 bp, Homo sapiens
aatttctttgacaactta

SEQ ID NO: 9136782 - DNA, 22 bp, Homo sapiens
aatttgcatgatgagaacaata

SEQ ID NO: 9136783 - DNA, 21 bp, Homo sapiens
aatttgctaagcaaaggagca

SEQ ID NO: 9136784 - DNA, 22 bp, Homo sapiens
aatttggagagaaacaagtagg

SEQ ID NO: 9136785 - DNA, 22 bp, Homo sapiens
aatttcttcagctctaaaatgg

SEQ ID NO: 9136786 - DNA, 22 bp, Homo sapiens
aatttcttcagctctaaaatgg

SEQ ID NO: 9136787 - DNA, 22 bp, Homo sapiens
aatttctgtatgaatagagaaa

SEQ ID NO: 9136788 - DNA, 22 bp, Homo sapiens
aatttcttcagctctaaaatgg

SEQ ID NO: 9136789 - DNA, 22 bp, Homo sapiens
aatttctccagacagctgtgca

SEQ ID NO: 9136790 - DNA, 22 bp, Homo sapiens
aatttctaattgaatctctctt

SEQ ID NO: 9136791 - DNA, 19 bp, Homo sapiens
acaaagtgcgtgctctttt

SEQ ID NO: 9136792 - DNA, 22 bp, Homo sapiens
agatgcagaaaaactaagtgat

SEQ ID NO: 9136793 - DNA, 22 bp, Homo sapiens
agatctttagtgaagctaaatc

SEQ ID NO: 9136794 - DNA, 22 bp, Homo sapiens
acaaatagagattcaaataaag

SEQ ID NO: 9136795 - DNA, 22 bp, Homo sapiens
agatgctgctccacaggccagg

SEQ ID NO: 9136796 - DNA, 22 bp, Homo sapiens
agatgctgctccacaggccagg

SEQ ID NO: 9136797 - DNA, 22 bp, Homo sapiens
acaacagctgttcacaggggtc

SEQ ID NO: 9136798 - DNA, 23 bp, Homo sapiens
acaacaggaaatcagacctgaac

SEQ ID NO: 9136799 - DNA, 21 bp, Homo sapiens
agatgcagtttgcaggtgggt

SEQ ID NO: 9136800 - DNA, 22 bp, Homo sapiens
agatgcagagtttgctgtggac

SEQ ID NO: 9136801 - DNA, 22 bp, Homo sapiens
agatgcagagttgcttaagcat

SEQ ID NO: 9136802 - DNA, 22 bp, Homo sapiens
agaggaggtccttttctgatgt

SEQ ID NO: 9136803 - DNA, 22 bp, Homo sapiens
agaggatgattttaaggacact

SEQ ID NO: 9136804 - DNA, 22 bp, Homo sapiens
agaggagtattttctaagggaa

SEQ ID NO: 9136805 - DNA, 22 bp, Homo sapiens
agaggatctaagtgagtcctca

SEQ ID NO: 9136806 - DNA, 23 bp, Homo sapiens
aatttcccctgtctctgatttgg

SEQ ID NO: 9136807 - DNA, 22 bp, Homo sapiens
agaggcaaaaatctatggcaac

SEQ ID NO: 9136808 - DNA, 22 bp, Homo sapiens
agaggatgttctaggcactcat

SEQ ID NO: 9136809 - DNA, 22 bp, Homo sapiens
agaggatggttgaggaagacct

SEQ ID NO: 9136810 - DNA, 21 bp, Homo sapiens
agaggaagtgattggtctggc

SEQ ID NO: 9136811 - DNA, 22 bp, Homo sapiens
agaggaagtaatcaggacctgc

SEQ ID NO: 9136812 - DNA, 22 bp, Homo sapiens
agaggaagtaatcaggacctgc

SEQ ID NO: 9136813 - DNA, 22 bp, Homo sapiens
agaggaagtaatcaggacctgc

SEQ ID NO: 9136814 - DNA, 22 bp, Homo sapiens
agaggaagtaatcaggacctgc

SEQ ID NO: 9136815 - DNA, 22 bp, Homo sapiens
agaggaagtaatcaggacctgc

SEQ ID NO: 9136816 - DNA, 22 bp, Homo sapiens
agaggaagtaatcaggacctgc

SEQ ID NO: 9136817 - DNA, 21 bp, Homo sapiens
agagctggtaggtaggtaggt

SEQ ID NO: 9136818 - DNA, 22 bp, Homo sapiens
agagctgggtggtggtgactca

SEQ ID NO: 9136819 - DNA, 22 bp, Homo sapiens
aattccacagatgtctatctgt

SEQ ID NO: 9136820 - DNA, 22 bp, Homo sapiens
aattaagaaaatgttttatgat

SEQ ID NO: 9136821 - DNA, 22 bp, Homo sapiens
aattaactaatttggtacaaga

SEQ ID NO: 9136822 - DNA, 22 bp, Homo sapiens
aattaactaaaattcactttat

SEQ ID NO: 9136823 - DNA, 22 bp, Homo sapiens
agagcacagccaccatttacaa

SEQ ID NO: 9136824 - DNA, 23 bp, Homo sapiens
aattacaaccaagaactggaagg

SEQ ID NO: 9136825 - DNA, 23 bp, Homo sapiens
aattacaaccaagaactggaagg

SEQ ID NO: 9136826 - DNA, 22 bp, Homo sapiens
aattacaaatgtagactctcat

SEQ ID NO: 9136827 - DNA, 22 bp, Homo sapiens
aattaattttgttcattcagtc

SEQ ID NO: 9136828 - DNA, 22 bp, Homo sapiens
agagcctggcaaaaggtcctgc

SEQ ID NO: 9136829 - DNA, 22 bp, Homo sapiens
agagctgaattcaagtgctggc

SEQ ID NO: 9136830 - DNA, 22 bp, Homo sapiens
aattacagtcggagcagcactg

SEQ ID NO: 9136831 - DNA, 21 bp, Homo sapiens
aattacagatggaattacaga

SEQ ID NO: 9136832 - DNA, 22 bp, Homo sapiens
agagctggaagctgctcttaga

SEQ ID NO: 9136833 - DNA, 22 bp, Homo sapiens
agagctggaatcagacctcagg

SEQ ID NO: 9136834 - DNA, 22 bp, Homo sapiens
agagctggaagctgctcttaga

SEQ ID NO: 9136835 - DNA, 22 bp, Homo sapiens
agagctgctcagatgtcactgc

SEQ ID NO: 9136836 - DNA, 22 bp, Homo sapiens
agagctggaaaagttgttttaa

SEQ ID NO: 9136837 - DNA, 22 bp, Homo sapiens
aattcattgccagaatctatga

SEQ ID NO: 9136838 - DNA, 22 bp, Homo sapiens
agagctgaggatccagctgagc

SEQ ID NO: 9136839 - DNA, 22 bp, Homo sapiens
agagctgagcaccaagcatggt

SEQ ID NO: 9136840 - DNA, 22 bp, Homo sapiens
agagctgcaacttcataggcct

SEQ ID NO: 9136841 - DNA, 22 bp, Homo sapiens
agagctgaggatccagctgagc

SEQ ID NO: 9136842 - DNA, 22 bp, Homo sapiens
agagctgagcaccaagcatggt

SEQ ID NO: 9136843 - DNA, 22 bp, Homo sapiens
agagctgcagggtggacccagg

SEQ ID NO: 9136844 - DNA, 22 bp, Homo sapiens
agagctgcccacacagcagatt

SEQ ID NO: 9136845 - DNA, 22 bp, Homo sapiens
agagctgcgtctattcacaatc

SEQ ID NO: 9136846 - DNA, 22 bp, Homo sapiens
agagctgcaatttcatgtggtg

SEQ ID NO: 9136847 - DNA, 22 bp, Homo sapiens
agagctgcacctatgcagacct

SEQ ID NO: 9136848 - DNA, 22 bp, Homo sapiens
agagatgaaaagggtactgagg

SEQ ID NO: 9136849 - DNA, 21 bp, Homo sapiens
aatgtgtgctatttatctttt

SEQ ID NO: 9136850 - DNA, 22 bp, Homo sapiens
aatgtgtgaattgagagaagag

SEQ ID NO: 9136851 - DNA, 22 bp, Homo sapiens
aatgtgtatactggcaattaag

SEQ ID NO: 9136852 - DNA, 22 bp, Homo sapiens
agagcaaatagagaagccagct

SEQ ID NO: 9136853 - DNA, 22 bp, Homo sapiens
agagcaaagggacatggaagag

SEQ ID NO: 9136854 - DNA, 22 bp, Homo sapiens
agagcaaagggacatggaagag

SEQ ID NO: 9136855 - DNA, 22 bp, Homo sapiens
agagcaagtgacagaaacaggg

SEQ ID NO: 9136856 - DNA, 22 bp, Homo sapiens
agagcaagtgacagaaacaggg

SEQ ID NO: 9136857 - DNA, 22 bp, Homo sapiens
agagaaggggtaaagagtcctg

SEQ ID NO: 9136858 - DNA, 22 bp, Homo sapiens
agagaaggggtaaagagtcctg

SEQ ID NO: 9136859 - DNA, 22 bp, Homo sapiens
agagaaggggtaaagagtcctg

SEQ ID NO: 9136860 - DNA, 22 bp, Homo sapiens
agagaagggcctgtatgtaatc

SEQ ID NO: 9136861 - DNA, 22 bp, Homo sapiens
agagaagggcctgtatgtaatc

SEQ ID NO: 9136862 - DNA, 22 bp, Homo sapiens
agagaagggggaaagatctcac

SEQ ID NO: 9136863 - DNA, 22 bp, Homo sapiens
agagaaggggtaaagagtcctg

SEQ ID NO: 9136864 - DNA, 22 bp, Homo sapiens
aatgtgtagcatttaatgcagt

SEQ ID NO: 9136865 - DNA, 22 bp, Homo sapiens
agagaagggcctgtatgtaatc

SEQ ID NO: 9136866 - DNA, 21 bp, Homo sapiens
agagaagggactcttccagtc

SEQ ID NO: 9136867 - DNA, 22 bp, Homo sapiens
agagaaatggggtaatctttca

SEQ ID NO: 9136868 - DNA, 19 bp, Homo sapiens
agagaaggatcctatggtt

SEQ ID NO: 9136869 - DNA, 22 bp, Homo sapiens
agagaaggcatagaacttgagt

SEQ ID NO: 9136870 - DNA, 21 bp, Homo sapiens
aatgtatgtttatctcacagt

SEQ ID NO: 9136871 - DNA, 22 bp, Homo sapiens
agacattatggctttcactggg

SEQ ID NO: 9136872 - DNA, 22 bp, Homo sapiens
agacatttatgtttctctagga

SEQ ID NO: 9136873 - DNA, 22 bp, Homo sapiens
agacatttattcacacatttat

SEQ ID NO: 9136874 - DNA, 22 bp, Homo sapiens
agacatttatgtttctctagga

SEQ ID NO: 9136875 - DNA, 22 bp, Homo sapiens
agacatttatgtttctctagga

SEQ ID NO: 9136876 - DNA, 22 bp, Homo sapiens
agacatggagaaggagccagtg

SEQ ID NO: 9136877 - DNA, 22 bp, Homo sapiens
aatgctagtgtgatatgtaagg

SEQ ID NO: 9136878 - DNA, 22 bp, Homo sapiens
aatgctaacattggtttatatc

SEQ ID NO: 9136879 - DNA, 22 bp, Homo sapiens
aatgctctttgaatttgtcaga

SEQ ID NO: 9136880 - DNA, 22 bp, Homo sapiens
aatgctctgtctctgacagtgg

SEQ ID NO: 9136881 - DNA, 22 bp, Homo sapiens
aatgctctctgccatagctaac

SEQ ID NO: 9136882 - DNA, 22 bp, Homo sapiens
aatgctctgtctctgacagtgg

SEQ ID NO: 9136883 - DNA, 22 bp, Homo sapiens
aatgctctttaacctattctga

SEQ ID NO: 9136884 - DNA, 22 bp, Homo sapiens
aatgctaaaacacagatttttg

SEQ ID NO: 9136885 - DNA, 22 bp, Homo sapiens
agacatgacagatagttgctag

SEQ ID NO: 9136886 - DNA, 22 bp, Homo sapiens
agacatgaaaattccaaacatc

SEQ ID NO: 9136887 - DNA, 22 bp, Homo sapiens
agacatgagaaacccaccagag

SEQ ID NO: 9136888 - DNA, 22 bp, Homo sapiens
agacatggagaaggagccagtg

SEQ ID NO: 9136889 - DNA, 22 bp, Homo sapiens
acacttaagcatgaagtataaa

SEQ ID NO: 9136890 - DNA, 22 bp, Homo sapiens
acacttaagcatgaagtataaa

SEQ ID NO: 9136891 - DNA, 22 bp, Homo sapiens
acactgttgcttacagttttgg

SEQ ID NO: 9136892 - DNA, 22 bp, Homo sapiens
acacttatttttgtccacttcc

SEQ ID NO: 9136893 - DNA, 22 bp, Homo sapiens
acacttacggttccttcatcca

SEQ ID NO: 9136894 - DNA, 22 bp, Homo sapiens
acactgttccacactaagaagg

SEQ ID NO: 9136895 - DNA, 22 bp, Homo sapiens
acacttcaaatggttggaaaat

SEQ ID NO: 9136896 - DNA, 23 bp, Homo sapiens
acacttcacccattgtgatagga

SEQ ID NO: 9136897 - DNA, 22 bp, Homo sapiens
agccagagattgagatgcaggc

SEQ ID NO: 9136898 - DNA, 22 bp, Homo sapiens
agccagagattgagatgcaggc

SEQ ID NO: 9136899 - DNA, 22 bp, Homo sapiens
agccagagattgagatgcaggc

SEQ ID NO: 9136900 - DNA, 22 bp, Homo sapiens
agccagaggaagcctggccctc

SEQ ID NO: 9136901 - DNA, 22 bp, Homo sapiens
agccagaggtcatgagcacagg

SEQ ID NO: 9136902 - DNA, 22 bp, Homo sapiens
agccagctgcctttcacatctg

SEQ ID NO: 9136903 - DNA, 19 bp, Homo sapiens
agccagagtggcccagggg

SEQ ID NO: 9136904 - DNA, 22 bp, Homo sapiens
agccagcttctttacggtggca

SEQ ID NO: 9136905 - DNA, 22 bp, Homo sapiens
agccaggaaccagctacagtct

SEQ ID NO: 9136906 - DNA, 22 bp, Homo sapiens
agccaggaagaaggtcacacca

SEQ ID NO: 9136907 - DNA, 22 bp, Homo sapiens
agccaggaagaaggtcacacca

SEQ ID NO: 9136908 - DNA, 22 bp, Homo sapiens
agccaggaagagaggcctcacc

SEQ ID NO: 9136909 - DNA, 22 bp, Homo sapiens
agccaggaagagaggcctcacc

SEQ ID NO: 9136910 - DNA, 22 bp, Homo sapiens
agccagctgtgggctcaggcgg

SEQ ID NO: 9136911 - DNA, 22 bp, Homo sapiens
agccagctgtgggctcaggcgg

SEQ ID NO: 9136912 - DNA, 22 bp, Homo sapiens
agccagctgtgtggtcaggcaa

SEQ ID NO: 9136913 - DNA, 22 bp, Homo sapiens
agccagctgtgtggtcaggcaa

SEQ ID NO: 9136914 - DNA, 22 bp, Homo sapiens
agccagctgtggctatggctcc

SEQ ID NO: 9136915 - DNA, 22 bp, Homo sapiens
acaccagtttcttaagaatatt

SEQ ID NO: 9136916 - DNA, 22 bp, Homo sapiens
acaccagtccttactcattttt

SEQ ID NO: 9136917 - DNA, 19 bp, Homo sapiens
agcaggtgggtaagaaaat

SEQ ID NO: 9136918 - DNA, 22 bp, Homo sapiens
agcaggtggtaggcagtcagca

SEQ ID NO: 9136919 - DNA, 22 bp, Homo sapiens
agcaggtggtgggccagatttg

SEQ ID NO: 9136920 - DNA, 21 bp, Homo sapiens
agcaggtgtaaaggaggaaat

SEQ ID NO: 9136921 - DNA, 21 bp, Homo sapiens
agcaggtgtaaaggaggaaat

SEQ ID NO: 9136922 - DNA, 21 bp, Homo sapiens
agcaggtgtaaaggaggaaat

SEQ ID NO: 9136923 - DNA, 22 bp, Homo sapiens
agcaggtgtagggctctttgta

SEQ ID NO: 9136924 - DNA, 22 bp, Homo sapiens
agccaatacactgaagatctaa

SEQ ID NO: 9136925 - DNA, 22 bp, Homo sapiens
agccaatgcgtaaaaagatcta

SEQ ID NO: 9136926 - DNA, 23 bp, Homo sapiens
agccaatctatgctgggttcaaa

SEQ ID NO: 9136927 - DNA, 22 bp, Homo sapiens
agccaatctggggagacgggag

SEQ ID NO: 9136928 - DNA, 22 bp, Homo sapiens
agccaatctcctgttgatgcca

SEQ ID NO: 9136929 - DNA, 22 bp, Homo sapiens
agccaatcatcctcagactctc

SEQ ID NO: 9136930 - DNA, 22 bp, Homo sapiens
agccaatctacaacaaaggata

SEQ ID NO: 9136931 - DNA, 22 bp, Homo sapiens
acacaatgtgcaggacacctgt

SEQ ID NO: 9136932 - DNA, 22 bp, Homo sapiens
acacacaaatctattagtgaat

SEQ ID NO: 9136933 - DNA, 22 bp, Homo sapiens
acacaagattgtgtattgaatt

SEQ ID NO: 9136934 - DNA, 22 bp, Homo sapiens
acacaagggcctatagtgtatt

SEQ ID NO: 9136935 - DNA, 22 bp, Homo sapiens
acacaataaatttatcctttga

SEQ ID NO: 9136936 - DNA, 22 bp, Homo sapiens
acacagttcaggatcaaatagc

SEQ ID NO: 9136937 - DNA, 22 bp, Homo sapiens
acacagtgtcttaggtagtgtc

SEQ ID NO: 9136938 - DNA, 22 bp, Homo sapiens
acacagtggtgtttacaaaatt

SEQ ID NO: 9136939 - DNA, 20 bp, Homo sapiens
acacagtgacaggaaagaga

SEQ ID NO: 9136940 - DNA, 22 bp, Homo sapiens
acacagtgccaaattgcagtta

SEQ ID NO: 9136941 - DNA, 22 bp, Homo sapiens
acacagtattacaataggtgct

SEQ ID NO: 9136942 - DNA, 22 bp, Homo sapiens
acacagtattgtgactataact

SEQ ID NO: 9136943 - DNA, 22 bp, Homo sapiens
acacagtattgtgactataact

SEQ ID NO: 9136944 - DNA, 19 bp, Homo sapiens
acacagggctagagttaca

SEQ ID NO: 9136945 - DNA, 22 bp, Homo sapiens
acacagtagtttgtcattgcta

SEQ ID NO: 9136946 - DNA, 22 bp, Homo sapiens
acacagtatgcatctagaaatt

SEQ ID NO: 9136947 - DNA, 22 bp, Homo sapiens
acacagtatgaaaagtctagtt

SEQ ID NO: 9136948 - DNA, 22 bp, Homo sapiens
acacacacaagcaggttgtgga

SEQ ID NO: 9136949 - DNA, 22 bp, Homo sapiens
agcagggaatagcggaaagaat

SEQ ID NO: 9136950 - DNA, 22 bp, Homo sapiens
agcagggaatagcggaaagaat

SEQ ID NO: 9136951 - DNA, 22 bp, Homo sapiens
agcagggaatagcggaaagaat

SEQ ID NO: 9136952 - DNA, 22 bp, Homo sapiens
agcagggaagcctccagaacct

SEQ ID NO: 9136953 - DNA, 22 bp, Homo sapiens
agcagggaagcctccagaacct

SEQ ID NO: 9136954 - DNA, 19 bp, Homo sapiens
agcagggacatggaacttt

SEQ ID NO: 9136955 - DNA, 22 bp, Homo sapiens
agcagggacatggcatctctcc

SEQ ID NO: 9136956 - DNA, 22 bp, Homo sapiens
agcagggacatggcatctctcc

SEQ ID NO: 9136957 - DNA, 22 bp, Homo sapiens
agcagggactacgtgaaagtga

SEQ ID NO: 9136958 - DNA, 22 bp, Homo sapiens
agcagggactacgtgaaagtga

SEQ ID NO: 9136959 - DNA, 22 bp, Homo sapiens
agcagggactgagccagtggga

SEQ ID NO: 9136960 - DNA, 22 bp, Homo sapiens
acacatattcatatgtacttac

SEQ ID NO: 9136961 - DNA, 22 bp, Homo sapiens
acacatcagaaatatgaatgag

SEQ ID NO: 9136962 - DNA, 22 bp, Homo sapiens
acacatattcatatgtacttac

SEQ ID NO: 9136963 - DNA, 22 bp, Homo sapiens
acacatatgtcattgaaaaatc

SEQ ID NO: 9136964 - DNA, 22 bp, Homo sapiens
acacatcatgccaagtttcacc

SEQ ID NO: 9136965 - DNA, 22 bp, Homo sapiens
acacatctcaggggacactctc

SEQ ID NO: 9136966 - DNA, 22 bp, Homo sapiens
acacatctcaggggacactctc

SEQ ID NO: 9136967 - DNA, 22 bp, Homo sapiens
agcaggcttggtccccagcctc

SEQ ID NO: 9136968 - DNA, 22 bp, Homo sapiens
agctaacacattccagctattt

SEQ ID NO: 9136969 - DNA, 22 bp, Homo sapiens
agctaaatgtgaaatgtcaacc

SEQ ID NO: 9136970 - DNA, 22 bp, Homo sapiens
agctaaatgcatttcaagactg

SEQ ID NO: 9136971 - DNA, 22 bp, Homo sapiens
agcgtgaattagttggtacaca

SEQ ID NO: 9136972 - DNA, 22 bp, Homo sapiens
agccttcaacctagctagagca

SEQ ID NO: 9136973 - DNA, 22 bp, Homo sapiens
agcggctgctccgcaggctggc

SEQ ID NO: 9136974 - DNA, 22 bp, Homo sapiens
agcggctggaccagcgttcaag

SEQ ID NO: 9136975 - DNA, 22 bp, Homo sapiens
agcggctgctcttttcagatcc

SEQ ID NO: 9136976 - DNA, 22 bp, Homo sapiens
agcggctgtcggccagccggag

SEQ ID NO: 9136977 - DNA, 22 bp, Homo sapiens
agcggctgctccgcaggctggc

SEQ ID NO: 9136978 - DNA, 22 bp, Homo sapiens
acagaggccccgtgggagagcc

SEQ ID NO: 9136979 - DNA, 22 bp, Homo sapiens
acagaggccccgtgggagagcc

SEQ ID NO: 9136980 - DNA, 22 bp, Homo sapiens
acagaggccgcctctctcacgg

SEQ ID NO: 9136981 - DNA, 22 bp, Homo sapiens
acagaggcctcgtaggtacaac

SEQ ID NO: 9136982 - DNA, 23 bp, Homo sapiens
acagaggcttaaatgagtggcag

SEQ ID NO: 9136983 - DNA, 22 bp, Homo sapiens
acagaggctgcgcttgggaacg

SEQ ID NO: 9136984 - DNA, 22 bp, Homo sapiens
acagaggctgatcttcaagccc

SEQ ID NO: 9136985 - DNA, 22 bp, Homo sapiens
acagaggcctcgtaggtacaac

SEQ ID NO: 9136986 - DNA, 19 bp, Homo sapiens
acagagggcaactgagaaa

SEQ ID NO: 9136987 - DNA, 22 bp, Homo sapiens
acagagggggccttggagtgca

SEQ ID NO: 9136988 - DNA, 22 bp, Homo sapiens
acagaggggtcacagcctgaag

SEQ ID NO: 9136989 - DNA, 22 bp, Homo sapiens
acagagggtttctaaggatttg

SEQ ID NO: 9136990 - DNA, 22 bp, Homo sapiens
acagagggtgtggaggaagacg

SEQ ID NO: 9136991 - DNA, 22 bp, Homo sapiens
acagaacttccagggaacatac

SEQ ID NO: 9136992 - DNA, 22 bp, Homo sapiens
agccaggaatgcatgctctgct

SEQ ID NO: 9136993 - DNA, 22 bp, Homo sapiens
acagaaggacttgagaaagaca

SEQ ID NO: 9136994 - DNA, 22 bp, Homo sapiens
acagaaggacttgagaaagaca

SEQ ID NO: 9136995 - DNA, 22 bp, Homo sapiens
acagaaggcggggacaaggcgg

SEQ ID NO: 9136996 - DNA, 22 bp, Homo sapiens
acagaagtgacaatttcttggg

SEQ ID NO: 9136997 - DNA, 22 bp, Homo sapiens
acagaaggcggggacaaggcgg

SEQ ID NO: 9136998 - DNA, 22 bp, Homo sapiens
acagaagtgtctttttcattca

SEQ ID NO: 9136999 - DNA, 23 bp, Homo sapiens
acagaataccattgactaggtgt

SEQ ID NO: 9137000 - DNA, 22 bp, Homo sapiens
acagagctgtacatgtgccatg

SEQ ID NO: 9137001 - DNA, 22 bp, Homo sapiens
acagaatgcgtagtgcatgttg

SEQ ID NO: 9137002 - DNA, 17 bp, Homo sapiens
acagaggcaggagtgga

SEQ ID NO: 9137003 - DNA, 17 bp, Homo sapiens
acagaggcaggagtgga

SEQ ID NO: 9137004 - DNA, 22 bp, Homo sapiens
acagaggcagtgtgagatactg

SEQ ID NO: 9137005 - DNA, 22 bp, Homo sapiens
acagaatagagactgcctgctc

SEQ ID NO: 9137006 - DNA, 22 bp, Homo sapiens
acagaatagtagcttaaagtca

SEQ ID NO: 9137007 - DNA, 22 bp, Homo sapiens
acagaatagtagcttaaagtca

SEQ ID NO: 9137008 - DNA, 22 bp, Homo sapiens
acagcagcataaactgactaag

SEQ ID NO: 9137009 - DNA, 20 bp, Homo sapiens
acagcagccttgctagaaac

SEQ ID NO: 9137010 - DNA, 22 bp, Homo sapiens
acagcagccttgttggtttcga

SEQ ID NO: 9137011 - DNA, 22 bp, Homo sapiens
acagcagccagccactgtgagc

SEQ ID NO: 9137012 - DNA, 22 bp, Homo sapiens
acagcagcaatagcagtgacat

SEQ ID NO: 9137013 - DNA, 22 bp, Homo sapiens
acagcagcaatagcagtgacat

SEQ ID NO: 9137014 - DNA, 22 bp, Homo sapiens
acagcagatttccctgggctcc

SEQ ID NO: 9137015 - DNA, 22 bp, Homo sapiens
acagcagatttccctgggctcc

SEQ ID NO: 9137016 - DNA, 22 bp, Homo sapiens
acagcagatttccctgggctcc

SEQ ID NO: 9137017 - DNA, 22 bp, Homo sapiens
acagcagatttccctgggctcc

SEQ ID NO: 9137018 - DNA, 22 bp, Homo sapiens
acagcagattacattctgctat

SEQ ID NO: 9137019 - DNA, 22 bp, Homo sapiens
acagcagattacattctgctat

SEQ ID NO: 9137020 - DNA, 22 bp, Homo sapiens
acagcagattacattctgctat

SEQ ID NO: 9137021 - DNA, 22 bp, Homo sapiens
acagcagatgacaactatttat

SEQ ID NO: 9137022 - DNA, 22 bp, Homo sapiens
acagcagatgacaactatttat

SEQ ID NO: 9137023 - DNA, 22 bp, Homo sapiens
acagcagatgacaactatttat

SEQ ID NO: 9137024 - DNA, 22 bp, Homo sapiens
acagcagattacattctgctat

SEQ ID NO: 9137025 - DNA, 22 bp, Homo sapiens
acagcagatctggctacaggtt

SEQ ID NO: 9137026 - DNA, 22 bp, Homo sapiens
acagcagatctggctacaggtt

SEQ ID NO: 9137027 - DNA, 22 bp, Homo sapiens
acagcagatctgtggagcttat

SEQ ID NO: 9137028 - DNA, 22 bp, Homo sapiens
acagcagatctgtggagcttat

SEQ ID NO: 9137029 - DNA, 22 bp, Homo sapiens
acagcagatctgtggagcttat

SEQ ID NO: 9137030 - DNA, 20 bp, Homo sapiens
acagataccagggacatggg

SEQ ID NO: 9137031 - DNA, 22 bp, Homo sapiens
acagatagatgataatggcttt

SEQ ID NO: 9137032 - DNA, 22 bp, Homo sapiens
acagatactataatgtaaagtg

SEQ ID NO: 9137033 - DNA, 22 bp, Homo sapiens
acagcagaccactactagtagg

SEQ ID NO: 9137034 - DNA, 22 bp, Homo sapiens
acagcagaccactactagtagg

SEQ ID NO: 9137035 - DNA, 22 bp, Homo sapiens
acagcagagtggagatgagcac

SEQ ID NO: 9137036 - DNA, 22 bp, Homo sapiens
acagcagagtggagatgagcac

SEQ ID NO: 9137037 - DNA, 22 bp, Homo sapiens
acagcagagtgtgagatagcca

SEQ ID NO: 9137038 - DNA, 22 bp, Homo sapiens
acagcagagtgtgagatagcca

SEQ ID NO: 9137039 - DNA, 22 bp, Homo sapiens
acagcagagttgagtagttgca

SEQ ID NO: 9137040 - DNA, 22 bp, Homo sapiens
acagcagagttgagtagttgca

SEQ ID NO: 9137041 - DNA, 22 bp, Homo sapiens
acagcagagttgagtagttgca

SEQ ID NO: 9137042 - DNA, 22 bp, Homo sapiens
acagcagagttgagtagttgca

SEQ ID NO: 9137043 - DNA, 22 bp, Homo sapiens
acagcagagtgtgagatagcca

SEQ ID NO: 9137044 - DNA, 20 bp, Homo sapiens
acagcagataccacaactat

SEQ ID NO: 9137045 - DNA, 20 bp, Homo sapiens
acagcagataccacaactat

SEQ ID NO: 9137046 - DNA, 20 bp, Homo sapiens
acagcagataccacaactat

SEQ ID NO: 9137047 - DNA, 22 bp, Homo sapiens
acagcagatctggctacaggtt

SEQ ID NO: 9137048 - DNA, 22 bp, Homo sapiens
agctgaggttgaagagtgaacg

SEQ ID NO: 9137049 - DNA, 22 bp, Homo sapiens
agctgaggttgaagagtgaacg

SEQ ID NO: 9137050 - DNA, 22 bp, Homo sapiens
agctgatgccatgtggaacagt

SEQ ID NO: 9137051 - DNA, 22 bp, Homo sapiens
acagcaggcatgaatgacactg

SEQ ID NO: 9137052 - DNA, 22 bp, Homo sapiens
agctgaggttagtataaatgtg

SEQ ID NO: 9137053 - DNA, 23 bp, Homo sapiens
agctgaggtgcagatccaaagaa

SEQ ID NO: 9137054 - DNA, 21 bp, Homo sapiens
agctgaggtaaggcaagagag

SEQ ID NO: 9137055 - DNA, 21 bp, Homo sapiens
agctgaggtaaggcaagagag

SEQ ID NO: 9137056 - DNA, 21 bp, Homo sapiens
agctgaggtaaggcaagagag

SEQ ID NO: 9137057 - DNA, 22 bp, Homo sapiens
acagcagcgtgaagtgtgttat

SEQ ID NO: 9137058 - DNA, 18 bp, Homo sapiens
agctgaggggactgaaga

SEQ ID NO: 9137059 - DNA, 22 bp, Homo sapiens
agctgagggcaggatggggtga

SEQ ID NO: 9137060 - DNA, 22 bp, Homo sapiens
agctgagggttcggtgtccaca

SEQ ID NO: 9137061 - DNA, 22 bp, Homo sapiens
acagcagtgcacagagaaccct

SEQ ID NO: 9137062 - DNA, 22 bp, Homo sapiens
acagcaggttttaactttgaag

SEQ ID NO: 9137063 - DNA, 22 bp, Homo sapiens
acagcaggttttaactttgaag

SEQ ID NO: 9137064 - DNA, 22 bp, Homo sapiens
acagcaggttattgttatggca

SEQ ID NO: 9137065 - DNA, 18 bp, Homo sapiens
acagcaggtttcattctt

SEQ ID NO: 9137066 - DNA, 17 bp, Homo sapiens
acagcagggaagtgttg

SEQ ID NO: 9137067 - DNA, 22 bp, Homo sapiens
acagcagggaatatgggaattg

SEQ ID NO: 9137068 - DNA, 19 bp, Homo sapiens
acagcagggatttttggag

SEQ ID NO: 9137069 - DNA, 17 bp, Homo sapiens
acagcaggcccggaggg

SEQ ID NO: 9137070 - DNA, 22 bp, Homo sapiens
acagcaggcatgaatgacactg

SEQ ID NO: 9137071 - DNA, 22 bp, Homo sapiens
acagcaggcccatactggaagg

SEQ ID NO: 9137072 - DNA, 22 bp, Homo sapiens
tcagcagaaaggcactagatga

SEQ ID NO: 9137073 - DNA, 21 bp, Homo sapiens
tcagcagaaagcaaggtcagt

SEQ ID NO: 9137074 - DNA, 21 bp, Homo sapiens
tcagcagaaagcaaggtcagt

SEQ ID NO: 9137075 - DNA, 21 bp, Homo sapiens
tcagcagaaagcaaggtcagt

SEQ ID NO: 9137076 - DNA, 21 bp, Homo sapiens
tcagcagaaagcaaggtcagt

SEQ ID NO: 9137077 - DNA, 21 bp, Homo sapiens
tcagcagcttttgcagtccct

SEQ ID NO: 9137078 - DNA, 22 bp, Homo sapiens
tcagcaggcacaccaaaaactg

SEQ ID NO: 9137079 - DNA, 21 bp, Homo sapiens
tcagcagaaggaccactaggg

SEQ ID NO: 9137080 - DNA, 21 bp, Homo sapiens
tcagcagaaggaccactaggg

SEQ ID NO: 9137081 - DNA, 22 bp, Homo sapiens
tcagcagaacaaggaagcttaa

SEQ ID NO: 9137082 - DNA, 22 bp, Homo sapiens
tcagcagaacaaggaagcttaa

SEQ ID NO: 9137083 - DNA, 22 bp, Homo sapiens
tcagcagaacaaggaagcttaa

SEQ ID NO: 9137084 - DNA, 22 bp, Homo sapiens
tcagcagaaaggcactagatga

SEQ ID NO: 9137085 - DNA, 22 bp, Homo sapiens
tcagcagaaaggcactagatga

SEQ ID NO: 9137086 - DNA, 21 bp, Homo sapiens
tcagcagaaggaccactaggg

SEQ ID NO: 9137087 - DNA, 22 bp, Homo sapiens
tcagcctgcgtcatggtgacac

SEQ ID NO: 9137088 - DNA, 22 bp, Homo sapiens
tcagcaggcacggacaggctgc

SEQ ID NO: 9137089 - DNA, 22 bp, Homo sapiens
tcagcaggcacggacaggctgc

SEQ ID NO: 9137090 - DNA, 22 bp, Homo sapiens
tcagcaggcacggacaggctgc

SEQ ID NO: 9137091 - DNA, 22 bp, Homo sapiens
tcagcaggcaccggaagtgttt

SEQ ID NO: 9137092 - DNA, 22 bp, Homo sapiens
tcagcaggcaccggaagtgttt

SEQ ID NO: 9137093 - DNA, 21 bp, Homo sapiens
tcagcaggcaccagaaggctg

SEQ ID NO: 9137094 - DNA, 22 bp, Homo sapiens
tcagctccatccctgcttttgc

SEQ ID NO: 9137095 - DNA, 22 bp, Homo sapiens
tcagctccatccctgcttttgc

SEQ ID NO: 9137096 - DNA, 22 bp, Homo sapiens
tcagctcctcagagcctcagtt

SEQ ID NO: 9137097 - DNA, 22 bp, Homo sapiens
tcagctctcacagatctcaacc

SEQ ID NO: 9137098 - DNA, 17 bp, Homo sapiens
tcagctcagagcacctg

SEQ ID NO: 9137099 - DNA, 22 bp, Homo sapiens
tcagctcatctgagtgtcagcg

SEQ ID NO: 9137100 - DNA, 22 bp, Homo sapiens
tcagctccacagctcctctgcc

SEQ ID NO: 9137101 - DNA, 22 bp, Homo sapiens
tcagctatgttttggaacaggg

SEQ ID NO: 9137102 - DNA, 22 bp, Homo sapiens
tcaggaggtgtaggtcaagtga

SEQ ID NO: 9137103 - DNA, 17 bp, Homo sapiens
tcaggaggtgtttctag

SEQ ID NO: 9137104 - DNA, 22 bp, Homo sapiens
tcaggaggttgaccacggggca

SEQ ID NO: 9137105 - DNA, 22 bp, Homo sapiens
tcaggaggttgaccacggggca

SEQ ID NO: 9137106 - DNA, 22 bp, Homo sapiens
tcaggaggtttggattcagtta

SEQ ID NO: 9137107 - DNA, 22 bp, Homo sapiens
tcaggagtaaagacagagttcc

SEQ ID NO: 9137108 - DNA, 22 bp, Homo sapiens
tcaggagtaagggtaacccaga

SEQ ID NO: 9137109 - DNA, 22 bp, Homo sapiens
tcaggagtcctgcctgcagcct

SEQ ID NO: 9137110 - DNA, 22 bp, Homo sapiens
tcaggagtactggtgtctacag

SEQ ID NO: 9137111 - DNA, 22 bp, Homo sapiens
tcaggaaggcaaattgcatgat

SEQ ID NO: 9137112 - DNA, 22 bp, Homo sapiens
tcaggaaggcacttggtgtgtt

SEQ ID NO: 9137113 - DNA, 22 bp, Homo sapiens
tcaggaaggcacttggtgtgtt

SEQ ID NO: 9137114 - DNA, 22 bp, Homo sapiens
tcaggaaggcttcacacgagtg

SEQ ID NO: 9137115 - DNA, 22 bp, Homo sapiens
tcaggaaggcgccccatcagga

SEQ ID NO: 9137116 - DNA, 22 bp, Homo sapiens
tcaggaagctgctctgggtggt

SEQ ID NO: 9137117 - DNA, 22 bp, Homo sapiens
tcaggaagctgctctgggtggt

SEQ ID NO: 9137118 - DNA, 22 bp, Homo sapiens
tcaggaaggagctggcctgcca

SEQ ID NO: 9137119 - DNA, 22 bp, Homo sapiens
tcaggaaggagctggcctgcca

SEQ ID NO: 9137120 - DNA, 22 bp, Homo sapiens
tcaggaaggagctggcctgcca

SEQ ID NO: 9137121 - DNA, 22 bp, Homo sapiens
tcaggaagctgctctgggtggt

SEQ ID NO: 9137122 - DNA, 22 bp, Homo sapiens
tcaggaagattagtttcctacc

SEQ ID NO: 9137123 - DNA, 21 bp, Homo sapiens
tcaggaagagcttctcccact

SEQ ID NO: 9137124 - DNA, 21 bp, Homo sapiens
tcaggaagagcttctcccact

SEQ ID NO: 9137125 - DNA, 21 bp, Homo sapiens
tcaggaagagccagttcatgc

SEQ ID NO: 9137126 - DNA, 21 bp, Homo sapiens
tcaggaagagccagttcatgc

SEQ ID NO: 9137127 - DNA, 22 bp, Homo sapiens
tcaggaagctcttgctgattct

SEQ ID NO: 9137128 - DNA, 22 bp, Homo sapiens
tcaggaagccggttaaatagat

SEQ ID NO: 9137129 - DNA, 22 bp, Homo sapiens
tcaggaagacaatctttggctc

SEQ ID NO: 9137130 - DNA, 22 bp, Homo sapiens
tcaggaagacaatctttggctc

SEQ ID NO: 9137131 - DNA, 22 bp, Homo sapiens
tcaggaagaagacggggcagga

SEQ ID NO: 9137132 - DNA, 22 bp, Homo sapiens
tcaggaacccccgctgggtgaa

SEQ ID NO: 9137133 - DNA, 22 bp, Homo sapiens
tcaggaacccccgctgggtgaa

SEQ ID NO: 9137134 - DNA, 22 bp, Homo sapiens
tcaggaacataatgtgagtcag

SEQ ID NO: 9137135 - DNA, 22 bp, Homo sapiens
tcagggaaatagcagggctgaa

SEQ ID NO: 9137136 - DNA, 22 bp, Homo sapiens
tcagggaaattcaagggagatt

SEQ ID NO: 9137137 - DNA, 22 bp, Homo sapiens
tcagggaaattcaagggagatt

SEQ ID NO: 9137138 - DNA, 22 bp, Homo sapiens
tcagggaaatttccatgtgttt

SEQ ID NO: 9137139 - DNA, 22 bp, Homo sapiens
tcagggaacaatgttatggctt

SEQ ID NO: 9137140 - DNA, 22 bp, Homo sapiens
tcagggaaaagtcacactgggt

SEQ ID NO: 9137141 - DNA, 22 bp, Homo sapiens
tcagggaaaagtcacactgggt

SEQ ID NO: 9137142 - DNA, 22 bp, Homo sapiens
tcagggaaacctaaggaagcca

SEQ ID NO: 9137143 - DNA, 22 bp, Homo sapiens
tcagggaaacctaaggaagcca

SEQ ID NO: 9137144 - DNA, 22 bp, Homo sapiens
tcagggaaaggggagagtcatt

SEQ ID NO: 9137145 - DNA, 22 bp, Homo sapiens
tcaggctggggtgctaaggtgt

SEQ ID NO: 9137146 - DNA, 18 bp, Homo sapiens
tcaggctgggcctccttc

SEQ ID NO: 9137147 - DNA, 18 bp, Homo sapiens
tcaggctgggcctccttc

SEQ ID NO: 9137148 - DNA, 22 bp, Homo sapiens
tcaggctggggtgctaaggtgt

SEQ ID NO: 9137149 - DNA, 22 bp, Homo sapiens
tcaggctggagtgcagtggcgc

SEQ ID NO: 9137150 - DNA, 18 bp, Homo sapiens
tcaggctggaagtttgcc

SEQ ID NO: 9137151 - DNA, 22 bp, Homo sapiens
tcaggctgctgtactgtgaatg

SEQ ID NO: 9137152 - DNA, 22 bp, Homo sapiens
tcaggctgctgtactgtgaatg

SEQ ID NO: 9137153 - DNA, 22 bp, Homo sapiens
tcaggctggaatgcagtggggc

SEQ ID NO: 9137154 - DNA, 22 bp, Homo sapiens
tcaggctggaatgcagtggggc

SEQ ID NO: 9137155 - DNA, 22 bp, Homo sapiens
tcaggctggaatgcagtggggc

SEQ ID NO: 9137156 - DNA, 22 bp, Homo sapiens
tcaggctgctggccagcaggct

SEQ ID NO: 9137157 - DNA, 22 bp, Homo sapiens
tcaggctgataggaggaactga

SEQ ID NO: 9137158 - DNA, 16 bp, Homo sapiens
tcaggcctggacgagc

SEQ ID NO: 9137159 - DNA, 22 bp, Homo sapiens
tcaggcctgctgtatgatggat

SEQ ID NO: 9137160 - DNA, 22 bp, Homo sapiens
tcaggcctgtgctggaggagat

SEQ ID NO: 9137161 - DNA, 22 bp, Homo sapiens
tcaggcctggagaaaggaatga

SEQ ID NO: 9137162 - DNA, 22 bp, Homo sapiens
tcaggccttcagacctggcccg

SEQ ID NO: 9137163 - DNA, 22 bp, Homo sapiens
tcaggctgaggtcatctgcatc

SEQ ID NO: 9137164 - DNA, 22 bp, Homo sapiens
tcaggcctgcaaatgaatggta

SEQ ID NO: 9137165 - DNA, 22 bp, Homo sapiens
tcaggcctgcaggcttcctgga

SEQ ID NO: 9137166 - DNA, 22 bp, Homo sapiens
tcaggccaggagatcagattga

SEQ ID NO: 9137167 - DNA, 22 bp, Homo sapiens
tcaggcctgcaaggagagtccc

SEQ ID NO: 9137168 - DNA, 22 bp, Homo sapiens
tcaggcctgccctgaaagcaca

SEQ ID NO: 9137169 - DNA, 22 bp, Homo sapiens
tcaggcctgcagtgccaaccca

SEQ ID NO: 9137170 - DNA, 22 bp, Homo sapiens
tcaggcatgcattctgcaggtt

SEQ ID NO: 9137171 - DNA, 22 bp, Homo sapiens
tcaggcatgtgtactctttgat

SEQ ID NO: 9137172 - DNA, 19 bp, Homo sapiens
tcaggcagttattcacaaa

SEQ ID NO: 9137173 - DNA, 22 bp, Homo sapiens
tcaggcagtggtaaatgagtta

SEQ ID NO: 9137174 - DNA, 20 bp, Homo sapiens
tcaggcagtggggaaaggca

SEQ ID NO: 9137175 - DNA, 22 bp, Homo sapiens
tcaggcagtagaattgcttgaa

SEQ ID NO: 9137176 - DNA, 20 bp, Homo sapiens
tcaggatgtgctgagtgaag

SEQ ID NO: 9137177 - DNA, 22 bp, Homo sapiens
tcaggatgtccaaaatccagcc

SEQ ID NO: 9137178 - DNA, 17 bp, Homo sapiens
tcaggatgtagcagtag

SEQ ID NO: 9137179 - DNA, 21 bp, Homo sapiens
tcaggcagtgcaaatacatgg

SEQ ID NO: 9137180 - DNA, 22 bp, Homo sapiens
tcaggatggtcctttatgagaa

SEQ ID NO: 9137181 - DNA, 22 bp, Homo sapiens
tcaggatggcttctgcatcaaa

SEQ ID NO: 9137182 - DNA, 22 bp, Homo sapiens
tcaggatggtgtggaggaaata

SEQ ID NO: 9137183 - DNA, 22 bp, Homo sapiens
tcaggatggagggaagcacaga

SEQ ID NO: 9137184 - DNA, 22 bp, Homo sapiens
tcaggatggagtctatccagtg

SEQ ID NO: 9137185 - DNA, 22 bp, Homo sapiens
tcaggatggcacccaagctctt

SEQ ID NO: 9137186 - DNA, 22 bp, Homo sapiens
tcaggatgagctcataactatg

SEQ ID NO: 9137187 - DNA, 22 bp, Homo sapiens
tcaggatgagtcatcaagctgc

SEQ ID NO: 9137188 - DNA, 22 bp, Homo sapiens
tcaggatgacttcaaggaggaa

SEQ ID NO: 9137189 - DNA, 22 bp, Homo sapiens
tcaggagtgataccatttgtca

SEQ ID NO: 9137190 - DNA, 22 bp, Homo sapiens
tcaggagtgcagcagtttggag

SEQ ID NO: 9137191 - DNA, 22 bp, Homo sapiens
tcaggagtctgtgcagttccac

SEQ ID NO: 9137192 - DNA, 22 bp, Homo sapiens
tcaggagtgccagtaccttttg

SEQ ID NO: 9137193 - DNA, 22 bp, Homo sapiens
tcaggagtttcaggtgtaagtg

SEQ ID NO: 9137194 - DNA, 18 bp, Homo sapiens
tcaggagtttgtggatgg

SEQ ID NO: 9137195 - DNA, 22 bp, Homo sapiens
tcaggatcggcctttttttaag

SEQ ID NO: 9137196 - DNA, 22 bp, Homo sapiens
tcaggatgaagtcagaggggtc

SEQ ID NO: 9137197 - DNA, 22 bp, Homo sapiens
tcaggatgaccacgagcctcta

SEQ ID NO: 9137198 - DNA, 22 bp, Homo sapiens
tcatatttaggcctttaattca

SEQ ID NO: 9137199 - DNA, 22 bp, Homo sapiens
tcatattagggtaatgataaga

SEQ ID NO: 9137200 - DNA, 22 bp, Homo sapiens
tcatgcctgattatgttactca

SEQ ID NO: 9137201 - DNA, 22 bp, Homo sapiens
tcatgctagttaagaacacaat

SEQ ID NO: 9137202 - DNA, 22 bp, Homo sapiens
tcatgctcatcattagagtgac

SEQ ID NO: 9137203 - DNA, 22 bp, Homo sapiens
tcatgctgaggatgctgtgaag

SEQ ID NO: 9137204 - DNA, 22 bp, Homo sapiens
tcatgctgggtactatggctgc

SEQ ID NO: 9137205 - DNA, 22 bp, Homo sapiens
tcatgctggcccagaatggagg

SEQ ID NO: 9137206 - DNA, 22 bp, Homo sapiens
tcatgctgcaggcccaggcagg

SEQ ID NO: 9137207 - DNA, 22 bp, Homo sapiens
tcatgctgagtcctggctttgt

SEQ ID NO: 9137208 - DNA, 22 bp, Homo sapiens
tcatgctgagtcctggctttgt

SEQ ID NO: 9137209 - DNA, 21 bp, Homo sapiens
tcatgcatgagtttatatata

SEQ ID NO: 9137210 - DNA, 22 bp, Homo sapiens
tcatagctaagctccagagtgc

SEQ ID NO: 9137211 - DNA, 22 bp, Homo sapiens
tcataggctaaggatttttccc

SEQ ID NO: 9137212 - DNA, 22 bp, Homo sapiens
tcataggctcctctgcttctgc

SEQ ID NO: 9137213 - DNA, 22 bp, Homo sapiens
tcataggctttgacttagttgt

SEQ ID NO: 9137214 - DNA, 22 bp, Homo sapiens
tcatataactggatattttcaa

SEQ ID NO: 9137215 - DNA, 22 bp, Homo sapiens
tcatataactggatattttcaa

SEQ ID NO: 9137216 - DNA, 22 bp, Homo sapiens
tcatataagtttaaaactatct

SEQ ID NO: 9137217 - DNA, 22 bp, Homo sapiens
tcatataagagctttagagtca

SEQ ID NO: 9137218 - DNA, 22 bp, Homo sapiens
tcatatgtatgatctctgtaca

SEQ ID NO: 9137219 - DNA, 20 bp, Homo sapiens
tcatatgtggttgtatacaa

SEQ ID NO: 9137220 - DNA, 20 bp, Homo sapiens
tcatatgtggttgtatacaa

SEQ ID NO: 9137221 - DNA, 22 bp, Homo sapiens
tcatatatctgcaaagcagtat

SEQ ID NO: 9137222 - DNA, 22 bp, Homo sapiens
tcatatattttggcagtgatca

SEQ ID NO: 9137223 - DNA, 22 bp, Homo sapiens
tcatatatctgcaaagcagtat

SEQ ID NO: 9137224 - DNA, 22 bp, Homo sapiens
tcatatagagggcatacaaatg

SEQ ID NO: 9137225 - DNA, 22 bp, Homo sapiens
tcatatactgccttgtagatta

SEQ ID NO: 9137226 - DNA, 22 bp, Homo sapiens
tcatatactgccttgtagatta

SEQ ID NO: 9137227 - DNA, 22 bp, Homo sapiens
tcatataccagagagtttatat

SEQ ID NO: 9137228 - DNA, 22 bp, Homo sapiens
tcattatagagttgtattttag

SEQ ID NO: 9137229 - DNA, 22 bp, Homo sapiens
tcattattctctttaatgttct

SEQ ID NO: 9137230 - DNA, 20 bp, Homo sapiens
tcattacagtgctaagatgt

SEQ ID NO: 9137231 - DNA, 22 bp, Homo sapiens
tcattcaggttgggcaagtgtc

SEQ ID NO: 9137232 - DNA, 22 bp, Homo sapiens
tcattcactttgaaataaacga

SEQ ID NO: 9137233 - DNA, 23 bp, Homo sapiens
tcattcaaggctggtatctttca

SEQ ID NO: 9137234 - DNA, 18 bp, Homo sapiens
tcattattgtttctggag

SEQ ID NO: 9137235 - DNA, 22 bp, Homo sapiens
tcatggcattgttaagggtttt

SEQ ID NO: 9137236 - DNA, 22 bp, Homo sapiens
tcatggctaatgcagtatattc

SEQ ID NO: 9137237 - DNA, 22 bp, Homo sapiens
tcatggctaatgcagtatattc

SEQ ID NO: 9137238 - DNA, 22 bp, Homo sapiens
tcatggcacttagcacagtcct

SEQ ID NO: 9137239 - DNA, 22 bp, Homo sapiens
tcatggcacttagcacagtcct

SEQ ID NO: 9137240 - DNA, 22 bp, Homo sapiens
tcatgcttaaaagacacttgag

SEQ ID NO: 9137241 - DNA, 22 bp, Homo sapiens
tcatgcttattgcatatttgga

SEQ ID NO: 9137242 - DNA, 22 bp, Homo sapiens
tcatgctgggtactatggctgc

SEQ ID NO: 9137243 - DNA, 22 bp, Homo sapiens
tcatgctgtgaactgtatacat

SEQ ID NO: 9137244 - DNA, 22 bp, Homo sapiens
tcatgctgtgaactgtatacat

SEQ ID NO: 9137245 - DNA, 22 bp, Homo sapiens
tcatgctgcaggcccaggcagg

SEQ ID NO: 9137246 - DNA, 22 bp, Homo sapiens
tcatgctttgttaatgtggcac

SEQ ID NO: 9137247 - DNA, 22 bp, Homo sapiens
tcagggaactacttctccctat

SEQ ID NO: 9137248 - DNA, 22 bp, Homo sapiens
tcagggaagaaatgggacttta

SEQ ID NO: 9137249 - DNA, 22 bp, Homo sapiens
tcagggaataagtagatgagtg

SEQ ID NO: 9137250 - DNA, 21 bp, Homo sapiens
tcagggaagtgtgcagaaggg

SEQ ID NO: 9137251 - DNA, 21 bp, Homo sapiens
tcagggaagtgtgcagaaggg

SEQ ID NO: 9137252 - DNA, 22 bp, Homo sapiens
tcagggaataagtagatgagtg

SEQ ID NO: 9137253 - DNA, 22 bp, Homo sapiens
tcagggaatcagactctgcagc

SEQ ID NO: 9137254 - DNA, 22 bp, Homo sapiens
tcagggaatcagactctgcagc

SEQ ID NO: 9137255 - DNA, 18 bp, Homo sapiens
tcagggaatcttggcctt

SEQ ID NO: 9137256 - DNA, 22 bp, Homo sapiens
tcaggtggccaaatgggagcgc

SEQ ID NO: 9137257 - DNA, 17 bp, Homo sapiens
tcagggaatgaggttgt

SEQ ID NO: 9137258 - DNA, 22 bp, Homo sapiens
tcagggaatgatgcacacagtt

SEQ ID NO: 9137259 - DNA, 21 bp, Homo sapiens
tcagtaaaaaaactacctaga

SEQ ID NO: 9137260 - DNA, 17 bp, Homo sapiens
tcagtctctgtcctgga

SEQ ID NO: 9137261 - DNA, 22 bp, Homo sapiens
tcagtcttccctccagtgcaac

SEQ ID NO: 9137262 - DNA, 22 bp, Homo sapiens
tcagtcttccctccagtgcaac

SEQ ID NO: 9137263 - DNA, 23 bp, Homo sapiens
tcagtcttccctgtcagtaatag

SEQ ID NO: 9137264 - DNA, 22 bp, Homo sapiens
tcagtcttctagcaaatccagg

SEQ ID NO: 9137265 - DNA, 22 bp, Homo sapiens
tcagtgtcctgtgcggtgcagc

SEQ ID NO: 9137266 - DNA, 22 bp, Homo sapiens
tcagtgtccttcgttcttgttg

SEQ ID NO: 9137267 - DNA, 23 bp, Homo sapiens
tcagtgtctagttgtggaattga

SEQ ID NO: 9137268 - DNA, 22 bp, Homo sapiens
tcagtgtcccgtctcttaactc

SEQ ID NO: 9137269 - DNA, 22 bp, Homo sapiens
tcagtgtctgtgggcaggatgg

SEQ ID NO: 9137270 - DNA, 22 bp, Homo sapiens
tcagtgtaagtttttggatagg

SEQ ID NO: 9137271 - DNA, 22 bp, Homo sapiens
tcagtgcagtagaactttagtt

SEQ ID NO: 9137272 - DNA, 22 bp, Homo sapiens
tcagtgcagggtgggagagaga

SEQ ID NO: 9137273 - DNA, 22 bp, Homo sapiens
tcagtgcagggtgggagagaga

SEQ ID NO: 9137274 - DNA, 22 bp, Homo sapiens
tcagtgtcagtcttttagatat

SEQ ID NO: 9137275 - DNA, 23 bp, Homo sapiens
tcagtgcaaaaataggattttgg

SEQ ID NO: 9137276 - DNA, 22 bp, Homo sapiens
tcagtgcaatcaaggtatgttt

SEQ ID NO: 9137277 - DNA, 22 bp, Homo sapiens
tcagtgcaatcaaggtatgttt

SEQ ID NO: 9137278 - DNA, 22 bp, Homo sapiens
tcagtgcaaaaaatgggctaga

SEQ ID NO: 9137279 - DNA, 22 bp, Homo sapiens
tcagtgcacagagatttttgtt

SEQ ID NO: 9137280 - DNA, 22 bp, Homo sapiens
tcagtgcacagagatttttgtt

SEQ ID NO: 9137281 - DNA, 22 bp, Homo sapiens
tcagtgcacccaattctctcca

SEQ ID NO: 9137282 - DNA, 21 bp, Homo sapiens
tcagtgcaattctatggggaa

SEQ ID NO: 9137283 - DNA, 22 bp, Homo sapiens
tcagtgcacaatgacggtggct

SEQ ID NO: 9137284 - DNA, 22 bp, Homo sapiens
tcagtgcagaatagtgatgcat

SEQ ID NO: 9137285 - DNA, 22 bp, Homo sapiens
tcagtgcagaatagtgatgcat

SEQ ID NO: 9137286 - DNA, 22 bp, Homo sapiens
tcagtgcagactgtaagttgga

SEQ ID NO: 9137287 - DNA, 20 bp, Homo sapiens
tcagtgcagattgtccaagt

SEQ ID NO: 9137288 - DNA, 22 bp, Homo sapiens
tcagtgcagcggcagcagctct

SEQ ID NO: 9137289 - DNA, 22 bp, Homo sapiens
tcagtgcagactgtaagttgga

SEQ ID NO: 9137290 - DNA, 22 bp, Homo sapiens
tcagtgcagcggcagcagctct

SEQ ID NO: 9137291 - DNA, 22 bp, Homo sapiens
tcagtgcaggaatttccttaga

SEQ ID NO: 9137292 - DNA, 22 bp, Homo sapiens
tcagtgcaggaatctctagcca

SEQ ID NO: 9137293 - DNA, 22 bp, Homo sapiens
tcagtgatttctggggtgaggg

SEQ ID NO: 9137294 - DNA, 22 bp, Homo sapiens
tcagtcttttaactttctgcca

SEQ ID NO: 9137295 - DNA, 22 bp, Homo sapiens
tcagtgaatgagataactttag

SEQ ID NO: 9137296 - DNA, 23 bp, Homo sapiens
tcagtcttggcttctgattttcc

SEQ ID NO: 9137297 - DNA, 22 bp, Homo sapiens
tcagtcttgtttgattcctcac

SEQ ID NO: 9137298 - DNA, 22 bp, Homo sapiens
tcagtcttgtttttctggtcca

SEQ ID NO: 9137299 - DNA, 22 bp, Homo sapiens
tcagtctttcgaattcagccag

SEQ ID NO: 9137300 - DNA, 22 bp, Homo sapiens
tcagtgaaccttctgtggcagg

SEQ ID NO: 9137301 - DNA, 22 bp, Homo sapiens
tcaatttaaggtactactttgg

SEQ ID NO: 9137302 - DNA, 22 bp, Homo sapiens
tcaataatggcaggataaattt

SEQ ID NO: 9137303 - DNA, 22 bp, Homo sapiens
tcaattttatgaaacaaagtga

SEQ ID NO: 9137304 - DNA, 22 bp, Homo sapiens
tcaatttcattctattagttaa

SEQ ID NO: 9137305 - DNA, 20 bp, Homo sapiens
tcaagttttgcttgacaaga

SEQ ID NO: 9137306 - DNA, 20 bp, Homo sapiens
tcaagttttgcttgacaaga

SEQ ID NO: 9137307 - DNA, 22 bp, Homo sapiens
tcaataaaattgttttcctatc

SEQ ID NO: 9137308 - DNA, 22 bp, Homo sapiens
tcaataaatccctctgaccctg

SEQ ID NO: 9137309 - DNA, 22 bp, Homo sapiens
tcaataaatagcttggctcagc

SEQ ID NO: 9137310 - DNA, 22 bp, Homo sapiens
tcaataaatccctctgaccctg

SEQ ID NO: 9137311 - DNA, 22 bp, Homo sapiens
tcaagtgcttgtgaggtatttg

SEQ ID NO: 9137312 - DNA, 22 bp, Homo sapiens
tcaagtattattacagatgtag

SEQ ID NO: 9137313 - DNA, 22 bp, Homo sapiens
tcaagtatttatttctgctggc

SEQ ID NO: 9137314 - DNA, 22 bp, Homo sapiens
tcaagtatttatttctgctggc

SEQ ID NO: 9137315 - DNA, 22 bp, Homo sapiens
tcaagtatgacatcaagtttct

SEQ ID NO: 9137316 - DNA, 22 bp, Homo sapiens
tcaaggctattaattctgtgag

SEQ ID NO: 9137317 - DNA, 22 bp, Homo sapiens
tcaagggcaaatgctacctata

SEQ ID NO: 9137318 - DNA, 22 bp, Homo sapiens
tcaaggcaaagtaaatattcaa

SEQ ID NO: 9137319 - DNA, 22 bp, Homo sapiens
tcaaggaggtgcttggcttcac

SEQ ID NO: 9137320 - DNA, 22 bp, Homo sapiens
tcaaggccacagtgagcagagt

SEQ ID NO: 9137321 - DNA, 22 bp, Homo sapiens
tatttctgtttatttgtacatc

SEQ ID NO: 9137322 - DNA, 22 bp, Homo sapiens
tatttctgtatgcataaaagga

SEQ ID NO: 9137323 - DNA, 22 bp, Homo sapiens
tatttctgtcagccagatatgg

SEQ ID NO: 9137324 - DNA, 22 bp, Homo sapiens
tatttctgggagttcagaaatt

SEQ ID NO: 9137325 - DNA, 22 bp, Homo sapiens
tatttctgaggcccaggaagtg

SEQ ID NO: 9137326 - DNA, 22 bp, Homo sapiens
tatttctgattgctcatgaggc

SEQ ID NO: 9137327 - DNA, 22 bp, Homo sapiens
tatttcttcgggattcaagcta

SEQ ID NO: 9137328 - DNA, 22 bp, Homo sapiens
tatttcttcgggattcaagcta

SEQ ID NO: 9137329 - DNA, 22 bp, Homo sapiens
tatttcttcgggattcaagcta

SEQ ID NO: 9137330 - DNA, 22 bp, Homo sapiens
tatttcttgagactcgtcttcc

SEQ ID NO: 9137331 - DNA, 22 bp, Homo sapiens
tatttcttgagactcgtcttcc

SEQ ID NO: 9137332 - DNA, 22 bp, Homo sapiens
tatttcttgagtggtcagtttc

SEQ ID NO: 9137333 - DNA, 22 bp, Homo sapiens
tcaagaaggagttatttattca

SEQ ID NO: 9137334 - DNA, 22 bp, Homo sapiens
tcaagaagtctgtaccatttga

SEQ ID NO: 9137335 - DNA, 22 bp, Homo sapiens
tcaagatgaaagatgtagccat

SEQ ID NO: 9137336 - DNA, 22 bp, Homo sapiens
tcaagagttggtcaaatccaaa

SEQ ID NO: 9137337 - DNA, 22 bp, Homo sapiens
tcaagagagtgctgcttggggt

SEQ ID NO: 9137338 - DNA, 22 bp, Homo sapiens
tcaagagcatgtatctccctaa

SEQ ID NO: 9137339 - DNA, 22 bp, Homo sapiens
tcaagacagatgggtaacttgg

SEQ ID NO: 9137340 - DNA, 22 bp, Homo sapiens
tcacagaataaattgagaagac

SEQ ID NO: 9137341 - DNA, 22 bp, Homo sapiens
tcacagctattctcatgtattt

SEQ ID NO: 9137342 - DNA, 22 bp, Homo sapiens
tcacagctccagactgcaactc

SEQ ID NO: 9137343 - DNA, 22 bp, Homo sapiens
tcacagctgagtttccatttct

SEQ ID NO: 9137344 - DNA, 22 bp, Homo sapiens
tcacagctctgtcaattttata

SEQ ID NO: 9137345 - DNA, 22 bp, Homo sapiens
tcacagctccagactgcaactc

SEQ ID NO: 9137346 - DNA, 22 bp, Homo sapiens
tcacagctcactgtagcctcga

SEQ ID NO: 9137347 - DNA, 19 bp, Homo sapiens
tcacaggcatctccccaga

SEQ ID NO: 9137348 - DNA, 22 bp, Homo sapiens
tcacaggcccaaaccacgctta

SEQ ID NO: 9137349 - DNA, 22 bp, Homo sapiens
tcacagctggacacgttggcat

SEQ ID NO: 9137350 - DNA, 22 bp, Homo sapiens
tcacaggataaggtggcatcac

SEQ ID NO: 9137351 - DNA, 22 bp, Homo sapiens
tcacagaaggaccttgtttcat

SEQ ID NO: 9137352 - DNA, 22 bp, Homo sapiens
tcacagaaggcatcacagaaga

SEQ ID NO: 9137353 - DNA, 22 bp, Homo sapiens
tcacaggctctccaccatgagg

SEQ ID NO: 9137354 - DNA, 22 bp, Homo sapiens
tcacaggctctccaccatgagg

SEQ ID NO: 9137355 - DNA, 22 bp, Homo sapiens
tcacaggcttgtgaacattgca

SEQ ID NO: 9137356 - DNA, 23 bp, Homo sapiens
tcacagggcactggctggggttg

SEQ ID NO: 9137357 - DNA, 22 bp, Homo sapiens
tcacaggttccagggatgagaa

SEQ ID NO: 9137358 - DNA, 22 bp, Homo sapiens
tcacagggtatctgggatggat

SEQ ID NO: 9137359 - DNA, 22 bp, Homo sapiens
tcacagggcattatggctccag

SEQ ID NO: 9137360 - DNA, 23 bp, Homo sapiens
tcacaggggccagcgctctgtgg

SEQ ID NO: 9137361 - DNA, 23 bp, Homo sapiens
tcacaggggccagcgctctgtgg

SEQ ID NO: 9137362 - DNA, 22 bp, Homo sapiens
tcacacatgctaagccagagat

SEQ ID NO: 9137363 - DNA, 22 bp, Homo sapiens
tcacacatgctaagccagagat

SEQ ID NO: 9137364 - DNA, 20 bp, Homo sapiens
tcacagaaacaaatagagaa

SEQ ID NO: 9137365 - DNA, 22 bp, Homo sapiens
tcacacatgagtaaatacaggg

SEQ ID NO: 9137366 - DNA, 22 bp, Homo sapiens
tcacaattcagaaaccaagtag

SEQ ID NO: 9137367 - DNA, 22 bp, Homo sapiens
tcacagaaatctgttttttcta

SEQ ID NO: 9137368 - DNA, 22 bp, Homo sapiens
tcacagaacaatgtttagttct

SEQ ID NO: 9137369 - DNA, 22 bp, Homo sapiens
tcacaaagctttgataagcaga

SEQ ID NO: 9137370 - DNA, 22 bp, Homo sapiens
tcacaaagagaattgtgggtgt

SEQ ID NO: 9137371 - DNA, 20 bp, Homo sapiens
tcaattttctacaacatttg

SEQ ID NO: 9137372 - DNA, 20 bp, Homo sapiens
tcaattttctacaacatttg

SEQ ID NO: 9137373 - DNA, 20 bp, Homo sapiens
tcaattttctacaacatttg

SEQ ID NO: 9137374 - DNA, 22 bp, Homo sapiens
tcacaaaagcttttgaatttgg

SEQ ID NO: 9137375 - DNA, 22 bp, Homo sapiens
tcacaaaagcttttgaatttgg

SEQ ID NO: 9137376 - DNA, 22 bp, Homo sapiens
tcacaaaagcttttgaatttgg

SEQ ID NO: 9137377 - DNA, 22 bp, Homo sapiens
tcacaaagggagggatagctgg

SEQ ID NO: 9137378 - DNA, 22 bp, Homo sapiens
tcacaaagtgaagtgtgtcatg

SEQ ID NO: 9137379 - DNA, 22 bp, Homo sapiens
tcacaagatacagttagaagca

SEQ ID NO: 9137380 - DNA, 22 bp, Homo sapiens
tcagagcaccacacagttccct

SEQ ID NO: 9137381 - DNA, 22 bp, Homo sapiens
tcagagaggttaaatatcttgt

SEQ ID NO: 9137382 - DNA, 22 bp, Homo sapiens
tcagagcatgtgggctgcagtt

SEQ ID NO: 9137383 - DNA, 22 bp, Homo sapiens
tcagagcattcgggtgacaaat

SEQ ID NO: 9137384 - DNA, 22 bp, Homo sapiens
tcagagctgggtgcttcttcct

SEQ ID NO: 9137385 - DNA, 22 bp, Homo sapiens
tcagagctttggagaccaggaa

SEQ ID NO: 9137386 - DNA, 22 bp, Homo sapiens
tcagaggaaacaatctttagta

SEQ ID NO: 9137387 - DNA, 22 bp, Homo sapiens
tcagagcttatctcttgctgga

SEQ ID NO: 9137388 - DNA, 22 bp, Homo sapiens
tcagagcttcacctgttacatt

SEQ ID NO: 9137389 - DNA, 22 bp, Homo sapiens
tcagagcttcacctgttacatt

SEQ ID NO: 9137390 - DNA, 22 bp, Homo sapiens
tcagagctaaggggagagcaaa

SEQ ID NO: 9137391 - DNA, 22 bp, Homo sapiens
tcagagctcatgagcagagcca

SEQ ID NO: 9137392 - DNA, 22 bp, Homo sapiens
tcagagctcatgagcagagcca

SEQ ID NO: 9137393 - DNA, 22 bp, Homo sapiens
tcagagctcctaagggctgatt

SEQ ID NO: 9137394 - DNA, 22 bp, Homo sapiens
tcagcaatatgataggctttgt

SEQ ID NO: 9137395 - DNA, 20 bp, Homo sapiens
tcagcacagctgacaaggtt

SEQ ID NO: 9137396 - DNA, 22 bp, Homo sapiens
tcagaggaaagggaacatagtc

SEQ ID NO: 9137397 - DNA, 22 bp, Homo sapiens
tcagaggaaagggaacatagtc

SEQ ID NO: 9137398 - DNA, 22 bp, Homo sapiens
tcagaggaaagggaacatagtc

SEQ ID NO: 9137399 - DNA, 22 bp, Homo sapiens
tcagaggaaagggaacatagtc

SEQ ID NO: 9137400 - DNA, 22 bp, Homo sapiens
tcagaggaaaggtcagatggct

SEQ ID NO: 9137401 - DNA, 22 bp, Homo sapiens
tcagaggaaaggtcagatggct

SEQ ID NO: 9137402 - DNA, 22 bp, Homo sapiens
tcagaggaacactgtttcatgc

SEQ ID NO: 9137403 - DNA, 22 bp, Homo sapiens
tcagaggaactggactaaagcc

SEQ ID NO: 9137404 - DNA, 22 bp, Homo sapiens
tcagaggaactggactaaagcc

SEQ ID NO: 9137405 - DNA, 22 bp, Homo sapiens
tcagaaaagaccacattattct

SEQ ID NO: 9137406 - DNA, 22 bp, Homo sapiens
tcagaaaagaccacattattct

SEQ ID NO: 9137407 - DNA, 22 bp, Homo sapiens
tcagaaaagagaaaatcttata

SEQ ID NO: 9137408 - DNA, 22 bp, Homo sapiens
tcagaaaagagaaaatcttata

SEQ ID NO: 9137409 - DNA, 22 bp, Homo sapiens
tcagaaaaggtagctgtgacaa

SEQ ID NO: 9137410 - DNA, 22 bp, Homo sapiens
tcactttttgatatcattctgc

SEQ ID NO: 9137411 - DNA, 22 bp, Homo sapiens
tcagaaaaggtagctgtgacaa

SEQ ID NO: 9137412 - DNA, 22 bp, Homo sapiens
tcagaaaaggtagctgtgacaa

SEQ ID NO: 9137413 - DNA, 22 bp, Homo sapiens
tcagacagcttgcagggaggtg

SEQ ID NO: 9137414 - DNA, 22 bp, Homo sapiens
tcagacatgggatatgaagctc

SEQ ID NO: 9137415 - DNA, 22 bp, Homo sapiens
tcagacatatttttaacaaagt

SEQ ID NO: 9137416 - DNA, 22 bp, Homo sapiens
tcagacatgttttaagacttat

SEQ ID NO: 9137417 - DNA, 22 bp, Homo sapiens
tcagagaactccacaccttagg

SEQ ID NO: 9137418 - DNA, 22 bp, Homo sapiens
tcagagaactccacaccttagg

SEQ ID NO: 9137419 - DNA, 21 bp, Homo sapiens
tcagagaacccggcaggcaag

SEQ ID NO: 9137420 - DNA, 22 bp, Homo sapiens
tcagagaaggctgagtcacggc

SEQ ID NO: 9137421 - DNA, 22 bp, Homo sapiens
tcagagaaggcaattttatggt

SEQ ID NO: 9137422 - DNA, 22 bp, Homo sapiens
tcagagaaggaggcacgagggc

SEQ ID NO: 9137423 - DNA, 20 bp, Homo sapiens
tcagagaaggagctttcctg

SEQ ID NO: 9137424 - DNA, 22 bp, Homo sapiens
tcagagaagcttaagctgtaat

SEQ ID NO: 9137425 - DNA, 22 bp, Homo sapiens
tcagagaagacatcattgtgaa

SEQ ID NO: 9137426 - DNA, 22 bp, Homo sapiens
tcagagaagctgccaggcgagc

SEQ ID NO: 9137427 - DNA, 22 bp, Homo sapiens
tcactttactttgttaatctgg

SEQ ID NO: 9137428 - DNA, 22 bp, Homo sapiens
tcactttacagctaaggttgtt

SEQ ID NO: 9137429 - DNA, 22 bp, Homo sapiens
tcactttaatgatttgtagaat

SEQ ID NO: 9137430 - DNA, 22 bp, Homo sapiens
tcactttgaattccttgatttt

SEQ ID NO: 9137431 - DNA, 22 bp, Homo sapiens
tcactttcctcatcacgactag

SEQ ID NO: 9137432 - DNA, 22 bp, Homo sapiens
tcactttgacagagaaatgaat

SEQ ID NO: 9137433 - DNA, 22 bp, Homo sapiens
tcactttggaagatagcacatc

SEQ ID NO: 9137434 - DNA, 22 bp, Homo sapiens
tcactttggattatgtaatttc

SEQ ID NO: 9137435 - DNA, 23 bp, Homo sapiens
tcactttgatgtaattgaaaagc

SEQ ID NO: 9137436 - DNA, 22 bp, Homo sapiens
tcactttgccctgtaccttggg

SEQ ID NO: 9137437 - DNA, 22 bp, Homo sapiens
tcacttgatccttccctgaaat

SEQ ID NO: 9137438 - DNA, 22 bp, Homo sapiens
tcacttgacctcttgaactcct

SEQ ID NO: 9137439 - DNA, 23 bp, Homo sapiens
tcacttgaagctagaatctgccc

SEQ ID NO: 9137440 - DNA, 22 bp, Homo sapiens
tcactgtgcacatatgataggt

SEQ ID NO: 9137441 - DNA, 22 bp, Homo sapiens
tcactgtgctctctagataggc

SEQ ID NO: 9137442 - DNA, 22 bp, Homo sapiens
tcactgatgcttatgaaagtgt

SEQ ID NO: 9137443 - DNA, 22 bp, Homo sapiens
tcactgaatgcagatacgtgac

SEQ ID NO: 9137444 - DNA, 21 bp, Homo sapiens
tcactgaagcctaagatgttt

SEQ ID NO: 9137445 - DNA, 22 bp, Homo sapiens
tcactacacaatatatttcaga

SEQ ID NO: 9137446 - DNA, 19 bp, Homo sapiens
tcacccaggctgctggctc

SEQ ID NO: 9137447 - DNA, 22 bp, Homo sapiens
tcaccaggattcctatcagtag

SEQ ID NO: 9137448 - DNA, 22 bp, Homo sapiens
tcaccaggactgagaccttggg

SEQ ID NO: 9137449 - DNA, 22 bp, Homo sapiens
tcaccaggactgagaccttggg

SEQ ID NO: 9137450 - DNA, 22 bp, Homo sapiens
tcaccagatctctctgtaatgg

SEQ ID NO: 9137451 - DNA, 22 bp, Homo sapiens
tcaccagatgatttttcttcag

SEQ ID NO: 9137452 - DNA, 22 bp, Homo sapiens
tcaccaggcaactatgtactcc

SEQ ID NO: 9137453 - DNA, 22 bp, Homo sapiens
tcaccaggattgggctgtaggc

SEQ ID NO: 9137454 - DNA, 22 bp, Homo sapiens
tcaccaggattgggctgtaggc

SEQ ID NO: 9137455 - DNA, 22 bp, Homo sapiens
tcaccaggattgggctgtaggc

SEQ ID NO: 9137456 - DNA, 22 bp, Homo sapiens
tcaccaggctagagtgcagtgg

SEQ ID NO: 9137457 - DNA, 22 bp, Homo sapiens
tcacccagcagctgcttctgct

SEQ ID NO: 9137458 - DNA, 22 bp, Homo sapiens
tcaccaaggcattttcacagca

SEQ ID NO: 9137459 - DNA, 22 bp, Homo sapiens
tcaccactaggaattgtgtagt

SEQ ID NO: 9137460 - DNA, 22 bp, Homo sapiens
tcaccactgaacagacctttgg

SEQ ID NO: 9137461 - DNA, 22 bp, Homo sapiens
tcaccactcactcaggcaagtc

SEQ ID NO: 9137462 - DNA, 22 bp, Homo sapiens
tcaccactgaggccacgtggct

SEQ ID NO: 9137463 - DNA, 23 bp, Homo sapiens
tcaccagaaggggtcaataaaga

SEQ ID NO: 9137464 - DNA, 22 bp, Homo sapiens
tcaccagacagttactgcatgt

SEQ ID NO: 9137465 - DNA, 22 bp, Homo sapiens
tcaccagacgcgtgggtctgag

SEQ ID NO: 9137466 - DNA, 22 bp, Homo sapiens
tcaccagacgcgtgggtctgag

SEQ ID NO: 9137467 - DNA, 22 bp, Homo sapiens
tcacattttgttcaaggctagt

SEQ ID NO: 9137468 - DNA, 22 bp, Homo sapiens
tcacattttctactactgtacg

SEQ ID NO: 9137469 - DNA, 22 bp, Homo sapiens
tcattgcaagctcatttatctg

SEQ ID NO: 9137470 - DNA, 22 bp, Homo sapiens
tcattgaagtgactgaaagatt

SEQ ID NO: 9137471 - DNA, 22 bp, Homo sapiens
tcattgaatgctctgcaggttg

SEQ ID NO: 9137472 - DNA, 22 bp, Homo sapiens
tccagagaggtttctccatgct

SEQ ID NO: 9137473 - DNA, 20 bp, Homo sapiens
tccagagagtggcaaagctc

SEQ ID NO: 9137474 - DNA, 20 bp, Homo sapiens
tccagacatctagctcagtt

SEQ ID NO: 9137475 - DNA, 22 bp, Homo sapiens
tcattgcagtagggagagaccc

SEQ ID NO: 9137476 - DNA, 22 bp, Homo sapiens
tcattgcagtgatgttgtatgt

SEQ ID NO: 9137477 - DNA, 22 bp, Homo sapiens
tcattgcagactaacaatctca

SEQ ID NO: 9137478 - DNA, 22 bp, Homo sapiens
tccagagatctctcttccctgt

SEQ ID NO: 9137479 - DNA, 22 bp, Homo sapiens
tccagagatctctcttccctgt

SEQ ID NO: 9137480 - DNA, 17 bp, Homo sapiens
tccagagcacagagctc

SEQ ID NO: 9137481 - DNA, 22 bp, Homo sapiens
tccagagatcacactgggcagg

SEQ ID NO: 9137482 - DNA, 22 bp, Homo sapiens
tccagagcaggtgtctacacag

SEQ ID NO: 9137483 - DNA, 18 bp, Homo sapiens
tccagagcagtctttggc

SEQ ID NO: 9137484 - DNA, 22 bp, Homo sapiens
tccagagccccaattcacctct

SEQ ID NO: 9137485 - DNA, 22 bp, Homo sapiens
tccagagccccagtctagtggg

SEQ ID NO: 9137486 - DNA, 22 bp, Homo sapiens
tccagagcctgcgcactggctg

SEQ ID NO: 9137487 - DNA, 22 bp, Homo sapiens
tccagagcctgcgcactggctg

SEQ ID NO: 9137488 - DNA, 22 bp, Homo sapiens
tccagagccttcgataagaaga

SEQ ID NO: 9137489 - DNA, 22 bp, Homo sapiens
tccagagcctttccacccactt

SEQ ID NO: 9137490 - DNA, 22 bp, Homo sapiens
tccagagctaattcagcagctg

SEQ ID NO: 9137491 - DNA, 22 bp, Homo sapiens
tccagagctaattcagcagctg

SEQ ID NO: 9137492 - DNA, 18 bp, Homo sapiens
tccagagctactgtggtg

SEQ ID NO: 9137493 - DNA, 22 bp, Homo sapiens
tccagagctacttgctcaactt

SEQ ID NO: 9137494 - DNA, 22 bp, Homo sapiens
tccagcagaccatcaaggctca

SEQ ID NO: 9137495 - DNA, 22 bp, Homo sapiens
tccagcagaccatcaaggctca

SEQ ID NO: 9137496 - DNA, 22 bp, Homo sapiens
tccagcagactcatcagcaagg

SEQ ID NO: 9137497 - DNA, 22 bp, Homo sapiens
tccagcagactcatcagcaagg

SEQ ID NO: 9137498 - DNA, 23 bp, Homo sapiens
tccagcagagccttccaggaggg

SEQ ID NO: 9137499 - DNA, 23 bp, Homo sapiens
tccagcagagccttccaggaggg

SEQ ID NO: 9137500 - DNA, 18 bp, Homo sapiens
tccagcagcatagtttcc

SEQ ID NO: 9137501 - DNA, 23 bp, Homo sapiens
tccagcagccaagaagggtagaa

SEQ ID NO: 9137502 - DNA, 23 bp, Homo sapiens
tccagcagccaagaagggtagaa

SEQ ID NO: 9137503 - DNA, 23 bp, Homo sapiens
tccagcagccaagaagggtagaa

SEQ ID NO: 9137504 - DNA, 22 bp, Homo sapiens
tccagcagccacacctctggac

SEQ ID NO: 9137505 - DNA, 22 bp, Homo sapiens
tccagcagagtctctgaggggg

SEQ ID NO: 9137506 - DNA, 18 bp, Homo sapiens
tccagcagcatagtttcc

SEQ ID NO: 9137507 - DNA, 22 bp, Homo sapiens
tccagcagaggttgataatacc

SEQ ID NO: 9137508 - DNA, 22 bp, Homo sapiens
tccagcagagtctctgaggggg

SEQ ID NO: 9137509 - DNA, 22 bp, Homo sapiens
tccagcagcctgacttccctct

SEQ ID NO: 9137510 - DNA, 22 bp, Homo sapiens
tccagcagcctgacttccctct

SEQ ID NO: 9137511 - DNA, 22 bp, Homo sapiens
tccagcagggaattagtagtct

SEQ ID NO: 9137512 - DNA, 22 bp, Homo sapiens
tccagcagcccgaaggcccatc

SEQ ID NO: 9137513 - DNA, 22 bp, Homo sapiens
tccagcagccacacctctggac

SEQ ID NO: 9137514 - DNA, 22 bp, Homo sapiens
tccagcagccacacctctggac

SEQ ID NO: 9137515 - DNA, 22 bp, Homo sapiens
tccagcagccacacctctggac

SEQ ID NO: 9137516 - DNA, 22 bp, Homo sapiens
tccagcagggaattagtagtct

SEQ ID NO: 9137517 - DNA, 22 bp, Homo sapiens
tccagcaggtccgagacaagtt

SEQ ID NO: 9137518 - DNA, 22 bp, Homo sapiens
tccagcaggtccgagacaagtt

SEQ ID NO: 9137519 - DNA, 18 bp, Homo sapiens
tccagcaggtctgaggtg

SEQ ID NO: 9137520 - DNA, 18 bp, Homo sapiens
tccagcaggtctgaggtg

SEQ ID NO: 9137521 - DNA, 22 bp, Homo sapiens
tccagcaggtgtttgccaactt

SEQ ID NO: 9137522 - DNA, 22 bp, Homo sapiens
tccagcaggtgtttgccaactt

SEQ ID NO: 9137523 - DNA, 22 bp, Homo sapiens
tccagagctgggtctgtgctca

SEQ ID NO: 9137524 - DNA, 23 bp, Homo sapiens
tccagagctcatgctctcaacca

SEQ ID NO: 9137525 - DNA, 22 bp, Homo sapiens
tccagagctgagcagtcattct

SEQ ID NO: 9137526 - DNA, 22 bp, Homo sapiens
tccagagctgagcagtcattct

SEQ ID NO: 9137527 - DNA, 22 bp, Homo sapiens
tccagagctctgggcatagctg

SEQ ID NO: 9137528 - DNA, 21 bp, Homo sapiens
tccagaggaggacagactcag

SEQ ID NO: 9137529 - DNA, 22 bp, Homo sapiens
tccagagctgtcctactgtgag

SEQ ID NO: 9137530 - DNA, 22 bp, Homo sapiens
tccagagctgtatgattttttt

SEQ ID NO: 9137531 - DNA, 18 bp, Homo sapiens
tccagagctggtgcttct

SEQ ID NO: 9137532 - DNA, 22 bp, Homo sapiens
tccagctcctctacccgatgcg

SEQ ID NO: 9137533 - DNA, 23 bp, Homo sapiens
tccagctcccttcaatggcactg

SEQ ID NO: 9137534 - DNA, 22 bp, Homo sapiens
tccagctcccactctcactgct

SEQ ID NO: 9137535 - DNA, 22 bp, Homo sapiens
tccagctcagggttggctcaag

SEQ ID NO: 9137536 - DNA, 22 bp, Homo sapiens
tccagctcagggttggctcaag

SEQ ID NO: 9137537 - DNA, 20 bp, Homo sapiens
tccagcgtgtgactctgcgc

SEQ ID NO: 9137538 - DNA, 22 bp, Homo sapiens
tccagctcaaagtgctcctgtc

SEQ ID NO: 9137539 - DNA, 22 bp, Homo sapiens
tccagctcaaagtgctcctgtc

SEQ ID NO: 9137540 - DNA, 18 bp, Homo sapiens
tccagctcacagatgggc

SEQ ID NO: 9137541 - DNA, 22 bp, Homo sapiens
tccagctcagatgcagggatca

SEQ ID NO: 9137542 - DNA, 22 bp, Homo sapiens
tccagcattcttagacctctat

SEQ ID NO: 9137543 - DNA, 22 bp, Homo sapiens
tccagcatgactagttccccat

SEQ ID NO: 9137544 - DNA, 22 bp, Homo sapiens
tccagccaatcagagctgaggc

SEQ ID NO: 9137545 - DNA, 22 bp, Homo sapiens
tccagccaagccttggtagctg

SEQ ID NO: 9137546 - DNA, 22 bp, Homo sapiens
tccagcagtgctcaggactcac

SEQ ID NO: 9137547 - DNA, 22 bp, Homo sapiens
tccagcagtgctcaggactcac

SEQ ID NO: 9137548 - DNA, 16 bp, Homo sapiens
tccagcagtctctgta

SEQ ID NO: 9137549 - DNA, 16 bp, Homo sapiens
tccagcagtctctgta

SEQ ID NO: 9137550 - DNA, 20 bp, Homo sapiens
tccagcatataaactcctct

SEQ ID NO: 9137551 - DNA, 19 bp, Homo sapiens
tccagcagtgcttgaaatc

SEQ ID NO: 9137552 - DNA, 22 bp, Homo sapiens
tccagcagtgctcaggactcac

SEQ ID NO: 9137553 - DNA, 22 bp, Homo sapiens
tccagcagtgctctagagcgtg

SEQ ID NO: 9137554 - DNA, 22 bp, Homo sapiens
tccagcagtccatgtgagacac

SEQ ID NO: 9137555 - DNA, 22 bp, Homo sapiens
tccagcagtccatgtgagacac

SEQ ID NO: 9137556 - DNA, 22 bp, Homo sapiens
tccagcagtccatgtgagacac

SEQ ID NO: 9137557 - DNA, 20 bp, Homo sapiens
tccagcagtatgctatactt

SEQ ID NO: 9137558 - DNA, 20 bp, Homo sapiens
tccagcagtatgctatactt

SEQ ID NO: 9137559 - DNA, 22 bp, Homo sapiens
tccagcagtaaggaaagtacat

SEQ ID NO: 9137560 - DNA, 22 bp, Homo sapiens
tccagcaggttggtcaggtgca

SEQ ID NO: 9137561 - DNA, 22 bp, Homo sapiens
tccagcttggagagaagtttct

SEQ ID NO: 9137562 - DNA, 22 bp, Homo sapiens
tccagctttcacgctcctgcct

SEQ ID NO: 9137563 - DNA, 22 bp, Homo sapiens
tccagctgttccatcagctctt

SEQ ID NO: 9137564 - DNA, 22 bp, Homo sapiens
tccagctgttgatattctaggt

SEQ ID NO: 9137565 - DNA, 22 bp, Homo sapiens
tccaggaggctctggttgacgt

SEQ ID NO: 9137566 - DNA, 22 bp, Homo sapiens
tccaggaggcctcatttcctgt

SEQ ID NO: 9137567 - DNA, 22 bp, Homo sapiens
tccaggaaagcactgggctggg

SEQ ID NO: 9137568 - DNA, 22 bp, Homo sapiens
tccaggaaacactcaagccatg

SEQ ID NO: 9137569 - DNA, 22 bp, Homo sapiens
tccaggaaacagcatctcagca

SEQ ID NO: 9137570 - DNA, 21 bp, Homo sapiens
tccagctcctgccactcctta

SEQ ID NO: 9137571 - DNA, 22 bp, Homo sapiens
tccagctctgcttcacagtctc

SEQ ID NO: 9137572 - DNA, 22 bp, Homo sapiens
tccagctctgctgtgcgccggt

SEQ ID NO: 9137573 - DNA, 22 bp, Homo sapiens
tccagctctggcttggctagct

SEQ ID NO: 9137574 - DNA, 22 bp, Homo sapiens
tccagctctggcttggctagct

SEQ ID NO: 9137575 - DNA, 22 bp, Homo sapiens
tccagctggggcagtggctggg

SEQ ID NO: 9137576 - DNA, 22 bp, Homo sapiens
tccagctggggcagtggctggg

SEQ ID NO: 9137577 - DNA, 22 bp, Homo sapiens
tccagctggggcagtggctggg

SEQ ID NO: 9137578 - DNA, 22 bp, Homo sapiens
tccagctggggacatgggcttc

SEQ ID NO: 9137579 - DNA, 22 bp, Homo sapiens
tccagctggggacatgggcttc

SEQ ID NO: 9137580 - DNA, 20 bp, Homo sapiens
tccagctgtctttcagagac

SEQ ID NO: 9137581 - DNA, 20 bp, Homo sapiens
tccagctgtctttcagagac

SEQ ID NO: 9137582 - DNA, 21 bp, Homo sapiens
tccagctgtgattatgaatgt

SEQ ID NO: 9137583 - DNA, 22 bp, Homo sapiens
tccagctgtgctccaggaggtg

SEQ ID NO: 9137584 - DNA, 22 bp, Homo sapiens
tccagctgtgctccaggaggtg

SEQ ID NO: 9137585 - DNA, 19 bp, Homo sapiens
tccagctggtatgcccaga

SEQ ID NO: 9137586 - DNA, 19 bp, Homo sapiens
tccagctggtatgcccaga

SEQ ID NO: 9137587 - DNA, 22 bp, Homo sapiens
tccaggagtttgagactgcagt

SEQ ID NO: 9137588 - DNA, 22 bp, Homo sapiens
tccaggagtggggcagaggtct

SEQ ID NO: 9137589 - DNA, 22 bp, Homo sapiens
tccaggagtgataaggccactg

SEQ ID NO: 9137590 - DNA, 22 bp, Homo sapiens
tccaggagtctagcctcaggcc

SEQ ID NO: 9137591 - DNA, 22 bp, Homo sapiens
tccaggagtgctggttagagta

SEQ ID NO: 9137592 - DNA, 22 bp, Homo sapiens
tccaggcagggttaagggtcct

SEQ ID NO: 9137593 - DNA, 22 bp, Homo sapiens
tccaggcataagccttgagtgt

SEQ ID NO: 9137594 - DNA, 22 bp, Homo sapiens
tccaggcataatgcccagtggt

SEQ ID NO: 9137595 - DNA, 22 bp, Homo sapiens
tccaggatggtgacggtggcca

SEQ ID NO: 9137596 - DNA, 22 bp, Homo sapiens
tccaggatgcccgcttttgctt

SEQ ID NO: 9137597 - DNA, 22 bp, Homo sapiens
tccaggattgcaggtgcacaac

SEQ ID NO: 9137598 - DNA, 22 bp, Homo sapiens
tccaggattgtcagccagaagg

SEQ ID NO: 9137599 - DNA, 20 bp, Homo sapiens
tccaggcagctcagagtgtc

SEQ ID NO: 9137600 - DNA, 20 bp, Homo sapiens
tccaggcagctcagagtgtc

SEQ ID NO: 9137601 - DNA, 22 bp, Homo sapiens
tccaggagggttttctgccttc

SEQ ID NO: 9137602 - DNA, 22 bp, Homo sapiens
tccaggagggggagccgtgccg

SEQ ID NO: 9137603 - DNA, 22 bp, Homo sapiens
tccaggaggggtaggcagtatg

SEQ ID NO: 9137604 - DNA, 22 bp, Homo sapiens
tccaggaggttgagactgcagt

SEQ ID NO: 9137605 - DNA, 22 bp, Homo sapiens
tccaggaggtttggaggaagca

SEQ ID NO: 9137606 - DNA, 22 bp, Homo sapiens
tccaggagtcagacagatggtg

SEQ ID NO: 9137607 - DNA, 22 bp, Homo sapiens
tccaggagtcagacagatggtg

SEQ ID NO: 9137608 - DNA, 22 bp, Homo sapiens
tccaggagtcctgggagtgatt

SEQ ID NO: 9137609 - DNA, 22 bp, Homo sapiens
tccaggagtcctgggagtgatt

SEQ ID NO: 9137610 - DNA, 22 bp, Homo sapiens
tccaggagtcctgggagtgatt

SEQ ID NO: 9137611 - DNA, 22 bp, Homo sapiens
tccaggagtcctgggtggcccc

SEQ ID NO: 9137612 - DNA, 22 bp, Homo sapiens
tccaggagtctagcctcaggcc

SEQ ID NO: 9137613 - DNA, 22 bp, Homo sapiens
tccaggagtctagcctcaggcc

SEQ ID NO: 9137614 - DNA, 22 bp, Homo sapiens
tccaggccacgacctcctggat

SEQ ID NO: 9137615 - DNA, 22 bp, Homo sapiens
tccaggcatgtctgagtccttc

SEQ ID NO: 9137616 - DNA, 23 bp, Homo sapiens
tccaggcatgagctctggatgga

SEQ ID NO: 9137617 - DNA, 23 bp, Homo sapiens
tccaggcatgagctctggatgga

SEQ ID NO: 9137618 - DNA, 23 bp, Homo sapiens
tccaggcatgagctctggatgga

SEQ ID NO: 9137619 - DNA, 22 bp, Homo sapiens
tccaggcatcccccaggacaga

SEQ ID NO: 9137620 - DNA, 22 bp, Homo sapiens
tccaggcatcccccaggacaga

SEQ ID NO: 9137621 - DNA, 23 bp, Homo sapiens
tccaggctgaaggagcagatttt

SEQ ID NO: 9137622 - DNA, 23 bp, Homo sapiens
tccaggctgaaggagcagatttt

SEQ ID NO: 9137623 - DNA, 19 bp, Homo sapiens
tccaggctgagagtcagct

SEQ ID NO: 9137624 - DNA, 22 bp, Homo sapiens
tccaggctgacgcagctattta

SEQ ID NO: 9137625 - DNA, 22 bp, Homo sapiens
tccaggctgatccatgaagaat

SEQ ID NO: 9137626 - DNA, 22 bp, Homo sapiens
tccaggctgatccatgaagaat

SEQ ID NO: 9137627 - DNA, 21 bp, Homo sapiens
tccaggctgatgatgtcaact

SEQ ID NO: 9137628 - DNA, 22 bp, Homo sapiens
tccaggctgcaaggccacaggg

SEQ ID NO: 9137629 - DNA, 22 bp, Homo sapiens
tccaggctcagcacttgctact

SEQ ID NO: 9137630 - DNA, 22 bp, Homo sapiens
tccaggctaggtttacaggaca

SEQ ID NO: 9137631 - DNA, 22 bp, Homo sapiens
tccaggctctcaggtgtcagca

SEQ ID NO: 9137632 - DNA, 22 bp, Homo sapiens
tccaggctctcaggtgtcagca

SEQ ID NO: 9137633 - DNA, 22 bp, Homo sapiens
tccaggctctaggctgctctcc

SEQ ID NO: 9137634 - DNA, 22 bp, Homo sapiens
tccaggctctaggctgctctcc

SEQ ID NO: 9137635 - DNA, 22 bp, Homo sapiens
tccaggctctaggctgctctcc

SEQ ID NO: 9137636 - DNA, 22 bp, Homo sapiens
tcccaattaacaggtatcaggc

SEQ ID NO: 9137637 - DNA, 22 bp, Homo sapiens
tcccacacctgtctattcctag

SEQ ID NO: 9137638 - DNA, 22 bp, Homo sapiens
tcccacactacacggttgttgg

SEQ ID NO: 9137639 - DNA, 22 bp, Homo sapiens
tcccacacagcccgctcaccgg

SEQ ID NO: 9137640 - DNA, 22 bp, Homo sapiens
tcccacacttgaaacaaggctg

SEQ ID NO: 9137641 - DNA, 22 bp, Homo sapiens
tcccacacttgaaacaaggctg

SEQ ID NO: 9137642 - DNA, 21 bp, Homo sapiens
tcccaagctgctggctcagct

SEQ ID NO: 9137643 - DNA, 22 bp, Homo sapiens
tccatgccaggcagtcgatgca

SEQ ID NO: 9137644 - DNA, 22 bp, Homo sapiens
tcccaaggataagagagtctga

SEQ ID NO: 9137645 - DNA, 20 bp, Homo sapiens
tcccaagggctgagaggatc

SEQ ID NO: 9137646 - DNA, 22 bp, Homo sapiens
tcccaaggcctctagttgatta

SEQ ID NO: 9137647 - DNA, 22 bp, Homo sapiens
tccatctgtttactataaagat

SEQ ID NO: 9137648 - DNA, 22 bp, Homo sapiens
tccatctgtttactataaagat

SEQ ID NO: 9137649 - DNA, 22 bp, Homo sapiens
tccatctgtctttcccatccac

SEQ ID NO: 9137650 - DNA, 20 bp, Homo sapiens
tccatctggtataagctgat

SEQ ID NO: 9137651 - DNA, 22 bp, Homo sapiens
tccatctggtgagtgaggagcc

SEQ ID NO: 9137652 - DNA, 22 bp, Homo sapiens
tccatccatgtaggaagatggt

SEQ ID NO: 9137653 - DNA, 22 bp, Homo sapiens
tccatccagattttaagtgctg

SEQ ID NO: 9137654 - DNA, 22 bp, Homo sapiens
tccatcatgttcacagctatat

SEQ ID NO: 9137655 - DNA, 22 bp, Homo sapiens
tccatgagtttgaggaaaagag

SEQ ID NO: 9137656 - DNA, 23 bp, Homo sapiens
tccatgagatgtgggcttctagt

SEQ ID NO: 9137657 - DNA, 22 bp, Homo sapiens
tccatgagctagggattcatca

SEQ ID NO: 9137658 - DNA, 22 bp, Homo sapiens
tccaggctggaaatgtcaaact

SEQ ID NO: 9137659 - DNA, 22 bp, Homo sapiens
tccaggctggaaatgtcaaact

SEQ ID NO: 9137660 - DNA, 22 bp, Homo sapiens
tccaggctgcagtcttgccctc

SEQ ID NO: 9137661 - DNA, 22 bp, Homo sapiens
tccaggctgccacagtgcaacg

SEQ ID NO: 9137662 - DNA, 22 bp, Homo sapiens
tccagggcagccgcgggtgcgc

SEQ ID NO: 9137663 - DNA, 19 bp, Homo sapiens
tccagggcaggaacatgta

SEQ ID NO: 9137664 - DNA, 19 bp, Homo sapiens
tccagggcaggaacatgta

SEQ ID NO: 9137665 - DNA, 19 bp, Homo sapiens
tccagggcaggaacatgta

SEQ ID NO: 9137666 - DNA, 22 bp, Homo sapiens
tccagggcagggtgcgcatggg

SEQ ID NO: 9137667 - DNA, 22 bp, Homo sapiens
tccagggccaagtcatggaacc

SEQ ID NO: 9137668 - DNA, 22 bp, Homo sapiens
tccagggccatctccatgaggc

SEQ ID NO: 9137669 - DNA, 22 bp, Homo sapiens
tccagggccagtccttgtctgt

SEQ ID NO: 9137670 - DNA, 22 bp, Homo sapiens
tccagggccagtccttgtctgt

SEQ ID NO: 9137671 - DNA, 22 bp, Homo sapiens
tccagggccacagaggatgcta

SEQ ID NO: 9137672 - DNA, 22 bp, Homo sapiens
tccagggccacagaggatgcta

SEQ ID NO: 9137673 - DNA, 22 bp, Homo sapiens
tccagggccacagaggatgcta

SEQ ID NO: 9137674 - DNA, 22 bp, Homo sapiens
tccagggccccccagttgcacg

SEQ ID NO: 9137675 - DNA, 20 bp, Homo sapiens
tccagggccctggctcctct

SEQ ID NO: 9137676 - DNA, 20 bp, Homo sapiens
tccagggccctggctcctct

SEQ ID NO: 9137677 - DNA, 20 bp, Homo sapiens
tccagggccctggctcctct

SEQ ID NO: 9137678 - DNA, 22 bp, Homo sapiens
tccagggccccccagttgcacg

SEQ ID NO: 9137679 - DNA, 22 bp, Homo sapiens
tccagggccccccagttgcacg

SEQ ID NO: 9137680 - DNA, 22 bp, Homo sapiens
tccagggccatgaagttgcaca

SEQ ID NO: 9137681 - DNA, 22 bp, Homo sapiens
tccagggccatgaagttgcaca

SEQ ID NO: 9137682 - DNA, 22 bp, Homo sapiens
tccagggccatgaagttgcaca

SEQ ID NO: 9137683 - DNA, 22 bp, Homo sapiens
tccagtttccaatcactgcacg

SEQ ID NO: 9137684 - DNA, 22 bp, Homo sapiens
tccagtttccaatcactgcacg

SEQ ID NO: 9137685 - DNA, 22 bp, Homo sapiens
tccatcaccatttctgcgagct

SEQ ID NO: 9137686 - DNA, 22 bp, Homo sapiens
tccatcagcatgcaggctgttc

SEQ ID NO: 9137687 - DNA, 22 bp, Homo sapiens
tccatccacattaacagatacg

SEQ ID NO: 9137688 - DNA, 22 bp, Homo sapiens
tccagggctccccaacatccag

SEQ ID NO: 9137689 - DNA, 22 bp, Homo sapiens
tccagggctccccaacatccag

SEQ ID NO: 9137690 - DNA, 22 bp, Homo sapiens
tccagtttacagggttgctttt

SEQ ID NO: 9137691 - DNA, 22 bp, Homo sapiens
tccagggccttacctcttcaga

SEQ ID NO: 9137692 - DNA, 22 bp, Homo sapiens
tccagggcctgaggttgaagtg

SEQ ID NO: 9137693 - DNA, 22 bp, Homo sapiens
tccagggcctgaggttgaagtg

SEQ ID NO: 9137694 - DNA, 22 bp, Homo sapiens
tccagggcctgaggttgaagtg

SEQ ID NO: 9137695 - DNA, 21 bp, Homo sapiens
tccagggcgggcgcacggaga

SEQ ID NO: 9137696 - DNA, 21 bp, Homo sapiens
tccagggcgggcgcacggaga

SEQ ID NO: 9137697 - DNA, 21 bp, Homo sapiens
tccagggcgggcgcacggaga

SEQ ID NO: 9137698 - DNA, 20 bp, Homo sapiens
tccagggctagggagctcat

SEQ ID NO: 9137699 - DNA, 20 bp, Homo sapiens
tccagggctagggagctcat

SEQ ID NO: 9137700 - DNA, 20 bp, Homo sapiens
tccagggctagggagctcat

SEQ ID NO: 9137701 - DNA, 20 bp, Homo sapiens
tccagggctagggagctcat

SEQ ID NO: 9137702 - DNA, 22 bp, Homo sapiens
tccagggctacaaggcaccaga

SEQ ID NO: 9137703 - DNA, 22 bp, Homo sapiens
tccagggctacaaggcaccaga

SEQ ID NO: 9137704 - DNA, 22 bp, Homo sapiens
tccagggcgtgtgtgaaggaaa

SEQ ID NO: 9137705 - DNA, 22 bp, Homo sapiens
tccccacctaagatacccatct

SEQ ID NO: 9137706 - DNA, 22 bp, Homo sapiens
tccccaccccagaactactagg

SEQ ID NO: 9137707 - DNA, 22 bp, Homo sapiens
tccccacctacacactgctcct

SEQ ID NO: 9137708 - DNA, 22 bp, Homo sapiens
tccccacctacacactgctcct

SEQ ID NO: 9137709 - DNA, 22 bp, Homo sapiens
tccccaggaatcaggtggttgc

SEQ ID NO: 9137710 - DNA, 22 bp, Homo sapiens
tccccaggaatcaggtggttgc

SEQ ID NO: 9137711 - DNA, 22 bp, Homo sapiens
tccccaggagcaatgattcagt

SEQ ID NO: 9137712 - DNA, 22 bp, Homo sapiens
tccccaggactaagttgcaatc

SEQ ID NO: 9137713 - DNA, 22 bp, Homo sapiens
tccccaggaaggcccttcctgg

SEQ ID NO: 9137714 - DNA, 22 bp, Homo sapiens
tccccaggaaattctgattctt

SEQ ID NO: 9137715 - DNA, 19 bp, Homo sapiens
tccccaagagttctagctc

SEQ ID NO: 9137716 - DNA, 22 bp, Homo sapiens
tccccacacagatacagagtag

SEQ ID NO: 9137717 - DNA, 22 bp, Homo sapiens
tccccacacagatacagagtag

SEQ ID NO: 9137718 - DNA, 22 bp, Homo sapiens
tccccacactttcactcctggc

SEQ ID NO: 9137719 - DNA, 22 bp, Homo sapiens
tccccacagcagaagatctgag

SEQ ID NO: 9137720 - DNA, 21 bp, Homo sapiens
tccccacatttctaaacagac

SEQ ID NO: 9137721 - DNA, 22 bp, Homo sapiens
tccccaccccagaactactagg

SEQ ID NO: 9137722 - DNA, 22 bp, Homo sapiens
tccccacatctctgcatcaggc

SEQ ID NO: 9137723 - DNA, 22 bp, Homo sapiens
tccccacatctctgcatcaggc

SEQ ID NO: 9137724 - DNA, 22 bp, Homo sapiens
tccccaggggcatctctctgct

SEQ ID NO: 9137725 - DNA, 22 bp, Homo sapiens
tccccaggggcatctctctgct

SEQ ID NO: 9137726 - DNA, 22 bp, Homo sapiens
tccccaggggcatctctctgct

SEQ ID NO: 9137727 - DNA, 22 bp, Homo sapiens
tccccaggggcctgggcacagt

SEQ ID NO: 9137728 - DNA, 22 bp, Homo sapiens
tccccagggtccctgcttccat

SEQ ID NO: 9137729 - DNA, 22 bp, Homo sapiens
tccccagggtccctgcttccat

SEQ ID NO: 9137730 - DNA, 22 bp, Homo sapiens
tccccaggggcctgggcacagt

SEQ ID NO: 9137731 - DNA, 22 bp, Homo sapiens
tccccaggagttttactttgca

SEQ ID NO: 9137732 - DNA, 20 bp, Homo sapiens
tccccagggcatcaggagca

SEQ ID NO: 9137733 - DNA, 20 bp, Homo sapiens
tccccagggcatcaggagca

SEQ ID NO: 9137734 - DNA, 20 bp, Homo sapiens
tccccagggcatcaggagca

SEQ ID NO: 9137735 - DNA, 22 bp, Homo sapiens
tccccagggctgcagagggtgt

SEQ ID NO: 9137736 - DNA, 22 bp, Homo sapiens
tcccagtttttctccactaagg

SEQ ID NO: 9137737 - DNA, 22 bp, Homo sapiens
tcccagtttttctccactaagg

SEQ ID NO: 9137738 - DNA, 22 bp, Homo sapiens
tcccagtgggtgactggaggct

SEQ ID NO: 9137739 - DNA, 22 bp, Homo sapiens
tcccagtgtggcaggccatgga

SEQ ID NO: 9137740 - DNA, 20 bp, Homo sapiens
tcccagtcagccagagtgag

SEQ ID NO: 9137741 - DNA, 22 bp, Homo sapiens
tcccagtgctacagacagggca

SEQ ID NO: 9137742 - DNA, 22 bp, Homo sapiens
tcccacagtctcacaatgcata

SEQ ID NO: 9137743 - DNA, 22 bp, Homo sapiens
tcccagggactgggctaggctt

SEQ ID NO: 9137744 - DNA, 22 bp, Homo sapiens
tcccagggactggatgatgcag

SEQ ID NO: 9137745 - DNA, 22 bp, Homo sapiens
tcccagggatcctccgggtcgc

SEQ ID NO: 9137746 - DNA, 22 bp, Homo sapiens
tcccagggactgggctaggctt

SEQ ID NO: 9137747 - DNA, 22 bp, Homo sapiens
tcccacaggaaagtagacattg

SEQ ID NO: 9137748 - DNA, 22 bp, Homo sapiens
tcccagggttacagccagggca

SEQ ID NO: 9137749 - DNA, 22 bp, Homo sapiens
tcccagggttacagccagggca

SEQ ID NO: 9137750 - DNA, 22 bp, Homo sapiens
tcccagggtgcgcctgccctcg

SEQ ID NO: 9137751 - DNA, 22 bp, Homo sapiens
tcccagggttacagccagggca

SEQ ID NO: 9137752 - DNA, 22 bp, Homo sapiens
tcccagggattaggacatggat

SEQ ID NO: 9137753 - DNA, 22 bp, Homo sapiens
tcccagggattaggacatggat

SEQ ID NO: 9137754 - DNA, 21 bp, Homo sapiens
tcccagggtcttatgggatgt

SEQ ID NO: 9137755 - DNA, 22 bp, Homo sapiens
tcccagggtgaaatgcagtagg

SEQ ID NO: 9137756 - DNA, 21 bp, Homo sapiens
tcccagggtcttatgggatgt

SEQ ID NO: 9137757 - DNA, 22 bp, Homo sapiens
tatacactgttgttgggagtct

SEQ ID NO: 9137758 - DNA, 22 bp, Homo sapiens
tatacactgatataaggagtaa

SEQ ID NO: 9137759 - DNA, 22 bp, Homo sapiens
tatacacatttttacctatagt

SEQ ID NO: 9137760 - DNA, 22 bp, Homo sapiens
tatacacatttttacctatagt

SEQ ID NO: 9137761 - DNA, 22 bp, Homo sapiens
tatacacatttttacctatagt

SEQ ID NO: 9137762 - DNA, 22 bp, Homo sapiens
tatacacatgtgtgtattcata

SEQ ID NO: 9137763 - DNA, 23 bp, Homo sapiens
tatacacatgtggcagtatagtg

SEQ ID NO: 9137764 - DNA, 22 bp, Homo sapiens
tatacacacctccaaagcagga

SEQ ID NO: 9137765 - DNA, 22 bp, Homo sapiens
tatacacaaggtgtgcatttgt

SEQ ID NO: 9137766 - DNA, 22 bp, Homo sapiens
tatacacaaggtgtgcatttgt

SEQ ID NO: 9137767 - DNA, 22 bp, Homo sapiens
tatacaatggctgaatcatcca

SEQ ID NO: 9137768 - DNA, 22 bp, Homo sapiens
tataatttggggaaagtggtgt

SEQ ID NO: 9137769 - DNA, 22 bp, Homo sapiens
tataatttatcatgtcacagtt

SEQ ID NO: 9137770 - DNA, 22 bp, Homo sapiens
tataattttaagtggtaaatta

SEQ ID NO: 9137771 - DNA, 22 bp, Homo sapiens
tataattttaagtggtaaatta

SEQ ID NO: 9137772 - DNA, 22 bp, Homo sapiens
tataatttggggaaagtggtgt

SEQ ID NO: 9137773 - DNA, 22 bp, Homo sapiens
tatacaatgagtacattctggg

SEQ ID NO: 9137774 - DNA, 22 bp, Homo sapiens
tataatttttctgtggccagtt

SEQ ID NO: 9137775 - DNA, 22 bp, Homo sapiens
tataatttttctgtggccagtt

SEQ ID NO: 9137776 - DNA, 22 bp, Homo sapiens
tataattttagaagagatggaa

SEQ ID NO: 9137777 - DNA, 22 bp, Homo sapiens
tataattttagaagagatggaa

SEQ ID NO: 9137778 - DNA, 22 bp, Homo sapiens
taggtctcctggcctagagatt

SEQ ID NO: 9137779 - DNA, 22 bp, Homo sapiens
taggtcatgaccatacatatcc

SEQ ID NO: 9137780 - DNA, 22 bp, Homo sapiens
taggtctggcagaagaaaaatg

SEQ ID NO: 9137781 - DNA, 22 bp, Homo sapiens
taggtcatcagattgacaaggg

SEQ ID NO: 9137782 - DNA, 22 bp, Homo sapiens
taggggtggagctaagagtccc

SEQ ID NO: 9137783 - DNA, 22 bp, Homo sapiens
taggggtgggatccaggaatta

SEQ ID NO: 9137784 - DNA, 22 bp, Homo sapiens
taggggtgaggccaggcatcag

SEQ ID NO: 9137785 - DNA, 22 bp, Homo sapiens
taggtgtctgctcttatttaac

SEQ ID NO: 9137786 - DNA, 22 bp, Homo sapiens
taggtgggtgacttccatgggg

SEQ ID NO: 9137787 - DNA, 22 bp, Homo sapiens
tataaattattaggctgctaaa

SEQ ID NO: 9137788 - DNA, 21 bp, Homo sapiens
tataacacacttcagcttctc

SEQ ID NO: 9137789 - DNA, 20 bp, Homo sapiens
tataaattcagagctttggt

SEQ ID NO: 9137790 - DNA, 22 bp, Homo sapiens
tataacaggaagtattcaaaca

SEQ ID NO: 9137791 - DNA, 22 bp, Homo sapiens
tataaagtttcgaaagatgtat

SEQ ID NO: 9137792 - DNA, 22 bp, Homo sapiens
tataaagtttcgaaagatgtat

SEQ ID NO: 9137793 - DNA, 22 bp, Homo sapiens
tataaatgcacttttgaaatat

SEQ ID NO: 9137794 - DNA, 22 bp, Homo sapiens
tataaatgcacttttgaaatat

SEQ ID NO: 9137795 - DNA, 22 bp, Homo sapiens
taggtgtctaacaataagtgta

SEQ ID NO: 9137796 - DNA, 22 bp, Homo sapiens
tataaattattaggctgctaaa

SEQ ID NO: 9137797 - DNA, 22 bp, Homo sapiens
tataaattaatgtgcccatgag

SEQ ID NO: 9137798 - DNA, 22 bp, Homo sapiens
tataaatgcacttttgaaatat

SEQ ID NO: 9137799 - DNA, 22 bp, Homo sapiens
tataaatgccaggactttagat

SEQ ID NO: 9137800 - DNA, 22 bp, Homo sapiens
tataaatgccaggactttagat

SEQ ID NO: 9137801 - DNA, 22 bp, Homo sapiens
tatatcaccaaaaacagttctg

SEQ ID NO: 9137802 - DNA, 22 bp, Homo sapiens
tatatcagagttaaaagaatgt

SEQ ID NO: 9137803 - DNA, 22 bp, Homo sapiens
tatatcttatatgtgcaggtac

SEQ ID NO: 9137804 - DNA, 22 bp, Homo sapiens
tatccattaggtctatggtcaa

SEQ ID NO: 9137805 - DNA, 22 bp, Homo sapiens
tatccatggccaatcaaataca

SEQ ID NO: 9137806 - DNA, 22 bp, Homo sapiens
tatccatctttgaaactttaag

SEQ ID NO: 9137807 - DNA, 22 bp, Homo sapiens
tatccatttattttctaggcaa

SEQ ID NO: 9137808 - DNA, 22 bp, Homo sapiens
tatccaattcaccattgatggg

SEQ ID NO: 9137809 - DNA, 22 bp, Homo sapiens
tatatgactgtattatgctttt

SEQ ID NO: 9137810 - DNA, 22 bp, Homo sapiens
tatccaaagtggcatattatag

SEQ ID NO: 9137811 - DNA, 22 bp, Homo sapiens
tatccaattcaccattgatggg

SEQ ID NO: 9137812 - DNA, 22 bp, Homo sapiens
tatccaattcaccattgatggg

SEQ ID NO: 9137813 - DNA, 22 bp, Homo sapiens
tataggaacagctagcacagaa

SEQ ID NO: 9137814 - DNA, 21 bp, Homo sapiens
tataggaatcagtcacatctg

SEQ ID NO: 9137815 - DNA, 22 bp, Homo sapiens
tataggaaggcagattttagct

SEQ ID NO: 9137816 - DNA, 22 bp, Homo sapiens
tataggaagtattcaaagactg

SEQ ID NO: 9137817 - DNA, 22 bp, Homo sapiens
tataggaaaggagtggtcacaa

SEQ ID NO: 9137818 - DNA, 22 bp, Homo sapiens
tataggaacagctagcacagaa

SEQ ID NO: 9137819 - DNA, 22 bp, Homo sapiens
tatagccatttccagtggcatc

SEQ ID NO: 9137820 - DNA, 22 bp, Homo sapiens
tatagcactgcaatatttccct

SEQ ID NO: 9137821 - DNA, 21 bp, Homo sapiens
tatagtgtggatatgctgatg

SEQ ID NO: 9137822 - DNA, 22 bp, Homo sapiens
tatagttagtttcataatcatg

SEQ ID NO: 9137823 - DNA, 22 bp, Homo sapiens
tatccccacctctgttaaggac

SEQ ID NO: 9137824 - DNA, 22 bp, Homo sapiens
tatccgttgttaccagataaga

SEQ ID NO: 9137825 - DNA, 22 bp, Homo sapiens
tatccgttagaatcatgctggg

SEQ ID NO: 9137826 - DNA, 22 bp, Homo sapiens
tatcctgttttgcacaattata

SEQ ID NO: 9137827 - DNA, 22 bp, Homo sapiens
tatctaaaggatttaatttagt

SEQ ID NO: 9137828 - DNA, 22 bp, Homo sapiens
tatcctgttttacctggcacag

SEQ ID NO: 9137829 - DNA, 22 bp, Homo sapiens
tatcctgttttgcacaattata

SEQ ID NO: 9137830 - DNA, 22 bp, Homo sapiens
tatcctgtccatcctcccactg

SEQ ID NO: 9137831 - DNA, 22 bp, Homo sapiens
tatcctgtgtactgtctagtac

SEQ ID NO: 9137832 - DNA, 22 bp, Homo sapiens
tatctaaatggaatattccaga

SEQ ID NO: 9137833 - DNA, 20 bp, Homo sapiens
tatctaaatgcttacattac

SEQ ID NO: 9137834 - DNA, 19 bp, Homo sapiens
tatgacaagtactagttct

SEQ ID NO: 9137835 - DNA, 22 bp, Homo sapiens
tatctagataccaagaagcaca

SEQ ID NO: 9137836 - DNA, 22 bp, Homo sapiens
tatgactttggaaaaattactt

SEQ ID NO: 9137837 - DNA, 22 bp, Homo sapiens
tatgacttatttcatcagttct

SEQ ID NO: 9137838 - DNA, 22 bp, Homo sapiens
tatgacaatgtgggcctaaggg

SEQ ID NO: 9137839 - DNA, 22 bp, Homo sapiens
tatgacattatgtattacatgt

SEQ ID NO: 9137840 - DNA, 22 bp, Homo sapiens
tatgagaaattgctgatatttg

SEQ ID NO: 9137841 - DNA, 22 bp, Homo sapiens
tatgagaaaataaatatctgtt

SEQ ID NO: 9137842 - DNA, 22 bp, Homo sapiens
tatgacttttcccaattcagga

SEQ ID NO: 9137843 - DNA, 22 bp, Homo sapiens
tatgagaaaataaatatctgtt

SEQ ID NO: 9137844 - DNA, 22 bp, Homo sapiens
tatgagatactacagattgtga

SEQ ID NO: 9137845 - DNA, 22 bp, Homo sapiens
tatgtacacacacatgcatgta

SEQ ID NO: 9137846 - DNA, 22 bp, Homo sapiens
tatgtacacacacatgcatgta

SEQ ID NO: 9137847 - DNA, 22 bp, Homo sapiens
tatgtacaatttgttgtatgtc

SEQ ID NO: 9137848 - DNA, 22 bp, Homo sapiens
tatgtacaatcagcagttcata

SEQ ID NO: 9137849 - DNA, 22 bp, Homo sapiens
tatgtacaatcagcagttcata

SEQ ID NO: 9137850 - DNA, 22 bp, Homo sapiens
tatgtacaagcacacatgtgac

SEQ ID NO: 9137851 - DNA, 22 bp, Homo sapiens
tatgtacaagcacacatgtgac

SEQ ID NO: 9137852 - DNA, 22 bp, Homo sapiens
tatgtacataacatgaaatgca

SEQ ID NO: 9137853 - DNA, 22 bp, Homo sapiens
tatgtacatacatgtgcatacg

SEQ ID NO: 9137854 - DNA, 22 bp, Homo sapiens
tatgtcctgttcagatcagaga

SEQ ID NO: 9137855 - DNA, 22 bp, Homo sapiens
tatgtctagacccaagaatatg

SEQ ID NO: 9137856 - DNA, 22 bp, Homo sapiens
tatgtacagggatagaacttga

SEQ ID NO: 9137857 - DNA, 22 bp, Homo sapiens
tatgtacataacatgaaatgca

SEQ ID NO: 9137858 - DNA, 22 bp, Homo sapiens
tatgtacagtccttaacttaaa

SEQ ID NO: 9137859 - DNA, 22 bp, Homo sapiens
tatgtacaccggggaaggtggg

SEQ ID NO: 9137860 - DNA, 22 bp, Homo sapiens
tatgtacaccggggaaggtggg

SEQ ID NO: 9137861 - DNA, 22 bp, Homo sapiens
tatgtacacggtggctctgaag

SEQ ID NO: 9137862 - DNA, 22 bp, Homo sapiens
tatgtacagggatagaacttga

SEQ ID NO: 9137863 - DNA, 22 bp, Homo sapiens
tatgtacacttaagtttgagaa

SEQ ID NO: 9137864 - DNA, 22 bp, Homo sapiens
tatgtacaccaaggattgaaaa

SEQ ID NO: 9137865 - DNA, 22 bp, Homo sapiens
tatgtacacatacacttgtaat

SEQ ID NO: 9137866 - DNA, 22 bp, Homo sapiens
tattagaaagcttaatatcgtg

SEQ ID NO: 9137867 - DNA, 22 bp, Homo sapiens
tattagaaaggctattgcatag

SEQ ID NO: 9137868 - DNA, 22 bp, Homo sapiens
tattagaaaggctattgcatag

SEQ ID NO: 9137869 - DNA, 23 bp, Homo sapiens
tattagcaattcccacagagcag

SEQ ID NO: 9137870 - DNA, 22 bp, Homo sapiens
tattagcacaaagcaaggtatt

SEQ ID NO: 9137871 - DNA, 22 bp, Homo sapiens
tattagcagcatgagaatgggc

SEQ ID NO: 9137872 - DNA, 22 bp, Homo sapiens
tatgtgtgcatgtatacattaa

SEQ ID NO: 9137873 - DNA, 22 bp, Homo sapiens
tatgtgtgctttttccatgcat

SEQ ID NO: 9137874 - DNA, 22 bp, Homo sapiens
tattacacagtgaaagcatgga

SEQ ID NO: 9137875 - DNA, 20 bp, Homo sapiens
tattacacacaatgagcagt

SEQ ID NO: 9137876 - DNA, 22 bp, Homo sapiens
tattacagttcgagtttctagg

SEQ ID NO: 9137877 - DNA, 22 bp, Homo sapiens
tattacagctttgattatctgg

SEQ ID NO: 9137878 - DNA, 22 bp, Homo sapiens
tatgtctttttctcactatagt

SEQ ID NO: 9137879 - DNA, 22 bp, Homo sapiens
tatgtctttgtcccactcccag

SEQ ID NO: 9137880 - DNA, 22 bp, Homo sapiens
tatgtcttttgcttgcaaatag

SEQ ID NO: 9137881 - DNA, 22 bp, Homo sapiens
tatgtcttgtgtttgctaatct

SEQ ID NO: 9137882 - DNA, 22 bp, Homo sapiens
tatgtctttagtatcttttgga

SEQ ID NO: 9137883 - DNA, 22 bp, Homo sapiens
tatgtctttattctctgatgcg

SEQ ID NO: 9137884 - DNA, 22 bp, Homo sapiens
tatgtctttgtccatgtgcagt

SEQ ID NO: 9137885 - DNA, 22 bp, Homo sapiens
tatgtcttttccaatgctgtct

SEQ ID NO: 9137886 - DNA, 22 bp, Homo sapiens
tatgtcttcgtcacctatctca

SEQ ID NO: 9137887 - DNA, 22 bp, Homo sapiens
tatgtcttccctagcaggcaga

SEQ ID NO: 9137888 - DNA, 22 bp, Homo sapiens
tatgtcttagaacaaaacagtg

SEQ ID NO: 9137889 - DNA, 22 bp, Homo sapiens
tatgtcttgaaatgagaagcca

SEQ ID NO: 9137890 - DNA, 22 bp, Homo sapiens
tatgtcttgcatttttcaaact

SEQ ID NO: 9137891 - DNA, 22 bp, Homo sapiens
tatgtcttaatccttccttagg

SEQ ID NO: 9137892 - DNA, 22 bp, Homo sapiens
tatgtcttactacagcaattaa

SEQ ID NO: 9137893 - DNA, 22 bp, Homo sapiens
tatgtcttaactctagaaaggt

SEQ ID NO: 9137894 - DNA, 22 bp, Homo sapiens
tatgtgataggcattttactga

SEQ ID NO: 9137895 - DNA, 22 bp, Homo sapiens
tatgtgcaaattaattgctaga

SEQ ID NO: 9137896 - DNA, 22 bp, Homo sapiens
tatgtgcaaattaattgctaga

SEQ ID NO: 9137897 - DNA, 20 bp, Homo sapiens
tatgtgattttctcatcaat

SEQ ID NO: 9137898 - DNA, 22 bp, Homo sapiens
tatgtgcacatacaagtgtgct

SEQ ID NO: 9137899 - DNA, 22 bp, Homo sapiens
tatgtgcacattagagagatgg

SEQ ID NO: 9137900 - DNA, 22 bp, Homo sapiens
tatgtgcactttgggtctggga

SEQ ID NO: 9137901 - DNA, 22 bp, Homo sapiens
tatgtgcagcacttgccattac

SEQ ID NO: 9137902 - DNA, 22 bp, Homo sapiens
tatgtgcaggggcaggagctca

SEQ ID NO: 9137903 - DNA, 20 bp, Homo sapiens
tatgtgcagtttggtttatc

SEQ ID NO: 9137904 - DNA, 16 bp, Homo sapiens
tatgtgtctcatctac

SEQ ID NO: 9137905 - DNA, 22 bp, Homo sapiens
tatgtgtcctaagcaatcatcc

SEQ ID NO: 9137906 - DNA, 22 bp, Homo sapiens
tatgtgtctcagttgtgattga

SEQ ID NO: 9137907 - DNA, 22 bp, Homo sapiens
tatttattggacagtgttgctg

SEQ ID NO: 9137908 - DNA, 22 bp, Homo sapiens
tatttattggacagtgttgctg

SEQ ID NO: 9137909 - DNA, 22 bp, Homo sapiens
tatttattggacagtgttgctg

SEQ ID NO: 9137910 - DNA, 22 bp, Homo sapiens
tatttattggacagtgttgctg

SEQ ID NO: 9137911 - DNA, 22 bp, Homo sapiens
tatttattggacagtgttgctg

SEQ ID NO: 9137912 - DNA, 22 bp, Homo sapiens
tatttattctttgtactgcctt

SEQ ID NO: 9137913 - DNA, 22 bp, Homo sapiens
tatttattcattcagcaagcat

SEQ ID NO: 9137914 - DNA, 22 bp, Homo sapiens
tatttattcattcagcaagcat

SEQ ID NO: 9137915 - DNA, 22 bp, Homo sapiens
tatttattcattcagcaagcat

SEQ ID NO: 9137916 - DNA, 22 bp, Homo sapiens
tatttattggacagtgttgctg

SEQ ID NO: 9137917 - DNA, 19 bp, Homo sapiens
tatttcaaagtgccgtcta

SEQ ID NO: 9137918 - DNA, 22 bp, Homo sapiens
tatttctgaatccaaaaggtca

SEQ ID NO: 9137919 - DNA, 22 bp, Homo sapiens
tatttctgagaaccaacttacc

SEQ ID NO: 9137920 - DNA, 22 bp, Homo sapiens
tatttctcagcattttacatcc

SEQ ID NO: 9137921 - DNA, 22 bp, Homo sapiens
tatttctccctataccctccaa

SEQ ID NO: 9137922 - DNA, 22 bp, Homo sapiens
tattgacagatgcattatgttg

SEQ ID NO: 9137923 - DNA, 22 bp, Homo sapiens
tattgacagacttgaaagtgtt

SEQ ID NO: 9137924 - DNA, 22 bp, Homo sapiens
tattgacactttttgtgtagcc

SEQ ID NO: 9137925 - DNA, 22 bp, Homo sapiens
tatttataatctgccaaagaga

SEQ ID NO: 9137926 - DNA, 22 bp, Homo sapiens
tatttaatttgctcattgtgat

SEQ ID NO: 9137927 - DNA, 22 bp, Homo sapiens
tatttataatctgccaaagaga

SEQ ID NO: 9137928 - DNA, 22 bp, Homo sapiens
tatttataatctgccaaagaga

SEQ ID NO: 9137929 - DNA, 22 bp, Homo sapiens
tatttataatctgccaaagaga

SEQ ID NO: 9137930 - DNA, 22 bp, Homo sapiens
tatttatattctgccttctgct

SEQ ID NO: 9137931 - DNA, 22 bp, Homo sapiens
tatttataccaggtgatcggag

SEQ ID NO: 9137932 - DNA, 22 bp, Homo sapiens
tatttataccaggtgatcggag

SEQ ID NO: 9137933 - DNA, 22 bp, Homo sapiens
tatttatattctgccttctgct

SEQ ID NO: 9137934 - DNA, 22 bp, Homo sapiens
tatttatattctgccttctgct

SEQ ID NO: 9137935 - DNA, 22 bp, Homo sapiens
tatttatcgagtgtctactatg

SEQ ID NO: 9137936 - DNA, 21 bp, Homo sapiens
tatttattaatttgtaaggct

SEQ ID NO: 9137937 - DNA, 21 bp, Homo sapiens
tatttattaatttgtaaggct

SEQ ID NO: 9137938 - DNA, 21 bp, Homo sapiens
tatttattaatttgtaaggct

SEQ ID NO: 9137939 - DNA, 22 bp, Homo sapiens
tatttatgtggaccataagcct

SEQ ID NO: 9137940 - DNA, 22 bp, Homo sapiens
tattcatgggggtccaggtacc

SEQ ID NO: 9137941 - DNA, 22 bp, Homo sapiens
tattccaaaatcccaaactgcc

SEQ ID NO: 9137942 - DNA, 22 bp, Homo sapiens
tattcaaagtaccttcattgcc

SEQ ID NO: 9137943 - DNA, 19 bp, Homo sapiens
tattatttgtagcaaggcc

SEQ ID NO: 9137944 - DNA, 22 bp, Homo sapiens
tattattgactattcagaatgt

SEQ ID NO: 9137945 - DNA, 22 bp, Homo sapiens
tattattgactattcagaatgt

SEQ ID NO: 9137946 - DNA, 22 bp, Homo sapiens
tattattatgcatagcatgaaa

SEQ ID NO: 9137947 - DNA, 22 bp, Homo sapiens
tattattatctttgaatgggac

SEQ ID NO: 9137948 - DNA, 22 bp, Homo sapiens
tattattatattggatgagact

SEQ ID NO: 9137949 - DNA, 22 bp, Homo sapiens
tattattatattggatgagact

SEQ ID NO: 9137950 - DNA, 20 bp, Homo sapiens
tattaggaaggaggaaggaa

SEQ ID NO: 9137951 - DNA, 22 bp, Homo sapiens
tattctgcatgaaaataaacag

SEQ ID NO: 9137952 - DNA, 22 bp, Homo sapiens
tattctcagcaacacacatgga

SEQ ID NO: 9137953 - DNA, 22 bp, Homo sapiens
tattcttgtaccttaaatgatt

SEQ ID NO: 9137954 - DNA, 22 bp, Homo sapiens
tattgaaatccattacgttctt

SEQ ID NO: 9137955 - DNA, 22 bp, Homo sapiens
tattgaaatccattacgttctt

SEQ ID NO: 9137956 - DNA, 22 bp, Homo sapiens
tattcttgtcttttccagaaat

SEQ ID NO: 9137957 - DNA, 22 bp, Homo sapiens
tattcttgtatactacaatctt

SEQ ID NO: 9137958 - DNA, 22 bp, Homo sapiens
tattgacaataggcaactgagg

SEQ ID NO: 9137959 - DNA, 22 bp, Homo sapiens
tattgacaatttgtgaaactat

SEQ ID NO: 9137960 - DNA, 22 bp, Homo sapiens
tattgaagagataagtgacaga

SEQ ID NO: 9137961 - DNA, 22 bp, Homo sapiens
tattgaagagataagtgacaga

SEQ ID NO: 9137962 - DNA, 22 bp, Homo sapiens
tattgaaattcttcatgtcctc

SEQ ID NO: 9137963 - DNA, 22 bp, Homo sapiens
tattgaaatgaatgacagtgat

SEQ ID NO: 9137964 - DNA, 22 bp, Homo sapiens
tattgaaatgaatgacagtgat

SEQ ID NO: 9137965 - DNA, 22 bp, Homo sapiens
tattgaaattcttcatgtcctc

SEQ ID NO: 9137966 - DNA, 22 bp, Homo sapiens
tacttttcaagcagctggttat

SEQ ID NO: 9137967 - DNA, 22 bp, Homo sapiens
tacttttcataatgaagcagca

SEQ ID NO: 9137968 - DNA, 22 bp, Homo sapiens
tacttttcacccagcccgcttc

SEQ ID NO: 9137969 - DNA, 22 bp, Homo sapiens
tacttttcctggaaccactgct

SEQ ID NO: 9137970 - DNA, 22 bp, Homo sapiens
tacttttctataggtttgaaat

SEQ ID NO: 9137971 - DNA, 22 bp, Homo sapiens
tacttttccagggctggctgag

SEQ ID NO: 9137972 - DNA, 22 bp, Homo sapiens
tactttttatgataagaactga

SEQ ID NO: 9137973 - DNA, 22 bp, Homo sapiens
tacttttctgtgtggcagtcac

SEQ ID NO: 9137974 - DNA, 22 bp, Homo sapiens
tacttttctttgtcatgcatct

SEQ ID NO: 9137975 - DNA, 22 bp, Homo sapiens
tagaaaagataacattctgtgc

SEQ ID NO: 9137976 - DNA, 22 bp, Homo sapiens
tagaaaagataacattctgtgc

SEQ ID NO: 9137977 - DNA, 22 bp, Homo sapiens
tagaaaactaatacatgcttga

SEQ ID NO: 9137978 - DNA, 22 bp, Homo sapiens
tactttttgtctctttgaatgt

SEQ ID NO: 9137979 - DNA, 22 bp, Homo sapiens
tactttgcagcttgataaaatg

SEQ ID NO: 9137980 - DNA, 22 bp, Homo sapiens
tactttgcggcgcggaggagca

SEQ ID NO: 9137981 - DNA, 22 bp, Homo sapiens
tactttggatccttacaatagc

SEQ ID NO: 9137982 - DNA, 22 bp, Homo sapiens
tactttgcagcttgataaaatg

SEQ ID NO: 9137983 - DNA, 22 bp, Homo sapiens
tactttgcagcttgataaaatg

SEQ ID NO: 9137984 - DNA, 22 bp, Homo sapiens
tacttttagcctatttgattct

SEQ ID NO: 9137985 - DNA, 22 bp, Homo sapiens
tactttgtcatgctaagagtga

SEQ ID NO: 9137986 - DNA, 22 bp, Homo sapiens
tactttggttgaatatgtaatg

SEQ ID NO: 9137987 - DNA, 22 bp, Homo sapiens
tactttgagtaatggtagagat

SEQ ID NO: 9137988 - DNA, 22 bp, Homo sapiens
tactttgaattaaatatttcag

SEQ ID NO: 9137989 - DNA, 22 bp, Homo sapiens
taccaaagatacataaatgtga

SEQ ID NO: 9137990 - DNA, 22 bp, Homo sapiens
taccaaagaatattttaaatag

SEQ ID NO: 9137991 - DNA, 22 bp, Homo sapiens
taccaaaagcttgtttcataca

SEQ ID NO: 9137992 - DNA, 22 bp, Homo sapiens
taccaaaagcttgtttcataca

SEQ ID NO: 9137993 - DNA, 22 bp, Homo sapiens
taccaaaaccaagccattatct

SEQ ID NO: 9137994 - DNA, 22 bp, Homo sapiens
taccaaaaccaagccattatct

SEQ ID NO: 9137995 - DNA, 22 bp, Homo sapiens
tacattttctaggggaccaaga

SEQ ID NO: 9137996 - DNA, 22 bp, Homo sapiens
tagaaacagatgtttttgaaga

SEQ ID NO: 9137997 - DNA, 22 bp, Homo sapiens
tagaaacagatgtttttgaaga

SEQ ID NO: 9137998 - DNA, 22 bp, Homo sapiens
tagaaacagcatatattagccc

SEQ ID NO: 9137999 - DNA, 22 bp, Homo sapiens
tagaaacaatgacatgcttgta

SEQ ID NO: 9138000 - DNA, 22 bp, Homo sapiens
tagaaacaatgacatgcttgta

SEQ ID NO: 9138001 - DNA, 22 bp, Homo sapiens
tagaaactcacgttatcattgc

SEQ ID NO: 9138002 - DNA, 22 bp, Homo sapiens
tagaaactctcacgagtgaaac

SEQ ID NO: 9138003 - DNA, 22 bp, Homo sapiens
tagaaactactagaataagaga

SEQ ID NO: 9138004 - DNA, 22 bp, Homo sapiens
tagaaacattcagttgcagtcc

SEQ ID NO: 9138005 - DNA, 22 bp, Homo sapiens
tagaaacatatgtttgagacat

SEQ ID NO: 9138006 - DNA, 22 bp, Homo sapiens
tagaaacatatgtttgagacat

SEQ ID NO: 9138007 - DNA, 22 bp, Homo sapiens
tagaaacatcagctaaccaaaa

SEQ ID NO: 9138008 - DNA, 22 bp, Homo sapiens
tagaaacatgttctgttctgtt

SEQ ID NO: 9138009 - DNA, 22 bp, Homo sapiens
tagaaacatgagagaaactctt

SEQ ID NO: 9138010 - DNA, 22 bp, Homo sapiens
tagaattttctgctttgatagt

SEQ ID NO: 9138011 - DNA, 22 bp, Homo sapiens
tagacaaaagggggcagatatg

SEQ ID NO: 9138012 - DNA, 23 bp, Homo sapiens
tagaatgtcattcaatgatatgg

SEQ ID NO: 9138013 - DNA, 22 bp, Homo sapiens
tagaatgtgcctggaatacagt

SEQ ID NO: 9138014 - DNA, 22 bp, Homo sapiens
tagaatgtggaggtaacagact

SEQ ID NO: 9138015 - DNA, 23 bp, Homo sapiens
tagaattcaatctgttccacatc

SEQ ID NO: 9138016 - DNA, 22 bp, Homo sapiens
tagaattgagtttcactgttcc

SEQ ID NO: 9138017 - DNA, 22 bp, Homo sapiens
tagaatgttaagaatatgtata

SEQ ID NO: 9138018 - DNA, 22 bp, Homo sapiens
tagaatgttcacctttaaatga

SEQ ID NO: 9138019 - DNA, 20 bp, Homo sapiens
tagaatctgttctgattcat

SEQ ID NO: 9138020 - DNA, 22 bp, Homo sapiens
tagaatctttaaaattcatagt

SEQ ID NO: 9138021 - DNA, 22 bp, Homo sapiens
tagaatgtagtgcttcaagatt

SEQ ID NO: 9138022 - DNA, 22 bp, Homo sapiens
tagaatgtagtgcttcaagatt

SEQ ID NO: 9138023 - DNA, 22 bp, Homo sapiens
tagaatgtaaattccaagggca

SEQ ID NO: 9138024 - DNA, 22 bp, Homo sapiens
tagaatgtaaattccaagggca

SEQ ID NO: 9138025 - DNA, 22 bp, Homo sapiens
tagacacatcttcatccacaat

SEQ ID NO: 9138026 - DNA, 22 bp, Homo sapiens
tagacagatgttttctggctgt

SEQ ID NO: 9138027 - DNA, 22 bp, Homo sapiens
tagaggcagaagaaattgacaa

SEQ ID NO: 9138028 - DNA, 22 bp, Homo sapiens
tagaggcagaagaaattgacaa

SEQ ID NO: 9138029 - DNA, 21 bp, Homo sapiens
tagaggcaggagggactgcag

SEQ ID NO: 9138030 - DNA, 22 bp, Homo sapiens
tagacagagtgaagacaagtgg

SEQ ID NO: 9138031 - DNA, 22 bp, Homo sapiens
tagaggctcctgtgtgtaggtt

SEQ ID NO: 9138032 - DNA, 22 bp, Homo sapiens
tagaggctcctgtgtgtaggtt

SEQ ID NO: 9138033 - DNA, 22 bp, Homo sapiens
tagaggctactagaggcacctg

SEQ ID NO: 9138034 - DNA, 22 bp, Homo sapiens
tagaggcattaatgaataaaca

SEQ ID NO: 9138035 - DNA, 22 bp, Homo sapiens
tagaggcattaatgaataaaca

SEQ ID NO: 9138036 - DNA, 22 bp, Homo sapiens
tagaggcattgcttaatttcag

SEQ ID NO: 9138037 - DNA, 22 bp, Homo sapiens
tagaggcataagagggaagcag

SEQ ID NO: 9138038 - DNA, 22 bp, Homo sapiens
tagagggccagctggacagcga

SEQ ID NO: 9138039 - DNA, 22 bp, Homo sapiens
tagaggctcttcattgcagtag

SEQ ID NO: 9138040 - DNA, 22 bp, Homo sapiens
tagaggctcttcattgcagtag

SEQ ID NO: 9138041 - DNA, 22 bp, Homo sapiens
tagaggctcttcattgcagtag

SEQ ID NO: 9138042 - DNA, 22 bp, Homo sapiens
tagaggctgggaattattttca

SEQ ID NO: 9138043 - DNA, 22 bp, Homo sapiens
tagaggctgggaattattttca

SEQ ID NO: 9138044 - DNA, 22 bp, Homo sapiens
tagaggcttctactgctcactt

SEQ ID NO: 9138045 - DNA, 22 bp, Homo sapiens
tagaggcttctactgctcactt

SEQ ID NO: 9138046 - DNA, 22 bp, Homo sapiens
tagaggctttcagcggtaggtc

SEQ ID NO: 9138047 - DNA, 22 bp, Homo sapiens
tagaggctttcagcggtaggtc

SEQ ID NO: 9138048 - DNA, 22 bp, Homo sapiens
tagaaatgagccatggtagagc

SEQ ID NO: 9138049 - DNA, 22 bp, Homo sapiens
tagaaatgattggttgagctct

SEQ ID NO: 9138050 - DNA, 22 bp, Homo sapiens
tagaaatgaatgtttaaaagtc

SEQ ID NO: 9138051 - DNA, 22 bp, Homo sapiens
tagaaatgaatgtttaaaagtc

SEQ ID NO: 9138052 - DNA, 22 bp, Homo sapiens
tagaaatgaatgtttaaaagtc

SEQ ID NO: 9138053 - DNA, 22 bp, Homo sapiens
tagaaatgcagtgtactgtgtc

SEQ ID NO: 9138054 - DNA, 22 bp, Homo sapiens
tagaaatgattttgatgcttca

SEQ ID NO: 9138055 - DNA, 22 bp, Homo sapiens
tagaaatgattttgatgcttca

SEQ ID NO: 9138056 - DNA, 22 bp, Homo sapiens
tagaaatgattttgatgcttca

SEQ ID NO: 9138057 - DNA, 22 bp, Homo sapiens
tagaaagtgaaggttaattaat

SEQ ID NO: 9138058 - DNA, 22 bp, Homo sapiens
tagaaataaatctgcagctggg

SEQ ID NO: 9138059 - DNA, 22 bp, Homo sapiens
tagaaataaatctgcagctggg

SEQ ID NO: 9138060 - DNA, 22 bp, Homo sapiens
tagaaatcacagaaaatcaggg

SEQ ID NO: 9138061 - DNA, 22 bp, Homo sapiens
tagaaatcaggtttttagaaag

SEQ ID NO: 9138062 - DNA, 22 bp, Homo sapiens
tagaaaggagcattttagacta

SEQ ID NO: 9138063 - DNA, 22 bp, Homo sapiens
tagaaaggatattgagatgaat

SEQ ID NO: 9138064 - DNA, 22 bp, Homo sapiens
tagaaagcttggggtgtttaaa

SEQ ID NO: 9138065 - DNA, 22 bp, Homo sapiens
tagaaagaaattcagattggct

SEQ ID NO: 9138066 - DNA, 22 bp, Homo sapiens
tagaaagaaattcagattggct

SEQ ID NO: 9138067 - DNA, 22 bp, Homo sapiens
tagaaaggcaatcattcttgga

SEQ ID NO: 9138068 - DNA, 22 bp, Homo sapiens
tagaaaggctgctgccaaccca

SEQ ID NO: 9138069 - DNA, 22 bp, Homo sapiens
tagaaagtaaatcagttttatt

SEQ ID NO: 9138070 - DNA, 22 bp, Homo sapiens
tagaaagtactaaatttaactg

SEQ ID NO: 9138071 - DNA, 22 bp, Homo sapiens
tagaaagtactaaatttaactg

SEQ ID NO: 9138072 - DNA, 22 bp, Homo sapiens
tagaaagtcatgaattacacca

SEQ ID NO: 9138073 - DNA, 22 bp, Homo sapiens
tagaaagtgaaggttaattaat

SEQ ID NO: 9138074 - DNA, 22 bp, Homo sapiens
tagaaagtagccacttacagag

SEQ ID NO: 9138075 - DNA, 22 bp, Homo sapiens
tagaaagtagccacttacagag

SEQ ID NO: 9138076 - DNA, 22 bp, Homo sapiens
tagcccctgcctttgaacctgg

SEQ ID NO: 9138077 - DNA, 22 bp, Homo sapiens
tagcccctgcctttgaacctgg

SEQ ID NO: 9138078 - DNA, 17 bp, Homo sapiens
tagcccatggctgccag

SEQ ID NO: 9138079 - DNA, 22 bp, Homo sapiens
tagcccatggactggtcagctg

SEQ ID NO: 9138080 - DNA, 22 bp, Homo sapiens
tagcccatgcagctctgtcatt

SEQ ID NO: 9138081 - DNA, 22 bp, Homo sapiens
tagcccatttgttggaagcatg

SEQ ID NO: 9138082 - DNA, 23 bp, Homo sapiens
tagcccattgtgcttgtggtttt

SEQ ID NO: 9138083 - DNA, 22 bp, Homo sapiens
tagcccattacctttggattgg

SEQ ID NO: 9138084 - DNA, 22 bp, Homo sapiens
tagcccatgtgcgtgttggggg

SEQ ID NO: 9138085 - DNA, 22 bp, Homo sapiens
tagccctcagcttggagcgtgg

SEQ ID NO: 9138086 - DNA, 22 bp, Homo sapiens
tagccctctccagcgaggtctg

SEQ ID NO: 9138087 - DNA, 22 bp, Homo sapiens
tagcccttttctgagcccacat

SEQ ID NO: 9138088 - DNA, 22 bp, Homo sapiens
tagccctgtccttggcctgtgc

SEQ ID NO: 9138089 - DNA, 21 bp, Homo sapiens
tagcccttctccacctcgccc

SEQ ID NO: 9138090 - DNA, 22 bp, Homo sapiens
tagcagctcactaactctgcgt

SEQ ID NO: 9138091 - DNA, 22 bp, Homo sapiens
tagcagctcacagcctcccatt

SEQ ID NO: 9138092 - DNA, 22 bp, Homo sapiens
tagcagctatgccattttgaca

SEQ ID NO: 9138093 - DNA, 22 bp, Homo sapiens
tagcagctccatttctctggca

SEQ ID NO: 9138094 - DNA, 22 bp, Homo sapiens
tagcccagcatgagcagagctg

SEQ ID NO: 9138095 - DNA, 22 bp, Homo sapiens
tagcccagcatgagcagagctg

SEQ ID NO: 9138096 - DNA, 22 bp, Homo sapiens
tagcccaggctggagggcagtg

SEQ ID NO: 9138097 - DNA, 22 bp, Homo sapiens
tagcccagcttggcctatttct

SEQ ID NO: 9138098 - DNA, 22 bp, Homo sapiens
tagcccagctcaaatgaccggt

SEQ ID NO: 9138099 - DNA, 22 bp, Homo sapiens
tagcccaggctgtagtgcagtg

SEQ ID NO: 9138100 - DNA, 22 bp, Homo sapiens
tagcccatgatggtggaaggca

SEQ ID NO: 9138101 - DNA, 22 bp, Homo sapiens
tagcccatatggtgcctttgtg

SEQ ID NO: 9138102 - DNA, 22 bp, Homo sapiens
tagcccatatgaaatgatttgg

SEQ ID NO: 9138103 - DNA, 22 bp, Homo sapiens
tagcccaggctggagtgcaggg

SEQ ID NO: 9138104 - DNA, 22 bp, Homo sapiens
tagctcttcatttcatctgatt

SEQ ID NO: 9138105 - DNA, 22 bp, Homo sapiens
tagctgaagggcatttaataaa

SEQ ID NO: 9138106 - DNA, 22 bp, Homo sapiens
tagctcttcaatcactgtctcc

SEQ ID NO: 9138107 - DNA, 22 bp, Homo sapiens
tagctctgtgctctggatctgt

SEQ ID NO: 9138108 - DNA, 22 bp, Homo sapiens
tagctctgtggatctttttaag

SEQ ID NO: 9138109 - DNA, 19 bp, Homo sapiens
tagctctgtcttattccaa

SEQ ID NO: 9138110 - DNA, 22 bp, Homo sapiens
tagctctgccaaatggaggctg

SEQ ID NO: 9138111 - DNA, 22 bp, Homo sapiens
tagctctggcattctttccaaa

SEQ ID NO: 9138112 - DNA, 22 bp, Homo sapiens
tagctctggcattctttccaaa

SEQ ID NO: 9138113 - DNA, 22 bp, Homo sapiens
tagctctggagtcttctcagaa

SEQ ID NO: 9138114 - DNA, 22 bp, Homo sapiens
tagctctgaccaagagactgag

SEQ ID NO: 9138115 - DNA, 22 bp, Homo sapiens
tagctcctggtgagcctactct

SEQ ID NO: 9138116 - DNA, 22 bp, Homo sapiens
tagcagaaccagtcagtgagcc

SEQ ID NO: 9138117 - DNA, 22 bp, Homo sapiens
tagcagaagaaattcagagttg

SEQ ID NO: 9138118 - DNA, 22 bp, Homo sapiens
tagcagaagtcaccccgccact

SEQ ID NO: 9138119 - DNA, 22 bp, Homo sapiens
tagcagagaggggacagtggca

SEQ ID NO: 9138120 - DNA, 22 bp, Homo sapiens
tagcagagaggtttcagctaat

SEQ ID NO: 9138121 - DNA, 21 bp, Homo sapiens
tagcagagagttaacttctcc

SEQ ID NO: 9138122 - DNA, 20 bp, Homo sapiens
tagaggggacaatcattgcc

SEQ ID NO: 9138123 - DNA, 22 bp, Homo sapiens
tagcagagcagggatcagagcc

SEQ ID NO: 9138124 - DNA, 19 bp, Homo sapiens
tagcagagatgactccagc

SEQ ID NO: 9138125 - DNA, 22 bp, Homo sapiens
tagcagagcacatcttcattct

SEQ ID NO: 9138126 - DNA, 21 bp, Homo sapiens
tagcagagatcattttctcct

SEQ ID NO: 9138127 - DNA, 22 bp, Homo sapiens
tagcagagctgcaatatagacc

SEQ ID NO: 9138128 - DNA, 22 bp, Homo sapiens
tagcagaggctactgctccttg

SEQ ID NO: 9138129 - DNA, 22 bp, Homo sapiens
tagcagaggctgtctgacttaa

SEQ ID NO: 9138130 - DNA, 22 bp, Homo sapiens
tagcagaggctgtctgacttaa

SEQ ID NO: 9138131 - DNA, 22 bp, Homo sapiens
tagcagaggcaaggatgtgaat

SEQ ID NO: 9138132 - DNA, 22 bp, Homo sapiens
tagcagaggcaaggatgtgaat

SEQ ID NO: 9138133 - DNA, 22 bp, Homo sapiens
tagcagcaggggaaacagctgt

SEQ ID NO: 9138134 - DNA, 17 bp, Homo sapiens
tagcagcagtaattgtg

SEQ ID NO: 9138135 - DNA, 22 bp, Homo sapiens
tagcagagggtagtgccggggc

SEQ ID NO: 9138136 - DNA, 22 bp, Homo sapiens
tagcagaggtaagtgtggcaat

SEQ ID NO: 9138137 - DNA, 22 bp, Homo sapiens
tagcagagtaatactttggagc

SEQ ID NO: 9138138 - DNA, 22 bp, Homo sapiens
tagcagagtaatactttggagc

SEQ ID NO: 9138139 - DNA, 22 bp, Homo sapiens
tagcagcatcctgtggtgatgg

SEQ ID NO: 9138140 - DNA, 22 bp, Homo sapiens
tagcagctacctggctaagagt

SEQ ID NO: 9138141 - DNA, 23 bp, Homo sapiens
tagcagcatttttagcctctgtc

SEQ ID NO: 9138142 - DNA, 22 bp, Homo sapiens
tagcagcatttttgtagagtat

SEQ ID NO: 9138143 - DNA, 22 bp, Homo sapiens
taggattttttggattctggat

SEQ ID NO: 9138144 - DNA, 22 bp, Homo sapiens
taggatttggctttagtcaggt

SEQ ID NO: 9138145 - DNA, 22 bp, Homo sapiens
taggatttggctttagtcaggt

SEQ ID NO: 9138146 - DNA, 22 bp, Homo sapiens
taggcaagtggaccagaggttt

SEQ ID NO: 9138147 - DNA, 22 bp, Homo sapiens
taggcacaaaatgaaaatggca

SEQ ID NO: 9138148 - DNA, 22 bp, Homo sapiens
taggcacaagaccatgcaaagg

SEQ ID NO: 9138149 - DNA, 22 bp, Homo sapiens
taggcacaagaccatgcaaagg

SEQ ID NO: 9138150 - DNA, 22 bp, Homo sapiens
tagggacactgctcatgagttc

SEQ ID NO: 9138151 - DNA, 20 bp, Homo sapiens
tagggagatatgctcttttc

SEQ ID NO: 9138152 - DNA, 22 bp, Homo sapiens
taggctgggagcctgaggctag

SEQ ID NO: 9138153 - DNA, 22 bp, Homo sapiens
tagggaggctacttcttgtagg

SEQ ID NO: 9138154 - DNA, 22 bp, Homo sapiens
tagggaggctacttcttgtagg

SEQ ID NO: 9138155 - DNA, 22 bp, Homo sapiens
tagggaggagggttttcaaatc

SEQ ID NO: 9138156 - DNA, 22 bp, Homo sapiens
tagggatgacgaaaggacagag

SEQ ID NO: 9138157 - DNA, 22 bp, Homo sapiens
tagggatgaagatggtatttct

SEQ ID NO: 9138158 - DNA, 22 bp, Homo sapiens
tagggatgaagttgctatttac

SEQ ID NO: 9138159 - DNA, 22 bp, Homo sapiens
tagggatgaagatggtatttct

SEQ ID NO: 9138160 - DNA, 22 bp, Homo sapiens
tagggatgactatgattcccac

SEQ ID NO: 9138161 - DNA, 22 bp, Homo sapiens
tagggatgagcaactggtagtg

SEQ ID NO: 9138162 - DNA, 22 bp, Homo sapiens
tagggatgaggatagatttttc

SEQ ID NO: 9138163 - DNA, 22 bp, Homo sapiens
tagggatgagccagtgggtagt

SEQ ID NO: 9138164 - DNA, 22 bp, Homo sapiens
tagggcacagcttagataaatg

SEQ ID NO: 9138165 - DNA, 22 bp, Homo sapiens
tagggcagagcttgtacacgat

SEQ ID NO: 9138166 - DNA, 22 bp, Homo sapiens
tagggcagagcttgtacacgat

SEQ ID NO: 9138167 - DNA, 22 bp, Homo sapiens
tagggatgtaaacatagtaatt

SEQ ID NO: 9138168 - DNA, 22 bp, Homo sapiens
tagggatgtaaacatagtaatt

SEQ ID NO: 9138169 - DNA, 22 bp, Homo sapiens
tagggatgtcctgagacttggc

SEQ ID NO: 9138170 - DNA, 22 bp, Homo sapiens
tagggatgtggtgagaactgag

SEQ ID NO: 9138171 - DNA, 22 bp, Homo sapiens
tagggatggcagcatgtagctt

SEQ ID NO: 9138172 - DNA, 22 bp, Homo sapiens
tagggatggcagcatgtagctt

SEQ ID NO: 9138173 - DNA, 22 bp, Homo sapiens
tagggatgggagattctcaaac

SEQ ID NO: 9138174 - DNA, 22 bp, Homo sapiens
tagggatggaaactaggaatct

SEQ ID NO: 9138175 - DNA, 22 bp, Homo sapiens
tagggatggaaactaggaatct

SEQ ID NO: 9138176 - DNA, 22 bp, Homo sapiens
tagggatggatgatgcctggca

SEQ ID NO: 9138177 - DNA, 22 bp, Homo sapiens
tagggatgatggagcctatgta

SEQ ID NO: 9138178 - DNA, 22 bp, Homo sapiens
tagggatgatgtctaaaatcat

SEQ ID NO: 9138179 - DNA, 20 bp, Homo sapiens
tagggatgccagtacttctc

SEQ ID NO: 9138180 - DNA, 22 bp, Homo sapiens
tagggatgcttagtaggaccca

SEQ ID NO: 9138181 - DNA, 22 bp, Homo sapiens
tagggatggaaacccgttttct

SEQ ID NO: 9138182 - DNA, 22 bp, Homo sapiens
taggagtctcaaaaagactcag

SEQ ID NO: 9138183 - DNA, 22 bp, Homo sapiens
taggatatgcatttttatacat

SEQ ID NO: 9138184 - DNA, 22 bp, Homo sapiens
taggatatgtgaaatcatatta

SEQ ID NO: 9138185 - DNA, 22 bp, Homo sapiens
taggatctatttgtatttcagg

SEQ ID NO: 9138186 - DNA, 22 bp, Homo sapiens
taggaaactaatacagtctgga

SEQ ID NO: 9138187 - DNA, 22 bp, Homo sapiens
taggacaggtgaggggctgtgg

SEQ ID NO: 9138188 - DNA, 22 bp, Homo sapiens
taggaaacatttgaagaggatt

SEQ ID NO: 9138189 - DNA, 22 bp, Homo sapiens
taggaaaccaatcttttgggag

SEQ ID NO: 9138190 - DNA, 22 bp, Homo sapiens
taggaaacaaagtggatgaaat

SEQ ID NO: 9138191 - DNA, 22 bp, Homo sapiens
taggaaacaaagtaatgcaact

SEQ ID NO: 9138192 - DNA, 22 bp, Homo sapiens
taggaaacaaagcttagcagga

SEQ ID NO: 9138193 - DNA, 22 bp, Homo sapiens
taggaaaatatctcttattggg

SEQ ID NO: 9138194 - DNA, 22 bp, Homo sapiens
taggaaaatatctcttattggg

SEQ ID NO: 9138195 - DNA, 22 bp, Homo sapiens
taggacagtggagataaccaga

SEQ ID NO: 9138196 - DNA, 22 bp, Homo sapiens
taggacagttatgggttttatt

SEQ ID NO: 9138197 - DNA, 22 bp, Homo sapiens
taggacagtagctggtgcacag

SEQ ID NO: 9138198 - DNA, 22 bp, Homo sapiens
taggacagtagctggtgcacag

SEQ ID NO: 9138199 - DNA, 22 bp, Homo sapiens
taggacagtttactttggttac

SEQ ID NO: 9138200 - DNA, 22 bp, Homo sapiens
taggaaaagcacaggatgttct

SEQ ID NO: 9138201 - DNA, 22 bp, Homo sapiens
taggaaaagcacaggatgttct

SEQ ID NO: 9138202 - DNA, 22 bp, Homo sapiens
taggaaaagtctagattgatga

SEQ ID NO: 9138203 - DNA, 22 bp, Homo sapiens
taggaaaagtctagattgatga

SEQ ID NO: 9138204 - DNA, 22 bp, Homo sapiens
taggaaaaatacagaattatat

SEQ ID NO: 9138205 - DNA, 22 bp, Homo sapiens
taggaaaaatacagaattatat

SEQ ID NO: 9138206 - DNA, 22 bp, Homo sapiens
taggaaaaatacagaattatat

SEQ ID NO: 9138207 - DNA, 22 bp, Homo sapiens
taggaaaacgtgattttctcac

SEQ ID NO: 9138208 - DNA, 22 bp, Homo sapiens
taggaaaaagaggctggcaagg

SEQ ID NO: 9138209 - DNA, 22 bp, Homo sapiens
tagctttgttagaatgtcttca

SEQ ID NO: 9138210 - DNA, 22 bp, Homo sapiens
tagctttgcctgaagtaatcag

SEQ ID NO: 9138211 - DNA, 22 bp, Homo sapiens
tagctttgcctgttaatcacaa

SEQ ID NO: 9138212 - DNA, 22 bp, Homo sapiens
tacattctggtggagaaagtaa

SEQ ID NO: 9138213 - DNA, 22 bp, Homo sapiens
tacattgaaagtcatttaatcc

SEQ ID NO: 9138214 - DNA, 22 bp, Homo sapiens
tacattgaaatcaatggatgtg

SEQ ID NO: 9138215 - DNA, 22 bp, Homo sapiens
tacattctatatctgttacatc

SEQ ID NO: 9138216 - DNA, 21 bp, Homo sapiens
tacattgaagaatgggaatga

SEQ ID NO: 9138217 - DNA, 22 bp, Homo sapiens
tacattgaattttttagcatgt

SEQ ID NO: 9138218 - DNA, 22 bp, Homo sapiens
tacatttgcctccaccaaaggt

SEQ ID NO: 9138219 - DNA, 22 bp, Homo sapiens
tacattgagcacgtactatgtg

SEQ ID NO: 9138220 - DNA, 22 bp, Homo sapiens
tacattgagtattatttagcca

SEQ ID NO: 9138221 - DNA, 22 bp, Homo sapiens
tacattgaggcagtagctggag

SEQ ID NO: 9138222 - DNA, 22 bp, Homo sapiens
tacattgatggagtacctagct

SEQ ID NO: 9138223 - DNA, 22 bp, Homo sapiens
tacatctttgtctatgaccagc

SEQ ID NO: 9138224 - DNA, 22 bp, Homo sapiens
tacattcccccaattaccaatg

SEQ ID NO: 9138225 - DNA, 22 bp, Homo sapiens
tacattcctgttagcatctaag

SEQ ID NO: 9138226 - DNA, 22 bp, Homo sapiens
tacattcctgttagcatctaag

SEQ ID NO: 9138227 - DNA, 22 bp, Homo sapiens
tacatctatctagatgctcaga

SEQ ID NO: 9138228 - DNA, 19 bp, Homo sapiens
tacatccgggttacttaag

SEQ ID NO: 9138229 - DNA, 22 bp, Homo sapiens
tacatctagccttacaattatt

SEQ ID NO: 9138230 - DNA, 22 bp, Homo sapiens
tacatctagccttacaattatt

SEQ ID NO: 9138231 - DNA, 22 bp, Homo sapiens
tacatctatactgatctacatt

SEQ ID NO: 9138232 - DNA, 22 bp, Homo sapiens
tacatctatactgatctacatt

SEQ ID NO: 9138233 - DNA, 22 bp, Homo sapiens
tacatctagccttacaattatt

SEQ ID NO: 9138234 - DNA, 22 bp, Homo sapiens
tacataggtacagcctttttta

SEQ ID NO: 9138235 - DNA, 22 bp, Homo sapiens
tacatagtgaacatttacagag

SEQ ID NO: 9138236 - DNA, 22 bp, Homo sapiens
tacatcatgtaagcagaatcat

SEQ ID NO: 9138237 - DNA, 22 bp, Homo sapiens
tacatagagggtaatagcatca

SEQ ID NO: 9138238 - DNA, 22 bp, Homo sapiens
tacatagagaagttacagtgga

SEQ ID NO: 9138239 - DNA, 22 bp, Homo sapiens
tacatagaacatgtttaatgtc

SEQ ID NO: 9138240 - DNA, 22 bp, Homo sapiens
tacatagattttgaaactggac

SEQ ID NO: 9138241 - DNA, 22 bp, Homo sapiens
tacatacatgtatgtgtgtatt

SEQ ID NO: 9138242 - DNA, 19 bp, Homo sapiens
tacatacttattctaaaag

SEQ ID NO: 9138243 - DNA, 22 bp, Homo sapiens
tacagtaccagaaatgctaaga

SEQ ID NO: 9138244 - DNA, 22 bp, Homo sapiens
tacagtacacaggtaccaagct

SEQ ID NO: 9138245 - DNA, 21 bp, Homo sapiens
tacagtaagttgggtggtcct

SEQ ID NO: 9138246 - DNA, 22 bp, Homo sapiens
tacagtaataaaatgagctaca

SEQ ID NO: 9138247 - DNA, 22 bp, Homo sapiens
tacagtaatctggacatgattt

SEQ ID NO: 9138248 - DNA, 22 bp, Homo sapiens
tacaggcactgaaatgcttatt

SEQ ID NO: 9138249 - DNA, 22 bp, Homo sapiens
tacaggcactgaaatgcttatt

SEQ ID NO: 9138250 - DNA, 22 bp, Homo sapiens
tacaggagcacaaaagagttga

SEQ ID NO: 9138251 - DNA, 22 bp, Homo sapiens
tacaggcatgaatgaaatctgt

SEQ ID NO: 9138252 - DNA, 22 bp, Homo sapiens
tacaggcatgaatgaaatctgt

SEQ ID NO: 9138253 - DNA, 22 bp, Homo sapiens
tacaggcatgtagcatggtgat

SEQ ID NO: 9138254 - DNA, 22 bp, Homo sapiens
tacaggcatgtagcatggtgat

SEQ ID NO: 9138255 - DNA, 22 bp, Homo sapiens
tacaggctgaactcaatgatga

SEQ ID NO: 9138256 - DNA, 22 bp, Homo sapiens
tacaggctgcagggctagaggg

SEQ ID NO: 9138257 - DNA, 22 bp, Homo sapiens
tacaggctcttgtcagacgtat

SEQ ID NO: 9138258 - DNA, 22 bp, Homo sapiens
tacaggctgcagggctagaggg

SEQ ID NO: 9138259 - DNA, 22 bp, Homo sapiens
tacagtaagatgaaatagcaat

SEQ ID NO: 9138260 - DNA, 20 bp, Homo sapiens
tacagaaacaggacttttgg

SEQ ID NO: 9138261 - DNA, 22 bp, Homo sapiens
tacactcttaggaattggttat

SEQ ID NO: 9138262 - DNA, 22 bp, Homo sapiens
tacactctaattctttggtcct

SEQ ID NO: 9138263 - DNA, 22 bp, Homo sapiens
tacactattttactgatacaaa

SEQ ID NO: 9138264 - DNA, 22 bp, Homo sapiens
tacacttttcaatgtagtctgt

SEQ ID NO: 9138265 - DNA, 20 bp, Homo sapiens
tacaacaagtagagacatac

SEQ ID NO: 9138266 - DNA, 22 bp, Homo sapiens
tacaaagtttggggtcctcaaa

SEQ ID NO: 9138267 - DNA, 22 bp, Homo sapiens
tacaaagtgctttagaaatgaa

SEQ ID NO: 9138268 - DNA, 22 bp, Homo sapiens
tacaaagtgctttagaaatgaa

SEQ ID NO: 9138269 - DNA, 22 bp, Homo sapiens
tacaaagtcaccagcttcttgc

SEQ ID NO: 9138270 - DNA, 22 bp, Homo sapiens
tacaaagtcccattgccatgga

SEQ ID NO: 9138271 - DNA, 22 bp, Homo sapiens
tacaaagtgagcaacctctttt

SEQ ID NO: 9138272 - DNA, 22 bp, Homo sapiens
tacaaagtgaaataattctgag

SEQ ID NO: 9138273 - DNA, 22 bp, Homo sapiens
tacagcacagcaaagaggacgg

SEQ ID NO: 9138274 - DNA, 22 bp, Homo sapiens
tacagcaatgctacaagatgac

SEQ ID NO: 9138275 - DNA, 22 bp, Homo sapiens
tacagcaagacagaccgctcaa

SEQ ID NO: 9138276 - DNA, 22 bp, Homo sapiens
tacagatttggggagtaaagtt

SEQ ID NO: 9138277 - DNA, 22 bp, Homo sapiens
tacagattttgtgaagaagtgt

SEQ ID NO: 9138278 - DNA, 22 bp, Homo sapiens
tacagataggaggaatctgaaa

SEQ ID NO: 9138279 - DNA, 22 bp, Homo sapiens
tacagatatagagatttataga

SEQ ID NO: 9138280 - DNA, 22 bp, Homo sapiens
tacagatatgtatgcacttttt

SEQ ID NO: 9138281 - DNA, 22 bp, Homo sapiens
tacagatatgtatgcacttttt

SEQ ID NO: 9138282 - DNA, 22 bp, Homo sapiens
tacagatatagagatttataga

SEQ ID NO: 9138283 - DNA, 22 bp, Homo sapiens
tacagatattgtacagttatag

SEQ ID NO: 9138284 - DNA, 22 bp, Homo sapiens
tacagattgaggtttttaatat

SEQ ID NO: 9138285 - DNA, 22 bp, Homo sapiens
tacagataactgaatgcagact

SEQ ID NO: 9138286 - DNA, 22 bp, Homo sapiens
tacagataactgaatgcagact

SEQ ID NO: 9138287 - DNA, 22 bp, Homo sapiens
tacagatacagatctagataca

SEQ ID NO: 9138288 - DNA, 22 bp, Homo sapiens
tacagataactgaatgcagact

SEQ ID NO: 9138289 - DNA, 22 bp, Homo sapiens
tacagataaattttaagtagaa

SEQ ID NO: 9138290 - DNA, 22 bp, Homo sapiens
tacagaagctgagacactgaga

SEQ ID NO: 9138291 - DNA, 19 bp, Homo sapiens
taaggtttaccagcaaaat

SEQ ID NO: 9138292 - DNA, 22 bp, Homo sapiens
taaggtcatggtgaataataag

SEQ ID NO: 9138293 - DNA, 22 bp, Homo sapiens
taagggttcagaatgcagtggt

SEQ ID NO: 9138294 - DNA, 22 bp, Homo sapiens
taagggaacagcttcaaactca

SEQ ID NO: 9138295 - DNA, 21 bp, Homo sapiens
taagggcaggaattgggcttt

SEQ ID NO: 9138296 - DNA, 22 bp, Homo sapiens
taaggcttatgatcagaaggtt

SEQ ID NO: 9138297 - DNA, 22 bp, Homo sapiens
taaggcttcttggaatactgca

SEQ ID NO: 9138298 - DNA, 22 bp, Homo sapiens
taaggctcttgagatggggaga

SEQ ID NO: 9138299 - DNA, 22 bp, Homo sapiens
taaggcaggtatggtaccaggc

SEQ ID NO: 9138300 - DNA, 22 bp, Homo sapiens
taaggcaggtagatgactacgg

SEQ ID NO: 9138301 - DNA, 22 bp, Homo sapiens
taactgcaggtcatcctcgcat

SEQ ID NO: 9138302 - DNA, 22 bp, Homo sapiens
taactgccagcagcgatgaaca

SEQ ID NO: 9138303 - DNA, 22 bp, Homo sapiens
taactggtactctggtagcctg

SEQ ID NO: 9138304 - DNA, 22 bp, Homo sapiens
taactgcctactgtgcaaatat

SEQ ID NO: 9138305 - DNA, 22 bp, Homo sapiens
taactgctcagtgagtattttt

SEQ ID NO: 9138306 - DNA, 22 bp, Homo sapiens
taaggcaaaggggaagttatca

SEQ ID NO: 9138307 - DNA, 22 bp, Homo sapiens
taaggattcaggcaggccatac

SEQ ID NO: 9138308 - DNA, 23 bp, Homo sapiens
taaggcattttttctgtatcagt

SEQ ID NO: 9138309 - DNA, 22 bp, Homo sapiens
taaggcatgagtttatttcata

SEQ ID NO: 9138310 - DNA, 22 bp, Homo sapiens
taaggcataaggaagatttgga

SEQ ID NO: 9138311 - DNA, 22 bp, Homo sapiens
taatacatcattcatctaagga

SEQ ID NO: 9138312 - DNA, 22 bp, Homo sapiens
taatacatgtattccagagagt

SEQ ID NO: 9138313 - DNA, 22 bp, Homo sapiens
taatacattacctaacctctct

SEQ ID NO: 9138314 - DNA, 22 bp, Homo sapiens
taatacatgtattccagagagt

SEQ ID NO: 9138315 - DNA, 22 bp, Homo sapiens
taatacctactggtcattgcaa

SEQ ID NO: 9138316 - DNA, 22 bp, Homo sapiens
taatactgactaaagatatcaa

SEQ ID NO: 9138317 - DNA, 21 bp, Homo sapiens
taatactgaaagtgacatctg

SEQ ID NO: 9138318 - DNA, 22 bp, Homo sapiens
taatactgaaagggaaatgtcc

SEQ ID NO: 9138319 - DNA, 22 bp, Homo sapiens
taatactgaaaggagtatcagc

SEQ ID NO: 9138320 - DNA, 22 bp, Homo sapiens
taataattaacagtgatgggtc

SEQ ID NO: 9138321 - DNA, 22 bp, Homo sapiens
taataatagcagtagctgccac

SEQ ID NO: 9138322 - DNA, 22 bp, Homo sapiens
taatacatcattcatctaagga

SEQ ID NO: 9138323 - DNA, 22 bp, Homo sapiens
taagtgttattattctcacttt

SEQ ID NO: 9138324 - DNA, 22 bp, Homo sapiens
taagtgtgtaataggtccttct

SEQ ID NO: 9138325 - DNA, 22 bp, Homo sapiens
taagtagcctacaagtatattt

SEQ ID NO: 9138326 - DNA, 22 bp, Homo sapiens
taagtgaatccttgagaagaaa

SEQ ID NO: 9138327 - DNA, 22 bp, Homo sapiens
taagtacaaatgtatacataag

SEQ ID NO: 9138328 - DNA, 22 bp, Homo sapiens
taagtacaaatgtatacataag

SEQ ID NO: 9138329 - DNA, 22 bp, Homo sapiens
taagtaatttgtgcagagatac

SEQ ID NO: 9138330 - DNA, 22 bp, Homo sapiens
taagtaactgcataattaaatt

SEQ ID NO: 9138331 - DNA, 18 bp, Homo sapiens
taagtaaggtcatatggg

SEQ ID NO: 9138332 - DNA, 22 bp, Homo sapiens
taagtaaatttataatgtgatt

SEQ ID NO: 9138333 - DNA, 22 bp, Homo sapiens
taaggtttggctgtctcttggt

SEQ ID NO: 9138334 - DNA, 22 bp, Homo sapiens
taaggtttaacgccctgtctcg

SEQ ID NO: 9138335 - DNA, 22 bp, Homo sapiens
taaggtttgcttatcttcgcct

SEQ ID NO: 9138336 - DNA, 22 bp, Homo sapiens
taatactgtgcttcattttcct

SEQ ID NO: 9138337 - DNA, 22 bp, Homo sapiens
taatactgtatactgcaaattt

SEQ ID NO: 9138338 - DNA, 19 bp, Homo sapiens
taatactggctgtagctgg

SEQ ID NO: 9138339 - DNA, 22 bp, Homo sapiens
taatactgggaaatacttgggt

SEQ ID NO: 9138340 - DNA, 22 bp, Homo sapiens
taatactgatgtctgagcccca

SEQ ID NO: 9138341 - DNA, 22 bp, Homo sapiens
taatactgctgtgcttgagttg

SEQ ID NO: 9138342 - DNA, 22 bp, Homo sapiens
taatacttaccttgcagagtct

SEQ ID NO: 9138343 - DNA, 22 bp, Homo sapiens
taatactgtaacttggtgggtc

SEQ ID NO: 9138344 - DNA, 22 bp, Homo sapiens
taatagaatagtggaaacattg

SEQ ID NO: 9138345 - DNA, 22 bp, Homo sapiens
taatggattaacgtccctgtcg

SEQ ID NO: 9138346 - DNA, 22 bp, Homo sapiens
taatgtttccagtctatgatgg

SEQ ID NO: 9138347 - DNA, 22 bp, Homo sapiens
taatgtttagaagcagacagct

SEQ ID NO: 9138348 - DNA, 22 bp, Homo sapiens
taatgtaaacacagagacagaa

SEQ ID NO: 9138349 - DNA, 22 bp, Homo sapiens
taatgggcccaaaggagctgag

SEQ ID NO: 9138350 - DNA, 22 bp, Homo sapiens
taatgggctatctgttgagact

SEQ ID NO: 9138351 - DNA, 22 bp, Homo sapiens
taatgtttgggaaggtgctttg

SEQ ID NO: 9138352 - DNA, 22 bp, Homo sapiens
taattacaaagcaagcacaggg

SEQ ID NO: 9138353 - DNA, 22 bp, Homo sapiens
taattacaaagcaagcacaggg

SEQ ID NO: 9138354 - DNA, 22 bp, Homo sapiens
taattaacatacaaaacagctg

SEQ ID NO: 9138355 - DNA, 22 bp, Homo sapiens
taattacaggtccaaaacaatc

SEQ ID NO: 9138356 - DNA, 22 bp, Homo sapiens
taattacaggtccaaaacaatc

SEQ ID NO: 9138357 - DNA, 22 bp, Homo sapiens
taattatacaaaaaggcatgca

SEQ ID NO: 9138358 - DNA, 22 bp, Homo sapiens
taattatagcattggagtggcc

SEQ ID NO: 9138359 - DNA, 22 bp, Homo sapiens
taattataacatgctttctggc

SEQ ID NO: 9138360 - DNA, 22 bp, Homo sapiens
taattagagtcacaagtaacca

SEQ ID NO: 9138361 - DNA, 22 bp, Homo sapiens
taattataaactgcagtaggta

SEQ ID NO: 9138362 - DNA, 22 bp, Homo sapiens
taattataacagttacatctta

SEQ ID NO: 9138363 - DNA, 22 bp, Homo sapiens
tacaaaggagataaattggagg

SEQ ID NO: 9138364 - DNA, 19 bp, Homo sapiens
tacaaaggaggatgtaaaa

SEQ ID NO: 9138365 - DNA, 22 bp, Homo sapiens
tacaaagcctggtagatatctg

SEQ ID NO: 9138366 - DNA, 22 bp, Homo sapiens
tacaaagatagtgttagagtaa

SEQ ID NO: 9138367 - DNA, 22 bp, Homo sapiens
tacaaagatagtgttagagtaa

SEQ ID NO: 9138368 - DNA, 22 bp, Homo sapiens
tacaaagtcacattgaaatgaa

SEQ ID NO: 9138369 - DNA, 22 bp, Homo sapiens
tacaaagtagaaattcagtaaa

SEQ ID NO: 9138370 - DNA, 22 bp, Homo sapiens
tacaaagtaatgtataatatcg

SEQ ID NO: 9138371 - DNA, 22 bp, Homo sapiens
tacaaaggcttaaagagatttc

SEQ ID NO: 9138372 - DNA, 22 bp, Homo sapiens
tacaaaaaattgatactgacga

SEQ ID NO: 9138373 - DNA, 23 bp, Homo sapiens
taattatggaataatttgcaacg

SEQ ID NO: 9138374 - DNA, 22 bp, Homo sapiens
taattatagccgctattttgct

SEQ ID NO: 9138375 - DNA, 22 bp, Homo sapiens
tacaaactctttatatttcata

SEQ ID NO: 9138376 - DNA, 22 bp, Homo sapiens
tacaaactccgaagtttgtacc

SEQ ID NO: 9138377 - DNA, 22 bp, Homo sapiens
tacaaagaggcagctccatttt

SEQ ID NO: 9138378 - DNA, 22 bp, Homo sapiens
tacaaacttgttttaagtaagt

SEQ ID NO: 9138379 - DNA, 22 bp, Homo sapiens
tacaaagaggtaattgcatata

SEQ ID NO: 9138380 - DNA, 22 bp, Homo sapiens
tacaaagaggtaattgcatata

SEQ ID NO: 9138381 - DNA, 22 bp, Homo sapiens
tacaaagagtttggtctctaga

SEQ ID NO: 9138382 - DNA, 22 bp, Homo sapiens
taactgaagctggaagcgctgg

SEQ ID NO: 9138383 - DNA, 22 bp, Homo sapiens
taactctagtcccaggcatgaa

SEQ ID NO: 9138384 - DNA, 22 bp, Homo sapiens
taacctggggcctgaagaccat

SEQ ID NO: 9138385 - DNA, 22 bp, Homo sapiens
taacctgggatctgacgggatg

SEQ ID NO: 9138386 - DNA, 22 bp, Homo sapiens
taacctggggcggtttcccaat

SEQ ID NO: 9138387 - DNA, 22 bp, Homo sapiens
taacctggatgtgccaacgtga

SEQ ID NO: 9138388 - DNA, 22 bp, Homo sapiens
taactaactagtgttcaaaata

SEQ ID NO: 9138389 - DNA, 22 bp, Homo sapiens
taactaactagtgttcaaaata

SEQ ID NO: 9138390 - DNA, 22 bp, Homo sapiens
taactaactagtgttcaaaata

SEQ ID NO: 9138391 - DNA, 22 bp, Homo sapiens
taactacaagggcggtctctgt

SEQ ID NO: 9138392 - DNA, 22 bp, Homo sapiens
taactacatttcactgcaatta

SEQ ID NO: 9138393 - DNA, 22 bp, Homo sapiens
taacattacagacaccttgtgt

SEQ ID NO: 9138394 - DNA, 22 bp, Homo sapiens
taaatttacccaaggaacatgt

SEQ ID NO: 9138395 - DNA, 22 bp, Homo sapiens
taaatttttgttaacagcctct

SEQ ID NO: 9138396 - DNA, 22 bp, Homo sapiens
taacccgtgttactggcataag

SEQ ID NO: 9138397 - DNA, 22 bp, Homo sapiens
taaccccgccctcaatgtgaat

SEQ ID NO: 9138398 - DNA, 22 bp, Homo sapiens
taaccatattttccattaagtt

SEQ ID NO: 9138399 - DNA, 22 bp, Homo sapiens
taacattacggacatctgtcag

SEQ ID NO: 9138400 - DNA, 20 bp, Homo sapiens
taaccaagaattggcaaggg

SEQ ID NO: 9138401 - DNA, 22 bp, Homo sapiens
taaccagcatgaaatctgcagc

SEQ ID NO: 9138402 - DNA, 22 bp, Homo sapiens
taaccatattttccattaagtt

SEQ ID NO: 9138403 - DNA, 22 bp, Homo sapiens
taaattctacaacttcaaagat

SEQ ID NO: 9138404 - DNA, 22 bp, Homo sapiens
taaattgaaaatctacagaaca

SEQ ID NO: 9138405 - DNA, 22 bp, Homo sapiens
taaattgtggccatttgtgttt

SEQ ID NO: 9138406 - DNA, 22 bp, Homo sapiens
taaattgttttctagaagttgt

SEQ ID NO: 9138407 - DNA, 22 bp, Homo sapiens
taaattgcataagtacaaatga

SEQ ID NO: 9138408 - DNA, 22 bp, Homo sapiens
taaattgatcgtttgggatgaa

SEQ ID NO: 9138409 - DNA, 22 bp, Homo sapiens
taaagtatccagttattcttct

SEQ ID NO: 9138410 - DNA, 22 bp, Homo sapiens
taaagtaatccttcataaggag

SEQ ID NO: 9138411 - DNA, 22 bp, Homo sapiens
taaagtaatccttcataaggag

SEQ ID NO: 9138412 - DNA, 22 bp, Homo sapiens
taaaggtatgtcttaatcaaac

SEQ ID NO: 9138413 - DNA, 22 bp, Homo sapiens
taaaggtcaagagatgctgtct

SEQ ID NO: 9138414 - DNA, 22 bp, Homo sapiens
taaaggtcatcagattagcggg

SEQ ID NO: 9138415 - DNA, 22 bp, Homo sapiens
taaaggtccaaagagggctacg

SEQ ID NO: 9138416 - DNA, 22 bp, Homo sapiens
taaaggtctgaacacagtgagg

SEQ ID NO: 9138417 - DNA, 22 bp, Homo sapiens
taaaggtagtgtgacatattgt

SEQ ID NO: 9138418 - DNA, 22 bp, Homo sapiens
taaattagggactttagttaat

SEQ ID NO: 9138419 - DNA, 22 bp, Homo sapiens
taaattatgttccatgtccttt

SEQ ID NO: 9138420 - DNA, 22 bp, Homo sapiens
taaattatgtcacatgactctg

SEQ ID NO: 9138421 - DNA, 22 bp, Homo sapiens
taaattatgtcacatgactctg

SEQ ID NO: 9138422 - DNA, 22 bp, Homo sapiens
taaattatgttccatgtccttt

SEQ ID NO: 9138423 - DNA, 23 bp, Homo sapiens
taaattacctttccagtgcaggg

SEQ ID NO: 9138424 - DNA, 22 bp, Homo sapiens
taaattaaagattggagaagga

SEQ ID NO: 9138425 - DNA, 22 bp, Homo sapiens
taaattaaagattggagaagga

SEQ ID NO: 9138426 - DNA, 22 bp, Homo sapiens
taaagtgtatgccatctctcat

SEQ ID NO: 9138427 - DNA, 22 bp, Homo sapiens
taaagtgtatgccatctctcat

SEQ ID NO: 9138428 - DNA, 22 bp, Homo sapiens
taaagtgtcctagctaggaggc

SEQ ID NO: 9138429 - DNA, 22 bp, Homo sapiens
taaagtgtctgcctcagctcag

SEQ ID NO: 9138430 - DNA, 22 bp, Homo sapiens
taaagtgtctgcctcagctcag

SEQ ID NO: 9138431 - DNA, 22 bp, Homo sapiens
taaattaaagattggagaagga

SEQ ID NO: 9138432 - DNA, 22 bp, Homo sapiens
taaagtggtggtgctaatgtat

SEQ ID NO: 9138433 - DNA, 22 bp, Homo sapiens
gtttttatctaatagcagttat

SEQ ID NO: 9138434 - DNA, 22 bp, Homo sapiens
gtttttattgtgtaaatgtggg

SEQ ID NO: 9138435 - DNA, 22 bp, Homo sapiens
gtttttatatcctgtggagtgt

SEQ ID NO: 9138436 - DNA, 22 bp, Homo sapiens
gttttgttttgagtcaactcca

SEQ ID NO: 9138437 - DNA, 19 bp, Homo sapiens
gttttgtttgcagaactta

SEQ ID NO: 9138438 - DNA, 19 bp, Homo sapiens
taaaatgtctgtggtcagt

SEQ ID NO: 9138439 - DNA, 22 bp, Homo sapiens
taaaatgccagaccagttcacg

SEQ ID NO: 9138440 - DNA, 22 bp, Homo sapiens
taaaatgccagaccagttcacg

SEQ ID NO: 9138441 - DNA, 22 bp, Homo sapiens
taaaatgtttgcaagagaccag

SEQ ID NO: 9138442 - DNA, 22 bp, Homo sapiens
taaaatgtttgcaagagaccag

SEQ ID NO: 9138443 - DNA, 22 bp, Homo sapiens
taaaatgtgtttctgtatggtt

SEQ ID NO: 9138444 - DNA, 22 bp, Homo sapiens
taaaattgcggtgaatatttcc

SEQ ID NO: 9138445 - DNA, 22 bp, Homo sapiens
taaaatttgtccctgagtgttg

SEQ ID NO: 9138446 - DNA, 22 bp, Homo sapiens
taaacaagctgtctgatattct

SEQ ID NO: 9138447 - DNA, 22 bp, Homo sapiens
taaacagaatgcgtaagaagtg

SEQ ID NO: 9138448 - DNA, 22 bp, Homo sapiens
taaacagaaagcagatgtactt

SEQ ID NO: 9138449 - DNA, 22 bp, Homo sapiens
taaagggtaggttttactgtaa

SEQ ID NO: 9138450 - DNA, 22 bp, Homo sapiens
gtttccaggcccctccctagac

SEQ ID NO: 9138451 - DNA, 22 bp, Homo sapiens
gtttccacttgagaggactcct

SEQ ID NO: 9138452 - DNA, 22 bp, Homo sapiens
gtttccagccaatcccctcagg

SEQ ID NO: 9138453 - DNA, 22 bp, Homo sapiens
gtttccaggaggctacacctga

SEQ ID NO: 9138454 - DNA, 22 bp, Homo sapiens
gttttctttgaatgcttctaga

SEQ ID NO: 9138455 - DNA, 22 bp, Homo sapiens
gttttgaatcactgcgcttcac

SEQ ID NO: 9138456 - DNA, 22 bp, Homo sapiens
gttttgaaatgaaagaaccaag

SEQ ID NO: 9138457 - DNA, 22 bp, Homo sapiens
gttttgcttctcatgttaagtg

SEQ ID NO: 9138458 - DNA, 18 bp, Homo sapiens
gttttgaattgtcttaca

SEQ ID NO: 9138459 - DNA, 22 bp, Homo sapiens
gttttggcagccgtgttcacat

SEQ ID NO: 9138460 - DNA, 22 bp, Homo sapiens
gttttggctctggcatgtggaa

SEQ ID NO: 9138461 - DNA, 22 bp, Homo sapiens
gttttgtgaggcacccacaggt

SEQ ID NO: 9138462 - DNA, 22 bp, Homo sapiens
gttttgtgaggcacccacaggt

SEQ ID NO: 9138463 - DNA, 22 bp, Homo sapiens
gttttgttgctgcagagctcaa

SEQ ID NO: 9138464 - DNA, 22 bp, Homo sapiens
gttttgttcttgtccagggaaa

SEQ ID NO: 9138465 - DNA, 18 bp, Homo sapiens
gttttgtggctagtagtg

SEQ ID NO: 9138466 - DNA, 22 bp, Homo sapiens
gttttgttcatgaacattgggt

SEQ ID NO: 9138467 - DNA, 22 bp, Homo sapiens
gtttcagggccttttatgtgtt

SEQ ID NO: 9138468 - DNA, 19 bp, Homo sapiens
gtttcattaagataggaaa

SEQ ID NO: 9138469 - DNA, 22 bp, Homo sapiens
gtttcattacctgacccatgag

SEQ ID NO: 9138470 - DNA, 22 bp, Homo sapiens
gtttcattacctgacccatgag

SEQ ID NO: 9138471 - DNA, 22 bp, Homo sapiens
gtttcatttacatctgtaggta

SEQ ID NO: 9138472 - DNA, 22 bp, Homo sapiens
gtttcatttacatctgtaggta

SEQ ID NO: 9138473 - DNA, 22 bp, Homo sapiens
gtttcattcggcagctcataag

SEQ ID NO: 9138474 - DNA, 22 bp, Homo sapiens
gtttcattcggcagctcataag

SEQ ID NO: 9138475 - DNA, 22 bp, Homo sapiens
gtttcatgccatttccagattg

SEQ ID NO: 9138476 - DNA, 19 bp, Homo sapiens
gtttcattaagataggaaa

SEQ ID NO: 9138477 - DNA, 22 bp, Homo sapiens
gtttcagagtagaacctcaagg

SEQ ID NO: 9138478 - DNA, 22 bp, Homo sapiens
gtttcagactattctgtttctg

SEQ ID NO: 9138479 - DNA, 22 bp, Homo sapiens
gtttcagaggtgttcattttca

SEQ ID NO: 9138480 - DNA, 22 bp, Homo sapiens
gtttcagaacaccccatttggg

SEQ ID NO: 9138481 - DNA, 22 bp, Homo sapiens
gttgtacagcatccagtgcaga

SEQ ID NO: 9138482 - DNA, 22 bp, Homo sapiens
gttgtacagcatccagtgcaga

SEQ ID NO: 9138483 - DNA, 22 bp, Homo sapiens
gtttcagatatatttgtactta

SEQ ID NO: 9138484 - DNA, 22 bp, Homo sapiens
gtttcagagttagtgctggctg

SEQ ID NO: 9138485 - DNA, 22 bp, Homo sapiens
gtttcagatttggtttcagaag

SEQ ID NO: 9138486 - DNA, 23 bp, Homo sapiens
gttgtaatggataatgcaaattg

SEQ ID NO: 9138487 - DNA, 22 bp, Homo sapiens
gttgtaagtttaatgtcaattg

SEQ ID NO: 9138488 - DNA, 23 bp, Homo sapiens
gttgtaatggataatgcaaattg

SEQ ID NO: 9138489 - DNA, 22 bp, Homo sapiens
gttgtacaaaatatcagtgagg

SEQ ID NO: 9138490 - DNA, 22 bp, Homo sapiens
gttgagtgggttaggatgctga

SEQ ID NO: 9138491 - DNA, 22 bp, Homo sapiens
gttgagtgggttaggatgctga

SEQ ID NO: 9138492 - DNA, 22 bp, Homo sapiens
gttgccaggggctgctgtcacc

SEQ ID NO: 9138493 - DNA, 22 bp, Homo sapiens
gttgccagacttctgtggctcc

SEQ ID NO: 9138494 - DNA, 22 bp, Homo sapiens
gttgccaggggctgctgtcacc

SEQ ID NO: 9138495 - DNA, 22 bp, Homo sapiens
gttgccaggacagcgcggcccg

SEQ ID NO: 9138496 - DNA, 22 bp, Homo sapiens
gttgcaggaagcacacacatgt

SEQ ID NO: 9138497 - DNA, 22 bp, Homo sapiens
gttgcataaagccttcctcata

SEQ ID NO: 9138498 - DNA, 22 bp, Homo sapiens
gttgcaggaggatggctgcata

SEQ ID NO: 9138499 - DNA, 22 bp, Homo sapiens
gttgggaatttattccttttct

SEQ ID NO: 9138500 - DNA, 22 bp, Homo sapiens
gttgggagcagcagaccaagag

SEQ ID NO: 9138501 - DNA, 22 bp, Homo sapiens
gttgggttaaccaggatgtcaa

SEQ ID NO: 9138502 - DNA, 22 bp, Homo sapiens
gttggggaaggtgggagaatgt

SEQ ID NO: 9138503 - DNA, 22 bp, Homo sapiens
gttggggtaccttgaggctggg

SEQ ID NO: 9138504 - DNA, 22 bp, Homo sapiens
gttcagtgtttacatgattgtt

SEQ ID NO: 9138505 - DNA, 22 bp, Homo sapiens
gttcatttaggaaaggaagagt

SEQ ID NO: 9138506 - DNA, 22 bp, Homo sapiens
gttcatttaggaaaggaagagt

SEQ ID NO: 9138507 - DNA, 22 bp, Homo sapiens
gttcatttatgatgtaacatgt

SEQ ID NO: 9138508 - DNA, 22 bp, Homo sapiens
gttcatttatgatgtaacatgt

SEQ ID NO: 9138509 - DNA, 22 bp, Homo sapiens
gttgaggtgatgccagccctgc

SEQ ID NO: 9138510 - DNA, 22 bp, Homo sapiens
gttgaggtgatgccagccctgc

SEQ ID NO: 9138511 - DNA, 22 bp, Homo sapiens
gttcaagtctggggctgccagt

SEQ ID NO: 9138512 - DNA, 22 bp, Homo sapiens
gttacaaaggactgggggccac

SEQ ID NO: 9138513 - DNA, 22 bp, Homo sapiens
gttacaaaggactgggggccac

SEQ ID NO: 9138514 - DNA, 22 bp, Homo sapiens
gttacaaaggactgggggccac

SEQ ID NO: 9138515 - DNA, 22 bp, Homo sapiens
gttacaaaggactgggggccac

SEQ ID NO: 9138516 - DNA, 22 bp, Homo sapiens
gttcagagtattaattgattta

SEQ ID NO: 9138517 - DNA, 22 bp, Homo sapiens
gttcagcaatagatctagaggc

SEQ ID NO: 9138518 - DNA, 22 bp, Homo sapiens
gttcagcacaggtgctcagaca

SEQ ID NO: 9138519 - DNA, 20 bp, Homo sapiens
gttcactgagcttaaatgtt

SEQ ID NO: 9138520 - DNA, 22 bp, Homo sapiens
gttcaccatatggtaatttaat

SEQ ID NO: 9138521 - DNA, 22 bp, Homo sapiens
gttcagagacacttattggaaa

SEQ ID NO: 9138522 - DNA, 22 bp, Homo sapiens
gttacaaaggaagcttcactgc

SEQ ID NO: 9138523 - DNA, 22 bp, Homo sapiens
gttacaaaggaagcttcactgc

SEQ ID NO: 9138524 - DNA, 22 bp, Homo sapiens
gttacaaaggaagcttcactgc

SEQ ID NO: 9138525 - DNA, 22 bp, Homo sapiens
gttacaaaggaagcttcactgc

SEQ ID NO: 9138526 - DNA, 22 bp, Homo sapiens
gttacaaaggaagcttcactgc

SEQ ID NO: 9138527 - DNA, 22 bp, Homo sapiens
gttacaaagcacttcaagtgaa

SEQ ID NO: 9138528 - DNA, 22 bp, Homo sapiens
gttacaaagcacttcaagtgaa

SEQ ID NO: 9138529 - DNA, 22 bp, Homo sapiens
gttacaaagcacttcaagtgaa

SEQ ID NO: 9138530 - DNA, 22 bp, Homo sapiens
gttacaaagcacttcaagtgaa

SEQ ID NO: 9138531 - DNA, 22 bp, Homo sapiens
gttacaaactcaggtgccaaaa

SEQ ID NO: 9138532 - DNA, 22 bp, Homo sapiens
gttaatttgcagctttcgagct

SEQ ID NO: 9138533 - DNA, 22 bp, Homo sapiens
gttacaaactcaggtgccaaaa

SEQ ID NO: 9138534 - DNA, 22 bp, Homo sapiens
gttacaaactcaggtgccaaaa

SEQ ID NO: 9138535 - DNA, 22 bp, Homo sapiens
gttaatgtgtctgacacaatgg

SEQ ID NO: 9138536 - DNA, 22 bp, Homo sapiens
gttaatgtgatataaagtattt

SEQ ID NO: 9138537 - DNA, 22 bp, Homo sapiens
gttaatgttatctgaagacagt

SEQ ID NO: 9138538 - DNA, 23 bp, Homo sapiens
gttaataatgaacactttctccc

SEQ ID NO: 9138539 - DNA, 22 bp, Homo sapiens
gttaataaaggtatagaatcag

SEQ ID NO: 9138540 - DNA, 22 bp, Homo sapiens
gttaataaaggtatagaatcag

SEQ ID NO: 9138541 - DNA, 22 bp, Homo sapiens
gttaagtgaatgtcatgtcagg

SEQ ID NO: 9138542 - DNA, 22 bp, Homo sapiens
gtgtgggaatggcggtcgtgca

SEQ ID NO: 9138543 - DNA, 22 bp, Homo sapiens
gtgtggcttgggtgaggcgcct

SEQ ID NO: 9138544 - DNA, 22 bp, Homo sapiens
gtgtgggaaggctaggatgctg

SEQ ID NO: 9138545 - DNA, 18 bp, Homo sapiens
gtgtggctgagatgaggc

SEQ ID NO: 9138546 - DNA, 18 bp, Homo sapiens
gtgtggctgagatgaggc

SEQ ID NO: 9138547 - DNA, 22 bp, Homo sapiens
gtgtggctgccagccaagaggc

SEQ ID NO: 9138548 - DNA, 22 bp, Homo sapiens
gtgtggctgaaatcaaggcagg

SEQ ID NO: 9138549 - DNA, 22 bp, Homo sapiens
gtgtggctgaaatcaaggcagg

SEQ ID NO: 9138550 - DNA, 22 bp, Homo sapiens
gtgtggctgaaatcaaggcagg

SEQ ID NO: 9138551 - DNA, 22 bp, Homo sapiens
gtgtggctacctcagaggagca

SEQ ID NO: 9138552 - DNA, 22 bp, Homo sapiens
gtgtgcctcccattagggtgta

SEQ ID NO: 9138553 - DNA, 22 bp, Homo sapiens
gtgtggccttgggagaggtctg

SEQ ID NO: 9138554 - DNA, 22 bp, Homo sapiens
gtgtgccaggaactggctgctg

SEQ ID NO: 9138555 - DNA, 22 bp, Homo sapiens
gtgtgccactgcctgaggaccc

SEQ ID NO: 9138556 - DNA, 22 bp, Homo sapiens
gtgtgccaccagtcaaggtgaa

SEQ ID NO: 9138557 - DNA, 19 bp, Homo sapiens
gtgtgcattgtcgcatcat

SEQ ID NO: 9138558 - DNA, 22 bp, Homo sapiens
gtgtgcatgtgcttgcacagat

SEQ ID NO: 9138559 - DNA, 22 bp, Homo sapiens
gtgctgaagtgaaattcatcaa

SEQ ID NO: 9138560 - DNA, 22 bp, Homo sapiens
gtgtgcatagtcgtgcatgcat

SEQ ID NO: 9138561 - DNA, 22 bp, Homo sapiens
gtgtgcatgcatagacaccaca

SEQ ID NO: 9138562 - DNA, 22 bp, Homo sapiens
gtgtgcatctcacccttccccg

SEQ ID NO: 9138563 - DNA, 22 bp, Homo sapiens
gtgctgaactataaaaagcttt

SEQ ID NO: 9138564 - DNA, 22 bp, Homo sapiens
gtgctgaacatttgggacttgt

SEQ ID NO: 9138565 - DNA, 22 bp, Homo sapiens
gtgctgaactataaaaagcttt

SEQ ID NO: 9138566 - DNA, 22 bp, Homo sapiens
gtgctgaaatagaggaggtggc

SEQ ID NO: 9138567 - DNA, 22 bp, Homo sapiens
gtgctgaaatggacctcaggaa

SEQ ID NO: 9138568 - DNA, 22 bp, Homo sapiens
gtgctgaagaagtctgttcgcc

SEQ ID NO: 9138569 - DNA, 22 bp, Homo sapiens
gtgctgaagtgaaattcatcaa

SEQ ID NO: 9138570 - DNA, 18 bp, Homo sapiens
gtgtgcagttgcaggggt

SEQ ID NO: 9138571 - DNA, 22 bp, Homo sapiens
gtgctccctccttcctcaagga

SEQ ID NO: 9138572 - DNA, 22 bp, Homo sapiens
gtgctctggccaagcgcgtgcg

SEQ ID NO: 9138573 - DNA, 22 bp, Homo sapiens
gtgctcctcacagtgtggccct

SEQ ID NO: 9138574 - DNA, 22 bp, Homo sapiens
gtgctccctccttcctcaagga

SEQ ID NO: 9138575 - DNA, 22 bp, Homo sapiens
gtgctccctccttcctcaagga

SEQ ID NO: 9138576 - DNA, 22 bp, Homo sapiens
gtgctccctccttcctcaagga

SEQ ID NO: 9138577 - DNA, 22 bp, Homo sapiens
gcctccggagttgcagtgtctt

SEQ ID NO: 9138578 - DNA, 22 bp, Homo sapiens
gcctccggagtcacagtgtctt

SEQ ID NO: 9138579 - DNA, 22 bp, Homo sapiens
gccctgtgtgtttgcactgatt

SEQ ID NO: 9138580 - DNA, 22 bp, Homo sapiens
gccctgtgtatcccctgtgctt

SEQ ID NO: 9138581 - DNA, 22 bp, Homo sapiens
gcctcctccttcccgagggtct

SEQ ID NO: 9138582 - DNA, 22 bp, Homo sapiens
gcctcctcacaatgtacccacg

SEQ ID NO: 9138583 - DNA, 22 bp, Homo sapiens
gcctcctgaagtgctgggatta

SEQ ID NO: 9138584 - DNA, 22 bp, Homo sapiens
gcctcctgaagtgctgggatta

SEQ ID NO: 9138585 - DNA, 22 bp, Homo sapiens
gcctcctgaaaggaagagctcc

SEQ ID NO: 9138586 - DNA, 22 bp, Homo sapiens
gcctcctcttgagggtcaggga

SEQ ID NO: 9138587 - DNA, 22 bp, Homo sapiens
gcctcctggcctttgctcctca

SEQ ID NO: 9138588 - DNA, 22 bp, Homo sapiens
gcctcctgggttcatgccattc

SEQ ID NO: 9138589 - DNA, 22 bp, Homo sapiens
gcctcctggttgcttctccaac

SEQ ID NO: 9138590 - DNA, 22 bp, Homo sapiens
gcctctggagtcgcagcgtctt

SEQ ID NO: 9138591 - DNA, 22 bp, Homo sapiens
gcctcctggaagtcacatgttt

SEQ ID NO: 9138592 - DNA, 22 bp, Homo sapiens
gcctcctggaagtcacatgttt

SEQ ID NO: 9138593 - DNA, 22 bp, Homo sapiens
gcctcctgagtagctgggattg

SEQ ID NO: 9138594 - DNA, 22 bp, Homo sapiens
gcctcctgagtagctgggattg

SEQ ID NO: 9138595 - DNA, 22 bp, Homo sapiens
gcctcctgcccagatgagtgat

SEQ ID NO: 9138596 - DNA, 22 bp, Homo sapiens
gcctcctgacttacactgagct

SEQ ID NO: 9138597 - DNA, 22 bp, Homo sapiens
gcctcctgacttacactgagct

SEQ ID NO: 9138598 - DNA, 22 bp, Homo sapiens
gcctcctgacttacactgagct

SEQ ID NO: 9138599 - DNA, 22 bp, Homo sapiens
gcctcctgagaagccacaggct

SEQ ID NO: 9138600 - DNA, 22 bp, Homo sapiens
gcctcctgagaagccacaggct

SEQ ID NO: 9138601 - DNA, 22 bp, Homo sapiens
gccccagcctcccgagtagctg

SEQ ID NO: 9138602 - DNA, 22 bp, Homo sapiens
gccccagcctcccgagtagctg

SEQ ID NO: 9138603 - DNA, 22 bp, Homo sapiens
gccccagcctcccgagtagctg

SEQ ID NO: 9138604 - DNA, 22 bp, Homo sapiens
gccccagcctcccgagtagctg

SEQ ID NO: 9138605 - DNA, 22 bp, Homo sapiens
gccccagcctagttttctttca

SEQ ID NO: 9138606 - DNA, 22 bp, Homo sapiens
gccccagccctgtggaccatgg

SEQ ID NO: 9138607 - DNA, 22 bp, Homo sapiens
gccccagccctgtggaccatgg

SEQ ID NO: 9138608 - DNA, 22 bp, Homo sapiens
gccccagccaaggtgacacgaa

SEQ ID NO: 9138609 - DNA, 22 bp, Homo sapiens
gccccagccaaggtgacacgaa

SEQ ID NO: 9138610 - DNA, 22 bp, Homo sapiens
gccccagatggaggaagctggg

SEQ ID NO: 9138611 - DNA, 22 bp, Homo sapiens
gccccagcagcaatgcggttga

SEQ ID NO: 9138612 - DNA, 22 bp, Homo sapiens
gccccagatggaggaagctggg

SEQ ID NO: 9138613 - DNA, 22 bp, Homo sapiens
gccccagctctgccacaactag

SEQ ID NO: 9138614 - DNA, 22 bp, Homo sapiens
gccccagcgtggctgtgttagg

SEQ ID NO: 9138615 - DNA, 22 bp, Homo sapiens
gccccaggggaggtgccctgca

SEQ ID NO: 9138616 - DNA, 22 bp, Homo sapiens
gccccaggggaggtgccctgca

SEQ ID NO: 9138617 - DNA, 15 bp, Homo sapiens
gccccaggaatcaaa

SEQ ID NO: 9138618 - DNA, 22 bp, Homo sapiens
gccccaggataaatttgtaaga

SEQ ID NO: 9138619 - DNA, 22 bp, Homo sapiens
gccctggagctagactaggaca

SEQ ID NO: 9138620 - DNA, 17 bp, Homo sapiens
gccctggagccaggcta

SEQ ID NO: 9138621 - DNA, 17 bp, Homo sapiens
gccctggagccaggcta

SEQ ID NO: 9138622 - DNA, 17 bp, Homo sapiens
gccctggagccaggcta

SEQ ID NO: 9138623 - DNA, 22 bp, Homo sapiens
gccctggagggccagcgactgg

SEQ ID NO: 9138624 - DNA, 22 bp, Homo sapiens
gccccaggggaggtgccctgca

SEQ ID NO: 9138625 - DNA, 22 bp, Homo sapiens
gccccaggggaggtgccctgca

SEQ ID NO: 9138626 - DNA, 22 bp, Homo sapiens
gccccaggggaggtgccctgca

SEQ ID NO: 9138627 - DNA, 22 bp, Homo sapiens
gccctgggcaaggttctggcca

SEQ ID NO: 9138628 - DNA, 22 bp, Homo sapiens
gccctgggcaaggttctggcca

SEQ ID NO: 9138629 - DNA, 22 bp, Homo sapiens
gccctgggattgggtggaggct

SEQ ID NO: 9138630 - DNA, 22 bp, Homo sapiens
gccctgggattgggtggaggct

SEQ ID NO: 9138631 - DNA, 22 bp, Homo sapiens
gccctgtgctcatgggaacatc

SEQ ID NO: 9138632 - DNA, 22 bp, Homo sapiens
gccctgtgcttggatggcagat

SEQ ID NO: 9138633 - DNA, 22 bp, Homo sapiens
gccctggcctggcgcgttgtca

SEQ ID NO: 9138634 - DNA, 22 bp, Homo sapiens
gccctggccttcatctcagaca

SEQ ID NO: 9138635 - DNA, 22 bp, Homo sapiens
gccctggccttcatctcagaca

SEQ ID NO: 9138636 - DNA, 22 bp, Homo sapiens
gccctggatggcaggagccatc

SEQ ID NO: 9138637 - DNA, 22 bp, Homo sapiens
gccctggatggcaggagccatc

SEQ ID NO: 9138638 - DNA, 22 bp, Homo sapiens
gccctggatgtacaggcatgtt

SEQ ID NO: 9138639 - DNA, 22 bp, Homo sapiens
gccctggatgtacaggcatgtt

SEQ ID NO: 9138640 - DNA, 22 bp, Homo sapiens
gcccagcctccaagctccaagg

SEQ ID NO: 9138641 - DNA, 22 bp, Homo sapiens
gcccagcctccaagctccaagg

SEQ ID NO: 9138642 - DNA, 22 bp, Homo sapiens
gcccagcctccaagctccaagg

SEQ ID NO: 9138643 - DNA, 22 bp, Homo sapiens
gcccagccctgaggtcacagct

SEQ ID NO: 9138644 - DNA, 22 bp, Homo sapiens
gcccagccctgaggtcacagct

SEQ ID NO: 9138645 - DNA, 22 bp, Homo sapiens
gcccagctccattcttggtgag

SEQ ID NO: 9138646 - DNA, 22 bp, Homo sapiens
gcccagctgcaccctggtgggt

SEQ ID NO: 9138647 - DNA, 22 bp, Homo sapiens
gcccagcactcctctctgacat

SEQ ID NO: 9138648 - DNA, 22 bp, Homo sapiens
gcccagcacctctctcagggtt

SEQ ID NO: 9138649 - DNA, 22 bp, Homo sapiens
gcccagcagatctcagtgtctc

SEQ ID NO: 9138650 - DNA, 22 bp, Homo sapiens
gcccagcagatctcagtgtctc

SEQ ID NO: 9138651 - DNA, 22 bp, Homo sapiens
gcccagccctgaggtcacagct

SEQ ID NO: 9138652 - DNA, 21 bp, Homo sapiens
gcccagcaaggtgagaaggcc

SEQ ID NO: 9138653 - DNA, 22 bp, Homo sapiens
gccaggtacatttaagaagcct

SEQ ID NO: 9138654 - DNA, 22 bp, Homo sapiens
gccaggtatgaattacgcacga

SEQ ID NO: 9138655 - DNA, 22 bp, Homo sapiens
gcccagcaaggaccaagggccg

SEQ ID NO: 9138656 - DNA, 22 bp, Homo sapiens
gcccagcacagctggaagagtc

SEQ ID NO: 9138657 - DNA, 22 bp, Homo sapiens
gcccagcacattgctgaggacc

SEQ ID NO: 9138658 - DNA, 22 bp, Homo sapiens
gccagggttcgaatccgtatgg

SEQ ID NO: 9138659 - DNA, 22 bp, Homo sapiens
gccaggggacgcggagcgacga

SEQ ID NO: 9138660 - DNA, 22 bp, Homo sapiens
gccccactttcctaggcagtat

SEQ ID NO: 9138661 - DNA, 22 bp, Homo sapiens
gccccacagcctgcggtctcag

SEQ ID NO: 9138662 - DNA, 22 bp, Homo sapiens
gccccaccgagggtgcagtcct

SEQ ID NO: 9138663 - DNA, 22 bp, Homo sapiens
gccccaagggagcccagcacac

SEQ ID NO: 9138664 - DNA, 22 bp, Homo sapiens
gcccatgtctgacagggtgggg

SEQ ID NO: 9138665 - DNA, 22 bp, Homo sapiens
gcccatggttacttttctggct

SEQ ID NO: 9138666 - DNA, 22 bp, Homo sapiens
gcccatggtcagggaggcaggg

SEQ ID NO: 9138667 - DNA, 22 bp, Homo sapiens
gcccatggtcagggaggcaggg

SEQ ID NO: 9138668 - DNA, 22 bp, Homo sapiens
gcccatgggcctgaggccctag

SEQ ID NO: 9138669 - DNA, 22 bp, Homo sapiens
gcccatggcttccctaggcaca

SEQ ID NO: 9138670 - DNA, 18 bp, Homo sapiens
gcccatggtaaatgctgt

SEQ ID NO: 9138671 - DNA, 22 bp, Homo sapiens
gcccatgggcctgaggccctag

SEQ ID NO: 9138672 - DNA, 22 bp, Homo sapiens
gcccaggagcctggagatgtgt

SEQ ID NO: 9138673 - DNA, 22 bp, Homo sapiens
gcccatggcttccctaggcaca

SEQ ID NO: 9138674 - DNA, 16 bp, Homo sapiens
gcccaggacgggaggc

SEQ ID NO: 9138675 - DNA, 22 bp, Homo sapiens
gcccaggagaggccagggctga

SEQ ID NO: 9138676 - DNA, 22 bp, Homo sapiens
gcccagctttttgaggcaggca

SEQ ID NO: 9138677 - DNA, 22 bp, Homo sapiens
gcccaggaaagatagggcctca

SEQ ID NO: 9138678 - DNA, 22 bp, Homo sapiens
gcccagctgtctggcagggatg

SEQ ID NO: 9138679 - DNA, 22 bp, Homo sapiens
gcccagcttttcacttccacac

SEQ ID NO: 9138680 - DNA, 22 bp, Homo sapiens
gcccaggaaatgccccgtggtg

SEQ ID NO: 9138681 - DNA, 22 bp, Homo sapiens
gcccaggaagccaccgggaagt

SEQ ID NO: 9138682 - DNA, 17 bp, Homo sapiens
gcccaggaaggacggcc

SEQ ID NO: 9138683 - DNA, 17 bp, Homo sapiens
gcccaggaaggacggcc

SEQ ID NO: 9138684 - DNA, 17 bp, Homo sapiens
gcccaggaaggacggcc

SEQ ID NO: 9138685 - DNA, 22 bp, Homo sapiens
gcccaggaagttgaggctgccg

SEQ ID NO: 9138686 - DNA, 22 bp, Homo sapiens
gcccaggaagttgaggctgccg

SEQ ID NO: 9138687 - DNA, 22 bp, Homo sapiens
gccaccatgtagcccattagag

SEQ ID NO: 9138688 - DNA, 22 bp, Homo sapiens
gccaccccaacctccctaagtt

SEQ ID NO: 9138689 - DNA, 21 bp, Homo sapiens
gccacccctggcacaggtgct

SEQ ID NO: 9138690 - DNA, 21 bp, Homo sapiens
gccacccctggcacaggtgct

SEQ ID NO: 9138691 - DNA, 20 bp, Homo sapiens
gccagccctgacacaggagc

SEQ ID NO: 9138692 - DNA, 20 bp, Homo sapiens
gccagccctgacacaggagc

SEQ ID NO: 9138693 - DNA, 22 bp, Homo sapiens
gccagccctgggagacttatgg

SEQ ID NO: 9138694 - DNA, 18 bp, Homo sapiens
gccagccctccaacctcc

SEQ ID NO: 9138695 - DNA, 18 bp, Homo sapiens
gccagccctccaacctcc

SEQ ID NO: 9138696 - DNA, 22 bp, Homo sapiens
gccagcctgtgcttggccaggc

SEQ ID NO: 9138697 - DNA, 22 bp, Homo sapiens
gccagccttctgtggcctgcaa

SEQ ID NO: 9138698 - DNA, 22 bp, Homo sapiens
gccagccttctgtggcctgcaa

SEQ ID NO: 9138699 - DNA, 22 bp, Homo sapiens
gccagctgaagggaagctcctg

SEQ ID NO: 9138700 - DNA, 22 bp, Homo sapiens
gccagctgaagggaagctcctg

SEQ ID NO: 9138701 - DNA, 22 bp, Homo sapiens
gccagctgaatttccaactgtt

SEQ ID NO: 9138702 - DNA, 22 bp, Homo sapiens
gccagctgaaatttcagttctg

SEQ ID NO: 9138703 - DNA, 22 bp, Homo sapiens
gccagctgaaatttcagttctg

SEQ ID NO: 9138704 - DNA, 22 bp, Homo sapiens
gccagctgaagggaagctcctg

SEQ ID NO: 9138705 - DNA, 22 bp, Homo sapiens
gccaggcactgctctaagccct

SEQ ID NO: 9138706 - DNA, 22 bp, Homo sapiens
gccagctcagatgcaggaagga

SEQ ID NO: 9138707 - DNA, 22 bp, Homo sapiens
gccagctcagatgcaggaagga

SEQ ID NO: 9138708 - DNA, 22 bp, Homo sapiens
gccagctcagatgcaggaagga

SEQ ID NO: 9138709 - DNA, 23 bp, Homo sapiens
gccagccttgctctcctgcagcc

SEQ ID NO: 9138710 - DNA, 22 bp, Homo sapiens
gccagctccgcaggatggcgcg

SEQ ID NO: 9138711 - DNA, 22 bp, Homo sapiens
gccagggagtctgggccacaga

SEQ ID NO: 9138712 - DNA, 22 bp, Homo sapiens
gccagggaggctgtagggtcct

SEQ ID NO: 9138713 - DNA, 22 bp, Homo sapiens
gccagggcaggggagcatctgc

SEQ ID NO: 9138714 - DNA, 22 bp, Homo sapiens
gccagggcaggggagcatctgc

SEQ ID NO: 9138715 - DNA, 22 bp, Homo sapiens
gccagggcaggggagcatctgc

SEQ ID NO: 9138716 - DNA, 22 bp, Homo sapiens
gccagggcaggggagcatctgc

SEQ ID NO: 9138717 - DNA, 22 bp, Homo sapiens
gccagggctcgcggtccctcgt

SEQ ID NO: 9138718 - DNA, 22 bp, Homo sapiens
gccagggctcgcggtccctcgt

SEQ ID NO: 9138719 - DNA, 22 bp, Homo sapiens
gccagggctgtgcaggtttgtt

SEQ ID NO: 9138720 - DNA, 22 bp, Homo sapiens
gccagggctgtgcaggtttgtt

SEQ ID NO: 9138721 - DNA, 17 bp, Homo sapiens
gccagggagaggaagcc

SEQ ID NO: 9138722 - DNA, 17 bp, Homo sapiens
gccagggagaggaagcc

SEQ ID NO: 9138723 - DNA, 21 bp, Homo sapiens
gccagggaagagagttggctg

SEQ ID NO: 9138724 - DNA, 21 bp, Homo sapiens
gccagggaagagagttggctg

SEQ ID NO: 9138725 - DNA, 21 bp, Homo sapiens
gccagggaagagagttggctg

SEQ ID NO: 9138726 - DNA, 22 bp, Homo sapiens
gccagggaacccaagggcctca

SEQ ID NO: 9138727 - DNA, 22 bp, Homo sapiens
gccagggaacccaagggcctca

SEQ ID NO: 9138728 - DNA, 22 bp, Homo sapiens
gccagggaacccaagggcctca

SEQ ID NO: 9138729 - DNA, 22 bp, Homo sapiens
gccaggcagcagcgaggatggt

SEQ ID NO: 9138730 - DNA, 22 bp, Homo sapiens
gccaggcagatatgtgagctta

SEQ ID NO: 9138731 - DNA, 22 bp, Homo sapiens
gccaggcagttcaagtacacca

SEQ ID NO: 9138732 - DNA, 22 bp, Homo sapiens
gccacaggcttaggagggaggt

SEQ ID NO: 9138733 - DNA, 22 bp, Homo sapiens
gccacaggcttaggagggaggt

SEQ ID NO: 9138734 - DNA, 22 bp, Homo sapiens
gccacatagaggaggatattaa

SEQ ID NO: 9138735 - DNA, 19 bp, Homo sapiens
gccacatctgtaccccttt

SEQ ID NO: 9138736 - DNA, 19 bp, Homo sapiens
gccacatcttttccagagt

SEQ ID NO: 9138737 - DNA, 22 bp, Homo sapiens
gccaccagcagaaaaggggcca

SEQ ID NO: 9138738 - DNA, 19 bp, Homo sapiens
gccacatcttttccagagt

SEQ ID NO: 9138739 - DNA, 22 bp, Homo sapiens
gccacatgtcatgtgctcagta

SEQ ID NO: 9138740 - DNA, 22 bp, Homo sapiens
gccaccagggggctccagtgag

SEQ ID NO: 9138741 - DNA, 22 bp, Homo sapiens
gccaccaggagcccagtccaaa

SEQ ID NO: 9138742 - DNA, 22 bp, Homo sapiens
gccaccaggttctgggttaagc

SEQ ID NO: 9138743 - DNA, 22 bp, Homo sapiens
gccaccagggggtgcaaggtcc

SEQ ID NO: 9138744 - DNA, 22 bp, Homo sapiens
gccaccagtgggggcctgggca

SEQ ID NO: 9138745 - DNA, 22 bp, Homo sapiens
gcatggctgctccctggctgca

SEQ ID NO: 9138746 - DNA, 22 bp, Homo sapiens
gcatggccttgctgtagtggta

SEQ ID NO: 9138747 - DNA, 22 bp, Homo sapiens
gcatggccttcagggacagctg

SEQ ID NO: 9138748 - DNA, 22 bp, Homo sapiens
gcatggccatggcactatggac

SEQ ID NO: 9138749 - DNA, 22 bp, Homo sapiens
gcatggccaggaaaggtagaaa

SEQ ID NO: 9138750 - DNA, 22 bp, Homo sapiens
gcatgctgcaccagagcctctc

SEQ ID NO: 9138751 - DNA, 22 bp, Homo sapiens
gcagtgggaaggttggcacatg

SEQ ID NO: 9138752 - DNA, 22 bp, Homo sapiens
gcagtgggagcttaggcagtgc

SEQ ID NO: 9138753 - DNA, 22 bp, Homo sapiens
gcagtggctaggagtctggcgt

SEQ ID NO: 9138754 - DNA, 22 bp, Homo sapiens
gcatgcagggagggtctggctg

SEQ ID NO: 9138755 - DNA, 22 bp, Homo sapiens
gcagtgggagcttaggcagtgc

SEQ ID NO: 9138756 - DNA, 22 bp, Homo sapiens
gcagtggatggccagcaggggc

SEQ ID NO: 9138757 - DNA, 22 bp, Homo sapiens
gcagtggatggccagcaggggc

SEQ ID NO: 9138758 - DNA, 22 bp, Homo sapiens
gcagtggatggccagcaggggc

SEQ ID NO: 9138759 - DNA, 22 bp, Homo sapiens
gcagtggatggccagcaggggc

SEQ ID NO: 9138760 - DNA, 17 bp, Homo sapiens
gcagtggaggggtagtt

SEQ ID NO: 9138761 - DNA, 17 bp, Homo sapiens
gcagtggaggggtagtt

SEQ ID NO: 9138762 - DNA, 22 bp, Homo sapiens
gcagtggatccaatggtatctt

SEQ ID NO: 9138763 - DNA, 23 bp, Homo sapiens
gcagtggaatgtctctgtttgga

SEQ ID NO: 9138764 - DNA, 23 bp, Homo sapiens
gcagtggaatgtctctgtttgga

SEQ ID NO: 9138765 - DNA, 17 bp, Homo sapiens
gcagtggaggggtagtt

SEQ ID NO: 9138766 - DNA, 22 bp, Homo sapiens
gcagtggcagctgagggggtat

SEQ ID NO: 9138767 - DNA, 22 bp, Homo sapiens
gcagtggcatgatgtgggctca

SEQ ID NO: 9138768 - DNA, 22 bp, Homo sapiens
gcagtggcatgatgtgggctca

SEQ ID NO: 9138769 - DNA, 22 bp, Homo sapiens
gcagtggcaccgctggctctgg

SEQ ID NO: 9138770 - DNA, 22 bp, Homo sapiens
gcaggggagtccactctatgca

SEQ ID NO: 9138771 - DNA, 22 bp, Homo sapiens
gcaggggagtggatgatggatt

SEQ ID NO: 9138772 - DNA, 22 bp, Homo sapiens
gcagtgacagggctgctgcctt

SEQ ID NO: 9138773 - DNA, 22 bp, Homo sapiens
gcagtgacatacctggagggca

SEQ ID NO: 9138774 - DNA, 22 bp, Homo sapiens
gcagtgaagccagatctgaaat

SEQ ID NO: 9138775 - DNA, 18 bp, Homo sapiens
gcagtgactatggggatc

SEQ ID NO: 9138776 - DNA, 22 bp, Homo sapiens
gcagtggaagcctctttaagca

SEQ ID NO: 9138777 - DNA, 22 bp, Homo sapiens
gcaggcagttatttagtagaat

SEQ ID NO: 9138778 - DNA, 19 bp, Homo sapiens
gcaggcagtggcattcgga

SEQ ID NO: 9138779 - DNA, 22 bp, Homo sapiens
gcaggcagtcatctttcatatt

SEQ ID NO: 9138780 - DNA, 22 bp, Homo sapiens
gcagggaagacccggagcagcg

SEQ ID NO: 9138781 - DNA, 22 bp, Homo sapiens
gcagggaagacccggagcagcg

SEQ ID NO: 9138782 - DNA, 22 bp, Homo sapiens
gcagggaagggaaacagagacc

SEQ ID NO: 9138783 - DNA, 22 bp, Homo sapiens
gcagggaagggaaacagagacc

SEQ ID NO: 9138784 - DNA, 22 bp, Homo sapiens
gcagggaaggggcatgctggag

SEQ ID NO: 9138785 - DNA, 21 bp, Homo sapiens
gcagggacaaagcttcaggag

SEQ ID NO: 9138786 - DNA, 21 bp, Homo sapiens
gcagggacaaagcttcaggag

SEQ ID NO: 9138787 - DNA, 21 bp, Homo sapiens
gcagggacaaagcttcaggag

SEQ ID NO: 9138788 - DNA, 22 bp, Homo sapiens
gcaggcagaggtggaggagaca

SEQ ID NO: 9138789 - DNA, 22 bp, Homo sapiens
gcaggacacagatgcaaggcca

SEQ ID NO: 9138790 - DNA, 16 bp, Homo sapiens
gcaggacactcagaca

SEQ ID NO: 9138791 - DNA, 16 bp, Homo sapiens
gcaggacactcagaca

SEQ ID NO: 9138792 - DNA, 16 bp, Homo sapiens
gcaggcagatcacatg

SEQ ID NO: 9138793 - DNA, 22 bp, Homo sapiens
gcaggcagagtcaatttgatcc

SEQ ID NO: 9138794 - DNA, 22 bp, Homo sapiens
gcaggcagatcacctgtcagga

SEQ ID NO: 9138795 - DNA, 22 bp, Homo sapiens
gcaggcagatcacctgtcagga

SEQ ID NO: 9138796 - DNA, 22 bp, Homo sapiens
gcaggcaggtggcatcttgtga

SEQ ID NO: 9138797 - DNA, 22 bp, Homo sapiens
gcaggcagccacgattcccttg

SEQ ID NO: 9138798 - DNA, 22 bp, Homo sapiens
gcagggaccaaaagaggcagta

SEQ ID NO: 9138799 - DNA, 21 bp, Homo sapiens
gcagggaccgcgacttctggg

SEQ ID NO: 9138800 - DNA, 21 bp, Homo sapiens
gcagggaccgcgacttctggg

SEQ ID NO: 9138801 - DNA, 22 bp, Homo sapiens
gcagggacctgccactgctgtc

SEQ ID NO: 9138802 - DNA, 22 bp, Homo sapiens
gcagggacctatgacgatggaa

SEQ ID NO: 9138803 - DNA, 22 bp, Homo sapiens
gcagggacctcactacccccag

SEQ ID NO: 9138804 - DNA, 22 bp, Homo sapiens
gcagggacaaggcaggtgttct

SEQ ID NO: 9138805 - DNA, 22 bp, Homo sapiens
gcagggacaactgtgcacctga

SEQ ID NO: 9138806 - DNA, 22 bp, Homo sapiens
gcagggacaactgtgcacctga

SEQ ID NO: 9138807 - DNA, 18 bp, Homo sapiens
gcagggacacagggtcac

SEQ ID NO: 9138808 - DNA, 18 bp, Homo sapiens
gcagggacacagggtcac

SEQ ID NO: 9138809 - DNA, 22 bp, Homo sapiens
gcagggacatctttgtctagta

SEQ ID NO: 9138810 - DNA, 22 bp, Homo sapiens
gcagggacatctttgtctagta

SEQ ID NO: 9138811 - DNA, 22 bp, Homo sapiens
gcagggacatcttcagatcact

SEQ ID NO: 9138812 - DNA, 22 bp, Homo sapiens
gcagggacagggcagggccttt

SEQ ID NO: 9138813 - DNA, 22 bp, Homo sapiens
gcagggacagggcagggccttt

SEQ ID NO: 9138814 - DNA, 22 bp, Homo sapiens
gcagggacagggcagggccttt

SEQ ID NO: 9138815 - DNA, 22 bp, Homo sapiens
gcagggcttgcagcagctagac

SEQ ID NO: 9138816 - DNA, 22 bp, Homo sapiens
gcagggcttagaaatggtggct

SEQ ID NO: 9138817 - DNA, 22 bp, Homo sapiens
gcagggctgtggacactttggt

SEQ ID NO: 9138818 - DNA, 22 bp, Homo sapiens
gcagggctgttcaggagggtgg

SEQ ID NO: 9138819 - DNA, 22 bp, Homo sapiens
gcagggctgaaggtcccaggcc

SEQ ID NO: 9138820 - DNA, 22 bp, Homo sapiens
gcagggctgggtcctgtctcat

SEQ ID NO: 9138821 - DNA, 22 bp, Homo sapiens
gcagggctgggtcctgtctcat

SEQ ID NO: 9138822 - DNA, 22 bp, Homo sapiens
gcagggctggggctgctcctga

SEQ ID NO: 9138823 - DNA, 22 bp, Homo sapiens
gcagggctggggctgctcctga

SEQ ID NO: 9138824 - DNA, 22 bp, Homo sapiens
gcagccctaacctgtcatagtg

SEQ ID NO: 9138825 - DNA, 22 bp, Homo sapiens
gcagccctaacctgtcatagtg

SEQ ID NO: 9138826 - DNA, 22 bp, Homo sapiens
gcagcccaggtgtagctctttg

SEQ ID NO: 9138827 - DNA, 22 bp, Homo sapiens
gcagcccataacatttgaggcc

SEQ ID NO: 9138828 - DNA, 22 bp, Homo sapiens
gcagcccataacatttgaggcc

SEQ ID NO: 9138829 - DNA, 22 bp, Homo sapiens
gcagccctcgctagctctcccc

SEQ ID NO: 9138830 - DNA, 22 bp, Homo sapiens
gcagccctgcagctccacaccg

SEQ ID NO: 9138831 - DNA, 22 bp, Homo sapiens
gcagccctcgggtactcacgtg

SEQ ID NO: 9138832 - DNA, 22 bp, Homo sapiens
gcagccctcgggtactcacgtg

SEQ ID NO: 9138833 - DNA, 22 bp, Homo sapiens
gcagccctcttggtcactaggc

SEQ ID NO: 9138834 - DNA, 22 bp, Homo sapiens
gcagcccaggtgtagctctttg

SEQ ID NO: 9138835 - DNA, 22 bp, Homo sapiens
gcagcccaggtctctctcactc

SEQ ID NO: 9138836 - DNA, 22 bp, Homo sapiens
gcagcccaggtggagtaatcta

SEQ ID NO: 9138837 - DNA, 22 bp, Homo sapiens
gcagcccaggctcgctcactgc

SEQ ID NO: 9138838 - DNA, 22 bp, Homo sapiens
gcagcccaggagcaggcgaccc

SEQ ID NO: 9138839 - DNA, 22 bp, Homo sapiens
gcagcccaggaggcgggagccc

SEQ ID NO: 9138840 - DNA, 22 bp, Homo sapiens
gcagcccaggaccctggacaga

SEQ ID NO: 9138841 - DNA, 22 bp, Homo sapiens
gcagcccagcagggcccggagc

SEQ ID NO: 9138842 - DNA, 22 bp, Homo sapiens
gcagcccacagctggaggccta

SEQ ID NO: 9138843 - DNA, 22 bp, Homo sapiens
gcagcccagagcgcaggacccc

SEQ ID NO: 9138844 - DNA, 22 bp, Homo sapiens
gcagatggtgggggaggagtac

SEQ ID NO: 9138845 - DNA, 22 bp, Homo sapiens
gcagatggtgggggaggagtac

SEQ ID NO: 9138846 - DNA, 22 bp, Homo sapiens
gcagatggatgtggacggcgcc

SEQ ID NO: 9138847 - DNA, 22 bp, Homo sapiens
gcagatggatcacctgaggtcg

SEQ ID NO: 9138848 - DNA, 22 bp, Homo sapiens
gcagatggagataaatggaact

SEQ ID NO: 9138849 - DNA, 18 bp, Homo sapiens
gcagatggagattcaggg

SEQ ID NO: 9138850 - DNA, 18 bp, Homo sapiens
gcagatggagattcaggg

SEQ ID NO: 9138851 - DNA, 23 bp, Homo sapiens
gcagatggccccagagtgctgcc

SEQ ID NO: 9138852 - DNA, 23 bp, Homo sapiens
gcagatggccccagagtgctgcc

SEQ ID NO: 9138853 - DNA, 23 bp, Homo sapiens
gcagatggccccagagtgctgcc

SEQ ID NO: 9138854 - DNA, 23 bp, Homo sapiens
gcagatggccccagagtgctgcc

SEQ ID NO: 9138855 - DNA, 22 bp, Homo sapiens
gcagatggcgcagtggaagttc

SEQ ID NO: 9138856 - DNA, 22 bp, Homo sapiens
gcagatggcagcccaggctggg

SEQ ID NO: 9138857 - DNA, 22 bp, Homo sapiens
gcagatggcagcccaggctggg

SEQ ID NO: 9138858 - DNA, 22 bp, Homo sapiens
gcagatggcagcccaggctggg

SEQ ID NO: 9138859 - DNA, 22 bp, Homo sapiens
gcagatggcagcccaggctggg

SEQ ID NO: 9138860 - DNA, 22 bp, Homo sapiens
gcagatgggagccccaggggag

SEQ ID NO: 9138861 - DNA, 21 bp, Homo sapiens
gcagatgggaagagacgaggc

SEQ ID NO: 9138862 - DNA, 21 bp, Homo sapiens
gcagatgggaagagacgaggc

SEQ ID NO: 9138863 - DNA, 22 bp, Homo sapiens
gcagatggctcagacactgggg

SEQ ID NO: 9138864 - DNA, 22 bp, Homo sapiens
gcagatggctcagacactgggg

SEQ ID NO: 9138865 - DNA, 22 bp, Homo sapiens
gcagatggctgagcctgcagat

SEQ ID NO: 9138866 - DNA, 22 bp, Homo sapiens
gcagatggctgagcctgcagat

SEQ ID NO: 9138867 - DNA, 21 bp, Homo sapiens
gcagatgggagtcatcaggct

SEQ ID NO: 9138868 - DNA, 21 bp, Homo sapiens
gcagatgggagtcatcaggct

SEQ ID NO: 9138869 - DNA, 15 bp, Homo sapiens
gcagatgggggtgat

SEQ ID NO: 9138870 - DNA, 22 bp, Homo sapiens
gcagatggtggggcaggaaaat

SEQ ID NO: 9138871 - DNA, 22 bp, Homo sapiens
gcagatggtggggcaggaaaat

SEQ ID NO: 9138872 - DNA, 22 bp, Homo sapiens
gcagatggtgccatgtcttgtg

SEQ ID NO: 9138873 - DNA, 22 bp, Homo sapiens
gcagatggtggaggcaagaggc

SEQ ID NO: 9138874 - DNA, 22 bp, Homo sapiens
gcagatggtggaggcaagaggc

SEQ ID NO: 9138875 - DNA, 22 bp, Homo sapiens
gcagatggtggaggcaagaggc

SEQ ID NO: 9138876 - DNA, 22 bp, Homo sapiens
gcagccctggcctggcctactt

SEQ ID NO: 9138877 - DNA, 22 bp, Homo sapiens
gcagccctgcaggcagctccag

SEQ ID NO: 9138878 - DNA, 22 bp, Homo sapiens
gcagctgtcatttacaacaggg

SEQ ID NO: 9138879 - DNA, 22 bp, Homo sapiens
gcagctgtcatttacaacaggg

SEQ ID NO: 9138880 - DNA, 22 bp, Homo sapiens
gcagctgtcgctaggagctgtg

SEQ ID NO: 9138881 - DNA, 22 bp, Homo sapiens
gcagctttcttgccctaatctt

SEQ ID NO: 9138882 - DNA, 20 bp, Homo sapiens
gcagctgtgcattcttagga

SEQ ID NO: 9138883 - DNA, 22 bp, Homo sapiens
gcagctgtcggaaagctaagtg

SEQ ID NO: 9138884 - DNA, 22 bp, Homo sapiens
gcagctgtcggaaagctaagtg

SEQ ID NO: 9138885 - DNA, 22 bp, Homo sapiens
gcaggaaaggttgagactttgc

SEQ ID NO: 9138886 - DNA, 22 bp, Homo sapiens
gcaggaaaggttgagactttgc

SEQ ID NO: 9138887 - DNA, 22 bp, Homo sapiens
gcaggaagaggctcgaagcccc

SEQ ID NO: 9138888 - DNA, 23 bp, Homo sapiens
gcaggaactcagggtaggcagca

SEQ ID NO: 9138889 - DNA, 22 bp, Homo sapiens
gcaggaagaggctcgaagcccc

SEQ ID NO: 9138890 - DNA, 22 bp, Homo sapiens
gcaggacaaaatttccagggtg

SEQ ID NO: 9138891 - DNA, 23 bp, Homo sapiens
gcaggacaacagagtgggaaggc

SEQ ID NO: 9138892 - DNA, 22 bp, Homo sapiens
gcaggaagggaaaggttgactc

SEQ ID NO: 9138893 - DNA, 22 bp, Homo sapiens
gcaggaagggaaaggttgactc

SEQ ID NO: 9138894 - DNA, 22 bp, Homo sapiens
gcaggaagggaaaggttgactc

SEQ ID NO: 9138895 - DNA, 22 bp, Homo sapiens
gcaggaagcatagaagaatgcc

SEQ ID NO: 9138896 - DNA, 22 bp, Homo sapiens
gcaggaagcatagaagaatgcc

SEQ ID NO: 9138897 - DNA, 22 bp, Homo sapiens
gcaggaagccttaccaagccca

SEQ ID NO: 9138898 - DNA, 22 bp, Homo sapiens
gcaggaagccttaccaagccca

SEQ ID NO: 9138899 - DNA, 22 bp, Homo sapiens
gcagaggcatttctgacgctgc

SEQ ID NO: 9138900 - DNA, 22 bp, Homo sapiens
gcagaggccaggccaccagcaa

SEQ ID NO: 9138901 - DNA, 22 bp, Homo sapiens
gcagatggaaagtgcttgaggg

SEQ ID NO: 9138902 - DNA, 22 bp, Homo sapiens
gcagatggaaagtgcttgaggg

SEQ ID NO: 9138903 - DNA, 22 bp, Homo sapiens
gcagatggaaagtgcttgaggg

SEQ ID NO: 9138904 - DNA, 22 bp, Homo sapiens
gcagatggagacgaggttccgc

SEQ ID NO: 9138905 - DNA, 22 bp, Homo sapiens
gcagatggagacgaggttccgc

SEQ ID NO: 9138906 - DNA, 22 bp, Homo sapiens
gcagatggactgtatgacctga

SEQ ID NO: 9138907 - DNA, 22 bp, Homo sapiens
gcagaggtctagcaccaagaat

SEQ ID NO: 9138908 - DNA, 22 bp, Homo sapiens
gcagaggtctcttcaaaataat

SEQ ID NO: 9138909 - DNA, 22 bp, Homo sapiens
gcagaggatcaggctctggaaa

SEQ ID NO: 9138910 - DNA, 22 bp, Homo sapiens
gcagaggatagcatatgaacct

SEQ ID NO: 9138911 - DNA, 22 bp, Homo sapiens
gcagaggatagcatatgaacct

SEQ ID NO: 9138912 - DNA, 21 bp, Homo sapiens
gcagaggcacggcaccaaggg

SEQ ID NO: 9138913 - DNA, 22 bp, Homo sapiens
gcagaggcacagccccagatga

SEQ ID NO: 9138914 - DNA, 22 bp, Homo sapiens
gcagaggcagggccctcctcca

SEQ ID NO: 9138915 - DNA, 22 bp, Homo sapiens
gcagaggagtgattatgccgtg

SEQ ID NO: 9138916 - DNA, 22 bp, Homo sapiens
gcagagcagaggtgcaggttgg

SEQ ID NO: 9138917 - DNA, 18 bp, Homo sapiens
gcagagcagaagctcaag

SEQ ID NO: 9138918 - DNA, 22 bp, Homo sapiens
gcagagcaggaaggaagtcagg

SEQ ID NO: 9138919 - DNA, 22 bp, Homo sapiens
gcagagcagcaaatggaaagga

SEQ ID NO: 9138920 - DNA, 22 bp, Homo sapiens
gcagactgcgagcgtgctggtg

SEQ ID NO: 9138921 - DNA, 22 bp, Homo sapiens
gcagactgtacctggaagaggg

SEQ ID NO: 9138922 - DNA, 22 bp, Homo sapiens
gcagacatgtgttctaacagga

SEQ ID NO: 9138923 - DNA, 22 bp, Homo sapiens
gcagacatgaccaccaaccagg

SEQ ID NO: 9138924 - DNA, 22 bp, Homo sapiens
gcagagaaagttttgtcctcag

SEQ ID NO: 9138925 - DNA, 22 bp, Homo sapiens
gcagagaaagttttgtcctcag

SEQ ID NO: 9138926 - DNA, 22 bp, Homo sapiens
gcagagaacccagcagattggc

SEQ ID NO: 9138927 - DNA, 22 bp, Homo sapiens
gcagagaacccagcagattggc

SEQ ID NO: 9138928 - DNA, 22 bp, Homo sapiens
gcagagaagatgcccaggcttc

SEQ ID NO: 9138929 - DNA, 22 bp, Homo sapiens
gcagagcaccaaagtgaaagat

SEQ ID NO: 9138930 - DNA, 22 bp, Homo sapiens
gcacagttaaagggtcatgtga

SEQ ID NO: 9138931 - DNA, 22 bp, Homo sapiens
gcacataaagggcatgggaggt

SEQ ID NO: 9138932 - DNA, 22 bp, Homo sapiens
gcacataactgaccacatctaa

SEQ ID NO: 9138933 - DNA, 19 bp, Homo sapiens
gcagacaggtccagagagg

SEQ ID NO: 9138934 - DNA, 19 bp, Homo sapiens
gcagacaggtccagagagg

SEQ ID NO: 9138935 - DNA, 22 bp, Homo sapiens
gcacatctggagctctgtggaa

SEQ ID NO: 9138936 - DNA, 23 bp, Homo sapiens
gcacatagtaagtaagcagacat

SEQ ID NO: 9138937 - DNA, 22 bp, Homo sapiens
gcacatactgcaaagattacta

SEQ ID NO: 9138938 - DNA, 22 bp, Homo sapiens
gcacatacccactgtcaagcac

SEQ ID NO: 9138939 - DNA, 22 bp, Homo sapiens
gcacacaggggagttctcagaa

SEQ ID NO: 9138940 - DNA, 22 bp, Homo sapiens
gcacacagaatcagtgggcata

SEQ ID NO: 9138941 - DNA, 19 bp, Homo sapiens
gcacacagtagggctggca

SEQ ID NO: 9138942 - DNA, 19 bp, Homo sapiens
gcacacagtagggctggca

SEQ ID NO: 9138943 - DNA, 19 bp, Homo sapiens
gcacacagtagggctggca

SEQ ID NO: 9138944 - DNA, 22 bp, Homo sapiens
gcacacagtagggattcaatga

SEQ ID NO: 9138945 - DNA, 22 bp, Homo sapiens
gcaaatatttctaattcctgaa

SEQ ID NO: 9138946 - DNA, 22 bp, Homo sapiens
gcacacactgttttcctcacat

SEQ ID NO: 9138947 - DNA, 22 bp, Homo sapiens
gcacacagaatcagtgggcata

SEQ ID NO: 9138948 - DNA, 22 bp, Homo sapiens
gcacacagaatcagtgggcata

SEQ ID NO: 9138949 - DNA, 22 bp, Homo sapiens
gcacacagtatatgctcattaa

SEQ ID NO: 9138950 - DNA, 22 bp, Homo sapiens
gcacacagtatatgctcattaa

SEQ ID NO: 9138951 - DNA, 22 bp, Homo sapiens
gcacacattcggattcttaacc

SEQ ID NO: 9138952 - DNA, 22 bp, Homo sapiens
gcacacattctagccttttgtg

SEQ ID NO: 9138953 - DNA, 22 bp, Homo sapiens
gcacacatgcatgcacaggagt

SEQ ID NO: 9138954 - DNA, 21 bp, Homo sapiens
gcacagtaagaaaagctgcct

SEQ ID NO: 9138955 - DNA, 22 bp, Homo sapiens
gcacagtattgcacaactctag

SEQ ID NO: 9138956 - DNA, 22 bp, Homo sapiens
gcacagtaggctcagctctatc

SEQ ID NO: 9138957 - DNA, 22 bp, Homo sapiens
gcacagtgataggcagttgtgc

SEQ ID NO: 9138958 - DNA, 22 bp, Homo sapiens
gcacagtgataggcagttgtgc

SEQ ID NO: 9138959 - DNA, 22 bp, Homo sapiens
gcacagtatttagtagaatgag

SEQ ID NO: 9138960 - DNA, 22 bp, Homo sapiens
gcacaggctccggaggagagct

SEQ ID NO: 9138961 - DNA, 22 bp, Homo sapiens
gcacaggctccggaggagagct

SEQ ID NO: 9138962 - DNA, 22 bp, Homo sapiens
gcacagggctgccaggcggctt

SEQ ID NO: 9138963 - DNA, 22 bp, Homo sapiens
gcacagggctgccaggcggctt

SEQ ID NO: 9138964 - DNA, 22 bp, Homo sapiens
gcacagaacactggtgagtccc

SEQ ID NO: 9138965 - DNA, 22 bp, Homo sapiens
gcacagaacagagaaatagcca

SEQ ID NO: 9138966 - DNA, 22 bp, Homo sapiens
gcacaggccatgggaggacagc

SEQ ID NO: 9138967 - DNA, 22 bp, Homo sapiens
gcacaggccatgggaggacagc

SEQ ID NO: 9138968 - DNA, 22 bp, Homo sapiens
gcacaggctccggaggagagct

SEQ ID NO: 9138969 - DNA, 22 bp, Homo sapiens
gcacaggctccggaggagagct

SEQ ID NO: 9138970 - DNA, 22 bp, Homo sapiens
gcacactgcggtgatgtgagtc

SEQ ID NO: 9138971 - DNA, 22 bp, Homo sapiens
gcaaagatattagaatagagta

SEQ ID NO: 9138972 - DNA, 22 bp, Homo sapiens
gcaaagatattagaatagagta

SEQ ID NO: 9138973 - DNA, 22 bp, Homo sapiens
gcaaagaatgcagatttgcctc

SEQ ID NO: 9138974 - DNA, 22 bp, Homo sapiens
gcaaagaaatgtcagtgagagg

SEQ ID NO: 9138975 - DNA, 22 bp, Homo sapiens
gcaaagaaatgtcagtgagagg

SEQ ID NO: 9138976 - DNA, 22 bp, Homo sapiens
gcaaagaaagccaaggtctaac

SEQ ID NO: 9138977 - DNA, 22 bp, Homo sapiens
gcaaagaaagttttaatgaggt

SEQ ID NO: 9138978 - DNA, 22 bp, Homo sapiens
gaggccagtgtgctgtgttttc

SEQ ID NO: 9138979 - DNA, 22 bp, Homo sapiens
gaggccaggaggatctctctaa

SEQ ID NO: 9138980 - DNA, 22 bp, Homo sapiens
gcaaaggctagagacacaggga

SEQ ID NO: 9138981 - DNA, 22 bp, Homo sapiens
gcaaaggccactggggcgatgg

SEQ ID NO: 9138982 - DNA, 17 bp, Homo sapiens
gcaaaggtgaggagaga

SEQ ID NO: 9138983 - DNA, 22 bp, Homo sapiens
gcaaataaatgctcactgctgt

SEQ ID NO: 9138984 - DNA, 22 bp, Homo sapiens
gcaaatacatgttgagcaccta

SEQ ID NO: 9138985 - DNA, 22 bp, Homo sapiens
gcaaagcagaaccctctctatc

SEQ ID NO: 9138986 - DNA, 22 bp, Homo sapiens
gcaaagcacactggagatgtcg

SEQ ID NO: 9138987 - DNA, 22 bp, Homo sapiens
gcaaagcagtcttctgtgccta

SEQ ID NO: 9138988 - DNA, 22 bp, Homo sapiens
gcaaagcatcagtagaaatgtt

SEQ ID NO: 9138989 - DNA, 22 bp, Homo sapiens
gcaaagcattctgtggagtcta

SEQ ID NO: 9138990 - DNA, 22 bp, Homo sapiens
gcaaagcattctgtggagtcta

SEQ ID NO: 9138991 - DNA, 22 bp, Homo sapiens
gcaaagctgggtgtgaatgcac

SEQ ID NO: 9138992 - DNA, 22 bp, Homo sapiens
gcaaagcaagctgtcagcctca

SEQ ID NO: 9138993 - DNA, 22 bp, Homo sapiens
gcaaagcacaccctcagagttt

SEQ ID NO: 9138994 - DNA, 22 bp, Homo sapiens
gcaaagcaatcaggagtagcat

SEQ ID NO: 9138995 - DNA, 22 bp, Homo sapiens
gcaaagcaaatgcctgaaggcg

SEQ ID NO: 9138996 - DNA, 22 bp, Homo sapiens
gcaaagcaaatgcctgaaggcg

SEQ ID NO: 9138997 - DNA, 22 bp, Homo sapiens
gcaaagcaagattcagatgtag

SEQ ID NO: 9138998 - DNA, 19 bp, Homo sapiens
gctcagagtccccctgcgg

SEQ ID NO: 9138999 - DNA, 22 bp, Homo sapiens
gctcagagtggcctggctaggg

SEQ ID NO: 9139000 - DNA, 22 bp, Homo sapiens
gctcagagtggcctggctaggg

SEQ ID NO: 9139001 - DNA, 22 bp, Homo sapiens
gctcagagggttttggccaagt

SEQ ID NO: 9139002 - DNA, 22 bp, Homo sapiens
gctcagagggttttggccaagt

SEQ ID NO: 9139003 - DNA, 23 bp, Homo sapiens
gctcagaggtttttctctggatg

SEQ ID NO: 9139004 - DNA, 22 bp, Homo sapiens
gctcagagcttgaagttccact

SEQ ID NO: 9139005 - DNA, 22 bp, Homo sapiens
gctcagaggaggcctttaccta

SEQ ID NO: 9139006 - DNA, 22 bp, Homo sapiens
gctacaggtgacagcctctgca

SEQ ID NO: 9139007 - DNA, 22 bp, Homo sapiens
gctacagtgataggaaacacat

SEQ ID NO: 9139008 - DNA, 22 bp, Homo sapiens
gctaccctgggaatctccctca

SEQ ID NO: 9139009 - DNA, 23 bp, Homo sapiens
gctcagatgccctaggaggtggc

SEQ ID NO: 9139010 - DNA, 22 bp, Homo sapiens
gctcagccgaacttcagagcag

SEQ ID NO: 9139011 - DNA, 22 bp, Homo sapiens
gctcagctatcagtgttcctga

SEQ ID NO: 9139012 - DNA, 22 bp, Homo sapiens
gctccagggagtacatttatca

SEQ ID NO: 9139013 - DNA, 22 bp, Homo sapiens
gctccagggacccaagagaaaa

SEQ ID NO: 9139014 - DNA, 22 bp, Homo sapiens
gctccagggagtacatttatca

SEQ ID NO: 9139015 - DNA, 22 bp, Homo sapiens
gctccagggacccaagagaaaa

SEQ ID NO: 9139016 - DNA, 22 bp, Homo sapiens
gctccagggtcagctcagaact

SEQ ID NO: 9139017 - DNA, 22 bp, Homo sapiens
gctccagggtggatgacaattc

SEQ ID NO: 9139018 - DNA, 22 bp, Homo sapiens
gctccagggtggatgacaattc

SEQ ID NO: 9139019 - DNA, 22 bp, Homo sapiens
gctccagggtcagctcagaact

SEQ ID NO: 9139020 - DNA, 22 bp, Homo sapiens
gctccaggataataaagttgtt

SEQ ID NO: 9139021 - DNA, 22 bp, Homo sapiens
gctccaggcagagcctctttcg

SEQ ID NO: 9139022 - DNA, 22 bp, Homo sapiens
gctccaggaggctcccgcgtct

SEQ ID NO: 9139023 - DNA, 22 bp, Homo sapiens
gctccaggaggctcccgcgtct

SEQ ID NO: 9139024 - DNA, 22 bp, Homo sapiens
gctccaggaggatgaccttcct

SEQ ID NO: 9139025 - DNA, 22 bp, Homo sapiens
gctccaggtgtcccaggtaaaa

SEQ ID NO: 9139026 - DNA, 22 bp, Homo sapiens
gctccaggtgtcccaggtaaaa

SEQ ID NO: 9139027 - DNA, 22 bp, Homo sapiens
gctccaggtggcttatttgtat

SEQ ID NO: 9139028 - DNA, 22 bp, Homo sapiens
gctccaggtggcttatttgtat

SEQ ID NO: 9139029 - DNA, 22 bp, Homo sapiens
gctccaggtggcttatttgtat

SEQ ID NO: 9139030 - DNA, 20 bp, Homo sapiens
gctccaggtcagagaggacg

SEQ ID NO: 9139031 - DNA, 22 bp, Homo sapiens
gctccaggtatttgccctttta

SEQ ID NO: 9139032 - DNA, 22 bp, Homo sapiens
gctccaggtatttgccctttta

SEQ ID NO: 9139033 - DNA, 22 bp, Homo sapiens
gctccaggtgaatcctctcacc

SEQ ID NO: 9139034 - DNA, 22 bp, Homo sapiens
gctccaggtgaatcctctcacc

SEQ ID NO: 9139035 - DNA, 22 bp, Homo sapiens
gctccaggtgaatcctctcacc

SEQ ID NO: 9139036 - DNA, 20 bp, Homo sapiens
gctccaggtcagagaggacg

SEQ ID NO: 9139037 - DNA, 22 bp, Homo sapiens
gctcccagaaccaaggctgggg

SEQ ID NO: 9139038 - DNA, 22 bp, Homo sapiens
gctcccagaaccaaggctgggg

SEQ ID NO: 9139039 - DNA, 22 bp, Homo sapiens
gctcccacctccagcctgagtt

SEQ ID NO: 9139040 - DNA, 22 bp, Homo sapiens
gctccctggaatgttggctgcc

SEQ ID NO: 9139041 - DNA, 21 bp, Homo sapiens
gctccctgctcagctcctggg

SEQ ID NO: 9139042 - DNA, 21 bp, Homo sapiens
gctccctgctcagctcctggg

SEQ ID NO: 9139043 - DNA, 22 bp, Homo sapiens
gctccctggcttttacagtgta

SEQ ID NO: 9139044 - DNA, 22 bp, Homo sapiens
gctccctggtattgctgccact

SEQ ID NO: 9139045 - DNA, 22 bp, Homo sapiens
gctccctggtagccatgctctc

SEQ ID NO: 9139046 - DNA, 22 bp, Homo sapiens
gctccctggtagccatgctctc

SEQ ID NO: 9139047 - DNA, 17 bp, Homo sapiens
gctccctgaggacagct

SEQ ID NO: 9139048 - DNA, 17 bp, Homo sapiens
gctccctgaggacagct

SEQ ID NO: 9139049 - DNA, 22 bp, Homo sapiens
gctccctgactcagttcctgag

SEQ ID NO: 9139050 - DNA, 22 bp, Homo sapiens
gctccctgcactctgcagccct

SEQ ID NO: 9139051 - DNA, 22 bp, Homo sapiens
gctccctgcagctgagagttcc

SEQ ID NO: 9139052 - DNA, 22 bp, Homo sapiens
gctccctgcatttcccaccctt

SEQ ID NO: 9139053 - DNA, 21 bp, Homo sapiens
gctccctgctcagctcctggg

SEQ ID NO: 9139054 - DNA, 22 bp, Homo sapiens
gccttgggattcttggatgctc

SEQ ID NO: 9139055 - DNA, 22 bp, Homo sapiens
gccttgggacggaggggtcacc

SEQ ID NO: 9139056 - DNA, 22 bp, Homo sapiens
gccttgggaaagtgggaggaga

SEQ ID NO: 9139057 - DNA, 22 bp, Homo sapiens
gccttgggccagctgctctgga

SEQ ID NO: 9139058 - DNA, 22 bp, Homo sapiens
gccttgggggtgaaagaggcta

SEQ ID NO: 9139059 - DNA, 22 bp, Homo sapiens
gccttgggcacaggcagggccc

SEQ ID NO: 9139060 - DNA, 22 bp, Homo sapiens
gccttggaaagctggagcagtt

SEQ ID NO: 9139061 - DNA, 22 bp, Homo sapiens
gccttgctaatttctcctcaac

SEQ ID NO: 9139062 - DNA, 22 bp, Homo sapiens
gccttggactaccactcccaca

SEQ ID NO: 9139063 - DNA, 20 bp, Homo sapiens
gcctgagctattgccaggat

SEQ ID NO: 9139064 - DNA, 20 bp, Homo sapiens
gcctgagctattgccaggat

SEQ ID NO: 9139065 - DNA, 22 bp, Homo sapiens
gcctctgggttggtgacaggct

SEQ ID NO: 9139066 - DNA, 22 bp, Homo sapiens
gcctctggtccctcatgctgtg

SEQ ID NO: 9139067 - DNA, 22 bp, Homo sapiens
gcctctggtccctcatgctgtg

SEQ ID NO: 9139068 - DNA, 22 bp, Homo sapiens
gcctctggtccctcatgctgtg

SEQ ID NO: 9139069 - DNA, 22 bp, Homo sapiens
gcctctggtccctcatgctgtg

SEQ ID NO: 9139070 - DNA, 22 bp, Homo sapiens
gcctgagcaggcgtggaccatg

SEQ ID NO: 9139071 - DNA, 21 bp, Homo sapiens
gcctgagcatgtcttcaggtc

SEQ ID NO: 9139072 - DNA, 21 bp, Homo sapiens
gcctgagcatgtcttcaggtc

SEQ ID NO: 9139073 - DNA, 18 bp, Homo sapiens
gcctctgttgcttgcctg

SEQ ID NO: 9139074 - DNA, 22 bp, Homo sapiens
gcctgagcagctatacacacag

SEQ ID NO: 9139075 - DNA, 22 bp, Homo sapiens
gcctctgtggctcagccttgct

SEQ ID NO: 9139076 - DNA, 22 bp, Homo sapiens
gccttgggtttcctatcctgag

SEQ ID NO: 9139077 - DNA, 22 bp, Homo sapiens
gcctttattgtttattcagtgc

SEQ ID NO: 9139078 - DNA, 22 bp, Homo sapiens
gcgggtggatcatgaggtcagg

SEQ ID NO: 9139079 - DNA, 18 bp, Homo sapiens
gcctttgcacaagcagct

SEQ ID NO: 9139080 - DNA, 18 bp, Homo sapiens
gcctttgcacaagcagct

SEQ ID NO: 9139081 - DNA, 22 bp, Homo sapiens
gcctttcctgctctggcattca

SEQ ID NO: 9139082 - DNA, 22 bp, Homo sapiens
gcggtagctcaagcttgtaatc

SEQ ID NO: 9139083 - DNA, 22 bp, Homo sapiens
gcggtggggaaaggaggtgctg

SEQ ID NO: 9139084 - DNA, 22 bp, Homo sapiens
gcggtggggaaaggaggtgctg

SEQ ID NO: 9139085 - DNA, 23 bp, Homo sapiens
gcgtcaggactgttttgtgaccc

SEQ ID NO: 9139086 - DNA, 22 bp, Homo sapiens
gcggtgggggaaaggagcggtt

SEQ ID NO: 9139087 - DNA, 22 bp, Homo sapiens
gcgtggggcagcccagggcttc

SEQ ID NO: 9139088 - DNA, 22 bp, Homo sapiens
gcgtggggcagcccagggcttc

SEQ ID NO: 9139089 - DNA, 22 bp, Homo sapiens
gcgtggggcagcccagggcttc

SEQ ID NO: 9139090 - DNA, 22 bp, Homo sapiens
gctacaggagataaaggcctct

SEQ ID NO: 9139091 - DNA, 22 bp, Homo sapiens
gctgagggatagctgctcactg

SEQ ID NO: 9139092 - DNA, 22 bp, Homo sapiens
gctgagggaccatgtttcagga

SEQ ID NO: 9139093 - DNA, 22 bp, Homo sapiens
gctgagggaccatgtttcagga

SEQ ID NO: 9139094 - DNA, 22 bp, Homo sapiens
gctgagggaccatgtttcagga

SEQ ID NO: 9139095 - DNA, 22 bp, Homo sapiens
gctgaggctgggagcagcctgt

SEQ ID NO: 9139096 - DNA, 22 bp, Homo sapiens
gctgagagtgggtgcagtgctt

SEQ ID NO: 9139097 - DNA, 22 bp, Homo sapiens
gctgagagtgagcactggatat

SEQ ID NO: 9139098 - DNA, 22 bp, Homo sapiens
gctgagagatcaaggcaggatt

SEQ ID NO: 9139099 - DNA, 22 bp, Homo sapiens
gctgagactggcagcaggaagt

SEQ ID NO: 9139100 - DNA, 23 bp, Homo sapiens
gctgaattaagcaatgaagaaat

SEQ ID NO: 9139101 - DNA, 22 bp, Homo sapiens
gctgacaatgagaaagagcaaa

SEQ ID NO: 9139102 - DNA, 22 bp, Homo sapiens
gctgacaatgagaaagagcaaa

SEQ ID NO: 9139103 - DNA, 22 bp, Homo sapiens
gctgagagcaaagcatgtctag

SEQ ID NO: 9139104 - DNA, 22 bp, Homo sapiens
gctgagagcaaggacaaagcat

SEQ ID NO: 9139105 - DNA, 22 bp, Homo sapiens
gctgagagtccaggaaaacatc

SEQ ID NO: 9139106 - DNA, 22 bp, Homo sapiens
gctgagagtgagcactggatat

SEQ ID NO: 9139107 - DNA, 22 bp, Homo sapiens
gctgagagtccaggaaaacatc

SEQ ID NO: 9139108 - DNA, 17 bp, Homo sapiens
gctgagaggcagcacag

SEQ ID NO: 9139109 - DNA, 22 bp, Homo sapiens
gctctgggattaccagccttag

SEQ ID NO: 9139110 - DNA, 22 bp, Homo sapiens
gctctgggattaccagccttag

SEQ ID NO: 9139111 - DNA, 20 bp, Homo sapiens
gctctgggagggatgtgatg

SEQ ID NO: 9139112 - DNA, 22 bp, Homo sapiens
gctctgggaattcagaaagcct

SEQ ID NO: 9139113 - DNA, 22 bp, Homo sapiens
gctctgggccatcctggccggg

SEQ ID NO: 9139114 - DNA, 22 bp, Homo sapiens
gctctgggccatcctggccggg

SEQ ID NO: 9139115 - DNA, 22 bp, Homo sapiens
gctctgggccgggcaccagcct

SEQ ID NO: 9139116 - DNA, 22 bp, Homo sapiens
gctctgggccgggcaccagcct

SEQ ID NO: 9139117 - DNA, 22 bp, Homo sapiens
gctctgggccgggcaccagcct

SEQ ID NO: 9139118 - DNA, 22 bp, Homo sapiens
gctctgggctgccctctggaca

SEQ ID NO: 9139119 - DNA, 22 bp, Homo sapiens
gctctgggctgccctctggaca

SEQ ID NO: 9139120 - DNA, 22 bp, Homo sapiens
gctctggggatgcttctgccgt

SEQ ID NO: 9139121 - DNA, 22 bp, Homo sapiens
gctctgggctgaatcatttatc

SEQ ID NO: 9139122 - DNA, 22 bp, Homo sapiens
gctctgggctgaatcatttatc

SEQ ID NO: 9139123 - DNA, 22 bp, Homo sapiens
gctctgggctgccctctggaca

SEQ ID NO: 9139124 - DNA, 22 bp, Homo sapiens
gctgaatgaatgtattttaaaa

SEQ ID NO: 9139125 - DNA, 22 bp, Homo sapiens
gctctggggatgcttctgccgt

SEQ ID NO: 9139126 - DNA, 22 bp, Homo sapiens
gctctggggcccagggatcaca

SEQ ID NO: 9139127 - DNA, 18 bp, Homo sapiens
gctctggctcacctccag

SEQ ID NO: 9139128 - DNA, 18 bp, Homo sapiens
gctctggctcacctccag

SEQ ID NO: 9139129 - DNA, 22 bp, Homo sapiens
gctctggctcaaaccaccggct

SEQ ID NO: 9139130 - DNA, 22 bp, Homo sapiens
gctctggctcaaaccaccggct

SEQ ID NO: 9139131 - DNA, 22 bp, Homo sapiens
gctctggctcaaaccaccggct

SEQ ID NO: 9139132 - DNA, 22 bp, Homo sapiens
gctctggcttggggcactcgtc

SEQ ID NO: 9139133 - DNA, 22 bp, Homo sapiens
gctctgggaactgactgccttc

SEQ ID NO: 9139134 - DNA, 22 bp, Homo sapiens
gctctgggaaggatcgtagtga

SEQ ID NO: 9139135 - DNA, 22 bp, Homo sapiens
gctctgggaagtcctttaccat

SEQ ID NO: 9139136 - DNA, 22 bp, Homo sapiens
gctctgggaaggatcgtagtga

SEQ ID NO: 9139137 - DNA, 22 bp, Homo sapiens
gctctgggaaggatcgtagtga

SEQ ID NO: 9139138 - DNA, 22 bp, Homo sapiens
gctctgggaattcagaaagcct

SEQ ID NO: 9139139 - DNA, 22 bp, Homo sapiens
gctccctgttctcagccatgat

SEQ ID NO: 9139140 - DNA, 22 bp, Homo sapiens
gctccctgttctcagccatgat

SEQ ID NO: 9139141 - DNA, 22 bp, Homo sapiens
gctcctccaatatggactcctc

SEQ ID NO: 9139142 - DNA, 22 bp, Homo sapiens
gctccgccacgcccactcctac

SEQ ID NO: 9139143 - DNA, 22 bp, Homo sapiens
gctccctgtgggatgaggcgcc

SEQ ID NO: 9139144 - DNA, 22 bp, Homo sapiens
gctcctctattccccacatttt

SEQ ID NO: 9139145 - DNA, 22 bp, Homo sapiens
gctctggctagttacctcttac

SEQ ID NO: 9139146 - DNA, 22 bp, Homo sapiens
gctcctctattccccacatttt

SEQ ID NO: 9139147 - DNA, 22 bp, Homo sapiens
gctcctctattccccacatttt

SEQ ID NO: 9139148 - DNA, 22 bp, Homo sapiens
gctgcgccggatcccacgttcc

SEQ ID NO: 9139149 - DNA, 22 bp, Homo sapiens
gctgcgccggatcccacgttcc

SEQ ID NO: 9139150 - DNA, 22 bp, Homo sapiens
gctgctaagcgtttctgttcca

SEQ ID NO: 9139151 - DNA, 22 bp, Homo sapiens
gctgctacaacagaataccata

SEQ ID NO: 9139152 - DNA, 22 bp, Homo sapiens
gctgccttatgtctattagtat

SEQ ID NO: 9139153 - DNA, 22 bp, Homo sapiens
gctgcctgtgtggccactcact

SEQ ID NO: 9139154 - DNA, 22 bp, Homo sapiens
gctgcctgtgtggccactcact

SEQ ID NO: 9139155 - DNA, 22 bp, Homo sapiens
gctgcctgtctgctgacccagg

SEQ ID NO: 9139156 - DNA, 19 bp, Homo sapiens
gctgcctgtcttagccagt

SEQ ID NO: 9139157 - DNA, 22 bp, Homo sapiens
gctgcctgtgcgggtcgctagg

SEQ ID NO: 9139158 - DNA, 22 bp, Homo sapiens
gctgcttctcctccctggggat

SEQ ID NO: 9139159 - DNA, 22 bp, Homo sapiens
gctgcttgattaggttgacact

SEQ ID NO: 9139160 - DNA, 22 bp, Homo sapiens
gctgctgttcctccagtggatc

SEQ ID NO: 9139161 - DNA, 22 bp, Homo sapiens
gctgctgttcctccagtggatc

SEQ ID NO: 9139162 - DNA, 22 bp, Homo sapiens
gctgctgttgatttagtccaat

SEQ ID NO: 9139163 - DNA, 22 bp, Homo sapiens
gctgctgttgatttagtccaat

SEQ ID NO: 9139164 - DNA, 22 bp, Homo sapiens
gctgctgtgtgggagacaggcg

SEQ ID NO: 9139165 - DNA, 21 bp, Homo sapiens
gctgctgtgggccagggaggc

SEQ ID NO: 9139166 - DNA, 22 bp, Homo sapiens
gctgctgttcctccagtggatc

SEQ ID NO: 9139167 - DNA, 22 bp, Homo sapiens
gctgctgttatgatgttacttt

SEQ ID NO: 9139168 - DNA, 22 bp, Homo sapiens
gctgctgtgaattttttaaatg

SEQ ID NO: 9139169 - DNA, 22 bp, Homo sapiens
gctgctgtgaattttttaaatg

SEQ ID NO: 9139170 - DNA, 21 bp, Homo sapiens
gctgctcgagatccagtgctt

SEQ ID NO: 9139171 - DNA, 19 bp, Homo sapiens
gctgctcctggctgaccac

SEQ ID NO: 9139172 - DNA, 22 bp, Homo sapiens
gctgctgtgcctggcgtcctgt

SEQ ID NO: 9139173 - DNA, 22 bp, Homo sapiens
gctgctgtggcagattggattc

SEQ ID NO: 9139174 - DNA, 22 bp, Homo sapiens
gctgctccagctgtgctgcaga

SEQ ID NO: 9139175 - DNA, 22 bp, Homo sapiens
gctgctccagctgtgctgcaga

SEQ ID NO: 9139176 - DNA, 22 bp, Homo sapiens
gctgctcatttgtatcctttgt

SEQ ID NO: 9139177 - DNA, 22 bp, Homo sapiens
gctgctccgcagagtgtgtgtg

SEQ ID NO: 9139178 - DNA, 22 bp, Homo sapiens
gctgctccgtctgagctctggt

SEQ ID NO: 9139179 - DNA, 22 bp, Homo sapiens
gctgctccgtctgagctctggt

SEQ ID NO: 9139180 - DNA, 22 bp, Homo sapiens
gctgagggctgtaacagcagag

SEQ ID NO: 9139181 - DNA, 19 bp, Homo sapiens
gctgagggccacccagccc

SEQ ID NO: 9139182 - DNA, 22 bp, Homo sapiens
gctgagggccgcatagggtcat

SEQ ID NO: 9139183 - DNA, 22 bp, Homo sapiens
gctgagggatagctgctcactg

SEQ ID NO: 9139184 - DNA, 19 bp, Homo sapiens
gctgagggccacccagccc

SEQ ID NO: 9139185 - DNA, 22 bp, Homo sapiens
gctgcccaggaagcctggggtt

SEQ ID NO: 9139186 - DNA, 22 bp, Homo sapiens
gctgcccagggctgagtgtcct

SEQ ID NO: 9139187 - DNA, 22 bp, Homo sapiens
gctgccctaatatcacatgtta

SEQ ID NO: 9139188 - DNA, 22 bp, Homo sapiens
gctgccccccggactcggcggg

SEQ ID NO: 9139189 - DNA, 22 bp, Homo sapiens
gctgccccgagccatccttcag

SEQ ID NO: 9139190 - DNA, 22 bp, Homo sapiens
gctgcctcaggcacctcctggc

SEQ ID NO: 9139191 - DNA, 22 bp, Homo sapiens
gctgcctcaggcacctcctggc

SEQ ID NO: 9139192 - DNA, 22 bp, Homo sapiens
gctgcctccaatctgtgccccg

SEQ ID NO: 9139193 - DNA, 22 bp, Homo sapiens
gctgccctgtggtccagcaggt

SEQ ID NO: 9139194 - DNA, 22 bp, Homo sapiens
gctgcccttcgtcatctataaa

SEQ ID NO: 9139195 - DNA, 22 bp, Homo sapiens
gctgccctgtttagccagggtt

SEQ ID NO: 9139196 - DNA, 22 bp, Homo sapiens
gctgcctcactccagcccaata

SEQ ID NO: 9139197 - DNA, 22 bp, Homo sapiens
gctgcctcactccagcccaata

SEQ ID NO: 9139198 - DNA, 22 bp, Homo sapiens
ggaatgaatttccagctgggtc

SEQ ID NO: 9139199 - DNA, 22 bp, Homo sapiens
ggaatgagctcggagcagaagg

SEQ ID NO: 9139200 - DNA, 22 bp, Homo sapiens
ggaatgaagaaatagatggtgt

SEQ ID NO: 9139201 - DNA, 22 bp, Homo sapiens
ggaatgaatttccagctgggtc

SEQ ID NO: 9139202 - DNA, 21 bp, Homo sapiens
ggaattgcaggctgtcttttg

SEQ ID NO: 9139203 - DNA, 22 bp, Homo sapiens
ggaattcagggaagtcaaaaag

SEQ ID NO: 9139204 - DNA, 22 bp, Homo sapiens
ggacaaagcctggtggcaggtg

SEQ ID NO: 9139205 - DNA, 22 bp, Homo sapiens
ggacaaaccaatagacactggc

SEQ ID NO: 9139206 - DNA, 22 bp, Homo sapiens
ggacaaagcctggtggcaggtg

SEQ ID NO: 9139207 - DNA, 17 bp, Homo sapiens
ggacacagctcatggct

SEQ ID NO: 9139208 - DNA, 17 bp, Homo sapiens
ggacacagctcatggct

SEQ ID NO: 9139209 - DNA, 22 bp, Homo sapiens
ggaagaggctggtagtgcccgt

SEQ ID NO: 9139210 - DNA, 22 bp, Homo sapiens
ggaagaggctggtagtgcccgt

SEQ ID NO: 9139211 - DNA, 22 bp, Homo sapiens
ggaagagggaaccacgactgta

SEQ ID NO: 9139212 - DNA, 22 bp, Homo sapiens
ggaagagggaaccacgactgta

SEQ ID NO: 9139213 - DNA, 22 bp, Homo sapiens
ggaagagggaaccacgactgta

SEQ ID NO: 9139214 - DNA, 22 bp, Homo sapiens
ggaagagggaaccacgactgta

SEQ ID NO: 9139215 - DNA, 22 bp, Homo sapiens
ggaagcagcctgaagccaaggg

SEQ ID NO: 9139216 - DNA, 22 bp, Homo sapiens
ggaagacaagcagtggctgagc

SEQ ID NO: 9139217 - DNA, 22 bp, Homo sapiens
ggaagaagggtcattggcagcc

SEQ ID NO: 9139218 - DNA, 22 bp, Homo sapiens
ggaagaggaggagccaggcttt

SEQ ID NO: 9139219 - DNA, 22 bp, Homo sapiens
ggaagaggaggagccaggcttt

SEQ ID NO: 9139220 - DNA, 22 bp, Homo sapiens
gctttggaaggggctggtggag

SEQ ID NO: 9139221 - DNA, 22 bp, Homo sapiens
gctttggagcctgtgttctgcc

SEQ ID NO: 9139222 - DNA, 19 bp, Homo sapiens
gctttggagggaggttcta

SEQ ID NO: 9139223 - DNA, 22 bp, Homo sapiens
gctttggagggcaagagctgtt

SEQ ID NO: 9139224 - DNA, 22 bp, Homo sapiens
gctttggagtcagaaagaccta

SEQ ID NO: 9139225 - DNA, 22 bp, Homo sapiens
ggaagaggctgagccaggtccc

SEQ ID NO: 9139226 - DNA, 22 bp, Homo sapiens
ggaagaggctgaggccatgctg

SEQ ID NO: 9139227 - DNA, 22 bp, Homo sapiens
ggaagaggctgaggccatgctg

SEQ ID NO: 9139228 - DNA, 22 bp, Homo sapiens
ggaagaggctgaggccatgctg

SEQ ID NO: 9139229 - DNA, 22 bp, Homo sapiens
ggaagaggctctcattgagggc

SEQ ID NO: 9139230 - DNA, 22 bp, Homo sapiens
ggaagaggctctcattgagggc

SEQ ID NO: 9139231 - DNA, 22 bp, Homo sapiens
ggaagaggctctcattgagggc

SEQ ID NO: 9139232 - DNA, 22 bp, Homo sapiens
gctttgctggcttgaaatgctg

SEQ ID NO: 9139233 - DNA, 22 bp, Homo sapiens
gctttgctatgactcaccagca

SEQ ID NO: 9139234 - DNA, 22 bp, Homo sapiens
gctttgctatgactcaccagca

SEQ ID NO: 9139235 - DNA, 22 bp, Homo sapiens
gctttgctagcactgcgcttcc

SEQ ID NO: 9139236 - DNA, 18 bp, Homo sapiens
gctttctatgcgacagta

SEQ ID NO: 9139237 - DNA, 22 bp, Homo sapiens
gctttctcttcactgatgttca

SEQ ID NO: 9139238 - DNA, 22 bp, Homo sapiens
gctttggaacttaaatccttgg

SEQ ID NO: 9139239 - DNA, 22 bp, Homo sapiens
gctttgcttccttccccttcaa

SEQ ID NO: 9139240 - DNA, 22 bp, Homo sapiens
gctttgcttcctgttctagcct

SEQ ID NO: 9139241 - DNA, 22 bp, Homo sapiens
gctttgctggcttgaaatgctg

SEQ ID NO: 9139242 - DNA, 22 bp, Homo sapiens
gctttctaggcagagatgactg

SEQ ID NO: 9139243 - DNA, 22 bp, Homo sapiens
gctttattttgtgagggattac

SEQ ID NO: 9139244 - DNA, 22 bp, Homo sapiens
gctttattttgtgagggattac

SEQ ID NO: 9139245 - DNA, 22 bp, Homo sapiens
gctttattttgtgagggattac

SEQ ID NO: 9139246 - DNA, 22 bp, Homo sapiens
gctttattttgtgagggattac

SEQ ID NO: 9139247 - DNA, 20 bp, Homo sapiens
gctttcaagcttgtcattgt

SEQ ID NO: 9139248 - DNA, 18 bp, Homo sapiens
gctttcaatttctttcct

SEQ ID NO: 9139249 - DNA, 22 bp, Homo sapiens
ggaccaggagctcagagccctc

SEQ ID NO: 9139250 - DNA, 19 bp, Homo sapiens
ggaccaggtcctgggcagc

SEQ ID NO: 9139251 - DNA, 22 bp, Homo sapiens
ggagacagggttgaaccacgca

SEQ ID NO: 9139252 - DNA, 22 bp, Homo sapiens
ggaccatgaggagatgggcctc

SEQ ID NO: 9139253 - DNA, 22 bp, Homo sapiens
ggaccatgttccctctgaagct

SEQ ID NO: 9139254 - DNA, 22 bp, Homo sapiens
ggacaggtgtgaggctggcaca

SEQ ID NO: 9139255 - DNA, 22 bp, Homo sapiens
ggacaggttcagcagtttataa

SEQ ID NO: 9139256 - DNA, 22 bp, Homo sapiens
ggacagtagtcactaaactaga

SEQ ID NO: 9139257 - DNA, 22 bp, Homo sapiens
ggacacaggtaaataccactga

SEQ ID NO: 9139258 - DNA, 22 bp, Homo sapiens
ggacagggtaagtactagtgtg

SEQ ID NO: 9139259 - DNA, 22 bp, Homo sapiens
ggacacagggctcactctctct

SEQ ID NO: 9139260 - DNA, 23 bp, Homo sapiens
ggacacaggccttgtctgcgcct

SEQ ID NO: 9139261 - DNA, 22 bp, Homo sapiens
ggacacagggctcactctctct

SEQ ID NO: 9139262 - DNA, 22 bp, Homo sapiens
ggacacagctgcagccacaccc

SEQ ID NO: 9139263 - DNA, 22 bp, Homo sapiens
ggacacaggcagctgggtgggt

SEQ ID NO: 9139264 - DNA, 22 bp, Homo sapiens
ggagagaattccatggacatgt

SEQ ID NO: 9139265 - DNA, 22 bp, Homo sapiens
ggagagaattccatggacatgt

SEQ ID NO: 9139266 - DNA, 22 bp, Homo sapiens
ggagcaggctctgtggtttcca

SEQ ID NO: 9139267 - DNA, 22 bp, Homo sapiens
ggagcaggctctgtggtttcca

SEQ ID NO: 9139268 - DNA, 22 bp, Homo sapiens
ggagcagcactgccacacagag

SEQ ID NO: 9139269 - DNA, 22 bp, Homo sapiens
ggagcagcactgccacacagag

SEQ ID NO: 9139270 - DNA, 22 bp, Homo sapiens
ggagcagggcagtgaattctgg

SEQ ID NO: 9139271 - DNA, 22 bp, Homo sapiens
ggagcatgcgctctgtgaccga

SEQ ID NO: 9139272 - DNA, 22 bp, Homo sapiens
ggagccagaaatgctgtggttg

SEQ ID NO: 9139273 - DNA, 22 bp, Homo sapiens
ggagcatgggtcagaactcagt

SEQ ID NO: 9139274 - DNA, 22 bp, Homo sapiens
ggagccaaagcacctcggacgt

SEQ ID NO: 9139275 - DNA, 22 bp, Homo sapiens
ggagagaactggctccttctag

SEQ ID NO: 9139276 - DNA, 22 bp, Homo sapiens
ggagagaatctgaacctgctcc

SEQ ID NO: 9139277 - DNA, 22 bp, Homo sapiens
ggagagaactgacctgaaagga

SEQ ID NO: 9139278 - DNA, 22 bp, Homo sapiens
ggagagaattccatggacatgt

SEQ ID NO: 9139279 - DNA, 22 bp, Homo sapiens
ggagagaatctgaacctgctcc

SEQ ID NO: 9139280 - DNA, 22 bp, Homo sapiens
ggagagaaattgaggtagcaag

SEQ ID NO: 9139281 - DNA, 22 bp, Homo sapiens
ggagacttgagtttttgtctta

SEQ ID NO: 9139282 - DNA, 22 bp, Homo sapiens
ggagagaaattgaggtagcaag

SEQ ID NO: 9139283 - DNA, 22 bp, Homo sapiens
ggagagaaattgaggtagcaag

SEQ ID NO: 9139284 - DNA, 22 bp, Homo sapiens
ggagagaaattgaggtagcaag

SEQ ID NO: 9139285 - DNA, 22 bp, Homo sapiens
ggagacagtgacttagagactg

SEQ ID NO: 9139286 - DNA, 22 bp, Homo sapiens
ggagactctcattgtcaagctt

SEQ ID NO: 9139287 - DNA, 22 bp, Homo sapiens
ggagactcgggttctagccttg

SEQ ID NO: 9139288 - DNA, 19 bp, Homo sapiens
ggagactcagcccatgcct

SEQ ID NO: 9139289 - DNA, 22 bp, Homo sapiens
ggagactcaccccgcattctag

SEQ ID NO: 9139290 - DNA, 18 bp, Homo sapiens
ggagactaaactgttgac

SEQ ID NO: 9139291 - DNA, 18 bp, Homo sapiens
ggagactaaactgttgac

SEQ ID NO: 9139292 - DNA, 22 bp, Homo sapiens
ggagaccaggtcagagatggtg

SEQ ID NO: 9139293 - DNA, 18 bp, Homo sapiens
gctttatttcttggggaa

SEQ ID NO: 9139294 - DNA, 18 bp, Homo sapiens
gctttatttcttggggaa

SEQ ID NO: 9139295 - DNA, 18 bp, Homo sapiens
gctttatttcttggggaa

SEQ ID NO: 9139296 - DNA, 18 bp, Homo sapiens
gctttatttcttggggaa

SEQ ID NO: 9139297 - DNA, 19 bp, Homo sapiens
gcttgctttatgaaggggg

SEQ ID NO: 9139298 - DNA, 20 bp, Homo sapiens
gcttgctttgtctgatgggc

SEQ ID NO: 9139299 - DNA, 22 bp, Homo sapiens
gcttgctggtgcctgcaggctc

SEQ ID NO: 9139300 - DNA, 22 bp, Homo sapiens
gcttgctggtgcctgcaggctc

SEQ ID NO: 9139301 - DNA, 22 bp, Homo sapiens
gcttgcttatttgcccttctcc

SEQ ID NO: 9139302 - DNA, 19 bp, Homo sapiens
gcttgctgctaggtaggga

SEQ ID NO: 9139303 - DNA, 20 bp, Homo sapiens
gcttcttttctggcccatga

SEQ ID NO: 9139304 - DNA, 20 bp, Homo sapiens
gcttcttttctggcccatga

SEQ ID NO: 9139305 - DNA, 22 bp, Homo sapiens
gcttctttggcaaccctgacat

SEQ ID NO: 9139306 - DNA, 22 bp, Homo sapiens
gcttctttccttgggctggaac

SEQ ID NO: 9139307 - DNA, 22 bp, Homo sapiens
gcttctttccttgggctggaac

SEQ ID NO: 9139308 - DNA, 22 bp, Homo sapiens
gcttctttggcaaccctgacat

SEQ ID NO: 9139309 - DNA, 22 bp, Homo sapiens
gcttgagttttgggacaaagcc

SEQ ID NO: 9139310 - DNA, 22 bp, Homo sapiens
gcttgagttttgggacaaagcc

SEQ ID NO: 9139311 - DNA, 22 bp, Homo sapiens
gcttgagttttgggacaaagcc

SEQ ID NO: 9139312 - DNA, 22 bp, Homo sapiens
gcttgcacataagcacacactt

SEQ ID NO: 9139313 - DNA, 22 bp, Homo sapiens
gcttgcaagtgtcaagctatta

SEQ ID NO: 9139314 - DNA, 22 bp, Homo sapiens
gcttgctagaagcttaaaggta

SEQ ID NO: 9139315 - DNA, 23 bp, Homo sapiens
gcttgctcattctatcacacagc

SEQ ID NO: 9139316 - DNA, 22 bp, Homo sapiens
gctgtgtgaccctagccagtag

SEQ ID NO: 9139317 - DNA, 22 bp, Homo sapiens
gctgtgtctgttttacgtcaag

SEQ ID NO: 9139318 - DNA, 22 bp, Homo sapiens
gctgtgtctgttttacgtcaag

SEQ ID NO: 9139319 - DNA, 22 bp, Homo sapiens
gctgtgtgaaaactgggcctgg

SEQ ID NO: 9139320 - DNA, 22 bp, Homo sapiens
gctgtgtcctcacacagccttt

SEQ ID NO: 9139321 - DNA, 22 bp, Homo sapiens
gctgtgtatcagatgccacggg

SEQ ID NO: 9139322 - DNA, 22 bp, Homo sapiens
gctgtgtatcagatgccacggg

SEQ ID NO: 9139323 - DNA, 22 bp, Homo sapiens
gctgtgtcagaaactctgggga

SEQ ID NO: 9139324 - DNA, 19 bp, Homo sapiens
gctgtgtcatttcttagga

SEQ ID NO: 9139325 - DNA, 22 bp, Homo sapiens
gctgtgtccaggtgggggtgac

SEQ ID NO: 9139326 - DNA, 19 bp, Homo sapiens
gctggggcctgaccagaca

SEQ ID NO: 9139327 - DNA, 19 bp, Homo sapiens
gctggggcctgaccagaca

SEQ ID NO: 9139328 - DNA, 22 bp, Homo sapiens
gctggggcctgaacagtcagct

SEQ ID NO: 9139329 - DNA, 22 bp, Homo sapiens
gctggggcctgaacagtcagct

SEQ ID NO: 9139330 - DNA, 22 bp, Homo sapiens
gctggggctgggctgaggaaga

SEQ ID NO: 9139331 - DNA, 22 bp, Homo sapiens
gctgggcttggtttccctgctt

SEQ ID NO: 9139332 - DNA, 22 bp, Homo sapiens
gctgggcttggtttccctgctt

SEQ ID NO: 9139333 - DNA, 19 bp, Homo sapiens
gctgggcttgggtttgtag

SEQ ID NO: 9139334 - DNA, 22 bp, Homo sapiens
gctgggcttctcaatgctgcct

SEQ ID NO: 9139335 - DNA, 22 bp, Homo sapiens
gctgggcttctcaatgctgcct

SEQ ID NO: 9139336 - DNA, 22 bp, Homo sapiens
gctgggcttggtttccctgctt

SEQ ID NO: 9139337 - DNA, 19 bp, Homo sapiens
gctgggcttgggtttgtag

SEQ ID NO: 9139338 - DNA, 22 bp, Homo sapiens
gctggggaggcagcagagaaca

SEQ ID NO: 9139339 - DNA, 22 bp, Homo sapiens
gctggggagggcgtcaaggcca

SEQ ID NO: 9139340 - DNA, 22 bp, Homo sapiens
gctggggcctgaacagtcagct

SEQ ID NO: 9139341 - DNA, 22 bp, Homo sapiens
gctggggcctctgtgaggttaa

SEQ ID NO: 9139342 - DNA, 22 bp, Homo sapiens
gctggggcctgaacagtcagct

SEQ ID NO: 9139343 - DNA, 22 bp, Homo sapiens
gctgtggctgacattgcagaca

SEQ ID NO: 9139344 - DNA, 22 bp, Homo sapiens
gctgtggctgaagatgcaggga

SEQ ID NO: 9139345 - DNA, 22 bp, Homo sapiens
gctgtggctctcacaagcaaat

SEQ ID NO: 9139346 - DNA, 22 bp, Homo sapiens
gctgtggctttctgtttctgtt

SEQ ID NO: 9139347 - DNA, 19 bp, Homo sapiens
gctgtgggacagcagggtg

SEQ ID NO: 9139348 - DNA, 22 bp, Homo sapiens
gctgtgggccacacggctgagt

SEQ ID NO: 9139349 - DNA, 22 bp, Homo sapiens
gctgtgggtaaacgctgagggt

SEQ ID NO: 9139350 - DNA, 22 bp, Homo sapiens
gctgtggtctgtgagctccaaa

SEQ ID NO: 9139351 - DNA, 22 bp, Homo sapiens
gctggctggcgggtgcgtcctc

SEQ ID NO: 9139352 - DNA, 22 bp, Homo sapiens
gctggctgtgattttgccaaca

SEQ ID NO: 9139353 - DNA, 22 bp, Homo sapiens
gctggctgtgggctccacgctc

SEQ ID NO: 9139354 - DNA, 22 bp, Homo sapiens
gctggctgtgggctccacgctc

SEQ ID NO: 9139355 - DNA, 22 bp, Homo sapiens
gctggctgtgttccttctgcca

SEQ ID NO: 9139356 - DNA, 22 bp, Homo sapiens
gctggctgtgttccttctgcca

SEQ ID NO: 9139357 - DNA, 22 bp, Homo sapiens
gctggctgtgtttcatctctga

SEQ ID NO: 9139358 - DNA, 22 bp, Homo sapiens
gctggctgtgtttcatctctga

SEQ ID NO: 9139359 - DNA, 22 bp, Homo sapiens
gctggctgtgtttcatctctga

SEQ ID NO: 9139360 - DNA, 22 bp, Homo sapiens
gctggctgttgaataatggcat

SEQ ID NO: 9139361 - DNA, 17 bp, Homo sapiens
gctggcttctccttgct

SEQ ID NO: 9139362 - DNA, 17 bp, Homo sapiens
gctggcttctccttgct

SEQ ID NO: 9139363 - DNA, 22 bp, Homo sapiens
gctggcttgacagaggcctggg

SEQ ID NO: 9139364 - DNA, 22 bp, Homo sapiens
gctggcttgacagaggcctggg

SEQ ID NO: 9139365 - DNA, 22 bp, Homo sapiens
gctggcttccttctgcagctag

SEQ ID NO: 9139366 - DNA, 22 bp, Homo sapiens
gctggcttccttctgcagctag

SEQ ID NO: 9139367 - DNA, 22 bp, Homo sapiens
gctggcttgtcccaggacaaag

SEQ ID NO: 9139368 - DNA, 22 bp, Homo sapiens
gctggcttgtaataggaatttc

SEQ ID NO: 9139369 - DNA, 18 bp, Homo sapiens
gctggcttgctgggtttg

SEQ ID NO: 9139370 - DNA, 18 bp, Homo sapiens
gctggcttgctgggtttg

SEQ ID NO: 9139371 - DNA, 22 bp, Homo sapiens
gctggcttgatagtttctgctt

SEQ ID NO: 9139372 - DNA, 22 bp, Homo sapiens
gctggcttccatgcggacatca

SEQ ID NO: 9139373 - DNA, 22 bp, Homo sapiens
gctggcttccatcagagggtga

SEQ ID NO: 9139374 - DNA, 22 bp, Homo sapiens
gctggcttccctacctgcacct

SEQ ID NO: 9139375 - DNA, 21 bp, Homo sapiens
gctggcttcctgagggctgag

SEQ ID NO: 9139376 - DNA, 22 bp, Homo sapiens
gctggcttaatagggatgggct

SEQ ID NO: 9139377 - DNA, 22 bp, Homo sapiens
gctggcttaatgtagctaaaaa

SEQ ID NO: 9139378 - DNA, 22 bp, Homo sapiens
gctggctgttggaggtacctgc

SEQ ID NO: 9139379 - DNA, 22 bp, Homo sapiens
gctggctttgtggtctctcctc

SEQ ID NO: 9139380 - DNA, 22 bp, Homo sapiens
gctggctttgtggtctctcctc

SEQ ID NO: 9139381 - DNA, 22 bp, Homo sapiens
gctggcttttgaagtctagcta

SEQ ID NO: 9139382 - DNA, 22 bp, Homo sapiens
gctggcttttgaagtctagcta

SEQ ID NO: 9139383 - DNA, 20 bp, Homo sapiens
gctgggaacaggattgaatc

SEQ ID NO: 9139384 - DNA, 22 bp, Homo sapiens
gctgggctggaaggccaaggca

SEQ ID NO: 9139385 - DNA, 22 bp, Homo sapiens
gctgggctggaaggccaaggca

SEQ ID NO: 9139386 - DNA, 22 bp, Homo sapiens
gctgggctggccgccgagatcg

SEQ ID NO: 9139387 - DNA, 22 bp, Homo sapiens
gctgggctggaaggccaaggca

SEQ ID NO: 9139388 - DNA, 22 bp, Homo sapiens
gctggctttgtcaagggcagca

SEQ ID NO: 9139389 - DNA, 21 bp, Homo sapiens
gctggctttcctggatgtgca

SEQ ID NO: 9139390 - DNA, 22 bp, Homo sapiens
gctggctttgatcttcccatct

SEQ ID NO: 9139391 - DNA, 22 bp, Homo sapiens
gctggctttgcactgggtgcat

SEQ ID NO: 9139392 - DNA, 21 bp, Homo sapiens
gctggctttattctgcgtttg

SEQ ID NO: 9139393 - DNA, 21 bp, Homo sapiens
gctggctttattctgcgtttg

SEQ ID NO: 9139394 - DNA, 20 bp, Homo sapiens
gctggctttcctaaactgct

SEQ ID NO: 9139395 - DNA, 22 bp, Homo sapiens
gctggctttatcgtcagactcc

SEQ ID NO: 9139396 - DNA, 22 bp, Homo sapiens
gctggcttgtcccaggacaaag

SEQ ID NO: 9139397 - DNA, 22 bp, Homo sapiens
gctggctttatggggcttgtgg

SEQ ID NO: 9139398 - DNA, 22 bp, Homo sapiens
gctgggcttcacagagccttta

SEQ ID NO: 9139399 - DNA, 22 bp, Homo sapiens
gctgggcttcacagagccttta

SEQ ID NO: 9139400 - DNA, 22 bp, Homo sapiens
gctgggcttcacctccagagtt

SEQ ID NO: 9139401 - DNA, 22 bp, Homo sapiens
gctgggcttcacctccagagtt

SEQ ID NO: 9139402 - DNA, 22 bp, Homo sapiens
gctgggcttcacctccagagtt

SEQ ID NO: 9139403 - DNA, 23 bp, Homo sapiens
gctgggcttactctttcagtgag

SEQ ID NO: 9139404 - DNA, 22 bp, Homo sapiens
gctgggctgtagtttgctgacc

SEQ ID NO: 9139405 - DNA, 22 bp, Homo sapiens
gctgggcttcacagagccttta

SEQ ID NO: 9139406 - DNA, 23 bp, Homo sapiens
gctgggcttactctttcagtgag

SEQ ID NO: 9139407 - DNA, 22 bp, Homo sapiens
gctgggctgtagtttgctgacc

SEQ ID NO: 9139408 - DNA, 22 bp, Homo sapiens
gctgggctggccgccgagatcg

SEQ ID NO: 9139409 - DNA, 22 bp, Homo sapiens
gctgggctggccgccgagatcg

SEQ ID NO: 9139410 - DNA, 22 bp, Homo sapiens
gctggagagataggcatggggt

SEQ ID NO: 9139411 - DNA, 22 bp, Homo sapiens
gctggagagataggcatggggt

SEQ ID NO: 9139412 - DNA, 22 bp, Homo sapiens
gctggctgctgttgagacttgt

SEQ ID NO: 9139413 - DNA, 22 bp, Homo sapiens
gctggctgctaggacagctaca

SEQ ID NO: 9139414 - DNA, 22 bp, Homo sapiens
gctggctgctaggacagctaca

SEQ ID NO: 9139415 - DNA, 22 bp, Homo sapiens
gctggctgcgtcatcacagggc

SEQ ID NO: 9139416 - DNA, 22 bp, Homo sapiens
gctggctgcgtcatcacagggc

SEQ ID NO: 9139417 - DNA, 22 bp, Homo sapiens
gctgctttagaattgaaacaga

SEQ ID NO: 9139418 - DNA, 22 bp, Homo sapiens
gctgctttataatctcggcaga

SEQ ID NO: 9139419 - DNA, 22 bp, Homo sapiens
gctggagaaacaggaggaggaa

SEQ ID NO: 9139420 - DNA, 22 bp, Homo sapiens
gctggagaaactgcagctgagg

SEQ ID NO: 9139421 - DNA, 22 bp, Homo sapiens
gctggagaaactgcagctgagg

SEQ ID NO: 9139422 - DNA, 22 bp, Homo sapiens
gctggctggaactagcagttgg

SEQ ID NO: 9139423 - DNA, 22 bp, Homo sapiens
gctggctggaatgggagaagaa

SEQ ID NO: 9139424 - DNA, 19 bp, Homo sapiens
gctggctggaggagggaca

SEQ ID NO: 9139425 - DNA, 22 bp, Homo sapiens
gctggctggaggagggaggttg

SEQ ID NO: 9139426 - DNA, 22 bp, Homo sapiens
gctggctggaggagggaggttg

SEQ ID NO: 9139427 - DNA, 22 bp, Homo sapiens
gctggctggaggagggaggttg

SEQ ID NO: 9139428 - DNA, 23 bp, Homo sapiens
gctggctggcagtaaaggttgtt

SEQ ID NO: 9139429 - DNA, 22 bp, Homo sapiens
gctggctggcgggtgcgtcctc

SEQ ID NO: 9139430 - DNA, 22 bp, Homo sapiens
gctggctggatggttggttcgc

SEQ ID NO: 9139431 - DNA, 22 bp, Homo sapiens
gctggctggagtaaggagggag

SEQ ID NO: 9139432 - DNA, 22 bp, Homo sapiens
gctggctggagtaaggagggag

SEQ ID NO: 9139433 - DNA, 22 bp, Homo sapiens
gctggctggaggtgaggaagaa

SEQ ID NO: 9139434 - DNA, 22 bp, Homo sapiens
gctggctggaggtgaggaagaa

SEQ ID NO: 9139435 - DNA, 22 bp, Homo sapiens
gggaccagaagaaggatggtga

SEQ ID NO: 9139436 - DNA, 22 bp, Homo sapiens
gggaccagaagaaggatggtga

SEQ ID NO: 9139437 - DNA, 22 bp, Homo sapiens
gggacatggaggcgcgcaggca

SEQ ID NO: 9139438 - DNA, 22 bp, Homo sapiens
gggaccagaggctgtgcacaat

SEQ ID NO: 9139439 - DNA, 23 bp, Homo sapiens
gggaccagctagggctgtgacct

SEQ ID NO: 9139440 - DNA, 22 bp, Homo sapiens
gggagaagtggaaatctcatta

SEQ ID NO: 9139441 - DNA, 22 bp, Homo sapiens
gggacaggcccctcgctagctt

SEQ ID NO: 9139442 - DNA, 22 bp, Homo sapiens
gggacaggcaaaggtatgcttc

SEQ ID NO: 9139443 - DNA, 22 bp, Homo sapiens
gggacaggctgagacttgagct

SEQ ID NO: 9139444 - DNA, 22 bp, Homo sapiens
gggacatgaagcatcggaggca

SEQ ID NO: 9139445 - DNA, 22 bp, Homo sapiens
gggacatctttctagtcagggt

SEQ ID NO: 9139446 - DNA, 22 bp, Homo sapiens
gggacaggctgagacttgagct

SEQ ID NO: 9139447 - DNA, 22 bp, Homo sapiens
gggacagtggctgtgtcagttt

SEQ ID NO: 9139448 - DNA, 22 bp, Homo sapiens
gggacagccatgtgcagatgcc

SEQ ID NO: 9139449 - DNA, 22 bp, Homo sapiens
gggacagcagaaagaaggcaag

SEQ ID NO: 9139450 - DNA, 22 bp, Homo sapiens
gggaatgtgcagccacagtgag

SEQ ID NO: 9139451 - DNA, 22 bp, Homo sapiens
ggctttagggcaggcagtgtta

SEQ ID NO: 9139452 - DNA, 22 bp, Homo sapiens
ggctttagggcaggcagtgtta

SEQ ID NO: 9139453 - DNA, 22 bp, Homo sapiens
ggcttgggagcaggcatgtgac

SEQ ID NO: 9139454 - DNA, 22 bp, Homo sapiens
ggcttcttaatcatgagagtga

SEQ ID NO: 9139455 - DNA, 22 bp, Homo sapiens
ggcttcttaatcatgagagtga

SEQ ID NO: 9139456 - DNA, 22 bp, Homo sapiens
ggcttcttaatcatgagagtga

SEQ ID NO: 9139457 - DNA, 22 bp, Homo sapiens
ggcttggctgtagctttagcgc

SEQ ID NO: 9139458 - DNA, 22 bp, Homo sapiens
ggcttggctacaagccatgggc

SEQ ID NO: 9139459 - DNA, 20 bp, Homo sapiens
ggcttgtctgagtccctggc

SEQ ID NO: 9139460 - DNA, 17 bp, Homo sapiens
gggagatgaagggatat

SEQ ID NO: 9139461 - DNA, 22 bp, Homo sapiens
gggagaggttacccgagcaact

SEQ ID NO: 9139462 - DNA, 22 bp, Homo sapiens
gggagaggttacccgagcaact

SEQ ID NO: 9139463 - DNA, 22 bp, Homo sapiens
gggagaggttacccgagcaact

SEQ ID NO: 9139464 - DNA, 22 bp, Homo sapiens
gggagctgggctggttttgctg

SEQ ID NO: 9139465 - DNA, 22 bp, Homo sapiens
gggagagatgctgattgccaat

SEQ ID NO: 9139466 - DNA, 22 bp, Homo sapiens
gggagagagagctcatgttgaa

SEQ ID NO: 9139467 - DNA, 22 bp, Homo sapiens
gggagagaattattgccagacc

SEQ ID NO: 9139468 - DNA, 22 bp, Homo sapiens
gggagaggttacccgagcaact

SEQ ID NO: 9139469 - DNA, 22 bp, Homo sapiens
gggagaggttacccgagcaact

SEQ ID NO: 9139470 - DNA, 22 bp, Homo sapiens
gggagagaattattgccagacc

SEQ ID NO: 9139471 - DNA, 22 bp, Homo sapiens
gggaggagcttggagattcact

SEQ ID NO: 9139472 - DNA, 22 bp, Homo sapiens
gggaggagctgagtgtgtgtgc

SEQ ID NO: 9139473 - DNA, 22 bp, Homo sapiens
gggatggggagctggaaagggg

SEQ ID NO: 9139474 - DNA, 22 bp, Homo sapiens
gggatggggtcaacatgtacct

SEQ ID NO: 9139475 - DNA, 22 bp, Homo sapiens
gggatggggagctggaaagggg

SEQ ID NO: 9139476 - DNA, 22 bp, Homo sapiens
gggagctgtgggattggttgag

SEQ ID NO: 9139477 - DNA, 22 bp, Homo sapiens
gggaggaaatgtgcagcgaatt

SEQ ID NO: 9139478 - DNA, 22 bp, Homo sapiens
gggaggaaagagaagtggtcca

SEQ ID NO: 9139479 - DNA, 22 bp, Homo sapiens
gggaggaaggcttgggtgagta

SEQ ID NO: 9139480 - DNA, 22 bp, Homo sapiens
gggaggaaatgtgcagcgaatt

SEQ ID NO: 9139481 - DNA, 22 bp, Homo sapiens
gggaggaaggcttgggtgagta

SEQ ID NO: 9139482 - DNA, 22 bp, Homo sapiens
gggcaaagtggtggaggcagtt

SEQ ID NO: 9139483 - DNA, 22 bp, Homo sapiens
gggcacagcccagtggggtccc

SEQ ID NO: 9139484 - DNA, 22 bp, Homo sapiens
gggcacagcccagtggggtccc

SEQ ID NO: 9139485 - DNA, 22 bp, Homo sapiens
gggcaagcacagcgagcgtgcg

SEQ ID NO: 9139486 - DNA, 19 bp, Homo sapiens
gggcacagcctccccccag

SEQ ID NO: 9139487 - DNA, 22 bp, Homo sapiens
gggcacagcctaactatggaga

SEQ ID NO: 9139488 - DNA, 22 bp, Homo sapiens
gggcacagcctaactatggaga

SEQ ID NO: 9139489 - DNA, 22 bp, Homo sapiens
gggcacagcccagtggggtccc

SEQ ID NO: 9139490 - DNA, 22 bp, Homo sapiens
gggatggggtcgggaccctgct

SEQ ID NO: 9139491 - DNA, 22 bp, Homo sapiens
gggatggtggcttgcatctgta

SEQ ID NO: 9139492 - DNA, 22 bp, Homo sapiens
gggatggggtcgggaccctgct

SEQ ID NO: 9139493 - DNA, 22 bp, Homo sapiens
gggatggggtcaacatgtacct

SEQ ID NO: 9139494 - DNA, 22 bp, Homo sapiens
gggatggggtcgggaccctgct

SEQ ID NO: 9139495 - DNA, 22 bp, Homo sapiens
gggatttgtgggatggccagtg

SEQ ID NO: 9139496 - DNA, 18 bp, Homo sapiens
gggattttgacttgctgt

SEQ ID NO: 9139497 - DNA, 22 bp, Homo sapiens
gggatttgtgggatggccagtg

SEQ ID NO: 9139498 - DNA, 22 bp, Homo sapiens
gggatttggaatctcctaatgc

SEQ ID NO: 9139499 - DNA, 22 bp, Homo sapiens
gggatttgaatcttgagttgag

SEQ ID NO: 9139500 - DNA, 19 bp, Homo sapiens
gggcaaagtgatcgtcctg

SEQ ID NO: 9139501 - DNA, 19 bp, Homo sapiens
gggcaaagtgatcgtcctg

SEQ ID NO: 9139502 - DNA, 22 bp, Homo sapiens
gggcaaaatacttataaaggct

SEQ ID NO: 9139503 - DNA, 22 bp, Homo sapiens
gggcaaaggcagaaagcggtgt

SEQ ID NO: 9139504 - DNA, 22 bp, Homo sapiens
gggcaaaggcagaaagcggtgt

SEQ ID NO: 9139505 - DNA, 22 bp, Homo sapiens
gggatgtcgtgggtggcagctg

SEQ ID NO: 9139506 - DNA, 22 bp, Homo sapiens
gggcagctgtatctgagcttat

SEQ ID NO: 9139507 - DNA, 22 bp, Homo sapiens
gggcagctgtatctgagcttat

SEQ ID NO: 9139508 - DNA, 23 bp, Homo sapiens
gggcagcttaagcttgtttttct

SEQ ID NO: 9139509 - DNA, 22 bp, Homo sapiens
gggcagctgtcttggttctcaa

SEQ ID NO: 9139510 - DNA, 22 bp, Homo sapiens
gggcagctggccaggtattctg

SEQ ID NO: 9139511 - DNA, 22 bp, Homo sapiens
gggcagctggcttataggtttg

SEQ ID NO: 9139512 - DNA, 22 bp, Homo sapiens
gggcagctggatagttttaaat

SEQ ID NO: 9139513 - DNA, 22 bp, Homo sapiens
gggcagctgcccctctctgggc

SEQ ID NO: 9139514 - DNA, 22 bp, Homo sapiens
gggcagctgcagggatggtgac

SEQ ID NO: 9139515 - DNA, 22 bp, Homo sapiens
gggcagctgccaagtgcatcgc

SEQ ID NO: 9139516 - DNA, 22 bp, Homo sapiens
gggcagctgccactccgcttgc

SEQ ID NO: 9139517 - DNA, 22 bp, Homo sapiens
gggcacagctgctacccagtgc

SEQ ID NO: 9139518 - DNA, 22 bp, Homo sapiens
gggcacaggaatttgggatgtg

SEQ ID NO: 9139519 - DNA, 22 bp, Homo sapiens
gggcacaggaatttgggatgtg

SEQ ID NO: 9139520 - DNA, 22 bp, Homo sapiens
gggcacaggaatttgggatgtg

SEQ ID NO: 9139521 - DNA, 21 bp, Homo sapiens
gggcagctctgttttattttc

SEQ ID NO: 9139522 - DNA, 22 bp, Homo sapiens
gggcagctctggctgtgggaag

SEQ ID NO: 9139523 - DNA, 22 bp, Homo sapiens
gggcagctctttggtatccttc

SEQ ID NO: 9139524 - DNA, 22 bp, Homo sapiens
gggcagctctgcccatcagagg

SEQ ID NO: 9139525 - DNA, 22 bp, Homo sapiens
gggcatgcctgcgcagtgcatg

SEQ ID NO: 9139526 - DNA, 22 bp, Homo sapiens
gggcaggctgagcatgtcacct

SEQ ID NO: 9139527 - DNA, 22 bp, Homo sapiens
gggcatgcctgcgcagtgcatg

SEQ ID NO: 9139528 - DNA, 22 bp, Homo sapiens
gggcaggctgagcatgtcacct

SEQ ID NO: 9139529 - DNA, 19 bp, Homo sapiens
gggcatggatgagcttacc

SEQ ID NO: 9139530 - DNA, 23 bp, Homo sapiens
gggcatggagtgtaggtggaagg

SEQ ID NO: 9139531 - DNA, 22 bp, Homo sapiens
gggcatggaggtctgtctgcag

SEQ ID NO: 9139532 - DNA, 22 bp, Homo sapiens
gggcatggaggtctgtctgcag

SEQ ID NO: 9139533 - DNA, 22 bp, Homo sapiens
gggcatggaggtctgtctgcag

SEQ ID NO: 9139534 - DNA, 22 bp, Homo sapiens
gggcaggagagaacagtcatgg

SEQ ID NO: 9139535 - DNA, 22 bp, Homo sapiens
gggcaggagagggccacctgga

SEQ ID NO: 9139536 - DNA, 22 bp, Homo sapiens
gggcaggaggctaattctgcat

SEQ ID NO: 9139537 - DNA, 22 bp, Homo sapiens
gggcaggagagaacagtcatgg

SEQ ID NO: 9139538 - DNA, 22 bp, Homo sapiens
ggctgagaaggagtgggtgagg

SEQ ID NO: 9139539 - DNA, 22 bp, Homo sapiens
ggctgagactagagtgaggcat

SEQ ID NO: 9139540 - DNA, 22 bp, Homo sapiens
ggctgacttctccagatctaaa

SEQ ID NO: 9139541 - DNA, 22 bp, Homo sapiens
ggctgacttttatgcacactaa

SEQ ID NO: 9139542 - DNA, 22 bp, Homo sapiens
ggctgaagtgtagtggctcact

SEQ ID NO: 9139543 - DNA, 22 bp, Homo sapiens
ggctgaagtgtagtggctcact

SEQ ID NO: 9139544 - DNA, 22 bp, Homo sapiens
ggctgaaggaactttttccatg

SEQ ID NO: 9139545 - DNA, 22 bp, Homo sapiens
ggctgaaggatgaaagctgcag

SEQ ID NO: 9139546 - DNA, 22 bp, Homo sapiens
ggctgaagttctttttgttcag

SEQ ID NO: 9139547 - DNA, 22 bp, Homo sapiens
ggctgaagtgtagtggctcact

SEQ ID NO: 9139548 - DNA, 22 bp, Homo sapiens
ggctgaagtgtagtggctcact

SEQ ID NO: 9139549 - DNA, 22 bp, Homo sapiens
ggctgaaacagatttcaagaca

SEQ ID NO: 9139550 - DNA, 22 bp, Homo sapiens
ggctgaaaccgttatccactga

SEQ ID NO: 9139551 - DNA, 22 bp, Homo sapiens
ggctgaaaccgttatccactga

SEQ ID NO: 9139552 - DNA, 22 bp, Homo sapiens
ggctgaaagcgcgacttgcccc

SEQ ID NO: 9139553 - DNA, 22 bp, Homo sapiens
ggctgaaaggtgggaggatggc

SEQ ID NO: 9139554 - DNA, 22 bp, Homo sapiens
ggctgaaaggtagtagtaggct

SEQ ID NO: 9139555 - DNA, 20 bp, Homo sapiens
ggctgaaagtagaaagtatt

SEQ ID NO: 9139556 - DNA, 22 bp, Homo sapiens
ggctgaaattcagagtaaattc

SEQ ID NO: 9139557 - DNA, 20 bp, Homo sapiens
ggctgaaagtagaaagtatt

SEQ ID NO: 9139558 - DNA, 22 bp, Homo sapiens
ggctgaaattcagagtaaattc

SEQ ID NO: 9139559 - DNA, 22 bp, Homo sapiens
ggctgaaattggatccttgggc

SEQ ID NO: 9139560 - DNA, 22 bp, Homo sapiens
ggctgaaggatgaaagctgcag

SEQ ID NO: 9139561 - DNA, 22 bp, Homo sapiens
ggctgaaggatgaaagctgcag

SEQ ID NO: 9139562 - DNA, 22 bp, Homo sapiens
ggctctgggccagagttggctt

SEQ ID NO: 9139563 - DNA, 22 bp, Homo sapiens
ggctcttgcccgcccaggctgg

SEQ ID NO: 9139564 - DNA, 22 bp, Homo sapiens
ggctcttgagaggcacaggttt

SEQ ID NO: 9139565 - DNA, 22 bp, Homo sapiens
ggctctgggaaatggtcttcct

SEQ ID NO: 9139566 - DNA, 22 bp, Homo sapiens
ggctctggctactccaccctgt

SEQ ID NO: 9139567 - DNA, 22 bp, Homo sapiens
ggctctgggcatagaaggaagc

SEQ ID NO: 9139568 - DNA, 22 bp, Homo sapiens
ggctctggcgtccaatggagcg

SEQ ID NO: 9139569 - DNA, 22 bp, Homo sapiens
ggctctggctactccaccctgt

SEQ ID NO: 9139570 - DNA, 19 bp, Homo sapiens
ggctctggcggctgtagcc

SEQ ID NO: 9139571 - DNA, 22 bp, Homo sapiens
ggctctggagacatgtggagag

SEQ ID NO: 9139572 - DNA, 22 bp, Homo sapiens
ggctctggagacatgtggagag

SEQ ID NO: 9139573 - DNA, 22 bp, Homo sapiens
ggctctggagatgtccgacctg

SEQ ID NO: 9139574 - DNA, 22 bp, Homo sapiens
ggctctggagcacagacgtctg

SEQ ID NO: 9139575 - DNA, 22 bp, Homo sapiens
ggctctggcaaggggaggctac

SEQ ID NO: 9139576 - DNA, 22 bp, Homo sapiens
ggctctggcaaggggaggctac

SEQ ID NO: 9139577 - DNA, 21 bp, Homo sapiens
ggcggcgcagagctgcggctc

SEQ ID NO: 9139578 - DNA, 22 bp, Homo sapiens
ggcgggaagttcttgcccactt

SEQ ID NO: 9139579 - DNA, 22 bp, Homo sapiens
ggcggcgcctgctgcgtgacct

SEQ ID NO: 9139580 - DNA, 22 bp, Homo sapiens
ggcgggaagttcttgcccactt

SEQ ID NO: 9139581 - DNA, 22 bp, Homo sapiens
ggcggggcctcgcgaacggcct

SEQ ID NO: 9139582 - DNA, 22 bp, Homo sapiens
ggcgggagcagcagctctgagc

SEQ ID NO: 9139583 - DNA, 22 bp, Homo sapiens
ggcgggaggctgaggagttggt

SEQ ID NO: 9139584 - DNA, 22 bp, Homo sapiens
ggcgggaggctgaggagttggt

SEQ ID NO: 9139585 - DNA, 22 bp, Homo sapiens
ggctccagaaatcatagagcag

SEQ ID NO: 9139586 - DNA, 22 bp, Homo sapiens
ggctccagaaacttcagtccat

SEQ ID NO: 9139587 - DNA, 22 bp, Homo sapiens
ggctccagaaacttcagtccat

SEQ ID NO: 9139588 - DNA, 22 bp, Homo sapiens
ggctccagatgtcccctggcaa

SEQ ID NO: 9139589 - DNA, 22 bp, Homo sapiens
ggctccagatgtcccctggcaa

SEQ ID NO: 9139590 - DNA, 22 bp, Homo sapiens
ggctccagatgtcccctggcaa

SEQ ID NO: 9139591 - DNA, 22 bp, Homo sapiens
ggctccagaggccttacctgca

SEQ ID NO: 9139592 - DNA, 22 bp, Homo sapiens
ggctctgctgcacccttggctc

SEQ ID NO: 9139593 - DNA, 22 bp, Homo sapiens
ggctccaggagatgctgggcag

SEQ ID NO: 9139594 - DNA, 22 bp, Homo sapiens
ggctccaggagatgctgggcag

SEQ ID NO: 9139595 - DNA, 22 bp, Homo sapiens
ggctccaggagggccttggcca

SEQ ID NO: 9139596 - DNA, 22 bp, Homo sapiens
ggctctgctcacagcccgcagc

SEQ ID NO: 9139597 - DNA, 22 bp, Homo sapiens
ggctccagccctggctcttcac

SEQ ID NO: 9139598 - DNA, 22 bp, Homo sapiens
ggctccagatgtctcctggcaa

SEQ ID NO: 9139599 - DNA, 22 bp, Homo sapiens
ggctccagccctggctcttcac

SEQ ID NO: 9139600 - DNA, 22 bp, Homo sapiens
ggctccagatgtctcctggcaa

SEQ ID NO: 9139601 - DNA, 22 bp, Homo sapiens
ggctccagatgtctcctggcaa

SEQ ID NO: 9139602 - DNA, 18 bp, Homo sapiens
ggctccaggacctaccca

SEQ ID NO: 9139603 - DNA, 22 bp, Homo sapiens
ggctccagctaatggtttctat

SEQ ID NO: 9139604 - DNA, 22 bp, Homo sapiens
ggctgctgcccacccctgcatg

SEQ ID NO: 9139605 - DNA, 22 bp, Homo sapiens
ggctgctgagttggccaggaga

SEQ ID NO: 9139606 - DNA, 22 bp, Homo sapiens
ggctgctgacttcatccagctt

SEQ ID NO: 9139607 - DNA, 22 bp, Homo sapiens
ggctgctgagttggccaggaga

SEQ ID NO: 9139608 - DNA, 22 bp, Homo sapiens
ggctgctgacaaacatgatcat

SEQ ID NO: 9139609 - DNA, 22 bp, Homo sapiens
ggctgagcaattttgatgacat

SEQ ID NO: 9139610 - DNA, 22 bp, Homo sapiens
ggctgagcaattttgatgacat

SEQ ID NO: 9139611 - DNA, 22 bp, Homo sapiens
ggctgctggcctctccccggcc

SEQ ID NO: 9139612 - DNA, 22 bp, Homo sapiens
ggctgctggccagcctaggagt

SEQ ID NO: 9139613 - DNA, 22 bp, Homo sapiens
ggctgctgggaatatgccagct

SEQ ID NO: 9139614 - DNA, 22 bp, Homo sapiens
ggctgctgggaatatgccagct

SEQ ID NO: 9139615 - DNA, 22 bp, Homo sapiens
ggctgctggcattgaggtaggt

SEQ ID NO: 9139616 - DNA, 22 bp, Homo sapiens
ggctgctggagttgggtctctc

SEQ ID NO: 9139617 - DNA, 22 bp, Homo sapiens
ggctgggcaaacaagactcttc

SEQ ID NO: 9139618 - DNA, 22 bp, Homo sapiens
ggctggcttgcggagtcacaga

SEQ ID NO: 9139619 - DNA, 21 bp, Homo sapiens
ggctgggcaggacccacccct

SEQ ID NO: 9139620 - DNA, 22 bp, Homo sapiens
ggctgggccagggcctgtggac

SEQ ID NO: 9139621 - DNA, 22 bp, Homo sapiens
ggctgggccagggcctgtggac

SEQ ID NO: 9139622 - DNA, 22 bp, Homo sapiens
ggctgggcatccatccatgaga

SEQ ID NO: 9139623 - DNA, 22 bp, Homo sapiens
ggctgggctccgggagcatgcg

SEQ ID NO: 9139624 - DNA, 22 bp, Homo sapiens
ggctgggctccgggagcatgcg

SEQ ID NO: 9139625 - DNA, 22 bp, Homo sapiens
ggctgggccgcggctacccaga

SEQ ID NO: 9139626 - DNA, 22 bp, Homo sapiens
ggctgggcctctccctcagctg

SEQ ID NO: 9139627 - DNA, 22 bp, Homo sapiens
ggctgggctgctgggtcagagc

SEQ ID NO: 9139628 - DNA, 22 bp, Homo sapiens
ggctgggctgctgggtcagagc

SEQ ID NO: 9139629 - DNA, 22 bp, Homo sapiens
ggctgggctcgctgattggctg

SEQ ID NO: 9139630 - DNA, 22 bp, Homo sapiens
ggcttctcccctttgagtcttc

SEQ ID NO: 9139631 - DNA, 22 bp, Homo sapiens
ggcttctcctggaagtacagag

SEQ ID NO: 9139632 - DNA, 22 bp, Homo sapiens
ggcttctgctcagcctgcacgc

SEQ ID NO: 9139633 - DNA, 22 bp, Homo sapiens
ggcttctgccacgagagggaag

SEQ ID NO: 9139634 - DNA, 22 bp, Homo sapiens
ggcttctgccttgccagttctt

SEQ ID NO: 9139635 - DNA, 22 bp, Homo sapiens
ggcttctgtcctctggatctgt

SEQ ID NO: 9139636 - DNA, 22 bp, Homo sapiens
ggcttctgtcctctggatctgt

SEQ ID NO: 9139637 - DNA, 22 bp, Homo sapiens
ggcttctgaaccaggccctgga

SEQ ID NO: 9139638 - DNA, 22 bp, Homo sapiens
ggcttctgagtgctctgctgtt

SEQ ID NO: 9139639 - DNA, 22 bp, Homo sapiens
ggcttctgaaccaggccctgga

SEQ ID NO: 9139640 - DNA, 22 bp, Homo sapiens
ggcttctgaaatctctgtgcgt

SEQ ID NO: 9139641 - DNA, 22 bp, Homo sapiens
ggcttctgaaatctctgtgcgt

SEQ ID NO: 9139642 - DNA, 22 bp, Homo sapiens
ggcttctctgtctagtttctac

SEQ ID NO: 9139643 - DNA, 22 bp, Homo sapiens
ggcaggcagaggctgagacagg

SEQ ID NO: 9139644 - DNA, 22 bp, Homo sapiens
ggcaggtggaagttggcagagc

SEQ ID NO: 9139645 - DNA, 22 bp, Homo sapiens
ggcaggtggacgtgctaaagct

SEQ ID NO: 9139646 - DNA, 22 bp, Homo sapiens
ggcaggtggccaagtgtctaag

SEQ ID NO: 9139647 - DNA, 22 bp, Homo sapiens
ggcaggtggcactgctgctccc

SEQ ID NO: 9139648 - DNA, 22 bp, Homo sapiens
ggcagtcccagcccagaggcgc

SEQ ID NO: 9139649 - DNA, 22 bp, Homo sapiens
ggcagtcagtttggagatggat

SEQ ID NO: 9139650 - DNA, 22 bp, Homo sapiens
ggcaggtggtaaggatttcata

SEQ ID NO: 9139651 - DNA, 22 bp, Homo sapiens
ggcagtgaatctgagagcctgg

SEQ ID NO: 9139652 - DNA, 22 bp, Homo sapiens
ggcagtgaatgaaacagaggct

SEQ ID NO: 9139653 - DNA, 22 bp, Homo sapiens
ggcagtgaatgaaacagaggct

SEQ ID NO: 9139654 - DNA, 19 bp, Homo sapiens
ggcagtctcaagcagcaca

SEQ ID NO: 9139655 - DNA, 22 bp, Homo sapiens
ggcagtctagctaggatgtcac

SEQ ID NO: 9139656 - DNA, 22 bp, Homo sapiens
ggcagtgaaaaagtatgtttcc

SEQ ID NO: 9139657 - DNA, 22 bp, Homo sapiens
ggcagtgaacagaaatgcagaa

SEQ ID NO: 9139658 - DNA, 22 bp, Homo sapiens
ggcagtgaacagaaatgcagaa

SEQ ID NO: 9139659 - DNA, 21 bp, Homo sapiens
ggcatggcacctctgggcagg

SEQ ID NO: 9139660 - DNA, 22 bp, Homo sapiens
ggcatggctgttggggatagag

SEQ ID NO: 9139661 - DNA, 22 bp, Homo sapiens
ggcatgggagtgagcaacctta

SEQ ID NO: 9139662 - DNA, 22 bp, Homo sapiens
ggcatggggtgtatgtggcacg

SEQ ID NO: 9139663 - DNA, 22 bp, Homo sapiens
ggcatggggtgtatgtggcacg

SEQ ID NO: 9139664 - DNA, 19 bp, Homo sapiens
ggcatggggtccggggacc

SEQ ID NO: 9139665 - DNA, 22 bp, Homo sapiens
ggcatggggtgtatgtggcacg

SEQ ID NO: 9139666 - DNA, 22 bp, Homo sapiens
ggcatgggccgaggtgcctcct

SEQ ID NO: 9139667 - DNA, 19 bp, Homo sapiens
ggcatggggtccggggacc

SEQ ID NO: 9139668 - DNA, 22 bp, Homo sapiens
ggccaggtggctgtcctggcgt

SEQ ID NO: 9139669 - DNA, 22 bp, Homo sapiens
ggccaggtggctgtcctggcgt

SEQ ID NO: 9139670 - DNA, 22 bp, Homo sapiens
ggccagtggctctgtgcttggg

SEQ ID NO: 9139671 - DNA, 19 bp, Homo sapiens
ggccatctctgccccagca

SEQ ID NO: 9139672 - DNA, 19 bp, Homo sapiens
ggccaggctgactgtggtc

SEQ ID NO: 9139673 - DNA, 22 bp, Homo sapiens
ggccagggcctggggactgtcc

SEQ ID NO: 9139674 - DNA, 20 bp, Homo sapiens
ggcatgggtggggctcccag

SEQ ID NO: 9139675 - DNA, 22 bp, Homo sapiens
ggcatggggtgtatgtggcacg

SEQ ID NO: 9139676 - DNA, 22 bp, Homo sapiens
ggcatggggtgtatgtggcacg

SEQ ID NO: 9139677 - DNA, 19 bp, Homo sapiens
ggcatggtcggaagagctc

SEQ ID NO: 9139678 - DNA, 22 bp, Homo sapiens
ggcatggtctttgcttgcagga

SEQ ID NO: 9139679 - DNA, 18 bp, Homo sapiens
ggcatgtgagtgctgagg

SEQ ID NO: 9139680 - DNA, 22 bp, Homo sapiens
ggccaaggctcttgagggctga

SEQ ID NO: 9139681 - DNA, 22 bp, Homo sapiens
ggccaaggctcttgagggctga

SEQ ID NO: 9139682 - DNA, 22 bp, Homo sapiens
ggcattaagaatatcattaaaa

SEQ ID NO: 9139683 - DNA, 22 bp, Homo sapiens
ggcattaactctgtttcaattt

SEQ ID NO: 9139684 - DNA, 19 bp, Homo sapiens
ggccaggctgactgtggtc

SEQ ID NO: 9139685 - DNA, 22 bp, Homo sapiens
ggccacagaacagctacaggac

SEQ ID NO: 9139686 - DNA, 22 bp, Homo sapiens
ggccacagaacagctacaggac

SEQ ID NO: 9139687 - DNA, 22 bp, Homo sapiens
ggccacactctggtagaggtga

SEQ ID NO: 9139688 - DNA, 22 bp, Homo sapiens
ggccacacagatgactgctttc

SEQ ID NO: 9139689 - DNA, 22 bp, Homo sapiens
ggccacacagatgactgctttc

SEQ ID NO: 9139690 - DNA, 22 bp, Homo sapiens
ggccacacggagaggctggtct

SEQ ID NO: 9139691 - DNA, 22 bp, Homo sapiens
ggccacaacttgctcctagccc

SEQ ID NO: 9139692 - DNA, 22 bp, Homo sapiens
ggccacaacttgctcctagccc

SEQ ID NO: 9139693 - DNA, 22 bp, Homo sapiens
ggccaattccaggagccggcgg

SEQ ID NO: 9139694 - DNA, 22 bp, Homo sapiens
ggcctcagggtcactctgtaga

SEQ ID NO: 9139695 - DNA, 23 bp, Homo sapiens
ggcctcagcgcacagaaactgct

SEQ ID NO: 9139696 - DNA, 21 bp, Homo sapiens
ggcctcagccacctggctctg

SEQ ID NO: 9139697 - DNA, 21 bp, Homo sapiens
ggcctcagccacctggctctg

SEQ ID NO: 9139698 - DNA, 22 bp, Homo sapiens
ggcctcagaccggagctggcca

SEQ ID NO: 9139699 - DNA, 19 bp, Homo sapiens
ggccatggcgggggtcaca

SEQ ID NO: 9139700 - DNA, 22 bp, Homo sapiens
ggcctcagagaaggctgtgcgg

SEQ ID NO: 9139701 - DNA, 22 bp, Homo sapiens
ggccatgctgttgcctgctggt

SEQ ID NO: 9139702 - DNA, 21 bp, Homo sapiens
ggcctctgtcatcctgggaag

SEQ ID NO: 9139703 - DNA, 22 bp, Homo sapiens
ggcctctggttcacagggagga

SEQ ID NO: 9139704 - DNA, 22 bp, Homo sapiens
ggcctctggttcacagggagga

SEQ ID NO: 9139705 - DNA, 22 bp, Homo sapiens
ggcctcttatctggctcctgca

SEQ ID NO: 9139706 - DNA, 22 bp, Homo sapiens
ggcctctgtttggagccaggat

SEQ ID NO: 9139707 - DNA, 21 bp, Homo sapiens
ggcctctgtcatcctgggaag

SEQ ID NO: 9139708 - DNA, 23 bp, Homo sapiens
ggcctctgtgttctgcccacatg

SEQ ID NO: 9139709 - DNA, 23 bp, Homo sapiens
ggcctcagtgatgatgggttaaa

SEQ ID NO: 9139710 - DNA, 22 bp, Homo sapiens
ggcctcagggttgggcccatta

SEQ ID NO: 9139711 - DNA, 22 bp, Homo sapiens
ggcctcagtgggccgctgcagg

SEQ ID NO: 9139712 - DNA, 22 bp, Homo sapiens
ggcctcagtgggccgctgcagg

SEQ ID NO: 9139713 - DNA, 22 bp, Homo sapiens
ggcctcagtttcttcaactgta

SEQ ID NO: 9139714 - DNA, 22 bp, Homo sapiens
ggcctcagtttctccatgggtt

SEQ ID NO: 9139715 - DNA, 22 bp, Homo sapiens
ggcctcagtttcttcaactgta

SEQ ID NO: 9139716 - DNA, 22 bp, Homo sapiens
ggcgctggccacggtggctctg

SEQ ID NO: 9139717 - DNA, 22 bp, Homo sapiens
ggcgctggccacggtggctctg

SEQ ID NO: 9139718 - DNA, 22 bp, Homo sapiens
ggcgctggtggtcttgcgagcg

SEQ ID NO: 9139719 - DNA, 22 bp, Homo sapiens
ggcgctggtggtcttgcgagcg

SEQ ID NO: 9139720 - DNA, 19 bp, Homo sapiens
ggcgaagcgcttggagtag

SEQ ID NO: 9139721 - DNA, 19 bp, Homo sapiens
ggcctttcacctggatgct

SEQ ID NO: 9139722 - DNA, 22 bp, Homo sapiens
ggcctcttatctggctcctgca

SEQ ID NO: 9139723 - DNA, 22 bp, Homo sapiens
ggcctcttatctggctcctgca

SEQ ID NO: 9139724 - DNA, 22 bp, Homo sapiens
ggcctgaaatagctctgaggtt

SEQ ID NO: 9139725 - DNA, 21 bp, Homo sapiens
ggcctgaaaaagtgaatgctt

SEQ ID NO: 9139726 - DNA, 21 bp, Homo sapiens
ggcctgagcacctgtccacct

SEQ ID NO: 9139727 - DNA, 22 bp, Homo sapiens
ggcctgagggtgggctctcagt

SEQ ID NO: 9139728 - DNA, 22 bp, Homo sapiens
ggcagaggtagctggaaccagg

SEQ ID NO: 9139729 - DNA, 22 bp, Homo sapiens
ggcagaggtagctggaaccagg

SEQ ID NO: 9139730 - DNA, 20 bp, Homo sapiens
ggcagagggcctgggagaag

SEQ ID NO: 9139731 - DNA, 20 bp, Homo sapiens
ggcagagggcctgggagaag

SEQ ID NO: 9139732 - DNA, 20 bp, Homo sapiens
ggcagagggcctgggagaag

SEQ ID NO: 9139733 - DNA, 20 bp, Homo sapiens
ggcagagggcctgggagaag

SEQ ID NO: 9139734 - DNA, 20 bp, Homo sapiens
ggcagagggcctgggagaag

SEQ ID NO: 9139735 - DNA, 22 bp, Homo sapiens
ggcagaggtagctggaaccagg

SEQ ID NO: 9139736 - DNA, 22 bp, Homo sapiens
ggcaggaggaagagttagcacc

SEQ ID NO: 9139737 - DNA, 22 bp, Homo sapiens
ggcaggaggaagagttagcacc

SEQ ID NO: 9139738 - DNA, 22 bp, Homo sapiens
ggcaggagggcggacaatgacc

SEQ ID NO: 9139739 - DNA, 22 bp, Homo sapiens
ggcaggaggtgagtggcgggtg

SEQ ID NO: 9139740 - DNA, 22 bp, Homo sapiens
ggcaggaggtgagtggcgggtg

SEQ ID NO: 9139741 - DNA, 22 bp, Homo sapiens
ggcaggcaatgaggatgggaag

SEQ ID NO: 9139742 - DNA, 22 bp, Homo sapiens
ggcaggcaagtctgctctgtga

SEQ ID NO: 9139743 - DNA, 22 bp, Homo sapiens
ggcaggaggtgagtggcgggtg

SEQ ID NO: 9139744 - DNA, 22 bp, Homo sapiens
ggcaggcacatttgggggccgt

SEQ ID NO: 9139745 - DNA, 22 bp, Homo sapiens
ggcaggcaccagctcagcaata

SEQ ID NO: 9139746 - DNA, 22 bp, Homo sapiens
ggcaggcagaggctgagacagg

SEQ ID NO: 9139747 - DNA, 22 bp, Homo sapiens
ggcaggcagaaaaatagaatat

SEQ ID NO: 9139748 - DNA, 22 bp, Homo sapiens
ggcagaggagctggaaacatgg

SEQ ID NO: 9139749 - DNA, 22 bp, Homo sapiens
ggcagaggagctggaaacatgg

SEQ ID NO: 9139750 - DNA, 22 bp, Homo sapiens
ggcagaggaggggtgaatttgc

SEQ ID NO: 9139751 - DNA, 22 bp, Homo sapiens
ggcagaggaggggtgaatttgc

SEQ ID NO: 9139752 - DNA, 22 bp, Homo sapiens
ggcagaggaggggtgaatttgc

SEQ ID NO: 9139753 - DNA, 20 bp, Homo sapiens
ggcagagggcctgggagaag

SEQ ID NO: 9139754 - DNA, 22 bp, Homo sapiens
ggcagaggaaggatgaattcac

SEQ ID NO: 9139755 - DNA, 22 bp, Homo sapiens
ggcagaggaaggatgaattcac

SEQ ID NO: 9139756 - DNA, 22 bp, Homo sapiens
ggcagaggaaggatgaattcac

SEQ ID NO: 9139757 - DNA, 22 bp, Homo sapiens
ggcagaggaagctggaagtggg

SEQ ID NO: 9139758 - DNA, 22 bp, Homo sapiens
ggcaccaggacatgactcccag

SEQ ID NO: 9139759 - DNA, 22 bp, Homo sapiens
ggcaccaggatcagtctgtcat

SEQ ID NO: 9139760 - DNA, 23 bp, Homo sapiens
ggcaccaggccatggagcgggag

SEQ ID NO: 9139761 - DNA, 22 bp, Homo sapiens
ggcaccaggctgggcataggcc

SEQ ID NO: 9139762 - DNA, 20 bp, Homo sapiens
ggcaccaggctaggattgga

SEQ ID NO: 9139763 - DNA, 20 bp, Homo sapiens
ggcaccaggctaggattgga

SEQ ID NO: 9139764 - DNA, 22 bp, Homo sapiens
ggcaccaggctgggcataggcc

SEQ ID NO: 9139765 - DNA, 22 bp, Homo sapiens
ggcacagctacttgctcactct

SEQ ID NO: 9139766 - DNA, 22 bp, Homo sapiens
ggcacagctacttgctcactct

SEQ ID NO: 9139767 - DNA, 22 bp, Homo sapiens
ggcacagcgactaccatcgaaa

SEQ ID NO: 9139768 - DNA, 21 bp, Homo sapiens
ggcacagcctgaaatgcctca

SEQ ID NO: 9139769 - DNA, 21 bp, Homo sapiens
ggcacagcctgaaatgcctca

SEQ ID NO: 9139770 - DNA, 22 bp, Homo sapiens
ggcacagcgactaccatcgaaa

SEQ ID NO: 9139771 - DNA, 22 bp, Homo sapiens
ggcacagcgactaccatcgaaa

SEQ ID NO: 9139772 - DNA, 22 bp, Homo sapiens
ggcacagcgactaccatcgaaa

SEQ ID NO: 9139773 - DNA, 22 bp, Homo sapiens
ggcacagccctctctgtggaca

SEQ ID NO: 9139774 - DNA, 22 bp, Homo sapiens
ggcacagccctctctgtggaca

SEQ ID NO: 9139775 - DNA, 22 bp, Homo sapiens
ggcacagcaggagctatgtgaa

SEQ ID NO: 9139776 - DNA, 22 bp, Homo sapiens
ggcacagcaggagctatgtgaa

SEQ ID NO: 9139777 - DNA, 22 bp, Homo sapiens
ggcacagccactttggagaact

SEQ ID NO: 9139778 - DNA, 22 bp, Homo sapiens
ggcacagcaggagctatgtgaa

SEQ ID NO: 9139779 - DNA, 22 bp, Homo sapiens
ggcacagccactttggagaact

SEQ ID NO: 9139780 - DNA, 22 bp, Homo sapiens
ggcacagctcaggtcccagctc

SEQ ID NO: 9139781 - DNA, 22 bp, Homo sapiens
ggcacagctcaggtcccagctc

SEQ ID NO: 9139782 - DNA, 22 bp, Homo sapiens
ggcacagctacttgctcactct

SEQ ID NO: 9139783 - DNA, 22 bp, Homo sapiens
ggcacagctgatgcagacacac

SEQ ID NO: 9139784 - DNA, 22 bp, Homo sapiens
ggcacagctcaggtcccagctc

SEQ ID NO: 9139785 - DNA, 22 bp, Homo sapiens
ggcacagctgatgcagacacac

SEQ ID NO: 9139786 - DNA, 22 bp, Homo sapiens
ggcacagctgatgcagacacac

SEQ ID NO: 9139787 - DNA, 17 bp, Homo sapiens
ggcaccagacggagagt

SEQ ID NO: 9139788 - DNA, 17 bp, Homo sapiens
ggcaccagacggagagt

SEQ ID NO: 9139789 - DNA, 22 bp, Homo sapiens
ggcacatgtatgtgggagtgtg

SEQ ID NO: 9139790 - DNA, 22 bp, Homo sapiens
ggcaccagcaggcaccgatgcc

SEQ ID NO: 9139791 - DNA, 22 bp, Homo sapiens
ggcaccagcacttgggatggct

SEQ ID NO: 9139792 - DNA, 22 bp, Homo sapiens
ggagtgcagtggcgtgatctcg

SEQ ID NO: 9139793 - DNA, 22 bp, Homo sapiens
ggagtgcagtggcgtgatctca

SEQ ID NO: 9139794 - DNA, 22 bp, Homo sapiens
ggagtgcagtggcgtgagctcg

SEQ ID NO: 9139795 - DNA, 22 bp, Homo sapiens
ggagtgcagtggcgtgagctcg

SEQ ID NO: 9139796 - DNA, 22 bp, Homo sapiens
ggagtgctcagcgccaacctgg

SEQ ID NO: 9139797 - DNA, 22 bp, Homo sapiens
ggagtgcggtggcaccatctca

SEQ ID NO: 9139798 - DNA, 23 bp, Homo sapiens
ggagtgcaatggcgccatctcgg

SEQ ID NO: 9139799 - DNA, 23 bp, Homo sapiens
ggagtgcaatggcgccatctcgg

SEQ ID NO: 9139800 - DNA, 23 bp, Homo sapiens
ggagtgcaatggcgccatctcgg

SEQ ID NO: 9139801 - DNA, 22 bp, Homo sapiens
ggagtgcagctcacaggacatc

SEQ ID NO: 9139802 - DNA, 22 bp, Homo sapiens
ggagtgcaatggcgtgatctca

SEQ ID NO: 9139803 - DNA, 22 bp, Homo sapiens
ggagtgatggaaagtgcttggc

SEQ ID NO: 9139804 - DNA, 22 bp, Homo sapiens
ggagtgatgcttgctgcctcca

SEQ ID NO: 9139805 - DNA, 22 bp, Homo sapiens
ggagtgagtggccttgtcactg

SEQ ID NO: 9139806 - DNA, 22 bp, Homo sapiens
ggagtgagtactggagtagctg

SEQ ID NO: 9139807 - DNA, 22 bp, Homo sapiens
ggagtgagtactggagtagctg

SEQ ID NO: 9139808 - DNA, 22 bp, Homo sapiens
ggcaaaaaccgcaataacttct

SEQ ID NO: 9139809 - DNA, 22 bp, Homo sapiens
ggcaaaaacagcaatgactttt

SEQ ID NO: 9139810 - DNA, 22 bp, Homo sapiens
ggagtgctcctctccccagtgc

SEQ ID NO: 9139811 - DNA, 22 bp, Homo sapiens
ggcaaagccctgcctggttcaa

SEQ ID NO: 9139812 - DNA, 22 bp, Homo sapiens
ggcaaatattatctttgctggt

SEQ ID NO: 9139813 - DNA, 22 bp, Homo sapiens
ggcaaagccttccagctgttac

SEQ ID NO: 9139814 - DNA, 22 bp, Homo sapiens
ggcaaagccttccagctgttac

SEQ ID NO: 9139815 - DNA, 22 bp, Homo sapiens
ggcaaagcggccctgtggccag

SEQ ID NO: 9139816 - DNA, 22 bp, Homo sapiens
ggcaaagcggccctgtggccag

SEQ ID NO: 9139817 - DNA, 22 bp, Homo sapiens
ggcaaaggaaccaggccacact

SEQ ID NO: 9139818 - DNA, 22 bp, Homo sapiens
ggcaacatgatgtcaaccagga

SEQ ID NO: 9139819 - DNA, 22 bp, Homo sapiens
ggcaagagggcagatggagtgc

SEQ ID NO: 9139820 - DNA, 22 bp, Homo sapiens
ggcaagaaggcttcaggtagct

SEQ ID NO: 9139821 - DNA, 22 bp, Homo sapiens
ggcaagaacctcaattaccttt

SEQ ID NO: 9139822 - DNA, 22 bp, Homo sapiens
ggcaagaggtccaagaggtctc

SEQ ID NO: 9139823 - DNA, 22 bp, Homo sapiens
ggcaagaggtccaagaggtctc

SEQ ID NO: 9139824 - DNA, 22 bp, Homo sapiens
ggcaagcataacctgtacagcc

SEQ ID NO: 9139825 - DNA, 22 bp, Homo sapiens
ggcaagctcaggcctcaggtgt

SEQ ID NO: 9139826 - DNA, 22 bp, Homo sapiens
ggcaagagttgaagctccagga

SEQ ID NO: 9139827 - DNA, 22 bp, Homo sapiens
ggagtccaacgtgcagccagga

SEQ ID NO: 9139828 - DNA, 21 bp, Homo sapiens
ggagtccaaaaattagccatg

SEQ ID NO: 9139829 - DNA, 22 bp, Homo sapiens
ggagtcctggactccatctcac

SEQ ID NO: 9139830 - DNA, 22 bp, Homo sapiens
ggagtctgactctgaccctgga

SEQ ID NO: 9139831 - DNA, 22 bp, Homo sapiens
ggagtctgacccttagagatga

SEQ ID NO: 9139832 - DNA, 22 bp, Homo sapiens
ggagtctgacccttagagatga

SEQ ID NO: 9139833 - DNA, 22 bp, Homo sapiens
ggagtctgagcttgtgtcctgg

SEQ ID NO: 9139834 - DNA, 22 bp, Homo sapiens
ggagtctgagtcctcatagaca

SEQ ID NO: 9139835 - DNA, 19 bp, Homo sapiens
ggagtctgagcccaggtat

SEQ ID NO: 9139836 - DNA, 19 bp, Homo sapiens
ggagtctgagcccaggtat

SEQ ID NO: 9139837 - DNA, 22 bp, Homo sapiens
ggagtctgatactgagttcctc

SEQ ID NO: 9139838 - DNA, 22 bp, Homo sapiens
ggagtctgagtcctcatagaca

SEQ ID NO: 9139839 - DNA, 22 bp, Homo sapiens
ggagtgaggcatttgtagctga

SEQ ID NO: 9139840 - DNA, 22 bp, Homo sapiens
ggagtcagaatggcagggtggt

SEQ ID NO: 9139841 - DNA, 22 bp, Homo sapiens
ggagtcagaatggcagggtggt

SEQ ID NO: 9139842 - DNA, 22 bp, Homo sapiens
ggagtcagaacccaggcttcta

SEQ ID NO: 9139843 - DNA, 19 bp, Homo sapiens
ggagtcactagaagccatc

SEQ ID NO: 9139844 - DNA, 19 bp, Homo sapiens
ggagtcactagaagccatc

SEQ ID NO: 9139845 - DNA, 22 bp, Homo sapiens
ggagtcaccaagtaggagtctt

SEQ ID NO: 9139846 - DNA, 22 bp, Homo sapiens
ggagtcacctgggaggactggg

SEQ ID NO: 9139847 - DNA, 22 bp, Homo sapiens
ggagtcacctgggaggactggg

SEQ ID NO: 9139848 - DNA, 22 bp, Homo sapiens
ggagtcaccaagtaggagtctt

SEQ ID NO: 9139849 - DNA, 22 bp, Homo sapiens
ggagtcaccaagtaggagtctt

SEQ ID NO: 9139850 - DNA, 20 bp, Homo sapiens
ggagtcacattctttactgc

SEQ ID NO: 9139851 - DNA, 22 bp, Homo sapiens
ggagtcacacaggaagaaggac

SEQ ID NO: 9139852 - DNA, 22 bp, Homo sapiens
ggagtcaccaagtaggagtctt

SEQ ID NO: 9139853 - DNA, 20 bp, Homo sapiens
ggagtcaccaagagagaccc

SEQ ID NO: 9139854 - DNA, 22 bp, Homo sapiens
ggagtcaggatcctggggatgg

SEQ ID NO: 9139855 - DNA, 22 bp, Homo sapiens
ggagtcaggagcaggctgggct

SEQ ID NO: 9139856 - DNA, 21 bp, Homo sapiens
ggagtcagggtctggctgggg

SEQ ID NO: 9139857 - DNA, 21 bp, Homo sapiens
ggagtcagggtctggctgggg

SEQ ID NO: 9139858 - DNA, 22 bp, Homo sapiens
ggagtcagcctgtcagagtgta

SEQ ID NO: 9139859 - DNA, 22 bp, Homo sapiens
ggagtcagcctgtcagagtgta

SEQ ID NO: 9139860 - DNA, 22 bp, Homo sapiens
ggagtcagaggaaggcttgctc

SEQ ID NO: 9139861 - DNA, 22 bp, Homo sapiens
ggagtcacacagagaagataag

SEQ ID NO: 9139862 - DNA, 19 bp, Homo sapiens
ggagccagctgtggaaggc

SEQ ID NO: 9139863 - DNA, 23 bp, Homo sapiens
ggagccagcctgtggggagcggg

SEQ ID NO: 9139864 - DNA, 23 bp, Homo sapiens
ggagccagcctgtggggagcggg

SEQ ID NO: 9139865 - DNA, 22 bp, Homo sapiens
ggagccagcagggtgacactga

SEQ ID NO: 9139866 - DNA, 22 bp, Homo sapiens
ggagccagaggctgctgctgtg

SEQ ID NO: 9139867 - DNA, 22 bp, Homo sapiens
ggagccagaggctgctgctgtg

SEQ ID NO: 9139868 - DNA, 22 bp, Homo sapiens
ggagccagagcactggggagcc

SEQ ID NO: 9139869 - DNA, 22 bp, Homo sapiens
gtgaaatatttaacgtccaggt

SEQ ID NO: 9139870 - DNA, 22 bp, Homo sapiens
gtgaaatctgaggcccatgatg

SEQ ID NO: 9139871 - DNA, 22 bp, Homo sapiens
gtgaaagcactgaacaaagtaa

SEQ ID NO: 9139872 - DNA, 22 bp, Homo sapiens
gtgaaatatttaacgtccaggt

SEQ ID NO: 9139873 - DNA, 18 bp, Homo sapiens
gtctggaggtcaggagct

SEQ ID NO: 9139874 - DNA, 22 bp, Homo sapiens
gtctggagtaccataaaaagga

SEQ ID NO: 9139875 - DNA, 17 bp, Homo sapiens
gtctggagtggccttca

SEQ ID NO: 9139876 - DNA, 22 bp, Homo sapiens
gtctggagtaccataaaaagga

SEQ ID NO: 9139877 - DNA, 17 bp, Homo sapiens
gtctggagtggccttca

SEQ ID NO: 9139878 - DNA, 18 bp, Homo sapiens
gtctggaggtcaggagct

SEQ ID NO: 9139879 - DNA, 18 bp, Homo sapiens
gtctggaggtcaggagct

SEQ ID NO: 9139880 - DNA, 22 bp, Homo sapiens
gtctggagggaagagatgtcag

SEQ ID NO: 9139881 - DNA, 22 bp, Homo sapiens
gtctggaggcccgtcagcccta

SEQ ID NO: 9139882 - DNA, 22 bp, Homo sapiens
gtctggagggaagagatgtcag

SEQ ID NO: 9139883 - DNA, 22 bp, Homo sapiens
gtctggagggaagagatgtcag

SEQ ID NO: 9139884 - DNA, 22 bp, Homo sapiens
gtctggaggggagatttgggtt

SEQ ID NO: 9139885 - DNA, 22 bp, Homo sapiens
gtctggagggtgggtagagacc

SEQ ID NO: 9139886 - DNA, 22 bp, Homo sapiens
gtctggaggggagatttgggtt

SEQ ID NO: 9139887 - DNA, 22 bp, Homo sapiens
gtctggagggtgggtagagacc

SEQ ID NO: 9139888 - DNA, 22 bp, Homo sapiens
gtgaaacaccctccaatgcaca

SEQ ID NO: 9139889 - DNA, 22 bp, Homo sapiens
gtgaaacaccctccaatgcaca

SEQ ID NO: 9139890 - DNA, 22 bp, Homo sapiens
gtgaaaataaggctggttcttg

SEQ ID NO: 9139891 - DNA, 22 bp, Homo sapiens
gtctggagtggggcctgagaat

SEQ ID NO: 9139892 - DNA, 17 bp, Homo sapiens
gtctggagtggccttca

SEQ ID NO: 9139893 - DNA, 22 bp, Homo sapiens
gtctggagtggggcctgagaat

SEQ ID NO: 9139894 - DNA, 22 bp, Homo sapiens
gtgaaaataaggctggttcttg

SEQ ID NO: 9139895 - DNA, 22 bp, Homo sapiens
gtctggagtggggcctgagaat

SEQ ID NO: 9139896 - DNA, 22 bp, Homo sapiens
gtctggagtggtggatttaaag

SEQ ID NO: 9139897 - DNA, 22 bp, Homo sapiens
gtgaagaaggcaatacaaagaa

SEQ ID NO: 9139898 - DNA, 17 bp, Homo sapiens
gtgaagagtcattgaat

SEQ ID NO: 9139899 - DNA, 22 bp, Homo sapiens
gtgaagagctgttgcagagatt

SEQ ID NO: 9139900 - DNA, 22 bp, Homo sapiens
gtgaagcataactgaaggattt

SEQ ID NO: 9139901 - DNA, 22 bp, Homo sapiens
gtgaccatcagagaataacaaa

SEQ ID NO: 9139902 - DNA, 22 bp, Homo sapiens
gtgaaggataaggatctaaatt

SEQ ID NO: 9139903 - DNA, 22 bp, Homo sapiens
gtgaccataatagattatgagt

SEQ ID NO: 9139904 - DNA, 22 bp, Homo sapiens
gtgaccatcctggtaatgaatc

SEQ ID NO: 9139905 - DNA, 22 bp, Homo sapiens
gtgaccatttgacatatccttg

SEQ ID NO: 9139906 - DNA, 22 bp, Homo sapiens
gtgaaggaggggccacagatat

SEQ ID NO: 9139907 - DNA, 22 bp, Homo sapiens
gtgaaggactgaatgaaaatgt

SEQ ID NO: 9139908 - DNA, 22 bp, Homo sapiens
gtgaagcctcggaaccaagctc

SEQ ID NO: 9139909 - DNA, 18 bp, Homo sapiens
gtgaagctttattgaatg

SEQ ID NO: 9139910 - DNA, 22 bp, Homo sapiens
gtcctggggaatacagaagccg

SEQ ID NO: 9139911 - DNA, 22 bp, Homo sapiens
gtcctggggatacagaagtgaa

SEQ ID NO: 9139912 - DNA, 22 bp, Homo sapiens
gtcctgggggcagctgtgtcca

SEQ ID NO: 9139913 - DNA, 22 bp, Homo sapiens
gtctgccctcacgccagctggg

SEQ ID NO: 9139914 - DNA, 22 bp, Homo sapiens
gtctgctgcagtcgtggctcta

SEQ ID NO: 9139915 - DNA, 22 bp, Homo sapiens
gtctgctgacagagcatggacc

SEQ ID NO: 9139916 - DNA, 22 bp, Homo sapiens
gtctggagcctgggtccctgct

SEQ ID NO: 9139917 - DNA, 22 bp, Homo sapiens
gtctggagcctgggtccctgct

SEQ ID NO: 9139918 - DNA, 22 bp, Homo sapiens
gtctggagcctgggtccctgct

SEQ ID NO: 9139919 - DNA, 22 bp, Homo sapiens
gtctggaggaggaagaaggcac

SEQ ID NO: 9139920 - DNA, 22 bp, Homo sapiens
gtctggaggaaaaggttaaatg

SEQ ID NO: 9139921 - DNA, 22 bp, Homo sapiens
gtctggaggaaaaggttaaatg

SEQ ID NO: 9139922 - DNA, 22 bp, Homo sapiens
gtctggaggcactttctcatga

SEQ ID NO: 9139923 - DNA, 22 bp, Homo sapiens
gtctggaggaggaagaaggcac

SEQ ID NO: 9139924 - DNA, 22 bp, Homo sapiens
gtctggaggagggctctgcggc

SEQ ID NO: 9139925 - DNA, 22 bp, Homo sapiens
gtctggaggcccgtcagcccta

SEQ ID NO: 9139926 - DNA, 22 bp, Homo sapiens
gtctggaggcccgtcagcccta

SEQ ID NO: 9139927 - DNA, 22 bp, Homo sapiens
gtctggaggagggctctgcggc

SEQ ID NO: 9139928 - DNA, 22 bp, Homo sapiens
gtctggaggcactttctcatga

SEQ ID NO: 9139929 - DNA, 22 bp, Homo sapiens
gtctggaggcactttctcatga

SEQ ID NO: 9139930 - DNA, 22 bp, Homo sapiens
gtctgctgtaggtaggacagca

SEQ ID NO: 9139931 - DNA, 22 bp, Homo sapiens
gtgccaatgcactctagcctgg

SEQ ID NO: 9139932 - DNA, 22 bp, Homo sapiens
gtgccacctctgccccagaggg

SEQ ID NO: 9139933 - DNA, 22 bp, Homo sapiens
gtgccacatggcctaatagaga

SEQ ID NO: 9139934 - DNA, 22 bp, Homo sapiens
gtgcatttgtgcatgcacatgt

SEQ ID NO: 9139935 - DNA, 22 bp, Homo sapiens
gtgcatttgacgaatactcact

SEQ ID NO: 9139936 - DNA, 22 bp, Homo sapiens
gtgcatatgtgtgtatacaaac

SEQ ID NO: 9139937 - DNA, 22 bp, Homo sapiens
gtgcatatgtgtgtatacaaac

SEQ ID NO: 9139938 - DNA, 22 bp, Homo sapiens
gtgcatttaggtcacatgatgt

SEQ ID NO: 9139939 - DNA, 22 bp, Homo sapiens
gtgcagtgtgtaatccaggaac

SEQ ID NO: 9139940 - DNA, 22 bp, Homo sapiens
gtgcagtggcagatcctagctc

SEQ ID NO: 9139941 - DNA, 22 bp, Homo sapiens
gtgcagttcccaaggtcacaca

SEQ ID NO: 9139942 - DNA, 22 bp, Homo sapiens
gtgcagaggtcacaaaagtgaa

SEQ ID NO: 9139943 - DNA, 22 bp, Homo sapiens
gtgcagagtgtctgtggactga

SEQ ID NO: 9139944 - DNA, 22 bp, Homo sapiens
gtgcagatcctgattgcagttc

SEQ ID NO: 9139945 - DNA, 22 bp, Homo sapiens
gtgcagtgaccctggagagctg

SEQ ID NO: 9139946 - DNA, 22 bp, Homo sapiens
gtgcagtgaccctggagagctg

SEQ ID NO: 9139947 - DNA, 22 bp, Homo sapiens
gtgcagtactagagcaccagga

SEQ ID NO: 9139948 - DNA, 22 bp, Homo sapiens
gtgcagtgaccctggagagctg

SEQ ID NO: 9139949 - DNA, 22 bp, Homo sapiens
gtgcagggtagcgacggcagga

SEQ ID NO: 9139950 - DNA, 22 bp, Homo sapiens
gtgagagaaattggagggaatg

SEQ ID NO: 9139951 - DNA, 23 bp, Homo sapiens
gtgagcagcccactaggaatgcc

SEQ ID NO: 9139952 - DNA, 22 bp, Homo sapiens
gtgagactcgcctttgtgtagc

SEQ ID NO: 9139953 - DNA, 22 bp, Homo sapiens
gtgagacacccaagagtcagat

SEQ ID NO: 9139954 - DNA, 22 bp, Homo sapiens
gtgagcaggataggggctccct

SEQ ID NO: 9139955 - DNA, 22 bp, Homo sapiens
gtgagcagctcagggtggtctc

SEQ ID NO: 9139956 - DNA, 22 bp, Homo sapiens
gtgagcaggataggggctccct

SEQ ID NO: 9139957 - DNA, 23 bp, Homo sapiens
gtgagcagcccactaggaatgcc

SEQ ID NO: 9139958 - DNA, 22 bp, Homo sapiens
gtgagcagcctcacctgagggt

SEQ ID NO: 9139959 - DNA, 22 bp, Homo sapiens
gtgagaagataagtattgcaaa

SEQ ID NO: 9139960 - DNA, 22 bp, Homo sapiens
gtgagaaattgaatggctccca

SEQ ID NO: 9139961 - DNA, 22 bp, Homo sapiens
gtgagaaatggaacttcatacg

SEQ ID NO: 9139962 - DNA, 22 bp, Homo sapiens
gtgagaaaattgcctaattttg

SEQ ID NO: 9139963 - DNA, 22 bp, Homo sapiens
gtgagaaaattgcctaattttg

SEQ ID NO: 9139964 - DNA, 22 bp, Homo sapiens
gtgagcaggataggggctccct

SEQ ID NO: 9139965 - DNA, 22 bp, Homo sapiens
gtgcacaggtgggaaaatgagt

SEQ ID NO: 9139966 - DNA, 23 bp, Homo sapiens
gtgcacagtcaagcccagcttag

SEQ ID NO: 9139967 - DNA, 21 bp, Homo sapiens
gtgcacagtcctgcacacagg

SEQ ID NO: 9139968 - DNA, 22 bp, Homo sapiens
gtgcacatcgtgcaggtttgtt

SEQ ID NO: 9139969 - DNA, 22 bp, Homo sapiens
gtgcagagaaatgagaagtcga

SEQ ID NO: 9139970 - DNA, 22 bp, Homo sapiens
gtgcagagaaggagcagtagtt

SEQ ID NO: 9139971 - DNA, 22 bp, Homo sapiens
gtgcagaagtaacaattaaaga

SEQ ID NO: 9139972 - DNA, 22 bp, Homo sapiens
gtgcactttgggagtctcagtg

SEQ ID NO: 9139973 - DNA, 22 bp, Homo sapiens
gtgcagaatcagtacagaacga

SEQ ID NO: 9139974 - DNA, 22 bp, Homo sapiens
gtgcacatcgtgcaggtttgtt

SEQ ID NO: 9139975 - DNA, 22 bp, Homo sapiens
gtgcaccccggggccctgctcc

SEQ ID NO: 9139976 - DNA, 19 bp, Homo sapiens
gtgcactgtcactttgctc

SEQ ID NO: 9139977 - DNA, 22 bp, Homo sapiens
gtgcactgtctggtcaagagca

SEQ ID NO: 9139978 - DNA, 22 bp, Homo sapiens
gtattcagtttgattgtctaca

SEQ ID NO: 9139979 - DNA, 22 bp, Homo sapiens
gtattcaagcgagcagatgtct

SEQ ID NO: 9139980 - DNA, 22 bp, Homo sapiens
gtattgtagctacaatagacgt

SEQ ID NO: 9139981 - DNA, 22 bp, Homo sapiens
gtattgcattttgaatgcatgg

SEQ ID NO: 9139982 - DNA, 22 bp, Homo sapiens
gtatttataggggaatgagagt

SEQ ID NO: 9139983 - DNA, 22 bp, Homo sapiens
gtatttcacatatggatatgct

SEQ ID NO: 9139984 - DNA, 22 bp, Homo sapiens
gtattgtatttatttatgtgac

SEQ ID NO: 9139985 - DNA, 22 bp, Homo sapiens
gtattgtattgaacacatgtga

SEQ ID NO: 9139986 - DNA, 22 bp, Homo sapiens
gtattgtatatttgcaaataca

SEQ ID NO: 9139987 - DNA, 22 bp, Homo sapiens
gtattgtattgggatgagctct

SEQ ID NO: 9139988 - DNA, 22 bp, Homo sapiens
gtagaaatgtaaccaggagata

SEQ ID NO: 9139989 - DNA, 22 bp, Homo sapiens
gtagaaatggtgtgtttcttct

SEQ ID NO: 9139990 - DNA, 22 bp, Homo sapiens
gtagaattttaataatggagat

SEQ ID NO: 9139991 - DNA, 18 bp, Homo sapiens
gtattagttttcagagag

SEQ ID NO: 9139992 - DNA, 22 bp, Homo sapiens
gtattattaagtgtatttgacc

SEQ ID NO: 9139993 - DNA, 22 bp, Homo sapiens
gtattagtcaattacagtgggg

SEQ ID NO: 9139994 - DNA, 22 bp, Homo sapiens
gtattagttatctactgctgtg

SEQ ID NO: 9139995 - DNA, 22 bp, Homo sapiens
gtattattgggtagtatggtaa

SEQ ID NO: 9139996 - DNA, 22 bp, Homo sapiens
gtattattgtcatgaaataata

SEQ ID NO: 9139997 - DNA, 22 bp, Homo sapiens
gtattattgtcatgaaataata

SEQ ID NO: 9139998 - DNA, 22 bp, Homo sapiens
gtattacatttagtaattaggc

SEQ ID NO: 9139999 - DNA, 22 bp, Homo sapiens
ggtttgcattctgaaaggctca

SEQ ID NO: 9140000 - DNA, 22 bp, Homo sapiens
ggtttgacagcttggggctgtc

SEQ ID NO: 9140001 - DNA, 22 bp, Homo sapiens
ggtttctctagggctgaccagt

SEQ ID NO: 9140002 - DNA, 22 bp, Homo sapiens
ggtttctctgggtgtgggtgct

SEQ ID NO: 9140003 - DNA, 19 bp, Homo sapiens
ggtttgaagaaaatcttgc

SEQ ID NO: 9140004 - DNA, 22 bp, Homo sapiens
ggtttgaacagctttggagaag

SEQ ID NO: 9140005 - DNA, 22 bp, Homo sapiens
ggttttctccccctcttctcag

SEQ ID NO: 9140006 - DNA, 22 bp, Homo sapiens
ggttttcgcgagtttgtggcac

SEQ ID NO: 9140007 - DNA, 22 bp, Homo sapiens
gtaaaacatgttttaactagga

SEQ ID NO: 9140008 - DNA, 22 bp, Homo sapiens
gtaaaacatgttttaactagga

SEQ ID NO: 9140009 - DNA, 22 bp, Homo sapiens
gtaaaacaagctttatggttcc

SEQ ID NO: 9140010 - DNA, 22 bp, Homo sapiens
gtaaaaaggccaagcccttgtg

SEQ ID NO: 9140011 - DNA, 22 bp, Homo sapiens
ggttttggaagtataaagatgt

SEQ ID NO: 9140012 - DNA, 22 bp, Homo sapiens
gtacatttctcccaacactaaa

SEQ ID NO: 9140013 - DNA, 22 bp, Homo sapiens
gtacccactatcctgagttttt

SEQ ID NO: 9140014 - DNA, 23 bp, Homo sapiens
gtacccactcccatatgtccatc

SEQ ID NO: 9140015 - DNA, 22 bp, Homo sapiens
gtacattttgaggttaaaacaa

SEQ ID NO: 9140016 - DNA, 22 bp, Homo sapiens
gtacatttcatttaaatgatgt

SEQ ID NO: 9140017 - DNA, 22 bp, Homo sapiens
gtaaaactgtctaatggtatat

SEQ ID NO: 9140018 - DNA, 22 bp, Homo sapiens
gtacatttatttttgcagcata

SEQ ID NO: 9140019 - DNA, 22 bp, Homo sapiens
gtacatttaggattcattgaaa

SEQ ID NO: 9140020 - DNA, 23 bp, Homo sapiens
gtaaaatacgcagtgcagtgtga

SEQ ID NO: 9140021 - DNA, 22 bp, Homo sapiens
gtccccagaaaggtgaggcagg

SEQ ID NO: 9140022 - DNA, 22 bp, Homo sapiens
gtccccagagctggtggtggtt

SEQ ID NO: 9140023 - DNA, 23 bp, Homo sapiens
gtccagaacccaggctggggtgg

SEQ ID NO: 9140024 - DNA, 22 bp, Homo sapiens
gtccactctctgccgtgcctgt

SEQ ID NO: 9140025 - DNA, 22 bp, Homo sapiens
gtccactgctgtgtgcttcacc

SEQ ID NO: 9140026 - DNA, 22 bp, Homo sapiens
gtccactctagggcagctctcg

SEQ ID NO: 9140027 - DNA, 22 bp, Homo sapiens
gtccactgctgtgtgcttcacc

SEQ ID NO: 9140028 - DNA, 22 bp, Homo sapiens
gtccacactgaggccttctcca

SEQ ID NO: 9140029 - DNA, 18 bp, Homo sapiens
gtccacagccctcacagc

SEQ ID NO: 9140030 - DNA, 22 bp, Homo sapiens
gtccacagctctgaggtctccc

SEQ ID NO: 9140031 - DNA, 22 bp, Homo sapiens
gtccaccttcttggtcaggccc

SEQ ID NO: 9140032 - DNA, 22 bp, Homo sapiens
gtccacccatgacacctgcctg

SEQ ID NO: 9140033 - DNA, 22 bp, Homo sapiens
gtccactcccagtgcctgaggc

SEQ ID NO: 9140034 - DNA, 19 bp, Homo sapiens
gtccactccactcggtctc

SEQ ID NO: 9140035 - DNA, 22 bp, Homo sapiens
gtccactcactcttagtcactc

SEQ ID NO: 9140036 - DNA, 22 bp, Homo sapiens
gtatttcatcttgaaaaccagt

SEQ ID NO: 9140037 - DNA, 22 bp, Homo sapiens
gtcattttatgggaacagattt

SEQ ID NO: 9140038 - DNA, 22 bp, Homo sapiens
gtcattttctagaattatttga

SEQ ID NO: 9140039 - DNA, 23 bp, Homo sapiens
gtatttcagcattctcagttaaa

SEQ ID NO: 9140040 - DNA, 22 bp, Homo sapiens
gtccaaaagagccagccgggcg

SEQ ID NO: 9140041 - DNA, 22 bp, Homo sapiens
gtccacaaaattactatcttac

SEQ ID NO: 9140042 - DNA, 22 bp, Homo sapiens
gtcctgggaggggctggtcctg

SEQ ID NO: 9140043 - DNA, 17 bp, Homo sapiens
gtcctgggaggagagag

SEQ ID NO: 9140044 - DNA, 20 bp, Homo sapiens
gtcctgggagccacagcaca

SEQ ID NO: 9140045 - DNA, 17 bp, Homo sapiens
gtcctgggaggagagag

SEQ ID NO: 9140046 - DNA, 22 bp, Homo sapiens
gtcctgggaactggacagctaa

SEQ ID NO: 9140047 - DNA, 22 bp, Homo sapiens
gtcctgggagatgggaccctga

SEQ ID NO: 9140048 - DNA, 22 bp, Homo sapiens
gtcctgggaactggacagctaa

SEQ ID NO: 9140049 - DNA, 22 bp, Homo sapiens
gtcccctcagccacccatgggg

SEQ ID NO: 9140050 - DNA, 22 bp, Homo sapiens
gtcccctcaaaattcatatgtt

SEQ ID NO: 9140051 - DNA, 22 bp, Homo sapiens
gtccccgacgtttggcttgatg

SEQ ID NO: 9140052 - DNA, 22 bp, Homo sapiens
gtccccagctgtgacgagagcc

SEQ ID NO: 9140053 - DNA, 22 bp, Homo sapiens
gtccccagctaatctctttgcc

SEQ ID NO: 9140054 - DNA, 22 bp, Homo sapiens
gtccccagctaatctctttgcc

SEQ ID NO: 9140055 - DNA, 22 bp, Homo sapiens
gtcccctgctggtgttgctgct

SEQ ID NO: 9140056 - DNA, 22 bp, Homo sapiens
gtcccctggcccccagcgtcgg

SEQ ID NO: 9140057 - DNA, 22 bp, Homo sapiens
gtccccttggtaaccttcagct

SEQ ID NO: 9140058 - DNA, 22 bp, Homo sapiens
gtcccctgtccagggccagcca

SEQ ID NO: 9140059 - DNA, 22 bp, Homo sapiens
gtcccctggcccccagcgtcgg

SEQ ID NO: 9140060 - DNA, 22 bp, Homo sapiens
gtcccctggtggctggagctgc

SEQ ID NO: 9140061 - DNA, 22 bp, Homo sapiens
gtcccctggtggctggagctgc

SEQ ID NO: 9140062 - DNA, 23 bp, Homo sapiens
gtccctcacccctaggcaatgcc

SEQ ID NO: 9140063 - DNA, 22 bp, Homo sapiens
gtccctctcaaatttatatgct

SEQ ID NO: 9140064 - DNA, 22 bp, Homo sapiens
gtccctcactggaccatatgaa

SEQ ID NO: 9140065 - DNA, 22 bp, Homo sapiens
gtccctgacacccgggtggagg

SEQ ID NO: 9140066 - DNA, 22 bp, Homo sapiens
gtccctgagcctggcatttccc

SEQ ID NO: 9140067 - DNA, 22 bp, Homo sapiens
gtccctgataagagccatcgat

SEQ ID NO: 9140068 - DNA, 22 bp, Homo sapiens
gtccctctgtgtccctgcagtc

SEQ ID NO: 9140069 - DNA, 22 bp, Homo sapiens
gtccctctgctctagagagcca

SEQ ID NO: 9140070 - DNA, 22 bp, Homo sapiens
gtccctctgggccatcaggtcc

SEQ ID NO: 9140071 - DNA, 22 bp, Homo sapiens
gtccctctgcctgtggttctct

SEQ ID NO: 9140072 - DNA, 22 bp, Homo sapiens
ggtttattaatgtgaactgtat

SEQ ID NO: 9140073 - DNA, 22 bp, Homo sapiens
ggtttattaatgtgaactgtat

SEQ ID NO: 9140074 - DNA, 22 bp, Homo sapiens
ggtttaatgggtgaaggcatga

SEQ ID NO: 9140075 - DNA, 22 bp, Homo sapiens
ggtttaattacctgcatctcaa

SEQ ID NO: 9140076 - DNA, 22 bp, Homo sapiens
ggtttaattggtccaggatggg

SEQ ID NO: 9140077 - DNA, 22 bp, Homo sapiens
ggtttattgttaataagtttga

SEQ ID NO: 9140078 - DNA, 22 bp, Homo sapiens
ggtttattgttaataagtttga

SEQ ID NO: 9140079 - DNA, 22 bp, Homo sapiens
ggtttattgaaggccaccccac

SEQ ID NO: 9140080 - DNA, 22 bp, Homo sapiens
ggtgtgtgtggattagcatgcc

SEQ ID NO: 9140081 - DNA, 22 bp, Homo sapiens
ggtgtgtagcatgtttaagacc

SEQ ID NO: 9140082 - DNA, 22 bp, Homo sapiens
ggtgtggtttgaagggagatgg

SEQ ID NO: 9140083 - DNA, 19 bp, Homo sapiens
ggtgtgtgctggggcctgt

SEQ ID NO: 9140084 - DNA, 19 bp, Homo sapiens
ggtgtgtgctggggcctgt

SEQ ID NO: 9140085 - DNA, 22 bp, Homo sapiens
ggtgtgggggcaagtttgagat

SEQ ID NO: 9140086 - DNA, 22 bp, Homo sapiens
ggtgtgggggcagctctgatat

SEQ ID NO: 9140087 - DNA, 22 bp, Homo sapiens
ggtgtgggcagatgccctactt

SEQ ID NO: 9140088 - DNA, 22 bp, Homo sapiens
ggtggctcggccagtgcaggcc

SEQ ID NO: 9140089 - DNA, 22 bp, Homo sapiens
ggtggctcggccagtgcaggcc

SEQ ID NO: 9140090 - DNA, 22 bp, Homo sapiens
ggtggctctcaggcttctcgga

SEQ ID NO: 9140091 - DNA, 19 bp, Homo sapiens
ggtggctctccctcaggga

SEQ ID NO: 9140092 - DNA, 22 bp, Homo sapiens
ggtggctctctgtcagtgacag

SEQ ID NO: 9140093 - DNA, 22 bp, Homo sapiens
ggtggctcagtgtcaggccctg

SEQ ID NO: 9140094 - DNA, 22 bp, Homo sapiens
ggtggctcagtgtcaggccctg

SEQ ID NO: 9140095 - DNA, 22 bp, Homo sapiens
ggtggctcatttgatcttcata

SEQ ID NO: 9140096 - DNA, 22 bp, Homo sapiens
ggtggctcagggctccaagcat

SEQ ID NO: 9140097 - DNA, 19 bp, Homo sapiens
ggtggctcagggcccagcc

SEQ ID NO: 9140098 - DNA, 18 bp, Homo sapiens
ggtggctcagtcatgggg

SEQ ID NO: 9140099 - DNA, 18 bp, Homo sapiens
ggtggcggggatggaggt

SEQ ID NO: 9140100 - DNA, 19 bp, Homo sapiens
ggtggctcagggcccagcc

SEQ ID NO: 9140101 - DNA, 22 bp, Homo sapiens
ggtggcctgaattagctcaggg

SEQ ID NO: 9140102 - DNA, 22 bp, Homo sapiens
ggtggcctctgcaggcctcgac

SEQ ID NO: 9140103 - DNA, 22 bp, Homo sapiens
ggtctggcaggtgaggactcag

SEQ ID NO: 9140104 - DNA, 22 bp, Homo sapiens
ggtctggccaatagacagcccc

SEQ ID NO: 9140105 - DNA, 22 bp, Homo sapiens
ggtctggcactcatgcagcagg

SEQ ID NO: 9140106 - DNA, 22 bp, Homo sapiens
ggtctggattttgaacaaaatt

SEQ ID NO: 9140107 - DNA, 22 bp, Homo sapiens
ggtggcctagggcccagcctgt

SEQ ID NO: 9140108 - DNA, 22 bp, Homo sapiens
ggtctggatattcaccagggcc

SEQ ID NO: 9140109 - DNA, 22 bp, Homo sapiens
ggtctggataattccagtacct

SEQ ID NO: 9140110 - DNA, 22 bp, Homo sapiens
ggtctggatttctgcttctttc

SEQ ID NO: 9140111 - DNA, 22 bp, Homo sapiens
ggtctggatgctgaggttccca

SEQ ID NO: 9140112 - DNA, 22 bp, Homo sapiens
ggtctggattttgaacaaaatt

SEQ ID NO: 9140113 - DNA, 22 bp, Homo sapiens
ggtctggattttatctactgta

SEQ ID NO: 9140114 - DNA, 22 bp, Homo sapiens
ggtctggagcttggctaaggga

SEQ ID NO: 9140115 - DNA, 16 bp, Homo sapiens
ggtctggaggatgtct

SEQ ID NO: 9140116 - DNA, 22 bp, Homo sapiens
ggtctggagtaggatgatggct

SEQ ID NO: 9140117 - DNA, 22 bp, Homo sapiens
ggtctggagtagatgagtcatg

SEQ ID NO: 9140118 - DNA, 22 bp, Homo sapiens
ggtctctgttgcctccatcaag

SEQ ID NO: 9140119 - DNA, 22 bp, Homo sapiens
ggtctctgtttggggctggcaa

SEQ ID NO: 9140120 - DNA, 22 bp, Homo sapiens
ggtctcttccagctttatcact

SEQ ID NO: 9140121 - DNA, 22 bp, Homo sapiens
ggtctgaaaatggtgaccacca

SEQ ID NO: 9140122 - DNA, 22 bp, Homo sapiens
ggtctggaccctcctggagtgg

SEQ ID NO: 9140123 - DNA, 22 bp, Homo sapiens
ggtctggagctaatcttgttgg

SEQ ID NO: 9140124 - DNA, 22 bp, Homo sapiens
ggtctggagctaatcttgttgg

SEQ ID NO: 9140125 - DNA, 22 bp, Homo sapiens
ggtctggacagaatgtgacact

SEQ ID NO: 9140126 - DNA, 22 bp, Homo sapiens
ggtctggaccatggacgccggg

SEQ ID NO: 9140127 - DNA, 22 bp, Homo sapiens
ggtctgaagcccacgtggtacc

SEQ ID NO: 9140128 - DNA, 22 bp, Homo sapiens
ggtctgaatatagaacttaagt

SEQ ID NO: 9140129 - DNA, 22 bp, Homo sapiens
ggtctgaatcactgtgcctatc

SEQ ID NO: 9140130 - DNA, 22 bp, Homo sapiens
ggtctgaaatgtgacttttgaa

SEQ ID NO: 9140131 - DNA, 22 bp, Homo sapiens
ggtctgaaattatgtcactgct

SEQ ID NO: 9140132 - DNA, 22 bp, Homo sapiens
ggtctgagagccactgaatccc

SEQ ID NO: 9140133 - DNA, 22 bp, Homo sapiens
ggtctgaattccagcccctctg

SEQ ID NO: 9140134 - DNA, 22 bp, Homo sapiens
ggtctggaataaggtccaggaa

SEQ ID NO: 9140135 - DNA, 22 bp, Homo sapiens
ggtctggaatggagtaggggtg

SEQ ID NO: 9140136 - DNA, 23 bp, Homo sapiens
ggtctggaattcgcggagttaac

SEQ ID NO: 9140137 - DNA, 22 bp, Homo sapiens
ggtctcaggtagggcctaggaa

SEQ ID NO: 9140138 - DNA, 22 bp, Homo sapiens
ggtctcagctggagtccttggt

SEQ ID NO: 9140139 - DNA, 22 bp, Homo sapiens
ggtctctgacttagagatggat

SEQ ID NO: 9140140 - DNA, 22 bp, Homo sapiens
ggtctctggccttggagattga

SEQ ID NO: 9140141 - DNA, 22 bp, Homo sapiens
ggtctctgctcagatgccactt

SEQ ID NO: 9140142 - DNA, 22 bp, Homo sapiens
ggtctctgtcactgagtggccc

SEQ ID NO: 9140143 - DNA, 22 bp, Homo sapiens
ggtctctgttgcctccatcaag

SEQ ID NO: 9140144 - DNA, 22 bp, Homo sapiens
ggtctccattccttcatctcac

SEQ ID NO: 9140145 - DNA, 22 bp, Homo sapiens
ggtctctgaacttccactgcgc

SEQ ID NO: 9140146 - DNA, 22 bp, Homo sapiens
ggtctctctgctttcccccaga

SEQ ID NO: 9140147 - DNA, 22 bp, Homo sapiens
ggtctccttgggaaagcaggaa

SEQ ID NO: 9140148 - DNA, 22 bp, Homo sapiens
ggtcgctgtgtaggttcagcta

SEQ ID NO: 9140149 - DNA, 22 bp, Homo sapiens
ggtccttgggtctcctgtgttt

SEQ ID NO: 9140150 - DNA, 20 bp, Homo sapiens
ggtccttgtcacaaggagag

SEQ ID NO: 9140151 - DNA, 22 bp, Homo sapiens
ggtccttgggtctcctgtgttt

SEQ ID NO: 9140152 - DNA, 22 bp, Homo sapiens
ggtcctttgaaaggggtgtgtc

SEQ ID NO: 9140153 - DNA, 22 bp, Homo sapiens
ggtcgagtcacttgttgccttt

SEQ ID NO: 9140154 - DNA, 22 bp, Homo sapiens
ggtcctttgccatctctccacc

SEQ ID NO: 9140155 - DNA, 22 bp, Homo sapiens
ggtctagatcaagaacagaact

SEQ ID NO: 9140156 - DNA, 22 bp, Homo sapiens
ggtctcagactggcaggcagtg

SEQ ID NO: 9140157 - DNA, 22 bp, Homo sapiens
ggtctcaaggaatataatgagt

SEQ ID NO: 9140158 - DNA, 22 bp, Homo sapiens
ggtcgtgaattgaatcagtggc

SEQ ID NO: 9140159 - DNA, 22 bp, Homo sapiens
ggtctagaggatgttcctttcc

SEQ ID NO: 9140160 - DNA, 18 bp, Homo sapiens
ggtcctgggcctggctca

SEQ ID NO: 9140161 - DNA, 22 bp, Homo sapiens
ggtcctgtctgacatcactgct

SEQ ID NO: 9140162 - DNA, 18 bp, Homo sapiens
ggtcctgggcctggctca

SEQ ID NO: 9140163 - DNA, 22 bp, Homo sapiens
ggtccctggttccctctgagct

SEQ ID NO: 9140164 - DNA, 22 bp, Homo sapiens
ggtccctggggaactaggctgt

SEQ ID NO: 9140165 - DNA, 22 bp, Homo sapiens
ggtccctgggtcttcttacgtc

SEQ ID NO: 9140166 - DNA, 22 bp, Homo sapiens
ggtccctggggaactaggctgt

SEQ ID NO: 9140167 - DNA, 22 bp, Homo sapiens
ggtccctgggtcttcttacgtc

SEQ ID NO: 9140168 - DNA, 22 bp, Homo sapiens
ggtccctggggaactaggctgt

SEQ ID NO: 9140169 - DNA, 22 bp, Homo sapiens
ggtccctggaagtccctcttct

SEQ ID NO: 9140170 - DNA, 22 bp, Homo sapiens
ggtcagcagtgcagggcagagc

SEQ ID NO: 9140171 - DNA, 22 bp, Homo sapiens
ggtcagcaggtccagccagtgc

SEQ ID NO: 9140172 - DNA, 22 bp, Homo sapiens
ggtcacattctgaggaatcagg

SEQ ID NO: 9140173 - DNA, 22 bp, Homo sapiens
ggtcacattctgaggtattagg

SEQ ID NO: 9140174 - DNA, 22 bp, Homo sapiens
ggtcacatggttgagcttgatc

SEQ ID NO: 9140175 - DNA, 22 bp, Homo sapiens
ggtcacatgcggggctgtagcc

SEQ ID NO: 9140176 - DNA, 23 bp, Homo sapiens
ggtcacatgtgagattaaacttg

SEQ ID NO: 9140177 - DNA, 22 bp, Homo sapiens
ggtcacatgtgatttgagccaa

SEQ ID NO: 9140178 - DNA, 22 bp, Homo sapiens
ggtcacatatcctcggtttgga

SEQ ID NO: 9140179 - DNA, 19 bp, Homo sapiens
ggtcacaggggttacaagg

SEQ ID NO: 9140180 - DNA, 22 bp, Homo sapiens
ggtcacatgagatgctgccctc

SEQ ID NO: 9140181 - DNA, 22 bp, Homo sapiens
ggtcacatctaaatggagcatt

SEQ ID NO: 9140182 - DNA, 22 bp, Homo sapiens
ggtcactgagctgtaattctgt

SEQ ID NO: 9140183 - DNA, 22 bp, Homo sapiens
ggtcactgatgtgttccctggg

SEQ ID NO: 9140184 - DNA, 22 bp, Homo sapiens
ggtcactccaccttctccacct

SEQ ID NO: 9140185 - DNA, 18 bp, Homo sapiens
ggtcactgagatgctact

SEQ ID NO: 9140186 - DNA, 22 bp, Homo sapiens
ggtcactgtctgaggtactgga

SEQ ID NO: 9140187 - DNA, 22 bp, Homo sapiens
ggtcactggtctctgcttccat

SEQ ID NO: 9140188 - DNA, 23 bp, Homo sapiens
ggtcactggcaagcagtgcagag

SEQ ID NO: 9140189 - DNA, 22 bp, Homo sapiens
ggtcagaacaagggtaaataaa

SEQ ID NO: 9140190 - DNA, 22 bp, Homo sapiens
ggtcagaacaagcaaataatag

SEQ ID NO: 9140191 - DNA, 22 bp, Homo sapiens
ggtcagaagtgcaaaatcagtt

SEQ ID NO: 9140192 - DNA, 22 bp, Homo sapiens
ggtcagaaggcctcggcaggaa

SEQ ID NO: 9140193 - DNA, 22 bp, Homo sapiens
ggtcagagaaagtggtagtaga

SEQ ID NO: 9140194 - DNA, 22 bp, Homo sapiens
ggtcagaggaggaataggacat

SEQ ID NO: 9140195 - DNA, 22 bp, Homo sapiens
ggtcagagctggagagataggg

SEQ ID NO: 9140196 - DNA, 22 bp, Homo sapiens
ggtaggggaagacaagtgaaaa

SEQ ID NO: 9140197 - DNA, 22 bp, Homo sapiens
ggtaggggaagacaagtgaaaa

SEQ ID NO: 9140198 - DNA, 20 bp, Homo sapiens
gggtggagttgcggtctgtg

SEQ ID NO: 9140199 - DNA, 22 bp, Homo sapiens
gggtggcaggattggcaggagt

SEQ ID NO: 9140200 - DNA, 22 bp, Homo sapiens
gggtggcacaggtgcagagggt

SEQ ID NO: 9140201 - DNA, 22 bp, Homo sapiens
gggtggcagctgttgccaaggt

SEQ ID NO: 9140202 - DNA, 22 bp, Homo sapiens
ggggtgtggacggctgtgccag

SEQ ID NO: 9140203 - DNA, 22 bp, Homo sapiens
ggggtggggttactcattgtgc

SEQ ID NO: 9140204 - DNA, 22 bp, Homo sapiens
ggggtggggttactcattgtgc

SEQ ID NO: 9140205 - DNA, 22 bp, Homo sapiens
ggggtgggcgtgcagggacacc

SEQ ID NO: 9140206 - DNA, 22 bp, Homo sapiens
ggggtgggcgtgcagggacacc

SEQ ID NO: 9140207 - DNA, 22 bp, Homo sapiens
ggggtgggcgtgcagggacacc

SEQ ID NO: 9140208 - DNA, 22 bp, Homo sapiens
ggggtgggcgtgcagggacacc

SEQ ID NO: 9140209 - DNA, 22 bp, Homo sapiens
ggggtgggcgtgcagggacacc

SEQ ID NO: 9140210 - DNA, 22 bp, Homo sapiens
ggggtgggcgtgcagggacacc

SEQ ID NO: 9140211 - DNA, 22 bp, Homo sapiens
ggggctgggatttgaacccagg

SEQ ID NO: 9140212 - DNA, 22 bp, Homo sapiens
ggggctgggatttgaacccagg

SEQ ID NO: 9140213 - DNA, 22 bp, Homo sapiens
ggggctggtggtggtttctcca

SEQ ID NO: 9140214 - DNA, 22 bp, Homo sapiens
ggggctggtggtggtttctcca

SEQ ID NO: 9140215 - DNA, 22 bp, Homo sapiens
ggggtgggcgtgcagggacacc

SEQ ID NO: 9140216 - DNA, 22 bp, Homo sapiens
ggggtgggcgtgcagggacacc

SEQ ID NO: 9140217 - DNA, 22 bp, Homo sapiens
gggtagggtgacttaggctggc

SEQ ID NO: 9140218 - DNA, 22 bp, Homo sapiens
gggtaggctgctcctggggccc

SEQ ID NO: 9140219 - DNA, 22 bp, Homo sapiens
gggtaggagaggtgtctgtgtg

SEQ ID NO: 9140220 - DNA, 22 bp, Homo sapiens
gggtaggagaggtgtctgtgtg

SEQ ID NO: 9140221 - DNA, 22 bp, Homo sapiens
gggtaggaaatccagaggtggc

SEQ ID NO: 9140222 - DNA, 22 bp, Homo sapiens
gggtaggatggtagaagggacc

SEQ ID NO: 9140223 - DNA, 22 bp, Homo sapiens
gggtggagcttggacaccagta

SEQ ID NO: 9140224 - DNA, 22 bp, Homo sapiens
gggtagtgtggtctctgggctg

SEQ ID NO: 9140225 - DNA, 22 bp, Homo sapiens
gggtggaggagaacaggcccca

SEQ ID NO: 9140226 - DNA, 22 bp, Homo sapiens
gggtggaggtgggttttgagat

SEQ ID NO: 9140227 - DNA, 22 bp, Homo sapiens
gggtggagtagaaagatgaatt

SEQ ID NO: 9140228 - DNA, 22 bp, Homo sapiens
ggggaagatttttaattagtaa

SEQ ID NO: 9140229 - DNA, 22 bp, Homo sapiens
ggggaaggatatgattagacta

SEQ ID NO: 9140230 - DNA, 22 bp, Homo sapiens
ggggaaggaaagttattagcag

SEQ ID NO: 9140231 - DNA, 22 bp, Homo sapiens
ggggccgaccgcggttcaggcc

SEQ ID NO: 9140232 - DNA, 22 bp, Homo sapiens
ggggaaggatatgattagacta

SEQ ID NO: 9140233 - DNA, 22 bp, Homo sapiens
ggggcggggctctgagaagcat

SEQ ID NO: 9140234 - DNA, 22 bp, Homo sapiens
ggggcggggctctgagaagcat

SEQ ID NO: 9140235 - DNA, 22 bp, Homo sapiens
ggggaagagcattgcacggtgt

SEQ ID NO: 9140236 - DNA, 22 bp, Homo sapiens
ggggctggctcactaagagact

SEQ ID NO: 9140237 - DNA, 22 bp, Homo sapiens
ggggctggctcactaagagact

SEQ ID NO: 9140238 - DNA, 22 bp, Homo sapiens
ggggctggctcactaagagact

SEQ ID NO: 9140239 - DNA, 22 bp, Homo sapiens
ggggctgctggtatttccagtt

SEQ ID NO: 9140240 - DNA, 22 bp, Homo sapiens
ggggctgctcgccgcgcgtttc

SEQ ID NO: 9140241 - DNA, 22 bp, Homo sapiens
ggggctgagtcagtgggaagag

SEQ ID NO: 9140242 - DNA, 22 bp, Homo sapiens
ggggctgatggaactcaggcct

SEQ ID NO: 9140243 - DNA, 22 bp, Homo sapiens
ggggctgctcccacccctgagg

SEQ ID NO: 9140244 - DNA, 20 bp, Homo sapiens
ggggctgcatgcagagaaga

SEQ ID NO: 9140245 - DNA, 22 bp, Homo sapiens
gggccaaggggagctggaaggg

SEQ ID NO: 9140246 - DNA, 22 bp, Homo sapiens
gggccacacagaacctcctggt

SEQ ID NO: 9140247 - DNA, 22 bp, Homo sapiens
gggccacacagaacctcctggt

SEQ ID NO: 9140248 - DNA, 22 bp, Homo sapiens
gggccacacagggcagctccct

SEQ ID NO: 9140249 - DNA, 22 bp, Homo sapiens
gggccacacagaacctcctggt

SEQ ID NO: 9140250 - DNA, 22 bp, Homo sapiens
gggccacacagggcagctccct

SEQ ID NO: 9140251 - DNA, 22 bp, Homo sapiens
gggccaaggggagctggaaggg

SEQ ID NO: 9140252 - DNA, 22 bp, Homo sapiens
gggcatgtagtgtgcatagaga

SEQ ID NO: 9140253 - DNA, 22 bp, Homo sapiens
gggcatggtggcaggcacctgt

SEQ ID NO: 9140254 - DNA, 22 bp, Homo sapiens
gggcatggtggcaggcacctgt

SEQ ID NO: 9140255 - DNA, 22 bp, Homo sapiens
gggcatggtggtgcacacctgt

SEQ ID NO: 9140256 - DNA, 22 bp, Homo sapiens
gggcatggtgatgtgcacctgt

SEQ ID NO: 9140257 - DNA, 22 bp, Homo sapiens
gggcatggtgatgtgcacctgt

SEQ ID NO: 9140258 - DNA, 22 bp, Homo sapiens
gggcatggtgctggtgttcatg

SEQ ID NO: 9140259 - DNA, 22 bp, Homo sapiens
gggcatggtgctggtgttcatg

SEQ ID NO: 9140260 - DNA, 22 bp, Homo sapiens
gggcatggcgtgtgctggattc

SEQ ID NO: 9140261 - DNA, 22 bp, Homo sapiens
gggcatggggcggacctggttc

SEQ ID NO: 9140262 - DNA, 22 bp, Homo sapiens
gggcatggtgagggatatgaag

SEQ ID NO: 9140263 - DNA, 22 bp, Homo sapiens
gggcatggtgatgtgcacctgt

SEQ ID NO: 9140264 - DNA, 22 bp, Homo sapiens
gggcatggccaggtgaggggtc

SEQ ID NO: 9140265 - DNA, 18 bp, Homo sapiens
gggcatggatgcagcatc

SEQ ID NO: 9140266 - DNA, 18 bp, Homo sapiens
gggcatggatgcagcatc

SEQ ID NO: 9140267 - DNA, 22 bp, Homo sapiens
gggcatggccaggtgaggggtc

SEQ ID NO: 9140268 - DNA, 22 bp, Homo sapiens
gggctgaggctaccactggtct

SEQ ID NO: 9140269 - DNA, 22 bp, Homo sapiens
gggctgaggaacatattttgtt

SEQ ID NO: 9140270 - DNA, 22 bp, Homo sapiens
gggctgaggaacatattttgtt

SEQ ID NO: 9140271 - DNA, 22 bp, Homo sapiens
gggctgagctgttctgagttta

SEQ ID NO: 9140272 - DNA, 22 bp, Homo sapiens
gggctgagctaagctgggttga

SEQ ID NO: 9140273 - DNA, 22 bp, Homo sapiens
gggctgagctaagctgggttga

SEQ ID NO: 9140274 - DNA, 22 bp, Homo sapiens
gggctgagccatttgaaccttg

SEQ ID NO: 9140275 - DNA, 22 bp, Homo sapiens
gggctgagccatttgaaccttg

SEQ ID NO: 9140276 - DNA, 22 bp, Homo sapiens
gggctgagcacatactgacagc

SEQ ID NO: 9140277 - DNA, 22 bp, Homo sapiens
gggctgagccacagcttttgtt

SEQ ID NO: 9140278 - DNA, 22 bp, Homo sapiens
gggctgagattggtgccctgtc

SEQ ID NO: 9140279 - DNA, 22 bp, Homo sapiens
gggctgagattggtgccctgtc

SEQ ID NO: 9140280 - DNA, 22 bp, Homo sapiens
gggctgagattggtgccctgtc

SEQ ID NO: 9140281 - DNA, 22 bp, Homo sapiens
gggctgagcacatactgacagc

SEQ ID NO: 9140282 - DNA, 22 bp, Homo sapiens
gggctgagattggtgccctgtc

SEQ ID NO: 9140283 - DNA, 22 bp, Homo sapiens
gggctgagagctggaatctgag

SEQ ID NO: 9140284 - DNA, 22 bp, Homo sapiens
gggctgagagctggaatctgag

SEQ ID NO: 9140285 - DNA, 22 bp, Homo sapiens
gggctgagagtgactgttctgt

SEQ ID NO: 9140286 - DNA, 22 bp, Homo sapiens
gggctgagagctggaatctgag

SEQ ID NO: 9140287 - DNA, 22 bp, Homo sapiens
gggctgccaagcctgcctgcct

SEQ ID NO: 9140288 - DNA, 22 bp, Homo sapiens
gggctgcacgtattctgctcac

SEQ ID NO: 9140289 - DNA, 22 bp, Homo sapiens
gggctgagtgggcctcttactt

SEQ ID NO: 9140290 - DNA, 22 bp, Homo sapiens
gggctgagtgtcccaggccgaa

SEQ ID NO: 9140291 - DNA, 22 bp, Homo sapiens
gggctgagggccaattcctact

SEQ ID NO: 9140292 - DNA, 22 bp, Homo sapiens
gggctgaggctaccactggtct

SEQ ID NO: 9140293 - DNA, 22 bp, Homo sapiens
gggctgagttcctgcctcactc

SEQ ID NO: 9140294 - DNA, 22 bp, Homo sapiens
gggctgagttcctgcctcactc

SEQ ID NO: 9140295 - DNA, 20 bp, Homo sapiens
gggcttggaggactcgaggg

SEQ ID NO: 9140296 - DNA, 20 bp, Homo sapiens
gggcttggaggactcgaggg

SEQ ID NO: 9140297 - DNA, 22 bp, Homo sapiens
gggcttgctgatttgggcagga

SEQ ID NO: 9140298 - DNA, 22 bp, Homo sapiens
gggcttggagtaggctgatgaa

SEQ ID NO: 9140299 - DNA, 22 bp, Homo sapiens
gggcttggagtaggctgatgaa

SEQ ID NO: 9140300 - DNA, 22 bp, Homo sapiens
gggctgctgtgttcctgaggca

SEQ ID NO: 9140301 - DNA, 22 bp, Homo sapiens
gggcttcttgagctgccggccc

SEQ ID NO: 9140302 - DNA, 22 bp, Homo sapiens
gggcttcttgcaggggcaacat

SEQ ID NO: 9140303 - DNA, 22 bp, Homo sapiens
gggcttcttgccatggggacgg

SEQ ID NO: 9140304 - DNA, 22 bp, Homo sapiens
gggcttcttgccatggggacgg

SEQ ID NO: 9140305 - DNA, 22 bp, Homo sapiens
gggctgctgggcaagaaacatt

SEQ ID NO: 9140306 - DNA, 22 bp, Homo sapiens
gggctgctgcccaggaggcacc

SEQ ID NO: 9140307 - DNA, 22 bp, Homo sapiens
cttattttaagtcagtttgggt

SEQ ID NO: 9140308 - DNA, 22 bp, Homo sapiens
cttatttgcccatgtttcttta

SEQ ID NO: 9140309 - DNA, 22 bp, Homo sapiens
cttatttgcccatgtttcttta

SEQ ID NO: 9140310 - DNA, 22 bp, Homo sapiens
cttatttgcccatgtttcttta

SEQ ID NO: 9140311 - DNA, 22 bp, Homo sapiens
cttattttgctgatgacccagg

SEQ ID NO: 9140312 - DNA, 22 bp, Homo sapiens
cttattttgctgatgacccagg

SEQ ID NO: 9140313 - DNA, 22 bp, Homo sapiens
cttatttcctgacatggaaaga

SEQ ID NO: 9140314 - DNA, 22 bp, Homo sapiens
cttcagaagaaaagcagtgtgt

SEQ ID NO: 9140315 - DNA, 22 bp, Homo sapiens
cttcagaactataaaaagtact

SEQ ID NO: 9140316 - DNA, 22 bp, Homo sapiens
cttcagcccagcctccgcctcc

SEQ ID NO: 9140317 - DNA, 22 bp, Homo sapiens
cttattttgctgatgacccagg

SEQ ID NO: 9140318 - DNA, 22 bp, Homo sapiens
cttcaaacactagaaacacagg

SEQ ID NO: 9140319 - DNA, 22 bp, Homo sapiens
cttcaaaagccagaagcctgcg

SEQ ID NO: 9140320 - DNA, 22 bp, Homo sapiens
cttcaaaagccagaagcctgcg

SEQ ID NO: 9140321 - DNA, 22 bp, Homo sapiens
cttcaaacccagattaaatgca

SEQ ID NO: 9140322 - DNA, 22 bp, Homo sapiens
cttcaaaccacatgctgaaaat

SEQ ID NO: 9140323 - DNA, 22 bp, Homo sapiens
cttcaaaccacatgctgaaaat

SEQ ID NO: 9140324 - DNA, 22 bp, Homo sapiens
cttcaaacccagattaaatgca

SEQ ID NO: 9140325 - DNA, 22 bp, Homo sapiens
cttcaaacactagaaacacagg

SEQ ID NO: 9140326 - DNA, 22 bp, Homo sapiens
ctgttggcattaagatagtcat

SEQ ID NO: 9140327 - DNA, 22 bp, Homo sapiens
ctgttggcctggtgatgaagct

SEQ ID NO: 9140328 - DNA, 23 bp, Homo sapiens
ctgttggctgtcagggctggact

SEQ ID NO: 9140329 - DNA, 22 bp, Homo sapiens
ctgttggcttcagtgcagagaa

SEQ ID NO: 9140330 - DNA, 22 bp, Homo sapiens
ctgttgtattattcaatattat

SEQ ID NO: 9140331 - DNA, 22 bp, Homo sapiens
cttatattttaggaacagacaa

SEQ ID NO: 9140332 - DNA, 22 bp, Homo sapiens
cttatattttaggaacagacaa

SEQ ID NO: 9140333 - DNA, 23 bp, Homo sapiens
cttattcattcatgtagcccatt

SEQ ID NO: 9140334 - DNA, 23 bp, Homo sapiens
cttattcattcatgtagcccatt

SEQ ID NO: 9140335 - DNA, 22 bp, Homo sapiens
cttattgtgagatgcgataatt

SEQ ID NO: 9140336 - DNA, 22 bp, Homo sapiens
cttattgtcttacagtaataga

SEQ ID NO: 9140337 - DNA, 22 bp, Homo sapiens
cttattgtgtctttgaataagt

SEQ ID NO: 9140338 - DNA, 22 bp, Homo sapiens
cttattgtgataccatgcagta

SEQ ID NO: 9140339 - DNA, 22 bp, Homo sapiens
cttattgtgaggtattgagatt

SEQ ID NO: 9140340 - DNA, 22 bp, Homo sapiens
cttattgtgattcctgcctctt

SEQ ID NO: 9140341 - DNA, 22 bp, Homo sapiens
cttattgttcagatagagatga

SEQ ID NO: 9140342 - DNA, 22 bp, Homo sapiens
cttattgtgtgtattttctagt

SEQ ID NO: 9140343 - DNA, 22 bp, Homo sapiens
cttattgttcctggaccctgag

SEQ ID NO: 9140344 - DNA, 18 bp, Homo sapiens
cttattgtttaaatggcc

SEQ ID NO: 9140345 - DNA, 22 bp, Homo sapiens
cttatttaatgagggttagaat

SEQ ID NO: 9140346 - DNA, 22 bp, Homo sapiens
cttatttactgatccacagatg

SEQ ID NO: 9140347 - DNA, 22 bp, Homo sapiens
cttattgtcctgactcatggcc

SEQ ID NO: 9140348 - DNA, 22 bp, Homo sapiens
cttattctactccacaagctct

SEQ ID NO: 9140349 - DNA, 22 bp, Homo sapiens
cttcagtgaatgttgagtaagg

SEQ ID NO: 9140350 - DNA, 22 bp, Homo sapiens
cttcagtgattgcagaaagcct

SEQ ID NO: 9140351 - DNA, 22 bp, Homo sapiens
cttcagtgattgcagaaagcct

SEQ ID NO: 9140352 - DNA, 22 bp, Homo sapiens
cttcaggatttaggaagatgaa

SEQ ID NO: 9140353 - DNA, 22 bp, Homo sapiens
cttcagtatcctccacatgtta

SEQ ID NO: 9140354 - DNA, 18 bp, Homo sapiens
cttcagtcttcccacctc

SEQ ID NO: 9140355 - DNA, 22 bp, Homo sapiens
cttcagctaggatccctgcagc

SEQ ID NO: 9140356 - DNA, 22 bp, Homo sapiens
cttcagccctgagtgccagcag

SEQ ID NO: 9140357 - DNA, 22 bp, Homo sapiens
cttcagcctcaactactatggt

SEQ ID NO: 9140358 - DNA, 22 bp, Homo sapiens
cttcagcctcatctcagcccgt

SEQ ID NO: 9140359 - DNA, 22 bp, Homo sapiens
cttcagcctcgttactcctgcg

SEQ ID NO: 9140360 - DNA, 22 bp, Homo sapiens
cttcaggaaaatctctaaggat

SEQ ID NO: 9140361 - DNA, 22 bp, Homo sapiens
cttcaggaaaatctctaaggat

SEQ ID NO: 9140362 - DNA, 22 bp, Homo sapiens
cttcagctgtggtctccaaggc

SEQ ID NO: 9140363 - DNA, 22 bp, Homo sapiens
cttcagctgcagttatgtttag

SEQ ID NO: 9140364 - DNA, 22 bp, Homo sapiens
cttcaggattaatttggggcct

SEQ ID NO: 9140365 - DNA, 22 bp, Homo sapiens
cttcaggattaatttggggcct

SEQ ID NO: 9140366 - DNA, 22 bp, Homo sapiens
cttcaggagtagttacctagca

SEQ ID NO: 9140367 - DNA, 22 bp, Homo sapiens
cttcctctgtgtcctgggcttg

SEQ ID NO: 9140368 - DNA, 16 bp, Homo sapiens
cttcctcttcactggc

SEQ ID NO: 9140369 - DNA, 22 bp, Homo sapiens
cttcctctgtgtcctgggcttc

SEQ ID NO: 9140370 - DNA, 22 bp, Homo sapiens
cttcctctgtggccagagtgta

SEQ ID NO: 9140371 - DNA, 18 bp, Homo sapiens
cttcctcttctggagaaa

SEQ ID NO: 9140372 - DNA, 18 bp, Homo sapiens
cttcctcttctggagaaa

SEQ ID NO: 9140373 - DNA, 22 bp, Homo sapiens
cttcctgaaggatggcagcctc

SEQ ID NO: 9140374 - DNA, 22 bp, Homo sapiens
cttcctgaacaatgccatcaat

SEQ ID NO: 9140375 - DNA, 22 bp, Homo sapiens
cttcctctgaggcttctgagtc

SEQ ID NO: 9140376 - DNA, 22 bp, Homo sapiens
cttcctctgaggcttctgagtc

SEQ ID NO: 9140377 - DNA, 22 bp, Homo sapiens
cttccgtgtcagttccaggtgg

SEQ ID NO: 9140378 - DNA, 22 bp, Homo sapiens
cttccctttttatgtcttcagc

SEQ ID NO: 9140379 - DNA, 18 bp, Homo sapiens
cttcagtggctgctctgc

SEQ ID NO: 9140380 - DNA, 22 bp, Homo sapiens
ctttatgtactgtgtatttgaa

SEQ ID NO: 9140381 - DNA, 22 bp, Homo sapiens
cttgtcagccaattgtggattt

SEQ ID NO: 9140382 - DNA, 22 bp, Homo sapiens
cttgtcagccaattgtggattt

SEQ ID NO: 9140383 - DNA, 22 bp, Homo sapiens
cttgtcctttacttgagactca

SEQ ID NO: 9140384 - DNA, 22 bp, Homo sapiens
cttgtccgaggagacgcggaag

SEQ ID NO: 9140385 - DNA, 22 bp, Homo sapiens
cttgtcagccaattgtggattt

SEQ ID NO: 9140386 - DNA, 22 bp, Homo sapiens
cttgtattcttccacttaagat

SEQ ID NO: 9140387 - DNA, 22 bp, Homo sapiens
cttgtattctgcctaaccttca

SEQ ID NO: 9140388 - DNA, 22 bp, Homo sapiens
cttgtattcttgtacctttcaa

SEQ ID NO: 9140389 - DNA, 22 bp, Homo sapiens
cttgtattcagcatcttaacta

SEQ ID NO: 9140390 - DNA, 22 bp, Homo sapiens
cttgtattcagagtggacatga

SEQ ID NO: 9140391 - DNA, 22 bp, Homo sapiens
cttgtatacagtgtacacattg

SEQ ID NO: 9140392 - DNA, 22 bp, Homo sapiens
cttgcagtttaggtcctctgtg

SEQ ID NO: 9140393 - DNA, 22 bp, Homo sapiens
cttgcagtgtggccttgaagag

SEQ ID NO: 9140394 - DNA, 20 bp, Homo sapiens
cttgcagtttcaccttcact

SEQ ID NO: 9140395 - DNA, 22 bp, Homo sapiens
cttgccagtgttgcagaagctc

SEQ ID NO: 9140396 - DNA, 22 bp, Homo sapiens
cttgccagggactcagtcaggg

SEQ ID NO: 9140397 - DNA, 22 bp, Homo sapiens
cttgccagcaggcgctgtgtac

SEQ ID NO: 9140398 - DNA, 22 bp, Homo sapiens
cttgcccaccagtcagtggctt

SEQ ID NO: 9140399 - DNA, 22 bp, Homo sapiens
cttgtagaattgaaatggtctc

SEQ ID NO: 9140400 - DNA, 22 bp, Homo sapiens
cttgtagctgcttcttctgaag

SEQ ID NO: 9140401 - DNA, 20 bp, Homo sapiens
cttgtacatgataaagattt

SEQ ID NO: 9140402 - DNA, 22 bp, Homo sapiens
cttgggtgctggaggctgccgc

SEQ ID NO: 9140403 - DNA, 22 bp, Homo sapiens
cttcctgggcaatgttctgctt

SEQ ID NO: 9140404 - DNA, 22 bp, Homo sapiens
cttcctggccattgccatggca

SEQ ID NO: 9140405 - DNA, 22 bp, Homo sapiens
cttgacagtcccaggaaaatag

SEQ ID NO: 9140406 - DNA, 22 bp, Homo sapiens
cttgactcaggctatattctag

SEQ ID NO: 9140407 - DNA, 22 bp, Homo sapiens
cttgactcttgcttcccatgga

SEQ ID NO: 9140408 - DNA, 22 bp, Homo sapiens
cttcctgggtcagcctggaggt

SEQ ID NO: 9140409 - DNA, 22 bp, Homo sapiens
cttcctgcaggacagccatctg

SEQ ID NO: 9140410 - DNA, 22 bp, Homo sapiens
cttcctgctcccctgccaattc

SEQ ID NO: 9140411 - DNA, 19 bp, Homo sapiens
cttcctggaggagagcctc

SEQ ID NO: 9140412 - DNA, 22 bp, Homo sapiens
cttcctggatgaacagtagaaa

SEQ ID NO: 9140413 - DNA, 22 bp, Homo sapiens
cttcctggatgagcaggctgat

SEQ ID NO: 9140414 - DNA, 22 bp, Homo sapiens
cttcctggatgagcaggctgat

SEQ ID NO: 9140415 - DNA, 22 bp, Homo sapiens
cttcctggcaaagcaatcagag

SEQ ID NO: 9140416 - DNA, 22 bp, Homo sapiens
cttcctggatgaagcccagcat

SEQ ID NO: 9140417 - DNA, 23 bp, Homo sapiens
cttgcaggaagcagatggcacac

SEQ ID NO: 9140418 - DNA, 22 bp, Homo sapiens
cttgcaggattttgctgctgta

SEQ ID NO: 9140419 - DNA, 22 bp, Homo sapiens
cttgcaggattttgctgctgta

SEQ ID NO: 9140420 - DNA, 22 bp, Homo sapiens
cttgcaggcagggacactgtct

SEQ ID NO: 9140421 - DNA, 22 bp, Homo sapiens
cttgcaggcagggcctcctgga

SEQ ID NO: 9140422 - DNA, 23 bp, Homo sapiens
cttgcagggctggaggcttagaa

SEQ ID NO: 9140423 - DNA, 22 bp, Homo sapiens
cttgactcttgcttcccatgga

SEQ ID NO: 9140424 - DNA, 22 bp, Homo sapiens
cttgcaaacactcaaagccatc

SEQ ID NO: 9140425 - DNA, 22 bp, Homo sapiens
cttgatgtataagttgatatgt

SEQ ID NO: 9140426 - DNA, 22 bp, Homo sapiens
ctgttacacggaccttcaaatc

SEQ ID NO: 9140427 - DNA, 22 bp, Homo sapiens
ctgtgtcttcctctgcccaggc

SEQ ID NO: 9140428 - DNA, 22 bp, Homo sapiens
ctgtgtctccttggtgggatat

SEQ ID NO: 9140429 - DNA, 23 bp, Homo sapiens
ctgtgtctatgcagccatatcca

SEQ ID NO: 9140430 - DNA, 22 bp, Homo sapiens
ctgtgtctgcctgggatccatt

SEQ ID NO: 9140431 - DNA, 22 bp, Homo sapiens
ctgtgtctgcctgggatccatt

SEQ ID NO: 9140432 - DNA, 22 bp, Homo sapiens
ctgttgagtaatttatatcagg

SEQ ID NO: 9140433 - DNA, 22 bp, Homo sapiens
ctgttgctcccagggagagggt

SEQ ID NO: 9140434 - DNA, 22 bp, Homo sapiens
ctgttgcttcaggaaacagtaa

SEQ ID NO: 9140435 - DNA, 22 bp, Homo sapiens
ctgttctttagttccactgcaa

SEQ ID NO: 9140436 - DNA, 22 bp, Homo sapiens
ctgttcttatcgtcttaatatc

SEQ ID NO: 9140437 - DNA, 22 bp, Homo sapiens
ctgttctggagacactgatgaa

SEQ ID NO: 9140438 - DNA, 22 bp, Homo sapiens
ctgttctccggccagtccagag

SEQ ID NO: 9140439 - DNA, 22 bp, Homo sapiens
ctgttctatcattaaaagctat

SEQ ID NO: 9140440 - DNA, 22 bp, Homo sapiens
ctgttctctggcggtggctgtt

SEQ ID NO: 9140441 - DNA, 22 bp, Homo sapiens
ctgttctctggcggtggctgtt

SEQ ID NO: 9140442 - DNA, 22 bp, Homo sapiens
ctgttctctggcggtggctgtt

SEQ ID NO: 9140443 - DNA, 22 bp, Homo sapiens
ctgttctgaccagtgcagggat

SEQ ID NO: 9140444 - DNA, 22 bp, Homo sapiens
ctgttctgaccagtgcagggat

SEQ ID NO: 9140445 - DNA, 18 bp, Homo sapiens
ctgttcagctgaactaca

SEQ ID NO: 9140446 - DNA, 22 bp, Homo sapiens
ctgttccagatcaggacaccgt

SEQ ID NO: 9140447 - DNA, 17 bp, Homo sapiens
ctgttccccactactca

SEQ ID NO: 9140448 - DNA, 22 bp, Homo sapiens
ctgttcagatggcacattcagt

SEQ ID NO: 9140449 - DNA, 22 bp, Homo sapiens
ctgttcagaaaaaatcttcatg

SEQ ID NO: 9140450 - DNA, 22 bp, Homo sapiens
ctgttcacagaatcctcccctg

SEQ ID NO: 9140451 - DNA, 22 bp, Homo sapiens
ctgtggctgtatttggccagag

SEQ ID NO: 9140452 - DNA, 22 bp, Homo sapiens
ctgtggctgtatttggccagag

SEQ ID NO: 9140453 - DNA, 22 bp, Homo sapiens
ctgtggctgtatttggccagag

SEQ ID NO: 9140454 - DNA, 22 bp, Homo sapiens
ctgtggctggcctgtctgacat

SEQ ID NO: 9140455 - DNA, 22 bp, Homo sapiens
ctgtggctgcgtaggtctggca

SEQ ID NO: 9140456 - DNA, 22 bp, Homo sapiens
ctgtggtggcctccctgccatg

SEQ ID NO: 9140457 - DNA, 22 bp, Homo sapiens
ctgtggtggcctccctgccatg

SEQ ID NO: 9140458 - DNA, 22 bp, Homo sapiens
ctgtggctgtatttggccagag

SEQ ID NO: 9140459 - DNA, 22 bp, Homo sapiens
ctgtggctgtgaaacttctcag

SEQ ID NO: 9140460 - DNA, 23 bp, Homo sapiens
ctgtgtctatgcagccatatcca

SEQ ID NO: 9140461 - DNA, 22 bp, Homo sapiens
ctgtgtcctttaaaaaagacac

SEQ ID NO: 9140462 - DNA, 22 bp, Homo sapiens
ctgtgtccttttagttgctgtg

SEQ ID NO: 9140463 - DNA, 22 bp, Homo sapiens
ctgtgtccttttagttgctgtg

SEQ ID NO: 9140464 - DNA, 22 bp, Homo sapiens
ctgtgtcctgcgtcaagccaat

SEQ ID NO: 9140465 - DNA, 22 bp, Homo sapiens
ctgtgtcctcccgctgcaccca

SEQ ID NO: 9140466 - DNA, 22 bp, Homo sapiens
ctgtgtcctgtctcctaaggtg

SEQ ID NO: 9140467 - DNA, 22 bp, Homo sapiens
ctgtgtcctccccatcacttct

SEQ ID NO: 9140468 - DNA, 22 bp, Homo sapiens
ctgtggctctccaatggaggga

SEQ ID NO: 9140469 - DNA, 22 bp, Homo sapiens
ctgtggctctctgcagggtccc

SEQ ID NO: 9140470 - DNA, 22 bp, Homo sapiens
ctgtggctctctgcagggtccc

SEQ ID NO: 9140471 - DNA, 22 bp, Homo sapiens
ctgtggctctcagaggctgctg

SEQ ID NO: 9140472 - DNA, 22 bp, Homo sapiens
ctgtggctctcagaggctgctg

SEQ ID NO: 9140473 - DNA, 20 bp, Homo sapiens
ctgtggctcatgcatctgcc

SEQ ID NO: 9140474 - DNA, 22 bp, Homo sapiens
ctgtggctccagtgaaccaatg

SEQ ID NO: 9140475 - DNA, 22 bp, Homo sapiens
ctgtggctccatagaagttgca

SEQ ID NO: 9140476 - DNA, 16 bp, Homo sapiens
ctgtggctcccaggtt

SEQ ID NO: 9140477 - DNA, 22 bp, Homo sapiens
ctgtggctcatatctgtaatct

SEQ ID NO: 9140478 - DNA, 20 bp, Homo sapiens
ctgtggctcatgcatctgcc

SEQ ID NO: 9140479 - DNA, 20 bp, Homo sapiens
ctgtggctcatgcatctgcc

SEQ ID NO: 9140480 - DNA, 23 bp, Homo sapiens
ctgtggctgagtcctgttggagt

SEQ ID NO: 9140481 - DNA, 19 bp, Homo sapiens
ctgtggctgacctctggcc

SEQ ID NO: 9140482 - DNA, 22 bp, Homo sapiens
ctgtggctctttagttgagcac

SEQ ID NO: 9140483 - DNA, 22 bp, Homo sapiens
ctgtggctgaactctgaagagg

SEQ ID NO: 9140484 - DNA, 22 bp, Homo sapiens
ctgtggctgaactctgaagagg

SEQ ID NO: 9140485 - DNA, 22 bp, Homo sapiens
ctgtggctctgcagtcccaaca

SEQ ID NO: 9140486 - DNA, 22 bp, Homo sapiens
ctgtggctctttagttgagcac

SEQ ID NO: 9140487 - DNA, 22 bp, Homo sapiens
ctgtggctgcgccctgggggag

SEQ ID NO: 9140488 - DNA, 22 bp, Homo sapiens
ctgtggctgcgccatcgaaaac

SEQ ID NO: 9140489 - DNA, 22 bp, Homo sapiens
ctgtggctgcagccttggtcct

SEQ ID NO: 9140490 - DNA, 22 bp, Homo sapiens
ctgtggctgcagccttggtcct

SEQ ID NO: 9140491 - DNA, 22 bp, Homo sapiens
ctgtggctgcctcacctacagg

SEQ ID NO: 9140492 - DNA, 22 bp, Homo sapiens
ctgtcctgaagttttcatgaga

SEQ ID NO: 9140493 - DNA, 22 bp, Homo sapiens
ctgtcctgagataaagatgagg

SEQ ID NO: 9140494 - DNA, 20 bp, Homo sapiens
ctgtcctgatcttttcagaa

SEQ ID NO: 9140495 - DNA, 22 bp, Homo sapiens
ctgtcctgcccaccctgcaggg

SEQ ID NO: 9140496 - DNA, 22 bp, Homo sapiens
ctgtcctgcccaccctgcaggg

SEQ ID NO: 9140497 - DNA, 22 bp, Homo sapiens
ctgtcctgccagtcctggactc

SEQ ID NO: 9140498 - DNA, 22 bp, Homo sapiens
ctgtcctgatggtgccactggt

SEQ ID NO: 9140499 - DNA, 19 bp, Homo sapiens
ctgtcctggtttggtccct

SEQ ID NO: 9140500 - DNA, 21 bp, Homo sapiens
ctgtcctggtctagaggcaca

SEQ ID NO: 9140501 - DNA, 22 bp, Homo sapiens
ctgtcctgcccaccctgcaggg

SEQ ID NO: 9140502 - DNA, 22 bp, Homo sapiens
ctgtcctggagggcataggacg

SEQ ID NO: 9140503 - DNA, 22 bp, Homo sapiens
ctgtcctggccgcccttgtgag

SEQ ID NO: 9140504 - DNA, 22 bp, Homo sapiens
ctgtcctgggggtggtccttgc

SEQ ID NO: 9140505 - DNA, 22 bp, Homo sapiens
ctgtcccttcattattcactac

SEQ ID NO: 9140506 - DNA, 22 bp, Homo sapiens
ctgtcctctgtcctcagcagga

SEQ ID NO: 9140507 - DNA, 22 bp, Homo sapiens
ctgtccctgagcaactcctgtt

SEQ ID NO: 9140508 - DNA, 22 bp, Homo sapiens
ctgggtgccacgggcaccctgg

SEQ ID NO: 9140509 - DNA, 22 bp, Homo sapiens
ctgggtgccacgggcaccctgg

SEQ ID NO: 9140510 - DNA, 22 bp, Homo sapiens
ctgggtgctgtgggctcagagg

SEQ ID NO: 9140511 - DNA, 22 bp, Homo sapiens
ctgtccctgagcaactcctgtt

SEQ ID NO: 9140512 - DNA, 22 bp, Homo sapiens
ctgggtgagttgatgaaggaga

SEQ ID NO: 9140513 - DNA, 22 bp, Homo sapiens
ctgggtgattcctgtccaggca

SEQ ID NO: 9140514 - DNA, 22 bp, Homo sapiens
ctgggtgccaattcatgtttat

SEQ ID NO: 9140515 - DNA, 22 bp, Homo sapiens
ctgggtgattcctgtccaggca

SEQ ID NO: 9140516 - DNA, 22 bp, Homo sapiens
ctgggtgagctggccagagggt

SEQ ID NO: 9140517 - DNA, 22 bp, Homo sapiens
ctgggtgagtataggaaaggga

SEQ ID NO: 9140518 - DNA, 22 bp, Homo sapiens
ctgggtgagctggccagagggt

SEQ ID NO: 9140519 - DNA, 22 bp, Homo sapiens
ctgggtgagctggccagagggt

SEQ ID NO: 9140520 - DNA, 22 bp, Homo sapiens
ctgggtgacagagtgagatggt

SEQ ID NO: 9140521 - DNA, 22 bp, Homo sapiens
ctgggtctgtcactagataaat

SEQ ID NO: 9140522 - DNA, 22 bp, Homo sapiens
ctgggtctgtgcccagggacct

SEQ ID NO: 9140523 - DNA, 19 bp, Homo sapiens
ctgggtcttattctgtgaa

SEQ ID NO: 9140524 - DNA, 22 bp, Homo sapiens
ctgggtcttcagcagcaggcgg

SEQ ID NO: 9140525 - DNA, 22 bp, Homo sapiens
ctgggtctttttcttccattga

SEQ ID NO: 9140526 - DNA, 22 bp, Homo sapiens
ctgggtgaatttgaaggaaagg

SEQ ID NO: 9140527 - DNA, 22 bp, Homo sapiens
ctgtgagggccagagtcagggc

SEQ ID NO: 9140528 - DNA, 22 bp, Homo sapiens
ctgtgagggccagagtcagggc

SEQ ID NO: 9140529 - DNA, 22 bp, Homo sapiens
ctgtgcagtccagccctggaca

SEQ ID NO: 9140530 - DNA, 22 bp, Homo sapiens
ctgtgcagtaggtcagggctgg

SEQ ID NO: 9140531 - DNA, 22 bp, Homo sapiens
ctgtgcagtggcagcgtgtggg

SEQ ID NO: 9140532 - DNA, 22 bp, Homo sapiens
ctgtgagtaatgacctgtcttg

SEQ ID NO: 9140533 - DNA, 22 bp, Homo sapiens
ctgtgagtccctggggaggtta

SEQ ID NO: 9140534 - DNA, 22 bp, Homo sapiens
ctgtgcagtgtggggtaggcct

SEQ ID NO: 9140535 - DNA, 22 bp, Homo sapiens
ctgtgcatggccatcagtgccc

SEQ ID NO: 9140536 - DNA, 22 bp, Homo sapiens
ctgtgcatggcagatgctgtta

SEQ ID NO: 9140537 - DNA, 22 bp, Homo sapiens
ctgtgcatgcgcggagctgaaa

SEQ ID NO: 9140538 - DNA, 22 bp, Homo sapiens
ctgtgccacctgagggactcta

SEQ ID NO: 9140539 - DNA, 22 bp, Homo sapiens
ctgtgcccagctccctgactgc

SEQ ID NO: 9140540 - DNA, 22 bp, Homo sapiens
ctgtgcccaggcccctggggat

SEQ ID NO: 9140541 - DNA, 22 bp, Homo sapiens
ctgtgcccacctggctctgagg

SEQ ID NO: 9140542 - DNA, 22 bp, Homo sapiens
ctgtgccattctttgtagcatg

SEQ ID NO: 9140543 - DNA, 22 bp, Homo sapiens
ctgtgccaggcccagctgactt

SEQ ID NO: 9140544 - DNA, 22 bp, Homo sapiens
ctgtgccatctgcactctcgtc

SEQ ID NO: 9140545 - DNA, 22 bp, Homo sapiens
ctgtgccatcctagggctgctg

SEQ ID NO: 9140546 - DNA, 22 bp, Homo sapiens
ctgtggccagatggtgccagtt

SEQ ID NO: 9140547 - DNA, 22 bp, Homo sapiens
ctgtggccagatggtgccagtt

SEQ ID NO: 9140548 - DNA, 22 bp, Homo sapiens
ctgtggctcaggcctgtaagcc

SEQ ID NO: 9140549 - DNA, 22 bp, Homo sapiens
ctggccaggccccttgcagggc

SEQ ID NO: 9140550 - DNA, 22 bp, Homo sapiens
ctggccaggcatcccctgatcc

SEQ ID NO: 9140551 - DNA, 22 bp, Homo sapiens
ctggcccagtctcagagtgtca

SEQ ID NO: 9140552 - DNA, 22 bp, Homo sapiens
ctggccctattccaggccttcc

SEQ ID NO: 9140553 - DNA, 22 bp, Homo sapiens
ctggccctatgagcctcctgat

SEQ ID NO: 9140554 - DNA, 22 bp, Homo sapiens
ctggccctcagactcatgggca

SEQ ID NO: 9140555 - DNA, 22 bp, Homo sapiens
ctggccctcagactcatgggca

SEQ ID NO: 9140556 - DNA, 22 bp, Homo sapiens
ctggccctcggagtccagctgc

SEQ ID NO: 9140557 - DNA, 22 bp, Homo sapiens
ctggccctcggagtccagctgc

SEQ ID NO: 9140558 - DNA, 22 bp, Homo sapiens
ctggccctgcctaatgtacttg

SEQ ID NO: 9140559 - DNA, 22 bp, Homo sapiens
ctggccctcgtcagtttcactg

SEQ ID NO: 9140560 - DNA, 22 bp, Homo sapiens
ctggcctgtgggctgtctccgg

SEQ ID NO: 9140561 - DNA, 22 bp, Homo sapiens
ctggccctggctggagcccagg

SEQ ID NO: 9140562 - DNA, 23 bp, Homo sapiens
ctggccctggctctgtgatcatg

SEQ ID NO: 9140563 - DNA, 23 bp, Homo sapiens
ctggccctggctctgtgatcatg

SEQ ID NO: 9140564 - DNA, 22 bp, Homo sapiens
ctggccctggtaaggacaccca

SEQ ID NO: 9140565 - DNA, 22 bp, Homo sapiens
ctggcctggtctggcctctcca

SEQ ID NO: 9140566 - DNA, 22 bp, Homo sapiens
ctggcctggtctggcctctcca

SEQ ID NO: 9140567 - DNA, 22 bp, Homo sapiens
ctggcctggtctggcctctcca

SEQ ID NO: 9140568 - DNA, 22 bp, Homo sapiens
ctggccctgtaggatgtgagtt

SEQ ID NO: 9140569 - DNA, 22 bp, Homo sapiens
ctggctccaaattctgatgttc

SEQ ID NO: 9140570 - DNA, 22 bp, Homo sapiens
ctggctccaaattctgatgttc

SEQ ID NO: 9140571 - DNA, 22 bp, Homo sapiens
ctggctccaaggaagaggtttt

SEQ ID NO: 9140572 - DNA, 22 bp, Homo sapiens
ctggctcttgcgactcagcttg

SEQ ID NO: 9140573 - DNA, 22 bp, Homo sapiens
ctggctgcaggaaggagtgggc

SEQ ID NO: 9140574 - DNA, 22 bp, Homo sapiens
ctggctgcaggatgaggctgcc

SEQ ID NO: 9140575 - DNA, 22 bp, Homo sapiens
ctggctgcaggatgaggctgcc

SEQ ID NO: 9140576 - DNA, 22 bp, Homo sapiens
ctggctcatagagcagctccaa

SEQ ID NO: 9140577 - DNA, 22 bp, Homo sapiens
ctggctcatgtgatgagggcaa

SEQ ID NO: 9140578 - DNA, 22 bp, Homo sapiens
ctggctgtgcagtcttccagaa

SEQ ID NO: 9140579 - DNA, 22 bp, Homo sapiens
ctggctggagcaggcatcttgt

SEQ ID NO: 9140580 - DNA, 22 bp, Homo sapiens
ctggctggagcaggcatcttgt

SEQ ID NO: 9140581 - DNA, 22 bp, Homo sapiens
ctggctggacttgtgcatgtca

SEQ ID NO: 9140582 - DNA, 22 bp, Homo sapiens
ctggctggaagttagagaactt

SEQ ID NO: 9140583 - DNA, 22 bp, Homo sapiens
ctggctggaagttagagaactt

SEQ ID NO: 9140584 - DNA, 22 bp, Homo sapiens
ctggctggacttgtgcatgtca

SEQ ID NO: 9140585 - DNA, 22 bp, Homo sapiens
ctggctggacttgtgcatgtca

SEQ ID NO: 9140586 - DNA, 22 bp, Homo sapiens
ctggctggagaaatgaaattct

SEQ ID NO: 9140587 - DNA, 22 bp, Homo sapiens
ctggctggagcaggcatcttgt

SEQ ID NO: 9140588 - DNA, 20 bp, Homo sapiens
ctggctggaaacttagcctt

SEQ ID NO: 9140589 - DNA, 20 bp, Homo sapiens
ctggctggaaacttagcctt

SEQ ID NO: 9140590 - DNA, 22 bp, Homo sapiens
ctggctgcttgttttgatgggt

SEQ ID NO: 9140591 - DNA, 22 bp, Homo sapiens
ctggctgcttgtagactcgact

SEQ ID NO: 9140592 - DNA, 16 bp, Homo sapiens
ctggctggaagcctgg

SEQ ID NO: 9140593 - DNA, 22 bp, Homo sapiens
ctggctggaacgccgaggcggc

SEQ ID NO: 9140594 - DNA, 22 bp, Homo sapiens
ctggctggaacgccgaggcggc

SEQ ID NO: 9140595 - DNA, 22 bp, Homo sapiens
ctggctggaacgccgaggcggc

SEQ ID NO: 9140596 - DNA, 22 bp, Homo sapiens
ctggctgcttgggacagccatg

SEQ ID NO: 9140597 - DNA, 22 bp, Homo sapiens
ctggctgctggcctgaggatgc

SEQ ID NO: 9140598 - DNA, 22 bp, Homo sapiens
ctggctgcattggcaagtcaat

SEQ ID NO: 9140599 - DNA, 22 bp, Homo sapiens
ctggctgcaggatgaggctgcc

SEQ ID NO: 9140600 - DNA, 22 bp, Homo sapiens
ctggctgccacttcagggtctt

SEQ ID NO: 9140601 - DNA, 22 bp, Homo sapiens
ctggctgcctatagtctccctt

SEQ ID NO: 9140602 - DNA, 22 bp, Homo sapiens
ctgccagccaggccaggtaggc

SEQ ID NO: 9140603 - DNA, 22 bp, Homo sapiens
ctgccagcagaggccagcgctg

SEQ ID NO: 9140604 - DNA, 22 bp, Homo sapiens
ctgccagcaatgtgaccatgct

SEQ ID NO: 9140605 - DNA, 22 bp, Homo sapiens
ctgccagcaagctaccctggca

SEQ ID NO: 9140606 - DNA, 22 bp, Homo sapiens
ctgccagcactgcctcctgagg

SEQ ID NO: 9140607 - DNA, 22 bp, Homo sapiens
ctgccagctcgccacaatgaca

SEQ ID NO: 9140608 - DNA, 22 bp, Homo sapiens
ctgccagctcaaagcgcagcta

SEQ ID NO: 9140609 - DNA, 22 bp, Homo sapiens
ctgccagctcaccggctcagac

SEQ ID NO: 9140610 - DNA, 22 bp, Homo sapiens
ctgccagctagctcctagttga

SEQ ID NO: 9140611 - DNA, 22 bp, Homo sapiens
ctggcagcttcaggacactcgg

SEQ ID NO: 9140612 - DNA, 22 bp, Homo sapiens
ctggcagcccaacctagagtct

SEQ ID NO: 9140613 - DNA, 22 bp, Homo sapiens
ctggcaggaaggcatttagaca

SEQ ID NO: 9140614 - DNA, 22 bp, Homo sapiens
ctggcaggaagttagatggtaa

SEQ ID NO: 9140615 - DNA, 22 bp, Homo sapiens
ctggcaggagcattcacagagg

SEQ ID NO: 9140616 - DNA, 22 bp, Homo sapiens
ctgccaccatgccccagcagag

SEQ ID NO: 9140617 - DNA, 22 bp, Homo sapiens
ctgccaagtaatgcctgggctc

SEQ ID NO: 9140618 - DNA, 22 bp, Homo sapiens
ctgccacaagctggccctgtgt

SEQ ID NO: 9140619 - DNA, 22 bp, Homo sapiens
ctgccacaggggagcaggcaga

SEQ ID NO: 9140620 - DNA, 22 bp, Homo sapiens
ctgccaccaaatagctgcatga

SEQ ID NO: 9140621 - DNA, 22 bp, Homo sapiens
ctgccacaagctggccctgtgt

SEQ ID NO: 9140622 - DNA, 22 bp, Homo sapiens
ctgcatccatgttgctgcaaag

SEQ ID NO: 9140623 - DNA, 22 bp, Homo sapiens
ctgcatcataaaatttagagtt

SEQ ID NO: 9140624 - DNA, 20 bp, Homo sapiens
ctgcatcatggttaagaaca

SEQ ID NO: 9140625 - DNA, 22 bp, Homo sapiens
ctgcatcaggccaattaagaat

SEQ ID NO: 9140626 - DNA, 22 bp, Homo sapiens
ctgcatcattttcagacaatgg

SEQ ID NO: 9140627 - DNA, 22 bp, Homo sapiens
ctgcatccatctcctagcacag

SEQ ID NO: 9140628 - DNA, 22 bp, Homo sapiens
ctgccactagctttcacatctt

SEQ ID NO: 9140629 - DNA, 22 bp, Homo sapiens
ctgccactctgggtgggcctgg

SEQ ID NO: 9140630 - DNA, 22 bp, Homo sapiens
ctgccactttcacccagtgctc

SEQ ID NO: 9140631 - DNA, 22 bp, Homo sapiens
ctgccagaaggttcctgctgca

SEQ ID NO: 9140632 - DNA, 22 bp, Homo sapiens
ctgccagaaggttcctgctgca

SEQ ID NO: 9140633 - DNA, 22 bp, Homo sapiens
ctgccactttggagtgctcaga

SEQ ID NO: 9140634 - DNA, 22 bp, Homo sapiens
ctgccagacacgttatgctcat

SEQ ID NO: 9140635 - DNA, 22 bp, Homo sapiens
ctgccagatcattggattcaca

SEQ ID NO: 9140636 - DNA, 22 bp, Homo sapiens
ctgccagagtacttgtaagaat

SEQ ID NO: 9140637 - DNA, 22 bp, Homo sapiens
ctgccagagtcacttgccacct

SEQ ID NO: 9140638 - DNA, 22 bp, Homo sapiens
ctgccagagatttggtgaacaa

SEQ ID NO: 9140639 - DNA, 22 bp, Homo sapiens
ctggccactgcacctcttcctt

SEQ ID NO: 9140640 - DNA, 22 bp, Homo sapiens
ctggccactgcacctcttcctt

SEQ ID NO: 9140641 - DNA, 22 bp, Homo sapiens
ctggccactgcacctcttcctt

SEQ ID NO: 9140642 - DNA, 21 bp, Homo sapiens
ctggccactgcacctcttcct

SEQ ID NO: 9140643 - DNA, 21 bp, Homo sapiens
ctggccactgcacctcttcct

SEQ ID NO: 9140644 - DNA, 22 bp, Homo sapiens
ctggccactgattcctcccctg

SEQ ID NO: 9140645 - DNA, 21 bp, Homo sapiens
ctggccactgcacctcttcct

SEQ ID NO: 9140646 - DNA, 22 bp, Homo sapiens
ctggccactgattcctcccctg

SEQ ID NO: 9140647 - DNA, 22 bp, Homo sapiens
ctggccactgcacctcttcctt

SEQ ID NO: 9140648 - DNA, 22 bp, Homo sapiens
ctggccagcctgtcgatgccct

SEQ ID NO: 9140649 - DNA, 22 bp, Homo sapiens
ctggccagcctgtcgatgccct

SEQ ID NO: 9140650 - DNA, 22 bp, Homo sapiens
ctggccagcctgtcgatgccct

SEQ ID NO: 9140651 - DNA, 22 bp, Homo sapiens
ctggccagctgacagcagggct

SEQ ID NO: 9140652 - DNA, 22 bp, Homo sapiens
ctggcaggatctaaccagggaa

SEQ ID NO: 9140653 - DNA, 20 bp, Homo sapiens
ctggcaggagcgagtctacc

SEQ ID NO: 9140654 - DNA, 22 bp, Homo sapiens
ctggcaggagcattcacagagg

SEQ ID NO: 9140655 - DNA, 22 bp, Homo sapiens
ctggcaggcaaattggtgggag

SEQ ID NO: 9140656 - DNA, 22 bp, Homo sapiens
ctggcaggcaaattggtgggag

SEQ ID NO: 9140657 - DNA, 22 bp, Homo sapiens
ctggcaggcactcatgaaataa

SEQ ID NO: 9140658 - DNA, 22 bp, Homo sapiens
ctggcaggcagacttctgcaag

SEQ ID NO: 9140659 - DNA, 22 bp, Homo sapiens
ctggcaggatctaaccagggaa

SEQ ID NO: 9140660 - DNA, 22 bp, Homo sapiens
ctggcaggcaaattggtgggag

SEQ ID NO: 9140661 - DNA, 22 bp, Homo sapiens
ctggccactgattcctcccctg

SEQ ID NO: 9140662 - DNA, 22 bp, Homo sapiens
ctggccactgattcctcccctg

SEQ ID NO: 9140663 - DNA, 22 bp, Homo sapiens
ctggccacccatgcctccctga

SEQ ID NO: 9140664 - DNA, 22 bp, Homo sapiens
ctggcaggcggcagagcccagg

SEQ ID NO: 9140665 - DNA, 22 bp, Homo sapiens
ctggcaggcggaggttgcagtg

SEQ ID NO: 9140666 - DNA, 22 bp, Homo sapiens
ctggcaggcggcagagcccagg

SEQ ID NO: 9140667 - DNA, 22 bp, Homo sapiens
ctggcaggcggaggttgcagtg

SEQ ID NO: 9140668 - DNA, 22 bp, Homo sapiens
ctgggaggcagaggttgcagtg

SEQ ID NO: 9140669 - DNA, 22 bp, Homo sapiens
ctgggaggcactattcaggagg

SEQ ID NO: 9140670 - DNA, 22 bp, Homo sapiens
ctgggaggcactattcaggagg

SEQ ID NO: 9140671 - DNA, 22 bp, Homo sapiens
ctgggaggcagaggttgcagtg

SEQ ID NO: 9140672 - DNA, 22 bp, Homo sapiens
ctgggaggcagaggttgtagtg

SEQ ID NO: 9140673 - DNA, 22 bp, Homo sapiens
ctgggaggcggagcttgcagtg

SEQ ID NO: 9140674 - DNA, 22 bp, Homo sapiens
ctgggaggcagtctctctagaa

SEQ ID NO: 9140675 - DNA, 22 bp, Homo sapiens
ctgggaggcagtctctctagaa

SEQ ID NO: 9140676 - DNA, 22 bp, Homo sapiens
ctgggaggcccacgttgggaag

SEQ ID NO: 9140677 - DNA, 22 bp, Homo sapiens
ctgggaggcccacgttgggaag

SEQ ID NO: 9140678 - DNA, 22 bp, Homo sapiens
ctgggcagtttattcagttctg

SEQ ID NO: 9140679 - DNA, 22 bp, Homo sapiens
ctgggcagtttattcagttctg

SEQ ID NO: 9140680 - DNA, 22 bp, Homo sapiens
ctgggcagtttattcagttctg

SEQ ID NO: 9140681 - DNA, 22 bp, Homo sapiens
ctgggcagttttacatcattgc

SEQ ID NO: 9140682 - DNA, 22 bp, Homo sapiens
ctgggcagtttattcagttctg

SEQ ID NO: 9140683 - DNA, 22 bp, Homo sapiens
ctgggccacaaaaaactcctgt

SEQ ID NO: 9140684 - DNA, 22 bp, Homo sapiens
ctgggccacaaaaaactcctgt

SEQ ID NO: 9140685 - DNA, 22 bp, Homo sapiens
ctgggccaagaagttgtgtatg

SEQ ID NO: 9140686 - DNA, 22 bp, Homo sapiens
ctgggccaaaagaagtgttctt

SEQ ID NO: 9140687 - DNA, 22 bp, Homo sapiens
ctgggcatgaaaaggatgccag

SEQ ID NO: 9140688 - DNA, 22 bp, Homo sapiens
ctgggcatggacagctgcacag

SEQ ID NO: 9140689 - DNA, 22 bp, Homo sapiens
ctgggcatatacgtgcaagtca

SEQ ID NO: 9140690 - DNA, 23 bp, Homo sapiens
ctgggcatggagcttcagaggct

SEQ ID NO: 9140691 - DNA, 23 bp, Homo sapiens
ctgggcatggagcttcagaggct

SEQ ID NO: 9140692 - DNA, 22 bp, Homo sapiens
ctgggccacatcagatgaagac

SEQ ID NO: 9140693 - DNA, 22 bp, Homo sapiens
ctgggccactccagatgcccac

SEQ ID NO: 9140694 - DNA, 22 bp, Homo sapiens
ctgggccactccagatgcccac

SEQ ID NO: 9140695 - DNA, 22 bp, Homo sapiens
ctgggccagaagacatttagga

SEQ ID NO: 9140696 - DNA, 19 bp, Homo sapiens
ctgggccagaatcagctca

SEQ ID NO: 9140697 - DNA, 22 bp, Homo sapiens
ctgggccacaagcctgtgtgat

SEQ ID NO: 9140698 - DNA, 22 bp, Homo sapiens
ctgggccacaagcctgtgtgat

SEQ ID NO: 9140699 - DNA, 22 bp, Homo sapiens
ctgggccacaagcctgtgtgat

SEQ ID NO: 9140700 - DNA, 22 bp, Homo sapiens
ctgggccacagactcaaggcag

SEQ ID NO: 9140701 - DNA, 22 bp, Homo sapiens
ctgggagctagctctgagctga

SEQ ID NO: 9140702 - DNA, 22 bp, Homo sapiens
ctgggagctgaggctgacgctg

SEQ ID NO: 9140703 - DNA, 22 bp, Homo sapiens
ctgggaggattcattgaggtga

SEQ ID NO: 9140704 - DNA, 22 bp, Homo sapiens
ctgggaggcaccgcgtcgtgct

SEQ ID NO: 9140705 - DNA, 22 bp, Homo sapiens
ctgggagctcagccctggggtg

SEQ ID NO: 9140706 - DNA, 22 bp, Homo sapiens
ctggcttttcctaaactgggaa

SEQ ID NO: 9140707 - DNA, 22 bp, Homo sapiens
ctggcttttcaaactgttcagt

SEQ ID NO: 9140708 - DNA, 22 bp, Homo sapiens
ctggcttttagtgtgaagactt

SEQ ID NO: 9140709 - DNA, 22 bp, Homo sapiens
ctggctttgttctgattgcttc

SEQ ID NO: 9140710 - DNA, 22 bp, Homo sapiens
ctgggaaaactgtgacccctgt

SEQ ID NO: 9140711 - DNA, 22 bp, Homo sapiens
ctggcttttttcccattatgca

SEQ ID NO: 9140712 - DNA, 22 bp, Homo sapiens
ctggcttttggaggagggtcag

SEQ ID NO: 9140713 - DNA, 22 bp, Homo sapiens
ctggcttttggaggagggtcag

SEQ ID NO: 9140714 - DNA, 22 bp, Homo sapiens
ctgggaacaggcactgctgtca

SEQ ID NO: 9140715 - DNA, 22 bp, Homo sapiens
ctgggaaagtgtgctcccctcc

SEQ ID NO: 9140716 - DNA, 22 bp, Homo sapiens
ctggctttgatcagagtgacct

SEQ ID NO: 9140717 - DNA, 22 bp, Homo sapiens
ctggctttgcgtctttgccaca

SEQ ID NO: 9140718 - DNA, 22 bp, Homo sapiens
ctggctttgctggactgggagt

SEQ ID NO: 9140719 - DNA, 22 bp, Homo sapiens
ctggctttgaaatgcatttcag

SEQ ID NO: 9140720 - DNA, 22 bp, Homo sapiens
ctggctttctctgtggtgttca

SEQ ID NO: 9140721 - DNA, 22 bp, Homo sapiens
ctggctttccttgtctgcatcc

SEQ ID NO: 9140722 - DNA, 22 bp, Homo sapiens
ctggctttctccagaaattttt

SEQ ID NO: 9140723 - DNA, 22 bp, Homo sapiens
ctggctttctatttggtgctat

SEQ ID NO: 9140724 - DNA, 22 bp, Homo sapiens
ctggctttaggttggagagctg

SEQ ID NO: 9140725 - DNA, 22 bp, Homo sapiens
ctggctttacctcactggggct

SEQ ID NO: 9140726 - DNA, 22 bp, Homo sapiens
ctggctttcattcattcaggcc

SEQ ID NO: 9140727 - DNA, 22 bp, Homo sapiens
ctggcttgttttaagaatacaa

SEQ ID NO: 9140728 - DNA, 22 bp, Homo sapiens
ctggctgtgctgcaggctttgg

SEQ ID NO: 9140729 - DNA, 22 bp, Homo sapiens
ctgggctgctgtccactagggt

SEQ ID NO: 9140730 - DNA, 22 bp, Homo sapiens
ctgggctgctcagccccctcgc

SEQ ID NO: 9140731 - DNA, 23 bp, Homo sapiens
ctgggctgcttgagtccctggct

SEQ ID NO: 9140732 - DNA, 20 bp, Homo sapiens
ctgggctgcccagctatggg

SEQ ID NO: 9140733 - DNA, 20 bp, Homo sapiens
ctgggctgcccagctatggg

SEQ ID NO: 9140734 - DNA, 20 bp, Homo sapiens
ctgggctgcccagctatggg

SEQ ID NO: 9140735 - DNA, 22 bp, Homo sapiens
ctgggctgccaggtaggcacac

SEQ ID NO: 9140736 - DNA, 22 bp, Homo sapiens
ctgggctgccaggtaggcacac

SEQ ID NO: 9140737 - DNA, 22 bp, Homo sapiens
ctgggctgcggttctctgaagc

SEQ ID NO: 9140738 - DNA, 22 bp, Homo sapiens
ctgggctgcggtggtaggttgt

SEQ ID NO: 9140739 - DNA, 22 bp, Homo sapiens
ctgggctgctcagccccctcgc

SEQ ID NO: 9140740 - DNA, 22 bp, Homo sapiens
ctgggctgcgggcgcccctcca

SEQ ID NO: 9140741 - DNA, 22 bp, Homo sapiens
ctgggctgcgggcgcccctcca

SEQ ID NO: 9140742 - DNA, 22 bp, Homo sapiens
ctgggctgcgggcgcccctcca

SEQ ID NO: 9140743 - DNA, 22 bp, Homo sapiens
ctgggctgcagttcctggtcct

SEQ ID NO: 9140744 - DNA, 22 bp, Homo sapiens
ctgggctgcagttcctggtcct

SEQ ID NO: 9140745 - DNA, 22 bp, Homo sapiens
ctgggctgcagttcctggtcct

SEQ ID NO: 9140746 - DNA, 22 bp, Homo sapiens
ctgggctgcaggagtggggcaa

SEQ ID NO: 9140747 - DNA, 22 bp, Homo sapiens
ctgggctgcagcgggagcgacg

SEQ ID NO: 9140748 - DNA, 22 bp, Homo sapiens
ctgggctgcagcgggagcgacg

SEQ ID NO: 9140749 - DNA, 18 bp, Homo sapiens
ctgggccagagtttctgc

SEQ ID NO: 9140750 - DNA, 19 bp, Homo sapiens
ctgggccagagctgtcctc

SEQ ID NO: 9140751 - DNA, 19 bp, Homo sapiens
ctgggccagagctgtcctc

SEQ ID NO: 9140752 - DNA, 18 bp, Homo sapiens
ctgggccagagtttctgc

SEQ ID NO: 9140753 - DNA, 18 bp, Homo sapiens
ctgggccagagtttctgc

SEQ ID NO: 9140754 - DNA, 22 bp, Homo sapiens
ctgggctctaggaaccattcct

SEQ ID NO: 9140755 - DNA, 22 bp, Homo sapiens
ctgggctctgcagttgatgttt

SEQ ID NO: 9140756 - DNA, 22 bp, Homo sapiens
ctgggtctggccacaggaagta

SEQ ID NO: 9140757 - DNA, 22 bp, Homo sapiens
ctgggtctggctactgcttcct

SEQ ID NO: 9140758 - DNA, 22 bp, Homo sapiens
ctgggtctggtgtcaggcgacg

SEQ ID NO: 9140759 - DNA, 22 bp, Homo sapiens
ctgggtctgggcctcctggagt

SEQ ID NO: 9140760 - DNA, 22 bp, Homo sapiens
ctgggtctctttagggtgccgt

SEQ ID NO: 9140761 - DNA, 22 bp, Homo sapiens
ctgggtctctttagggtgccgt

SEQ ID NO: 9140762 - DNA, 22 bp, Homo sapiens
ctgggtctcttaccatgtgact

SEQ ID NO: 9140763 - DNA, 22 bp, Homo sapiens
ctgggtctggaggccaagggtg

SEQ ID NO: 9140764 - DNA, 22 bp, Homo sapiens
ctgggtctggaggccaagggtg

SEQ ID NO: 9140765 - DNA, 22 bp, Homo sapiens
ctgggtctccggcagcctcggg

SEQ ID NO: 9140766 - DNA, 22 bp, Homo sapiens
ctgggtctcttaccatgtgact

SEQ ID NO: 9140767 - DNA, 22 bp, Homo sapiens
ctggggttggccagggccctag

SEQ ID NO: 9140768 - DNA, 22 bp, Homo sapiens
ctgggtaaaggctgcttttcta

SEQ ID NO: 9140769 - DNA, 22 bp, Homo sapiens
ctggggctgcagcgatcttcat

SEQ ID NO: 9140770 - DNA, 22 bp, Homo sapiens
ctggggctgcagcgatcttcat

SEQ ID NO: 9140771 - DNA, 22 bp, Homo sapiens
ctggggtgtgctcagagcaggg

SEQ ID NO: 9140772 - DNA, 22 bp, Homo sapiens
ctggggcccatcgagggctgag

SEQ ID NO: 9140773 - DNA, 22 bp, Homo sapiens
ctggggcattgggagaggcctg

SEQ ID NO: 9140774 - DNA, 22 bp, Homo sapiens
ctggggcatgggcccctagagg

SEQ ID NO: 9140775 - DNA, 22 bp, Homo sapiens
ctggggctcactccagccctgg

SEQ ID NO: 9140776 - DNA, 22 bp, Homo sapiens
ctggggctcactccagccctgg

SEQ ID NO: 9140777 - DNA, 22 bp, Homo sapiens
ctggggctcactccagccctgg

SEQ ID NO: 9140778 - DNA, 22 bp, Homo sapiens
ctggggctcactttggtcaggc

SEQ ID NO: 9140779 - DNA, 23 bp, Homo sapiens
ctggggctcattgcagtagccat

SEQ ID NO: 9140780 - DNA, 23 bp, Homo sapiens
ctggggctcattgcagtagccat

SEQ ID NO: 9140781 - DNA, 22 bp, Homo sapiens
ctggggctctctggaatgcttg

SEQ ID NO: 9140782 - DNA, 22 bp, Homo sapiens
ctggggctgcagcgatcttcat

SEQ ID NO: 9140783 - DNA, 22 bp, Homo sapiens
gacctccagcggccctgcagag

SEQ ID NO: 9140784 - DNA, 22 bp, Homo sapiens
gacctccattctgtcatgactg

SEQ ID NO: 9140785 - DNA, 22 bp, Homo sapiens
gacctccgtgtacacctcccag

SEQ ID NO: 9140786 - DNA, 22 bp, Homo sapiens
gacctccgtgtacacctcccag

SEQ ID NO: 9140787 - DNA, 22 bp, Homo sapiens
gagaaggagctccttggggtct

SEQ ID NO: 9140788 - DNA, 22 bp, Homo sapiens
gagaaggagtagctgacctggg

SEQ ID NO: 9140789 - DNA, 22 bp, Homo sapiens
gagaaggatgaggaaatggtat

SEQ ID NO: 9140790 - DNA, 22 bp, Homo sapiens
gacctgaaatttgtggtagaac

SEQ ID NO: 9140791 - DNA, 22 bp, Homo sapiens
gagaaggactacacatctggcc

SEQ ID NO: 9140792 - DNA, 22 bp, Homo sapiens
gacctgaaatgggggcctgtcc

SEQ ID NO: 9140793 - DNA, 22 bp, Homo sapiens
gacctgaaagagattaaatgac

SEQ ID NO: 9140794 - DNA, 22 bp, Homo sapiens
gagaagggatatgccactctcg

SEQ ID NO: 9140795 - DNA, 22 bp, Homo sapiens
gagaaggctgatccttggagtt

SEQ ID NO: 9140796 - DNA, 22 bp, Homo sapiens
gagaaggcttcttttcctctga

SEQ ID NO: 9140797 - DNA, 22 bp, Homo sapiens
gagaaggctggtcttaagtcga

SEQ ID NO: 9140798 - DNA, 22 bp, Homo sapiens
gagacaaaagttggagtgcaag

SEQ ID NO: 9140799 - DNA, 22 bp, Homo sapiens
gagaatctgggttttggctatc

SEQ ID NO: 9140800 - DNA, 22 bp, Homo sapiens
gagaagggggctcgagtgtcct

SEQ ID NO: 9140801 - DNA, 22 bp, Homo sapiens
gagaagggggctcgagtgtcct

SEQ ID NO: 9140802 - DNA, 22 bp, Homo sapiens
gagaagggggctcgagtgtcct

SEQ ID NO: 9140803 - DNA, 20 bp, Homo sapiens
gagatgcaagtgtatctgac

SEQ ID NO: 9140804 - DNA, 22 bp, Homo sapiens
gagatgcagaaccctcaggagc

SEQ ID NO: 9140805 - DNA, 22 bp, Homo sapiens
gagatgagtgggggatctctca

SEQ ID NO: 9140806 - DNA, 22 bp, Homo sapiens
gagatcggtaaagagcatgcac

SEQ ID NO: 9140807 - DNA, 22 bp, Homo sapiens
gagaggctggtaaagtctgaac

SEQ ID NO: 9140808 - DNA, 22 bp, Homo sapiens
gagagggagccagccaggaacc

SEQ ID NO: 9140809 - DNA, 22 bp, Homo sapiens
gagagggagccagccaggaacc

SEQ ID NO: 9140810 - DNA, 22 bp, Homo sapiens
gagaggccctgtggtcccagct

SEQ ID NO: 9140811 - DNA, 22 bp, Homo sapiens
gagaggccctgaagcccacaga

SEQ ID NO: 9140812 - DNA, 18 bp, Homo sapiens
gagaggcccggctgtgcc

SEQ ID NO: 9140813 - DNA, 22 bp, Homo sapiens
gagaggctatgaggttctgtgt

SEQ ID NO: 9140814 - DNA, 22 bp, Homo sapiens
gagaggcctgggcccgtgagct

SEQ ID NO: 9140815 - DNA, 21 bp, Homo sapiens
gagaggcctgggcccgtgagc

SEQ ID NO: 9140816 - DNA, 22 bp, Homo sapiens
gagaggcatggaacagattctt

SEQ ID NO: 9140817 - DNA, 22 bp, Homo sapiens
gagaggcatggaacagattctt

SEQ ID NO: 9140818 - DNA, 22 bp, Homo sapiens
gagacaaaagttggagtgcaag

SEQ ID NO: 9140819 - DNA, 22 bp, Homo sapiens
gagaggccatggctgtgcagtg

SEQ ID NO: 9140820 - DNA, 22 bp, Homo sapiens
gagaggccatggggtgggatgc

SEQ ID NO: 9140821 - DNA, 22 bp, Homo sapiens
gagaggccaaaatccctgcccc

SEQ ID NO: 9140822 - DNA, 22 bp, Homo sapiens
gagaggccatggctgtgcagtg

SEQ ID NO: 9140823 - DNA, 22 bp, Homo sapiens
gagattatggagaggacattct

SEQ ID NO: 9140824 - DNA, 23 bp, Homo sapiens
gagatgtgggtttgttcagtgtc

SEQ ID NO: 9140825 - DNA, 22 bp, Homo sapiens
gagatgtgatcctttgctgtgt

SEQ ID NO: 9140826 - DNA, 21 bp, Homo sapiens
gagatgtgagctctgatagtc

SEQ ID NO: 9140827 - DNA, 22 bp, Homo sapiens
gagattggatttaatggccaaa

SEQ ID NO: 9140828 - DNA, 22 bp, Homo sapiens
gagatggagaaggaagctgttt

SEQ ID NO: 9140829 - DNA, 22 bp, Homo sapiens
gagatggagtctttttctgtca

SEQ ID NO: 9140830 - DNA, 20 bp, Homo sapiens
gagatggacagatgaagggg

SEQ ID NO: 9140831 - DNA, 22 bp, Homo sapiens
gagatggaatctgtgtggaggg

SEQ ID NO: 9140832 - DNA, 22 bp, Homo sapiens
gagatggaaaactgctggtagt

SEQ ID NO: 9140833 - DNA, 22 bp, Homo sapiens
gagcagagtctatttccacact

SEQ ID NO: 9140834 - DNA, 22 bp, Homo sapiens
gagatttagagagacttaaaca

SEQ ID NO: 9140835 - DNA, 18 bp, Homo sapiens
gagcagaggctcaactgg

SEQ ID NO: 9140836 - DNA, 22 bp, Homo sapiens
gagcagcactgagttagcagct

SEQ ID NO: 9140837 - DNA, 22 bp, Homo sapiens
gagcagcactgagttagcagct

SEQ ID NO: 9140838 - DNA, 22 bp, Homo sapiens
gagcagcaagcactcaaaggct

SEQ ID NO: 9140839 - DNA, 18 bp, Homo sapiens
gagcagcaggatcaagaa

SEQ ID NO: 9140840 - DNA, 22 bp, Homo sapiens
gagcagcagttgttacaatgat

SEQ ID NO: 9140841 - DNA, 22 bp, Homo sapiens
gagcagcagttgttacaatgat

SEQ ID NO: 9140842 - DNA, 22 bp, Homo sapiens
gagcagcaggtggggctggctt

SEQ ID NO: 9140843 - DNA, 22 bp, Homo sapiens
gagcagcaggtggggctggctt

SEQ ID NO: 9140844 - DNA, 22 bp, Homo sapiens
gagccaccttcaactcaggaat

SEQ ID NO: 9140845 - DNA, 22 bp, Homo sapiens
gagccagaaaagctgcctgact

SEQ ID NO: 9140846 - DNA, 22 bp, Homo sapiens
gagccagactgcctgaagctca

SEQ ID NO: 9140847 - DNA, 22 bp, Homo sapiens
gagccagattttatgcaagaca

SEQ ID NO: 9140848 - DNA, 22 bp, Homo sapiens
gagccagattttatgcaagaca

SEQ ID NO: 9140849 - DNA, 22 bp, Homo sapiens
gagccagccgcaagagctgtga

SEQ ID NO: 9140850 - DNA, 22 bp, Homo sapiens
gagccagccgcaagagctgtga

SEQ ID NO: 9140851 - DNA, 22 bp, Homo sapiens
gagccagggctgtgagctgagc

SEQ ID NO: 9140852 - DNA, 22 bp, Homo sapiens
gagccaggggtcagctccgagg

SEQ ID NO: 9140853 - DNA, 22 bp, Homo sapiens
gagccagggtttgaaactagac

SEQ ID NO: 9140854 - DNA, 16 bp, Homo sapiens
gagccaggtgccttga

SEQ ID NO: 9140855 - DNA, 22 bp, Homo sapiens
gagccaggtcgggccgcggcga

SEQ ID NO: 9140856 - DNA, 22 bp, Homo sapiens
gagccaggttggaggctgcagt

SEQ ID NO: 9140857 - DNA, 22 bp, Homo sapiens
gagcagcttatgtcaagccaga

SEQ ID NO: 9140858 - DNA, 22 bp, Homo sapiens
gagcagcttatgtcaagccaga

SEQ ID NO: 9140859 - DNA, 22 bp, Homo sapiens
gagccacagtggattgattcca

SEQ ID NO: 9140860 - DNA, 22 bp, Homo sapiens
gagccaccttcaactcaggaat

SEQ ID NO: 9140861 - DNA, 22 bp, Homo sapiens
gagccacagtggtggcccacgt

SEQ ID NO: 9140862 - DNA, 22 bp, Homo sapiens
gagccaccatgtctcacgcgct

SEQ ID NO: 9140863 - DNA, 22 bp, Homo sapiens
gagccacagcaacctcaaagga

SEQ ID NO: 9140864 - DNA, 22 bp, Homo sapiens
gagccacagactgtatttggga

SEQ ID NO: 9140865 - DNA, 22 bp, Homo sapiens
gagccacagaaggaaattgggg

SEQ ID NO: 9140866 - DNA, 22 bp, Homo sapiens
gagccaagggttgccatggaga

SEQ ID NO: 9140867 - DNA, 22 bp, Homo sapiens
gagccaatctttgggctcttgg

SEQ ID NO: 9140868 - DNA, 22 bp, Homo sapiens
gagcagctgtggggttgaccat

SEQ ID NO: 9140869 - DNA, 20 bp, Homo sapiens
gagcagctgtttgcattgca

SEQ ID NO: 9140870 - DNA, 22 bp, Homo sapiens
gagcagctgttctgacttgtct

SEQ ID NO: 9140871 - DNA, 22 bp, Homo sapiens
gagcagctggtaggtgaaccca

SEQ ID NO: 9140872 - DNA, 22 bp, Homo sapiens
gagcagctggtaggtgaaccca

SEQ ID NO: 9140873 - DNA, 22 bp, Homo sapiens
gagcagctggctgtattggttt

SEQ ID NO: 9140874 - DNA, 22 bp, Homo sapiens
gagcagctgtccccaaagcttc

SEQ ID NO: 9140875 - DNA, 22 bp, Homo sapiens
gagcagctgtggggttgaccat

SEQ ID NO: 9140876 - DNA, 22 bp, Homo sapiens
gagcagctgcagtgcagaccct

SEQ ID NO: 9140877 - DNA, 22 bp, Homo sapiens
gagcagctgcagtgcagaccct

SEQ ID NO: 9140878 - DNA, 22 bp, Homo sapiens
gagcagcctgaggagcgtgggc

SEQ ID NO: 9140879 - DNA, 22 bp, Homo sapiens
gagcagcctgaggagcgtgggc

SEQ ID NO: 9140880 - DNA, 22 bp, Homo sapiens
gagcagccctagggcataagca

SEQ ID NO: 9140881 - DNA, 22 bp, Homo sapiens
gagcagctggacaggcctccct

SEQ ID NO: 9140882 - DNA, 22 bp, Homo sapiens
gagcagctggacaggcctccct

SEQ ID NO: 9140883 - DNA, 22 bp, Homo sapiens
gagcagctggaggccttgttgg

SEQ ID NO: 9140884 - DNA, 22 bp, Homo sapiens
gagctgtgttgtctagtaccga

SEQ ID NO: 9140885 - DNA, 22 bp, Homo sapiens
gagctgtgttgtctagtaccga

SEQ ID NO: 9140886 - DNA, 22 bp, Homo sapiens
gagcttggacaagctctgaagg

SEQ ID NO: 9140887 - DNA, 22 bp, Homo sapiens
gagcttttgtgggggccaaggt

SEQ ID NO: 9140888 - DNA, 22 bp, Homo sapiens
gagcttcctttttctgcatgac

SEQ ID NO: 9140889 - DNA, 22 bp, Homo sapiens
gagcttcctgcaggtcactgtg

SEQ ID NO: 9140890 - DNA, 22 bp, Homo sapiens
gagcttcctgatgccgaccagt

SEQ ID NO: 9140891 - DNA, 22 bp, Homo sapiens
gagcttcctcagcctttctcac

SEQ ID NO: 9140892 - DNA, 22 bp, Homo sapiens
gagcttccatggacgccatctg

SEQ ID NO: 9140893 - DNA, 22 bp, Homo sapiens
gagctgaaatatgaagccaatt

SEQ ID NO: 9140894 - DNA, 22 bp, Homo sapiens
gagctgaattgaagcaaggagc

SEQ ID NO: 9140895 - DNA, 18 bp, Homo sapiens
gagctgagaagaggatgc

SEQ ID NO: 9140896 - DNA, 18 bp, Homo sapiens
gagctgagaagaggatgc

SEQ ID NO: 9140897 - DNA, 22 bp, Homo sapiens
gagctgacatccagcagtgacc

SEQ ID NO: 9140898 - DNA, 22 bp, Homo sapiens
gagctgagaagcagcgcttgat

SEQ ID NO: 9140899 - DNA, 22 bp, Homo sapiens
gagctgagacacactttggcaa

SEQ ID NO: 9140900 - DNA, 19 bp, Homo sapiens
gagctgagagtagcactgg

SEQ ID NO: 9140901 - DNA, 22 bp, Homo sapiens
gagctgtgttcatgaggagaaa

SEQ ID NO: 9140902 - DNA, 19 bp, Homo sapiens
gagctgagagtagcactgg

SEQ ID NO: 9140903 - DNA, 22 bp, Homo sapiens
gagctctgttctcgtcctgctg

SEQ ID NO: 9140904 - DNA, 22 bp, Homo sapiens
gagctctgtgtggcttgggtgg

SEQ ID NO: 9140905 - DNA, 22 bp, Homo sapiens
gagctctgtgtagcctgagggt

SEQ ID NO: 9140906 - DNA, 22 bp, Homo sapiens
gagctctgtgtagcctgagggt

SEQ ID NO: 9140907 - DNA, 22 bp, Homo sapiens
gagctctgaaaaagcttgcctt

SEQ ID NO: 9140908 - DNA, 22 bp, Homo sapiens
gagctctgactgctgggtgaca

SEQ ID NO: 9140909 - DNA, 22 bp, Homo sapiens
gagctctgatgtttagtggaga

SEQ ID NO: 9140910 - DNA, 22 bp, Homo sapiens
gagctctctggggagatgggat

SEQ ID NO: 9140911 - DNA, 22 bp, Homo sapiens
gagctactgaaatattgatttt

SEQ ID NO: 9140912 - DNA, 22 bp, Homo sapiens
gagctactgaaatattgatttt

SEQ ID NO: 9140913 - DNA, 22 bp, Homo sapiens
gagcgggggctgccgggatttg

SEQ ID NO: 9140914 - DNA, 22 bp, Homo sapiens
gagcgggaggaacggctcgggc

SEQ ID NO: 9140915 - DNA, 22 bp, Homo sapiens
gagctaagccctggagaggtcg

SEQ ID NO: 9140916 - DNA, 22 bp, Homo sapiens
gagctacactgattcatttgtt

SEQ ID NO: 9140917 - DNA, 22 bp, Homo sapiens
gagctacaggcagctgagccct

SEQ ID NO: 9140918 - DNA, 22 bp, Homo sapiens
gagcctgcaggcctcggcctca

SEQ ID NO: 9140919 - DNA, 22 bp, Homo sapiens
gagcctcgtggcggccactgcg

SEQ ID NO: 9140920 - DNA, 22 bp, Homo sapiens
gagccctgttcaggcctcctca

SEQ ID NO: 9140921 - DNA, 22 bp, Homo sapiens
gagcctcagggttttgttgaca

SEQ ID NO: 9140922 - DNA, 22 bp, Homo sapiens
gagcctggattgaagtgggtgg

SEQ ID NO: 9140923 - DNA, 22 bp, Homo sapiens
gagcctggacatctcaggccca

SEQ ID NO: 9140924 - DNA, 22 bp, Homo sapiens
gagcctggacatctcaggccca

SEQ ID NO: 9140925 - DNA, 22 bp, Homo sapiens
gagcctgcctctagtctctaga

SEQ ID NO: 9140926 - DNA, 22 bp, Homo sapiens
gagcctgcgagggagtaaggca

SEQ ID NO: 9140927 - DNA, 22 bp, Homo sapiens
gaggcagaagttgcagtgagca

SEQ ID NO: 9140928 - DNA, 22 bp, Homo sapiens
gaggcagaagttgcagtgagca

SEQ ID NO: 9140929 - DNA, 22 bp, Homo sapiens
gaggcagagactccaccttcag

SEQ ID NO: 9140930 - DNA, 22 bp, Homo sapiens
gaggcagagaccttcaggacct

SEQ ID NO: 9140931 - DNA, 22 bp, Homo sapiens
gaggcagagaccttcaggacct

SEQ ID NO: 9140932 - DNA, 22 bp, Homo sapiens
gaggcagagaccttcaggacct

SEQ ID NO: 9140933 - DNA, 22 bp, Homo sapiens
gaggcagaagttgcagtgagca

SEQ ID NO: 9140934 - DNA, 22 bp, Homo sapiens
gaggcacatcacttggtgcatt

SEQ ID NO: 9140935 - DNA, 22 bp, Homo sapiens
gaggcacatgactcaccaatgg

SEQ ID NO: 9140936 - DNA, 22 bp, Homo sapiens
gaggcacctcgcgggaggaggc

SEQ ID NO: 9140937 - DNA, 22 bp, Homo sapiens
gaggcactgcagtacagtgact

SEQ ID NO: 9140938 - DNA, 22 bp, Homo sapiens
gaggcactgaatacttgagggt

SEQ ID NO: 9140939 - DNA, 22 bp, Homo sapiens
gaggcactgaatacttgagggt

SEQ ID NO: 9140940 - DNA, 22 bp, Homo sapiens
gaggccaggacatgaaagctga

SEQ ID NO: 9140941 - DNA, 22 bp, Homo sapiens
gaggccaggaagcccaagatca

SEQ ID NO: 9140942 - DNA, 22 bp, Homo sapiens
gaggccaggaagcccaagatca

SEQ ID NO: 9140943 - DNA, 22 bp, Homo sapiens
gaggccagctacccaagggtca

SEQ ID NO: 9140944 - DNA, 22 bp, Homo sapiens
gaggccagctacccaagggtca

SEQ ID NO: 9140945 - DNA, 22 bp, Homo sapiens
gaggccagcgcgcagcactttt

SEQ ID NO: 9140946 - DNA, 22 bp, Homo sapiens
gaggccagctagtccaggaagt

SEQ ID NO: 9140947 - DNA, 22 bp, Homo sapiens
gaggccagatgtcatgtcttat

SEQ ID NO: 9140948 - DNA, 22 bp, Homo sapiens
gaggccagcccctcttgaaggc

SEQ ID NO: 9140949 - DNA, 22 bp, Homo sapiens
gaggcagaggaaggtggtctct

SEQ ID NO: 9140950 - DNA, 22 bp, Homo sapiens
gaggcagaggaaggtggtctct

SEQ ID NO: 9140951 - DNA, 22 bp, Homo sapiens
gaggcagaggaaggtggtctct

SEQ ID NO: 9140952 - DNA, 22 bp, Homo sapiens
gaggaggcacttgagcagatgt

SEQ ID NO: 9140953 - DNA, 22 bp, Homo sapiens
gaggaggaggaagtggaaccca

SEQ ID NO: 9140954 - DNA, 22 bp, Homo sapiens
gaggaggagtatatattagaat

SEQ ID NO: 9140955 - DNA, 22 bp, Homo sapiens
gaggaggaggaagtggaaccca

SEQ ID NO: 9140956 - DNA, 22 bp, Homo sapiens
gaggaggaggaagtggaaccca

SEQ ID NO: 9140957 - DNA, 22 bp, Homo sapiens
gaggaggaagttctctgtaggc

SEQ ID NO: 9140958 - DNA, 22 bp, Homo sapiens
gaggaggaaaggagttgaaatg

SEQ ID NO: 9140959 - DNA, 19 bp, Homo sapiens
gaggaggaaaactagtgta

SEQ ID NO: 9140960 - DNA, 19 bp, Homo sapiens
gaggaggaaaactagtgta

SEQ ID NO: 9140961 - DNA, 19 bp, Homo sapiens
gaggaggaaaactagtgta

SEQ ID NO: 9140962 - DNA, 22 bp, Homo sapiens
gaggaggccagtggaaggaagc

SEQ ID NO: 9140963 - DNA, 22 bp, Homo sapiens
gaggaaaatattcagggaggtt

SEQ ID NO: 9140964 - DNA, 22 bp, Homo sapiens
gaggaaaatgcaacaggaatgc

SEQ ID NO: 9140965 - DNA, 22 bp, Homo sapiens
gaggaaaatgcaacaggaatgc

SEQ ID NO: 9140966 - DNA, 22 bp, Homo sapiens
gaggaaaatgcaacaggaatgc

SEQ ID NO: 9140967 - DNA, 22 bp, Homo sapiens
gaggagccctgttccccaggcc

SEQ ID NO: 9140968 - DNA, 22 bp, Homo sapiens
gaggaaaatattcagggaggtt

SEQ ID NO: 9140969 - DNA, 22 bp, Homo sapiens
gaggaaaatattcagggaggtt

SEQ ID NO: 9140970 - DNA, 22 bp, Homo sapiens
gaggaaaatattcagggaggtt

SEQ ID NO: 9140971 - DNA, 22 bp, Homo sapiens
gaggaaaataacaactaagggc

SEQ ID NO: 9140972 - DNA, 22 bp, Homo sapiens
gaggaaaataacaactaagggc

SEQ ID NO: 9140973 - DNA, 22 bp, Homo sapiens
gaggaaaataacaactaagggc

SEQ ID NO: 9140974 - DNA, 22 bp, Homo sapiens
gaggaaaataacaactaagggc

SEQ ID NO: 9140975 - DNA, 20 bp, Homo sapiens
gaggaaaagctgccaggcct

SEQ ID NO: 9140976 - DNA, 20 bp, Homo sapiens
gaggaaaagctgccaggcct

SEQ ID NO: 9140977 - DNA, 22 bp, Homo sapiens
gaggaaaagagacaggttattg

SEQ ID NO: 9140978 - DNA, 22 bp, Homo sapiens
gaggaaaagagacaggttattg

SEQ ID NO: 9140979 - DNA, 22 bp, Homo sapiens
gaggaaaagagacaggttattg

SEQ ID NO: 9140980 - DNA, 19 bp, Homo sapiens
gaggagctatcggagacag

SEQ ID NO: 9140981 - DNA, 19 bp, Homo sapiens
gaggagctatcggagacag

SEQ ID NO: 9140982 - DNA, 19 bp, Homo sapiens
gaggagctatcggagacag

SEQ ID NO: 9140983 - DNA, 18 bp, Homo sapiens
gaggagccgtccctacta

SEQ ID NO: 9140984 - DNA, 22 bp, Homo sapiens
gaggagcctggccccacatcca

SEQ ID NO: 9140985 - DNA, 22 bp, Homo sapiens
gaggagcctggccccacatcca

SEQ ID NO: 9140986 - DNA, 22 bp, Homo sapiens
gaggagccctgttccccaggcc

SEQ ID NO: 9140987 - DNA, 22 bp, Homo sapiens
gaggagccctgttccccaggcc

SEQ ID NO: 9140988 - DNA, 22 bp, Homo sapiens
gaggagcttgaggctaggagcc

SEQ ID NO: 9140989 - DNA, 22 bp, Homo sapiens
gaggagcttcagaggaatctta

SEQ ID NO: 9140990 - DNA, 22 bp, Homo sapiens
gaatacatgaaccctcctgtgg

SEQ ID NO: 9140991 - DNA, 22 bp, Homo sapiens
gaatacatctgaaggctatgaa

SEQ ID NO: 9140992 - DNA, 22 bp, Homo sapiens
gaatacatccagagcagggctg

SEQ ID NO: 9140993 - DNA, 22 bp, Homo sapiens
gaatacatgatacatgaactgc

SEQ ID NO: 9140994 - DNA, 19 bp, Homo sapiens
gaatacagataataagcag

SEQ ID NO: 9140995 - DNA, 22 bp, Homo sapiens
gaatacatatcagatgtgtttc

SEQ ID NO: 9140996 - DNA, 22 bp, Homo sapiens
gaatacaccaaggaatcagaat

SEQ ID NO: 9140997 - DNA, 22 bp, Homo sapiens
gaatacacgaatagagcatggt

SEQ ID NO: 9140998 - DNA, 22 bp, Homo sapiens
gaatacaagcctgccacctgga

SEQ ID NO: 9140999 - DNA, 22 bp, Homo sapiens
gaatacaagccaggcacaaggc

SEQ ID NO: 9141000 - DNA, 22 bp, Homo sapiens
gaagttttctgaggctgtagct

SEQ ID NO: 9141001 - DNA, 22 bp, Homo sapiens
gaagtttattttacacatccat

SEQ ID NO: 9141002 - DNA, 22 bp, Homo sapiens
gaagtttagagtttggagtcct

SEQ ID NO: 9141003 - DNA, 22 bp, Homo sapiens
gaagtttagagtgttgtaattt

SEQ ID NO: 9141004 - DNA, 22 bp, Homo sapiens
gaagtttagagtgttgtaattt

SEQ ID NO: 9141005 - DNA, 22 bp, Homo sapiens
gaagtttagagtgttgtaattt

SEQ ID NO: 9141006 - DNA, 22 bp, Homo sapiens
gaagtttatggtgcttgtaagg

SEQ ID NO: 9141007 - DNA, 22 bp, Homo sapiens
gaagtttaggttcttatgttta

SEQ ID NO: 9141008 - DNA, 22 bp, Homo sapiens
gaagtttatttcaatctattca

SEQ ID NO: 9141009 - DNA, 22 bp, Homo sapiens
gaagtttattttacacatccat

SEQ ID NO: 9141010 - DNA, 22 bp, Homo sapiens
gaagcttctggcatttctcaaa

SEQ ID NO: 9141011 - DNA, 22 bp, Homo sapiens
gaagctttattgcaagtgaggc

SEQ ID NO: 9141012 - DNA, 22 bp, Homo sapiens
gaagcttcgaaagagtgatttc

SEQ ID NO: 9141013 - DNA, 22 bp, Homo sapiens
gaagcttcgaaagagtgatttc

SEQ ID NO: 9141014 - DNA, 22 bp, Homo sapiens
gaagcttcgtggctcttcaaat

SEQ ID NO: 9141015 - DNA, 22 bp, Homo sapiens
gaagcttagggataataggctg

SEQ ID NO: 9141016 - DNA, 22 bp, Homo sapiens
gaagctgtgttgatggcatgga

SEQ ID NO: 9141017 - DNA, 22 bp, Homo sapiens
gaagcctcaacatctctgcgtc

SEQ ID NO: 9141018 - DNA, 22 bp, Homo sapiens
gaaggaaaaatactctgtaagg

SEQ ID NO: 9141019 - DNA, 22 bp, Homo sapiens
gaagctttgagagcagaagccc

SEQ ID NO: 9141020 - DNA, 22 bp, Homo sapiens
gaagctttgtcttgtctcctgg

SEQ ID NO: 9141021 - DNA, 22 bp, Homo sapiens
gaagctttgtcttgtctcctgg

SEQ ID NO: 9141022 - DNA, 22 bp, Homo sapiens
gaaggaaaacagatctgcctga

SEQ ID NO: 9141023 - DNA, 22 bp, Homo sapiens
gaaggaaaggtctcatgccttt

SEQ ID NO: 9141024 - DNA, 22 bp, Homo sapiens
gaaggaaaggtctcatgccttt

SEQ ID NO: 9141025 - DNA, 22 bp, Homo sapiens
gaaggaaaggtctcatgccttt

SEQ ID NO: 9141026 - DNA, 22 bp, Homo sapiens
gaaggaaatctgtgatttatgc

SEQ ID NO: 9141027 - DNA, 22 bp, Homo sapiens
gaaggaagattctgttggaatc

SEQ ID NO: 9141028 - DNA, 22 bp, Homo sapiens
gaagttctcttgggggcctgag

SEQ ID NO: 9141029 - DNA, 22 bp, Homo sapiens
gaagtttacctctgccttgctt

SEQ ID NO: 9141030 - DNA, 22 bp, Homo sapiens
gaagtttagaagtgacaggttt

SEQ ID NO: 9141031 - DNA, 22 bp, Homo sapiens
gaatacatggcagggagtcatc

SEQ ID NO: 9141032 - DNA, 22 bp, Homo sapiens
gaatacatgtgtgtatagaggt

SEQ ID NO: 9141033 - DNA, 22 bp, Homo sapiens
gaatacatgcacgacacggggg

SEQ ID NO: 9141034 - DNA, 22 bp, Homo sapiens
gaatacatgattaaagtttgat

SEQ ID NO: 9141035 - DNA, 22 bp, Homo sapiens
gaatacattggaaatcagaata

SEQ ID NO: 9141036 - DNA, 22 bp, Homo sapiens
gaatacatgttgtttccctgga

SEQ ID NO: 9141037 - DNA, 22 bp, Homo sapiens
gaatacatgtgtgtatagaggt

SEQ ID NO: 9141038 - DNA, 22 bp, Homo sapiens
gaatacatttgccgtggttctc

SEQ ID NO: 9141039 - DNA, 22 bp, Homo sapiens
gaatacattggaaatcagaata

SEQ ID NO: 9141040 - DNA, 22 bp, Homo sapiens
gaatactgacactcaggtggga

SEQ ID NO: 9141041 - DNA, 22 bp, Homo sapiens
gaatacttttgttaggaaaacg

SEQ ID NO: 9141042 - DNA, 22 bp, Homo sapiens
gaatacttgggtctggagtcaa

SEQ ID NO: 9141043 - DNA, 18 bp, Homo sapiens
gaatactgagagcacaaa

SEQ ID NO: 9141044 - DNA, 22 bp, Homo sapiens
gaatactggaaaactcatttta

SEQ ID NO: 9141045 - DNA, 22 bp, Homo sapiens
gaatactgatgctcagccccct

SEQ ID NO: 9141046 - DNA, 22 bp, Homo sapiens
gaatatattggtgaaaatagtt

SEQ ID NO: 9141047 - DNA, 22 bp, Homo sapiens
gaatagttctatggctgcaggg

SEQ ID NO: 9141048 - DNA, 21 bp, Homo sapiens
gaatagttctgtggcagcagt

SEQ ID NO: 9141049 - DNA, 23 bp, Homo sapiens
gaatagttttagaaattggagaa

SEQ ID NO: 9141050 - DNA, 22 bp, Homo sapiens
gaatatattggtgaaaatagtt

SEQ ID NO: 9141051 - DNA, 22 bp, Homo sapiens
gaatagatcctcatttattgat

SEQ ID NO: 9141052 - DNA, 22 bp, Homo sapiens
gaatagcttagattccttagtg

SEQ ID NO: 9141053 - DNA, 22 bp, Homo sapiens
gaatagcttccttttttccaaa

SEQ ID NO: 9141054 - DNA, 22 bp, Homo sapiens
gaatagctgtaggctagtgtct

SEQ ID NO: 9141055 - DNA, 22 bp, Homo sapiens
gaatagcttgacaattattttt

SEQ ID NO: 9141056 - DNA, 22 bp, Homo sapiens
gaatatcccgctatgcaaagta

SEQ ID NO: 9141057 - DNA, 22 bp, Homo sapiens
gaatatcccgctatgcaaagta

SEQ ID NO: 9141058 - DNA, 22 bp, Homo sapiens
gaatatgttctggaagttcttg

SEQ ID NO: 9141059 - DNA, 22 bp, Homo sapiens
gaatatgtttgacatttagttg

SEQ ID NO: 9141060 - DNA, 22 bp, Homo sapiens
gaatattagtatcagttatacc

SEQ ID NO: 9141061 - DNA, 22 bp, Homo sapiens
gaatatgtgcatttatgagtgt

SEQ ID NO: 9141062 - DNA, 22 bp, Homo sapiens
gacaagacattggtaaagatat

SEQ ID NO: 9141063 - DNA, 22 bp, Homo sapiens
gacaagcaagagtttgctgggc

SEQ ID NO: 9141064 - DNA, 22 bp, Homo sapiens
gacaagatgacatcatggcttc

SEQ ID NO: 9141065 - DNA, 22 bp, Homo sapiens
gacaggcctagattcactgctg

SEQ ID NO: 9141066 - DNA, 17 bp, Homo sapiens
gacaggctcagtgacga

SEQ ID NO: 9141067 - DNA, 22 bp, Homo sapiens
gacaggccaggggctgaggtgg

SEQ ID NO: 9141068 - DNA, 22 bp, Homo sapiens
gacacagacagttagaggtaat

SEQ ID NO: 9141069 - DNA, 22 bp, Homo sapiens
gacacagaatttactcccgata

SEQ ID NO: 9141070 - DNA, 18 bp, Homo sapiens
gacacacttgcagtagtc

SEQ ID NO: 9141071 - DNA, 22 bp, Homo sapiens
gacacagaaggtcacatgttca

SEQ ID NO: 9141072 - DNA, 22 bp, Homo sapiens
gacagggaacttcattagctgt

SEQ ID NO: 9141073 - DNA, 22 bp, Homo sapiens
gacagggaaacattgaagtgtc

SEQ ID NO: 9141074 - DNA, 22 bp, Homo sapiens
gacaggcttcctaagtgccaga

SEQ ID NO: 9141075 - DNA, 21 bp, Homo sapiens
gacaggggaagaagcaaggag

SEQ ID NO: 9141076 - DNA, 22 bp, Homo sapiens
gacaggggctttgcatgcttta

SEQ ID NO: 9141077 - DNA, 21 bp, Homo sapiens
gacaggggccatgggtttcta

SEQ ID NO: 9141078 - DNA, 22 bp, Homo sapiens
gacaggggtccctctgggctgt

SEQ ID NO: 9141079 - DNA, 22 bp, Homo sapiens
gacaggggtccctctgggctgt

SEQ ID NO: 9141080 - DNA, 23 bp, Homo sapiens
gacagggctgacttggcagctgc

SEQ ID NO: 9141081 - DNA, 22 bp, Homo sapiens
gacagggctgtgggaggagcag

SEQ ID NO: 9141082 - DNA, 22 bp, Homo sapiens
gacaggtatttgagagctggga

SEQ ID NO: 9141083 - DNA, 22 bp, Homo sapiens
gacaggttgaagtatcaaaggt

SEQ ID NO: 9141084 - DNA, 22 bp, Homo sapiens
gaccctgtttctacaaataatt

SEQ ID NO: 9141085 - DNA, 22 bp, Homo sapiens
gaccctgtttctacaaataatt

SEQ ID NO: 9141086 - DNA, 22 bp, Homo sapiens
gaccctgtttctacaaataatt

SEQ ID NO: 9141087 - DNA, 22 bp, Homo sapiens
gaccggttctgccgtggactgg

SEQ ID NO: 9141088 - DNA, 22 bp, Homo sapiens
gaccctggctggagctggcctg

SEQ ID NO: 9141089 - DNA, 22 bp, Homo sapiens
gacagtaagtcagagacttggt

SEQ ID NO: 9141090 - DNA, 22 bp, Homo sapiens
gacagtaactgagagatgtaat

SEQ ID NO: 9141091 - DNA, 22 bp, Homo sapiens
gacccatataggaccctccaaa

SEQ ID NO: 9141092 - DNA, 22 bp, Homo sapiens
gacccagtgactcgtctctgtg

SEQ ID NO: 9141093 - DNA, 22 bp, Homo sapiens
gacccagggtttctgcacaggg

SEQ ID NO: 9141094 - DNA, 22 bp, Homo sapiens
gaaatgccctcccactgaatgt

SEQ ID NO: 9141095 - DNA, 22 bp, Homo sapiens
gaaatgcaggcttggattcagc

SEQ ID NO: 9141096 - DNA, 22 bp, Homo sapiens
gaaatgcatggatcttggcaga

SEQ ID NO: 9141097 - DNA, 22 bp, Homo sapiens
gaaatgcatggatcttggcaga

SEQ ID NO: 9141098 - DNA, 22 bp, Homo sapiens
gaacagcagcttcctgggaatt

SEQ ID NO: 9141099 - DNA, 22 bp, Homo sapiens
gaacagcagctcgttctcgatg

SEQ ID NO: 9141100 - DNA, 22 bp, Homo sapiens
gaacagcagcttcctgggaatt

SEQ ID NO: 9141101 - DNA, 22 bp, Homo sapiens
gaacagcagctcgttctcgatg

SEQ ID NO: 9141102 - DNA, 17 bp, Homo sapiens
gaacagcagaggggaca

SEQ ID NO: 9141103 - DNA, 17 bp, Homo sapiens
gaacagcagaggggaca

SEQ ID NO: 9141104 - DNA, 22 bp, Homo sapiens
gaaatgtactttaaagccatcc

SEQ ID NO: 9141105 - DNA, 22 bp, Homo sapiens
gaaatccagttccctactctta

SEQ ID NO: 9141106 - DNA, 22 bp, Homo sapiens
gaacatttggatttgtaaattt

SEQ ID NO: 9141107 - DNA, 22 bp, Homo sapiens
gaacagtaactgtctgctgtgt

SEQ ID NO: 9141108 - DNA, 22 bp, Homo sapiens
gaacagtaaatttatgcagcac

SEQ ID NO: 9141109 - DNA, 22 bp, Homo sapiens
gaacagctctgaagcagtaaat

SEQ ID NO: 9141110 - DNA, 22 bp, Homo sapiens
gaacagctataatcatctgtcc

SEQ ID NO: 9141111 - DNA, 22 bp, Homo sapiens
gaacagcatgcatgcaagacta

SEQ ID NO: 9141112 - DNA, 22 bp, Homo sapiens
gaacagcatgcatgcaagacta

SEQ ID NO: 9141113 - DNA, 22 bp, Homo sapiens
gaacagcagtcactcatgttat

SEQ ID NO: 9141114 - DNA, 22 bp, Homo sapiens
gaacagcagcttcctgggaatt

SEQ ID NO: 9141115 - DNA, 22 bp, Homo sapiens
gaacagcatgtaagaagctact

SEQ ID NO: 9141116 - DNA, 22 bp, Homo sapiens
gaacagcatgtaagaagctact

SEQ ID NO: 9141117 - DNA, 22 bp, Homo sapiens
gaacagccctgttaagtctgtt

SEQ ID NO: 9141118 - DNA, 22 bp, Homo sapiens
gaacagcctcaataacatcctt

SEQ ID NO: 9141119 - DNA, 22 bp, Homo sapiens
gaacagctgctagagatctgtg

SEQ ID NO: 9141120 - DNA, 22 bp, Homo sapiens
gaacaggctggagtagcacaga

SEQ ID NO: 9141121 - DNA, 22 bp, Homo sapiens
gaacaggctggagtagcacaga

SEQ ID NO: 9141122 - DNA, 22 bp, Homo sapiens
gaacaggcataagcatttgcat

SEQ ID NO: 9141123 - DNA, 22 bp, Homo sapiens
gaacagggtttgagaggcttag

SEQ ID NO: 9141124 - DNA, 22 bp, Homo sapiens
ctttcaggttctataggaagcc

SEQ ID NO: 9141125 - DNA, 22 bp, Homo sapiens
ctttcagaagtatattctggaa

SEQ ID NO: 9141126 - DNA, 22 bp, Homo sapiens
ctttcagaagccggaagggcag

SEQ ID NO: 9141127 - DNA, 22 bp, Homo sapiens
ctttcagaagtatattctggaa

SEQ ID NO: 9141128 - DNA, 22 bp, Homo sapiens
ctttcagatagtctgagatata

SEQ ID NO: 9141129 - DNA, 22 bp, Homo sapiens
ctttcagatagtctgagatata

SEQ ID NO: 9141130 - DNA, 22 bp, Homo sapiens
ctttcaggagaggattataaca

SEQ ID NO: 9141131 - DNA, 18 bp, Homo sapiens
ctttcagatggatatgct

SEQ ID NO: 9141132 - DNA, 22 bp, Homo sapiens
ctttcagggcagacaacgagca

SEQ ID NO: 9141133 - DNA, 22 bp, Homo sapiens
ctttcaggggcttgactccaca

SEQ ID NO: 9141134 - DNA, 22 bp, Homo sapiens
ctttcaggtcacataacgccaa

SEQ ID NO: 9141135 - DNA, 22 bp, Homo sapiens
ctttcacataattgaccttgaa

SEQ ID NO: 9141136 - DNA, 22 bp, Homo sapiens
ctttcacacacatacatttgga

SEQ ID NO: 9141137 - DNA, 22 bp, Homo sapiens
ctttcacagcacaagcctgcct

SEQ ID NO: 9141138 - DNA, 22 bp, Homo sapiens
ctttcacagctactcacctctg

SEQ ID NO: 9141139 - DNA, 22 bp, Homo sapiens
ctttcaatcaaagtttctagtg

SEQ ID NO: 9141140 - DNA, 22 bp, Homo sapiens
ctttatgtccttgaagagttgt

SEQ ID NO: 9141141 - DNA, 22 bp, Homo sapiens
ctttcacacacatacatttgga

SEQ ID NO: 9141142 - DNA, 22 bp, Homo sapiens
gaaatatttctcttgagcccct

SEQ ID NO: 9141143 - DNA, 22 bp, Homo sapiens
gaaatatttctcttgagcccct

SEQ ID NO: 9141144 - DNA, 22 bp, Homo sapiens
gaaatatttctcttgagcccct

SEQ ID NO: 9141145 - DNA, 22 bp, Homo sapiens
gaaatatttctcttgagcccct

SEQ ID NO: 9141146 - DNA, 22 bp, Homo sapiens
gaaatatttctcttgagcccct

SEQ ID NO: 9141147 - DNA, 22 bp, Homo sapiens
gaaatcacttttttcatagttg

SEQ ID NO: 9141148 - DNA, 22 bp, Homo sapiens
ctttcatccgcagatgagcctc

SEQ ID NO: 9141149 - DNA, 23 bp, Homo sapiens
ctttcattgtggtttcacagagc

SEQ ID NO: 9141150 - DNA, 22 bp, Homo sapiens
ctttccaactctagtgaaattt

SEQ ID NO: 9141151 - DNA, 22 bp, Homo sapiens
ctttcattcttagatattagtg

SEQ ID NO: 9141152 - DNA, 22 bp, Homo sapiens
gaagatgggaatgatgagtggg

SEQ ID NO: 9141153 - DNA, 23 bp, Homo sapiens
gaagagttgcaaagacgggacag

SEQ ID NO: 9141154 - DNA, 22 bp, Homo sapiens
gaagagtatatttagtgaaatc

SEQ ID NO: 9141155 - DNA, 22 bp, Homo sapiens
gaagataactttaaaaagtggc

SEQ ID NO: 9141156 - DNA, 22 bp, Homo sapiens
gaagaggctttcctagggcaag

SEQ ID NO: 9141157 - DNA, 20 bp, Homo sapiens
gaagatgggtagaggcacag

SEQ ID NO: 9141158 - DNA, 22 bp, Homo sapiens
gaagattgaaggctgggaatta

SEQ ID NO: 9141159 - DNA, 22 bp, Homo sapiens
gaagatttaagcacaatagtct

SEQ ID NO: 9141160 - DNA, 22 bp, Homo sapiens
gaagatttaagcacaatagtct

SEQ ID NO: 9141161 - DNA, 22 bp, Homo sapiens
gaagatttataaggaccttatt

SEQ ID NO: 9141162 - DNA, 22 bp, Homo sapiens
gaagatttaagcacaatagtct

SEQ ID NO: 9141163 - DNA, 22 bp, Homo sapiens
gaagatttctttatgaaagatg

SEQ ID NO: 9141164 - DNA, 22 bp, Homo sapiens
gaagatttcagttaagtatcta

SEQ ID NO: 9141165 - DNA, 22 bp, Homo sapiens
gaagccctcctatagtcatctg

SEQ ID NO: 9141166 - DNA, 23 bp, Homo sapiens
gaagccctcattggttctccaga

SEQ ID NO: 9141167 - DNA, 22 bp, Homo sapiens
gaagccctaatacacagtacct

SEQ ID NO: 9141168 - DNA, 22 bp, Homo sapiens
gaagccctatcctctcctggga

SEQ ID NO: 9141169 - DNA, 19 bp, Homo sapiens
gaagccctgcattctccgc

SEQ ID NO: 9141170 - DNA, 22 bp, Homo sapiens
gaagccctggggtcagtgtcgt

SEQ ID NO: 9141171 - DNA, 22 bp, Homo sapiens
gaagccctgtaggtgcaaaggt

SEQ ID NO: 9141172 - DNA, 22 bp, Homo sapiens
gaagcccttagcagagtctgac

SEQ ID NO: 9141173 - DNA, 22 bp, Homo sapiens
gaagcctcaacatctctgcgtc

SEQ ID NO: 9141174 - DNA, 22 bp, Homo sapiens
gaagccctaagagaatagagct

SEQ ID NO: 9141175 - DNA, 22 bp, Homo sapiens
gaagcccatttgtacagcacat

SEQ ID NO: 9141176 - DNA, 22 bp, Homo sapiens
gaagcccaggcttccttggctt

SEQ ID NO: 9141177 - DNA, 22 bp, Homo sapiens
gaagcccagggcgtggccgggc

SEQ ID NO: 9141178 - DNA, 22 bp, Homo sapiens
gaagccagtactgtgctctgca

SEQ ID NO: 9141179 - DNA, 22 bp, Homo sapiens
gaagccagtgtttgaagaattt

SEQ ID NO: 9141180 - DNA, 22 bp, Homo sapiens
gaagccagtgtttgaagaattt

SEQ ID NO: 9141181 - DNA, 22 bp, Homo sapiens
gaagccatctttgttccccacc

SEQ ID NO: 9141182 - DNA, 22 bp, Homo sapiens
gaagcccaagcttcacagctat

SEQ ID NO: 9141183 - DNA, 22 bp, Homo sapiens
gaagcccagcaaactgtgatca

SEQ ID NO: 9141184 - DNA, 22 bp, Homo sapiens
gaagcccagcaaactgtgatca

SEQ ID NO: 9141185 - DNA, 22 bp, Homo sapiens
gaagcccagcaaactgtgatca

SEQ ID NO: 9141186 - DNA, 22 bp, Homo sapiens
gaagcccacgtttggtgatgta

SEQ ID NO: 9141187 - DNA, 22 bp, Homo sapiens
gaagccagcagtggagaaagga

SEQ ID NO: 9141188 - DNA, 22 bp, Homo sapiens
gaagccagatttggggcatatc

SEQ ID NO: 9141189 - DNA, 22 bp, Homo sapiens
gaagccaggggcctgacaggca

SEQ ID NO: 9141190 - DNA, 22 bp, Homo sapiens
gaagccagccttgtctgcctct

SEQ ID NO: 9141191 - DNA, 22 bp, Homo sapiens
gaagccagccttgtctgcctct

SEQ ID NO: 9141192 - DNA, 22 bp, Homo sapiens
gaagccagccttgtctgcctct

SEQ ID NO: 9141193 - DNA, 22 bp, Homo sapiens
gaagccagcagtggagaaagga

SEQ ID NO: 9141194 - DNA, 22 bp, Homo sapiens
gaagccagcatccctctcccat

SEQ ID NO: 9141195 - DNA, 22 bp, Homo sapiens
gaagatttgcccatgcactttt

SEQ ID NO: 9141196 - DNA, 22 bp, Homo sapiens
gaagatttgaaacacatagaca

SEQ ID NO: 9141197 - DNA, 22 bp, Homo sapiens
gaagatttgcccatgcactttt

SEQ ID NO: 9141198 - DNA, 22 bp, Homo sapiens
gaagatttgttgtaatttttag

SEQ ID NO: 9141199 - DNA, 22 bp, Homo sapiens
gaagatttgaaacacatagaca

SEQ ID NO: 9141200 - DNA, 22 bp, Homo sapiens
gaagatttgaaacacatagaca

SEQ ID NO: 9141201 - DNA, 22 bp, Homo sapiens
gaagatttgcccatgcactttt

SEQ ID NO: 9141202 - DNA, 22 bp, Homo sapiens
gaagatttttcttaatgctccg

SEQ ID NO: 9141203 - DNA, 22 bp, Homo sapiens
gaagattttctcctttaaatga

SEQ ID NO: 9141204 - DNA, 22 bp, Homo sapiens
gaagattttctcctttaaatga

SEQ ID NO: 9141205 - DNA, 22 bp, Homo sapiens
gaagatttgttgtaatttttag

SEQ ID NO: 9141206 - DNA, 22 bp, Homo sapiens
gaagagaaaggcaaggagtttt

SEQ ID NO: 9141207 - DNA, 22 bp, Homo sapiens
gaagagaaaggcaaggagtttt

SEQ ID NO: 9141208 - DNA, 22 bp, Homo sapiens
gaagagctaaaggcacaggctt

SEQ ID NO: 9141209 - DNA, 22 bp, Homo sapiens
gaagagaaggtgtaggccatcc

SEQ ID NO: 9141210 - DNA, 22 bp, Homo sapiens
gaagagaagcatcaataggtaa

SEQ ID NO: 9141211 - DNA, 22 bp, Homo sapiens
gaagagaagcatcaataggtaa

SEQ ID NO: 9141212 - DNA, 22 bp, Homo sapiens
gaagagctgacagtgtcatcct

SEQ ID NO: 9141213 - DNA, 22 bp, Homo sapiens
gaagagctgctcagaacatgat

SEQ ID NO: 9141214 - DNA, 22 bp, Homo sapiens
gaagagctgcacactggggact

SEQ ID NO: 9141215 - DNA, 22 bp, Homo sapiens
gaagagctgcagtttcctgggc

SEQ ID NO: 9141216 - DNA, 22 bp, Homo sapiens
gaagagctatgtccagggagca

SEQ ID NO: 9141217 - DNA, 22 bp, Homo sapiens
gaagagctccaaaaacagtgag

SEQ ID NO: 9141218 - DNA, 22 bp, Homo sapiens
gaagagctccaaaaacagtgag

SEQ ID NO: 9141219 - DNA, 22 bp, Homo sapiens
gaagaggactgtggcatcctag

SEQ ID NO: 9141220 - DNA, 22 bp, Homo sapiens
gaagaggatgacaggagccggt

SEQ ID NO: 9141221 - DNA, 22 bp, Homo sapiens
gaagaggactgtggcatcctag

SEQ ID NO: 9141222 - DNA, 22 bp, Homo sapiens
gaagaggatgacaggagccggt

SEQ ID NO: 9141223 - DNA, 22 bp, Homo sapiens
gaagaggcaattgaataagcta

SEQ ID NO: 9141224 - DNA, 22 bp, Homo sapiens
gaagaggatgacaggagccggt

SEQ ID NO: 9141225 - DNA, 22 bp, Homo sapiens
gaagagctgtagcctgctcttt

SEQ ID NO: 9141226 - DNA, 22 bp, Homo sapiens
gaagagctggaatccagtctgg

SEQ ID NO: 9141227 - DNA, 22 bp, Homo sapiens
gaagagctggaatccagtctgg

SEQ ID NO: 9141228 - DNA, 22 bp, Homo sapiens
gaagagctgtcagaaaagctaa

SEQ ID NO: 9141229 - DNA, 22 bp, Homo sapiens
gaagagcttagttgtcctagaa

SEQ ID NO: 9141230 - DNA, 22 bp, Homo sapiens
gaagagcttagttgtcctagaa

SEQ ID NO: 9141231 - DNA, 22 bp, Homo sapiens
gaagagcttagacagaatcaaa

SEQ ID NO: 9141232 - DNA, 22 bp, Homo sapiens
gaagagctgtgattcaggctta

SEQ ID NO: 9141233 - DNA, 22 bp, Homo sapiens
gaagagctgtgattcaggctta

SEQ ID NO: 9141234 - DNA, 22 bp, Homo sapiens
gaagacaagctgagtgttgtcc

SEQ ID NO: 9141235 - DNA, 22 bp, Homo sapiens
gaaccatttctgaatagtttgt

SEQ ID NO: 9141236 - DNA, 22 bp, Homo sapiens
gaaccattgttgaaaagaatag

SEQ ID NO: 9141237 - DNA, 22 bp, Homo sapiens
gaaccatgagaaattgctattt

SEQ ID NO: 9141238 - DNA, 22 bp, Homo sapiens
gaaccagcagttgcctgaaaaa

SEQ ID NO: 9141239 - DNA, 21 bp, Homo sapiens
gaacatttgggttgtttctac

SEQ ID NO: 9141240 - DNA, 22 bp, Homo sapiens
gaagacatcgtgtggactaaca

SEQ ID NO: 9141241 - DNA, 22 bp, Homo sapiens
gaagacatcatggagaggatag

SEQ ID NO: 9141242 - DNA, 22 bp, Homo sapiens
gaagacatcatggagaggatag

SEQ ID NO: 9141243 - DNA, 22 bp, Homo sapiens
gaagacactaaggcccagggag

SEQ ID NO: 9141244 - DNA, 22 bp, Homo sapiens
gaagacatgtggattctagttt

SEQ ID NO: 9141245 - DNA, 22 bp, Homo sapiens
gaagacatgtggattctagttt

SEQ ID NO: 9141246 - DNA, 22 bp, Homo sapiens
gaagacatgtttttaatatgta

SEQ ID NO: 9141247 - DNA, 22 bp, Homo sapiens
gaagacatgtttttaatatgta

SEQ ID NO: 9141248 - DNA, 22 bp, Homo sapiens
gaagacattaagtctatgtcac

SEQ ID NO: 9141249 - DNA, 22 bp, Homo sapiens
gaagaccccagagcgaggtaag

SEQ ID NO: 9141250 - DNA, 22 bp, Homo sapiens
gaagacattttatgcatactct

SEQ ID NO: 9141251 - DNA, 22 bp, Homo sapiens
gaagacatttgtaacacttgca

SEQ ID NO: 9141252 - DNA, 22 bp, Homo sapiens
ttccaggatgggctgtcctact

SEQ ID NO: 9141253 - DNA, 22 bp, Homo sapiens
ttccaggatgggctgtcctact

SEQ ID NO: 9141254 - DNA, 22 bp, Homo sapiens
ttccaggatgctgctgcttttt

SEQ ID NO: 9141255 - DNA, 22 bp, Homo sapiens
ttccaggatgctgctgcttttt

SEQ ID NO: 9141256 - DNA, 22 bp, Homo sapiens
ttccaggaggcattcttagttt

SEQ ID NO: 9141257 - DNA, 22 bp, Homo sapiens
ttccaggaggcattcttagttt

SEQ ID NO: 9141258 - DNA, 22 bp, Homo sapiens
ttccaggactcgttctggctca

SEQ ID NO: 9141259 - DNA, 22 bp, Homo sapiens
ttccaggactcgttctggctca

SEQ ID NO: 9141260 - DNA, 22 bp, Homo sapiens
ttccaggactgggtgtttgaag

SEQ ID NO: 9141261 - DNA, 22 bp, Homo sapiens
ctaaatgatattttggtttcct

SEQ ID NO: 9141262 - DNA, 22 bp, Homo sapiens
ttccaggacaagatgtttcagg

SEQ ID NO: 9141263 - DNA, 22 bp, Homo sapiens
ctaaatgacaggtaccatagtg

SEQ ID NO: 9141264 - DNA, 22 bp, Homo sapiens
ctacagctgtaaaaggaatgtc

SEQ ID NO: 9141265 - DNA, 22 bp, Homo sapiens
ctacaggtcaagcagtagctct

SEQ ID NO: 9141266 - DNA, 22 bp, Homo sapiens
ctacaggtatgtgcatgacatc

SEQ ID NO: 9141267 - DNA, 22 bp, Homo sapiens
ctacagctgtgtgtttatgtgc

SEQ ID NO: 9141268 - DNA, 22 bp, Homo sapiens
ttcctgggcaggacgagagtct

SEQ ID NO: 9141269 - DNA, 22 bp, Homo sapiens
ttcctgggcaggacgagagtct

SEQ ID NO: 9141270 - DNA, 21 bp, Homo sapiens
ctaccctcactcccattcctc

SEQ ID NO: 9141271 - DNA, 22 bp, Homo sapiens
ttcctgggctgcagagagcacc

SEQ ID NO: 9141272 - DNA, 22 bp, Homo sapiens
ctactatttgtcctttataagc

SEQ ID NO: 9141273 - DNA, 22 bp, Homo sapiens
ctactgccattgtctctgccat

SEQ ID NO: 9141274 - DNA, 22 bp, Homo sapiens
ctactgtaatagatgaatttga

SEQ ID NO: 9141275 - DNA, 22 bp, Homo sapiens
ctactgtaatagatgaatttga

SEQ ID NO: 9141276 - DNA, 22 bp, Homo sapiens
ctactgtcttccttggtaacaa

SEQ ID NO: 9141277 - DNA, 22 bp, Homo sapiens
ctactgttattattaatagtaa

SEQ ID NO: 9141278 - DNA, 22 bp, Homo sapiens
ctagaaaaatactttattgtga

SEQ ID NO: 9141279 - DNA, 21 bp, Homo sapiens
ctacttaagtaggggattagg

SEQ ID NO: 9141280 - DNA, 22 bp, Homo sapiens
ttctctggagagtatcttctta

SEQ ID NO: 9141281 - DNA, 22 bp, Homo sapiens
ttctctggagggctgcccggcc

SEQ ID NO: 9141282 - DNA, 20 bp, Homo sapiens
ttctctggatagccagatgt

SEQ ID NO: 9141283 - DNA, 21 bp, Homo sapiens
ttctctggataggccagtcct

SEQ ID NO: 9141284 - DNA, 22 bp, Homo sapiens
ctagaaacgcctttagcacaac

SEQ ID NO: 9141285 - DNA, 22 bp, Homo sapiens
ttctctaaagagttaggccaag

SEQ ID NO: 9141286 - DNA, 22 bp, Homo sapiens
ttctctggactatttgcactcc

SEQ ID NO: 9141287 - DNA, 19 bp, Homo sapiens
ttctctggactagatgctg

SEQ ID NO: 9141288 - DNA, 22 bp, Homo sapiens
ctcaaggaaagtctggagaaga

SEQ ID NO: 9141289 - DNA, 22 bp, Homo sapiens
ctcaagaggatatgtccagaaa

SEQ ID NO: 9141290 - DNA, 22 bp, Homo sapiens
ctcaagagatataaaaatgtgg

SEQ ID NO: 9141291 - DNA, 22 bp, Homo sapiens
ctcaagaatctagggaggattc

SEQ ID NO: 9141292 - DNA, 22 bp, Homo sapiens
ctcaaggccagttcttctgact

SEQ ID NO: 9141293 - DNA, 22 bp, Homo sapiens
ctattattatcctaatttctgt

SEQ ID NO: 9141294 - DNA, 22 bp, Homo sapiens
ctcacaggcggtaattcaggga

SEQ ID NO: 9141295 - DNA, 22 bp, Homo sapiens
ctcacaggcatctcatcaggct

SEQ ID NO: 9141296 - DNA, 22 bp, Homo sapiens
ctcacaggtaccagcaccctcc

SEQ ID NO: 9141297 - DNA, 22 bp, Homo sapiens
ctcacaggagaaagtcatggtc

SEQ ID NO: 9141298 - DNA, 22 bp, Homo sapiens
ctcacaggagaaagtcatggtc

SEQ ID NO: 9141299 - DNA, 22 bp, Homo sapiens
ctcacaggagaaagtcatggtc

SEQ ID NO: 9141300 - DNA, 22 bp, Homo sapiens
ctcacagatgtcctggcacttc

SEQ ID NO: 9141301 - DNA, 22 bp, Homo sapiens
ctcaatgtagacctcaacatat

SEQ ID NO: 9141302 - DNA, 22 bp, Homo sapiens
ctcacaccagcttacaagactt

SEQ ID NO: 9141303 - DNA, 22 bp, Homo sapiens
ctcacagagcctctgtgtcttc

SEQ ID NO: 9141304 - DNA, 22 bp, Homo sapiens
ctatgagaagaaaacaagatta

SEQ ID NO: 9141305 - DNA, 22 bp, Homo sapiens
ctatgtactggattagctccca

SEQ ID NO: 9141306 - DNA, 22 bp, Homo sapiens
ctatgtaccatgcctgatgtta

SEQ ID NO: 9141307 - DNA, 22 bp, Homo sapiens
ctattacaatctgctactatga

SEQ ID NO: 9141308 - DNA, 22 bp, Homo sapiens
ctattacatttctggacattca

SEQ ID NO: 9141309 - DNA, 22 bp, Homo sapiens
ctattacagggaagccttggga

SEQ ID NO: 9141310 - DNA, 22 bp, Homo sapiens
ctattacaattctgcaaggagt

SEQ ID NO: 9141311 - DNA, 18 bp, Homo sapiens
ctattacaatgcagtggt

SEQ ID NO: 9141312 - DNA, 22 bp, Homo sapiens
ctattaaatactcttcaaattg

SEQ ID NO: 9141313 - DNA, 22 bp, Homo sapiens
ctattaaacactactgtgcact

SEQ ID NO: 9141314 - DNA, 22 bp, Homo sapiens
ctatgtctcactccctagtcag

SEQ ID NO: 9141315 - DNA, 22 bp, Homo sapiens
ctagcagcatcacaggaagact

SEQ ID NO: 9141316 - DNA, 22 bp, Homo sapiens
ctagcagcatcacaggaagact

SEQ ID NO: 9141317 - DNA, 22 bp, Homo sapiens
ctagcagaagctccttgagggt

SEQ ID NO: 9141318 - DNA, 22 bp, Homo sapiens
ctagcagtgtactcaacaaggg

SEQ ID NO: 9141319 - DNA, 22 bp, Homo sapiens
ctagccagatttaaagagagac

SEQ ID NO: 9141320 - DNA, 22 bp, Homo sapiens
ttctctggatgtttctcagtca

SEQ ID NO: 9141321 - DNA, 22 bp, Homo sapiens
ttctctggccatagctggctag

SEQ ID NO: 9141322 - DNA, 22 bp, Homo sapiens
ttctctggatgtttctcagtca

SEQ ID NO: 9141323 - DNA, 22 bp, Homo sapiens
ttctctggcctgaggcgaggcc

SEQ ID NO: 9141324 - DNA, 22 bp, Homo sapiens
ttctctggcctgaggcgaggcc

SEQ ID NO: 9141325 - DNA, 22 bp, Homo sapiens
ttctctggcggtgtgttttcct

SEQ ID NO: 9141326 - DNA, 22 bp, Homo sapiens
ttctctggcgcgctgtgctatg

SEQ ID NO: 9141327 - DNA, 22 bp, Homo sapiens
ttctctggcctgaggcgaggcc

SEQ ID NO: 9141328 - DNA, 22 bp, Homo sapiens
ctagcactgagaatagtgcata

SEQ ID NO: 9141329 - DNA, 22 bp, Homo sapiens
ctagcaccagcctgagagtttt

SEQ ID NO: 9141330 - DNA, 21 bp, Homo sapiens
ttctctggcttctgtagctgg

SEQ ID NO: 9141331 - DNA, 22 bp, Homo sapiens
ttctctgggaacataaatgaag

SEQ ID NO: 9141332 - DNA, 22 bp, Homo sapiens
ctaaataatccctctggtctta

SEQ ID NO: 9141333 - DNA, 22 bp, Homo sapiens
ctaaataatccctctggtctta

SEQ ID NO: 9141334 - DNA, 22 bp, Homo sapiens
ctaaatactagccttcagattt

SEQ ID NO: 9141335 - DNA, 17 bp, Homo sapiens
ctaaatacttgcgtttc

SEQ ID NO: 9141336 - DNA, 22 bp, Homo sapiens
ttcatctgtagtttttccaagg

SEQ ID NO: 9141337 - DNA, 21 bp, Homo sapiens
ttcatctggccgtattccagg

SEQ ID NO: 9141338 - DNA, 22 bp, Homo sapiens
ttcatctgtagtttttccaagg

SEQ ID NO: 9141339 - DNA, 22 bp, Homo sapiens
ttcatctgtagcatcttccaat

SEQ ID NO: 9141340 - DNA, 22 bp, Homo sapiens
cggtctgagagcaggagaaggg

SEQ ID NO: 9141341 - DNA, 22 bp, Homo sapiens
cggtctgatctggaaatagggc

SEQ ID NO: 9141342 - DNA, 22 bp, Homo sapiens
cggtctgagatttttaataggc

SEQ ID NO: 9141343 - DNA, 22 bp, Homo sapiens
cggtcctggcacttgcggctcc

SEQ ID NO: 9141344 - DNA, 22 bp, Homo sapiens
cggtcctgtacttgatgagata

SEQ ID NO: 9141345 - DNA, 22 bp, Homo sapiens
cggtcctgtacttgatgagata

SEQ ID NO: 9141346 - DNA, 22 bp, Homo sapiens
cggtcctggcacttgcggctcc

SEQ ID NO: 9141347 - DNA, 22 bp, Homo sapiens
cggtcaggtgcagcgttggcac

SEQ ID NO: 9141348 - DNA, 22 bp, Homo sapiens
cggtggctcaggcccccagcag

SEQ ID NO: 9141349 - DNA, 22 bp, Homo sapiens
cggtggctcaggcccccagcag

SEQ ID NO: 9141350 - DNA, 22 bp, Homo sapiens
cgtagcttcaggatgagggctt

SEQ ID NO: 9141351 - DNA, 22 bp, Homo sapiens
cgtaccagcataaactgaaggt

SEQ ID NO: 9141352 - DNA, 22 bp, Homo sapiens
ttcagggcagagagttcaggga

SEQ ID NO: 9141353 - DNA, 22 bp, Homo sapiens
ttcagggacttagtgtcagttt

SEQ ID NO: 9141354 - DNA, 22 bp, Homo sapiens
cgggggagttgaggcacatggg

SEQ ID NO: 9141355 - DNA, 22 bp, Homo sapiens
cggggctgtagcacagctgagc

SEQ ID NO: 9141356 - DNA, 22 bp, Homo sapiens
ttcaggattctttcagactggg

SEQ ID NO: 9141357 - DNA, 19 bp, Homo sapiens
ttcaggattgaccctactg

SEQ ID NO: 9141358 - DNA, 22 bp, Homo sapiens
ttcaggattctgtgtctgacaa

SEQ ID NO: 9141359 - DNA, 22 bp, Homo sapiens
ttcaggattgtgtttttcctga

SEQ ID NO: 9141360 - DNA, 22 bp, Homo sapiens
ttcaggcagctgaggagaaagt

SEQ ID NO: 9141361 - DNA, 22 bp, Homo sapiens
ttcaggcatggaaactggatta

SEQ ID NO: 9141362 - DNA, 22 bp, Homo sapiens
ttcaggatgacaccatgtccag

SEQ ID NO: 9141363 - DNA, 22 bp, Homo sapiens
ttcaggattatactctcttccc

SEQ ID NO: 9141364 - DNA, 22 bp, Homo sapiens
ttcaggatcactaaaccctcca

SEQ ID NO: 9141365 - DNA, 22 bp, Homo sapiens
ttcaggatcaagttgccagtag

SEQ ID NO: 9141366 - DNA, 22 bp, Homo sapiens
ttcaggatatgtgatatctgaa

SEQ ID NO: 9141367 - DNA, 22 bp, Homo sapiens
ttcaggatccccttgatgggct

SEQ ID NO: 9141368 - DNA, 22 bp, Homo sapiens
ttcagattttttaataggtaat

SEQ ID NO: 9141369 - DNA, 22 bp, Homo sapiens
ttcagattttttaataggtaat

SEQ ID NO: 9141370 - DNA, 22 bp, Homo sapiens
ttcagagggcttgctatgtaca

SEQ ID NO: 9141371 - DNA, 22 bp, Homo sapiens
ttcagaggacaaccagccatct

SEQ ID NO: 9141372 - DNA, 22 bp, Homo sapiens
ttcagaaagtgaatcttgttat

SEQ ID NO: 9141373 - DNA, 22 bp, Homo sapiens
ttcagaaagtgaatcttgttat

SEQ ID NO: 9141374 - DNA, 22 bp, Homo sapiens
ttcacactgtttttcatagtgg

SEQ ID NO: 9141375 - DNA, 20 bp, Homo sapiens
ttcagaggtgaagttgtggt

SEQ ID NO: 9141376 - DNA, 22 bp, Homo sapiens
ttcagataagtcaagttagtat

SEQ ID NO: 9141377 - DNA, 22 bp, Homo sapiens
cgcccctcagcgacccaccagc

SEQ ID NO: 9141378 - DNA, 22 bp, Homo sapiens
cgccccggacgtctgaccaaac

SEQ ID NO: 9141379 - DNA, 21 bp, Homo sapiens
ttcaagtctctaggacttctc

SEQ ID NO: 9141380 - DNA, 22 bp, Homo sapiens
cgccggcttgaggcaggcggca

SEQ ID NO: 9141381 - DNA, 22 bp, Homo sapiens
ttcaagttaactctccttgtac

SEQ ID NO: 9141382 - DNA, 20 bp, Homo sapiens
cgcccaggagggcccatgtg

SEQ ID NO: 9141383 - DNA, 22 bp, Homo sapiens
cgccccagtctgtaggtgcccc

SEQ ID NO: 9141384 - DNA, 22 bp, Homo sapiens
ttcacacacagcttcctattgt

SEQ ID NO: 9141385 - DNA, 21 bp, Homo sapiens
ttcaatactatttcaatagtc

SEQ ID NO: 9141386 - DNA, 20 bp, Homo sapiens
ttcaatacattactttgatt

SEQ ID NO: 9141387 - DNA, 22 bp, Homo sapiens
ttcaatacaaagaaaggaattt

SEQ ID NO: 9141388 - DNA, 20 bp, Homo sapiens
ttcaatacattactttgatt

SEQ ID NO: 9141389 - DNA, 22 bp, Homo sapiens
ttcaatacaccataggaatagt

SEQ ID NO: 9141390 - DNA, 19 bp, Homo sapiens
ttcacaattatgaaattag

SEQ ID NO: 9141391 - DNA, 20 bp, Homo sapiens
ttcaagttgggtctctggct

SEQ ID NO: 9141392 - DNA, 20 bp, Homo sapiens
ttcaagttgggtctctggct

SEQ ID NO: 9141393 - DNA, 20 bp, Homo sapiens
ttcaagttgggtctctggct

SEQ ID NO: 9141394 - DNA, 22 bp, Homo sapiens
ttcaagttctagtgttcacttc

SEQ ID NO: 9141395 - DNA, 22 bp, Homo sapiens
ttcaagttaatgattctggttt

SEQ ID NO: 9141396 - DNA, 22 bp, Homo sapiens
ttcaagttagagatatatttag

SEQ ID NO: 9141397 - DNA, 22 bp, Homo sapiens
ttcaagttttatatccatggct

SEQ ID NO: 9141398 - DNA, 22 bp, Homo sapiens
ttcaagttttcagaatagccac

SEQ ID NO: 9141399 - DNA, 22 bp, Homo sapiens
ttcaagtttgtatttctgtatt

SEQ ID NO: 9141400 - DNA, 22 bp, Homo sapiens
ttcaagtttgtatttctgtatt

SEQ ID NO: 9141401 - DNA, 22 bp, Homo sapiens
ttcaagttgtgttttccgggct

SEQ ID NO: 9141402 - DNA, 22 bp, Homo sapiens
ttcaagtttactttgaagttta

SEQ ID NO: 9141403 - DNA, 22 bp, Homo sapiens
ttaggcttccggcaggcggcgc

SEQ ID NO: 9141404 - DNA, 22 bp, Homo sapiens
ttaggcttcatgtgcagaggat

SEQ ID NO: 9141405 - DNA, 22 bp, Homo sapiens
ttaggctgttcttgtgttgtta

SEQ ID NO: 9141406 - DNA, 22 bp, Homo sapiens
ttaggcctttgattggggtgct

SEQ ID NO: 9141407 - DNA, 22 bp, Homo sapiens
ttaggagtccagatgtcttggg

SEQ ID NO: 9141408 - DNA, 22 bp, Homo sapiens
cgccaggcttggtagctcatgc

SEQ ID NO: 9141409 - DNA, 22 bp, Homo sapiens
cgcatgagacctgccggccatc

SEQ ID NO: 9141410 - DNA, 23 bp, Homo sapiens
cgcccagcctcagtgacctgggc

SEQ ID NO: 9141411 - DNA, 19 bp, Homo sapiens
cgcaggtggaaggagccgc

SEQ ID NO: 9141412 - DNA, 22 bp, Homo sapiens
cgcagtgagtctgtaaaaggct

SEQ ID NO: 9141413 - DNA, 22 bp, Homo sapiens
cgcaggtgtgttttcaggacta

SEQ ID NO: 9141414 - DNA, 22 bp, Homo sapiens
cgcatacatagaaacacacaga

SEQ ID NO: 9141415 - DNA, 22 bp, Homo sapiens
cctttctcttggataccgattg

SEQ ID NO: 9141416 - DNA, 22 bp, Homo sapiens
cctttctctggcagcaggacag

SEQ ID NO: 9141417 - DNA, 22 bp, Homo sapiens
cctttctctatcgacccatcgc

SEQ ID NO: 9141418 - DNA, 17 bp, Homo sapiens
cctttctctttcatctc

SEQ ID NO: 9141419 - DNA, 22 bp, Homo sapiens
cctttctctttgctgatcatgt

SEQ ID NO: 9141420 - DNA, 22 bp, Homo sapiens
cctttctgacagtgatgggggg

SEQ ID NO: 9141421 - DNA, 22 bp, Homo sapiens
ttaggaatatgtattttaaagt

SEQ ID NO: 9141422 - DNA, 22 bp, Homo sapiens
cctttctcattttaagcattag

SEQ ID NO: 9141423 - DNA, 22 bp, Homo sapiens
cctttctctatcgacccatcgc

SEQ ID NO: 9141424 - DNA, 18 bp, Homo sapiens
cctttcctcccctcagct

SEQ ID NO: 9141425 - DNA, 22 bp, Homo sapiens
tgtttagactcaaaattgaaag

SEQ ID NO: 9141426 - DNA, 22 bp, Homo sapiens
tgtttagcataaagattttcca

SEQ ID NO: 9141427 - DNA, 22 bp, Homo sapiens
tgtttagacagaatgagttctt

SEQ ID NO: 9141428 - DNA, 22 bp, Homo sapiens
tgtttagacaaggatcaggtta

SEQ ID NO: 9141429 - DNA, 22 bp, Homo sapiens
cctgtctctgttaccacatttg

SEQ ID NO: 9141430 - DNA, 22 bp, Homo sapiens
cctgtctctgcagggccctgcc

SEQ ID NO: 9141431 - DNA, 22 bp, Homo sapiens
cctgtctctgcagggccctgcc

SEQ ID NO: 9141432 - DNA, 22 bp, Homo sapiens
cctgtctctttcaatctgagag

SEQ ID NO: 9141433 - DNA, 22 bp, Homo sapiens
cctgtctgaggaggtgctcttt

SEQ ID NO: 9141434 - DNA, 22 bp, Homo sapiens
cctgtctgaggaggtgctcttt

SEQ ID NO: 9141435 - DNA, 22 bp, Homo sapiens
cctgtctgcatgatccctgcca

SEQ ID NO: 9141436 - DNA, 22 bp, Homo sapiens
cctgtctgcagatatctcaggt

SEQ ID NO: 9141437 - DNA, 20 bp, Homo sapiens
cctgtctgcaatggaggtca

SEQ ID NO: 9141438 - DNA, 22 bp, Homo sapiens
cctgtctgcatgagtgagcata

SEQ ID NO: 9141439 - DNA, 22 bp, Homo sapiens
cctgtctggggactccctgggt

SEQ ID NO: 9141440 - DNA, 22 bp, Homo sapiens
cctgtctggaacatggcctgtt

SEQ ID NO: 9141441 - DNA, 22 bp, Homo sapiens
cctgtctggaacatggcctgtt

SEQ ID NO: 9141442 - DNA, 20 bp, Homo sapiens
cctgtctggagacaaagaga

SEQ ID NO: 9141443 - DNA, 22 bp, Homo sapiens
cctgtctggccttccacggggg

SEQ ID NO: 9141444 - DNA, 22 bp, Homo sapiens
cctgtctggccaccagggcgat

SEQ ID NO: 9141445 - DNA, 22 bp, Homo sapiens
cctgtctgtcctctcatgagcc

SEQ ID NO: 9141446 - DNA, 23 bp, Homo sapiens
cctgtctgtgctgggtggacaca

SEQ ID NO: 9141447 - DNA, 23 bp, Homo sapiens
cctgtctgtgctgggtggacaca

SEQ ID NO: 9141448 - DNA, 19 bp, Homo sapiens
cctgtctgtcttcagctag

SEQ ID NO: 9141449 - DNA, 22 bp, Homo sapiens
cctgtctgttctgactggtcag

SEQ ID NO: 9141450 - DNA, 23 bp, Homo sapiens
cctgtgacactgtttgtggtaag

SEQ ID NO: 9141451 - DNA, 21 bp, Homo sapiens
cctgtcttggactgaggcacc

SEQ ID NO: 9141452 - DNA, 22 bp, Homo sapiens
cctgtcttagggaaagactgga

SEQ ID NO: 9141453 - DNA, 21 bp, Homo sapiens
cctgtcttggactgaggcacc

SEQ ID NO: 9141454 - DNA, 17 bp, Homo sapiens
cctgtcttgtttctgcc

SEQ ID NO: 9141455 - DNA, 17 bp, Homo sapiens
cctgtcttgtttctgcc

SEQ ID NO: 9141456 - DNA, 17 bp, Homo sapiens
cctgtcttgtttctgcc

SEQ ID NO: 9141457 - DNA, 22 bp, Homo sapiens
ttaaagtttgcctatgtgttgt

SEQ ID NO: 9141458 - DNA, 22 bp, Homo sapiens
ttaaagttcattaaatgagcca

SEQ ID NO: 9141459 - DNA, 22 bp, Homo sapiens
ttaaagtttcagaaacttggtc

SEQ ID NO: 9141460 - DNA, 22 bp, Homo sapiens
ttaaagtatagaggacaaaaac

SEQ ID NO: 9141461 - DNA, 22 bp, Homo sapiens
ttaaagtatggtttaagggctt

SEQ ID NO: 9141462 - DNA, 22 bp, Homo sapiens
ttaaagtaatctgtgtgaattt

SEQ ID NO: 9141463 - DNA, 22 bp, Homo sapiens
cctgtgggttttcaagatgcta

SEQ ID NO: 9141464 - DNA, 22 bp, Homo sapiens
cctgtgggttttcaagatgcta

SEQ ID NO: 9141465 - DNA, 21 bp, Homo sapiens
cctgtggtctggagggagcac

SEQ ID NO: 9141466 - DNA, 22 bp, Homo sapiens
cctgtggtttactctgtggcta

SEQ ID NO: 9141467 - DNA, 22 bp, Homo sapiens
cctgtgtcatcagctgtggcta

SEQ ID NO: 9141468 - DNA, 22 bp, Homo sapiens
cctgtgtccagttccaggttgt

SEQ ID NO: 9141469 - DNA, 19 bp, Homo sapiens
cctgtgtcccacgtagatg

SEQ ID NO: 9141470 - DNA, 22 bp, Homo sapiens
cctgtgtcagcccctgcctcca

SEQ ID NO: 9141471 - DNA, 22 bp, Homo sapiens
cctgtgtcaccggaacggagga

SEQ ID NO: 9141472 - DNA, 22 bp, Homo sapiens
cctgtgccctcagcctggctct

SEQ ID NO: 9141473 - DNA, 18 bp, Homo sapiens
cctgtgctccagcatctg

SEQ ID NO: 9141474 - DNA, 19 bp, Homo sapiens
cctgtgctaggagctgacc

SEQ ID NO: 9141475 - DNA, 22 bp, Homo sapiens
ttaaaggcatggttagacatgg

SEQ ID NO: 9141476 - DNA, 20 bp, Homo sapiens
cctgtgctgccctcggggcc

SEQ ID NO: 9141477 - DNA, 22 bp, Homo sapiens
cctgtgctgggtgtgagggaca

SEQ ID NO: 9141478 - DNA, 22 bp, Homo sapiens
cctgtgctggacagggctgggc

SEQ ID NO: 9141479 - DNA, 21 bp, Homo sapiens
ttacttttgcaccaacctaat

SEQ ID NO: 9141480 - DNA, 21 bp, Homo sapiens
ttacttttgcaccaacctaat

SEQ ID NO: 9141481 - DNA, 22 bp, Homo sapiens
ttacttttgcaccaaactaata

SEQ ID NO: 9141482 - DNA, 22 bp, Homo sapiens
ttacttttgcaccaaactaata

SEQ ID NO: 9141483 - DNA, 22 bp, Homo sapiens
ttactaagagaagtaaatattt

SEQ ID NO: 9141484 - DNA, 21 bp, Homo sapiens
ttacttttgcagcaacctaat

SEQ ID NO: 9141485 - DNA, 21 bp, Homo sapiens
ttacttttgcagcaacctaat

SEQ ID NO: 9141486 - DNA, 23 bp, Homo sapiens
ttacttttgcaccaacctaatat

SEQ ID NO: 9141487 - DNA, 22 bp, Homo sapiens
ttagaaaaaacgtcttctagtg

SEQ ID NO: 9141488 - DNA, 22 bp, Homo sapiens
ccttctagcaaatcaacataaa

SEQ ID NO: 9141489 - DNA, 22 bp, Homo sapiens
ccttctagcaaatcaacataaa

SEQ ID NO: 9141490 - DNA, 22 bp, Homo sapiens
ccttccttttactgtctccgga

SEQ ID NO: 9141491 - DNA, 22 bp, Homo sapiens
ccttcctttgcatcatttctag

SEQ ID NO: 9141492 - DNA, 22 bp, Homo sapiens
ccttctcagccccagctcccgc

SEQ ID NO: 9141493 - DNA, 22 bp, Homo sapiens
ccttcctttcagggctatgcct

SEQ ID NO: 9141494 - DNA, 22 bp, Homo sapiens
ccttccttgtctacaaaagctc

SEQ ID NO: 9141495 - DNA, 22 bp, Homo sapiens
ccttccttcaagcacacatcta

SEQ ID NO: 9141496 - DNA, 22 bp, Homo sapiens
ttagaagtacatttagaacata

SEQ ID NO: 9141497 - DNA, 22 bp, Homo sapiens
ttagaaaatggaggtgggaggg

SEQ ID NO: 9141498 - DNA, 22 bp, Homo sapiens
ttagaaaacataagtggtaaag

SEQ ID NO: 9141499 - DNA, 22 bp, Homo sapiens
ttagaaaaaggctgtggtctta

SEQ ID NO: 9141500 - DNA, 22 bp, Homo sapiens
ttagaagttcaggtctgtaatc

SEQ ID NO: 9141501 - DNA, 22 bp, Homo sapiens
cctttacagtatggttgtatca

SEQ ID NO: 9141502 - DNA, 22 bp, Homo sapiens
cctttacatctgacttctttca

SEQ ID NO: 9141503 - DNA, 22 bp, Homo sapiens
cctttattcaattagtcctaat

SEQ ID NO: 9141504 - DNA, 22 bp, Homo sapiens
ccttccccagtgattctctcag

SEQ ID NO: 9141505 - DNA, 22 bp, Homo sapiens
ccttccagttcttggttgtaat

SEQ ID NO: 9141506 - DNA, 22 bp, Homo sapiens
ccttcccatgcagcctgtctga

SEQ ID NO: 9141507 - DNA, 22 bp, Homo sapiens
ccttccagtgactaaggaggaa

SEQ ID NO: 9141508 - DNA, 22 bp, Homo sapiens
ccttcaggtcatatatgtcaga

SEQ ID NO: 9141509 - DNA, 22 bp, Homo sapiens
ccttcctggagcccatgcagat

SEQ ID NO: 9141510 - DNA, 22 bp, Homo sapiens
ccttccttcaagcacacatcta

SEQ ID NO: 9141511 - DNA, 19 bp, Homo sapiens
ccttcctccccagggccat

SEQ ID NO: 9141512 - DNA, 22 bp, Homo sapiens
ccttcaggtcatatatgtcaga

SEQ ID NO: 9141513 - DNA, 21 bp, Homo sapiens
cctgtgtgtctgactgggcta

SEQ ID NO: 9141514 - DNA, 22 bp, Homo sapiens
cctgtgtctttgcctcagggtc

SEQ ID NO: 9141515 - DNA, 22 bp, Homo sapiens
cctgtgtcttccccactggtgt

SEQ ID NO: 9141516 - DNA, 23 bp, Homo sapiens
cctgtgtctgttgctgaataatg

SEQ ID NO: 9141517 - DNA, 22 bp, Homo sapiens
cctgtgtctgaccatgcacatg

SEQ ID NO: 9141518 - DNA, 22 bp, Homo sapiens
cctgtgtccttggcagatatcc

SEQ ID NO: 9141519 - DNA, 16 bp, Homo sapiens
cctgtgtctatcaggt

SEQ ID NO: 9141520 - DNA, 22 bp, Homo sapiens
cctgtgtcctcccactcagtcc

SEQ ID NO: 9141521 - DNA, 22 bp, Homo sapiens
cctgtgtcctaatccatcaggc

SEQ ID NO: 9141522 - DNA, 22 bp, Homo sapiens
tgttacaatattatcaactgag

SEQ ID NO: 9141523 - DNA, 21 bp, Homo sapiens
tgttcagaccaacttggactg

SEQ ID NO: 9141524 - DNA, 22 bp, Homo sapiens
tgttcagagacagaaattctaa

SEQ ID NO: 9141525 - DNA, 21 bp, Homo sapiens
tgttacagtccaaatgtttgt

SEQ ID NO: 9141526 - DNA, 22 bp, Homo sapiens
tgttcagtttgctatcataatc

SEQ ID NO: 9141527 - DNA, 22 bp, Homo sapiens
tgttcattaaactactgtgtgg

SEQ ID NO: 9141528 - DNA, 23 bp, Homo sapiens
tgttccagatacgccttttcctc

SEQ ID NO: 9141529 - DNA, 23 bp, Homo sapiens
tgttccagatacgccttttcctc

SEQ ID NO: 9141530 - DNA, 22 bp, Homo sapiens
tgttccagaggcagagatagga

SEQ ID NO: 9141531 - DNA, 20 bp, Homo sapiens
tgttccaggaggccagggct

SEQ ID NO: 9141532 - DNA, 23 bp, Homo sapiens
tgttccagatacgccttttcctc

SEQ ID NO: 9141533 - DNA, 22 bp, Homo sapiens
tgttcattttgaagtacttcaa

SEQ ID NO: 9141534 - DNA, 22 bp, Homo sapiens
tgttcattttgaagtacttcaa

SEQ ID NO: 9141535 - DNA, 22 bp, Homo sapiens
tgttcattgccccctgtgtaaa

SEQ ID NO: 9141536 - DNA, 22 bp, Homo sapiens
tgttcattcgctattgtctatg

SEQ ID NO: 9141537 - DNA, 22 bp, Homo sapiens
tgttcattactgctgtttgcca

SEQ ID NO: 9141538 - DNA, 22 bp, Homo sapiens
cctggttgagggaggtgtggac

SEQ ID NO: 9141539 - DNA, 22 bp, Homo sapiens
cctggttgtgagttgagttgag

SEQ ID NO: 9141540 - DNA, 22 bp, Homo sapiens
tgtttacttaaatgttttcata

SEQ ID NO: 9141541 - DNA, 22 bp, Homo sapiens
cctgggtgtcatgggcagctgg

SEQ ID NO: 9141542 - DNA, 22 bp, Homo sapiens
cctgggtgtcatgggcagctgg

SEQ ID NO: 9141543 - DNA, 22 bp, Homo sapiens
cctggtggaaggtgagtgaggc

SEQ ID NO: 9141544 - DNA, 22 bp, Homo sapiens
cctggtggacagcagccagcag

SEQ ID NO: 9141545 - DNA, 22 bp, Homo sapiens
cctggtggaaggtgagtgaggc

SEQ ID NO: 9141546 - DNA, 22 bp, Homo sapiens
cctggtggagaggggcggagcg

SEQ ID NO: 9141547 - DNA, 22 bp, Homo sapiens
cctggtggccttcagcccacaa

SEQ ID NO: 9141548 - DNA, 22 bp, Homo sapiens
cctggtggagaggggcggagcg

SEQ ID NO: 9141549 - DNA, 22 bp, Homo sapiens
cctggtggcgaatggtggtagg

SEQ ID NO: 9141550 - DNA, 22 bp, Homo sapiens
cctggtggccttcagcccacaa

SEQ ID NO: 9141551 - DNA, 22 bp, Homo sapiens
cctggtggcttctgggtggacg

SEQ ID NO: 9141552 - DNA, 22 bp, Homo sapiens
cctggtgggcaggagtgagacc

SEQ ID NO: 9141553 - DNA, 22 bp, Homo sapiens
cctggtggcttctgggtggacg

SEQ ID NO: 9141554 - DNA, 22 bp, Homo sapiens
cctgggcttacgacctctgact

SEQ ID NO: 9141555 - DNA, 22 bp, Homo sapiens
cctgggcttacgacctctgact

SEQ ID NO: 9141556 - DNA, 22 bp, Homo sapiens
cctgggctgttgcatcatcctt

SEQ ID NO: 9141557 - DNA, 22 bp, Homo sapiens
cctgggctgggcgtctcatggg

SEQ ID NO: 9141558 - DNA, 22 bp, Homo sapiens
cctgggctgggcgtctcatggg

SEQ ID NO: 9141559 - DNA, 22 bp, Homo sapiens
cctgggctgtacctgtgcgcgg

SEQ ID NO: 9141560 - DNA, 21 bp, Homo sapiens
cctgggctgtggtttggagac

SEQ ID NO: 9141561 - DNA, 21 bp, Homo sapiens
cctgggctgtggtttggagac

SEQ ID NO: 9141562 - DNA, 22 bp, Homo sapiens
cctgggctgtacctgtgcgcgg

SEQ ID NO: 9141563 - DNA, 22 bp, Homo sapiens
cctgggctgtacctgtgcgcgg

SEQ ID NO: 9141564 - DNA, 22 bp, Homo sapiens
tgttacaagtcttgaggtactt

SEQ ID NO: 9141565 - DNA, 23 bp, Homo sapiens
tgttacaagcaccacaggtggct

SEQ ID NO: 9141566 - DNA, 22 bp, Homo sapiens
tgttacaaggaagaatgtaggt

SEQ ID NO: 9141567 - DNA, 22 bp, Homo sapiens
tgttaatgtgctttgaaagact

SEQ ID NO: 9141568 - DNA, 22 bp, Homo sapiens
tgttaatatactaaaatccact

SEQ ID NO: 9141569 - DNA, 22 bp, Homo sapiens
tgttaagttgccagtgtatgac

SEQ ID NO: 9141570 - DNA, 23 bp, Homo sapiens
tgttaatacatctgccactcatt

SEQ ID NO: 9141571 - DNA, 22 bp, Homo sapiens
cctgggctctatcctgacccag

SEQ ID NO: 9141572 - DNA, 22 bp, Homo sapiens
cctgggctctatcctgacccag

SEQ ID NO: 9141573 - DNA, 22 bp, Homo sapiens
cctgggctctatcctgacccag

SEQ ID NO: 9141574 - DNA, 22 bp, Homo sapiens
cctgggctctgaggagggagtc

SEQ ID NO: 9141575 - DNA, 22 bp, Homo sapiens
cctgggctctgaggagggagtc

SEQ ID NO: 9141576 - DNA, 22 bp, Homo sapiens
cctgggctcaagtgatcctcct

SEQ ID NO: 9141577 - DNA, 22 bp, Homo sapiens
cctgggctcaagtgatcctcct

SEQ ID NO: 9141578 - DNA, 16 bp, Homo sapiens
cctgggctctgttgga

SEQ ID NO: 9141579 - DNA, 22 bp, Homo sapiens
cctgggctctgtcagaattggg

SEQ ID NO: 9141580 - DNA, 22 bp, Homo sapiens
cctgggctgaagtcaagtgtgg

SEQ ID NO: 9141581 - DNA, 22 bp, Homo sapiens
cctgggctgcatgatggcattt

SEQ ID NO: 9141582 - DNA, 22 bp, Homo sapiens
cctgggctgcatgatggcattt

SEQ ID NO: 9141583 - DNA, 22 bp, Homo sapiens
cctgggctggagtacagcagtg

SEQ ID NO: 9141584 - DNA, 22 bp, Homo sapiens
cctgggctggagtacagcagtg

SEQ ID NO: 9141585 - DNA, 22 bp, Homo sapiens
cctgggctggagtacagcagtg

SEQ ID NO: 9141586 - DNA, 22 bp, Homo sapiens
cctgggctgctcatggggatga

SEQ ID NO: 9141587 - DNA, 22 bp, Homo sapiens
cctgggctgctcatggggatga

SEQ ID NO: 9141588 - DNA, 22 bp, Homo sapiens
cctgggctgctcatggggatga

SEQ ID NO: 9141589 - DNA, 22 bp, Homo sapiens
tgtgtctgaacatgctttgtaa

SEQ ID NO: 9141590 - DNA, 22 bp, Homo sapiens
tgtgtctgcactgagtcctcac

SEQ ID NO: 9141591 - DNA, 22 bp, Homo sapiens
tgtgtctgaactagttgctctc

SEQ ID NO: 9141592 - DNA, 22 bp, Homo sapiens
tgtgtctgaactagttgctctc

SEQ ID NO: 9141593 - DNA, 22 bp, Homo sapiens
tgtgtatattaggacacattct

SEQ ID NO: 9141594 - DNA, 22 bp, Homo sapiens
tgtgtatattaggacacattct

SEQ ID NO: 9141595 - DNA, 22 bp, Homo sapiens
tgtgtatatgtaaatatagttg

SEQ ID NO: 9141596 - DNA, 22 bp, Homo sapiens
tgtgtattaatgtttgtatatg

SEQ ID NO: 9141597 - DNA, 22 bp, Homo sapiens
tgtgtatacgagtatgaatatg

SEQ ID NO: 9141598 - DNA, 22 bp, Homo sapiens
tgtgtataaacaagagtctgtg

SEQ ID NO: 9141599 - DNA, 22 bp, Homo sapiens
tgtgtatacaacttataggagc

SEQ ID NO: 9141600 - DNA, 22 bp, Homo sapiens
tgtgtatacatacatacacacg

SEQ ID NO: 9141601 - DNA, 22 bp, Homo sapiens
tgtgtataactcttaattcatt

SEQ ID NO: 9141602 - DNA, 22 bp, Homo sapiens
tgtgtataagtgagaatgctgt

SEQ ID NO: 9141603 - DNA, 22 bp, Homo sapiens
tgtgtataattagaccatttac

SEQ ID NO: 9141604 - DNA, 22 bp, Homo sapiens
tgtgtatagatgcatgcatata

SEQ ID NO: 9141605 - DNA, 22 bp, Homo sapiens
tgtgtatagcagtttccagtct

SEQ ID NO: 9141606 - DNA, 22 bp, Homo sapiens
tgtgtataggttgtgctaatag

SEQ ID NO: 9141607 - DNA, 22 bp, Homo sapiens
tgtgtatatatgtgcacatgta

SEQ ID NO: 9141608 - DNA, 22 bp, Homo sapiens
cctgggcaacatagtgagacct

SEQ ID NO: 9141609 - DNA, 22 bp, Homo sapiens
cctgggcaatatagtgaggccc

SEQ ID NO: 9141610 - DNA, 20 bp, Homo sapiens
tgtgtataaatatatgtttc

SEQ ID NO: 9141611 - DNA, 20 bp, Homo sapiens
tgtgtataaatatatgtttc

SEQ ID NO: 9141612 - DNA, 22 bp, Homo sapiens
tgtgtataaaagcagtgcagga

SEQ ID NO: 9141613 - DNA, 22 bp, Homo sapiens
cctgggcaacatagggagaccc

SEQ ID NO: 9141614 - DNA, 22 bp, Homo sapiens
cctgggatttcctgagcactct

SEQ ID NO: 9141615 - DNA, 22 bp, Homo sapiens
cctgggcaacatagtgagaccc

SEQ ID NO: 9141616 - DNA, 22 bp, Homo sapiens
cctgggcaacatagtgagaccc

SEQ ID NO: 9141617 - DNA, 22 bp, Homo sapiens
cctgggcaacatagtgagacct

SEQ ID NO: 9141618 - DNA, 22 bp, Homo sapiens
cctgggagtggcactcacagca

SEQ ID NO: 9141619 - DNA, 22 bp, Homo sapiens
cctgggagtgtgccatctctgt

SEQ ID NO: 9141620 - DNA, 22 bp, Homo sapiens
cctgggagtgtgccatctctgt

SEQ ID NO: 9141621 - DNA, 22 bp, Homo sapiens
cctgggaggtggaggttgcagt

SEQ ID NO: 9141622 - DNA, 22 bp, Homo sapiens
cctgggaggctgaggctgcagt

SEQ ID NO: 9141623 - DNA, 22 bp, Homo sapiens
cctgggaggctgaggctgcagt

SEQ ID NO: 9141624 - DNA, 21 bp, Homo sapiens
tgggggagaattggttgcttt

SEQ ID NO: 9141625 - DNA, 21 bp, Homo sapiens
tgggggagaattggttgcttt

SEQ ID NO: 9141626 - DNA, 21 bp, Homo sapiens
tgggggagaattggttgcttt

SEQ ID NO: 9141627 - DNA, 22 bp, Homo sapiens
tgggggaagagcttgttaaagt

SEQ ID NO: 9141628 - DNA, 22 bp, Homo sapiens
tgggggacaccagtctctctct

SEQ ID NO: 9141629 - DNA, 22 bp, Homo sapiens
tggggcagccacatagacaaca

SEQ ID NO: 9141630 - DNA, 22 bp, Homo sapiens
tggggcagcagacctttcttgg

SEQ ID NO: 9141631 - DNA, 22 bp, Homo sapiens
tggggaggaagtcagatttcag

SEQ ID NO: 9141632 - DNA, 22 bp, Homo sapiens
tggggcagctccatctattcca

SEQ ID NO: 9141633 - DNA, 22 bp, Homo sapiens
tggggcagctccatctattcca

SEQ ID NO: 9141634 - DNA, 22 bp, Homo sapiens
tggggcagctccatctattcca

SEQ ID NO: 9141635 - DNA, 22 bp, Homo sapiens
tggggcagggatgggaaactat

SEQ ID NO: 9141636 - DNA, 22 bp, Homo sapiens
tggggcagggatgggaaactat

SEQ ID NO: 9141637 - DNA, 22 bp, Homo sapiens
tggggcagtggcttttcaccct

SEQ ID NO: 9141638 - DNA, 22 bp, Homo sapiens
tggggcagtggcttttcaccct

SEQ ID NO: 9141639 - DNA, 22 bp, Homo sapiens
tggggcagtggcttttcaccct

SEQ ID NO: 9141640 - DNA, 22 bp, Homo sapiens
tggggcagttaataaacattct

SEQ ID NO: 9141641 - DNA, 22 bp, Homo sapiens
tggggctgtgagactacaggat

SEQ ID NO: 9141642 - DNA, 22 bp, Homo sapiens
tggggctgtgagactacaggat

SEQ ID NO: 9141643 - DNA, 19 bp, Homo sapiens
tggggctgtgttttgaccc

SEQ ID NO: 9141644 - DNA, 22 bp, Homo sapiens
ttttaagtgcaatctgaatgcg

SEQ ID NO: 9141645 - DNA, 22 bp, Homo sapiens
ttttaagtgcaatctgaatgcg

SEQ ID NO: 9141646 - DNA, 19 bp, Homo sapiens
ttttaagtcctctctattc

SEQ ID NO: 9141647 - DNA, 19 bp, Homo sapiens
ttttaagtcctctctattc

SEQ ID NO: 9141648 - DNA, 22 bp, Homo sapiens
ttttaagcaaaagaatggtgtg

SEQ ID NO: 9141649 - DNA, 22 bp, Homo sapiens
ttttaatactgctattgtagga

SEQ ID NO: 9141650 - DNA, 22 bp, Homo sapiens
ttttaatactgctattgtagga

SEQ ID NO: 9141651 - DNA, 22 bp, Homo sapiens
ttttaagtttattccagtacat

SEQ ID NO: 9141652 - DNA, 22 bp, Homo sapiens
ttttagaatcaggttgtctggg

SEQ ID NO: 9141653 - DNA, 22 bp, Homo sapiens
ttttagaatcaggttgtctggg

SEQ ID NO: 9141654 - DNA, 22 bp, Homo sapiens
ttttagatagtttaactgcact

SEQ ID NO: 9141655 - DNA, 22 bp, Homo sapiens
ttttagatagtttaactgcact

SEQ ID NO: 9141656 - DNA, 22 bp, Homo sapiens
ttttagcactaagtgatatgct

SEQ ID NO: 9141657 - DNA, 22 bp, Homo sapiens
ttttagcactaagtgatatgct

SEQ ID NO: 9141658 - DNA, 22 bp, Homo sapiens
tttgtacaggtgcaggcatttg

SEQ ID NO: 9141659 - DNA, 22 bp, Homo sapiens
tttgtacactgtctactatgaa

SEQ ID NO: 9141660 - DNA, 22 bp, Homo sapiens
tttgtacactgtctactatgaa

SEQ ID NO: 9141661 - DNA, 22 bp, Homo sapiens
tttgtacactgtctactatgaa

SEQ ID NO: 9141662 - DNA, 22 bp, Homo sapiens
tttgtacacctacctaatacag

SEQ ID NO: 9141663 - DNA, 22 bp, Homo sapiens
tttgggcagaagctgaatgtct

SEQ ID NO: 9141664 - DNA, 22 bp, Homo sapiens
tttgtacacaggatgttataat

SEQ ID NO: 9141665 - DNA, 22 bp, Homo sapiens
tttgggcacagatattaagtat

SEQ ID NO: 9141666 - DNA, 22 bp, Homo sapiens
ttttaagaggaggctgtttgaa

SEQ ID NO: 9141667 - DNA, 22 bp, Homo sapiens
tttgtacatatataaaatctgt

SEQ ID NO: 9141668 - DNA, 22 bp, Homo sapiens
tttgtacatataaatcttgtat

SEQ ID NO: 9141669 - DNA, 22 bp, Homo sapiens
tttgtacatatataaaatctgt

SEQ ID NO: 9141670 - DNA, 22 bp, Homo sapiens
ttttcaggtgcagtaatcatat

SEQ ID NO: 9141671 - DNA, 22 bp, Homo sapiens
ttttcaggccagaagatagacc

SEQ ID NO: 9141672 - DNA, 22 bp, Homo sapiens
ttttcagaggcctaagaggttt

SEQ ID NO: 9141673 - DNA, 22 bp, Homo sapiens
ttttcagtaatgtctacataat

SEQ ID NO: 9141674 - DNA, 22 bp, Homo sapiens
ttttcaccagcttgctacaatt

SEQ ID NO: 9141675 - DNA, 22 bp, Homo sapiens
ttttcacttaaggaatttcatg

SEQ ID NO: 9141676 - DNA, 22 bp, Homo sapiens
ctcttcatgtgtttaattttta

SEQ ID NO: 9141677 - DNA, 22 bp, Homo sapiens
ttttcagagagcttttatgtcc

SEQ ID NO: 9141678 - DNA, 22 bp, Homo sapiens
ttttcagagagcttttatgtcc

SEQ ID NO: 9141679 - DNA, 22 bp, Homo sapiens
ttttcagaaagatgagaaatta

SEQ ID NO: 9141680 - DNA, 22 bp, Homo sapiens
ctcttcttgcctgatgaggcag

SEQ ID NO: 9141681 - DNA, 22 bp, Homo sapiens
ctcttcttgctagactgagtgc

SEQ ID NO: 9141682 - DNA, 21 bp, Homo sapiens
ctcttgtctttgctcagtagc

SEQ ID NO: 9141683 - DNA, 22 bp, Homo sapiens
ctcttcttggaatgctgactgt

SEQ ID NO: 9141684 - DNA, 22 bp, Homo sapiens
ctctttaactcccattctgtcc

SEQ ID NO: 9141685 - DNA, 21 bp, Homo sapiens
ctcttgtgtcagagccagagg

SEQ ID NO: 9141686 - DNA, 22 bp, Homo sapiens
ctctttaaagtaaaatttgtct

SEQ ID NO: 9141687 - DNA, 22 bp, Homo sapiens
ctctttactctgtgttattgtt

SEQ ID NO: 9141688 - DNA, 20 bp, Homo sapiens
ctcttattgcattagtttct

SEQ ID NO: 9141689 - DNA, 22 bp, Homo sapiens
ctcttatacatatttttaggcg

SEQ ID NO: 9141690 - DNA, 22 bp, Homo sapiens
ctcttattcctacagtaacagg

SEQ ID NO: 9141691 - DNA, 23 bp, Homo sapiens
ttttagtgactcctttatctgcc

SEQ ID NO: 9141692 - DNA, 22 bp, Homo sapiens
ttttagttactgcagtagcaaa

SEQ ID NO: 9141693 - DNA, 22 bp, Homo sapiens
ctctgtttctcagcctatttcc

SEQ ID NO: 9141694 - DNA, 22 bp, Homo sapiens
ctctgttacagccccctgcctc

SEQ ID NO: 9141695 - DNA, 22 bp, Homo sapiens
ctctgttaagccatgtaagtac

SEQ ID NO: 9141696 - DNA, 22 bp, Homo sapiens
ctcttcagtaaatgacactgtt

SEQ ID NO: 9141697 - DNA, 22 bp, Homo sapiens
ctcttcattagttcctgtccca

SEQ ID NO: 9141698 - DNA, 22 bp, Homo sapiens
ctcttcagcctatttgagtgca

SEQ ID NO: 9141699 - DNA, 22 bp, Homo sapiens
ctcttcaggaatatgtcagtca

SEQ ID NO: 9141700 - DNA, 22 bp, Homo sapiens
ctcttcaggatggcttgtgatg

SEQ ID NO: 9141701 - DNA, 22 bp, Homo sapiens
ctcttcaggtttctgctctgga

SEQ ID NO: 9141702 - DNA, 22 bp, Homo sapiens
tttgctaaataagtgattaagt

SEQ ID NO: 9141703 - DNA, 22 bp, Homo sapiens
tttgcgtctatgtgtgagcctt

SEQ ID NO: 9141704 - DNA, 20 bp, Homo sapiens
tttgcgaggccaaggcgggc

SEQ ID NO: 9141705 - DNA, 20 bp, Homo sapiens
tttgctatgcatatctgacc

SEQ ID NO: 9141706 - DNA, 22 bp, Homo sapiens
tttgctataaaagggtcacacg

SEQ ID NO: 9141707 - DNA, 22 bp, Homo sapiens
tttgcctgattctaagagctca

SEQ ID NO: 9141708 - DNA, 22 bp, Homo sapiens
tttgccaggtaagtactatgct

SEQ ID NO: 9141709 - DNA, 22 bp, Homo sapiens
ctctgctttctcaaaccctgtg

SEQ ID NO: 9141710 - DNA, 22 bp, Homo sapiens
tttgctcttgctgcttggggca

SEQ ID NO: 9141711 - DNA, 22 bp, Homo sapiens
tttgctcagttctctgtatttt

SEQ ID NO: 9141712 - DNA, 22 bp, Homo sapiens
tttggaattggaaagtgctgtg

SEQ ID NO: 9141713 - DNA, 22 bp, Homo sapiens
tttggaattggcattctattct

SEQ ID NO: 9141714 - DNA, 22 bp, Homo sapiens
tttgggaaagtgtcttttgtat

SEQ ID NO: 9141715 - DNA, 22 bp, Homo sapiens
tttgggaagaagttgcaaattt

SEQ ID NO: 9141716 - DNA, 22 bp, Homo sapiens
tttgggaactggacttcctgct

SEQ ID NO: 9141717 - DNA, 22 bp, Homo sapiens
tttgggaaggcagacatcccac

SEQ ID NO: 9141718 - DNA, 22 bp, Homo sapiens
tttgggaagaggaatctctgga

SEQ ID NO: 9141719 - DNA, 22 bp, Homo sapiens
tttgggaatctttgtgcatgac

SEQ ID NO: 9141720 - DNA, 22 bp, Homo sapiens
tttgggaattgtagctgtcttg

SEQ ID NO: 9141721 - DNA, 22 bp, Homo sapiens
tttgggcaagctcactgattca

SEQ ID NO: 9141722 - DNA, 22 bp, Homo sapiens
tttgggcaattcagtgggacct

SEQ ID NO: 9141723 - DNA, 22 bp, Homo sapiens
ctctgccatttatcagaactgt

SEQ ID NO: 9141724 - DNA, 22 bp, Homo sapiens
ctctgccatttatcagaactgt

SEQ ID NO: 9141725 - DNA, 22 bp, Homo sapiens
ctctgccactcgaagtcaagga

SEQ ID NO: 9141726 - DNA, 22 bp, Homo sapiens
ctctgccagccaaaatttatga

SEQ ID NO: 9141727 - DNA, 22 bp, Homo sapiens
ctctgccaggcagaacggcttt

SEQ ID NO: 9141728 - DNA, 22 bp, Homo sapiens
ctctgccatcttggagctcaag

SEQ ID NO: 9141729 - DNA, 22 bp, Homo sapiens
tttccttgttattatttgtcct

SEQ ID NO: 9141730 - DNA, 22 bp, Homo sapiens
tttcctttatgacatcaccact

SEQ ID NO: 9141731 - DNA, 20 bp, Homo sapiens
ctctgcagcaaggcctgggt

SEQ ID NO: 9141732 - DNA, 22 bp, Homo sapiens
ctctgccaccatgcttcctgac

SEQ ID NO: 9141733 - DNA, 20 bp, Homo sapiens
ctctgcagcaaggcctgggt

SEQ ID NO: 9141734 - DNA, 22 bp, Homo sapiens
ctctgccaagatgacaggtaag

SEQ ID NO: 9141735 - DNA, 19 bp, Homo sapiens
ctctgcctccctcctgggt

SEQ ID NO: 9141736 - DNA, 22 bp, Homo sapiens
tttgcaaagtgcttgcagagta

SEQ ID NO: 9141737 - DNA, 22 bp, Homo sapiens
ctctgcctcagtgatttcttta

SEQ ID NO: 9141738 - DNA, 22 bp, Homo sapiens
ctctgccctcgcacatctgcca

SEQ ID NO: 9141739 - DNA, 22 bp, Homo sapiens
ctctgcccccagctggtgcttg

SEQ ID NO: 9141740 - DNA, 21 bp, Homo sapiens
ctctgcccagggcctcctgcc

SEQ ID NO: 9141741 - DNA, 22 bp, Homo sapiens
ctctgcccgcggatgccacgtc

SEQ ID NO: 9141742 - DNA, 22 bp, Homo sapiens
ctgacaggctgagatccctggt

SEQ ID NO: 9141743 - DNA, 22 bp, Homo sapiens
ctgacagggtagacagagggca

SEQ ID NO: 9141744 - DNA, 19 bp, Homo sapiens
ctgacccaggacaccacgg

SEQ ID NO: 9141745 - DNA, 22 bp, Homo sapiens
ctgaccctggaggcatttctct

SEQ ID NO: 9141746 - DNA, 22 bp, Homo sapiens
ctgaccatcatggtgaaacccc

SEQ ID NO: 9141747 - DNA, 22 bp, Homo sapiens
ctgaccagccctgcccagggaa

SEQ ID NO: 9141748 - DNA, 20 bp, Homo sapiens
ctgaccagcagcctgtctcc

SEQ ID NO: 9141749 - DNA, 22 bp, Homo sapiens
ctgacatggggatccaccttag

SEQ ID NO: 9141750 - DNA, 22 bp, Homo sapiens
ctgaccacaggcctctaacagc

SEQ ID NO: 9141751 - DNA, 22 bp, Homo sapiens
ctgacagtctcattgatttgct

SEQ ID NO: 9141752 - DNA, 22 bp, Homo sapiens
ctctttggccagaaaatgtttt

SEQ ID NO: 9141753 - DNA, 22 bp, Homo sapiens
ctctttggatagaattacaaag

SEQ ID NO: 9141754 - DNA, 19 bp, Homo sapiens
ctctttggagatccttgga

SEQ ID NO: 9141755 - DNA, 22 bp, Homo sapiens
ctctttggatagaattacaaag

SEQ ID NO: 9141756 - DNA, 22 bp, Homo sapiens
ctctttggagaagcacgtatta

SEQ ID NO: 9141757 - DNA, 20 bp, Homo sapiens
ctctttgcaatgcagaagac

SEQ ID NO: 9141758 - DNA, 22 bp, Homo sapiens
ctctttctgattcgctgggacc

SEQ ID NO: 9141759 - DNA, 18 bp, Homo sapiens
ctctttctttggcacaaa

SEQ ID NO: 9141760 - DNA, 18 bp, Homo sapiens
ctctttctttggcacaaa

SEQ ID NO: 9141761 - DNA, 21 bp, Homo sapiens
ctctttatatagtaaagatat

SEQ ID NO: 9141762 - DNA, 21 bp, Homo sapiens
ctctttatatagtaaagatat

SEQ ID NO: 9141763 - DNA, 17 bp, Homo sapiens
ctctttataaagagtta

SEQ ID NO: 9141764 - DNA, 17 bp, Homo sapiens
ctctttataaagagtta

SEQ ID NO: 9141765 - DNA, 22 bp, Homo sapiens
ctctttcctcagccacagtcta

SEQ ID NO: 9141766 - DNA, 22 bp, Homo sapiens
ctctttctcgccgcccgcagtc

SEQ ID NO: 9141767 - DNA, 22 bp, Homo sapiens
ctctttctgattcgctgggacc

SEQ ID NO: 9141768 - DNA, 22 bp, Homo sapiens
ctctttctcattgtcagcagaa

SEQ ID NO: 9141769 - DNA, 22 bp, Homo sapiens
ctctttctcattgtcagcagaa

SEQ ID NO: 9141770 - DNA, 22 bp, Homo sapiens
ctctttctcgccgcccgcagtc

SEQ ID NO: 9141771 - DNA, 22 bp, Homo sapiens
ctctttctgattcgctgggacc

SEQ ID NO: 9141772 - DNA, 22 bp, Homo sapiens
ctctttctgattcgctgggacc

SEQ ID NO: 9141773 - DNA, 22 bp, Homo sapiens
ctgactccctccccaaagctgg

SEQ ID NO: 9141774 - DNA, 18 bp, Homo sapiens
ctgacccttttacattcc

SEQ ID NO: 9141775 - DNA, 22 bp, Homo sapiens
ctgagccatgggtctaagcact

SEQ ID NO: 9141776 - DNA, 22 bp, Homo sapiens
ctgagccatgagcctgcgccca

SEQ ID NO: 9141777 - DNA, 22 bp, Homo sapiens
ctgagccatccataccagctta

SEQ ID NO: 9141778 - DNA, 22 bp, Homo sapiens
ctgagccaaccacagcaggagc

SEQ ID NO: 9141779 - DNA, 20 bp, Homo sapiens
ctgagccaactctcttcttg

SEQ ID NO: 9141780 - DNA, 20 bp, Homo sapiens
ctgagcccccagcctgcagg

SEQ ID NO: 9141781 - DNA, 20 bp, Homo sapiens
ctgagcccagatcccaggtc

SEQ ID NO: 9141782 - DNA, 20 bp, Homo sapiens
ctgagcccagatcccaggtc

SEQ ID NO: 9141783 - DNA, 22 bp, Homo sapiens
ctgagcccctctgacctcagag

SEQ ID NO: 9141784 - DNA, 22 bp, Homo sapiens
ctgagccctcctgcttgctgag

SEQ ID NO: 9141785 - DNA, 22 bp, Homo sapiens
ctgagcctcctgcttctatttc

SEQ ID NO: 9141786 - DNA, 22 bp, Homo sapiens
ctgagcctccaggaggggggtg

SEQ ID NO: 9141787 - DNA, 22 bp, Homo sapiens
ctgaggcagagggcagaccaga

SEQ ID NO: 9141788 - DNA, 22 bp, Homo sapiens
ctgagcctcctgcttctatttc

SEQ ID NO: 9141789 - DNA, 22 bp, Homo sapiens
ctgagcccttgaacccaagtcc

SEQ ID NO: 9141790 - DNA, 19 bp, Homo sapiens
ctgagcctcagtttcctag

SEQ ID NO: 9141791 - DNA, 22 bp, Homo sapiens
ctgagccctggctcgcctggag

SEQ ID NO: 9141792 - DNA, 22 bp, Homo sapiens
ctgaggcatgttacaggacata

SEQ ID NO: 9141793 - DNA, 22 bp, Homo sapiens
ctgaggcatgggaagttgggtg

SEQ ID NO: 9141794 - DNA, 22 bp, Homo sapiens
ctgaggcatgttacaggacata

SEQ ID NO: 9141795 - DNA, 22 bp, Homo sapiens
ctgaggccagctgcagagctct

SEQ ID NO: 9141796 - DNA, 18 bp, Homo sapiens
ctgaggcccagagagggc

SEQ ID NO: 9141797 - DNA, 17 bp, Homo sapiens
ctgaggcccagggccca

SEQ ID NO: 9141798 - DNA, 22 bp, Homo sapiens
ctgaggccagctgcagagctct

SEQ ID NO: 9141799 - DNA, 22 bp, Homo sapiens
ctgaggccagctgcagagctct

SEQ ID NO: 9141800 - DNA, 22 bp, Homo sapiens
ctgaggccagctgcagagctct

SEQ ID NO: 9141801 - DNA, 22 bp, Homo sapiens
ctgcacaggggatgagggcagt

SEQ ID NO: 9141802 - DNA, 22 bp, Homo sapiens
ctgcacagggatatggggagct

SEQ ID NO: 9141803 - DNA, 22 bp, Homo sapiens
ctgcacagctgggcaagatata

SEQ ID NO: 9141804 - DNA, 22 bp, Homo sapiens
ctgcacagctggccagggagag

SEQ ID NO: 9141805 - DNA, 22 bp, Homo sapiens
ctgcacacatatggcttctctc

SEQ ID NO: 9141806 - DNA, 22 bp, Homo sapiens
ctgcacagagcagggcagacac

SEQ ID NO: 9141807 - DNA, 22 bp, Homo sapiens
ctgcacagagcggcagttctta

SEQ ID NO: 9141808 - DNA, 22 bp, Homo sapiens
ctgcaaagctgttcacaaattt

SEQ ID NO: 9141809 - DNA, 20 bp, Homo sapiens
ctgcaaaatgacattaggaa

SEQ ID NO: 9141810 - DNA, 22 bp, Homo sapiens
ctgaggccggagcactgaagag

SEQ ID NO: 9141811 - DNA, 22 bp, Homo sapiens
ctgcaccatctggagcacctcc

SEQ ID NO: 9141812 - DNA, 22 bp, Homo sapiens
ctgcaccatctggagcacctcc

SEQ ID NO: 9141813 - DNA, 22 bp, Homo sapiens
ctgcacagtttgatttcttgct

SEQ ID NO: 9141814 - DNA, 22 bp, Homo sapiens
ctgcacctacagccacatttac

SEQ ID NO: 9141815 - DNA, 22 bp, Homo sapiens
ctgcaccgtgtctcgggctgcc

SEQ ID NO: 9141816 - DNA, 22 bp, Homo sapiens
ctgcactgagaccctctttgct

SEQ ID NO: 9141817 - DNA, 22 bp, Homo sapiens
ctgcaggcatctaactgtgggc

SEQ ID NO: 9141818 - DNA, 22 bp, Homo sapiens
ctgcaggcccccttcctggagt

SEQ ID NO: 9141819 - DNA, 22 bp, Homo sapiens
ctgcaggcccccttcctggagt

SEQ ID NO: 9141820 - DNA, 22 bp, Homo sapiens
ctgcagggagaggggacagcct

SEQ ID NO: 9141821 - DNA, 22 bp, Homo sapiens
ctgcagggagcagatggcgtgt

SEQ ID NO: 9141822 - DNA, 22 bp, Homo sapiens
ctgcagggaggttccttgttct

SEQ ID NO: 9141823 - DNA, 22 bp, Homo sapiens
ctgcagggagcagatggcgtgt

SEQ ID NO: 9141824 - DNA, 22 bp, Homo sapiens
ctgcagggagcagatggcgtgt

SEQ ID NO: 9141825 - DNA, 19 bp, Homo sapiens
ctgcagggatgtgcagagt

SEQ ID NO: 9141826 - DNA, 19 bp, Homo sapiens
ctgcagggatgtgcagagt

SEQ ID NO: 9141827 - DNA, 19 bp, Homo sapiens
ctgcagggatgtgcagagt

SEQ ID NO: 9141828 - DNA, 19 bp, Homo sapiens
ctgcagggatgtgcagagt

SEQ ID NO: 9141829 - DNA, 22 bp, Homo sapiens
ctgcagggatgtgaggcccgtt

SEQ ID NO: 9141830 - DNA, 22 bp, Homo sapiens
ctgcagggatgtgaggcccgtt

SEQ ID NO: 9141831 - DNA, 22 bp, Homo sapiens
ctgcagggatgtgaggcccgtt

SEQ ID NO: 9141832 - DNA, 22 bp, Homo sapiens
ctgcagggcagaagggcataga

SEQ ID NO: 9141833 - DNA, 22 bp, Homo sapiens
ctgcagggcagaagggcataga

SEQ ID NO: 9141834 - DNA, 22 bp, Homo sapiens
ctgcagggattgcttctgtata

SEQ ID NO: 9141835 - DNA, 22 bp, Homo sapiens
ctgcagggattgcttctgtata

SEQ ID NO: 9141836 - DNA, 22 bp, Homo sapiens
ctgcagggcagaagggcataga

SEQ ID NO: 9141837 - DNA, 22 bp, Homo sapiens
ctgcagggcattgtaactcttt

SEQ ID NO: 9141838 - DNA, 22 bp, Homo sapiens
ctgcagggcagggcctcctggc

SEQ ID NO: 9141839 - DNA, 22 bp, Homo sapiens
ctgcaggggaccaaagtctgac

SEQ ID NO: 9141840 - DNA, 22 bp, Homo sapiens
ctgcaggggaccaaagtctgac

SEQ ID NO: 9141841 - DNA, 22 bp, Homo sapiens
ctgcagggcttaccttgctctg

SEQ ID NO: 9141842 - DNA, 22 bp, Homo sapiens
ctgcaggggaccaaagtctgac

SEQ ID NO: 9141843 - DNA, 22 bp, Homo sapiens
ctgcaggggcagtccacttcct

SEQ ID NO: 9141844 - DNA, 22 bp, Homo sapiens
ctgcaggggcagtccacttcct

SEQ ID NO: 9141845 - DNA, 22 bp, Homo sapiens
ctgcagggcccgcctgagccct

SEQ ID NO: 9141846 - DNA, 22 bp, Homo sapiens
ctgcagggcccgcctgagccct

SEQ ID NO: 9141847 - DNA, 22 bp, Homo sapiens
ctgcagggcccgcctgagccct

SEQ ID NO: 9141848 - DNA, 22 bp, Homo sapiens
ctgcagggcccaaggtcaacgg

SEQ ID NO: 9141849 - DNA, 22 bp, Homo sapiens
ctgcagggcccaaggtcaacgg

SEQ ID NO: 9141850 - DNA, 22 bp, Homo sapiens
ctgcagggccatgggttctata

SEQ ID NO: 9141851 - DNA, 22 bp, Homo sapiens
ctcatttaacagattaaaaagt

SEQ ID NO: 9141852 - DNA, 22 bp, Homo sapiens
ctcatttatgtaatgattaagg

SEQ ID NO: 9141853 - DNA, 22 bp, Homo sapiens
ttgaaatactgcattgttcagt

SEQ ID NO: 9141854 - DNA, 22 bp, Homo sapiens
ttgaaatactgcattgttcagt

SEQ ID NO: 9141855 - DNA, 22 bp, Homo sapiens
ttgaaatactgcattgttcagt

SEQ ID NO: 9141856 - DNA, 22 bp, Homo sapiens
ttgaaataaggaagctcgaaat

SEQ ID NO: 9141857 - DNA, 22 bp, Homo sapiens
ttgaaatagatgcgtcagagat

SEQ ID NO: 9141858 - DNA, 22 bp, Homo sapiens
ttgaaatatcaagttattagtg

SEQ ID NO: 9141859 - DNA, 22 bp, Homo sapiens
ttcttttacattaagatttcag

SEQ ID NO: 9141860 - DNA, 22 bp, Homo sapiens
ttcttttagaatttcctaaggt

SEQ ID NO: 9141861 - DNA, 22 bp, Homo sapiens
ttctttctgtccataatgagac

SEQ ID NO: 9141862 - DNA, 22 bp, Homo sapiens
ctcacaggttagttgtgtggat

SEQ ID NO: 9141863 - DNA, 22 bp, Homo sapiens
ttcttttaatttctgtctgcag

SEQ ID NO: 9141864 - DNA, 23 bp, Homo sapiens
ttgaaaggtagctggcagctaga

SEQ ID NO: 9141865 - DNA, 22 bp, Homo sapiens
ttcttttcccaatattttgctg

SEQ ID NO: 9141866 - DNA, 22 bp, Homo sapiens
ttcttttcccaatattttgctg

SEQ ID NO: 9141867 - DNA, 22 bp, Homo sapiens
ctccagattccgtttattcagg

SEQ ID NO: 9141868 - DNA, 22 bp, Homo sapiens
ttgtacaacgttttaaatttga

SEQ ID NO: 9141869 - DNA, 22 bp, Homo sapiens
ttgtacaaatgcatattcctgg

SEQ ID NO: 9141870 - DNA, 22 bp, Homo sapiens
ttgtacaacacatattctacag

SEQ ID NO: 9141871 - DNA, 22 bp, Homo sapiens
ttgtaattactccaggggtaaa

SEQ ID NO: 9141872 - DNA, 22 bp, Homo sapiens
ttgtaattaatggcagcaatta

SEQ ID NO: 9141873 - DNA, 22 bp, Homo sapiens
ctccacggcccattgggcagga

SEQ ID NO: 9141874 - DNA, 22 bp, Homo sapiens
ttggtcagattgggcttccatt

SEQ ID NO: 9141875 - DNA, 22 bp, Homo sapiens
ttgtacaaataggaacctctga

SEQ ID NO: 9141876 - DNA, 22 bp, Homo sapiens
ttgtacaaataggaacctctga

SEQ ID NO: 9141877 - DNA, 22 bp, Homo sapiens
ttgtacaaaggatttggaagag

SEQ ID NO: 9141878 - DNA, 22 bp, Homo sapiens
ttgtacaaagatttcacagctc

SEQ ID NO: 9141879 - DNA, 22 bp, Homo sapiens
ttgtaatttgcaaatgtattgt

SEQ ID NO: 9141880 - DNA, 22 bp, Homo sapiens
ttgtaattggacagccatcagg

SEQ ID NO: 9141881 - DNA, 22 bp, Homo sapiens
ctccaagggttgtgggtggtca

SEQ ID NO: 9141882 - DNA, 18 bp, Homo sapiens
ctccaaggtctctggctt

SEQ ID NO: 9141883 - DNA, 23 bp, Homo sapiens
ctccaagggagggcaaacaacag

SEQ ID NO: 9141884 - DNA, 20 bp, Homo sapiens
ctccaaggcttgcaggaggc

SEQ ID NO: 9141885 - DNA, 22 bp, Homo sapiens
ctccaaggctaggagcatgttc

SEQ ID NO: 9141886 - DNA, 20 bp, Homo sapiens
ctccaaggcttgcaggaggc

SEQ ID NO: 9141887 - DNA, 22 bp, Homo sapiens
ctccaaggaagccccaagggat

SEQ ID NO: 9141888 - DNA, 22 bp, Homo sapiens
ctccaaggaagccccaagggat

SEQ ID NO: 9141889 - DNA, 23 bp, Homo sapiens
ctccaaggcccaactgtctaggc

SEQ ID NO: 9141890 - DNA, 22 bp, Homo sapiens
ctccaaggattctggacccttg

SEQ ID NO: 9141891 - DNA, 22 bp, Homo sapiens
ctccaaggagaaatgggcaaca

SEQ ID NO: 9141892 - DNA, 22 bp, Homo sapiens
ctccaagtcggctgcagctgga

SEQ ID NO: 9141893 - DNA, 22 bp, Homo sapiens
ctccaagtccgagggctctcaa

SEQ ID NO: 9141894 - DNA, 22 bp, Homo sapiens
ctccaaggtttcagaacaaatg

SEQ ID NO: 9141895 - DNA, 22 bp, Homo sapiens
ctccacagagatgctgattgta

SEQ ID NO: 9141896 - DNA, 22 bp, Homo sapiens
ctccacagagcatgcttatagg

SEQ ID NO: 9141897 - DNA, 22 bp, Homo sapiens
ctccacagcccctccagtggca

SEQ ID NO: 9141898 - DNA, 22 bp, Homo sapiens
ctccacagcccctccagtggca

SEQ ID NO: 9141899 - DNA, 22 bp, Homo sapiens
ctccacaggtgtactgtacctt

SEQ ID NO: 9141900 - DNA, 22 bp, Homo sapiens
ctccacaggtgtactgtacctt

SEQ ID NO: 9141901 - DNA, 22 bp, Homo sapiens
ctccacaggtggtgtttgcttc

SEQ ID NO: 9141902 - DNA, 22 bp, Homo sapiens
ctccacaggtgtactgtacctt

SEQ ID NO: 9141903 - DNA, 22 bp, Homo sapiens
ctccacagctcaggctcagagt

SEQ ID NO: 9141904 - DNA, 22 bp, Homo sapiens
ctccacagctcaggctcagagt

SEQ ID NO: 9141905 - DNA, 22 bp, Homo sapiens
ctcccagagaccaagctgagaa

SEQ ID NO: 9141906 - DNA, 22 bp, Homo sapiens
ctcccagagaccaagctgagaa

SEQ ID NO: 9141907 - DNA, 22 bp, Homo sapiens
ctcccagagaccaagctgagaa

SEQ ID NO: 9141908 - DNA, 22 bp, Homo sapiens
ctcccagattcctgctgtggga

SEQ ID NO: 9141909 - DNA, 22 bp, Homo sapiens
ctcccagagagcaggtgggccg

SEQ ID NO: 9141910 - DNA, 22 bp, Homo sapiens
ctcccagaggtgtcattcgagc

SEQ ID NO: 9141911 - DNA, 22 bp, Homo sapiens
ctcccagagagcaggtgggccg

SEQ ID NO: 9141912 - DNA, 22 bp, Homo sapiens
ctcccagagagcaggtgggccg

SEQ ID NO: 9141913 - DNA, 22 bp, Homo sapiens
ctcccagagagcaggtgggccg

SEQ ID NO: 9141914 - DNA, 22 bp, Homo sapiens
ctcccagattcctgctgtggga

SEQ ID NO: 9141915 - DNA, 22 bp, Homo sapiens
ctcccagccttcgccagtctga

SEQ ID NO: 9141916 - DNA, 22 bp, Homo sapiens
ctcccaggactcagaggagaag

SEQ ID NO: 9141917 - DNA, 22 bp, Homo sapiens
ctcccaggactcagaggagaag

SEQ ID NO: 9141918 - DNA, 22 bp, Homo sapiens
ctcccaggactcagaggagaag

SEQ ID NO: 9141919 - DNA, 22 bp, Homo sapiens
ctcccactcctggctcaccaca

SEQ ID NO: 9141920 - DNA, 22 bp, Homo sapiens
ctcccacatggaatagcaggga

SEQ ID NO: 9141921 - DNA, 22 bp, Homo sapiens
ctcccactcctggctcaccaca

SEQ ID NO: 9141922 - DNA, 22 bp, Homo sapiens
ctcccagaaaattctcagacaa

SEQ ID NO: 9141923 - DNA, 22 bp, Homo sapiens
ctcccagaaaattctcagacaa

SEQ ID NO: 9141924 - DNA, 22 bp, Homo sapiens
ctcccagacatgtgcctccttg

SEQ ID NO: 9141925 - DNA, 22 bp, Homo sapiens
ctcccagacatgtgcctccttg

SEQ ID NO: 9141926 - DNA, 22 bp, Homo sapiens
ctccatggctttcgcatctgca

SEQ ID NO: 9141927 - DNA, 22 bp, Homo sapiens
ctccatggggaaatgaaggtgg

SEQ ID NO: 9141928 - DNA, 22 bp, Homo sapiens
ctccatgggggctggcctgtgt

SEQ ID NO: 9141929 - DNA, 22 bp, Homo sapiens
ctcccaggactggctctaactg

SEQ ID NO: 9141930 - DNA, 22 bp, Homo sapiens
ctcccaggcacagggaggagcc

SEQ ID NO: 9141931 - DNA, 22 bp, Homo sapiens
ctcccaggcacagggaggagcc

SEQ ID NO: 9141932 - DNA, 22 bp, Homo sapiens
ctcccaggcacagggaggagcc

SEQ ID NO: 9141933 - DNA, 22 bp, Homo sapiens
ctcccaggcagggctgcccact

SEQ ID NO: 9141934 - DNA, 22 bp, Homo sapiens
ctcccaggccatgctctagcca

SEQ ID NO: 9141935 - DNA, 22 bp, Homo sapiens
tttaacagatgctatgtctacc

SEQ ID NO: 9141936 - DNA, 22 bp, Homo sapiens
ctcccaggccatgctctagcca

SEQ ID NO: 9141937 - DNA, 22 bp, Homo sapiens
ctcccaggccatgctctagcca

SEQ ID NO: 9141938 - DNA, 22 bp, Homo sapiens
tttaagttccttttcaacaact

SEQ ID NO: 9141939 - DNA, 22 bp, Homo sapiens
tttaagttccttttcaacaact

SEQ ID NO: 9141940 - DNA, 22 bp, Homo sapiens
tttaatatccagtggatacaaa

SEQ ID NO: 9141941 - DNA, 22 bp, Homo sapiens
tttaatatctcacacttccatg

SEQ ID NO: 9141942 - DNA, 22 bp, Homo sapiens
tttaatatttctttcctgaagc

SEQ ID NO: 9141943 - DNA, 22 bp, Homo sapiens
ttgtgtaatgaagttatcatgt

SEQ ID NO: 9141944 - DNA, 22 bp, Homo sapiens
ttgtgtaagatgcaatatggta

SEQ ID NO: 9141945 - DNA, 20 bp, Homo sapiens
ttgtggtttagattatctga

SEQ ID NO: 9141946 - DNA, 22 bp, Homo sapiens
ttgtgtaaatatctaaatgttt

SEQ ID NO: 9141947 - DNA, 22 bp, Homo sapiens
ttgtgtaaatatctaaatgttt

SEQ ID NO: 9141948 - DNA, 22 bp, Homo sapiens
ttgtggggaacccctgtcccac

SEQ ID NO: 9141949 - DNA, 22 bp, Homo sapiens
ttgtgggatggctcttcccaaa

SEQ ID NO: 9141950 - DNA, 22 bp, Homo sapiens
ttgtattttgttatgctactgc

SEQ ID NO: 9141951 - DNA, 22 bp, Homo sapiens
ttgtattttgttatgctactgc

SEQ ID NO: 9141952 - DNA, 22 bp, Homo sapiens
ctccagccagagtgcctctgtt

SEQ ID NO: 9141953 - DNA, 22 bp, Homo sapiens
ctccagcaggtgcgtctcagag

SEQ ID NO: 9141954 - DNA, 22 bp, Homo sapiens
ctccagcaggtgcgtctcagag

SEQ ID NO: 9141955 - DNA, 22 bp, Homo sapiens
ttgtcttaccaaatatgatgca

SEQ ID NO: 9141956 - DNA, 22 bp, Homo sapiens
ttgtcttagagtgaaaacttta

SEQ ID NO: 9141957 - DNA, 19 bp, Homo sapiens
ttgtcttagctgcataaga

SEQ ID NO: 9141958 - DNA, 22 bp, Homo sapiens
ttgtctttcccagcttctagag

SEQ ID NO: 9141959 - DNA, 22 bp, Homo sapiens
ttgtctttcccagcttctagag

SEQ ID NO: 9141960 - DNA, 22 bp, Homo sapiens
ttgtctttcccagcttctagag

SEQ ID NO: 9141961 - DNA, 22 bp, Homo sapiens
ttgtcttttgtgggaaatatgg

SEQ ID NO: 9141962 - DNA, 22 bp, Homo sapiens
ttgtcttttgtgggaaatatgg

SEQ ID NO: 9141963 - DNA, 22 bp, Homo sapiens
ttgtctttggaaatttaatgtt

SEQ ID NO: 9141964 - DNA, 22 bp, Homo sapiens
ttgtctttggaaatttaatgtt

SEQ ID NO: 9141965 - DNA, 22 bp, Homo sapiens
ttgtctttggaaatttaatgtt

SEQ ID NO: 9141966 - DNA, 23 bp, Homo sapiens
ctccccagtgtcctcatgcatct

SEQ ID NO: 9141967 - DNA, 23 bp, Homo sapiens
ctccccagtgtcctcatgcatct

SEQ ID NO: 9141968 - DNA, 23 bp, Homo sapiens
ctccccagtgtcctcatgcatct

SEQ ID NO: 9141969 - DNA, 23 bp, Homo sapiens
ctccccagtgtcctcatgcatct

SEQ ID NO: 9141970 - DNA, 22 bp, Homo sapiens
tttaatcataagaaggaaaata

SEQ ID NO: 9141971 - DNA, 22 bp, Homo sapiens
tttaatcataagaaggaaaata

SEQ ID NO: 9141972 - DNA, 22 bp, Homo sapiens
ctccccatccaggcagcaggtg

SEQ ID NO: 9141973 - DNA, 22 bp, Homo sapiens
ctccccttcttgccagatcctt

SEQ ID NO: 9141974 - DNA, 22 bp, Homo sapiens
ctcccctttggaagaagggtct

SEQ ID NO: 9141975 - DNA, 22 bp, Homo sapiens
ctcccctccttaggtcttctag

SEQ ID NO: 9141976 - DNA, 20 bp, Homo sapiens
ctcccctctacagagggctg

SEQ ID NO: 9141977 - DNA, 22 bp, Homo sapiens
ctcccctgagcatagactctgt

SEQ ID NO: 9141978 - DNA, 22 bp, Homo sapiens
ctcccgtgccactggctcctgc

SEQ ID NO: 9141979 - DNA, 22 bp, Homo sapiens
tttagaccctgggagattgact

SEQ ID NO: 9141980 - DNA, 22 bp, Homo sapiens
tttagagaagttaggaaataaa

SEQ ID NO: 9141981 - DNA, 22 bp, Homo sapiens
tttagtactgtttaaaaatgga

SEQ ID NO: 9141982 - DNA, 22 bp, Homo sapiens
tttagtaagttcactgcaaagc

SEQ ID NO: 9141983 - DNA, 22 bp, Homo sapiens
tttagtactcaggggagaagtt

SEQ ID NO: 9141984 - DNA, 22 bp, Homo sapiens
tttaggtcttcttaagagtcaa

SEQ ID NO: 9141985 - DNA, 22 bp, Homo sapiens
tttaggctgcagcagggatgga

SEQ ID NO: 9141986 - DNA, 22 bp, Homo sapiens
tttagtctaataaaagtggagt

SEQ ID NO: 9141987 - DNA, 22 bp, Homo sapiens
ctcctcagttgtcccatggaga

SEQ ID NO: 9141988 - DNA, 22 bp, Homo sapiens
ctcctccacagacctactgaat

SEQ ID NO: 9141989 - DNA, 22 bp, Homo sapiens
ctcctccacagagtccttgcca

SEQ ID NO: 9141990 - DNA, 17 bp, Homo sapiens
ctcctggccacccctct

SEQ ID NO: 9141991 - DNA, 22 bp, Homo sapiens
ctcctggcagttccccttgtca

SEQ ID NO: 9141992 - DNA, 22 bp, Homo sapiens
ctcctggcagttccccttgtca

SEQ ID NO: 9141993 - DNA, 22 bp, Homo sapiens
ctcctggccacgttcttgctgg

SEQ ID NO: 9141994 - DNA, 22 bp, Homo sapiens
ctcctggccacgttcttgctgg

SEQ ID NO: 9141995 - DNA, 22 bp, Homo sapiens
ctcctggccccagatcccaatc

SEQ ID NO: 9141996 - DNA, 22 bp, Homo sapiens
ctcctggccccagatcccaatc

SEQ ID NO: 9141997 - DNA, 22 bp, Homo sapiens
ctcctggccctgagctcccagg

SEQ ID NO: 9141998 - DNA, 17 bp, Homo sapiens
ctcctggcagcctcagg

SEQ ID NO: 9141999 - DNA, 22 bp, Homo sapiens
ctcctggcaggctgagtgaaat

SEQ ID NO: 9142000 - DNA, 22 bp, Homo sapiens
ctcctggcagcaacatttatat

SEQ ID NO: 9142001 - DNA, 17 bp, Homo sapiens
ctcctggcagcctcagg

SEQ ID NO: 9142002 - DNA, 22 bp, Homo sapiens
ctcctggcactgtcttgaccca

SEQ ID NO: 9142003 - DNA, 22 bp, Homo sapiens
tttatttaaagtcgtgtgttaa

SEQ ID NO: 9142004 - DNA, 22 bp, Homo sapiens
tttatttaaagtcgtgtgttaa

SEQ ID NO: 9142005 - DNA, 22 bp, Homo sapiens
tttatttaccttatgtcctcca

SEQ ID NO: 9142006 - DNA, 22 bp, Homo sapiens
ctcctggatgcaggctgtctgc

SEQ ID NO: 9142007 - DNA, 22 bp, Homo sapiens
ctcctggcactcagtgtggaag

SEQ ID NO: 9142008 - DNA, 22 bp, Homo sapiens
ctcctggcactcagtgtggaag

SEQ ID NO: 9142009 - DNA, 22 bp, Homo sapiens
tttattctaacttgctgctcta

SEQ ID NO: 9142010 - DNA, 22 bp, Homo sapiens
tttattgttatcatgggtgagt

SEQ ID NO: 9142011 - DNA, 22 bp, Homo sapiens
tttattgttgggtcttaagctg

SEQ ID NO: 9142012 - DNA, 22 bp, Homo sapiens
tttattgtttagaagggggctg

SEQ ID NO: 9142013 - DNA, 22 bp, Homo sapiens
tttattgttgttagtcataagt

SEQ ID NO: 9142014 - DNA, 22 bp, Homo sapiens
ctcctccagtgggtccctcagg

SEQ ID NO: 9142015 - DNA, 22 bp, Homo sapiens
ctcctccactaggcaaaatgtg

SEQ ID NO: 9142016 - DNA, 22 bp, Homo sapiens
ctctccaggcgaggtcctactg

SEQ ID NO: 9142017 - DNA, 22 bp, Homo sapiens
ctctccaggagctcagagtcta

SEQ ID NO: 9142018 - DNA, 22 bp, Homo sapiens
ctctccaggagctcagagtcta

SEQ ID NO: 9142019 - DNA, 22 bp, Homo sapiens
ctctccaggagctcagagtcta

SEQ ID NO: 9142020 - DNA, 22 bp, Homo sapiens
ctctccaggctgggacaggacc

SEQ ID NO: 9142021 - DNA, 22 bp, Homo sapiens
ctctccaggctgggacaggacc

SEQ ID NO: 9142022 - DNA, 22 bp, Homo sapiens
ctctccaggcgaggtcctactg

SEQ ID NO: 9142023 - DNA, 22 bp, Homo sapiens
tttcctcacacagaagatcttg

SEQ ID NO: 9142024 - DNA, 22 bp, Homo sapiens
tttcctcacacagaagatcttg

SEQ ID NO: 9142025 - DNA, 22 bp, Homo sapiens
ctctccagtcatattctcagtc

SEQ ID NO: 9142026 - DNA, 22 bp, Homo sapiens
ctctccagtcatattctcagtc

SEQ ID NO: 9142027 - DNA, 22 bp, Homo sapiens
ctctcctggggagcacacacac

SEQ ID NO: 9142028 - DNA, 22 bp, Homo sapiens
ctctccaggttagagcacttat

SEQ ID NO: 9142029 - DNA, 22 bp, Homo sapiens
ctctccaggttagagcacttat

SEQ ID NO: 9142030 - DNA, 22 bp, Homo sapiens
ctctccagtcaggaactctgac

SEQ ID NO: 9142031 - DNA, 22 bp, Homo sapiens
ctctccagtcaggaactctgac

SEQ ID NO: 9142032 - DNA, 22 bp, Homo sapiens
ctctccaggggtagatgccttc

SEQ ID NO: 9142033 - DNA, 22 bp, Homo sapiens
ctctccaggggtagatgccttc

SEQ ID NO: 9142034 - DNA, 22 bp, Homo sapiens
ctctccaggggaacattgttcc

SEQ ID NO: 9142035 - DNA, 22 bp, Homo sapiens
ctctccaggggaacattgttcc

SEQ ID NO: 9142036 - DNA, 21 bp, Homo sapiens
ctctccaggtaggataaatgt

SEQ ID NO: 9142037 - DNA, 21 bp, Homo sapiens
ctctccaggtaggataaatgt

SEQ ID NO: 9142038 - DNA, 22 bp, Homo sapiens
ctctccaggggtagatgccttc

SEQ ID NO: 9142039 - DNA, 22 bp, Homo sapiens
ctctccagggaagcagtgtact

SEQ ID NO: 9142040 - DNA, 22 bp, Homo sapiens
ctctccagggcatgagttccac

SEQ ID NO: 9142041 - DNA, 22 bp, Homo sapiens
ctctccagggcatgagttccac

SEQ ID NO: 9142042 - DNA, 22 bp, Homo sapiens
ctctccagggaagcagtgtact

SEQ ID NO: 9142043 - DNA, 22 bp, Homo sapiens
ctctctcttgtgttgctgcaga

SEQ ID NO: 9142044 - DNA, 22 bp, Homo sapiens
ctctctgaggaaggagcatctg

SEQ ID NO: 9142045 - DNA, 22 bp, Homo sapiens
ctctctctttagaagcgtctgg

SEQ ID NO: 9142046 - DNA, 22 bp, Homo sapiens
ctctctctatgcgttgttccta

SEQ ID NO: 9142047 - DNA, 23 bp, Homo sapiens
ctctctctaccatgtgaggacac

SEQ ID NO: 9142048 - DNA, 20 bp, Homo sapiens
ctctctctccattcccaggg

SEQ ID NO: 9142049 - DNA, 20 bp, Homo sapiens
ctctctctccattcccaggg

SEQ ID NO: 9142050 - DNA, 22 bp, Homo sapiens
ctctctggaagggggagctgat

SEQ ID NO: 9142051 - DNA, 22 bp, Homo sapiens
ctctctgctgtatccttaggct

SEQ ID NO: 9142052 - DNA, 22 bp, Homo sapiens
tttccttgcctcctgtccttct

SEQ ID NO: 9142053 - DNA, 22 bp, Homo sapiens
tttccttgcctcctgtccttct

SEQ ID NO: 9142054 - DNA, 22 bp, Homo sapiens
ctctctggaagggggagctgat

SEQ ID NO: 9142055 - DNA, 22 bp, Homo sapiens
ctctctggaagggggagctgat

SEQ ID NO: 9142056 - DNA, 22 bp, Homo sapiens
tttccttgggtctcttagtggc

SEQ ID NO: 9142057 - DNA, 18 bp, Homo sapiens
tttccttgtatgaacata

SEQ ID NO: 9142058 - DNA, 22 bp, Homo sapiens
tttcaaatggagtcgtgaaatg

SEQ ID NO: 9142059 - DNA, 22 bp, Homo sapiens
tttcaaatggatccctcagcct

SEQ ID NO: 9142060 - DNA, 22 bp, Homo sapiens
tttcaattgactttggaagaaa

SEQ ID NO: 9142061 - DNA, 22 bp, Homo sapiens
tttcaattaggatgtttccatg

SEQ ID NO: 9142062 - DNA, 22 bp, Homo sapiens
tttcaattccaccaaagcgccc

SEQ ID NO: 9142063 - DNA, 22 bp, Homo sapiens
tttcaattccaccaaagcgccc

SEQ ID NO: 9142064 - DNA, 21 bp, Homo sapiens
tttcacaaaagtatgtgacaa

SEQ ID NO: 9142065 - DNA, 21 bp, Homo sapiens
tttcacaaaagtatgtgacaa

SEQ ID NO: 9142066 - DNA, 22 bp, Homo sapiens
tttcacaaactgaggagacaat

SEQ ID NO: 9142067 - DNA, 22 bp, Homo sapiens
tttcacaaagcatagcacttta

SEQ ID NO: 9142068 - DNA, 22 bp, Homo sapiens
tttcacaaagcatagcacttta

SEQ ID NO: 9142069 - DNA, 22 bp, Homo sapiens
tttcacaaatgtctttaacttg

SEQ ID NO: 9142070 - DNA, 22 bp, Homo sapiens
tttcacaggtacaaacactcct

SEQ ID NO: 9142071 - DNA, 22 bp, Homo sapiens
tttcacaggtaagcaatacagg

SEQ ID NO: 9142072 - DNA, 22 bp, Homo sapiens
tttcacaggtaagcaatacagg

SEQ ID NO: 9142073 - DNA, 22 bp, Homo sapiens
tttcacataaatggagtaaaga

SEQ ID NO: 9142074 - DNA, 22 bp, Homo sapiens
tttcacataaatggagtaaaga

SEQ ID NO: 9142075 - DNA, 22 bp, Homo sapiens
ccattgtaaattctgtggaagt

SEQ ID NO: 9142076 - DNA, 22 bp, Homo sapiens
ccattgtaaagagtatactttg

SEQ ID NO: 9142077 - DNA, 20 bp, Homo sapiens
tgatttctcttctattcctt

SEQ ID NO: 9142078 - DNA, 23 bp, Homo sapiens
tgattttaaaaagtaagttatca

SEQ ID NO: 9142079 - DNA, 22 bp, Homo sapiens
tgattttattgaaacttcactt

SEQ ID NO: 9142080 - DNA, 22 bp, Homo sapiens
tgattttattgaaacttcactt

SEQ ID NO: 9142081 - DNA, 22 bp, Homo sapiens
tgattttacttagcatgatgtt

SEQ ID NO: 9142082 - DNA, 22 bp, Homo sapiens
tgattttacttagcatgatgtt

SEQ ID NO: 9142083 - DNA, 22 bp, Homo sapiens
tgattttattggtgaggaaatt

SEQ ID NO: 9142084 - DNA, 22 bp, Homo sapiens
tgattttattggtgaggaaatt

SEQ ID NO: 9142085 - DNA, 22 bp, Homo sapiens
tgatttgaattttaaaacactg

SEQ ID NO: 9142086 - DNA, 22 bp, Homo sapiens
tgatttgaaacctttggcaaga

SEQ ID NO: 9142087 - DNA, 22 bp, Homo sapiens
tgatttgaactctgggacttgt

SEQ ID NO: 9142088 - DNA, 20 bp, Homo sapiens
tgatttgatcatggctgcat

SEQ ID NO: 9142089 - DNA, 22 bp, Homo sapiens
tgatttgattcttcttggagta

SEQ ID NO: 9142090 - DNA, 22 bp, Homo sapiens
tgatttgaggtacataaatcca

SEQ ID NO: 9142091 - DNA, 20 bp, Homo sapiens
tgatttgagaagctgctggt

SEQ ID NO: 9142092 - DNA, 22 bp, Homo sapiens
ccattctgtttaatgaatgaaa

SEQ ID NO: 9142093 - DNA, 19 bp, Homo sapiens
ccattgtaaagaaaaatgt

SEQ ID NO: 9142094 - DNA, 22 bp, Homo sapiens
ccattgcactccatcctgggca

SEQ ID NO: 9142095 - DNA, 23 bp, Homo sapiens
ccattcccactgtgccttccctg

SEQ ID NO: 9142096 - DNA, 22 bp, Homo sapiens
ccattctgaagtgcaggctaag

SEQ ID NO: 9142097 - DNA, 20 bp, Homo sapiens
ccattctgggtgcagtctgg

SEQ ID NO: 9142098 - DNA, 22 bp, Homo sapiens
ccattagtacctctggaaaatt

SEQ ID NO: 9142099 - DNA, 22 bp, Homo sapiens
ccattatccattttgagtctta

SEQ ID NO: 9142100 - DNA, 22 bp, Homo sapiens
ccattaaaatggaatgtagtga

SEQ ID NO: 9142101 - DNA, 23 bp, Homo sapiens
tgcaaataacaaggagtttaagg

SEQ ID NO: 9142102 - DNA, 22 bp, Homo sapiens
tgcaaagggctttgcatacaga

SEQ ID NO: 9142103 - DNA, 22 bp, Homo sapiens
tgcaaaggaggatgggaaagaa

SEQ ID NO: 9142104 - DNA, 22 bp, Homo sapiens
tgcaaagccacaatgaaatcag

SEQ ID NO: 9142105 - DNA, 22 bp, Homo sapiens
tgcaaatagcctgatgaaagaa

SEQ ID NO: 9142106 - DNA, 22 bp, Homo sapiens
tgcaaatattagcattcgatat

SEQ ID NO: 9142107 - DNA, 22 bp, Homo sapiens
cccactttggttgcactctgcc

SEQ ID NO: 9142108 - DNA, 22 bp, Homo sapiens
cccactgtgttgcagtctagtg

SEQ ID NO: 9142109 - DNA, 20 bp, Homo sapiens
cccagaagtcacctccactc

SEQ ID NO: 9142110 - DNA, 22 bp, Homo sapiens
cccagaaggtcgaggctgcagt

SEQ ID NO: 9142111 - DNA, 22 bp, Homo sapiens
cccagaaggtcgaggctgcagt

SEQ ID NO: 9142112 - DNA, 22 bp, Homo sapiens
cccagacattgcagggactggt

SEQ ID NO: 9142113 - DNA, 22 bp, Homo sapiens
cccagacataacagcagagagg

SEQ ID NO: 9142114 - DNA, 22 bp, Homo sapiens
cccagacagtcaagaggcctgc

SEQ ID NO: 9142115 - DNA, 22 bp, Homo sapiens
cccagacagtcaagaggcctgc

SEQ ID NO: 9142116 - DNA, 22 bp, Homo sapiens
tgcacacatgtatgtatatgtg

SEQ ID NO: 9142117 - DNA, 22 bp, Homo sapiens
tgcacagaatcattttcagctg

SEQ ID NO: 9142118 - DNA, 22 bp, Homo sapiens
tgcacagacaactctttctaga

SEQ ID NO: 9142119 - DNA, 22 bp, Homo sapiens
tgcacacattaaggatacacag

SEQ ID NO: 9142120 - DNA, 22 bp, Homo sapiens
ccatgccctaaaggactggcag

SEQ ID NO: 9142121 - DNA, 22 bp, Homo sapiens
ccatgcctcgggaagagtctgt

SEQ ID NO: 9142122 - DNA, 22 bp, Homo sapiens
ccatgcctggactccactctca

SEQ ID NO: 9142123 - DNA, 22 bp, Homo sapiens
ccatgcttaaataagaggcagc

SEQ ID NO: 9142124 - DNA, 22 bp, Homo sapiens
ccatgctgggatgctccaagtg

SEQ ID NO: 9142125 - DNA, 22 bp, Homo sapiens
ccatgctgggatgctccaagtg

SEQ ID NO: 9142126 - DNA, 22 bp, Homo sapiens
ccatgctggagtccctagctgt

SEQ ID NO: 9142127 - DNA, 22 bp, Homo sapiens
ccatgctctggggaggtcaagc

SEQ ID NO: 9142128 - DNA, 22 bp, Homo sapiens
ccatgctgaccctgtgcaggca

SEQ ID NO: 9142129 - DNA, 22 bp, Homo sapiens
ccatgctggagtccctagctgt

SEQ ID NO: 9142130 - DNA, 22 bp, Homo sapiens
ccatgccccaatacaggacacc

SEQ ID NO: 9142131 - DNA, 19 bp, Homo sapiens
ccatgccatcattttaaag

SEQ ID NO: 9142132 - DNA, 22 bp, Homo sapiens
ccatgtggtgggaaggagaatg

SEQ ID NO: 9142133 - DNA, 22 bp, Homo sapiens
tgaggtaggtggtaagagatac

SEQ ID NO: 9142134 - DNA, 22 bp, Homo sapiens
tgaggtaggtgtcgagagaggt

SEQ ID NO: 9142135 - DNA, 22 bp, Homo sapiens
ccatgcttaaataagaggcagc

SEQ ID NO: 9142136 - DNA, 22 bp, Homo sapiens
tgaggtaggttgaaagatagat

SEQ ID NO: 9142137 - DNA, 22 bp, Homo sapiens
tgaggcagcattcttcaagaca

SEQ ID NO: 9142138 - DNA, 22 bp, Homo sapiens
tgaggcagcattcttcaagaca

SEQ ID NO: 9142139 - DNA, 22 bp, Homo sapiens
tgaggcagcaattgtattgtat

SEQ ID NO: 9142140 - DNA, 20 bp, Homo sapiens
ccagtccctgagcaccaggg

SEQ ID NO: 9142141 - DNA, 22 bp, Homo sapiens
ccagtcccgcatggtccagaat

SEQ ID NO: 9142142 - DNA, 23 bp, Homo sapiens
ccagtctcacgtatacaggattt

SEQ ID NO: 9142143 - DNA, 20 bp, Homo sapiens
ccagtctctatcagaaataa

SEQ ID NO: 9142144 - DNA, 22 bp, Homo sapiens
ccagtcctttgagccagttctg

SEQ ID NO: 9142145 - DNA, 22 bp, Homo sapiens
ccagtcctggccagtaacatga

SEQ ID NO: 9142146 - DNA, 22 bp, Homo sapiens
tgagggctaaattgtggcaggt

SEQ ID NO: 9142147 - DNA, 23 bp, Homo sapiens
ccagtctctttccaaaatcacat

SEQ ID NO: 9142148 - DNA, 22 bp, Homo sapiens
tgagggcagagcactggggagc

SEQ ID NO: 9142149 - DNA, 22 bp, Homo sapiens
tgagggcaaagtggtgctgagg

SEQ ID NO: 9142150 - DNA, 22 bp, Homo sapiens
tgagggctgcttccagagctag

SEQ ID NO: 9142151 - DNA, 22 bp, Homo sapiens
ccagtgttccctcgggttcatg

SEQ ID NO: 9142152 - DNA, 22 bp, Homo sapiens
tgaatgcaagtcacacatttct

SEQ ID NO: 9142153 - DNA, 22 bp, Homo sapiens
tgacaaattcatatttcagagg

SEQ ID NO: 9142154 - DNA, 20 bp, Homo sapiens
tgacaacaaaatggtaattt

SEQ ID NO: 9142155 - DNA, 22 bp, Homo sapiens
tgacaactgcatcttggacttc

SEQ ID NO: 9142156 - DNA, 22 bp, Homo sapiens
tgaatgatgaggggagaataat

SEQ ID NO: 9142157 - DNA, 22 bp, Homo sapiens
tgaatgagtttggctgctgttc

SEQ ID NO: 9142158 - DNA, 22 bp, Homo sapiens
tgaatgagtgagttcagacctc

SEQ ID NO: 9142159 - DNA, 22 bp, Homo sapiens
tgaatgagtggattctgagtag

SEQ ID NO: 9142160 - DNA, 22 bp, Homo sapiens
tgaatgagtggattctgagtag

SEQ ID NO: 9142161 - DNA, 20 bp, Homo sapiens
ccaggctggcaaatgggggc

SEQ ID NO: 9142162 - DNA, 22 bp, Homo sapiens
ccaggctggattttgcagttca

SEQ ID NO: 9142163 - DNA, 22 bp, Homo sapiens
ccaggctggagtgtagtcgcat

SEQ ID NO: 9142164 - DNA, 22 bp, Homo sapiens
ccaggctggattttgcagttca

SEQ ID NO: 9142165 - DNA, 22 bp, Homo sapiens
ccaggctggattttgcagttca

SEQ ID NO: 9142166 - DNA, 22 bp, Homo sapiens
ccaggctggagtgcagtagtgt

SEQ ID NO: 9142167 - DNA, 22 bp, Homo sapiens
ccaggctggagtgcaatggtgc

SEQ ID NO: 9142168 - DNA, 22 bp, Homo sapiens
ccaggctggagtgcagtggcac

SEQ ID NO: 9142169 - DNA, 22 bp, Homo sapiens
ccaggctggagtgcagtggcac

SEQ ID NO: 9142170 - DNA, 22 bp, Homo sapiens
ccaggctggagtgcagtggcac

SEQ ID NO: 9142171 - DNA, 22 bp, Homo sapiens
ccaggctggagtgcagtggcac

SEQ ID NO: 9142172 - DNA, 19 bp, Homo sapiens
tgacaagataatagccttg

SEQ ID NO: 9142173 - DNA, 23 bp, Homo sapiens
tgacaagtctcagccaatgcaga

SEQ ID NO: 9142174 - DNA, 22 bp, Homo sapiens
tgacaatacagagagagcaaaa

SEQ ID NO: 9142175 - DNA, 22 bp, Homo sapiens
tgacaatagcgatttatcttgc

SEQ ID NO: 9142176 - DNA, 22 bp, Homo sapiens
ccagggctgctgtgggactcca

SEQ ID NO: 9142177 - DNA, 22 bp, Homo sapiens
ccagggcttcagaggttttggc

SEQ ID NO: 9142178 - DNA, 22 bp, Homo sapiens
ccaggggaaacagggagcactc

SEQ ID NO: 9142179 - DNA, 19 bp, Homo sapiens
ccagggctttaagttgagg

SEQ ID NO: 9142180 - DNA, 22 bp, Homo sapiens
ccagggctttatctgcctttga

SEQ ID NO: 9142181 - DNA, 22 bp, Homo sapiens
ccagggctttgccaaagtccag

SEQ ID NO: 9142182 - DNA, 22 bp, Homo sapiens
ccagggctttgccaaagtccag

SEQ ID NO: 9142183 - DNA, 22 bp, Homo sapiens
ccagggcttcagttagtggtga

SEQ ID NO: 9142184 - DNA, 22 bp, Homo sapiens
ccagggctgctgtgggactcca

SEQ ID NO: 9142185 - DNA, 22 bp, Homo sapiens
ccagggcttcagttagtggtga

SEQ ID NO: 9142186 - DNA, 22 bp, Homo sapiens
ccagggcttcccacgtgccctg

SEQ ID NO: 9142187 - DNA, 22 bp, Homo sapiens
ccagggcttggtggcttgtatc

SEQ ID NO: 9142188 - DNA, 22 bp, Homo sapiens
tgacatagggcaaaagagtagg

SEQ ID NO: 9142189 - DNA, 21 bp, Homo sapiens
tgacataatccatagtacaaa

SEQ ID NO: 9142190 - DNA, 19 bp, Homo sapiens
tgacatagcaagacaaaac

SEQ ID NO: 9142191 - DNA, 22 bp, Homo sapiens
tgacataataatccaaacatac

SEQ ID NO: 9142192 - DNA, 22 bp, Homo sapiens
tgacataagttggtagaaagga

SEQ ID NO: 9142193 - DNA, 21 bp, Homo sapiens
tgacataatccatagtacaaa

SEQ ID NO: 9142194 - DNA, 22 bp, Homo sapiens
tgacataataatccaaacatac

SEQ ID NO: 9142195 - DNA, 22 bp, Homo sapiens
tgagaaaaggttgagatgataa

SEQ ID NO: 9142196 - DNA, 22 bp, Homo sapiens
tgagaaaagtacatggagaagc

SEQ ID NO: 9142197 - DNA, 22 bp, Homo sapiens
tgagaaaaggttgagatgataa

SEQ ID NO: 9142198 - DNA, 22 bp, Homo sapiens
tgacagttttttgatgaggaat

SEQ ID NO: 9142199 - DNA, 22 bp, Homo sapiens
tgacataaaccagtgagcaaaa

SEQ ID NO: 9142200 - DNA, 22 bp, Homo sapiens
tgacataaatctaaaggaaagg

SEQ ID NO: 9142201 - DNA, 22 bp, Homo sapiens
tgacataagttggtagaaagga

SEQ ID NO: 9142202 - DNA, 22 bp, Homo sapiens
tgacataaaccagtgagcaaaa

SEQ ID NO: 9142203 - DNA, 22 bp, Homo sapiens
tgaggcagcaattgattattca

SEQ ID NO: 9142204 - DNA, 22 bp, Homo sapiens
tgaggcagcaattgattattca

SEQ ID NO: 9142205 - DNA, 22 bp, Homo sapiens
tgaggcagatatttattgggtt

SEQ ID NO: 9142206 - DNA, 22 bp, Homo sapiens
tgaggcagatatttattgggtt

SEQ ID NO: 9142207 - DNA, 22 bp, Homo sapiens
tgaggcagagtaagatacatga

SEQ ID NO: 9142208 - DNA, 22 bp, Homo sapiens
tgaggcagagtaagatacatga

SEQ ID NO: 9142209 - DNA, 22 bp, Homo sapiens
ccaggtgtggggaggactcaca

SEQ ID NO: 9142210 - DNA, 22 bp, Homo sapiens
ccaggtgtgctctgcagtggat

SEQ ID NO: 9142211 - DNA, 22 bp, Homo sapiens
ccaggtgtgctctgcagtggat

SEQ ID NO: 9142212 - DNA, 22 bp, Homo sapiens
ccaggtgtggggaggactcaca

SEQ ID NO: 9142213 - DNA, 22 bp, Homo sapiens
ccaggtgtggccacatggctgg

SEQ ID NO: 9142214 - DNA, 22 bp, Homo sapiens
ccaggtgtgatttggcagtgtc

SEQ ID NO: 9142215 - DNA, 22 bp, Homo sapiens
ccaggtgtgatttggcagtgtc

SEQ ID NO: 9142216 - DNA, 22 bp, Homo sapiens
ccaggtgtgctctgcagtggat

SEQ ID NO: 9142217 - DNA, 22 bp, Homo sapiens
ccaggtgtgccagcagggactg

SEQ ID NO: 9142218 - DNA, 22 bp, Homo sapiens
ccaggtgtgccagcagggactg

SEQ ID NO: 9142219 - DNA, 22 bp, Homo sapiens
ccaggtgtgatttggcagtgtc

SEQ ID NO: 9142220 - DNA, 22 bp, Homo sapiens
tgagacagttctgcagctgggt

SEQ ID NO: 9142221 - DNA, 22 bp, Homo sapiens
tgagacagttctgcagctgggt

SEQ ID NO: 9142222 - DNA, 22 bp, Homo sapiens
tgagacagtttttctatttcca

SEQ ID NO: 9142223 - DNA, 22 bp, Homo sapiens
tgagacagttggtgaaatctaa

SEQ ID NO: 9142224 - DNA, 22 bp, Homo sapiens
tgagacagtttttctatttcca

SEQ ID NO: 9142225 - DNA, 22 bp, Homo sapiens
tgagacagttctgcagctgggt

SEQ ID NO: 9142226 - DNA, 22 bp, Homo sapiens
tgagacagttggtgaaatctaa

SEQ ID NO: 9142227 - DNA, 22 bp, Homo sapiens
tgagacatcatggctgaaagta

SEQ ID NO: 9142228 - DNA, 22 bp, Homo sapiens
ccaggtgtagcactgctcacag

SEQ ID NO: 9142229 - DNA, 22 bp, Homo sapiens
ccaggtgtaggacaccaaggga

SEQ ID NO: 9142230 - DNA, 22 bp, Homo sapiens
ccaggtgtcatgcgtgtgaccc

SEQ ID NO: 9142231 - DNA, 22 bp, Homo sapiens
ccaggtgtcatgcgtgtgaccc

SEQ ID NO: 9142232 - DNA, 22 bp, Homo sapiens
ccaggtgtctgtggccagccct

SEQ ID NO: 9142233 - DNA, 22 bp, Homo sapiens
ccaggtgtccccgtcactgcag

SEQ ID NO: 9142234 - DNA, 22 bp, Homo sapiens
tgagaaggctcaggcttagaga

SEQ ID NO: 9142235 - DNA, 17 bp, Homo sapiens
tgagaagtaggcatcat

SEQ ID NO: 9142236 - DNA, 22 bp, Homo sapiens
tgagaataactgatttaaatgc

SEQ ID NO: 9142237 - DNA, 22 bp, Homo sapiens
tgagaataagagatagtttatt

SEQ ID NO: 9142238 - DNA, 22 bp, Homo sapiens
ccaggggctgcagatccatggt

SEQ ID NO: 9142239 - DNA, 22 bp, Homo sapiens
ccaggggctggtgctgagctgg

SEQ ID NO: 9142240 - DNA, 22 bp, Homo sapiens
tgagaatactgcattgttagga

SEQ ID NO: 9142241 - DNA, 22 bp, Homo sapiens
tgagaataggcatagaacctgg

SEQ ID NO: 9142242 - DNA, 22 bp, Homo sapiens
tgagaatagtaataatttctgg

SEQ ID NO: 9142243 - DNA, 22 bp, Homo sapiens
tgagaatatttgaagatgttag

SEQ ID NO: 9142244 - DNA, 22 bp, Homo sapiens
tgagaatatttgaagatgttag

SEQ ID NO: 9142245 - DNA, 22 bp, Homo sapiens
ccaggggggcgtagatgctggg

SEQ ID NO: 9142246 - DNA, 22 bp, Homo sapiens
ccaggggctggtgctgagctgg

SEQ ID NO: 9142247 - DNA, 22 bp, Homo sapiens
ccagggggcttggtgaggccat

SEQ ID NO: 9142248 - DNA, 22 bp, Homo sapiens
ccagggggcttggtgaggccat

SEQ ID NO: 9142249 - DNA, 21 bp, Homo sapiens
ccagggtccagctgccatggt

SEQ ID NO: 9142250 - DNA, 21 bp, Homo sapiens
ccagggtccagctgccatggt

SEQ ID NO: 9142251 - DNA, 22 bp, Homo sapiens
ccagggtaccccaagggcaggt

SEQ ID NO: 9142252 - DNA, 17 bp, Homo sapiens
ccaggtctccttgcttt

SEQ ID NO: 9142253 - DNA, 22 bp, Homo sapiens
ccaggtggaaggtctgtgctct

SEQ ID NO: 9142254 - DNA, 22 bp, Homo sapiens
ccaggtggaaggtctgtgctct

SEQ ID NO: 9142255 - DNA, 19 bp, Homo sapiens
ccaggtggaactgaggtag

SEQ ID NO: 9142256 - DNA, 22 bp, Homo sapiens
ccaggtgctcttgccagggctg

SEQ ID NO: 9142257 - DNA, 22 bp, Homo sapiens
tctttcttctttcatagtgtga

SEQ ID NO: 9142258 - DNA, 22 bp, Homo sapiens
tctttcttcctggagcccaaca

SEQ ID NO: 9142259 - DNA, 22 bp, Homo sapiens
tctttcttctttcatagtgtga

SEQ ID NO: 9142260 - DNA, 22 bp, Homo sapiens
tctttcttcctggagcccaaca

SEQ ID NO: 9142261 - DNA, 22 bp, Homo sapiens
tctttcttcagccctgtaagat

SEQ ID NO: 9142262 - DNA, 22 bp, Homo sapiens
tctttcttcagccctgtaagat

SEQ ID NO: 9142263 - DNA, 22 bp, Homo sapiens
tctttcttcagccctgtaagat

SEQ ID NO: 9142264 - DNA, 22 bp, Homo sapiens
tctttcttcagccctgtaagat

SEQ ID NO: 9142265 - DNA, 22 bp, Homo sapiens
tctttcttattatgctcaatgt

SEQ ID NO: 9142266 - DNA, 22 bp, Homo sapiens
tctttcttattatgctcaatgt

SEQ ID NO: 9142267 - DNA, 22 bp, Homo sapiens
tctttcttgtgggtgccctttt

SEQ ID NO: 9142268 - DNA, 22 bp, Homo sapiens
tctttcttgtgggtgccctttt

SEQ ID NO: 9142269 - DNA, 22 bp, Homo sapiens
tctttcttgtgggtgccctttt

SEQ ID NO: 9142270 - DNA, 22 bp, Homo sapiens
tctttcttggtataaagcaggg

SEQ ID NO: 9142271 - DNA, 22 bp, Homo sapiens
tctttgaaagctgttctagagt

SEQ ID NO: 9142272 - DNA, 22 bp, Homo sapiens
tctttgaaaagatattcctcct

SEQ ID NO: 9142273 - DNA, 22 bp, Homo sapiens
tctttgaaaagggagatagaaa

SEQ ID NO: 9142274 - DNA, 22 bp, Homo sapiens
ccaggcctggaccatgccaggg

SEQ ID NO: 9142275 - DNA, 19 bp, Homo sapiens
ccaggcctgcgggcgttgg

SEQ ID NO: 9142276 - DNA, 19 bp, Homo sapiens
ccaggcctgcgggcgttgg

SEQ ID NO: 9142277 - DNA, 22 bp, Homo sapiens
ccaggcctgcattccctctcag

SEQ ID NO: 9142278 - DNA, 22 bp, Homo sapiens
ccaggcctgcatctgctgcgca

SEQ ID NO: 9142279 - DNA, 22 bp, Homo sapiens
ccaggccccagggctggctttc

SEQ ID NO: 9142280 - DNA, 22 bp, Homo sapiens
ccaggcccagggtactgaccaa

SEQ ID NO: 9142281 - DNA, 22 bp, Homo sapiens
ccaggcccaccttggccactta

SEQ ID NO: 9142282 - DNA, 22 bp, Homo sapiens
ccaggcccaccttggccactta

SEQ ID NO: 9142283 - DNA, 22 bp, Homo sapiens
ccaggcccaccttggccactta

SEQ ID NO: 9142284 - DNA, 22 bp, Homo sapiens
ccaggccattcccagagttgct

SEQ ID NO: 9142285 - DNA, 22 bp, Homo sapiens
ccaggccccagggctggctttc

SEQ ID NO: 9142286 - DNA, 22 bp, Homo sapiens
ccaggccagggctgcagcgagc

SEQ ID NO: 9142287 - DNA, 22 bp, Homo sapiens
ccaggccagggctgcagcgagc

SEQ ID NO: 9142288 - DNA, 22 bp, Homo sapiens
ccaggccagtgtttggtccagg

SEQ ID NO: 9142289 - DNA, 22 bp, Homo sapiens
ccaggccaggagagcgaggttt

SEQ ID NO: 9142290 - DNA, 22 bp, Homo sapiens
ccaggccaggagagcgaggttt

SEQ ID NO: 9142291 - DNA, 22 bp, Homo sapiens
ccaggccaggagagcgaggttt

SEQ ID NO: 9142292 - DNA, 21 bp, Homo sapiens
ccaggccaggcctacggggat

SEQ ID NO: 9142293 - DNA, 22 bp, Homo sapiens
ccaggccattcccagagttgct

SEQ ID NO: 9142294 - DNA, 22 bp, Homo sapiens
ccaggccagtgtttggtccagg

SEQ ID NO: 9142295 - DNA, 22 bp, Homo sapiens
tctttggtgaatggtcatccag

SEQ ID NO: 9142296 - DNA, 22 bp, Homo sapiens
tctttggtgatatctctttggt

SEQ ID NO: 9142297 - DNA, 22 bp, Homo sapiens
ccaggctggagtgcaatggcgt

SEQ ID NO: 9142298 - DNA, 22 bp, Homo sapiens
ccaggctgaatatgttccaggg

SEQ ID NO: 9142299 - DNA, 22 bp, Homo sapiens
tctttggcttgtctcctcagtt

SEQ ID NO: 9142300 - DNA, 22 bp, Homo sapiens
tctttggggcatctgggagatt

SEQ ID NO: 9142301 - DNA, 23 bp, Homo sapiens
tctttggtaaataaagtggggat

SEQ ID NO: 9142302 - DNA, 22 bp, Homo sapiens
tctttggtattcacttgtgaag

SEQ ID NO: 9142303 - DNA, 22 bp, Homo sapiens
tctttggtcatcatgggaagca

SEQ ID NO: 9142304 - DNA, 22 bp, Homo sapiens
tctttggtcagaaagattacac

SEQ ID NO: 9142305 - DNA, 22 bp, Homo sapiens
ccaggcctggccaggggatgcc

SEQ ID NO: 9142306 - DNA, 22 bp, Homo sapiens
ccaggcctggccaggggatgcc

SEQ ID NO: 9142307 - DNA, 22 bp, Homo sapiens
ccaggcctggacgggtggcctg

SEQ ID NO: 9142308 - DNA, 22 bp, Homo sapiens
ccaggcctggaccatgccaggg

SEQ ID NO: 9142309 - DNA, 22 bp, Homo sapiens
ccaggcctggaccatgccaggg

SEQ ID NO: 9142310 - DNA, 22 bp, Homo sapiens
ccaggctctgttccccgaggag

SEQ ID NO: 9142311 - DNA, 22 bp, Homo sapiens
ccaggctctgttccccgaggag

SEQ ID NO: 9142312 - DNA, 23 bp, Homo sapiens
ccaggctctttcacctgctattc

SEQ ID NO: 9142313 - DNA, 22 bp, Homo sapiens
ccaggctgaatatgttccaggg

SEQ ID NO: 9142314 - DNA, 22 bp, Homo sapiens
ccaggctgaatatgttccaggg

SEQ ID NO: 9142315 - DNA, 22 bp, Homo sapiens
ccaggctgaatatgttccaggg

SEQ ID NO: 9142316 - DNA, 22 bp, Homo sapiens
ccaggatgacccccactttcct

SEQ ID NO: 9142317 - DNA, 22 bp, Homo sapiens
ccaggatggggagcagatagaa

SEQ ID NO: 9142318 - DNA, 22 bp, Homo sapiens
ccaggcaaatccctctggcaga

SEQ ID NO: 9142319 - DNA, 22 bp, Homo sapiens
ccaggcaaatccctctggcaga

SEQ ID NO: 9142320 - DNA, 22 bp, Homo sapiens
ccaggcaaagcccatgcaagag

SEQ ID NO: 9142321 - DNA, 22 bp, Homo sapiens
ccaggatctgggtccatgggac

SEQ ID NO: 9142322 - DNA, 22 bp, Homo sapiens
ccaggatctgtacacctctgag

SEQ ID NO: 9142323 - DNA, 22 bp, Homo sapiens
ccaggatctgatattgggctcc

SEQ ID NO: 9142324 - DNA, 22 bp, Homo sapiens
tcttcacatggagaagcaactc

SEQ ID NO: 9142325 - DNA, 22 bp, Homo sapiens
tcttcacattttaagaagttct

SEQ ID NO: 9142326 - DNA, 22 bp, Homo sapiens
tcttcacattttaagaagttct

SEQ ID NO: 9142327 - DNA, 22 bp, Homo sapiens
tcttagaatgtcaactgatgtt

SEQ ID NO: 9142328 - DNA, 22 bp, Homo sapiens
ccaggcaaggtctcctagagag

SEQ ID NO: 9142329 - DNA, 22 bp, Homo sapiens
tcttagaagtttatggcacgga

SEQ ID NO: 9142330 - DNA, 22 bp, Homo sapiens
ccaggcaagctctgctgtgccc

SEQ ID NO: 9142331 - DNA, 22 bp, Homo sapiens
ccaggcaagagaggctctggca

SEQ ID NO: 9142332 - DNA, 20 bp, Homo sapiens
ccaggcaactatcctgtctc

SEQ ID NO: 9142333 - DNA, 20 bp, Homo sapiens
ccaggcaactatcctgtctc

SEQ ID NO: 9142334 - DNA, 22 bp, Homo sapiens
ccaggcaagagaggctctggca

SEQ ID NO: 9142335 - DNA, 22 bp, Homo sapiens
ccaggagggaccgcggcatccc

SEQ ID NO: 9142336 - DNA, 22 bp, Homo sapiens
ccaggaggttgaggctgcagtg

SEQ ID NO: 9142337 - DNA, 22 bp, Homo sapiens
ccaggagacccagggaaggagc

SEQ ID NO: 9142338 - DNA, 22 bp, Homo sapiens
ccaggagacccagggaaggagc

SEQ ID NO: 9142339 - DNA, 22 bp, Homo sapiens
ccaggaggttgaggctgcagtg

SEQ ID NO: 9142340 - DNA, 22 bp, Homo sapiens
ccaggaggttgaggctgcagtg

SEQ ID NO: 9142341 - DNA, 22 bp, Homo sapiens
ccaggaggttgaggctgcagtg

SEQ ID NO: 9142342 - DNA, 22 bp, Homo sapiens
ccaggaggttgaggctgcagtg

SEQ ID NO: 9142343 - DNA, 22 bp, Homo sapiens
ccaggagtctggatgaggtgtc

SEQ ID NO: 9142344 - DNA, 22 bp, Homo sapiens
ccaggagtctggatgaggtgtc

SEQ ID NO: 9142345 - DNA, 22 bp, Homo sapiens
ccaggagtggctggtgaccttc

SEQ ID NO: 9142346 - DNA, 19 bp, Homo sapiens
ccaggagtggtggggtgag

SEQ ID NO: 9142347 - DNA, 21 bp, Homo sapiens
tcttcccattatgttccaatt

SEQ ID NO: 9142348 - DNA, 21 bp, Homo sapiens
tcttcccattatgttccaatt

SEQ ID NO: 9142349 - DNA, 22 bp, Homo sapiens
ccaggcaggctagaatgtaaat

SEQ ID NO: 9142350 - DNA, 22 bp, Homo sapiens
ccaggcagggagctgtttggcc

SEQ ID NO: 9142351 - DNA, 22 bp, Homo sapiens
ccaggccagagtgcagtggcac

SEQ ID NO: 9142352 - DNA, 22 bp, Homo sapiens
ccaggccagcaggcacacctgc

SEQ ID NO: 9142353 - DNA, 22 bp, Homo sapiens
ccaggccagcaggcacacctgc

SEQ ID NO: 9142354 - DNA, 22 bp, Homo sapiens
ccaggccagcgctggctggagg

SEQ ID NO: 9142355 - DNA, 22 bp, Homo sapiens
ccaggccagcgctggctggagg

SEQ ID NO: 9142356 - DNA, 22 bp, Homo sapiens
ccaggccagcctggagcatggc

SEQ ID NO: 9142357 - DNA, 22 bp, Homo sapiens
ccaggccagcctggagcatggc

SEQ ID NO: 9142358 - DNA, 22 bp, Homo sapiens
tcttcccagctgctgcgatgcc

SEQ ID NO: 9142359 - DNA, 22 bp, Homo sapiens
tcttcccagaggaggtgccagc

SEQ ID NO: 9142360 - DNA, 22 bp, Homo sapiens
tcttccagtgtagacatctgcc

SEQ ID NO: 9142361 - DNA, 22 bp, Homo sapiens
tcttcagataaagggagagtat

SEQ ID NO: 9142362 - DNA, 20 bp, Homo sapiens
tcttcagatgcttttggagt

SEQ ID NO: 9142363 - DNA, 20 bp, Homo sapiens
tcttccaggtacagtctgca

SEQ ID NO: 9142364 - DNA, 22 bp, Homo sapiens
tcttccaggtatgtttctagtt

SEQ ID NO: 9142365 - DNA, 22 bp, Homo sapiens
tcttccaggtatgtttctagtt

SEQ ID NO: 9142366 - DNA, 22 bp, Homo sapiens
tcttcagagatgtaacatatgg

SEQ ID NO: 9142367 - DNA, 22 bp, Homo sapiens
tcttcagagatgtaacatatgg

SEQ ID NO: 9142368 - DNA, 22 bp, Homo sapiens
tcttcagaaaattatcacttgt

SEQ ID NO: 9142369 - DNA, 22 bp, Homo sapiens
tcttcagactccaaatgtttta

SEQ ID NO: 9142370 - DNA, 22 bp, Homo sapiens
tcttcagacttccggaaacgtg

SEQ ID NO: 9142371 - DNA, 22 bp, Homo sapiens
tcttcagactccaaatgtttta

SEQ ID NO: 9142372 - DNA, 22 bp, Homo sapiens
ccagctgcccactatgtgttct

SEQ ID NO: 9142373 - DNA, 21 bp, Homo sapiens
ccagctgctccttgaggttcc

SEQ ID NO: 9142374 - DNA, 22 bp, Homo sapiens
tctggaggcaggctgccaggat

SEQ ID NO: 9142375 - DNA, 22 bp, Homo sapiens
tctggaggccatagggaaggat

SEQ ID NO: 9142376 - DNA, 22 bp, Homo sapiens
tctggcagcagcatcagtggct

SEQ ID NO: 9142377 - DNA, 22 bp, Homo sapiens
ccagctgctgacatgggcaggt

SEQ ID NO: 9142378 - DNA, 22 bp, Homo sapiens
ccagctgctgacatgggcaggt

SEQ ID NO: 9142379 - DNA, 22 bp, Homo sapiens
ccagctgcaggggagcagtgga

SEQ ID NO: 9142380 - DNA, 22 bp, Homo sapiens
ccagctgcaggtgttccagatg

SEQ ID NO: 9142381 - DNA, 22 bp, Homo sapiens
ccagctgcaggggagcagtgga

SEQ ID NO: 9142382 - DNA, 22 bp, Homo sapiens
ccagctgcaggtgttccagatg

SEQ ID NO: 9142383 - DNA, 22 bp, Homo sapiens
ccagctgcccaagaggcatcct

SEQ ID NO: 9142384 - DNA, 22 bp, Homo sapiens
ccagctgaggttgaagaaagag

SEQ ID NO: 9142385 - DNA, 22 bp, Homo sapiens
ccagctctgattttgacctcca

SEQ ID NO: 9142386 - DNA, 22 bp, Homo sapiens
ccagctctgattttgacctcca

SEQ ID NO: 9142387 - DNA, 22 bp, Homo sapiens
ccagctctctgtcctccccaca

SEQ ID NO: 9142388 - DNA, 22 bp, Homo sapiens
ccagctctgccaagcgtcagct

SEQ ID NO: 9142389 - DNA, 22 bp, Homo sapiens
tctggaaagatcattaaatcca

SEQ ID NO: 9142390 - DNA, 22 bp, Homo sapiens
tctggaaataaaattatagttg

SEQ ID NO: 9142391 - DNA, 22 bp, Homo sapiens
tctggaaaagcgataaaccatt

SEQ ID NO: 9142392 - DNA, 22 bp, Homo sapiens
ccagctctcagcgggagactca

SEQ ID NO: 9142393 - DNA, 22 bp, Homo sapiens
tctggaaatttcagttttagag

SEQ ID NO: 9142394 - DNA, 18 bp, Homo sapiens
tctggaacaacttcatgt

SEQ ID NO: 9142395 - DNA, 18 bp, Homo sapiens
tctggaacaacttcatgt

SEQ ID NO: 9142396 - DNA, 21 bp, Homo sapiens
tctggaagaaaaaagtattat

SEQ ID NO: 9142397 - DNA, 22 bp, Homo sapiens
tctgcttgtgtctgtccagcct

SEQ ID NO: 9142398 - DNA, 22 bp, Homo sapiens
tctgcttgcgttctgctccctc

SEQ ID NO: 9142399 - DNA, 22 bp, Homo sapiens
tctgctttagacataaaaggta

SEQ ID NO: 9142400 - DNA, 22 bp, Homo sapiens
tctgctttagtgcaaagtctta

SEQ ID NO: 9142401 - DNA, 22 bp, Homo sapiens
tctgctttcaaattcacttagt

SEQ ID NO: 9142402 - DNA, 22 bp, Homo sapiens
tctgctttcaaattcacttagt

SEQ ID NO: 9142403 - DNA, 22 bp, Homo sapiens
tctgctttattacactagccaa

SEQ ID NO: 9142404 - DNA, 22 bp, Homo sapiens
tctgctttcttactaaaaatga

SEQ ID NO: 9142405 - DNA, 22 bp, Homo sapiens
tctgctttcttactaaaaatga

SEQ ID NO: 9142406 - DNA, 22 bp, Homo sapiens
ccagagagaaaatggagggcca

SEQ ID NO: 9142407 - DNA, 22 bp, Homo sapiens
ccagagagaaaatggagggcca

SEQ ID NO: 9142408 - DNA, 22 bp, Homo sapiens
ccagagacgtcggtcagggcgc

SEQ ID NO: 9142409 - DNA, 22 bp, Homo sapiens
tctcagactatagtagagattc

SEQ ID NO: 9142410 - DNA, 22 bp, Homo sapiens
tctcagagaacagttggtgctt

SEQ ID NO: 9142411 - DNA, 22 bp, Homo sapiens
tctcagagaaatgtgtcaccat

SEQ ID NO: 9142412 - DNA, 22 bp, Homo sapiens
tctgctaatgtggttatttcta

SEQ ID NO: 9142413 - DNA, 22 bp, Homo sapiens
tctgctacagggaaggacccct

SEQ ID NO: 9142414 - DNA, 19 bp, Homo sapiens
tctcagaattaagagtgct

SEQ ID NO: 9142415 - DNA, 22 bp, Homo sapiens
tctggtagaagaagtgaagctg

SEQ ID NO: 9142416 - DNA, 22 bp, Homo sapiens
tctgggagctggctttgcctca

SEQ ID NO: 9142417 - DNA, 20 bp, Homo sapiens
tctggggatgaggtctagga

SEQ ID NO: 9142418 - DNA, 22 bp, Homo sapiens
tctgggagccatgccttggagt

SEQ ID NO: 9142419 - DNA, 22 bp, Homo sapiens
tctgggagcagctcagcagatt

SEQ ID NO: 9142420 - DNA, 22 bp, Homo sapiens
tctgggagcagctcagcagatt

SEQ ID NO: 9142421 - DNA, 22 bp, Homo sapiens
tctgggagcacacgcagtgatc

SEQ ID NO: 9142422 - DNA, 22 bp, Homo sapiens
tctgggagcacacgcagtgatc

SEQ ID NO: 9142423 - DNA, 22 bp, Homo sapiens
tctgggagcacacgcagtgatc

SEQ ID NO: 9142424 - DNA, 22 bp, Homo sapiens
tctgggagcagatgatggtata

SEQ ID NO: 9142425 - DNA, 22 bp, Homo sapiens
tctgggagatccaagcagaact

SEQ ID NO: 9142426 - DNA, 21 bp, Homo sapiens
ccaggactccatggggtctct

SEQ ID NO: 9142427 - DNA, 22 bp, Homo sapiens
tctgggagagtctaacttgttt

SEQ ID NO: 9142428 - DNA, 22 bp, Homo sapiens
tctgggagatccaagcagaact

SEQ ID NO: 9142429 - DNA, 22 bp, Homo sapiens
ccaggagaagcatctgagtgta

SEQ ID NO: 9142430 - DNA, 19 bp, Homo sapiens
tctggttcatttctgctgt

SEQ ID NO: 9142431 - DNA, 22 bp, Homo sapiens
tctggtcctctctgtgatgcta

SEQ ID NO: 9142432 - DNA, 22 bp, Homo sapiens
tctggtcccttttcctgcagtc

SEQ ID NO: 9142433 - DNA, 22 bp, Homo sapiens
tctggtccctgctcacttcttg

SEQ ID NO: 9142434 - DNA, 20 bp, Homo sapiens
tctggtccaggtcttcatgg

SEQ ID NO: 9142435 - DNA, 22 bp, Homo sapiens
tctggtgtcagtattctttgaa

SEQ ID NO: 9142436 - DNA, 22 bp, Homo sapiens
tctggtgtcagtattctttgaa

SEQ ID NO: 9142437 - DNA, 22 bp, Homo sapiens
tctggctcagggctctgaggga

SEQ ID NO: 9142438 - DNA, 21 bp, Homo sapiens
ccaggaaggactgagctccct

SEQ ID NO: 9142439 - DNA, 21 bp, Homo sapiens
ccaggaaggactgagctccct

SEQ ID NO: 9142440 - DNA, 22 bp, Homo sapiens
ccaggacaattcgtcactttct

SEQ ID NO: 9142441 - DNA, 22 bp, Homo sapiens
ccaggacacgatttttagtctg

SEQ ID NO: 9142442 - DNA, 18 bp, Homo sapiens
tctggctcaggactgaac

SEQ ID NO: 9142443 - DNA, 22 bp, Homo sapiens
tctggctcacttcaggcttcac

SEQ ID NO: 9142444 - DNA, 22 bp, Homo sapiens
tctggctcacttcaggcttcac

SEQ ID NO: 9142445 - DNA, 22 bp, Homo sapiens
tctggctcaggagctgtgttca

SEQ ID NO: 9142446 - DNA, 18 bp, Homo sapiens
tctggctcaggactgaac

SEQ ID NO: 9142447 - DNA, 22 bp, Homo sapiens
tctggctcaggagctgtgttca

SEQ ID NO: 9142448 - DNA, 22 bp, Homo sapiens
tctggctcagggctctgaggga

SEQ ID NO: 9142449 - DNA, 22 bp, Homo sapiens
tctggctcaaaatacgtactct

SEQ ID NO: 9142450 - DNA, 17 bp, Homo sapiens
tctggccttcctgaact

SEQ ID NO: 9142451 - DNA, 17 bp, Homo sapiens
tctggccttcctgaact

SEQ ID NO: 9142452 - DNA, 22 bp, Homo sapiens
ccaggacagggagacgggagcc

SEQ ID NO: 9142453 - DNA, 22 bp, Homo sapiens
ccaggacagggagacgggagcc

SEQ ID NO: 9142454 - DNA, 22 bp, Homo sapiens
ccaggacagggagacgggagcc

SEQ ID NO: 9142455 - DNA, 22 bp, Homo sapiens
ccaggacagggagacgggagcc

SEQ ID NO: 9142456 - DNA, 18 bp, Homo sapiens
ccaggacaggcaaaaggt

SEQ ID NO: 9142457 - DNA, 18 bp, Homo sapiens
ccaggacaggcaaaaggt

SEQ ID NO: 9142458 - DNA, 22 bp, Homo sapiens
ccaggacaggagttggcttcgc

SEQ ID NO: 9142459 - DNA, 22 bp, Homo sapiens
ccaggacactgcttcacagcag

SEQ ID NO: 9142460 - DNA, 22 bp, Homo sapiens
ccaggacactgcttcacagcag

SEQ ID NO: 9142461 - DNA, 22 bp, Homo sapiens
ccaggacctggagctctatgaa

SEQ ID NO: 9142462 - DNA, 22 bp, Homo sapiens
ccaggacatgttgcaagtttat

SEQ ID NO: 9142463 - DNA, 22 bp, Homo sapiens
ccaggacagtgaacatgtaaga

SEQ ID NO: 9142464 - DNA, 22 bp, Homo sapiens
tctggcaggacatgctgaccat

SEQ ID NO: 9142465 - DNA, 22 bp, Homo sapiens
tctggcaggatatcgaagtgaa

SEQ ID NO: 9142466 - DNA, 22 bp, Homo sapiens
tctggcaggcaatcggctctgg

SEQ ID NO: 9142467 - DNA, 22 bp, Homo sapiens
tctggcaggccttgtcaatctg

SEQ ID NO: 9142468 - DNA, 21 bp, Homo sapiens
tctggcaggaagacggatggg

SEQ ID NO: 9142469 - DNA, 22 bp, Homo sapiens
tctggccttatctgtccaagcc

SEQ ID NO: 9142470 - DNA, 22 bp, Homo sapiens
tctggcctcttgggatgctccc

SEQ ID NO: 9142471 - DNA, 22 bp, Homo sapiens
tctggcctcttgggatgctccc

SEQ ID NO: 9142472 - DNA, 22 bp, Homo sapiens
tctggcaggggttctgcacttg

SEQ ID NO: 9142473 - DNA, 22 bp, Homo sapiens
tctggccctgctgctgtgagca

SEQ ID NO: 9142474 - DNA, 22 bp, Homo sapiens
cctcagaggtgtggcatctctg

SEQ ID NO: 9142475 - DNA, 22 bp, Homo sapiens
cctcagcatcctcatgctcagt

SEQ ID NO: 9142476 - DNA, 22 bp, Homo sapiens
cctcagcagacacgcttctcac

SEQ ID NO: 9142477 - DNA, 22 bp, Homo sapiens
cctcagagttggccacgagagc

SEQ ID NO: 9142478 - DNA, 22 bp, Homo sapiens
cctcagagtttaagatgtcaga

SEQ ID NO: 9142479 - DNA, 22 bp, Homo sapiens
tggcccagatctctgaccttga

SEQ ID NO: 9142480 - DNA, 22 bp, Homo sapiens
tggcccagagcactgctgggca

SEQ ID NO: 9142481 - DNA, 19 bp, Homo sapiens
tggcccagatggtcctggg

SEQ ID NO: 9142482 - DNA, 19 bp, Homo sapiens
tggcccagatggtcctggg

SEQ ID NO: 9142483 - DNA, 19 bp, Homo sapiens
tggcccagatggtcctggg

SEQ ID NO: 9142484 - DNA, 20 bp, Homo sapiens
tggcccagcacgacgaggac

SEQ ID NO: 9142485 - DNA, 22 bp, Homo sapiens
tggcccagcactccaagtaggg

SEQ ID NO: 9142486 - DNA, 22 bp, Homo sapiens
tggcccagcactccaagtaggg

SEQ ID NO: 9142487 - DNA, 22 bp, Homo sapiens
cctcaggctgggctgcccctgg

SEQ ID NO: 9142488 - DNA, 22 bp, Homo sapiens
cctcaggctgggctgcccctgg

SEQ ID NO: 9142489 - DNA, 22 bp, Homo sapiens
cctcaggctgctcacacttgtc

SEQ ID NO: 9142490 - DNA, 22 bp, Homo sapiens
cctcaggcctgccagagcccca

SEQ ID NO: 9142491 - DNA, 22 bp, Homo sapiens
cctcaggcctctgcctcattgg

SEQ ID NO: 9142492 - DNA, 22 bp, Homo sapiens
cctcaggcctgccagagcccca

SEQ ID NO: 9142493 - DNA, 22 bp, Homo sapiens
cctcaggcctgccagagcccca

SEQ ID NO: 9142494 - DNA, 22 bp, Homo sapiens
cctcaggcttcgtcttccaccc

SEQ ID NO: 9142495 - DNA, 22 bp, Homo sapiens
cctcagggaatgggaggctggg

SEQ ID NO: 9142496 - DNA, 22 bp, Homo sapiens
cctcagggaatgggaggctggg

SEQ ID NO: 9142497 - DNA, 22 bp, Homo sapiens
cctcagggaatgggaggctggg

SEQ ID NO: 9142498 - DNA, 22 bp, Homo sapiens
cctcaggctgggctgcccctgg

SEQ ID NO: 9142499 - DNA, 22 bp, Homo sapiens
cctcagtttatcctctgtaaca

SEQ ID NO: 9142500 - DNA, 22 bp, Homo sapiens
cctcatcgtttccagaatgtgg

SEQ ID NO: 9142501 - DNA, 20 bp, Homo sapiens
cctcagtgtcctggactggg

SEQ ID NO: 9142502 - DNA, 22 bp, Homo sapiens
cctcagtgttaggataagagaa

SEQ ID NO: 9142503 - DNA, 20 bp, Homo sapiens
cctcagtgtcctggactggg

SEQ ID NO: 9142504 - DNA, 18 bp, Homo sapiens
cctcagggagagagacgc

SEQ ID NO: 9142505 - DNA, 22 bp, Homo sapiens
cctcatgctgcatctctgaggt

SEQ ID NO: 9142506 - DNA, 22 bp, Homo sapiens
cctcattaacacaatgtcattt

SEQ ID NO: 9142507 - DNA, 22 bp, Homo sapiens
cctcattctcgcgtgtgtttct

SEQ ID NO: 9142508 - DNA, 22 bp, Homo sapiens
cctccaagcttcatctcaacca

SEQ ID NO: 9142509 - DNA, 22 bp, Homo sapiens
cctccaagctggtcctctgtgt

SEQ ID NO: 9142510 - DNA, 22 bp, Homo sapiens
tggcctggctcacagtgagatt

SEQ ID NO: 9142511 - DNA, 18 bp, Homo sapiens
cctccaagtccccagcct

SEQ ID NO: 9142512 - DNA, 22 bp, Homo sapiens
tggcctgggcatgaagcatcgt

SEQ ID NO: 9142513 - DNA, 22 bp, Homo sapiens
tggcctgggcatgaagcatcgt

SEQ ID NO: 9142514 - DNA, 22 bp, Homo sapiens
tggcctgggccggcagatatac

SEQ ID NO: 9142515 - DNA, 22 bp, Homo sapiens
tggcctgggccggcagatatac

SEQ ID NO: 9142516 - DNA, 22 bp, Homo sapiens
tggcctgggcctgccggtgcaa

SEQ ID NO: 9142517 - DNA, 22 bp, Homo sapiens
tggctctgaccaggtagaggag

SEQ ID NO: 9142518 - DNA, 22 bp, Homo sapiens
tggctctgagacacaggctctc

SEQ ID NO: 9142519 - DNA, 21 bp, Homo sapiens
tggctctgggtaggagagtgc

SEQ ID NO: 9142520 - DNA, 22 bp, Homo sapiens
tggctctggtaacattgggtag

SEQ ID NO: 9142521 - DNA, 21 bp, Homo sapiens
tggctctgggtaggagagtgc

SEQ ID NO: 9142522 - DNA, 22 bp, Homo sapiens
tggctctgtcaaactgcacaca

SEQ ID NO: 9142523 - DNA, 22 bp, Homo sapiens
tggctctgtcaaactgcacaca

SEQ ID NO: 9142524 - DNA, 22 bp, Homo sapiens
tggctctggtgcgggctcctgc

SEQ ID NO: 9142525 - DNA, 22 bp, Homo sapiens
ccctgcaggggacctgcagcct

SEQ ID NO: 9142526 - DNA, 23 bp, Homo sapiens
ccctgcagtcagggtgagatggt

SEQ ID NO: 9142527 - DNA, 22 bp, Homo sapiens
ccctgtgggaactcctgagttg

SEQ ID NO: 9142528 - DNA, 22 bp, Homo sapiens
ccctgtgggccatgtgtctaca

SEQ ID NO: 9142529 - DNA, 22 bp, Homo sapiens
ccctgcaggggacctgcagcct

SEQ ID NO: 9142530 - DNA, 22 bp, Homo sapiens
ccctgcagggaggattctgaag

SEQ ID NO: 9142531 - DNA, 21 bp, Homo sapiens
ccctgcaggccagggctgagc

SEQ ID NO: 9142532 - DNA, 21 bp, Homo sapiens
ccctgcaggccagggctgagc

SEQ ID NO: 9142533 - DNA, 22 bp, Homo sapiens
ccctgcagcttttgcatagtca

SEQ ID NO: 9142534 - DNA, 22 bp, Homo sapiens
ccctgcagcttttgcatagtca

SEQ ID NO: 9142535 - DNA, 22 bp, Homo sapiens
ccctgcagccttgcatgccttc

SEQ ID NO: 9142536 - DNA, 22 bp, Homo sapiens
tggagcagggcatcactgtgcg

SEQ ID NO: 9142537 - DNA, 22 bp, Homo sapiens
tggagcaggccggaagtggctt

SEQ ID NO: 9142538 - DNA, 22 bp, Homo sapiens
tggagcaggccggaagtggctt

SEQ ID NO: 9142539 - DNA, 22 bp, Homo sapiens
tggagcaggcatctttctctct

SEQ ID NO: 9142540 - DNA, 18 bp, Homo sapiens
tggagcaggtaggcatga

SEQ ID NO: 9142541 - DNA, 22 bp, Homo sapiens
ccctgcagccggccagctcatt

SEQ ID NO: 9142542 - DNA, 22 bp, Homo sapiens
ccctgcagccttgcatgccttc

SEQ ID NO: 9142543 - DNA, 19 bp, Homo sapiens
tggagcagggcccttgttt

SEQ ID NO: 9142544 - DNA, 22 bp, Homo sapiens
cccttccttgtgactggtgggg

SEQ ID NO: 9142545 - DNA, 22 bp, Homo sapiens
cccttctctttcactcactatt

SEQ ID NO: 9142546 - DNA, 19 bp, Homo sapiens
tggcagaggacaaggactt

SEQ ID NO: 9142547 - DNA, 19 bp, Homo sapiens
tggcagaggacaaggactt

SEQ ID NO: 9142548 - DNA, 22 bp, Homo sapiens
cccttcctggagtaccctctgt

SEQ ID NO: 9142549 - DNA, 22 bp, Homo sapiens
cccttcctggagtaccctctgt

SEQ ID NO: 9142550 - DNA, 22 bp, Homo sapiens
cccttcctgggtgtcccggagt

SEQ ID NO: 9142551 - DNA, 22 bp, Homo sapiens
cccttcctcccaggcttctgtg

SEQ ID NO: 9142552 - DNA, 22 bp, Homo sapiens
cccttcctcccaggcttctgtg

SEQ ID NO: 9142553 - DNA, 22 bp, Homo sapiens
cccttcctcctcgcctgtcaga

SEQ ID NO: 9142554 - DNA, 22 bp, Homo sapiens
ccctgtggggtccgcctgtccg

SEQ ID NO: 9142555 - DNA, 22 bp, Homo sapiens
ccctgtggggtccgcctgtccg

SEQ ID NO: 9142556 - DNA, 22 bp, Homo sapiens
tggcagaggctctgtgatgttg

SEQ ID NO: 9142557 - DNA, 22 bp, Homo sapiens
tggcagaggctctgtgatgttg

SEQ ID NO: 9142558 - DNA, 22 bp, Homo sapiens
tggcagaggtaattcaaatccc

SEQ ID NO: 9142559 - DNA, 19 bp, Homo sapiens
tggcagaggcagtttgtac

SEQ ID NO: 9142560 - DNA, 19 bp, Homo sapiens
tggcagaggcagtttgtac

SEQ ID NO: 9142561 - DNA, 22 bp, Homo sapiens
tggcagaggaggctcagattga

SEQ ID NO: 9142562 - DNA, 22 bp, Homo sapiens
tggcagaggaggctcagattga

SEQ ID NO: 9142563 - DNA, 22 bp, Homo sapiens
tggcagaggagaattaagatta

SEQ ID NO: 9142564 - DNA, 22 bp, Homo sapiens
tggcagaggagaattaagatta

SEQ ID NO: 9142565 - DNA, 18 bp, Homo sapiens
cctaggaaagggaggcaa

SEQ ID NO: 9142566 - DNA, 21 bp, Homo sapiens
cctagcctcttacccagcttt

SEQ ID NO: 9142567 - DNA, 22 bp, Homo sapiens
cctagatgggatggcggccggg

SEQ ID NO: 9142568 - DNA, 22 bp, Homo sapiens
cctagagctctgctttatctaa

SEQ ID NO: 9142569 - DNA, 22 bp, Homo sapiens
cctagagccgcacctcctccac

SEQ ID NO: 9142570 - DNA, 22 bp, Homo sapiens
cctagagctctgctttatctaa

SEQ ID NO: 9142571 - DNA, 19 bp, Homo sapiens
cctagagcagtacctggta

SEQ ID NO: 9142572 - DNA, 22 bp, Homo sapiens
cctcagaaggacaagagacaaa

SEQ ID NO: 9142573 - DNA, 22 bp, Homo sapiens
tggcaggtacccattggctgta

SEQ ID NO: 9142574 - DNA, 18 bp, Homo sapiens
tggcaggtagactcaggt

SEQ ID NO: 9142575 - DNA, 22 bp, Homo sapiens
tggcaggtagagttctgagatg

SEQ ID NO: 9142576 - DNA, 22 bp, Homo sapiens
tggcagggttggccaccttacc

SEQ ID NO: 9142577 - DNA, 22 bp, Homo sapiens
tggcagggtgggcttcagcccc

SEQ ID NO: 9142578 - DNA, 22 bp, Homo sapiens
cctaggaagctgagattgcagt

SEQ ID NO: 9142579 - DNA, 22 bp, Homo sapiens
cctaggaaggagtatagtaaat

SEQ ID NO: 9142580 - DNA, 22 bp, Homo sapiens
cctaggagagggaaaatctagg

SEQ ID NO: 9142581 - DNA, 22 bp, Homo sapiens
cctaggaaggagtatagtaaat

SEQ ID NO: 9142582 - DNA, 19 bp, Homo sapiens
cctaggcattgtccaaggg

SEQ ID NO: 9142583 - DNA, 20 bp, Homo sapiens
cctaggcatgctgagtctcc

SEQ ID NO: 9142584 - DNA, 18 bp, Homo sapiens
cctgagccctgcttactt

SEQ ID NO: 9142585 - DNA, 22 bp, Homo sapiens
cctgagcatcagcgcctcctta

SEQ ID NO: 9142586 - DNA, 22 bp, Homo sapiens
tgggccagtttctcattgaaat

SEQ ID NO: 9142587 - DNA, 22 bp, Homo sapiens
tgggccagtttctcattgaaat

SEQ ID NO: 9142588 - DNA, 23 bp, Homo sapiens
tgggagtgttgggatctctgctc

SEQ ID NO: 9142589 - DNA, 23 bp, Homo sapiens
cctgagatctgtaagggaccttg

SEQ ID NO: 9142590 - DNA, 22 bp, Homo sapiens
cctcttctaggacgtccttgtg

SEQ ID NO: 9142591 - DNA, 22 bp, Homo sapiens
cctcttctaggtttcagcctgc

SEQ ID NO: 9142592 - DNA, 22 bp, Homo sapiens
cctcttctaggtttcagcctgc

SEQ ID NO: 9142593 - DNA, 19 bp, Homo sapiens
tgggagtggggaaggtcct

SEQ ID NO: 9142594 - DNA, 18 bp, Homo sapiens
tgggagtgggagtggata

SEQ ID NO: 9142595 - DNA, 22 bp, Homo sapiens
cctcttctcaactccagccaga

SEQ ID NO: 9142596 - DNA, 22 bp, Homo sapiens
cctcttctaggtttcagcctgc

SEQ ID NO: 9142597 - DNA, 22 bp, Homo sapiens
tgggagtggggcatagaaggta

SEQ ID NO: 9142598 - DNA, 22 bp, Homo sapiens
tgggccccagcacgtctgggga

SEQ ID NO: 9142599 - DNA, 22 bp, Homo sapiens
tgggccccagcacgtctgggga

SEQ ID NO: 9142600 - DNA, 22 bp, Homo sapiens
tgggccccagcacgtctgggga

SEQ ID NO: 9142601 - DNA, 22 bp, Homo sapiens
tgggccctgcccttgtctgtcc

SEQ ID NO: 9142602 - DNA, 22 bp, Homo sapiens
tgggctgctgtctgcacatgct

SEQ ID NO: 9142603 - DNA, 22 bp, Homo sapiens
tgggctgctgagaatgagagag

SEQ ID NO: 9142604 - DNA, 22 bp, Homo sapiens
tgggctgcggataggcctcgga

SEQ ID NO: 9142605 - DNA, 22 bp, Homo sapiens
tgggctgcggataggcctcgga

SEQ ID NO: 9142606 - DNA, 22 bp, Homo sapiens
tgggctccttgggagcaagtga

SEQ ID NO: 9142607 - DNA, 18 bp, Homo sapiens
tgggctgcctggcctctg

SEQ ID NO: 9142608 - DNA, 18 bp, Homo sapiens
tgggctgcctggcctctg

SEQ ID NO: 9142609 - DNA, 22 bp, Homo sapiens
tgggcccttatgaagctcaaga

SEQ ID NO: 9142610 - DNA, 22 bp, Homo sapiens
cctgagctggcagtgacctgga

SEQ ID NO: 9142611 - DNA, 22 bp, Homo sapiens
cctgagctgactctcctttcag

SEQ ID NO: 9142612 - DNA, 22 bp, Homo sapiens
cctgagctcaaagggtgcctgg

SEQ ID NO: 9142613 - DNA, 22 bp, Homo sapiens
tgggctggagcttgttgcttcc

SEQ ID NO: 9142614 - DNA, 22 bp, Homo sapiens
tgggctggcccaccacacctcg

SEQ ID NO: 9142615 - DNA, 21 bp, Homo sapiens
cctgagcctgtttatccagaa

SEQ ID NO: 9142616 - DNA, 22 bp, Homo sapiens
tgggctggagcttgttgcttcc

SEQ ID NO: 9142617 - DNA, 22 bp, Homo sapiens
tgggctgcttcctcagctgaga

SEQ ID NO: 9142618 - DNA, 22 bp, Homo sapiens
tgggaaggatacgttacaagat

SEQ ID NO: 9142619 - DNA, 22 bp, Homo sapiens
tgggaaggataccttggaacat

SEQ ID NO: 9142620 - DNA, 22 bp, Homo sapiens
tgggaaggatacgttacaagat

SEQ ID NO: 9142621 - DNA, 22 bp, Homo sapiens
tgggaaggcagtcactgtccta

SEQ ID NO: 9142622 - DNA, 22 bp, Homo sapiens
cctctggaggctctaagagaga

SEQ ID NO: 9142623 - DNA, 22 bp, Homo sapiens
cctctggaggctctaagagaga

SEQ ID NO: 9142624 - DNA, 22 bp, Homo sapiens
cctctggacttgggacagtgag

SEQ ID NO: 9142625 - DNA, 22 bp, Homo sapiens
cctctggacttgggacagtgag

SEQ ID NO: 9142626 - DNA, 22 bp, Homo sapiens
tgggaagctgcattttaacaag

SEQ ID NO: 9142627 - DNA, 22 bp, Homo sapiens
tgggaagctttaaatgggtgtc

SEQ ID NO: 9142628 - DNA, 22 bp, Homo sapiens
tgggaagctactcatgcaggca

SEQ ID NO: 9142629 - DNA, 22 bp, Homo sapiens
tgggaaggaactgcctttagct

SEQ ID NO: 9142630 - DNA, 22 bp, Homo sapiens
tgggaaggaactgcctttagct

SEQ ID NO: 9142631 - DNA, 22 bp, Homo sapiens
tgggaaggaatggtgattaata

SEQ ID NO: 9142632 - DNA, 22 bp, Homo sapiens
tgggaaggaatggtgattaata

SEQ ID NO: 9142633 - DNA, 22 bp, Homo sapiens
tgggaaggacagaacataattg

SEQ ID NO: 9142634 - DNA, 22 bp, Homo sapiens
tgggaaggacagaacataattg

SEQ ID NO: 9142635 - DNA, 22 bp, Homo sapiens
tgggaaggacgtgtcagtggca

SEQ ID NO: 9142636 - DNA, 20 bp, Homo sapiens
cctctgcctttctagtctga

SEQ ID NO: 9142637 - DNA, 20 bp, Homo sapiens
cctctgcctttctagtctga

SEQ ID NO: 9142638 - DNA, 22 bp, Homo sapiens
cctctgctccctggtgtctgag

SEQ ID NO: 9142639 - DNA, 22 bp, Homo sapiens
tggcttccagtaatcaggattt

SEQ ID NO: 9142640 - DNA, 19 bp, Homo sapiens
tggcttccatctctctcat

SEQ ID NO: 9142641 - DNA, 22 bp, Homo sapiens
tggcttccactgtgtgccccct

SEQ ID NO: 9142642 - DNA, 18 bp, Homo sapiens
cctctgccatagccagca

SEQ ID NO: 9142643 - DNA, 22 bp, Homo sapiens
cctctgcctgcacatcatcctg

SEQ ID NO: 9142644 - DNA, 22 bp, Homo sapiens
cctctgcccttttcctgtatca

SEQ ID NO: 9142645 - DNA, 22 bp, Homo sapiens
tggctggctgtccagctgggca

SEQ ID NO: 9142646 - DNA, 22 bp, Homo sapiens
tggctggctgtccagctgggca

SEQ ID NO: 9142647 - DNA, 22 bp, Homo sapiens
tggctggctgtcaaggaaagcc

SEQ ID NO: 9142648 - DNA, 22 bp, Homo sapiens
tggctggctgtcaaggaaagcc

SEQ ID NO: 9142649 - DNA, 22 bp, Homo sapiens
tggctgggagctggaactgggc

SEQ ID NO: 9142650 - DNA, 22 bp, Homo sapiens
tggctggcttgttcactgactg

SEQ ID NO: 9142651 - DNA, 20 bp, Homo sapiens
tggctggcttgtatttcctt

SEQ ID NO: 9142652 - DNA, 22 bp, Homo sapiens
tggcttcattcagcatgacagt

SEQ ID NO: 9142653 - DNA, 22 bp, Homo sapiens
tggcttcattctgtagttaaaa

SEQ ID NO: 9142654 - DNA, 22 bp, Homo sapiens
tggcttcatgtagtttgagttg

SEQ ID NO: 9142655 - DNA, 22 bp, Homo sapiens
tggcttcattattgtttttcct

SEQ ID NO: 9142656 - DNA, 22 bp, Homo sapiens
tggcttcaggcagaatttagac

SEQ ID NO: 9142657 - DNA, 22 bp, Homo sapiens
tggcttcagttcctgtgttgtt

SEQ ID NO: 9142658 - DNA, 22 bp, Homo sapiens
tggcttcagtctcatcttggaa

SEQ ID NO: 9142659 - DNA, 22 bp, Homo sapiens
tggcttcatctgcagcactgcc

SEQ ID NO: 9142660 - DNA, 22 bp, Homo sapiens
tggctgagaccttcccaaattc

SEQ ID NO: 9142661 - DNA, 22 bp, Homo sapiens
tggctgagaccttcccaaattc

SEQ ID NO: 9142662 - DNA, 22 bp, Homo sapiens
tggctgagagaagacggggaag

SEQ ID NO: 9142663 - DNA, 22 bp, Homo sapiens
tggctgagagaagacggggaag

SEQ ID NO: 9142664 - DNA, 16 bp, Homo sapiens
tggctgagagagggtt

SEQ ID NO: 9142665 - DNA, 16 bp, Homo sapiens
tggctgagagagggtt

SEQ ID NO: 9142666 - DNA, 22 bp, Homo sapiens
tggctgctagccagagcttcag

SEQ ID NO: 9142667 - DNA, 22 bp, Homo sapiens
tggctggctagtgggcaggatt

SEQ ID NO: 9142668 - DNA, 18 bp, Homo sapiens
tggctggctctgtcatct

SEQ ID NO: 9142669 - DNA, 22 bp, Homo sapiens
tggctggctagtgggcaggatt

SEQ ID NO: 9142670 - DNA, 22 bp, Homo sapiens
tggctggctagtgggcaggatt

SEQ ID NO: 9142671 - DNA, 22 bp, Homo sapiens
tggctggctggaccacacctgc

SEQ ID NO: 9142672 - DNA, 22 bp, Homo sapiens
tggctgagaccatcagggtgta

SEQ ID NO: 9142673 - DNA, 22 bp, Homo sapiens
tggctgagaccatcagggtgta

SEQ ID NO: 9142674 - DNA, 22 bp, Homo sapiens
tggctgagaccatcagggtgta

SEQ ID NO: 9142675 - DNA, 22 bp, Homo sapiens
tggctgagaatgggatgatgcc

SEQ ID NO: 9142676 - DNA, 22 bp, Homo sapiens
tggctgagaatgggatgatgcc

SEQ ID NO: 9142677 - DNA, 19 bp, Homo sapiens
tggctctgtcgaaggcaca

SEQ ID NO: 9142678 - DNA, 17 bp, Homo sapiens
tggctctgtcctcagct

SEQ ID NO: 9142679 - DNA, 22 bp, Homo sapiens
tgctgtgggatatatgttcaaa

SEQ ID NO: 9142680 - DNA, 22 bp, Homo sapiens
tgctgtgggcagtacataagct

SEQ ID NO: 9142681 - DNA, 22 bp, Homo sapiens
tgctgtggcagtttatgtatag

SEQ ID NO: 9142682 - DNA, 22 bp, Homo sapiens
tgctgtggttcccagagtggat

SEQ ID NO: 9142683 - DNA, 22 bp, Homo sapiens
tgctgtgtaaaaggtgattgaa

SEQ ID NO: 9142684 - DNA, 18 bp, Homo sapiens
cccggctaatttttggta

SEQ ID NO: 9142685 - DNA, 22 bp, Homo sapiens
tgctgtgtctttctgtgaaaag

SEQ ID NO: 9142686 - DNA, 22 bp, Homo sapiens
tgctgtgtggatgtgaagaatc

SEQ ID NO: 9142687 - DNA, 20 bp, Homo sapiens
tgctgtgtggcccagcatga

SEQ ID NO: 9142688 - DNA, 20 bp, Homo sapiens
tgctgtgtggcccagcatga

SEQ ID NO: 9142689 - DNA, 22 bp, Homo sapiens
tgctgtgtggatgtgaagaatc

SEQ ID NO: 9142690 - DNA, 22 bp, Homo sapiens
tgctgtgttcctcagtttcatg

SEQ ID NO: 9142691 - DNA, 22 bp, Homo sapiens
tgctgtgttcaccaatatgtgt

SEQ ID NO: 9142692 - DNA, 22 bp, Homo sapiens
tgctgtgttaaatacaagcatg

SEQ ID NO: 9142693 - DNA, 22 bp, Homo sapiens
tgctgtgttactgagatccggc

SEQ ID NO: 9142694 - DNA, 22 bp, Homo sapiens
tggaatggaaacaaactgagga

SEQ ID NO: 9142695 - DNA, 22 bp, Homo sapiens
tggaagggagctggaatttgga

SEQ ID NO: 9142696 - DNA, 22 bp, Homo sapiens
tgctgtgttctcctgactcacc

SEQ ID NO: 9142697 - DNA, 22 bp, Homo sapiens
tgctgtgttctcctgactcacc

SEQ ID NO: 9142698 - DNA, 22 bp, Homo sapiens
tggaatgtaaacctcaggtggg

SEQ ID NO: 9142699 - DNA, 22 bp, Homo sapiens
tggaatggaaacaaactgagga

SEQ ID NO: 9142700 - DNA, 22 bp, Homo sapiens
tggaatggaaacaaactgagga

SEQ ID NO: 9142701 - DNA, 22 bp, Homo sapiens
tggaatggaaacaaactgagga

SEQ ID NO: 9142702 - DNA, 22 bp, Homo sapiens
ccctcgccgcagctgcttcccg

SEQ ID NO: 9142703 - DNA, 22 bp, Homo sapiens
ccctcctctccctaagagtcac

SEQ ID NO: 9142704 - DNA, 22 bp, Homo sapiens
ccctcctctccctaagagtcac

SEQ ID NO: 9142705 - DNA, 22 bp, Homo sapiens
ccctctctcaggctgacagcct

SEQ ID NO: 9142706 - DNA, 22 bp, Homo sapiens
ccctctcctggctgcatggagc

SEQ ID NO: 9142707 - DNA, 22 bp, Homo sapiens
ccctgaaagtacactgggacgg

SEQ ID NO: 9142708 - DNA, 22 bp, Homo sapiens
ccctgaaatcctgtgctctgtg

SEQ ID NO: 9142709 - DNA, 22 bp, Homo sapiens
ccctctccctgcagaatgtggc

SEQ ID NO: 9142710 - DNA, 22 bp, Homo sapiens
ccctctcagtcagagccagata

SEQ ID NO: 9142711 - DNA, 18 bp, Homo sapiens
ccctctcctgctagtggg

SEQ ID NO: 9142712 - DNA, 20 bp, Homo sapiens
ccctgagaccagagagcagc

SEQ ID NO: 9142713 - DNA, 20 bp, Homo sapiens
ccctgagaccagagagcagc

SEQ ID NO: 9142714 - DNA, 22 bp, Homo sapiens
ccctgagagcagggtctttctc

SEQ ID NO: 9142715 - DNA, 20 bp, Homo sapiens
ccctgagacaaaggaggggc

SEQ ID NO: 9142716 - DNA, 18 bp, Homo sapiens
ccctgaagggcaagataa

SEQ ID NO: 9142717 - DNA, 22 bp, Homo sapiens
ccctgaacagtgagagataggg

SEQ ID NO: 9142718 - DNA, 22 bp, Homo sapiens
ccctgaggaaagggtggagggc

SEQ ID NO: 9142719 - DNA, 16 bp, Homo sapiens
tggagcaggcaggatg

SEQ ID NO: 9142720 - DNA, 22 bp, Homo sapiens
tggagcaggactgctgccctca

SEQ ID NO: 9142721 - DNA, 22 bp, Homo sapiens
tggagcaggacggggagtggta

SEQ ID NO: 9142722 - DNA, 22 bp, Homo sapiens
ccctgagccgctgctccaacct

SEQ ID NO: 9142723 - DNA, 22 bp, Homo sapiens
ccctgagaggttgagtgtctgc

SEQ ID NO: 9142724 - DNA, 22 bp, Homo sapiens
cccaggtctccctgcagccctg

SEQ ID NO: 9142725 - DNA, 22 bp, Homo sapiens
cccaggtctccctgcagccctg

SEQ ID NO: 9142726 - DNA, 22 bp, Homo sapiens
cccaggtctatgccagctctga

SEQ ID NO: 9142727 - DNA, 21 bp, Homo sapiens
cccaggtcgtggtcttcccag

SEQ ID NO: 9142728 - DNA, 22 bp, Homo sapiens
cccaggtcgtcagcagtgtggt

SEQ ID NO: 9142729 - DNA, 22 bp, Homo sapiens
cccaggtcccggggccagctgc

SEQ ID NO: 9142730 - DNA, 23 bp, Homo sapiens
cccaggtcaaaattcacaggcct

SEQ ID NO: 9142731 - DNA, 22 bp, Homo sapiens
ccccaaagctgagttcccgcct

SEQ ID NO: 9142732 - DNA, 22 bp, Homo sapiens
ccccaaagcctcagcctgcctg

SEQ ID NO: 9142733 - DNA, 22 bp, Homo sapiens
ccccaaaacttagtgacttaaa

SEQ ID NO: 9142734 - DNA, 22 bp, Homo sapiens
cccatttttgtgtgagtaatga

SEQ ID NO: 9142735 - DNA, 22 bp, Homo sapiens
cccattttggaacgagtagcca

SEQ ID NO: 9142736 - DNA, 22 bp, Homo sapiens
cccattttgcttatgctgctgt

SEQ ID NO: 9142737 - DNA, 22 bp, Homo sapiens
cccattcttcatacaagtctaa

SEQ ID NO: 9142738 - DNA, 22 bp, Homo sapiens
cccattcttcatggtttcctgt

SEQ ID NO: 9142739 - DNA, 22 bp, Homo sapiens
cccattctaagctttgctcttc

SEQ ID NO: 9142740 - DNA, 22 bp, Homo sapiens
cccattctaggctttgctcttc

SEQ ID NO: 9142741 - DNA, 23 bp, Homo sapiens
cccattttcatgttaactcctgg

SEQ ID NO: 9142742 - DNA, 22 bp, Homo sapiens
cccattttagcaaggggtggcg

SEQ ID NO: 9142743 - DNA, 22 bp, Homo sapiens
ccccaccatgtagaaactgaga

SEQ ID NO: 9142744 - DNA, 22 bp, Homo sapiens
ccccaccaccaaggctcagttt

SEQ ID NO: 9142745 - DNA, 22 bp, Homo sapiens
ccccaccagcaccctctctatc

SEQ ID NO: 9142746 - DNA, 22 bp, Homo sapiens
ccccacccacctaagagaaact

SEQ ID NO: 9142747 - DNA, 22 bp, Homo sapiens
tgctggccaatggcagaggcgg

SEQ ID NO: 9142748 - DNA, 21 bp, Homo sapiens
tgctggccatgtgctgggcat

SEQ ID NO: 9142749 - DNA, 22 bp, Homo sapiens
tgctggccaagcagaggtcaat

SEQ ID NO: 9142750 - DNA, 22 bp, Homo sapiens
ccccacaactcatgttgaaact

SEQ ID NO: 9142751 - DNA, 22 bp, Homo sapiens
ccccacaactcatgttgaaact

SEQ ID NO: 9142752 - DNA, 22 bp, Homo sapiens
ccccacacctgccgggcagcag

SEQ ID NO: 9142753 - DNA, 22 bp, Homo sapiens
ccccacacctgccgggcagcag

SEQ ID NO: 9142754 - DNA, 20 bp, Homo sapiens
ccccacactattgagcactt

SEQ ID NO: 9142755 - DNA, 20 bp, Homo sapiens
ccccacactattgagcactt

SEQ ID NO: 9142756 - DNA, 22 bp, Homo sapiens
ccccacactctttacattcata

SEQ ID NO: 9142757 - DNA, 22 bp, Homo sapiens
ccccacagccgccagcagggag

SEQ ID NO: 9142758 - DNA, 22 bp, Homo sapiens
ccccttctctgcaagcctgctc

SEQ ID NO: 9142759 - DNA, 22 bp, Homo sapiens
ccccttctgtgtcctgtcagcc

SEQ ID NO: 9142760 - DNA, 22 bp, Homo sapiens
cccctttctcccgcgtctggcc

SEQ ID NO: 9142761 - DNA, 22 bp, Homo sapiens
cccctttctcccgcgactggcc

SEQ ID NO: 9142762 - DNA, 22 bp, Homo sapiens
ccccttctgtgtcctgtcagcc

SEQ ID NO: 9142763 - DNA, 22 bp, Homo sapiens
ccccttggctgctctcaagtcc

SEQ ID NO: 9142764 - DNA, 22 bp, Homo sapiens
cccgactagctgggattacagg

SEQ ID NO: 9142765 - DNA, 22 bp, Homo sapiens
cccggacagaggggcagagtgt

SEQ ID NO: 9142766 - DNA, 22 bp, Homo sapiens
ccccttctctgcaagcctgctc

SEQ ID NO: 9142767 - DNA, 22 bp, Homo sapiens
ccccttccttcctcagacagcc

SEQ ID NO: 9142768 - DNA, 22 bp, Homo sapiens
cccctcttggcattgagtgcca

SEQ ID NO: 9142769 - DNA, 22 bp, Homo sapiens
tgctggctttttgtgtcaaaga

SEQ ID NO: 9142770 - DNA, 22 bp, Homo sapiens
tgctggctttgcgagatgcatt

SEQ ID NO: 9142771 - DNA, 22 bp, Homo sapiens
tgctggctaatggaaaccagat

SEQ ID NO: 9142772 - DNA, 22 bp, Homo sapiens
tgctggcctgtccacgggctgt

SEQ ID NO: 9142773 - DNA, 22 bp, Homo sapiens
tgctggcctggttagaaagggg

SEQ ID NO: 9142774 - DNA, 22 bp, Homo sapiens
tgctggcctggttagaaagggg

SEQ ID NO: 9142775 - DNA, 22 bp, Homo sapiens
tgctggcctcggcgctgggcct

SEQ ID NO: 9142776 - DNA, 22 bp, Homo sapiens
tgctggcctcggcgctgggcct

SEQ ID NO: 9142777 - DNA, 22 bp, Homo sapiens
tgctggccctggctcagggaac

SEQ ID NO: 9142778 - DNA, 22 bp, Homo sapiens
tgctggcccatgaagacgcagt

SEQ ID NO: 9142779 - DNA, 22 bp, Homo sapiens
tgctggccggccaggtgctgag

SEQ ID NO: 9142780 - DNA, 21 bp, Homo sapiens
tgctggccatgtgctgggcat

SEQ ID NO: 9142781 - DNA, 22 bp, Homo sapiens
cccaggctggggctcctccagc

SEQ ID NO: 9142782 - DNA, 22 bp, Homo sapiens
cccaggctggggctcctccagc

SEQ ID NO: 9142783 - DNA, 22 bp, Homo sapiens
cccaggctgggaacgattctag

SEQ ID NO: 9142784 - DNA, 22 bp, Homo sapiens
cccaggctggcactgctgaagt

SEQ ID NO: 9142785 - DNA, 22 bp, Homo sapiens
cccaggctggcctccgcagtgc

SEQ ID NO: 9142786 - DNA, 22 bp, Homo sapiens
cccaggctggcactgctgaagt

SEQ ID NO: 9142787 - DNA, 22 bp, Homo sapiens
cccaggctggcactgctgaagt

SEQ ID NO: 9142788 - DNA, 22 bp, Homo sapiens
cccaggctggatttcggtggca

SEQ ID NO: 9142789 - DNA, 22 bp, Homo sapiens
cccaggctggatttcggtggca

SEQ ID NO: 9142790 - DNA, 22 bp, Homo sapiens
cccaggctggagtgtaatggtg

SEQ ID NO: 9142791 - DNA, 22 bp, Homo sapiens
cccaggctggtcctgaactcct

SEQ ID NO: 9142792 - DNA, 22 bp, Homo sapiens
cccaggctggtcctgaactcct

SEQ ID NO: 9142793 - DNA, 21 bp, Homo sapiens
cccagggaagccgcagtcacc

SEQ ID NO: 9142794 - DNA, 22 bp, Homo sapiens
cccagggaaggcagatggagga

SEQ ID NO: 9142795 - DNA, 21 bp, Homo sapiens
cccagggaagccgcagtcacc

SEQ ID NO: 9142796 - DNA, 22 bp, Homo sapiens
cccagggaaggcagatggagga

SEQ ID NO: 9142797 - DNA, 22 bp, Homo sapiens
cccagggaaggcagatggagga

SEQ ID NO: 9142798 - DNA, 22 bp, Homo sapiens
cccagggaaggcagatggagga

SEQ ID NO: 9142799 - DNA, 22 bp, Homo sapiens
cccagggaagggctacctgagg

SEQ ID NO: 9142800 - DNA, 22 bp, Homo sapiens
cccagggaatgactctggcctt

SEQ ID NO: 9142801 - DNA, 22 bp, Homo sapiens
cccagggaatgactctggcctt

SEQ ID NO: 9142802 - DNA, 22 bp, Homo sapiens
cccagggaatgactctggcctt

SEQ ID NO: 9142803 - DNA, 22 bp, Homo sapiens
cccaggctggagtgcaatggca

SEQ ID NO: 9142804 - DNA, 22 bp, Homo sapiens
cccaggctggagtgcaatggca

SEQ ID NO: 9142805 - DNA, 22 bp, Homo sapiens
cccaggctggagtgcaatggtg

SEQ ID NO: 9142806 - DNA, 22 bp, Homo sapiens
cccaggctggagtgcaatggca

SEQ ID NO: 9142807 - DNA, 22 bp, Homo sapiens
cccaggctggagtgcagtggcg

SEQ ID NO: 9142808 - DNA, 22 bp, Homo sapiens
cccaggctggagtgcagtggcg

SEQ ID NO: 9142809 - DNA, 22 bp, Homo sapiens
cccaggctggagtgcaatggtg

SEQ ID NO: 9142810 - DNA, 22 bp, Homo sapiens
cccaggctggagtgcaatggtg

SEQ ID NO: 9142811 - DNA, 22 bp, Homo sapiens
cccaggctggagggcagtgtca

SEQ ID NO: 9142812 - DNA, 22 bp, Homo sapiens
cccaggctggagggcagtgtca

SEQ ID NO: 9142813 - DNA, 22 bp, Homo sapiens
cccaggctggaattccaggcct

SEQ ID NO: 9142814 - DNA, 22 bp, Homo sapiens
cccaggctgagttagaggtgtc

SEQ ID NO: 9142815 - DNA, 22 bp, Homo sapiens
cccaggctggaattccaggcct

SEQ ID NO: 9142816 - DNA, 22 bp, Homo sapiens
cccaggctgagttagaggtgtc

SEQ ID NO: 9142817 - DNA, 22 bp, Homo sapiens
tgccctggtagacacagactgt

SEQ ID NO: 9142818 - DNA, 22 bp, Homo sapiens
tgccctggtagacacagactgt

SEQ ID NO: 9142819 - DNA, 22 bp, Homo sapiens
tgccctggtgaagtgctctcct

SEQ ID NO: 9142820 - DNA, 22 bp, Homo sapiens
tgccctggtgaagtgctctcct

SEQ ID NO: 9142821 - DNA, 22 bp, Homo sapiens
tgccctggtgaagtgctctcct

SEQ ID NO: 9142822 - DNA, 22 bp, Homo sapiens
cccagggattataaaggtgaaa

SEQ ID NO: 9142823 - DNA, 22 bp, Homo sapiens
cccagggattataaaggtgaaa

SEQ ID NO: 9142824 - DNA, 22 bp, Homo sapiens
tgccttagggtacctggtgctt

SEQ ID NO: 9142825 - DNA, 22 bp, Homo sapiens
tgcctgtgttgattactttgtc

SEQ ID NO: 9142826 - DNA, 17 bp, Homo sapiens
cccagggaccactgctt

SEQ ID NO: 9142827 - DNA, 22 bp, Homo sapiens
cccagggacagctaggtggggc

SEQ ID NO: 9142828 - DNA, 22 bp, Homo sapiens
cccagggacagatgggcagcta

SEQ ID NO: 9142829 - DNA, 22 bp, Homo sapiens
cccagggacagctaggtggggc

SEQ ID NO: 9142830 - DNA, 22 bp, Homo sapiens
cccagggacagatgggcagcta

SEQ ID NO: 9142831 - DNA, 22 bp, Homo sapiens
cccagggacagatgggcagcta

SEQ ID NO: 9142832 - DNA, 22 bp, Homo sapiens
cccagggtagctgagctggcag

SEQ ID NO: 9142833 - DNA, 22 bp, Homo sapiens
cccagggtccctgctctctgtg

SEQ ID NO: 9142834 - DNA, 22 bp, Homo sapiens
cccagggtccctgctctctgtg

SEQ ID NO: 9142835 - DNA, 22 bp, Homo sapiens
cccagggtgctaattaaatatg

SEQ ID NO: 9142836 - DNA, 22 bp, Homo sapiens
cccagggtccggataaccctgg

SEQ ID NO: 9142837 - DNA, 22 bp, Homo sapiens
cccagggttgcctgcctctgct

SEQ ID NO: 9142838 - DNA, 19 bp, Homo sapiens
cccagggtttcctctctcc

SEQ ID NO: 9142839 - DNA, 22 bp, Homo sapiens
cccagggtggatgcaagcagca

SEQ ID NO: 9142840 - DNA, 22 bp, Homo sapiens
cccagggttgcctgcctctgct

SEQ ID NO: 9142841 - DNA, 19 bp, Homo sapiens
cccagggtttcctctctcc

SEQ ID NO: 9142842 - DNA, 22 bp, Homo sapiens
cccaggtagtgagaaatggagg

SEQ ID NO: 9142843 - DNA, 22 bp, Homo sapiens
cccaggtagtgagaaatggagg

SEQ ID NO: 9142844 - DNA, 22 bp, Homo sapiens
cccaggtagttggaagagacaa

SEQ ID NO: 9142845 - DNA, 22 bp, Homo sapiens
cccaggtagttggaagagacaa

SEQ ID NO: 9142846 - DNA, 22 bp, Homo sapiens
cccaggtagttggaagagacaa

SEQ ID NO: 9142847 - DNA, 22 bp, Homo sapiens
cccaggggttcaaggctgcagt

SEQ ID NO: 9142848 - DNA, 22 bp, Homo sapiens
cccaggggttcaaggctgcagt

SEQ ID NO: 9142849 - DNA, 22 bp, Homo sapiens
cccaggggttctagaccagctt

SEQ ID NO: 9142850 - DNA, 22 bp, Homo sapiens
cccagggtagctgagctggcag

SEQ ID NO: 9142851 - DNA, 20 bp, Homo sapiens
cccaggggttgtggtgagga

SEQ ID NO: 9142852 - DNA, 22 bp, Homo sapiens
cccaggggttctgagcagcagc

SEQ ID NO: 9142853 - DNA, 20 bp, Homo sapiens
cccaggggttgtggtgagga

SEQ ID NO: 9142854 - DNA, 20 bp, Homo sapiens
cccaggggttgtggtgagga

SEQ ID NO: 9142855 - DNA, 22 bp, Homo sapiens
cccaggcagtgtgtgcatgcgt

SEQ ID NO: 9142856 - DNA, 19 bp, Homo sapiens
cccaggctacatggagagg

SEQ ID NO: 9142857 - DNA, 22 bp, Homo sapiens
cccaggcagtgtgtgcatgcgt

SEQ ID NO: 9142858 - DNA, 22 bp, Homo sapiens
tgcccagcgcccacattctgtc

SEQ ID NO: 9142859 - DNA, 22 bp, Homo sapiens
tgcccagcgcccacattctgtc

SEQ ID NO: 9142860 - DNA, 22 bp, Homo sapiens
tgcccagccagtttatggtaat

SEQ ID NO: 9142861 - DNA, 22 bp, Homo sapiens
tgccagttgggaaaacagacat

SEQ ID NO: 9142862 - DNA, 22 bp, Homo sapiens
tgccagttgggaaaacagacat

SEQ ID NO: 9142863 - DNA, 22 bp, Homo sapiens
tgccagtgtggaactaggaaga

SEQ ID NO: 9142864 - DNA, 22 bp, Homo sapiens
cccaggctcactgtccgcttcc

SEQ ID NO: 9142865 - DNA, 22 bp, Homo sapiens
cccaggctcactgtccgcttcc

SEQ ID NO: 9142866 - DNA, 22 bp, Homo sapiens
cccaggctcagactggcttgtt

SEQ ID NO: 9142867 - DNA, 22 bp, Homo sapiens
cccaggctcagactggcttgtt

SEQ ID NO: 9142868 - DNA, 22 bp, Homo sapiens
cccaggctcccaggtgggacaa

SEQ ID NO: 9142869 - DNA, 22 bp, Homo sapiens
cccaggctcccaggtgggacaa

SEQ ID NO: 9142870 - DNA, 22 bp, Homo sapiens
cccaggctagtatgatatcagt

SEQ ID NO: 9142871 - DNA, 22 bp, Homo sapiens
cccaggctagtatgatatcagt

SEQ ID NO: 9142872 - DNA, 22 bp, Homo sapiens
cccaggctagaaaggccaacaa

SEQ ID NO: 9142873 - DNA, 22 bp, Homo sapiens
cccaggctagaaaggccaacaa

SEQ ID NO: 9142874 - DNA, 22 bp, Homo sapiens
tgccctgggagttggagctgct

SEQ ID NO: 9142875 - DNA, 22 bp, Homo sapiens
cccaggctcccaggtgggacaa

SEQ ID NO: 9142876 - DNA, 22 bp, Homo sapiens
cccaggctcctactgtattctg

SEQ ID NO: 9142877 - DNA, 22 bp, Homo sapiens
tgccctggggagcccagccagg

SEQ ID NO: 9142878 - DNA, 21 bp, Homo sapiens
tgccctggggctcttccctca

SEQ ID NO: 9142879 - DNA, 21 bp, Homo sapiens
tgccctggggctcttccctca

SEQ ID NO: 9142880 - DNA, 22 bp, Homo sapiens
tgccagtctcaccctgggtcct

SEQ ID NO: 9142881 - DNA, 22 bp, Homo sapiens
tgccagtgaaacgtggtctcat

SEQ ID NO: 9142882 - DNA, 22 bp, Homo sapiens
tgccagtgcttgtgtctgagca

SEQ ID NO: 9142883 - DNA, 22 bp, Homo sapiens
cccaggagagaggggataaagc

SEQ ID NO: 9142884 - DNA, 22 bp, Homo sapiens
cccaggagacctgtgaaaggac

SEQ ID NO: 9142885 - DNA, 22 bp, Homo sapiens
cccaggagacctgtgaaaggac

SEQ ID NO: 9142886 - DNA, 22 bp, Homo sapiens
cccaggagactgagctgtaacc

SEQ ID NO: 9142887 - DNA, 22 bp, Homo sapiens
cccaggagacctagatctgttt

SEQ ID NO: 9142888 - DNA, 22 bp, Homo sapiens
cccaggagacatatagaaggac

SEQ ID NO: 9142889 - DNA, 22 bp, Homo sapiens
tgccaggaggggacacctcctc

SEQ ID NO: 9142890 - DNA, 22 bp, Homo sapiens
tgccaggagtcaggccaggcag

SEQ ID NO: 9142891 - DNA, 22 bp, Homo sapiens
tgccaggagtgtagagtggttt

SEQ ID NO: 9142892 - DNA, 22 bp, Homo sapiens
tgccagctccgaggagctgcag

SEQ ID NO: 9142893 - DNA, 22 bp, Homo sapiens
tgccagctccgaggagctgcag

SEQ ID NO: 9142894 - DNA, 22 bp, Homo sapiens
tgccagctccgaggagctgcag

SEQ ID NO: 9142895 - DNA, 22 bp, Homo sapiens
tgccagctccgaggagctgcag

SEQ ID NO: 9142896 - DNA, 22 bp, Homo sapiens
tgccacagaggtgaagcccact

SEQ ID NO: 9142897 - DNA, 22 bp, Homo sapiens
tgcacagatctggtggcaagga

SEQ ID NO: 9142898 - DNA, 22 bp, Homo sapiens
tgcacagatagtgatagatagc

SEQ ID NO: 9142899 - DNA, 22 bp, Homo sapiens
tgcacagagggaggcataaaat

SEQ ID NO: 9142900 - DNA, 22 bp, Homo sapiens
tgcacagagctggactccgcgg

SEQ ID NO: 9142901 - DNA, 22 bp, Homo sapiens
tgcacagacatacacatatatg

SEQ ID NO: 9142902 - DNA, 22 bp, Homo sapiens
tgccagctgacagcagagacaa

SEQ ID NO: 9142903 - DNA, 22 bp, Homo sapiens
tgccagctcctgcagctcctgt

SEQ ID NO: 9142904 - DNA, 22 bp, Homo sapiens
tgccagcttgtggtcagaggct

SEQ ID NO: 9142905 - DNA, 22 bp, Homo sapiens
tgccagcttgtggtcagaggct

SEQ ID NO: 9142906 - DNA, 22 bp, Homo sapiens
tgccagcttctaaggacccagg

SEQ ID NO: 9142907 - DNA, 22 bp, Homo sapiens
tgccagcttcttacggctgcct

SEQ ID NO: 9142908 - DNA, 22 bp, Homo sapiens
tgccaggacaaggaccacatgg

SEQ ID NO: 9142909 - DNA, 22 bp, Homo sapiens
tgccaggaacctgttcttgttc

SEQ ID NO: 9142910 - DNA, 22 bp, Homo sapiens
tgccaggaagtgtgtgggcctg

SEQ ID NO: 9142911 - DNA, 22 bp, Homo sapiens
tgccaggaaactgtatatcttg

SEQ ID NO: 9142912 - DNA, 22 bp, Homo sapiens
tgccaggagagtgcatgcaggg

SEQ ID NO: 9142913 - DNA, 22 bp, Homo sapiens
caggctacatttgctctgagaa

SEQ ID NO: 9142914 - DNA, 22 bp, Homo sapiens
caggctacatttgctctgagaa

SEQ ID NO: 9142915 - DNA, 22 bp, Homo sapiens
caggctagattggggccagtag

SEQ ID NO: 9142916 - DNA, 22 bp, Homo sapiens
tacttgttgatcagttgttaaa

SEQ ID NO: 9142917 - DNA, 22 bp, Homo sapiens
tacttgttatcatcttttcctt

SEQ ID NO: 9142918 - DNA, 22 bp, Homo sapiens
tacttgttaggaatttctacta

SEQ ID NO: 9142919 - DNA, 22 bp, Homo sapiens
tacttgttaggaatttctacta

SEQ ID NO: 9142920 - DNA, 22 bp, Homo sapiens
tacttgttctttcaagagatag

SEQ ID NO: 9142921 - DNA, 22 bp, Homo sapiens
tacttgttatcatcttttcctt

SEQ ID NO: 9142922 - DNA, 22 bp, Homo sapiens
tacttgttatcatcttttcctt

SEQ ID NO: 9142923 - DNA, 22 bp, Homo sapiens
tacttgttatcccttactcttg

SEQ ID NO: 9142924 - DNA, 22 bp, Homo sapiens
tactttagaaggaaataagttc

SEQ ID NO: 9142925 - DNA, 22 bp, Homo sapiens
caggcgagggccctgaggagcc

SEQ ID NO: 9142926 - DNA, 22 bp, Homo sapiens
caggcctttgggaatcaccaca

SEQ ID NO: 9142927 - DNA, 22 bp, Homo sapiens
caggccttttttcctgcagtgt

SEQ ID NO: 9142928 - DNA, 22 bp, Homo sapiens
caggccttttttcctgcagtgt

SEQ ID NO: 9142929 - DNA, 22 bp, Homo sapiens
caggcggccatgatctggcagg

SEQ ID NO: 9142930 - DNA, 22 bp, Homo sapiens
caggcgggacgtgggaggatca

SEQ ID NO: 9142931 - DNA, 22 bp, Homo sapiens
caggcctttctggggaagtgag

SEQ ID NO: 9142932 - DNA, 22 bp, Homo sapiens
tacatttataaggcttctctgt

SEQ ID NO: 9142933 - DNA, 22 bp, Homo sapiens
tacatttacagagccttctctg

SEQ ID NO: 9142934 - DNA, 22 bp, Homo sapiens
tacattgtttgagatagtttgt

SEQ ID NO: 9142935 - DNA, 22 bp, Homo sapiens
tacattgtttgagatagtttgt

SEQ ID NO: 9142936 - DNA, 22 bp, Homo sapiens
tacattgtgttaaaacagaaga

SEQ ID NO: 9142937 - DNA, 22 bp, Homo sapiens
tacattgattcaggatataggc

SEQ ID NO: 9142938 - DNA, 22 bp, Homo sapiens
tacattgtgatgtttcaataca

SEQ ID NO: 9142939 - DNA, 22 bp, Homo sapiens
tacattgtgtctctatctagtc

SEQ ID NO: 9142940 - DNA, 18 bp, Homo sapiens
caggcctcttgatcttcc

SEQ ID NO: 9142941 - DNA, 22 bp, Homo sapiens
caggcctcttccatgcagcagc

SEQ ID NO: 9142942 - DNA, 22 bp, Homo sapiens
caggcctgaccctgagcttcac

SEQ ID NO: 9142943 - DNA, 22 bp, Homo sapiens
caggcctgaccctgagcttcac

SEQ ID NO: 9142944 - DNA, 22 bp, Homo sapiens
caggcctgatacactgaactct

SEQ ID NO: 9142945 - DNA, 22 bp, Homo sapiens
caggcctgagtgtggaagtctt

SEQ ID NO: 9142946 - DNA, 22 bp, Homo sapiens
caggcctgcaggaaaggctccc

SEQ ID NO: 9142947 - DNA, 22 bp, Homo sapiens
caggcctgcttcttacccttca

SEQ ID NO: 9142948 - DNA, 22 bp, Homo sapiens
tacatgttatttcactattggt

SEQ ID NO: 9142949 - DNA, 22 bp, Homo sapiens
caggcctctccttagtctggca

SEQ ID NO: 9142950 - DNA, 22 bp, Homo sapiens
caggcctctccttagtctggca

SEQ ID NO: 9142951 - DNA, 22 bp, Homo sapiens
caggcctctatggtcagctgag

SEQ ID NO: 9142952 - DNA, 22 bp, Homo sapiens
caggcctctatggtcagctgag

SEQ ID NO: 9142953 - DNA, 22 bp, Homo sapiens
caggcctctatggtcagctgag

SEQ ID NO: 9142954 - DNA, 22 bp, Homo sapiens
caggcctctatggtcagctgag

SEQ ID NO: 9142955 - DNA, 22 bp, Homo sapiens
caggcctcgaggagacagctac

SEQ ID NO: 9142956 - DNA, 22 bp, Homo sapiens
caggcctcgaggagacagctac

SEQ ID NO: 9142957 - DNA, 22 bp, Homo sapiens
caggcccagggagggagaccaa

SEQ ID NO: 9142958 - DNA, 22 bp, Homo sapiens
tagaaaatgttccactgccatt

SEQ ID NO: 9142959 - DNA, 22 bp, Homo sapiens
tagaaaatagggcctgtggagc

SEQ ID NO: 9142960 - DNA, 22 bp, Homo sapiens
tagaaaatagggcctgtggagc

SEQ ID NO: 9142961 - DNA, 22 bp, Homo sapiens
caggctgggaacgccacccgct

SEQ ID NO: 9142962 - DNA, 22 bp, Homo sapiens
caggctggcaatgcgtcaagca

SEQ ID NO: 9142963 - DNA, 22 bp, Homo sapiens
caggctggcaatgcgtcaagca

SEQ ID NO: 9142964 - DNA, 22 bp, Homo sapiens
caggctggagttcagtggtgtg

SEQ ID NO: 9142965 - DNA, 22 bp, Homo sapiens
caggctgggactgacccctgct

SEQ ID NO: 9142966 - DNA, 22 bp, Homo sapiens
caggctgcatggaggggtacag

SEQ ID NO: 9142967 - DNA, 22 bp, Homo sapiens
caggctgccctagcttggacat

SEQ ID NO: 9142968 - DNA, 22 bp, Homo sapiens
caggctgccgtgaagcaggcct

SEQ ID NO: 9142969 - DNA, 22 bp, Homo sapiens
caggctgccgaggctgcagaat

SEQ ID NO: 9142970 - DNA, 22 bp, Homo sapiens
caggctgccgtgaagcaggcct

SEQ ID NO: 9142971 - DNA, 22 bp, Homo sapiens
caggctggagttcagtggtgtg

SEQ ID NO: 9142972 - DNA, 22 bp, Homo sapiens
caggctggagttcagtggtgtg

SEQ ID NO: 9142973 - DNA, 22 bp, Homo sapiens
caggctggagttcagtggtgtg

SEQ ID NO: 9142974 - DNA, 22 bp, Homo sapiens
caggctgccgtgaagcaggcct

SEQ ID NO: 9142975 - DNA, 22 bp, Homo sapiens
caggctgccgtgaagcaggcct

SEQ ID NO: 9142976 - DNA, 22 bp, Homo sapiens
tagatacaggctctctgagcct

SEQ ID NO: 9142977 - DNA, 20 bp, Homo sapiens
cagggacagcagtgggtttt

SEQ ID NO: 9142978 - DNA, 20 bp, Homo sapiens
cagggacagcagtgggtttt

SEQ ID NO: 9142979 - DNA, 22 bp, Homo sapiens
cagggaaggctgcaaatgttaa

SEQ ID NO: 9142980 - DNA, 22 bp, Homo sapiens
cagggaaggctgcaaatgttaa

SEQ ID NO: 9142981 - DNA, 22 bp, Homo sapiens
cagggaaggctgcaaatgttaa

SEQ ID NO: 9142982 - DNA, 22 bp, Homo sapiens
cagggaatccatggtcataagg

SEQ ID NO: 9142983 - DNA, 22 bp, Homo sapiens
cagggacaaacaaggttgggga

SEQ ID NO: 9142984 - DNA, 22 bp, Homo sapiens
cagggacaatggcagagcctga

SEQ ID NO: 9142985 - DNA, 22 bp, Homo sapiens
cagggacaatggcagagcctga

SEQ ID NO: 9142986 - DNA, 20 bp, Homo sapiens
cagggacagcagtgggtttt

SEQ ID NO: 9142987 - DNA, 22 bp, Homo sapiens
cagggaaagttcttgtccactc

SEQ ID NO: 9142988 - DNA, 22 bp, Homo sapiens
cagggaacaagatgagaatgga

SEQ ID NO: 9142989 - DNA, 22 bp, Homo sapiens
cagggaagaatagttagcaaag

SEQ ID NO: 9142990 - DNA, 22 bp, Homo sapiens
cagggaagaatagttagcaaag

SEQ ID NO: 9142991 - DNA, 22 bp, Homo sapiens
cagggaagagccgatgctgcag

SEQ ID NO: 9142992 - DNA, 22 bp, Homo sapiens
cagggaagagccgatgctgcag

SEQ ID NO: 9142993 - DNA, 22 bp, Homo sapiens
cagggaagagccgatgctgcag

SEQ ID NO: 9142994 - DNA, 22 bp, Homo sapiens
caggctttttctgctgtcctct

SEQ ID NO: 9142995 - DNA, 22 bp, Homo sapiens
caggcttggagggcagtggcat

SEQ ID NO: 9142996 - DNA, 22 bp, Homo sapiens
caggcttggcagggaggctggt

SEQ ID NO: 9142997 - DNA, 22 bp, Homo sapiens
taatgtctgtgtttcagtgcag

SEQ ID NO: 9142998 - DNA, 22 bp, Homo sapiens
taatgtcttcttttaatttggc

SEQ ID NO: 9142999 - DNA, 22 bp, Homo sapiens
taatgtcttagtaccttaattt

SEQ ID NO: 9143000 - DNA, 22 bp, Homo sapiens
taatgtctccagggttgaccta

SEQ ID NO: 9143001 - DNA, 22 bp, Homo sapiens
taatgtctgatagtgatggctc

SEQ ID NO: 9143002 - DNA, 22 bp, Homo sapiens
taatgtctccagggttgaccta

SEQ ID NO: 9143003 - DNA, 22 bp, Homo sapiens
taatgtctagatcagacctcga

SEQ ID NO: 9143004 - DNA, 22 bp, Homo sapiens
taatgtctatgggccagataat

SEQ ID NO: 9143005 - DNA, 22 bp, Homo sapiens
taatgtctatgggccagataat

SEQ ID NO: 9143006 - DNA, 22 bp, Homo sapiens
taatgtcaaggtcattctagag

SEQ ID NO: 9143007 - DNA, 22 bp, Homo sapiens
taatgtcttgtgagagctggag

SEQ ID NO: 9143008 - DNA, 22 bp, Homo sapiens
taatgtcttgccttcctccccc

SEQ ID NO: 9143009 - DNA, 22 bp, Homo sapiens
taatgtctttaagagcattggg

SEQ ID NO: 9143010 - DNA, 22 bp, Homo sapiens
taatgtgaagacataaatcaga

SEQ ID NO: 9143011 - DNA, 22 bp, Homo sapiens
taatgtgtcctgaaagcttctg

SEQ ID NO: 9143012 - DNA, 22 bp, Homo sapiens
taatgtgaagacataaatcaga

SEQ ID NO: 9143013 - DNA, 22 bp, Homo sapiens
taatgtgttgaatatttgtaca

SEQ ID NO: 9143014 - DNA, 22 bp, Homo sapiens
taatgtgtgtcatcagtagagt

SEQ ID NO: 9143015 - DNA, 22 bp, Homo sapiens
caggcatggagaggcagagact

SEQ ID NO: 9143016 - DNA, 22 bp, Homo sapiens
caggcatggaaaagcccagagg

SEQ ID NO: 9143017 - DNA, 22 bp, Homo sapiens
caggcatgatcataggagttta

SEQ ID NO: 9143018 - DNA, 22 bp, Homo sapiens
caggcatgagccaggcccctcc

SEQ ID NO: 9143019 - DNA, 22 bp, Homo sapiens
caggcatgagccaggcccctcc

SEQ ID NO: 9143020 - DNA, 22 bp, Homo sapiens
caggcatgatcataggagttta

SEQ ID NO: 9143021 - DNA, 22 bp, Homo sapiens
taatgtataacaaatactcatc

SEQ ID NO: 9143022 - DNA, 22 bp, Homo sapiens
taatccagcgggtgattgcaca

SEQ ID NO: 9143023 - DNA, 22 bp, Homo sapiens
taatcacttttcattagtacct

SEQ ID NO: 9143024 - DNA, 22 bp, Homo sapiens
taatcactgggcgtttggtact

SEQ ID NO: 9143025 - DNA, 22 bp, Homo sapiens
taatcactgtcaacctttgttc

SEQ ID NO: 9143026 - DNA, 22 bp, Homo sapiens
taatcactgtgagtctgttttc

SEQ ID NO: 9143027 - DNA, 22 bp, Homo sapiens
taatcatggcctcaaattttat

SEQ ID NO: 9143028 - DNA, 22 bp, Homo sapiens
taatcatatgggtaatccaatg

SEQ ID NO: 9143029 - DNA, 22 bp, Homo sapiens
taatccacaatagagattatct

SEQ ID NO: 9143030 - DNA, 22 bp, Homo sapiens
taatcacagaaacagactgttt

SEQ ID NO: 9143031 - DNA, 22 bp, Homo sapiens
taatacagacaacttgccaaat

SEQ ID NO: 9143032 - DNA, 22 bp, Homo sapiens
taatatttctaccctgctgcct

SEQ ID NO: 9143033 - DNA, 22 bp, Homo sapiens
taatatgtgttactgacttttt

SEQ ID NO: 9143034 - DNA, 22 bp, Homo sapiens
caggcccacgaggcacacagag

SEQ ID NO: 9143035 - DNA, 22 bp, Homo sapiens
caggcccacgaggcacacagag

SEQ ID NO: 9143036 - DNA, 22 bp, Homo sapiens
caggccagtgtgcttcccaggc

SEQ ID NO: 9143037 - DNA, 19 bp, Homo sapiens
caggccagtgtcagggggc

SEQ ID NO: 9143038 - DNA, 19 bp, Homo sapiens
caggccagtgtcagggggc

SEQ ID NO: 9143039 - DNA, 19 bp, Homo sapiens
caggccagtgtcagggggc

SEQ ID NO: 9143040 - DNA, 19 bp, Homo sapiens
caggccagtgtcagggggc

SEQ ID NO: 9143041 - DNA, 19 bp, Homo sapiens
caggccagtgtcagggggc

SEQ ID NO: 9143042 - DNA, 22 bp, Homo sapiens
caggccagggttgagaagagaa

SEQ ID NO: 9143043 - DNA, 22 bp, Homo sapiens
caggccagggttgagaagagaa

SEQ ID NO: 9143044 - DNA, 22 bp, Homo sapiens
caggccagggttgagaagagaa

SEQ ID NO: 9143045 - DNA, 22 bp, Homo sapiens
caggccagggttgagaagagaa

SEQ ID NO: 9143046 - DNA, 22 bp, Homo sapiens
caggcatgtggcccaggggtga

SEQ ID NO: 9143047 - DNA, 22 bp, Homo sapiens
caggcatgtggcccaggggtga

SEQ ID NO: 9143048 - DNA, 22 bp, Homo sapiens
caggcattcctctatgaatatt

SEQ ID NO: 9143049 - DNA, 22 bp, Homo sapiens
caggcatgggccatgggaagtg

SEQ ID NO: 9143050 - DNA, 22 bp, Homo sapiens
caggcatggatctggaatcatt

SEQ ID NO: 9143051 - DNA, 21 bp, Homo sapiens
caggccaaaaggttcaacatt

SEQ ID NO: 9143052 - DNA, 22 bp, Homo sapiens
tacaaaaaattgatactgacga

SEQ ID NO: 9143053 - DNA, 22 bp, Homo sapiens
tacaaaaaattgatactgacga

SEQ ID NO: 9143054 - DNA, 22 bp, Homo sapiens
tacaaaaaattgatactgacga

SEQ ID NO: 9143055 - DNA, 22 bp, Homo sapiens
tacaaaacagtgctctggtcct

SEQ ID NO: 9143056 - DNA, 22 bp, Homo sapiens
tacaaaacagtgctctggtcct

SEQ ID NO: 9143057 - DNA, 22 bp, Homo sapiens
caggccagagcgcgtggttggg

SEQ ID NO: 9143058 - DNA, 22 bp, Homo sapiens
caggccagagcgcgtggttggg

SEQ ID NO: 9143059 - DNA, 22 bp, Homo sapiens
caggccagggttgagaagagaa

SEQ ID NO: 9143060 - DNA, 22 bp, Homo sapiens
taagtattggcctatagctaga

SEQ ID NO: 9143061 - DNA, 22 bp, Homo sapiens
taagtattggcctatagctaga

SEQ ID NO: 9143062 - DNA, 22 bp, Homo sapiens
taagtattggcctatagctaga

SEQ ID NO: 9143063 - DNA, 23 bp, Homo sapiens
cagctcagcacataggaggtact

SEQ ID NO: 9143064 - DNA, 22 bp, Homo sapiens
taagtcttgaaatatttcctat

SEQ ID NO: 9143065 - DNA, 22 bp, Homo sapiens
taagtgaaatggtgcatcaaat

SEQ ID NO: 9143066 - DNA, 22 bp, Homo sapiens
cagctcacccatcacgtctgct

SEQ ID NO: 9143067 - DNA, 22 bp, Homo sapiens
cagctcaagtttcccaggtcag

SEQ ID NO: 9143068 - DNA, 22 bp, Homo sapiens
cagctcagacgcaggtcgagca

SEQ ID NO: 9143069 - DNA, 22 bp, Homo sapiens
cagctcagacgcaggtcgagca

SEQ ID NO: 9143070 - DNA, 20 bp, Homo sapiens
gtgcttcagaagccattgct

SEQ ID NO: 9143071 - DNA, 22 bp, Homo sapiens
gtgcttaaaacagaaaacattg

SEQ ID NO: 9143072 - DNA, 22 bp, Homo sapiens
gtgcttaaggcagtctgtcaaa

SEQ ID NO: 9143073 - DNA, 22 bp, Homo sapiens
gtgcttctctgctctacccggc

SEQ ID NO: 9143074 - DNA, 22 bp, Homo sapiens
taatacaatggagttgggcccc

SEQ ID NO: 9143075 - DNA, 22 bp, Homo sapiens
taatacaatggagttgggcccc

SEQ ID NO: 9143076 - DNA, 22 bp, Homo sapiens
taatacaaggcaggaagcagta

SEQ ID NO: 9143077 - DNA, 22 bp, Homo sapiens
taatacaaggcaggaagcagta

SEQ ID NO: 9143078 - DNA, 22 bp, Homo sapiens
taatacaatggagttgggcccc

SEQ ID NO: 9143079 - DNA, 22 bp, Homo sapiens
taatacaaggcaggaagcagta

SEQ ID NO: 9143080 - DNA, 21 bp, Homo sapiens
taataattccactacagagta

SEQ ID NO: 9143081 - DNA, 21 bp, Homo sapiens
taataattccactacagagta

SEQ ID NO: 9143082 - DNA, 22 bp, Homo sapiens
taataattggcaatgttgagca

SEQ ID NO: 9143083 - DNA, 22 bp, Homo sapiens
taataattggcaatgttgagca

SEQ ID NO: 9143084 - DNA, 22 bp, Homo sapiens
taataattttaaagaaggctag

SEQ ID NO: 9143085 - DNA, 22 bp, Homo sapiens
taataattttaaagaaggctag

SEQ ID NO: 9143086 - DNA, 22 bp, Homo sapiens
taataattggctaaccctggga

SEQ ID NO: 9143087 - DNA, 22 bp, Homo sapiens
taataattggctaaccctggga

SEQ ID NO: 9143088 - DNA, 22 bp, Homo sapiens
caggcagcagccactctggtat

SEQ ID NO: 9143089 - DNA, 22 bp, Homo sapiens
taataattaacagtgatgggtc

SEQ ID NO: 9143090 - DNA, 22 bp, Homo sapiens
taataattagttattgatcgtg

SEQ ID NO: 9143091 - DNA, 22 bp, Homo sapiens
taataattagttattgatcgtg

SEQ ID NO: 9143092 - DNA, 21 bp, Homo sapiens
taataattccactacagagta

SEQ ID NO: 9143093 - DNA, 22 bp, Homo sapiens
caggcagcagaggagtgtggga

SEQ ID NO: 9143094 - DNA, 22 bp, Homo sapiens
caggcagatgctgacaagagtt

SEQ ID NO: 9143095 - DNA, 22 bp, Homo sapiens
caggcagatgctgacaagagtt

SEQ ID NO: 9143096 - DNA, 22 bp, Homo sapiens
caggcagatgctgacaagagtt

SEQ ID NO: 9143097 - DNA, 22 bp, Homo sapiens
caggcagatgctgacaagagtt

SEQ ID NO: 9143098 - DNA, 22 bp, Homo sapiens
caggcagagttagagcaactgg

SEQ ID NO: 9143099 - DNA, 22 bp, Homo sapiens
caggcagagttagtgatttagg

SEQ ID NO: 9143100 - DNA, 22 bp, Homo sapiens
caggcagagctgaagatagatg

SEQ ID NO: 9143101 - DNA, 22 bp, Homo sapiens
caggcaccccaggtgagcactg

SEQ ID NO: 9143102 - DNA, 22 bp, Homo sapiens
caggcaccacactaggggctga

SEQ ID NO: 9143103 - DNA, 22 bp, Homo sapiens
caggcaccagtgagaagggcct

SEQ ID NO: 9143104 - DNA, 22 bp, Homo sapiens
caggcaccagtgagaagggcct

SEQ ID NO: 9143105 - DNA, 22 bp, Homo sapiens
caggcacctgtgtgtctcaggg

SEQ ID NO: 9143106 - DNA, 22 bp, Homo sapiens
caggcaccctctgaggggaagc

SEQ ID NO: 9143107 - DNA, 22 bp, Homo sapiens
tcaaaacactattacctttaat

SEQ ID NO: 9143108 - DNA, 22 bp, Homo sapiens
tcaaaacactattacctttaat

SEQ ID NO: 9143109 - DNA, 22 bp, Homo sapiens
tcaaaacactattacctttaat

SEQ ID NO: 9143110 - DNA, 19 bp, Homo sapiens
tcaagatggatggctccca

SEQ ID NO: 9143111 - DNA, 22 bp, Homo sapiens
tcaagatgtccagtgcctataa

SEQ ID NO: 9143112 - DNA, 19 bp, Homo sapiens
tcaagatggatggctccca

SEQ ID NO: 9143113 - DNA, 22 bp, Homo sapiens
tcaatagataaagctacataaa

SEQ ID NO: 9143114 - DNA, 22 bp, Homo sapiens
tcaagcagggtagcaagctggt

SEQ ID NO: 9143115 - DNA, 22 bp, Homo sapiens
tcaagcagggtagcaagctggt

SEQ ID NO: 9143116 - DNA, 22 bp, Homo sapiens
tcaagcagggtagcaagctggt

SEQ ID NO: 9143117 - DNA, 22 bp, Homo sapiens
tcaaaaatgttttatattggta

SEQ ID NO: 9143118 - DNA, 22 bp, Homo sapiens
tattttaggtaatatccattgt

SEQ ID NO: 9143119 - DNA, 22 bp, Homo sapiens
tattttaggtaatatccattgt

SEQ ID NO: 9143120 - DNA, 22 bp, Homo sapiens
tcaaaacaatcattggatgtgc

SEQ ID NO: 9143121 - DNA, 22 bp, Homo sapiens
tcaaaaattttctgaggatgag

SEQ ID NO: 9143122 - DNA, 19 bp, Homo sapiens
tcaaaacacaaatggttga

SEQ ID NO: 9143123 - DNA, 19 bp, Homo sapiens
tcaaaacacaaatggttga

SEQ ID NO: 9143124 - DNA, 22 bp, Homo sapiens
tcaaaacactattacctttaat

SEQ ID NO: 9143125 - DNA, 22 bp, Homo sapiens
tcaaaacactattacctttaat

SEQ ID NO: 9143126 - DNA, 22 bp, Homo sapiens
tattttaaagtgaagggtcttg

SEQ ID NO: 9143127 - DNA, 22 bp, Homo sapiens
tattttaaagtgaagggtcttg

SEQ ID NO: 9143128 - DNA, 22 bp, Homo sapiens
tattttaaagtgaagggtcttg

SEQ ID NO: 9143129 - DNA, 20 bp, Homo sapiens
tatttgaaatggccaagtgt

SEQ ID NO: 9143130 - DNA, 22 bp, Homo sapiens
tattttaaagactgccagccta

SEQ ID NO: 9143131 - DNA, 22 bp, Homo sapiens
cagtcactggttctataggccc

SEQ ID NO: 9143132 - DNA, 22 bp, Homo sapiens
cagtcaggggtgggatcaaggc

SEQ ID NO: 9143133 - DNA, 22 bp, Homo sapiens
cagtcactggaatagctgagga

SEQ ID NO: 9143134 - DNA, 22 bp, Homo sapiens
cagtcaccaccaggtggcagta

SEQ ID NO: 9143135 - DNA, 22 bp, Homo sapiens
cagtcacattgccctgcattta

SEQ ID NO: 9143136 - DNA, 22 bp, Homo sapiens
cagtcaaacttataggcacatt

SEQ ID NO: 9143137 - DNA, 22 bp, Homo sapiens
cagtcacataggtatacacata

SEQ ID NO: 9143138 - DNA, 22 bp, Homo sapiens
cagtcacaggtggagaaccgag

SEQ ID NO: 9143139 - DNA, 17 bp, Homo sapiens
cagtcacaggtcttttc

SEQ ID NO: 9143140 - DNA, 22 bp, Homo sapiens
cagtcacaggtggagaaccgag

SEQ ID NO: 9143141 - DNA, 21 bp, Homo sapiens
cagtattttaagcagtgagtt

SEQ ID NO: 9143142 - DNA, 22 bp, Homo sapiens
cagtattttcaggatttggaag

SEQ ID NO: 9143143 - DNA, 22 bp, Homo sapiens
cagtatttttaagctgctttgt

SEQ ID NO: 9143144 - DNA, 19 bp, Homo sapiens
caggtggtaatctgagcct

SEQ ID NO: 9143145 - DNA, 22 bp, Homo sapiens
caggtggtacttaaagtcagaa

SEQ ID NO: 9143146 - DNA, 17 bp, Homo sapiens
caggtatttaggcattg

SEQ ID NO: 9143147 - DNA, 22 bp, Homo sapiens
caggtattcatagaattcagag

SEQ ID NO: 9143148 - DNA, 20 bp, Homo sapiens
caggtattacttcctttatg

SEQ ID NO: 9143149 - DNA, 22 bp, Homo sapiens
caggtcagaggtagatgagatg

SEQ ID NO: 9143150 - DNA, 22 bp, Homo sapiens
caggtcagaggtagatgagatg

SEQ ID NO: 9143151 - DNA, 22 bp, Homo sapiens
caggtattaataaatggagagt

SEQ ID NO: 9143152 - DNA, 22 bp, Homo sapiens
caggtaggcagccggtctctgg

SEQ ID NO: 9143153 - DNA, 22 bp, Homo sapiens
caggtagggatatgatggtgat

SEQ ID NO: 9143154 - DNA, 22 bp, Homo sapiens
caggtacccaggctctttccaa

SEQ ID NO: 9143155 - DNA, 22 bp, Homo sapiens
caggtaggaaaagggtgtcagg

SEQ ID NO: 9143156 - DNA, 22 bp, Homo sapiens
caggtagcttttgatattaggg

SEQ ID NO: 9143157 - DNA, 22 bp, Homo sapiens
caggtaggaggctccctagtcc

SEQ ID NO: 9143158 - DNA, 18 bp, Homo sapiens
caggtcagcctggcctca

SEQ ID NO: 9143159 - DNA, 22 bp, Homo sapiens
caggtcagcacttggaggtgca

SEQ ID NO: 9143160 - DNA, 22 bp, Homo sapiens
caggtcagagtccccctgtcct

SEQ ID NO: 9143161 - DNA, 22 bp, Homo sapiens
caggtccaaggttcctgaatag

SEQ ID NO: 9143162 - DNA, 22 bp, Homo sapiens
caggtgccgggaatgcagcaat

SEQ ID NO: 9143163 - DNA, 22 bp, Homo sapiens
caggtgcctcaggatgagacaa

SEQ ID NO: 9143164 - DNA, 22 bp, Homo sapiens
caggtgctgtcctgcacatgtc

SEQ ID NO: 9143165 - DNA, 22 bp, Homo sapiens
tattataaaattactggcaggg

SEQ ID NO: 9143166 - DNA, 22 bp, Homo sapiens
tattataatttagggcttggat

SEQ ID NO: 9143167 - DNA, 22 bp, Homo sapiens
tattatcattggtaatatggtc

SEQ ID NO: 9143168 - DNA, 22 bp, Homo sapiens
tattatgcaaatattcctacct

SEQ ID NO: 9143169 - DNA, 22 bp, Homo sapiens
tattattaaatggcagaatttt

SEQ ID NO: 9143170 - DNA, 22 bp, Homo sapiens
tattattaaatggcagaatttt

SEQ ID NO: 9143171 - DNA, 18 bp, Homo sapiens
caggtgggtctcctgccc

SEQ ID NO: 9143172 - DNA, 22 bp, Homo sapiens
tattaggtagattttactgatt

SEQ ID NO: 9143173 - DNA, 22 bp, Homo sapiens
tattaggttggtgcaaaattaa

SEQ ID NO: 9143174 - DNA, 22 bp, Homo sapiens
caggtggcaaatgagtagcatt

SEQ ID NO: 9143175 - DNA, 22 bp, Homo sapiens
caggtggatctctaaggactga

SEQ ID NO: 9143176 - DNA, 22 bp, Homo sapiens
caggtggatctctaaggactga

SEQ ID NO: 9143177 - DNA, 22 bp, Homo sapiens
tagcttcttgagaaagggtgcc

SEQ ID NO: 9143178 - DNA, 22 bp, Homo sapiens
tagcttcttgagaaagggtgcc

SEQ ID NO: 9143179 - DNA, 20 bp, Homo sapiens
tagcttgaagaactccagag

SEQ ID NO: 9143180 - DNA, 22 bp, Homo sapiens
tagcttgagtgtttcataaata

SEQ ID NO: 9143181 - DNA, 22 bp, Homo sapiens
tagcttgactattctatgatgt

SEQ ID NO: 9143182 - DNA, 22 bp, Homo sapiens
tagcttgagtgtttcataaata

SEQ ID NO: 9143183 - DNA, 22 bp, Homo sapiens
tagctttaagacatggtgaatg

SEQ ID NO: 9143184 - DNA, 22 bp, Homo sapiens
tagcttccagaatttaatgtca

SEQ ID NO: 9143185 - DNA, 19 bp, Homo sapiens
tagcttcacgtggtctaga

SEQ ID NO: 9143186 - DNA, 21 bp, Homo sapiens
tagcttccagctcaagctgag

SEQ ID NO: 9143187 - DNA, 22 bp, Homo sapiens
tagcttctaatacttaccaatt

SEQ ID NO: 9143188 - DNA, 22 bp, Homo sapiens
tagcttccctgctggatcataa

SEQ ID NO: 9143189 - DNA, 22 bp, Homo sapiens
taggccaaatgacttgatgttt

SEQ ID NO: 9143190 - DNA, 22 bp, Homo sapiens
taggcagtagcaggatctgcca

SEQ ID NO: 9143191 - DNA, 22 bp, Homo sapiens
taggcatgcaaataaatgtgca

SEQ ID NO: 9143192 - DNA, 22 bp, Homo sapiens
taggcatgcaaataaatgtgca

SEQ ID NO: 9143193 - DNA, 23 bp, Homo sapiens
cagggccctgctcaatttctcca

SEQ ID NO: 9143194 - DNA, 22 bp, Homo sapiens
cagggccctaagatacacatca

SEQ ID NO: 9143195 - DNA, 20 bp, Homo sapiens
cagggcctaagagctgaaaa

SEQ ID NO: 9143196 - DNA, 22 bp, Homo sapiens
cagggcccagtccctgctgtca

SEQ ID NO: 9143197 - DNA, 22 bp, Homo sapiens
cagggcccagtccctgctgtca

SEQ ID NO: 9143198 - DNA, 22 bp, Homo sapiens
cagggcccaggccactgggttg

SEQ ID NO: 9143199 - DNA, 22 bp, Homo sapiens
cagggcccaggccactgggttg

SEQ ID NO: 9143200 - DNA, 22 bp, Homo sapiens
cagggcccagtccctgctgtca

SEQ ID NO: 9143201 - DNA, 22 bp, Homo sapiens
taggccaaggacagtaaggaca

SEQ ID NO: 9143202 - DNA, 22 bp, Homo sapiens
taggccaagttgatcagacatc

SEQ ID NO: 9143203 - DNA, 22 bp, Homo sapiens
taggccacagagaggagatttc

SEQ ID NO: 9143204 - DNA, 22 bp, Homo sapiens
taggccacaaataagatcctgt

SEQ ID NO: 9143205 - DNA, 21 bp, Homo sapiens
taggccacatgggttggagat

SEQ ID NO: 9143206 - DNA, 22 bp, Homo sapiens
taggccaccagggttccattta

SEQ ID NO: 9143207 - DNA, 22 bp, Homo sapiens
taggccacagatgagacataag

SEQ ID NO: 9143208 - DNA, 22 bp, Homo sapiens
taggccactctcctttgtctca

SEQ ID NO: 9143209 - DNA, 22 bp, Homo sapiens
taggccacggaaagcaggttgc

SEQ ID NO: 9143210 - DNA, 22 bp, Homo sapiens
taggccacgaaggagatgatag

SEQ ID NO: 9143211 - DNA, 22 bp, Homo sapiens
tagatttgtgtttgggatgaga

SEQ ID NO: 9143212 - DNA, 22 bp, Homo sapiens
tagatttgtgcaagaagggatt

SEQ ID NO: 9143213 - DNA, 22 bp, Homo sapiens
tagatttgcctgggaaagctca

SEQ ID NO: 9143214 - DNA, 22 bp, Homo sapiens
tagatttgatgtaagcatagtc

SEQ ID NO: 9143215 - DNA, 22 bp, Homo sapiens
tagatttgaatgatgtaaagag

SEQ ID NO: 9143216 - DNA, 22 bp, Homo sapiens
cagggagatcttggctcctggt

SEQ ID NO: 9143217 - DNA, 22 bp, Homo sapiens
cagggagcagcatgggcaaagg

SEQ ID NO: 9143218 - DNA, 22 bp, Homo sapiens
cagggagcactgcgagcggcag

SEQ ID NO: 9143219 - DNA, 22 bp, Homo sapiens
cagggagcactgcgagcggcag

SEQ ID NO: 9143220 - DNA, 22 bp, Homo sapiens
cagggagcactgcgagcggcag

SEQ ID NO: 9143221 - DNA, 22 bp, Homo sapiens
cagggagcagcatgggcaaagg

SEQ ID NO: 9143222 - DNA, 22 bp, Homo sapiens
cagggagcagcccctagaagta

SEQ ID NO: 9143223 - DNA, 22 bp, Homo sapiens
cagggagcagcccctagaagta

SEQ ID NO: 9143224 - DNA, 22 bp, Homo sapiens
cagggagcagcgctggggcctc

SEQ ID NO: 9143225 - DNA, 22 bp, Homo sapiens
cagggagcagcgctggggcctc

SEQ ID NO: 9143226 - DNA, 22 bp, Homo sapiens
cagggagcaggctctgtccatc

SEQ ID NO: 9143227 - DNA, 22 bp, Homo sapiens
cagggagcaggctctgtccatc

SEQ ID NO: 9143228 - DNA, 22 bp, Homo sapiens
cagggagcaggctctgtccatc

SEQ ID NO: 9143229 - DNA, 22 bp, Homo sapiens
cagggccattggaacaaagagg

SEQ ID NO: 9143230 - DNA, 22 bp, Homo sapiens
cagggccagttctcgcagcagt

SEQ ID NO: 9143231 - DNA, 22 bp, Homo sapiens
cagggccatgaggcacagggtc

SEQ ID NO: 9143232 - DNA, 22 bp, Homo sapiens
cagggccatgaggcacagggtc

SEQ ID NO: 9143233 - DNA, 22 bp, Homo sapiens
cagggccatgaggcacagggtc

SEQ ID NO: 9143234 - DNA, 22 bp, Homo sapiens
cagggagcaggctctgtccatc

SEQ ID NO: 9143235 - DNA, 22 bp, Homo sapiens
cagggagccccaattccatgcc

SEQ ID NO: 9143236 - DNA, 22 bp, Homo sapiens
cagggagccccaattccatgcc

SEQ ID NO: 9143237 - DNA, 22 bp, Homo sapiens
cagggccaggctgatggcctgg

SEQ ID NO: 9143238 - DNA, 22 bp, Homo sapiens
cagggccactgcatgaggttca

SEQ ID NO: 9143239 - DNA, 22 bp, Homo sapiens
cagggccactgtagatgaggag

SEQ ID NO: 9143240 - DNA, 22 bp, Homo sapiens
cagggagcctccaaagctttca

SEQ ID NO: 9143241 - DNA, 22 bp, Homo sapiens
cagggagcctccaaagctttca

SEQ ID NO: 9143242 - DNA, 22 bp, Homo sapiens
cagggccaggctgatggcctgg

SEQ ID NO: 9143243 - DNA, 22 bp, Homo sapiens
cagggccagggacacgctgtca

SEQ ID NO: 9143244 - DNA, 22 bp, Homo sapiens
taggctttgtgttttgggaaca

SEQ ID NO: 9143245 - DNA, 23 bp, Homo sapiens
taggcttctgctgtccccgacgc

SEQ ID NO: 9143246 - DNA, 22 bp, Homo sapiens
taggcttcccgctcacatgccc

SEQ ID NO: 9143247 - DNA, 22 bp, Homo sapiens
cagggctggatttcatttctag

SEQ ID NO: 9143248 - DNA, 22 bp, Homo sapiens
tagggaagagcattcaaccttt

SEQ ID NO: 9143249 - DNA, 22 bp, Homo sapiens
tagggaagctcctgattcccct

SEQ ID NO: 9143250 - DNA, 22 bp, Homo sapiens
tagggaaatatagatttagggc

SEQ ID NO: 9143251 - DNA, 23 bp, Homo sapiens
cagggctggtagggaagagcgtg

SEQ ID NO: 9143252 - DNA, 22 bp, Homo sapiens
cagggctgggttaaaagcaggg

SEQ ID NO: 9143253 - DNA, 22 bp, Homo sapiens
cagggctgggttaaaagcaggg

SEQ ID NO: 9143254 - DNA, 22 bp, Homo sapiens
cagggctggatttcatttctag

SEQ ID NO: 9143255 - DNA, 22 bp, Homo sapiens
cagggctgtaaattagtgctga

SEQ ID NO: 9143256 - DNA, 22 bp, Homo sapiens
cagggctgtaaattagtgctga

SEQ ID NO: 9143257 - DNA, 22 bp, Homo sapiens
cagggctgtctccaaaggcccc

SEQ ID NO: 9143258 - DNA, 22 bp, Homo sapiens
cagggctgtctccaaaggcccc

SEQ ID NO: 9143259 - DNA, 22 bp, Homo sapiens
cagggctggtttgtcgaagaaa

SEQ ID NO: 9143260 - DNA, 23 bp, Homo sapiens
cagggctggtagggaagagcgtg

SEQ ID NO: 9143261 - DNA, 22 bp, Homo sapiens
cagggctgaactgagcttgtga

SEQ ID NO: 9143262 - DNA, 22 bp, Homo sapiens
cagggctgaaatcaaggtgtag

SEQ ID NO: 9143263 - DNA, 22 bp, Homo sapiens
cagggctcttcatcacacagta

SEQ ID NO: 9143264 - DNA, 20 bp, Homo sapiens
cagggctctgggcctggcct

SEQ ID NO: 9143265 - DNA, 20 bp, Homo sapiens
cagggctctgggcctggcct

SEQ ID NO: 9143266 - DNA, 22 bp, Homo sapiens
taggctgggctgagctggacgg

SEQ ID NO: 9143267 - DNA, 22 bp, Homo sapiens
cagggctgaactgagcttgtga

SEQ ID NO: 9143268 - DNA, 22 bp, Homo sapiens
cagggctgaagaaattcaaaag

SEQ ID NO: 9143269 - DNA, 22 bp, Homo sapiens
cagggctgaagaaattcaaaag

SEQ ID NO: 9143270 - DNA, 22 bp, Homo sapiens
cagggctgagaatttagagaca

SEQ ID NO: 9143271 - DNA, 22 bp, Homo sapiens
cagggggtggtccaggctgcgc

SEQ ID NO: 9143272 - DNA, 22 bp, Homo sapiens
caggggtgtttttggccaggag

SEQ ID NO: 9143273 - DNA, 22 bp, Homo sapiens
cagggggtggtccaggctgcgc

SEQ ID NO: 9143274 - DNA, 22 bp, Homo sapiens
caggggtggctgcagcagaggt

SEQ ID NO: 9143275 - DNA, 22 bp, Homo sapiens
caggggtggctgcagcagaggt

SEQ ID NO: 9143276 - DNA, 22 bp, Homo sapiens
caggggtggctgcagcagaggt

SEQ ID NO: 9143277 - DNA, 22 bp, Homo sapiens
cagggtagggcaagggaacctg

SEQ ID NO: 9143278 - DNA, 22 bp, Homo sapiens
caggggtgtttttggccaggag

SEQ ID NO: 9143279 - DNA, 22 bp, Homo sapiens
cagggtcccaggagctgctttc

SEQ ID NO: 9143280 - DNA, 22 bp, Homo sapiens
cagggtcccaggagctgctttc

SEQ ID NO: 9143281 - DNA, 22 bp, Homo sapiens
cagggtccccgggtctcctgtg

SEQ ID NO: 9143282 - DNA, 22 bp, Homo sapiens
cagggtccggctgcctggctgt

SEQ ID NO: 9143283 - DNA, 22 bp, Homo sapiens
cagggtccggctgcctggctgt

SEQ ID NO: 9143284 - DNA, 22 bp, Homo sapiens
cagggtcaggaggatctggctt

SEQ ID NO: 9143285 - DNA, 22 bp, Homo sapiens
cagggtcaggctgctagaagct

SEQ ID NO: 9143286 - DNA, 22 bp, Homo sapiens
cagggtccatctttcatcactg

SEQ ID NO: 9143287 - DNA, 22 bp, Homo sapiens
caggggcgggtaaaaggcctcc

SEQ ID NO: 9143288 - DNA, 22 bp, Homo sapiens
caggggctgtttgcctcaggcc

SEQ ID NO: 9143289 - DNA, 22 bp, Homo sapiens
cagggggcagcgtagaaaatga

SEQ ID NO: 9143290 - DNA, 22 bp, Homo sapiens
cagggggctgtggctgtccagt

SEQ ID NO: 9143291 - DNA, 22 bp, Homo sapiens
cagggggctgtggctgtccagt

SEQ ID NO: 9143292 - DNA, 22 bp, Homo sapiens
cagggggtggtccaggctgcgc

SEQ ID NO: 9143293 - DNA, 22 bp, Homo sapiens
cagggggtgcaggccctgtgac

SEQ ID NO: 9143294 - DNA, 22 bp, Homo sapiens
caggggcctgtcctggcttctg

SEQ ID NO: 9143295 - DNA, 22 bp, Homo sapiens
cagggctgtggctttgtgctgt

SEQ ID NO: 9143296 - DNA, 22 bp, Homo sapiens
cagggctgtggctttgtgctgt

SEQ ID NO: 9143297 - DNA, 22 bp, Homo sapiens
cagggctgtggctttgtgctgt

SEQ ID NO: 9143298 - DNA, 22 bp, Homo sapiens
cagggctgtgcccatcttcccc

SEQ ID NO: 9143299 - DNA, 22 bp, Homo sapiens
cagggctgtggaaaactggtgc

SEQ ID NO: 9143300 - DNA, 22 bp, Homo sapiens
cagggctgtgcccatcttcccc

SEQ ID NO: 9143301 - DNA, 22 bp, Homo sapiens
cagggctgtggaaaactggtgc

SEQ ID NO: 9143302 - DNA, 22 bp, Homo sapiens
cagggctgtgcccatcttcccc

SEQ ID NO: 9143303 - DNA, 22 bp, Homo sapiens
cagggctgtgcccatcttcccc

SEQ ID NO: 9143304 - DNA, 17 bp, Homo sapiens
cagggctgtctgcctag

SEQ ID NO: 9143305 - DNA, 17 bp, Homo sapiens
cagggctgtctgcctag

SEQ ID NO: 9143306 - DNA, 17 bp, Homo sapiens
cagggctgtctgcctag

SEQ ID NO: 9143307 - DNA, 17 bp, Homo sapiens
cagggctgtctgcctag

SEQ ID NO: 9143308 - DNA, 22 bp, Homo sapiens
cagggctgtctccaaaggcccc

SEQ ID NO: 9143309 - DNA, 22 bp, Homo sapiens
catagaaagtattatggaattt

SEQ ID NO: 9143310 - DNA, 22 bp, Homo sapiens
catagaaacttgcagcaagcac

SEQ ID NO: 9143311 - DNA, 22 bp, Homo sapiens
catagaaatcaggtgagaatct

SEQ ID NO: 9143312 - DNA, 22 bp, Homo sapiens
tcaggcctgagaaaaatccttt

SEQ ID NO: 9143313 - DNA, 22 bp, Homo sapiens
catagaaactgagacaaggatt

SEQ ID NO: 9143314 - DNA, 22 bp, Homo sapiens
catagaaactgagacaaggatt

SEQ ID NO: 9143315 - DNA, 22 bp, Homo sapiens
tcaggcccttctcccaggactc

SEQ ID NO: 9143316 - DNA, 22 bp, Homo sapiens
tcaggccccatcccagacttat

SEQ ID NO: 9143317 - DNA, 22 bp, Homo sapiens
tcaggcctagaacacagcagat

SEQ ID NO: 9143318 - DNA, 22 bp, Homo sapiens
tcaggcctagggagaaaattca

SEQ ID NO: 9143319 - DNA, 22 bp, Homo sapiens
tcaggcctcagaaattgcactg

SEQ ID NO: 9143320 - DNA, 22 bp, Homo sapiens
tcaggcctcaagctgctttaag

SEQ ID NO: 9143321 - DNA, 22 bp, Homo sapiens
tcaggcctagggagccacacca

SEQ ID NO: 9143322 - DNA, 22 bp, Homo sapiens
tcaggcctcagcagcccacagg

SEQ ID NO: 9143323 - DNA, 22 bp, Homo sapiens
tcaggcctccaggttaccattt

SEQ ID NO: 9143324 - DNA, 22 bp, Homo sapiens
catagaaatcaggtgagaatct

SEQ ID NO: 9143325 - DNA, 22 bp, Homo sapiens
catagaacagctcctagcacat

SEQ ID NO: 9143326 - DNA, 22 bp, Homo sapiens
catagaatatgtgtgattgtta

SEQ ID NO: 9143327 - DNA, 22 bp, Homo sapiens
catagaatcatagcacatttga

SEQ ID NO: 9143328 - DNA, 17 bp, Homo sapiens
tcaggctgtgcctggta

SEQ ID NO: 9143329 - DNA, 22 bp, Homo sapiens
tcaggctgttagccacctcctc

SEQ ID NO: 9143330 - DNA, 22 bp, Homo sapiens
tcagggagaggtgagagcctgt

SEQ ID NO: 9143331 - DNA, 17 bp, Homo sapiens
tcaggctgtgcctggta

SEQ ID NO: 9143332 - DNA, 22 bp, Homo sapiens
cataatcctggtgtagccctct

SEQ ID NO: 9143333 - DNA, 22 bp, Homo sapiens
cataatcctgtcctggattctt

SEQ ID NO: 9143334 - DNA, 22 bp, Homo sapiens
cataatccttgattcaaataat

SEQ ID NO: 9143335 - DNA, 22 bp, Homo sapiens
cataatcccccatttgtgacat

SEQ ID NO: 9143336 - DNA, 22 bp, Homo sapiens
cataatccatttgcactgcaga

SEQ ID NO: 9143337 - DNA, 22 bp, Homo sapiens
cataatcccaggcttgcattca

SEQ ID NO: 9143338 - DNA, 22 bp, Homo sapiens
cataacatccttgctactttga

SEQ ID NO: 9143339 - DNA, 22 bp, Homo sapiens
cataatatctccgattacttgc

SEQ ID NO: 9143340 - DNA, 22 bp, Homo sapiens
tcagcaggtgctttgtttactc

SEQ ID NO: 9143341 - DNA, 22 bp, Homo sapiens
tcagcaggtgctttgtttactc

SEQ ID NO: 9143342 - DNA, 22 bp, Homo sapiens
tcagcaggtgcctcagattctt

SEQ ID NO: 9143343 - DNA, 22 bp, Homo sapiens
tcagcaggtggtgggcaggtga

SEQ ID NO: 9143344 - DNA, 22 bp, Homo sapiens
tcagcaggtggtgggcaggtga

SEQ ID NO: 9143345 - DNA, 22 bp, Homo sapiens
tcagcagggtttgacttctaat

SEQ ID NO: 9143346 - DNA, 22 bp, Homo sapiens
tcagcagggtttgacttctaat

SEQ ID NO: 9143347 - DNA, 22 bp, Homo sapiens
tcagcaggtctgaggcggggcc

SEQ ID NO: 9143348 - DNA, 22 bp, Homo sapiens
tcagcaggtgaacatcatgcca

SEQ ID NO: 9143349 - DNA, 22 bp, Homo sapiens
tcaggcagagtggaagctgcaa

SEQ ID NO: 9143350 - DNA, 22 bp, Homo sapiens
tcaggcccagagtcacggatcc

SEQ ID NO: 9143351 - DNA, 22 bp, Homo sapiens
cataatttgtggtagtggggga

SEQ ID NO: 9143352 - DNA, 22 bp, Homo sapiens
cagttttcttgttatatttggg

SEQ ID NO: 9143353 - DNA, 22 bp, Homo sapiens
cagttttggtcctttctaggta

SEQ ID NO: 9143354 - DNA, 22 bp, Homo sapiens
cagtttgtgctaggcactattt

SEQ ID NO: 9143355 - DNA, 22 bp, Homo sapiens
cagtttgtgctaggcactattt

SEQ ID NO: 9143356 - DNA, 22 bp, Homo sapiens
cagttttaaattgttagataat

SEQ ID NO: 9143357 - DNA, 22 bp, Homo sapiens
cagttttctaaagtctctttaa

SEQ ID NO: 9143358 - DNA, 22 bp, Homo sapiens
tcagatattctctaagaacaat

SEQ ID NO: 9143359 - DNA, 22 bp, Homo sapiens
tcagatatggagtctaaaacca

SEQ ID NO: 9143360 - DNA, 22 bp, Homo sapiens
tcagatccgagtgtgccaagga

SEQ ID NO: 9143361 - DNA, 22 bp, Homo sapiens
tcagatcaggatgcagcaacat

SEQ ID NO: 9143362 - DNA, 22 bp, Homo sapiens
cagtttttgccattaagagtaa

SEQ ID NO: 9143363 - DNA, 22 bp, Homo sapiens
cagtttttcaaaattacatgat

SEQ ID NO: 9143364 - DNA, 22 bp, Homo sapiens
cataaaagccacctatttaaag

SEQ ID NO: 9143365 - DNA, 22 bp, Homo sapiens
cataaaagccacctatttaaag

SEQ ID NO: 9143366 - DNA, 22 bp, Homo sapiens
cataaaaggtagcagtttgaaa

SEQ ID NO: 9143367 - DNA, 22 bp, Homo sapiens
tcagagtttcaggatacaaata

SEQ ID NO: 9143368 - DNA, 22 bp, Homo sapiens
tcagagtttgtactgacaggag

SEQ ID NO: 9143369 - DNA, 22 bp, Homo sapiens
tcagataagtgaagcaaagttt

SEQ ID NO: 9143370 - DNA, 22 bp, Homo sapiens
tcagagttggcagtaaaacaca

SEQ ID NO: 9143371 - DNA, 22 bp, Homo sapiens
tcagaggatgctgttctttaat

SEQ ID NO: 9143372 - DNA, 22 bp, Homo sapiens
tcagaggatgctgttctttaat

SEQ ID NO: 9143373 - DNA, 22 bp, Homo sapiens
tcagataattaatcatgaaatt

SEQ ID NO: 9143374 - DNA, 22 bp, Homo sapiens
tcagataagtgaagcaaagttt

SEQ ID NO: 9143375 - DNA, 22 bp, Homo sapiens
tcagaggatagaaatacttatt

SEQ ID NO: 9143376 - DNA, 23 bp, Homo sapiens
tcagaggatcatcaaacgttttc

SEQ ID NO: 9143377 - DNA, 22 bp, Homo sapiens
tcagaggatcatgtccctactc

SEQ ID NO: 9143378 - DNA, 22 bp, Homo sapiens
tcagaggatagaaatacttatt

SEQ ID NO: 9143379 - DNA, 23 bp, Homo sapiens
tcagaggatcatcaaacgttttc

SEQ ID NO: 9143380 - DNA, 22 bp, Homo sapiens
tcagaggaggcatttaaacaga

SEQ ID NO: 9143381 - DNA, 22 bp, Homo sapiens
tcagaggagggactcagaccca

SEQ ID NO: 9143382 - DNA, 22 bp, Homo sapiens
tcagaggaggcatttaaacaga

SEQ ID NO: 9143383 - DNA, 22 bp, Homo sapiens
tcagaggagccaaagttctgag

SEQ ID NO: 9143384 - DNA, 22 bp, Homo sapiens
tcagaggagccaaagttctgag

SEQ ID NO: 9143385 - DNA, 22 bp, Homo sapiens
tcagaggagcaaaagaggggat

SEQ ID NO: 9143386 - DNA, 22 bp, Homo sapiens
tcagaggagatggttaccaggg

SEQ ID NO: 9143387 - DNA, 18 bp, Homo sapiens
tcagaggagatacctaaa

SEQ ID NO: 9143388 - DNA, 22 bp, Homo sapiens
cagttgtccccaaaatatacgg

SEQ ID NO: 9143389 - DNA, 22 bp, Homo sapiens
cagttgctacagttcaagtgtg

SEQ ID NO: 9143390 - DNA, 22 bp, Homo sapiens
cagttggaggaatgaggctgta

SEQ ID NO: 9143391 - DNA, 17 bp, Homo sapiens
cagttggagacaagtcc

SEQ ID NO: 9143392 - DNA, 22 bp, Homo sapiens
cagttgctggatgtgcagctct

SEQ ID NO: 9143393 - DNA, 22 bp, Homo sapiens
cagttgctggatgtgcagctct

SEQ ID NO: 9143394 - DNA, 23 bp, Homo sapiens
cagttggaggtacagagacactg

SEQ ID NO: 9143395 - DNA, 22 bp, Homo sapiens
cagttggaggaatgaggctgta

SEQ ID NO: 9143396 - DNA, 22 bp, Homo sapiens
tcagagcaacttttcctgcttt

SEQ ID NO: 9143397 - DNA, 22 bp, Homo sapiens
tcagagatctggagtacaactg

SEQ ID NO: 9143398 - DNA, 22 bp, Homo sapiens
tcaatgaaagagcatgcatttt

SEQ ID NO: 9143399 - DNA, 18 bp, Homo sapiens
tcaatctctgatggtgtt

SEQ ID NO: 9143400 - DNA, 22 bp, Homo sapiens
tcaatcacgtgttccatgttct

SEQ ID NO: 9143401 - DNA, 22 bp, Homo sapiens
cagttctttgtggggagttctc

SEQ ID NO: 9143402 - DNA, 22 bp, Homo sapiens
cagttcttatttggccagtgtc

SEQ ID NO: 9143403 - DNA, 22 bp, Homo sapiens
cagttgagtctgctagctagga

SEQ ID NO: 9143404 - DNA, 22 bp, Homo sapiens
cagttgatcactataggcttca

SEQ ID NO: 9143405 - DNA, 22 bp, Homo sapiens
cagttagctgacaagtaggcta

SEQ ID NO: 9143406 - DNA, 22 bp, Homo sapiens
cagttagcactcagtttccaga

SEQ ID NO: 9143407 - DNA, 22 bp, Homo sapiens
cagttagaggaggtaaagatgc

SEQ ID NO: 9143408 - DNA, 22 bp, Homo sapiens
cagttctggtttgcagatatat

SEQ ID NO: 9143409 - DNA, 22 bp, Homo sapiens
cagttctggaggctccacatct

SEQ ID NO: 9143410 - DNA, 22 bp, Homo sapiens
cagttctggaggctccacatct

SEQ ID NO: 9143411 - DNA, 22 bp, Homo sapiens
catgaaatttgaagtacagcaa

SEQ ID NO: 9143412 - DNA, 22 bp, Homo sapiens
catgaaattgctcctttggtgc

SEQ ID NO: 9143413 - DNA, 22 bp, Homo sapiens
catgaaattgtattggcctcaa

SEQ ID NO: 9143414 - DNA, 22 bp, Homo sapiens
catctgtcatcaaccctggcta

SEQ ID NO: 9143415 - DNA, 22 bp, Homo sapiens
catctgtctgcatgctctgggt

SEQ ID NO: 9143416 - DNA, 21 bp, Homo sapiens
catgaagaatcaagacccttg

SEQ ID NO: 9143417 - DNA, 22 bp, Homo sapiens
catgaagatcctgtatgttttt

SEQ ID NO: 9143418 - DNA, 22 bp, Homo sapiens
catctgctgttccttggactca

SEQ ID NO: 9143419 - DNA, 22 bp, Homo sapiens
catctgctgttccttggactca

SEQ ID NO: 9143420 - DNA, 22 bp, Homo sapiens
catctgctgttccttggactca

SEQ ID NO: 9143421 - DNA, 22 bp, Homo sapiens
catctggacaaaactctgaagg

SEQ ID NO: 9143422 - DNA, 19 bp, Homo sapiens
catctggatgattctcctg

SEQ ID NO: 9143423 - DNA, 22 bp, Homo sapiens
catctgggttctcagatggata

SEQ ID NO: 9143424 - DNA, 22 bp, Homo sapiens
catctgaatttgccttagtttc

SEQ ID NO: 9143425 - DNA, 22 bp, Homo sapiens
catctgaagtgaattgcttttt

SEQ ID NO: 9143426 - DNA, 22 bp, Homo sapiens
catctgcaggggaagccagttt

SEQ ID NO: 9143427 - DNA, 20 bp, Homo sapiens
catctgagcccacagaagtc

SEQ ID NO: 9143428 - DNA, 19 bp, Homo sapiens
tcagggagtttacagcatg

SEQ ID NO: 9143429 - DNA, 19 bp, Homo sapiens
tcagggagtttacagcatg

SEQ ID NO: 9143430 - DNA, 22 bp, Homo sapiens
tcagggagtgttggcaggatca

SEQ ID NO: 9143431 - DNA, 22 bp, Homo sapiens
tcagggagtgttggcaggatca

SEQ ID NO: 9143432 - DNA, 22 bp, Homo sapiens
tcagggaggtgtctgccagaga

SEQ ID NO: 9143433 - DNA, 22 bp, Homo sapiens
tcagggagtagtttgtgctatg

SEQ ID NO: 9143434 - DNA, 22 bp, Homo sapiens
tcagggaggtgtctgccagaga

SEQ ID NO: 9143435 - DNA, 22 bp, Homo sapiens
tcagggaggtgtctgccagaga

SEQ ID NO: 9143436 - DNA, 22 bp, Homo sapiens
tcagggagggacctgaggctgg

SEQ ID NO: 9143437 - DNA, 22 bp, Homo sapiens
tcagggagggacctgaggctgg

SEQ ID NO: 9143438 - DNA, 22 bp, Homo sapiens
tcagggagcctggacttcaagg

SEQ ID NO: 9143439 - DNA, 22 bp, Homo sapiens
tcagggagcctggacttcaagg

SEQ ID NO: 9143440 - DNA, 22 bp, Homo sapiens
tcagggagatttggggactcaa

SEQ ID NO: 9143441 - DNA, 22 bp, Homo sapiens
tcagggagatttggggactcaa

SEQ ID NO: 9143442 - DNA, 22 bp, Homo sapiens
tcagggagagtgacccatccac

SEQ ID NO: 9143443 - DNA, 22 bp, Homo sapiens
tcagtatttctaaacattggct

SEQ ID NO: 9143444 - DNA, 22 bp, Homo sapiens
tcagggattgcaaaattcatcc

SEQ ID NO: 9143445 - DNA, 22 bp, Homo sapiens
tcagggattgcaaaattcatcc

SEQ ID NO: 9143446 - DNA, 22 bp, Homo sapiens
tcagtcacttttgcctgctaca

SEQ ID NO: 9143447 - DNA, 22 bp, Homo sapiens
tcagtcagaatcaccagacttt

SEQ ID NO: 9143448 - DNA, 22 bp, Homo sapiens
tcagtgctgctttatgacagtt

SEQ ID NO: 9143449 - DNA, 22 bp, Homo sapiens
tcagtgctctgaggtccagggt

SEQ ID NO: 9143450 - DNA, 22 bp, Homo sapiens
tcagtgctgccatggcagggcc

SEQ ID NO: 9143451 - DNA, 22 bp, Homo sapiens
tcagtgctaaaagagctggtgt

SEQ ID NO: 9143452 - DNA, 19 bp, Homo sapiens
tcagtgctcctatgtcctt

SEQ ID NO: 9143453 - DNA, 22 bp, Homo sapiens
tcagtgctcctaaagtgaatgc

SEQ ID NO: 9143454 - DNA, 22 bp, Homo sapiens
tcagtgctcctaaagtgaatgc

SEQ ID NO: 9143455 - DNA, 22 bp, Homo sapiens
tcagtgcattgttcattgtagg

SEQ ID NO: 9143456 - DNA, 22 bp, Homo sapiens
tcagtgcattgttcattgtagg

SEQ ID NO: 9143457 - DNA, 22 bp, Homo sapiens
tcagtgcattctaccaaaaggc

SEQ ID NO: 9143458 - DNA, 22 bp, Homo sapiens
tcagtgcattcatgggtggctg

SEQ ID NO: 9143459 - DNA, 21 bp, Homo sapiens
tcagtccctgggtgtgtccca

SEQ ID NO: 9143460 - DNA, 22 bp, Homo sapiens
catggccagcccccagttcctc

SEQ ID NO: 9143461 - DNA, 22 bp, Homo sapiens
catggccagattctttcttctc

SEQ ID NO: 9143462 - DNA, 22 bp, Homo sapiens
catggccagcccccagttcctc

SEQ ID NO: 9143463 - DNA, 22 bp, Homo sapiens
catggccacattggaccgaagc

SEQ ID NO: 9143464 - DNA, 22 bp, Homo sapiens
catggccacatctagctgcaag

SEQ ID NO: 9143465 - DNA, 22 bp, Homo sapiens
catggccaaggatgctcaacca

SEQ ID NO: 9143466 - DNA, 22 bp, Homo sapiens
catggccaaagaattatatttt

SEQ ID NO: 9143467 - DNA, 23 bp, Homo sapiens
tccaggagaattccagggcccgg

SEQ ID NO: 9143468 - DNA, 20 bp, Homo sapiens
tccagctgggaacagctgat

SEQ ID NO: 9143469 - DNA, 22 bp, Homo sapiens
catggcaggaaggacatgcact

SEQ ID NO: 9143470 - DNA, 22 bp, Homo sapiens
catgcattcagaatctctcaca

SEQ ID NO: 9143471 - DNA, 22 bp, Homo sapiens
catgcattcagaatctctcaca

SEQ ID NO: 9143472 - DNA, 22 bp, Homo sapiens
catgcattcctcctctgcctta

SEQ ID NO: 9143473 - DNA, 22 bp, Homo sapiens
catgcatgtttactacagtgac

SEQ ID NO: 9143474 - DNA, 22 bp, Homo sapiens
catgcatgcctggctcacagag

SEQ ID NO: 9143475 - DNA, 22 bp, Homo sapiens
catgcatggtcatgctgggact

SEQ ID NO: 9143476 - DNA, 22 bp, Homo sapiens
catgcatgtttactacagtgac

SEQ ID NO: 9143477 - DNA, 22 bp, Homo sapiens
catggcagctttgggaggagga

SEQ ID NO: 9143478 - DNA, 22 bp, Homo sapiens
catggcagctttgggaggagga

SEQ ID NO: 9143479 - DNA, 22 bp, Homo sapiens
catgcacacacgtgcatgtacg

SEQ ID NO: 9143480 - DNA, 22 bp, Homo sapiens
catgagaaccaggtctgtgttt

SEQ ID NO: 9143481 - DNA, 22 bp, Homo sapiens
catgacatcctgaagctgcaca

SEQ ID NO: 9143482 - DNA, 22 bp, Homo sapiens
catgacagatgcaaaggattgg

SEQ ID NO: 9143483 - DNA, 22 bp, Homo sapiens
catgaccccccaaggcctgcag

SEQ ID NO: 9143484 - DNA, 22 bp, Homo sapiens
catgactgtgttagaagaatga

SEQ ID NO: 9143485 - DNA, 22 bp, Homo sapiens
catgacattttaaaaagaacat

SEQ ID NO: 9143486 - DNA, 22 bp, Homo sapiens
catgacacctaccatattaagt

SEQ ID NO: 9143487 - DNA, 22 bp, Homo sapiens
catgacacccaggcatagcacc

SEQ ID NO: 9143488 - DNA, 22 bp, Homo sapiens
catgacaataagccagcagaaa

SEQ ID NO: 9143489 - DNA, 22 bp, Homo sapiens
catgacaatatgttctttcatt

SEQ ID NO: 9143490 - DNA, 22 bp, Homo sapiens
catgacaaatcagaggggcttg

SEQ ID NO: 9143491 - DNA, 23 bp, Homo sapiens
catgacaaaggatctcatgggcc

SEQ ID NO: 9143492 - DNA, 22 bp, Homo sapiens
catgacaaataaacctttgcca

SEQ ID NO: 9143493 - DNA, 22 bp, Homo sapiens
catgaatatttagtatttactt

SEQ ID NO: 9143494 - DNA, 22 bp, Homo sapiens
catgaatatacatcctgatggc

SEQ ID NO: 9143495 - DNA, 22 bp, Homo sapiens
catgcagtgtgtatctacttaa

SEQ ID NO: 9143496 - DNA, 22 bp, Homo sapiens
catgcagtgcctctggattctt

SEQ ID NO: 9143497 - DNA, 21 bp, Homo sapiens
catgcatacatatacaagctt

SEQ ID NO: 9143498 - DNA, 22 bp, Homo sapiens
catgcatagaatgaagaggctg

SEQ ID NO: 9143499 - DNA, 22 bp, Homo sapiens
catgcatagagcagaacttggc

SEQ ID NO: 9143500 - DNA, 16 bp, Homo sapiens
catgcataaacgatgg

SEQ ID NO: 9143501 - DNA, 22 bp, Homo sapiens
catgcatacacaggtcaggcag

SEQ ID NO: 9143502 - DNA, 22 bp, Homo sapiens
catgcatatatgctacatgcaa

SEQ ID NO: 9143503 - DNA, 22 bp, Homo sapiens
catgcatatgtcaaaaaagcta

SEQ ID NO: 9143504 - DNA, 22 bp, Homo sapiens
catgcatagtttttctagaagg

SEQ ID NO: 9143505 - DNA, 22 bp, Homo sapiens
catgcataggaaatgttttttg

SEQ ID NO: 9143506 - DNA, 22 bp, Homo sapiens
catgcatagccagcattgtatg

SEQ ID NO: 9143507 - DNA, 22 bp, Homo sapiens
catgcatagctttggagctagg

SEQ ID NO: 9143508 - DNA, 20 bp, Homo sapiens
catgcatgacactggaaagg

SEQ ID NO: 9143509 - DNA, 22 bp, Homo sapiens
catgcatattactagcacagca

SEQ ID NO: 9143510 - DNA, 22 bp, Homo sapiens
catgcaggtgaccaggtgtggg

SEQ ID NO: 9143511 - DNA, 22 bp, Homo sapiens
catgcagtgactcagacacagg

SEQ ID NO: 9143512 - DNA, 22 bp, Homo sapiens
catgcagtgaaattgatatcca

SEQ ID NO: 9143513 - DNA, 22 bp, Homo sapiens
catgcagggagcagaggagaca

SEQ ID NO: 9143514 - DNA, 22 bp, Homo sapiens
catgcaggtctggagcttgggg

SEQ ID NO: 9143515 - DNA, 22 bp, Homo sapiens
catgcagggacttgtgctccat

SEQ ID NO: 9143516 - DNA, 17 bp, Homo sapiens
tccttcagtgcctctgc

SEQ ID NO: 9143517 - DNA, 22 bp, Homo sapiens
tccttaaaggactagaagtcaa

SEQ ID NO: 9143518 - DNA, 19 bp, Homo sapiens
tcctggggaggggcatggc

SEQ ID NO: 9143519 - DNA, 22 bp, Homo sapiens
tccttaaacaacacactttgta

SEQ ID NO: 9143520 - DNA, 19 bp, Homo sapiens
tccttaaaaaagcagttct

SEQ ID NO: 9143521 - DNA, 22 bp, Homo sapiens
tcctgggcttgctcctccagct

SEQ ID NO: 9143522 - DNA, 22 bp, Homo sapiens
tcctgggcttagtggctaggtc

SEQ ID NO: 9143523 - DNA, 22 bp, Homo sapiens
tcctgggcttagtggctaggtc

SEQ ID NO: 9143524 - DNA, 22 bp, Homo sapiens
tcctttaactagttaccatgtt

SEQ ID NO: 9143525 - DNA, 22 bp, Homo sapiens
tccttgtaaaggagctctaaca

SEQ ID NO: 9143526 - DNA, 22 bp, Homo sapiens
tccttgggtcagtgagtgaggt

SEQ ID NO: 9143527 - DNA, 22 bp, Homo sapiens
tccttgtaaaggagctctaaca

SEQ ID NO: 9143528 - DNA, 22 bp, Homo sapiens
tccttgtaaaggagctctaaca

SEQ ID NO: 9143529 - DNA, 22 bp, Homo sapiens
tcctttatgtgagttgtttccc

SEQ ID NO: 9143530 - DNA, 22 bp, Homo sapiens
ccactgctaacttgctgcagct

SEQ ID NO: 9143531 - DNA, 22 bp, Homo sapiens
ccactgcctgacttagatgaca

SEQ ID NO: 9143532 - DNA, 22 bp, Homo sapiens
tccttggggacgctgacatcgt

SEQ ID NO: 9143533 - DNA, 23 bp, Homo sapiens
tccttgggcctgcccagagtggt

SEQ ID NO: 9143534 - DNA, 22 bp, Homo sapiens
tccttcctgcaggccaagtcct

SEQ ID NO: 9143535 - DNA, 22 bp, Homo sapiens
tccttcctgctctaacattcag

SEQ ID NO: 9143536 - DNA, 21 bp, Homo sapiens
tccttcccccttggcctggga

SEQ ID NO: 9143537 - DNA, 22 bp, Homo sapiens
ccagagacaaggagctggagtc

SEQ ID NO: 9143538 - DNA, 22 bp, Homo sapiens
ccagagaattttagacaaaaat

SEQ ID NO: 9143539 - DNA, 22 bp, Homo sapiens
ccagagaaggtggagcttgtgt

SEQ ID NO: 9143540 - DNA, 22 bp, Homo sapiens
ccagagaaccttgagctgtgag

SEQ ID NO: 9143541 - DNA, 22 bp, Homo sapiens
ccagagaagaaaagcacctttt

SEQ ID NO: 9143542 - DNA, 22 bp, Homo sapiens
ccagagaaccttgagctgtgag

SEQ ID NO: 9143543 - DNA, 22 bp, Homo sapiens
tctaatcctatggtggggaggg

SEQ ID NO: 9143544 - DNA, 22 bp, Homo sapiens
tctaatccttgctacctgggtg

SEQ ID NO: 9143545 - DNA, 22 bp, Homo sapiens
ccagacaggggctgttcctgct

SEQ ID NO: 9143546 - DNA, 22 bp, Homo sapiens
ccagacaggggctgttcctgct

SEQ ID NO: 9143547 - DNA, 22 bp, Homo sapiens
tctaatcctatggtggggaggg

SEQ ID NO: 9143548 - DNA, 22 bp, Homo sapiens
tctaagggaaggtgatatgtta

SEQ ID NO: 9143549 - DNA, 22 bp, Homo sapiens
tctaagtaaaatttgtcatttc

SEQ ID NO: 9143550 - DNA, 22 bp, Homo sapiens
ccactgtttttcagttaacttt

SEQ ID NO: 9143551 - DNA, 22 bp, Homo sapiens
ccacttcctgcaggtaaggagc

SEQ ID NO: 9143552 - DNA, 22 bp, Homo sapiens
tctaagatctactatacatgtg

SEQ ID NO: 9143553 - DNA, 22 bp, Homo sapiens
ccactgtcttttccaggctgaa

SEQ ID NO: 9143554 - DNA, 22 bp, Homo sapiens
ccactgtctgtgacatcagaaa

SEQ ID NO: 9143555 - DNA, 22 bp, Homo sapiens
ccactgtcttttccaggctgaa

SEQ ID NO: 9143556 - DNA, 22 bp, Homo sapiens
ccactgtattttggaagcagat

SEQ ID NO: 9143557 - DNA, 22 bp, Homo sapiens
ccactgtatcttccttgaattt

SEQ ID NO: 9143558 - DNA, 22 bp, Homo sapiens
ccactgtatagccactgccggt

SEQ ID NO: 9143559 - DNA, 22 bp, Homo sapiens
ccactggttttattgtagctta

SEQ ID NO: 9143560 - DNA, 22 bp, Homo sapiens
ccactgctaacttgctgcagct

SEQ ID NO: 9143561 - DNA, 22 bp, Homo sapiens
ccactgtagttatgatgaagtt

SEQ ID NO: 9143562 - DNA, 22 bp, Homo sapiens
ccactgtagagatttgaatgcc

SEQ ID NO: 9143563 - DNA, 22 bp, Homo sapiens
ccacagaaagttgtctagagta

SEQ ID NO: 9143564 - DNA, 22 bp, Homo sapiens
tcctggctccagcagctcttcc

SEQ ID NO: 9143565 - DNA, 22 bp, Homo sapiens
tcctggctccagcagctcttcc

SEQ ID NO: 9143566 - DNA, 22 bp, Homo sapiens
tcctgggactttcaaggctagg

SEQ ID NO: 9143567 - DNA, 22 bp, Homo sapiens
tcctgggactttcaaggctagg

SEQ ID NO: 9143568 - DNA, 22 bp, Homo sapiens
tcctgggactctttatcagaga

SEQ ID NO: 9143569 - DNA, 22 bp, Homo sapiens
tcctgggagacccagctgtgga

SEQ ID NO: 9143570 - DNA, 22 bp, Homo sapiens
tcctgggagagtgggactgtat

SEQ ID NO: 9143571 - DNA, 22 bp, Homo sapiens
tcctgggagagtgggactgtat

SEQ ID NO: 9143572 - DNA, 22 bp, Homo sapiens
tcctgggcttaagtgatcctcc

SEQ ID NO: 9143573 - DNA, 22 bp, Homo sapiens
tcctgggagcccttgctccacc

SEQ ID NO: 9143574 - DNA, 22 bp, Homo sapiens
tcctgggctgtgtgccactctg

SEQ ID NO: 9143575 - DNA, 22 bp, Homo sapiens
tcctgggagcacatggtcctgc

SEQ ID NO: 9143576 - DNA, 22 bp, Homo sapiens
tcctgggagcacatggtcctgc

SEQ ID NO: 9143577 - DNA, 22 bp, Homo sapiens
tcctgggagcatggtgccgtga

SEQ ID NO: 9143578 - DNA, 22 bp, Homo sapiens
tcctgggagcatgaagagggat

SEQ ID NO: 9143579 - DNA, 22 bp, Homo sapiens
ccacagaaaataaagcacgatt

SEQ ID NO: 9143580 - DNA, 22 bp, Homo sapiens
ccacagaaaataaagcacgatt

SEQ ID NO: 9143581 - DNA, 22 bp, Homo sapiens
ccacactgaccagctgtgagac

SEQ ID NO: 9143582 - DNA, 22 bp, Homo sapiens
ccacacagggggatgagttatt

SEQ ID NO: 9143583 - DNA, 22 bp, Homo sapiens
ccacacagtcagtttccaagaa

SEQ ID NO: 9143584 - DNA, 19 bp, Homo sapiens
ccacacagtgtgcaattta

SEQ ID NO: 9143585 - DNA, 22 bp, Homo sapiens
ccacaccatcgtttttacctta

SEQ ID NO: 9143586 - DNA, 22 bp, Homo sapiens
ccacactaaactgctcaaacca

SEQ ID NO: 9143587 - DNA, 21 bp, Homo sapiens
tcctggcaggcccaggaccct

SEQ ID NO: 9143588 - DNA, 21 bp, Homo sapiens
tcctggcaggcccaggaccct

SEQ ID NO: 9143589 - DNA, 22 bp, Homo sapiens
tcctggcagcccgcaggtgctg

SEQ ID NO: 9143590 - DNA, 22 bp, Homo sapiens
tcctggcagggtctaggtctag

SEQ ID NO: 9143591 - DNA, 22 bp, Homo sapiens
tcctggcagggtctaggtctag

SEQ ID NO: 9143592 - DNA, 22 bp, Homo sapiens
tcctggcaggtcagcaggagca

SEQ ID NO: 9143593 - DNA, 22 bp, Homo sapiens
tcctggcagggtggcagcgggt

SEQ ID NO: 9143594 - DNA, 22 bp, Homo sapiens
tcctggcaggtctgagaggtct

SEQ ID NO: 9143595 - DNA, 22 bp, Homo sapiens
tcctggcagtcaaataaccttg

SEQ ID NO: 9143596 - DNA, 22 bp, Homo sapiens
ccaaggaggccccaggtcagct

SEQ ID NO: 9143597 - DNA, 22 bp, Homo sapiens
ccaaggagtagagcaggaagct

SEQ ID NO: 9143598 - DNA, 22 bp, Homo sapiens
ccaaggagtagagcaggaagct

SEQ ID NO: 9143599 - DNA, 22 bp, Homo sapiens
ccaaggcaatgtgcagctggtg

SEQ ID NO: 9143600 - DNA, 22 bp, Homo sapiens
ccaaggcaatgtgcagctggtg

SEQ ID NO: 9143601 - DNA, 22 bp, Homo sapiens
ccaaggcaacgttggtgtcagg

SEQ ID NO: 9143602 - DNA, 22 bp, Homo sapiens
ccaaggcaacgttggtgtcagg

SEQ ID NO: 9143603 - DNA, 22 bp, Homo sapiens
ccaaggcaacgttggtgtcagg

SEQ ID NO: 9143604 - DNA, 22 bp, Homo sapiens
ccaaggcacactctgcaaggtt

SEQ ID NO: 9143605 - DNA, 22 bp, Homo sapiens
ccaaggcagaagatggctcttg

SEQ ID NO: 9143606 - DNA, 22 bp, Homo sapiens
tcctaaggcaccagcttcctgt

SEQ ID NO: 9143607 - DNA, 22 bp, Homo sapiens
tcctagaaagatgtcttttcac

SEQ ID NO: 9143608 - DNA, 22 bp, Homo sapiens
tcctagaactccaggacagtcc

SEQ ID NO: 9143609 - DNA, 22 bp, Homo sapiens
tcctagaacagcccacctggaa

SEQ ID NO: 9143610 - DNA, 22 bp, Homo sapiens
ccaagaggttgaggctgcagtg

SEQ ID NO: 9143611 - DNA, 22 bp, Homo sapiens
ccaagaggttgaggctgcagtg

SEQ ID NO: 9143612 - DNA, 22 bp, Homo sapiens
ccaagaggttgaggctgcagtg

SEQ ID NO: 9143613 - DNA, 22 bp, Homo sapiens
ccaagaggttgtgaggcaggca

SEQ ID NO: 9143614 - DNA, 22 bp, Homo sapiens
ccaaggagaatgacaccatgga

SEQ ID NO: 9143615 - DNA, 22 bp, Homo sapiens
ccaaggagcaaggctcaacaag

SEQ ID NO: 9143616 - DNA, 22 bp, Homo sapiens
ccaaggcttcccagagatgctc

SEQ ID NO: 9143617 - DNA, 22 bp, Homo sapiens
tcctggaggacagaggcatctc

SEQ ID NO: 9143618 - DNA, 22 bp, Homo sapiens
tcctggaggacagaggcatctc

SEQ ID NO: 9143619 - DNA, 22 bp, Homo sapiens
tcctggaggagatccaatctga

SEQ ID NO: 9143620 - DNA, 22 bp, Homo sapiens
tcctggaggacagaggcatctc

SEQ ID NO: 9143621 - DNA, 22 bp, Homo sapiens
tcctggcactttgggggctcgc

SEQ ID NO: 9143622 - DNA, 22 bp, Homo sapiens
tcctggcagagagcatgaggcc

SEQ ID NO: 9143623 - DNA, 22 bp, Homo sapiens
tcctggcagagagcatgaggcc

SEQ ID NO: 9143624 - DNA, 22 bp, Homo sapiens
tcctggcagagggcggcctcga

SEQ ID NO: 9143625 - DNA, 22 bp, Homo sapiens
tcctggcagaaatggggctgtg

SEQ ID NO: 9143626 - DNA, 22 bp, Homo sapiens
ccaaggctcctcagctggtctt

SEQ ID NO: 9143627 - DNA, 18 bp, Homo sapiens
ccaaggcccctgctgggg

SEQ ID NO: 9143628 - DNA, 22 bp, Homo sapiens
catttattcatgatctgtagct

SEQ ID NO: 9143629 - DNA, 22 bp, Homo sapiens
catttattcatgatctgtagct

SEQ ID NO: 9143630 - DNA, 22 bp, Homo sapiens
catttattcatttgctagggct

SEQ ID NO: 9143631 - DNA, 22 bp, Homo sapiens
catttattcatgatctgtagct

SEQ ID NO: 9143632 - DNA, 22 bp, Homo sapiens
catttattcatgatctgtagct

SEQ ID NO: 9143633 - DNA, 22 bp, Homo sapiens
catttattctcagatccttgtc

SEQ ID NO: 9143634 - DNA, 22 bp, Homo sapiens
catttattctcagatccttgtc

SEQ ID NO: 9143635 - DNA, 22 bp, Homo sapiens
catttattctcagatccttgtc

SEQ ID NO: 9143636 - DNA, 22 bp, Homo sapiens
catttattgagtggccacagtg

SEQ ID NO: 9143637 - DNA, 22 bp, Homo sapiens
catttattgagtggccacagtg

SEQ ID NO: 9143638 - DNA, 22 bp, Homo sapiens
catttattctcagatccttgtc

SEQ ID NO: 9143639 - DNA, 22 bp, Homo sapiens
tccctccttaataagaggtctg

SEQ ID NO: 9143640 - DNA, 22 bp, Homo sapiens
tccctctacagggaagcgcttt

SEQ ID NO: 9143641 - DNA, 22 bp, Homo sapiens
tccctctccctattgcctggag

SEQ ID NO: 9143642 - DNA, 22 bp, Homo sapiens
tccctctccctattgcctggag

SEQ ID NO: 9143643 - DNA, 22 bp, Homo sapiens
catttattcagctcagtcggtt

SEQ ID NO: 9143644 - DNA, 22 bp, Homo sapiens
catttattagttagttcgatgt

SEQ ID NO: 9143645 - DNA, 22 bp, Homo sapiens
catttattagttagttcgatgt

SEQ ID NO: 9143646 - DNA, 18 bp, Homo sapiens
tccctggggctgccaccc

SEQ ID NO: 9143647 - DNA, 18 bp, Homo sapiens
tccctggggctgccaccc

SEQ ID NO: 9143648 - DNA, 20 bp, Homo sapiens
tccctggggccctacttcct

SEQ ID NO: 9143649 - DNA, 20 bp, Homo sapiens
tccctggggccctacttcct

SEQ ID NO: 9143650 - DNA, 22 bp, Homo sapiens
tccctgctttcttgtgagggga

SEQ ID NO: 9143651 - DNA, 22 bp, Homo sapiens
catttattgagtggccacagtg

SEQ ID NO: 9143652 - DNA, 22 bp, Homo sapiens
tccctggaacagagagacaacg

SEQ ID NO: 9143653 - DNA, 22 bp, Homo sapiens
tccctggggttcctccagccac

SEQ ID NO: 9143654 - DNA, 22 bp, Homo sapiens
tccctggggttcctccagccac

SEQ ID NO: 9143655 - DNA, 22 bp, Homo sapiens
tccctggggtatcgctgaggca

SEQ ID NO: 9143656 - DNA, 22 bp, Homo sapiens
tccctggggtatcgctgaggca

SEQ ID NO: 9143657 - DNA, 22 bp, Homo sapiens
tccctggggtatcgctgaggca

SEQ ID NO: 9143658 - DNA, 22 bp, Homo sapiens
tccctggggtaacattagaggg

SEQ ID NO: 9143659 - DNA, 22 bp, Homo sapiens
tccctgggtcctgcttgctctc

SEQ ID NO: 9143660 - DNA, 22 bp, Homo sapiens
tccctgggtcctgcttgctctc

SEQ ID NO: 9143661 - DNA, 22 bp, Homo sapiens
tccctgggtcctgcttgctctc

SEQ ID NO: 9143662 - DNA, 22 bp, Homo sapiens
tccctgggttcccgtggaagtg

SEQ ID NO: 9143663 - DNA, 22 bp, Homo sapiens
cattgtcacccaaagctcatag

SEQ ID NO: 9143664 - DNA, 22 bp, Homo sapiens
cattgtacagttattttaaaat

SEQ ID NO: 9143665 - DNA, 18 bp, Homo sapiens
cattgtacaatgctttat

SEQ ID NO: 9143666 - DNA, 22 bp, Homo sapiens
tcccactcccaggcaggcctct

SEQ ID NO: 9143667 - DNA, 22 bp, Homo sapiens
tcccactcccaggcaggcctct

SEQ ID NO: 9143668 - DNA, 22 bp, Homo sapiens
catttaaaggttgtgggtaaaa

SEQ ID NO: 9143669 - DNA, 22 bp, Homo sapiens
catttaaaggttgtgggtaaaa

SEQ ID NO: 9143670 - DNA, 18 bp, Homo sapiens
cattgtttccagaagacc

SEQ ID NO: 9143671 - DNA, 22 bp, Homo sapiens
cattgtttgagcatctgggatc

SEQ ID NO: 9143672 - DNA, 22 bp, Homo sapiens
cattgtcattctatgctattca

SEQ ID NO: 9143673 - DNA, 22 bp, Homo sapiens
cattgtgtatttctgtagtact

SEQ ID NO: 9143674 - DNA, 22 bp, Homo sapiens
cattgttaattggtatcttaca

SEQ ID NO: 9143675 - DNA, 22 bp, Homo sapiens
tccctcctgcatgaggctcggc

SEQ ID NO: 9143676 - DNA, 18 bp, Homo sapiens
tccctcctgcctgcttcc

SEQ ID NO: 9143677 - DNA, 22 bp, Homo sapiens
tccctcctggccgtcaccgctg

SEQ ID NO: 9143678 - DNA, 22 bp, Homo sapiens
tccctcctggccgtcaccgctg

SEQ ID NO: 9143679 - DNA, 22 bp, Homo sapiens
tccctccttaataagaggtctg

SEQ ID NO: 9143680 - DNA, 22 bp, Homo sapiens
tccctccttaataagaggtctg

SEQ ID NO: 9143681 - DNA, 22 bp, Homo sapiens
tccctccttaataagaggtctg

SEQ ID NO: 9143682 - DNA, 22 bp, Homo sapiens
tccctcctggtgatgatgcaaa

SEQ ID NO: 9143683 - DNA, 22 bp, Homo sapiens
tccctcctggtgagcaggggct

SEQ ID NO: 9143684 - DNA, 22 bp, Homo sapiens
tccctcctggtgatgatgcaaa

SEQ ID NO: 9143685 - DNA, 22 bp, Homo sapiens
tccctcctgcatgaggctcggc

SEQ ID NO: 9143686 - DNA, 22 bp, Homo sapiens
tccctcctgcatgaggctcggc

SEQ ID NO: 9143687 - DNA, 20 bp, Homo sapiens
tccctcctgcagatagagaa

SEQ ID NO: 9143688 - DNA, 22 bp, Homo sapiens
catttacaatgtacaggttgtg

SEQ ID NO: 9143689 - DNA, 22 bp, Homo sapiens
catttaatcctcacaagcctat

SEQ ID NO: 9143690 - DNA, 22 bp, Homo sapiens
catttaatagatgctgtttcag

SEQ ID NO: 9143691 - DNA, 22 bp, Homo sapiens
catttaatctggctcatgagca

SEQ ID NO: 9143692 - DNA, 22 bp, Homo sapiens
cattctccctattgaaaaagta

SEQ ID NO: 9143693 - DNA, 22 bp, Homo sapiens
cattctatcttggactggatct

SEQ ID NO: 9143694 - DNA, 22 bp, Homo sapiens
cattctaaagtgttttatacct

SEQ ID NO: 9143695 - DNA, 22 bp, Homo sapiens
cattagctatctgtttacatta

SEQ ID NO: 9143696 - DNA, 22 bp, Homo sapiens
cattagaactaagatgtccagg

SEQ ID NO: 9143697 - DNA, 22 bp, Homo sapiens
cattagacacagatgtataaat

SEQ ID NO: 9143698 - DNA, 22 bp, Homo sapiens
cattacatttcaaaatgtttcc

SEQ ID NO: 9143699 - DNA, 19 bp, Homo sapiens
cattaccctgtaagggcag

SEQ ID NO: 9143700 - DNA, 22 bp, Homo sapiens
cattacccttcattacttgagg

SEQ ID NO: 9143701 - DNA, 22 bp, Homo sapiens
cattctcttgacaggacagccc

SEQ ID NO: 9143702 - DNA, 22 bp, Homo sapiens
cattctctgatcttcacatacc

SEQ ID NO: 9143703 - DNA, 22 bp, Homo sapiens
cattctctacactcctgccctg

SEQ ID NO: 9143704 - DNA, 22 bp, Homo sapiens
cattcttacacaatattttaat

SEQ ID NO: 9143705 - DNA, 22 bp, Homo sapiens
tcccaccaggtgaccatttcat

SEQ ID NO: 9143706 - DNA, 22 bp, Homo sapiens
tcccacccatcctgcatctctt

SEQ ID NO: 9143707 - DNA, 22 bp, Homo sapiens
tcccaccaggtgaccatttcat

SEQ ID NO: 9143708 - DNA, 22 bp, Homo sapiens
tcccacatgtgaatcctcaggt

SEQ ID NO: 9143709 - DNA, 22 bp, Homo sapiens
tcccacattaccctgactgaca

SEQ ID NO: 9143710 - DNA, 22 bp, Homo sapiens
tcccaccccttgactctttaag

SEQ ID NO: 9143711 - DNA, 22 bp, Homo sapiens
tccattttagaagaaaatccac

SEQ ID NO: 9143712 - DNA, 22 bp, Homo sapiens
tccatattaactaaaactagaa

SEQ ID NO: 9143713 - DNA, 22 bp, Homo sapiens
tccatcaccacagaggacagag

SEQ ID NO: 9143714 - DNA, 22 bp, Homo sapiens
catgggctacagaagcatgctg

SEQ ID NO: 9143715 - DNA, 22 bp, Homo sapiens
catgggcagttggcagggctca

SEQ ID NO: 9143716 - DNA, 22 bp, Homo sapiens
catgggcagaagtggcatcatt

SEQ ID NO: 9143717 - DNA, 22 bp, Homo sapiens
tccattttctaagtatcactta

SEQ ID NO: 9143718 - DNA, 22 bp, Homo sapiens
tccattttcatctcatgtataa

SEQ ID NO: 9143719 - DNA, 22 bp, Homo sapiens
tccattttcatctcatgtataa

SEQ ID NO: 9143720 - DNA, 22 bp, Homo sapiens
tccattttagagatgaagaaac

SEQ ID NO: 9143721 - DNA, 22 bp, Homo sapiens
tccattttagagatgaagaaac

SEQ ID NO: 9143722 - DNA, 22 bp, Homo sapiens
tccattttctcttccggaggtg

SEQ ID NO: 9143723 - DNA, 22 bp, Homo sapiens
tccattttcttgctctaggtaa

SEQ ID NO: 9143724 - DNA, 22 bp, Homo sapiens
tccattttgtaggtatgctaca

SEQ ID NO: 9143725 - DNA, 22 bp, Homo sapiens
tccatttttcatgactcctcaa

SEQ ID NO: 9143726 - DNA, 23 bp, Homo sapiens
tccaggagaattccagggcccgg

SEQ ID NO: 9143727 - DNA, 22 bp, Homo sapiens
tccaggagacacaaggtacata

SEQ ID NO: 9143728 - DNA, 22 bp, Homo sapiens
tccaggagattcattaggtcat

SEQ ID NO: 9143729 - DNA, 22 bp, Homo sapiens
tccaggagatacactgcaccag

SEQ ID NO: 9143730 - DNA, 22 bp, Homo sapiens
catgggaggcctgctgctggtg

SEQ ID NO: 9143731 - DNA, 22 bp, Homo sapiens
catgggcaccttaaaatgaggc

SEQ ID NO: 9143732 - DNA, 23 bp, Homo sapiens
catgggagtgagaatgccagctc

SEQ ID NO: 9143733 - DNA, 21 bp, Homo sapiens
tccaggagcacgggactagga

SEQ ID NO: 9143734 - DNA, 22 bp, Homo sapiens
catgggaggcctgctgctggtg

SEQ ID NO: 9143735 - DNA, 22 bp, Homo sapiens
catgggaggcctgctgctggtg

SEQ ID NO: 9143736 - DNA, 21 bp, Homo sapiens
tccaggagcacgggactagga

SEQ ID NO: 9143737 - DNA, 22 bp, Homo sapiens
tttcattgcctttggaaggtct

SEQ ID NO: 9143738 - DNA, 22 bp, Homo sapiens
tttcattgtcaataaactgtat

SEQ ID NO: 9143739 - DNA, 22 bp, Homo sapiens
tttcattggctccctgatgaat

SEQ ID NO: 9143740 - DNA, 22 bp, Homo sapiens
tttcattggctccctgatgaat

SEQ ID NO: 9143741 - DNA, 20 bp, Homo sapiens
tttcattgtcagaatcttat

SEQ ID NO: 9143742 - DNA, 22 bp, Homo sapiens
tttcatttcatagaattgtgtt

SEQ ID NO: 9143743 - DNA, 22 bp, Homo sapiens
tttcattgtctacatatgacat

SEQ ID NO: 9143744 - DNA, 22 bp, Homo sapiens
tttcatttcatagaattgtgtt

SEQ ID NO: 9143745 - DNA, 22 bp, Homo sapiens
tttcatttcatagaattgtgtt

SEQ ID NO: 9143746 - DNA, 22 bp, Homo sapiens
tttcattttggttatgccataa

SEQ ID NO: 9143747 - DNA, 22 bp, Homo sapiens
tttcattttggttatgccataa

SEQ ID NO: 9143748 - DNA, 22 bp, Homo sapiens
tttcattttggttatgccataa

SEQ ID NO: 9143749 - DNA, 22 bp, Homo sapiens
tttccaaaatgaatctaatgca

SEQ ID NO: 9143750 - DNA, 22 bp, Homo sapiens
tttccaaaatgaatctaatgca

SEQ ID NO: 9143751 - DNA, 22 bp, Homo sapiens
tttccaaagctgagttgagcaa

SEQ ID NO: 9143752 - DNA, 22 bp, Homo sapiens
tttccaaaatgaatctaatgca

SEQ ID NO: 9143753 - DNA, 22 bp, Homo sapiens
tttccaaaagtttgttctgtgc

SEQ ID NO: 9143754 - DNA, 22 bp, Homo sapiens
tttccaaaggtggcaggaacaa

SEQ ID NO: 9143755 - DNA, 22 bp, Homo sapiens
tttccaaaggtggcaggaacaa

SEQ ID NO: 9143756 - DNA, 22 bp, Homo sapiens
tttccaaaggtggcaggaacaa

SEQ ID NO: 9143757 - DNA, 22 bp, Homo sapiens
tttccaaagttgccataagctt

SEQ ID NO: 9143758 - DNA, 22 bp, Homo sapiens
tttccaaataaggtcacactca

SEQ ID NO: 9143759 - DNA, 22 bp, Homo sapiens
tttccaaaggctaaactcagtt

SEQ ID NO: 9143760 - DNA, 22 bp, Homo sapiens
tttccaaaggctaaactcagtt

SEQ ID NO: 9143761 - DNA, 22 bp, Homo sapiens
tttccaaaggctaaactcagtt

SEQ ID NO: 9143762 - DNA, 16 bp, Homo sapiens
tttccaaagggcagct

SEQ ID NO: 9143763 - DNA, 22 bp, Homo sapiens
tttccaaacccagcgagctaca

SEQ ID NO: 9143764 - DNA, 22 bp, Homo sapiens
tttccaaagctgagttgagcaa

SEQ ID NO: 9143765 - DNA, 22 bp, Homo sapiens
tttccaaaggagtaccacgcat

SEQ ID NO: 9143766 - DNA, 22 bp, Homo sapiens
tttccaaaggaggaaccagttt

SEQ ID NO: 9143767 - DNA, 22 bp, Homo sapiens
tttccaaaggaggaaccagttt

SEQ ID NO: 9143768 - DNA, 22 bp, Homo sapiens
tttccaaaggaggaaccagttt

SEQ ID NO: 9143769 - DNA, 22 bp, Homo sapiens
tttcctcttcttcccatgtcat

SEQ ID NO: 9143770 - DNA, 22 bp, Homo sapiens
tttcctctgggccctgccaccc

SEQ ID NO: 9143771 - DNA, 22 bp, Homo sapiens
tttcctctgggccctgccaccc

SEQ ID NO: 9143772 - DNA, 22 bp, Homo sapiens
tttcctctgtcatgacagctga

SEQ ID NO: 9143773 - DNA, 22 bp, Homo sapiens
tttcctctgtcatgacagctga

SEQ ID NO: 9143774 - DNA, 22 bp, Homo sapiens
tttcctctgctgccattgcccc

SEQ ID NO: 9143775 - DNA, 22 bp, Homo sapiens
tttcctctgctgccattgcccc

SEQ ID NO: 9143776 - DNA, 22 bp, Homo sapiens
tttcagggtacatggagcaaat

SEQ ID NO: 9143777 - DNA, 22 bp, Homo sapiens
tttcaggtaagaaaactaagaa

SEQ ID NO: 9143778 - DNA, 22 bp, Homo sapiens
tttcaggagagaccagaaatga

SEQ ID NO: 9143779 - DNA, 22 bp, Homo sapiens
tttcagctggtaaaggagtagc

SEQ ID NO: 9143780 - DNA, 22 bp, Homo sapiens
tttcagagttgtcttcttgacc

SEQ ID NO: 9143781 - DNA, 22 bp, Homo sapiens
tttcagataaatatgggactaa

SEQ ID NO: 9143782 - DNA, 22 bp, Homo sapiens
tttcagatgaaatgtgtatatt

SEQ ID NO: 9143783 - DNA, 22 bp, Homo sapiens
tttcagatcttctttgggttaa

SEQ ID NO: 9143784 - DNA, 22 bp, Homo sapiens
tttcagatgaaatgtgtatatt

SEQ ID NO: 9143785 - DNA, 22 bp, Homo sapiens
tttcagatggtatatacagtag

SEQ ID NO: 9143786 - DNA, 22 bp, Homo sapiens
tttcagatggtatatacagtag

SEQ ID NO: 9143787 - DNA, 22 bp, Homo sapiens
tttcagattatctcaactttgg

SEQ ID NO: 9143788 - DNA, 20 bp, Homo sapiens
tttcagatttacagaaatgt

SEQ ID NO: 9143789 - DNA, 20 bp, Homo sapiens
tttcagatttacagaaatgt

SEQ ID NO: 9143790 - DNA, 22 bp, Homo sapiens
tttcaaagagttgtaaattact

SEQ ID NO: 9143791 - DNA, 23 bp, Homo sapiens
tttcaaagactttcccttagagt

SEQ ID NO: 9143792 - DNA, 22 bp, Homo sapiens
tttcaaagaccattaactatca

SEQ ID NO: 9143793 - DNA, 22 bp, Homo sapiens
tttcaaactttactcttgaatc

SEQ ID NO: 9143794 - DNA, 20 bp, Homo sapiens
tttcaaaggcacctatgaag

SEQ ID NO: 9143795 - DNA, 22 bp, Homo sapiens
tttcagaggtatgctgcttatc

SEQ ID NO: 9143796 - DNA, 22 bp, Homo sapiens
tttcagaggaggaaggcagtta

SEQ ID NO: 9143797 - DNA, 22 bp, Homo sapiens
tttcagaggaaatctcattgag

SEQ ID NO: 9143798 - DNA, 22 bp, Homo sapiens
tttcagaggtgcttggaatgct

SEQ ID NO: 9143799 - DNA, 22 bp, Homo sapiens
tttcagagtcagctcctctcta

SEQ ID NO: 9143800 - DNA, 22 bp, Homo sapiens
tttcagagttagtagagcatgt

SEQ ID NO: 9143801 - DNA, 20 bp, Homo sapiens
tttcagagtgtctttccatt

SEQ ID NO: 9143802 - DNA, 22 bp, Homo sapiens
tttcagagtctggctgcagcct

SEQ ID NO: 9143803 - DNA, 22 bp, Homo sapiens
tttctaaggtgaggtagaaaat

SEQ ID NO: 9143804 - DNA, 22 bp, Homo sapiens
tttccttctcagggagcttcaa

SEQ ID NO: 9143805 - DNA, 22 bp, Homo sapiens
tttccttctcagggagcttcaa

SEQ ID NO: 9143806 - DNA, 22 bp, Homo sapiens
tttccttcctaaggtgaagcaa

SEQ ID NO: 9143807 - DNA, 22 bp, Homo sapiens
tttccttccaggttcctaaggc

SEQ ID NO: 9143808 - DNA, 22 bp, Homo sapiens
tttccttccatgttgggcaaaa

SEQ ID NO: 9143809 - DNA, 22 bp, Homo sapiens
tttccttcatcatctgagagct

SEQ ID NO: 9143810 - DNA, 22 bp, Homo sapiens
tttcctgttgccatcaagaatg

SEQ ID NO: 9143811 - DNA, 22 bp, Homo sapiens
tttcctgtcctggtacttggca

SEQ ID NO: 9143812 - DNA, 22 bp, Homo sapiens
tttcctgtcttttgtgaaggat

SEQ ID NO: 9143813 - DNA, 22 bp, Homo sapiens
tttcctgttgccatcaagaatg

SEQ ID NO: 9143814 - DNA, 22 bp, Homo sapiens
tttcctggttggggacgtggtt

SEQ ID NO: 9143815 - DNA, 22 bp, Homo sapiens
tttcctctttgtgacacagctg

SEQ ID NO: 9143816 - DNA, 22 bp, Homo sapiens
tttcctctttgtgacacagctg

SEQ ID NO: 9143817 - DNA, 22 bp, Homo sapiens
tttcctctttgtaccttgacta

SEQ ID NO: 9143818 - DNA, 22 bp, Homo sapiens
tttctaagtaagattaacttct

SEQ ID NO: 9143819 - DNA, 22 bp, Homo sapiens
tttctcatggaacatagctcct

SEQ ID NO: 9143820 - DNA, 22 bp, Homo sapiens
tttctcatggaacatcgtttag

SEQ ID NO: 9143821 - DNA, 22 bp, Homo sapiens
tttctcatctggaaacagtgct

SEQ ID NO: 9143822 - DNA, 22 bp, Homo sapiens
tttctcatagtcatgcctctta

SEQ ID NO: 9143823 - DNA, 23 bp, Homo sapiens
tttctcatccagagagtcagtcc

SEQ ID NO: 9143824 - DNA, 21 bp, Homo sapiens
tttctccaagtgactgattcc

SEQ ID NO: 9143825 - DNA, 22 bp, Homo sapiens
tttctccaatgtatcagcacac

SEQ ID NO: 9143826 - DNA, 22 bp, Homo sapiens
tttctccaatgtatcagcacac

SEQ ID NO: 9143827 - DNA, 22 bp, Homo sapiens
tttctccacgccagcttgctta

SEQ ID NO: 9143828 - DNA, 22 bp, Homo sapiens
tttctccacttctcttgccaac

SEQ ID NO: 9143829 - DNA, 22 bp, Homo sapiens
tttctcatggcccttggctttt

SEQ ID NO: 9143830 - DNA, 22 bp, Homo sapiens
tttctccatcaccccctcggtg

SEQ ID NO: 9143831 - DNA, 22 bp, Homo sapiens
tttctccatcaccccctcggtg

SEQ ID NO: 9143832 - DNA, 22 bp, Homo sapiens
tttctccagaagaggaagcgga

SEQ ID NO: 9143833 - DNA, 22 bp, Homo sapiens
tttctccaatgtatcagcacac

SEQ ID NO: 9143834 - DNA, 22 bp, Homo sapiens
tttctccagaagaggaagcgga

SEQ ID NO: 9143835 - DNA, 20 bp, Homo sapiens
tttctcccaagtgcaagggt

SEQ ID NO: 9143836 - DNA, 20 bp, Homo sapiens
tttctcccaagtgcaagggt

SEQ ID NO: 9143837 - DNA, 22 bp, Homo sapiens
tttctcccaactctggaagcca

SEQ ID NO: 9143838 - DNA, 22 bp, Homo sapiens
tttctcctcatgactggttgtg

SEQ ID NO: 9143839 - DNA, 22 bp, Homo sapiens
tttctcctccagagagacacag

SEQ ID NO: 9143840 - DNA, 22 bp, Homo sapiens
tttctcctcatgactggttgtg

SEQ ID NO: 9143841 - DNA, 22 bp, Homo sapiens
tttctcctccagagagacacag

SEQ ID NO: 9143842 - DNA, 22 bp, Homo sapiens
tttctatttacagtgctaggta

SEQ ID NO: 9143843 - DNA, 22 bp, Homo sapiens
tttctagaaaccaagatattgt

SEQ ID NO: 9143844 - DNA, 22 bp, Homo sapiens
tttctagaaagttcatgtgttt

SEQ ID NO: 9143845 - DNA, 22 bp, Homo sapiens
tttctactgttatgacactggg

SEQ ID NO: 9143846 - DNA, 22 bp, Homo sapiens
tttctactcatcctttggagaa

SEQ ID NO: 9143847 - DNA, 22 bp, Homo sapiens
tttctcagtcacatgaaccaat

SEQ ID NO: 9143848 - DNA, 22 bp, Homo sapiens
tttctcagctcagcatctgggt

SEQ ID NO: 9143849 - DNA, 19 bp, Homo sapiens
tttctcaggaagtttgtgt

SEQ ID NO: 9143850 - DNA, 22 bp, Homo sapiens
tttctcagttactagctgtggt

SEQ ID NO: 9143851 - DNA, 22 bp, Homo sapiens
tttctcagtgtagcttttcaag

SEQ ID NO: 9143852 - DNA, 21 bp, Homo sapiens
tttctcataaaatactcatta

SEQ ID NO: 9143853 - DNA, 21 bp, Homo sapiens
tttctcagttgtgtgagcagc

SEQ ID NO: 9143854 - DNA, 22 bp, Homo sapiens
tttctctttcaatctgcagtac

SEQ ID NO: 9143855 - DNA, 22 bp, Homo sapiens
tttctctttcaatctgcagtac

SEQ ID NO: 9143856 - DNA, 22 bp, Homo sapiens
tttctctttcaatctgcagtac

SEQ ID NO: 9143857 - DNA, 22 bp, Homo sapiens
tttctctttgacaggaatcaga

SEQ ID NO: 9143858 - DNA, 22 bp, Homo sapiens
tttctctttggaggggctgaat

SEQ ID NO: 9143859 - DNA, 22 bp, Homo sapiens
tttctcttgcgatatgctacac

SEQ ID NO: 9143860 - DNA, 22 bp, Homo sapiens
tttctcttcactgtgtgcctca

SEQ ID NO: 9143861 - DNA, 22 bp, Homo sapiens
tttctcttgcgatatgctacac

SEQ ID NO: 9143862 - DNA, 22 bp, Homo sapiens
tttctcttcactgtgtgcctca

SEQ ID NO: 9143863 - DNA, 22 bp, Homo sapiens
tttctgaagatacagctttgct

SEQ ID NO: 9143864 - DNA, 21 bp, Homo sapiens
tttctgaaggcaacatctatc

SEQ ID NO: 9143865 - DNA, 22 bp, Homo sapiens
tttctgaaatgctggctttgga

SEQ ID NO: 9143866 - DNA, 22 bp, Homo sapiens
tttctgaaatctcttttgagga

SEQ ID NO: 9143867 - DNA, 22 bp, Homo sapiens
tttctgaaacatggtctttgta

SEQ ID NO: 9143868 - DNA, 22 bp, Homo sapiens
tttctcctctccagagtgcagt

SEQ ID NO: 9143869 - DNA, 22 bp, Homo sapiens
tttctcctgagttccacgctac

SEQ ID NO: 9143870 - DNA, 22 bp, Homo sapiens
tttctcctgcccagatgcctgg

SEQ ID NO: 9143871 - DNA, 22 bp, Homo sapiens
tttctcctgcccagatgcctgg

SEQ ID NO: 9143872 - DNA, 22 bp, Homo sapiens
tttctcctgtgtaagccgccca

SEQ ID NO: 9143873 - DNA, 22 bp, Homo sapiens
tttctcctgtgaggtcagaagt

SEQ ID NO: 9143874 - DNA, 22 bp, Homo sapiens
tttctcctgtgaggtcagaagt

SEQ ID NO: 9143875 - DNA, 22 bp, Homo sapiens
tttctccttgtgtctcctttga

SEQ ID NO: 9143876 - DNA, 22 bp, Homo sapiens
tttctccttgtgtctcctttga

SEQ ID NO: 9143877 - DNA, 22 bp, Homo sapiens
tttctccttgtgtctcctttga

SEQ ID NO: 9143878 - DNA, 17 bp, Homo sapiens
tttctccttccatctca

SEQ ID NO: 9143879 - DNA, 17 bp, Homo sapiens
tttctccttccatctca

SEQ ID NO: 9143880 - DNA, 17 bp, Homo sapiens
tttctccttccatctca

SEQ ID NO: 9143881 - DNA, 22 bp, Homo sapiens
tttctctgtgccatttccataa

SEQ ID NO: 9143882 - DNA, 22 bp, Homo sapiens
tttctctgtgggctttatgcat

SEQ ID NO: 9143883 - DNA, 22 bp, Homo sapiens
tttctctgttctctaactgtaa

SEQ ID NO: 9143884 - DNA, 22 bp, Homo sapiens
tttctctgttctctaactgtaa

SEQ ID NO: 9143885 - DNA, 22 bp, Homo sapiens
tttctctgttctctaactgtaa

SEQ ID NO: 9143886 - DNA, 22 bp, Homo sapiens
tttctcttaatgtctctgtgct

SEQ ID NO: 9143887 - DNA, 22 bp, Homo sapiens
tttctcttaatgtctctgtgct

SEQ ID NO: 9143888 - DNA, 18 bp, Homo sapiens
tttctctgtcgtcttctg

SEQ ID NO: 9143889 - DNA, 19 bp, Homo sapiens
tttctctgtgcaccttttc

SEQ ID NO: 9143890 - DNA, 22 bp, Homo sapiens
tttctctgtgccatttccataa

SEQ ID NO: 9143891 - DNA, 19 bp, Homo sapiens
tttctctgtgcaccttttc

SEQ ID NO: 9143892 - DNA, 22 bp, Homo sapiens
tttctgggactggggagattct

SEQ ID NO: 9143893 - DNA, 22 bp, Homo sapiens
tttctgtaaagaccaagccagc

SEQ ID NO: 9143894 - DNA, 21 bp, Homo sapiens
tttctgggtggctgcatagtg

SEQ ID NO: 9143895 - DNA, 22 bp, Homo sapiens
tttctgtaagtggcaaataatg

SEQ ID NO: 9143896 - DNA, 22 bp, Homo sapiens
tttctgtaattaaaagggcagg

SEQ ID NO: 9143897 - DNA, 22 bp, Homo sapiens
tttctgtaagttcaggctttcc

SEQ ID NO: 9143898 - DNA, 20 bp, Homo sapiens
tttctgtagctcagtattca

SEQ ID NO: 9143899 - DNA, 22 bp, Homo sapiens
tttctgtacctcctcttgcccc

SEQ ID NO: 9143900 - DNA, 22 bp, Homo sapiens
tttctggaggcccaagggcaga

SEQ ID NO: 9143901 - DNA, 22 bp, Homo sapiens
tttctggattcatacagatgta

SEQ ID NO: 9143902 - DNA, 17 bp, Homo sapiens
tttctggaatgggcaaa

SEQ ID NO: 9143903 - DNA, 22 bp, Homo sapiens
tttctgctgtgctttcttgcgt

SEQ ID NO: 9143904 - DNA, 22 bp, Homo sapiens
tttctgctgtgctttcttgcgt

SEQ ID NO: 9143905 - DNA, 22 bp, Homo sapiens
tttctgctttctatccttgtca

SEQ ID NO: 9143906 - DNA, 22 bp, Homo sapiens
tttctgctgtgctttcttgcgt

SEQ ID NO: 9143907 - DNA, 22 bp, Homo sapiens
tttctgactccagagaggaata

SEQ ID NO: 9143908 - DNA, 23 bp, Homo sapiens
tttctgaagttgagatggacttt

SEQ ID NO: 9143909 - DNA, 22 bp, Homo sapiens
tttctgctcatcctagtggagc

SEQ ID NO: 9143910 - DNA, 22 bp, Homo sapiens
tttctgccgttccctgctctgt

SEQ ID NO: 9143911 - DNA, 22 bp, Homo sapiens
tttctgccttatctttgctgag

SEQ ID NO: 9143912 - DNA, 22 bp, Homo sapiens
tttctgccttgtagactagaat

SEQ ID NO: 9143913 - DNA, 22 bp, Homo sapiens
tttctgctaatcttttactgag

SEQ ID NO: 9143914 - DNA, 22 bp, Homo sapiens
tttctgcattgtcctcttggtt

SEQ ID NO: 9143915 - DNA, 22 bp, Homo sapiens
tttctgcattgtcctcttggtt

SEQ ID NO: 9143916 - DNA, 22 bp, Homo sapiens
tttctgccagtcactgctctag

SEQ ID NO: 9143917 - DNA, 22 bp, Homo sapiens
tttctgcccccgagggcggtgc

SEQ ID NO: 9143918 - DNA, 22 bp, Homo sapiens
tttctgccaggtttctggatga

SEQ ID NO: 9143919 - DNA, 22 bp, Homo sapiens
tttctgccaaccatttaaactc

SEQ ID NO: 9143920 - DNA, 22 bp, Homo sapiens
tttctgcattgtcctcttggtt

SEQ ID NO: 9143921 - DNA, 17 bp, Homo sapiens
tttctgcatgattggac

SEQ ID NO: 9143922 - DNA, 22 bp, Homo sapiens
tttctgagaaattaaacacttt

SEQ ID NO: 9143923 - DNA, 22 bp, Homo sapiens
tttctgaggaattaatacagaa

SEQ ID NO: 9143924 - DNA, 22 bp, Homo sapiens
tttctgtagggatttcacagtt

SEQ ID NO: 9143925 - DNA, 22 bp, Homo sapiens
tttctgtcattactttcctccc

SEQ ID NO: 9143926 - DNA, 21 bp, Homo sapiens
tttctgtcctttccatcagct

SEQ ID NO: 9143927 - DNA, 22 bp, Homo sapiens
tttctgtcatagttatctttgt

SEQ ID NO: 9143928 - DNA, 22 bp, Homo sapiens
tttctgtattttgtcataacct

SEQ ID NO: 9143929 - DNA, 22 bp, Homo sapiens
tttctgtatttaggacaggtgg

SEQ ID NO: 9143930 - DNA, 20 bp, Homo sapiens
tttctgtgcccaggtctgtt

SEQ ID NO: 9143931 - DNA, 20 bp, Homo sapiens
tttctgtgagaaacactgtt

SEQ ID NO: 9143932 - DNA, 23 bp, Homo sapiens
tttctgttcctctagctttgcat

SEQ ID NO: 9143933 - DNA, 21 bp, Homo sapiens
tttcttatctgtaaagtggga

SEQ ID NO: 9143934 - DNA, 22 bp, Homo sapiens
tttctgtggattttccattcaa

SEQ ID NO: 9143935 - DNA, 22 bp, Homo sapiens
tttctgtggtgggtagttcaga

SEQ ID NO: 9143936 - DNA, 22 bp, Homo sapiens
tttcttatgagcaagactctat

SEQ ID NO: 9143937 - DNA, 21 bp, Homo sapiens
tttcttcactttgccccatgt

SEQ ID NO: 9143938 - DNA, 22 bp, Homo sapiens
tttcttcagagagagctttccc

SEQ ID NO: 9143939 - DNA, 21 bp, Homo sapiens
tttcttcccttggcttctgag

SEQ ID NO: 9143940 - DNA, 22 bp, Homo sapiens
tttcttccccactgcaggctct

SEQ ID NO: 9143941 - DNA, 22 bp, Homo sapiens
tttcttccaaaggcacgttctc

SEQ ID NO: 9143942 - DNA, 19 bp, Homo sapiens
tttcttccaaagactatgg

SEQ ID NO: 9143943 - DNA, 22 bp, Homo sapiens
tttcttcattcaccttcacccc

SEQ ID NO: 9143944 - DNA, 20 bp, Homo sapiens
tttcttgtcggctgttgctg

SEQ ID NO: 9143945 - DNA, 20 bp, Homo sapiens
tttcttgtcggctgttgctg

SEQ ID NO: 9143946 - DNA, 20 bp, Homo sapiens
tttcttgtcggctgttgctg

SEQ ID NO: 9143947 - DNA, 22 bp, Homo sapiens
tttcttctgagatcagggagaa

SEQ ID NO: 9143948 - DNA, 22 bp, Homo sapiens
tttcttctgagatcagggagaa

SEQ ID NO: 9143949 - DNA, 20 bp, Homo sapiens
tttcttgtacttggagaagg

SEQ ID NO: 9143950 - DNA, 22 bp, Homo sapiens
tttcttctctgattaaggctca

SEQ ID NO: 9143951 - DNA, 22 bp, Homo sapiens
tttcttctctgattaaggctca

SEQ ID NO: 9143952 - DNA, 22 bp, Homo sapiens
tttcttctctgattaaggctca

SEQ ID NO: 9143953 - DNA, 22 bp, Homo sapiens
tttcttctctaatctcaatgat

SEQ ID NO: 9143954 - DNA, 22 bp, Homo sapiens
tttcttgtttcatggtgtctca

SEQ ID NO: 9143955 - DNA, 22 bp, Homo sapiens
tttctttaaaggaactctgttt

SEQ ID NO: 9143956 - DNA, 22 bp, Homo sapiens
tttctttaggctgtgttgccaa

SEQ ID NO: 9143957 - DNA, 22 bp, Homo sapiens
tttctttaattctcacagcaat

SEQ ID NO: 9143958 - DNA, 22 bp, Homo sapiens
tttctttatcatagcatctttg

SEQ ID NO: 9143959 - DNA, 22 bp, Homo sapiens
tttctttatcatagcatctttg

SEQ ID NO: 9143960 - DNA, 22 bp, Homo sapiens
tttcttcctggattcctacttc

SEQ ID NO: 9143961 - DNA, 22 bp, Homo sapiens
tttcttcctatgtatcttgctg

SEQ ID NO: 9143962 - DNA, 22 bp, Homo sapiens
tttcttctaagatttcaaacta

SEQ ID NO: 9143963 - DNA, 22 bp, Homo sapiens
tttcttctaagatttcaaacta

SEQ ID NO: 9143964 - DNA, 22 bp, Homo sapiens
tttcttctaagatttcaaacta

SEQ ID NO: 9143965 - DNA, 22 bp, Homo sapiens
tttcttctaggactaataagag

SEQ ID NO: 9143966 - DNA, 22 bp, Homo sapiens
tttcttctcacccaggacagag

SEQ ID NO: 9143967 - DNA, 22 bp, Homo sapiens
tttcttctcacccaggacagag

SEQ ID NO: 9143968 - DNA, 22 bp, Homo sapiens
tttcttctcacccaggacagag

SEQ ID NO: 9143969 - DNA, 22 bp, Homo sapiens
tttcttctcacccaggacagag

SEQ ID NO: 9143970 - DNA, 22 bp, Homo sapiens
tttcttctatgtgtgatatttt

SEQ ID NO: 9143971 - DNA, 22 bp, Homo sapiens
tttcttctatgtgtgatatttt

SEQ ID NO: 9143972 - DNA, 22 bp, Homo sapiens
tttcttctatgtgtgatatttt

SEQ ID NO: 9143973 - DNA, 22 bp, Homo sapiens
tttcttctaggactaataagag

SEQ ID NO: 9143974 - DNA, 22 bp, Homo sapiens
tttcttctcatccctgaaatca

SEQ ID NO: 9143975 - DNA, 22 bp, Homo sapiens
tttcttctcatccctgaaatca

SEQ ID NO: 9143976 - DNA, 22 bp, Homo sapiens
tttcttctcatccctgaaatca

SEQ ID NO: 9143977 - DNA, 22 bp, Homo sapiens
tttcttctcgacaccttatccc

SEQ ID NO: 9143978 - DNA, 22 bp, Homo sapiens
tttcttctcgacaccttatccc

SEQ ID NO: 9143979 - DNA, 22 bp, Homo sapiens
tttcttctccatggcaggtcct

SEQ ID NO: 9143980 - DNA, 22 bp, Homo sapiens
tttaaaatcagatgggagttgg

SEQ ID NO: 9143981 - DNA, 22 bp, Homo sapiens
tttaaaatttagacctctccac

SEQ ID NO: 9143982 - DNA, 22 bp, Homo sapiens
tttaaaatttagacctctccac

SEQ ID NO: 9143983 - DNA, 23 bp, Homo sapiens
tttaaaagttgtaatgtaggctt

SEQ ID NO: 9143984 - DNA, 22 bp, Homo sapiens
ttgtttttaaacatgtgactga

SEQ ID NO: 9143985 - DNA, 22 bp, Homo sapiens
ttgtttttaaacatgtgactga

SEQ ID NO: 9143986 - DNA, 22 bp, Homo sapiens
ttgtttttagagaagccctgaa

SEQ ID NO: 9143987 - DNA, 22 bp, Homo sapiens
tttaatttgtatttctagaggg

SEQ ID NO: 9143988 - DNA, 22 bp, Homo sapiens
tttaattttcctcttcctggag

SEQ ID NO: 9143989 - DNA, 22 bp, Homo sapiens
tttaattctggcataatagctc

SEQ ID NO: 9143990 - DNA, 22 bp, Homo sapiens
tttaattagcaagccagagagc

SEQ ID NO: 9143991 - DNA, 22 bp, Homo sapiens
tttaattaggaaatgggcaggg

SEQ ID NO: 9143992 - DNA, 22 bp, Homo sapiens
tttaattgcatttaaagatgga

SEQ ID NO: 9143993 - DNA, 22 bp, Homo sapiens
tttaattgcatttaaagatgga

SEQ ID NO: 9143994 - DNA, 22 bp, Homo sapiens
tttaattgcatttaaagatgga

SEQ ID NO: 9143995 - DNA, 22 bp, Homo sapiens
tttaattgttgtgggtacatag

SEQ ID NO: 9143996 - DNA, 22 bp, Homo sapiens
tttaattgattcacagtctgta

SEQ ID NO: 9143997 - DNA, 22 bp, Homo sapiens
tttactgttcaacttgcaagta

SEQ ID NO: 9143998 - DNA, 22 bp, Homo sapiens
tttactgttttatattgtccag

SEQ ID NO: 9143999 - DNA, 22 bp, Homo sapiens
tttacttgttctgctgaattct

SEQ ID NO: 9144000 - DNA, 22 bp, Homo sapiens
tttactgtctcagagagacaaa

SEQ ID NO: 9144001 - DNA, 22 bp, Homo sapiens
tttactgtgcattagaatcacc

SEQ ID NO: 9144002 - DNA, 22 bp, Homo sapiens
tttactgtgcattagaatcacc

SEQ ID NO: 9144003 - DNA, 22 bp, Homo sapiens
tttactgtgtaaggggaatgtt

SEQ ID NO: 9144004 - DNA, 22 bp, Homo sapiens
tttagaaattgcagagtgggtg

SEQ ID NO: 9144005 - DNA, 22 bp, Homo sapiens
tttagaaattcatctatggcct

SEQ ID NO: 9144006 - DNA, 22 bp, Homo sapiens
tttacttttggtaaggtcattt

SEQ ID NO: 9144007 - DNA, 22 bp, Homo sapiens
tttagaacaatgtgtagaaaaa

SEQ ID NO: 9144008 - DNA, 22 bp, Homo sapiens
tttactttgtgtcaagtcaaga

SEQ ID NO: 9144009 - DNA, 22 bp, Homo sapiens
tttacttttggtaaggtcattt

SEQ ID NO: 9144010 - DNA, 22 bp, Homo sapiens
tttactttgtgtcaagtcaaga

SEQ ID NO: 9144011 - DNA, 22 bp, Homo sapiens
tttactttgtgtcaagtcaaga

SEQ ID NO: 9144012 - DNA, 22 bp, Homo sapiens
tttactttctcaagtatatagg

SEQ ID NO: 9144013 - DNA, 22 bp, Homo sapiens
tttaccagtgaggaaaatgagg

SEQ ID NO: 9144014 - DNA, 22 bp, Homo sapiens
tttaccatacatcaaaatattt

SEQ ID NO: 9144015 - DNA, 22 bp, Homo sapiens
tttactaacaccatacatgctg

SEQ ID NO: 9144016 - DNA, 22 bp, Homo sapiens
tttaccatctgccacagatatg

SEQ ID NO: 9144017 - DNA, 22 bp, Homo sapiens
tttaccatctgccacagatatg

SEQ ID NO: 9144018 - DNA, 22 bp, Homo sapiens
tttaccatcctcttttagaatt

SEQ ID NO: 9144019 - DNA, 22 bp, Homo sapiens
tttaccatataagaaaggcatg

SEQ ID NO: 9144020 - DNA, 22 bp, Homo sapiens
tttaccatcctcttttagaatt

SEQ ID NO: 9144021 - DNA, 22 bp, Homo sapiens
tttacccatattagcatcaagt

SEQ ID NO: 9144022 - DNA, 22 bp, Homo sapiens
tttaccattattaaaattaagt

SEQ ID NO: 9144023 - DNA, 22 bp, Homo sapiens
tttatacctcattcttagcaaa

SEQ ID NO: 9144024 - DNA, 22 bp, Homo sapiens
tttatactccactctgcaagcg

SEQ ID NO: 9144025 - DNA, 22 bp, Homo sapiens
tttatacttcataatgtctatt

SEQ ID NO: 9144026 - DNA, 22 bp, Homo sapiens
tttatacttcataatgtctatt

SEQ ID NO: 9144027 - DNA, 22 bp, Homo sapiens
tttatacatggagaatttttgc

SEQ ID NO: 9144028 - DNA, 22 bp, Homo sapiens
tttataagaagcaatgtctgag

SEQ ID NO: 9144029 - DNA, 22 bp, Homo sapiens
tttataatagatttggggcggc

SEQ ID NO: 9144030 - DNA, 22 bp, Homo sapiens
tttataaccaagttctgcttgt

SEQ ID NO: 9144031 - DNA, 22 bp, Homo sapiens
tttataacttagtttggttgaa

SEQ ID NO: 9144032 - DNA, 22 bp, Homo sapiens
tttagtttgatgttctactcct

SEQ ID NO: 9144033 - DNA, 22 bp, Homo sapiens
tttagttttgatgaaaatgcca

SEQ ID NO: 9144034 - DNA, 22 bp, Homo sapiens
tttagttctcccagtcttgatt

SEQ ID NO: 9144035 - DNA, 22 bp, Homo sapiens
tttatagttatatacagatgtt

SEQ ID NO: 9144036 - DNA, 20 bp, Homo sapiens
tttatagtgatcaatttata

SEQ ID NO: 9144037 - DNA, 22 bp, Homo sapiens
tttatagtcgtctcagtaataa

SEQ ID NO: 9144038 - DNA, 22 bp, Homo sapiens
tttatataacagagactgctat

SEQ ID NO: 9144039 - DNA, 23 bp, Homo sapiens
tttatagcagcatgatttatagt

SEQ ID NO: 9144040 - DNA, 23 bp, Homo sapiens
tttatagcagcatgatttataat

SEQ ID NO: 9144041 - DNA, 22 bp, Homo sapiens
tttattaagatgcgaatgctga

SEQ ID NO: 9144042 - DNA, 22 bp, Homo sapiens
tttattaatgtagcatccatgg

SEQ ID NO: 9144043 - DNA, 22 bp, Homo sapiens
tttattaatgtagcatccatgg

SEQ ID NO: 9144044 - DNA, 22 bp, Homo sapiens
tttattaagatgcgaatgctga

SEQ ID NO: 9144045 - DNA, 22 bp, Homo sapiens
tttatgtttgcattttcaaaga

SEQ ID NO: 9144046 - DNA, 22 bp, Homo sapiens
tttattaaaactgttggctctg

SEQ ID NO: 9144047 - DNA, 21 bp, Homo sapiens
tttattaacaactgtggacgt

SEQ ID NO: 9144048 - DNA, 22 bp, Homo sapiens
tttattatagtggtggggactg

SEQ ID NO: 9144049 - DNA, 22 bp, Homo sapiens
tttattatagtggtggggactg

SEQ ID NO: 9144050 - DNA, 22 bp, Homo sapiens
tttattatccagtgttgtcatg

SEQ ID NO: 9144051 - DNA, 22 bp, Homo sapiens
tttattatccagtgttgtcatg

SEQ ID NO: 9144052 - DNA, 22 bp, Homo sapiens
tttattatccagtgttgtcatg

SEQ ID NO: 9144053 - DNA, 22 bp, Homo sapiens
tttattagattatcaaagaggt

SEQ ID NO: 9144054 - DNA, 22 bp, Homo sapiens
tttattacaccaggttaactca

SEQ ID NO: 9144055 - DNA, 22 bp, Homo sapiens
tttattatgtacaggcactata

SEQ ID NO: 9144056 - DNA, 22 bp, Homo sapiens
tttattatgatggacaccttcg

SEQ ID NO: 9144057 - DNA, 22 bp, Homo sapiens
tttattatgatggacaccttcg

SEQ ID NO: 9144058 - DNA, 22 bp, Homo sapiens
tttattatccagtgttgtcatg

SEQ ID NO: 9144059 - DNA, 22 bp, Homo sapiens
tttattatccagtgttgtcatg

SEQ ID NO: 9144060 - DNA, 22 bp, Homo sapiens
tttattatgatggacaccttcg

SEQ ID NO: 9144061 - DNA, 22 bp, Homo sapiens
tttattatgtacaggcactata

SEQ ID NO: 9144062 - DNA, 22 bp, Homo sapiens
tttattattctctggagaatgt

SEQ ID NO: 9144063 - DNA, 22 bp, Homo sapiens
tttattattctgttctctctac

SEQ ID NO: 9144064 - DNA, 22 bp, Homo sapiens
tttattattctgttctctctac

SEQ ID NO: 9144065 - DNA, 22 bp, Homo sapiens
tttatttcactctccggatact

SEQ ID NO: 9144066 - DNA, 19 bp, Homo sapiens
tttatttgagacatgcctt

SEQ ID NO: 9144067 - DNA, 22 bp, Homo sapiens
tttatttgaatcaggggagaat

SEQ ID NO: 9144068 - DNA, 22 bp, Homo sapiens
tttatttggcatctctgccaag

SEQ ID NO: 9144069 - DNA, 22 bp, Homo sapiens
tttatttggcatccagggagaa

SEQ ID NO: 9144070 - DNA, 22 bp, Homo sapiens
tttatttggcatctctgccaag

SEQ ID NO: 9144071 - DNA, 22 bp, Homo sapiens
tttatttgtcttgccatttagt

SEQ ID NO: 9144072 - DNA, 22 bp, Homo sapiens
tttatttgtcttgccatttagt

SEQ ID NO: 9144073 - DNA, 22 bp, Homo sapiens
tttcaaacatatcttcattact

SEQ ID NO: 9144074 - DNA, 20 bp, Homo sapiens
tttcaaactgcacctttgct

SEQ ID NO: 9144075 - DNA, 22 bp, Homo sapiens
tttcaaactgcccagcacacct

SEQ ID NO: 9144076 - DNA, 22 bp, Homo sapiens
tttcaaacttaaatacctttcc

SEQ ID NO: 9144077 - DNA, 22 bp, Homo sapiens
tttcaaactgcccagcacacct

SEQ ID NO: 9144078 - DNA, 22 bp, Homo sapiens
tttcaaaattttgcagtggtaa

SEQ ID NO: 9144079 - DNA, 22 bp, Homo sapiens
tttcaaaagcgtacgtagtgaa

SEQ ID NO: 9144080 - DNA, 15 bp, Homo sapiens
tttcaaaatgaggcc

SEQ ID NO: 9144081 - DNA, 22 bp, Homo sapiens
ttgttttggagatgagctaaaa

SEQ ID NO: 9144082 - DNA, 22 bp, Homo sapiens
ttgttttggaagaacttactct

SEQ ID NO: 9144083 - DNA, 22 bp, Homo sapiens
ttgttttggagatgagctaaaa

SEQ ID NO: 9144084 - DNA, 22 bp, Homo sapiens
ttgttttggaagaacttactct

SEQ ID NO: 9144085 - DNA, 22 bp, Homo sapiens
ttgttttcttgtatatagcctc

SEQ ID NO: 9144086 - DNA, 22 bp, Homo sapiens
ttgttttcctgggataccaacc

SEQ ID NO: 9144087 - DNA, 22 bp, Homo sapiens
ttgttttcctgggataccaacc

SEQ ID NO: 9144088 - DNA, 22 bp, Homo sapiens
ttgttttattctgcaatttccc

SEQ ID NO: 9144089 - DNA, 22 bp, Homo sapiens
ttgttttattctgcaatttccc

SEQ ID NO: 9144090 - DNA, 22 bp, Homo sapiens
ttgttttatctttctacagact

SEQ ID NO: 9144091 - DNA, 22 bp, Homo sapiens
ttgttttaacctagtgtttatg

SEQ ID NO: 9144092 - DNA, 22 bp, Homo sapiens
ttgttttaacctagtgtttatg

SEQ ID NO: 9144093 - DNA, 22 bp, Homo sapiens
ttgttttaacgactcagcttgt

SEQ ID NO: 9144094 - DNA, 22 bp, Homo sapiens
ttgtttgtcataatatcattac

SEQ ID NO: 9144095 - DNA, 22 bp, Homo sapiens
ttgttttagtaggtacactgag

SEQ ID NO: 9144096 - DNA, 20 bp, Homo sapiens
ttgtttctgctattttctaa

SEQ ID NO: 9144097 - DNA, 22 bp, Homo sapiens
ttgtttctggaaaaggcgagaa

SEQ ID NO: 9144098 - DNA, 22 bp, Homo sapiens
ttgtttctctggtcttgagtga

SEQ ID NO: 9144099 - DNA, 22 bp, Homo sapiens
ttgtttctcctggtgcctgata

SEQ ID NO: 9144100 - DNA, 22 bp, Homo sapiens
ttgtttcctttctatacaggat

SEQ ID NO: 9144101 - DNA, 22 bp, Homo sapiens
ttgtttctccagtctaggaaaa

SEQ ID NO: 9144102 - DNA, 21 bp, Homo sapiens
ttgtttcctcccaaaatgcca

SEQ ID NO: 9144103 - DNA, 20 bp, Homo sapiens
ttgtttcctggctgttctgc

SEQ ID NO: 9144104 - DNA, 22 bp, Homo sapiens
ttgtttccctggatctagagct

SEQ ID NO: 9144105 - DNA, 22 bp, Homo sapiens
ttgtttcttcatttagaagctt

SEQ ID NO: 9144106 - DNA, 22 bp, Homo sapiens
ttgtttcttcatttagaagctt

SEQ ID NO: 9144107 - DNA, 17 bp, Homo sapiens
ttgtttcttctctgtgg

SEQ ID NO: 9144108 - DNA, 23 bp, Homo sapiens
ttgtttctttgtattgtctctat

SEQ ID NO: 9144109 - DNA, 22 bp, Homo sapiens
ttgtttgactaaattggtatca

SEQ ID NO: 9144110 - DNA, 22 bp, Homo sapiens
ttgtttgaggtcactgatattt

SEQ ID NO: 9144111 - DNA, 22 bp, Homo sapiens
ttgtttgtaaggctcttagaat

SEQ ID NO: 9144112 - DNA, 22 bp, Homo sapiens
ttgtgtttgatgctgacacgca

SEQ ID NO: 9144113 - DNA, 22 bp, Homo sapiens
ttgtgtttctgtgatatgtaaa

SEQ ID NO: 9144114 - DNA, 21 bp, Homo sapiens
ttgtgtttccccagtcacttt

SEQ ID NO: 9144115 - DNA, 22 bp, Homo sapiens
ttgtgttaaggtgcatctagtg

SEQ ID NO: 9144116 - DNA, 22 bp, Homo sapiens
ttgtgtttcccttgcatattcc

SEQ ID NO: 9144117 - DNA, 22 bp, Homo sapiens
ttgtttccatgcatgcatttat

SEQ ID NO: 9144118 - DNA, 22 bp, Homo sapiens
ttgtttccattgcagactgtgt

SEQ ID NO: 9144119 - DNA, 21 bp, Homo sapiens
ttgtttcccagagctcgctcc

SEQ ID NO: 9144120 - DNA, 22 bp, Homo sapiens
ttgttattattactaagtcttc

SEQ ID NO: 9144121 - DNA, 22 bp, Homo sapiens
ttgttagctgatcttgagtgca

SEQ ID NO: 9144122 - DNA, 22 bp, Homo sapiens
ttgttataaagactaaatatgt

SEQ ID NO: 9144123 - DNA, 22 bp, Homo sapiens
ttgttacatcttatgtaagtgg

SEQ ID NO: 9144124 - DNA, 20 bp, Homo sapiens
ttgttagaggaatgccatag

SEQ ID NO: 9144125 - DNA, 22 bp, Homo sapiens
ttgttagatatttcttagaaga

SEQ ID NO: 9144126 - DNA, 22 bp, Homo sapiens
ttgttagcatgcttaatggata

SEQ ID NO: 9144127 - DNA, 22 bp, Homo sapiens
ttgttacttgcatgtagactaa

SEQ ID NO: 9144128 - DNA, 20 bp, Homo sapiens
ttgttagaggaatgccatag

SEQ ID NO: 9144129 - DNA, 20 bp, Homo sapiens
ttgttagaggaatgccatag

SEQ ID NO: 9144130 - DNA, 22 bp, Homo sapiens
ttgtgttttcttatggcataaa

SEQ ID NO: 9144131 - DNA, 22 bp, Homo sapiens
ttgcaaggtcatcatgcattgg

SEQ ID NO: 9144132 - DNA, 22 bp, Homo sapiens
ttgcaaggagccactctgcctg

SEQ ID NO: 9144133 - DNA, 22 bp, Homo sapiens
ttgcaagaaattaggaagtgaa

SEQ ID NO: 9144134 - DNA, 22 bp, Homo sapiens
ttgcaagacacttggaagcaca

SEQ ID NO: 9144135 - DNA, 22 bp, Homo sapiens
ttgcaaggtttctctctgccta

SEQ ID NO: 9144136 - DNA, 22 bp, Homo sapiens
ttgcaagttttacttacctgga

SEQ ID NO: 9144137 - DNA, 21 bp, Homo sapiens
ttgcaatgttctagtaatcta

SEQ ID NO: 9144138 - DNA, 22 bp, Homo sapiens
ttgcaatagccttatttccaaa

SEQ ID NO: 9144139 - DNA, 22 bp, Homo sapiens
ttgcaacattgtaagtttatat

SEQ ID NO: 9144140 - DNA, 22 bp, Homo sapiens
ttgcaaattccaatccaatatt

SEQ ID NO: 9144141 - DNA, 22 bp, Homo sapiens
ttggtcagctcaatggagaggg

SEQ ID NO: 9144142 - DNA, 22 bp, Homo sapiens
ttggtcctgccccctccaggtc

SEQ ID NO: 9144143 - DNA, 22 bp, Homo sapiens
ttggtcctttatcctttaggca

SEQ ID NO: 9144144 - DNA, 22 bp, Homo sapiens
ttggtctggagtatgatgataa

SEQ ID NO: 9144145 - DNA, 22 bp, Homo sapiens
ttggtgggttaatgagtgactg

SEQ ID NO: 9144146 - DNA, 22 bp, Homo sapiens
ttggtgggttaatgagtgactg

SEQ ID NO: 9144147 - DNA, 22 bp, Homo sapiens
ttggtgggcacaggggagaagt

SEQ ID NO: 9144148 - DNA, 22 bp, Homo sapiens
ttggtgggagagatgagggttg

SEQ ID NO: 9144149 - DNA, 22 bp, Homo sapiens
ttggtgggagagatgagggttg

SEQ ID NO: 9144150 - DNA, 22 bp, Homo sapiens
ttggtgggagaagactctggtt

SEQ ID NO: 9144151 - DNA, 22 bp, Homo sapiens
ttggtgggagaagactctggtt

SEQ ID NO: 9144152 - DNA, 22 bp, Homo sapiens
ttggtcttttctattaaatata

SEQ ID NO: 9144153 - DNA, 22 bp, Homo sapiens
ttgtctgagggtttgagagaat

SEQ ID NO: 9144154 - DNA, 22 bp, Homo sapiens
ttgtctgagaaagtgagttgct

SEQ ID NO: 9144155 - DNA, 22 bp, Homo sapiens
ttgtctctcattcctgcaactc

SEQ ID NO: 9144156 - DNA, 22 bp, Homo sapiens
ttgtctctaagtgtgatcttca

SEQ ID NO: 9144157 - DNA, 22 bp, Homo sapiens
ttgtgaagtgttctgagacagg

SEQ ID NO: 9144158 - DNA, 22 bp, Homo sapiens
ttgtgaatagtgccgcaatgaa

SEQ ID NO: 9144159 - DNA, 22 bp, Homo sapiens
ttgtgaatagtgccgctataaa

SEQ ID NO: 9144160 - DNA, 22 bp, Homo sapiens
ttgtgaatgcttaatatgtttc

SEQ ID NO: 9144161 - DNA, 22 bp, Homo sapiens
ttgtgaatagtgctgcagtaaa

SEQ ID NO: 9144162 - DNA, 22 bp, Homo sapiens
ttgtccttcatgttggatttat

SEQ ID NO: 9144163 - DNA, 22 bp, Homo sapiens
ttgtcctgtttagggataagga

SEQ ID NO: 9144164 - DNA, 22 bp, Homo sapiens
ttgtcgggcttacgcagggcca

SEQ ID NO: 9144165 - DNA, 22 bp, Homo sapiens
ttggttcaggacatatttgagt

SEQ ID NO: 9144166 - DNA, 22 bp, Homo sapiens
ttggttcaaagggattcaattt

SEQ ID NO: 9144167 - DNA, 22 bp, Homo sapiens
ttggttcaaagggattcaattt

SEQ ID NO: 9144168 - DNA, 22 bp, Homo sapiens
ttggttcaacttttctaagtag

SEQ ID NO: 9144169 - DNA, 22 bp, Homo sapiens
ttggttcaatactaacttgaac

SEQ ID NO: 9144170 - DNA, 22 bp, Homo sapiens
ttggttcattttctcatctaga

SEQ ID NO: 9144171 - DNA, 22 bp, Homo sapiens
ttggttcattattgaatgtgct

SEQ ID NO: 9144172 - DNA, 22 bp, Homo sapiens
ttggttttctaatgtattaagg

SEQ ID NO: 9144173 - DNA, 22 bp, Homo sapiens
ttttatctgcttcattagttga

SEQ ID NO: 9144174 - DNA, 22 bp, Homo sapiens
ttttatctacctatgctcattt

SEQ ID NO: 9144175 - DNA, 19 bp, Homo sapiens
ttttccttctcctcttaat

SEQ ID NO: 9144176 - DNA, 19 bp, Homo sapiens
ttttccttctcctcttaat

SEQ ID NO: 9144177 - DNA, 22 bp, Homo sapiens
ttttccttctgatactccattt

SEQ ID NO: 9144178 - DNA, 20 bp, Homo sapiens
ttttccttgttgccgctgct

SEQ ID NO: 9144179 - DNA, 23 bp, Homo sapiens
ttttcctttggacaggctgtatt

SEQ ID NO: 9144180 - DNA, 22 bp, Homo sapiens
ttttcctttggaagatgcatat

SEQ ID NO: 9144181 - DNA, 22 bp, Homo sapiens
ttttcctttggaagatgcatat

SEQ ID NO: 9144182 - DNA, 22 bp, Homo sapiens
ttttcctttgattcccagatgt

SEQ ID NO: 9144183 - DNA, 22 bp, Homo sapiens
ttttctatctcctagaactgcc

SEQ ID NO: 9144184 - DNA, 22 bp, Homo sapiens
ttttctttaatctggtggggtg

SEQ ID NO: 9144185 - DNA, 22 bp, Homo sapiens
ttttgaaagagtcctgctacag

SEQ ID NO: 9144186 - DNA, 22 bp, Homo sapiens
ttttgaaagggtgatttggctt

SEQ ID NO: 9144187 - DNA, 22 bp, Homo sapiens
ttttgaataattcagaaacagc

SEQ ID NO: 9144188 - DNA, 22 bp, Homo sapiens
ttttgaccaaataatttagcag

SEQ ID NO: 9144189 - DNA, 22 bp, Homo sapiens
ttttggcaaagagatagcatga

SEQ ID NO: 9144190 - DNA, 23 bp, Homo sapiens
ttttgcaataagtcactggaata

SEQ ID NO: 9144191 - DNA, 22 bp, Homo sapiens
ttttgatatcatgatgaacaga

SEQ ID NO: 9144192 - DNA, 22 bp, Homo sapiens
ttttgcccttgctagatcactg

SEQ ID NO: 9144193 - DNA, 22 bp, Homo sapiens
tttttcatctgattgataactc

SEQ ID NO: 9144194 - DNA, 22 bp, Homo sapiens
tttttcccatatagaaagccaa

SEQ ID NO: 9144195 - DNA, 22 bp, Homo sapiens
tttttccacataccctaggcca

SEQ ID NO: 9144196 - DNA, 22 bp, Homo sapiens
ttttttgtcttgaagaaatggt

SEQ ID NO: 9144197 - DNA, 22 bp, Homo sapiens
ttttttgtcccagagagcctgg

SEQ ID NO: 9144198 - DNA, 22 bp, Homo sapiens
ttttttgtagcaagcgcagata

SEQ ID NO: 9144199 - DNA, 22 bp, Homo sapiens
tttttctactgcccacattgta

SEQ ID NO: 9144200 - DNA, 22 bp, Homo sapiens
tttttcttgtgctggatctaat

SEQ ID NO: 9144201 - DNA, 22 bp, Homo sapiens
ttttttgtcttgaagaaatggt

SEQ ID NO: 9144202 - DNA, 22 bp, Homo sapiens
ttttataagcaagaaagggaaa

SEQ ID NO: 9144203 - DNA, 22 bp, Homo sapiens
ttttataaagagagtcagttgg

SEQ ID NO: 9144204 - DNA, 22 bp, Homo sapiens
ttttataaagagagtcagttgg

SEQ ID NO: 9144205 - DNA, 22 bp, Homo sapiens
ttttataaagagagtcagttgg

SEQ ID NO: 9144206 - DNA, 22 bp, Homo sapiens
ttttataaagagagtcagttgg

SEQ ID NO: 9144207 - DNA, 22 bp, Homo sapiens
ttttagaagttcacttgggttt

SEQ ID NO: 9144208 - DNA, 22 bp, Homo sapiens
ttttagaagttcatgtgggatt

SEQ ID NO: 9144209 - DNA, 22 bp, Homo sapiens
ttttagaatcaggttgtctggg

SEQ ID NO: 9144210 - DNA, 20 bp, Homo sapiens
ttttatatgtagggtatatg

SEQ ID NO: 9144211 - DNA, 22 bp, Homo sapiens
ttttatattgagtgagagttcc

SEQ ID NO: 9144212 - DNA, 22 bp, Homo sapiens
ttttatatggcacattggttgg

SEQ ID NO: 9144213 - DNA, 22 bp, Homo sapiens
ttttatatggcacattggttgg

SEQ ID NO: 9144214 - DNA, 22 bp, Homo sapiens
ttttatcaatcattaagacatt

SEQ ID NO: 9144215 - DNA, 22 bp, Homo sapiens
ttttatcaatcattaagacatt

SEQ ID NO: 9144216 - DNA, 22 bp, Homo sapiens
tttgttttcaatgtgtcattca

SEQ ID NO: 9144217 - DNA, 22 bp, Homo sapiens
tttgttttcaatgtgtcattca

SEQ ID NO: 9144218 - DNA, 22 bp, Homo sapiens
tttgttttcaatgtgtcattca

SEQ ID NO: 9144219 - DNA, 22 bp, Homo sapiens
tttgttttctgtaggcctttcc

SEQ ID NO: 9144220 - DNA, 22 bp, Homo sapiens
tttgttttctgtaggcctttcc

SEQ ID NO: 9144221 - DNA, 22 bp, Homo sapiens
tttgttttgaactagctcagaa

SEQ ID NO: 9144222 - DNA, 22 bp, Homo sapiens
ttttagaagttcacttgggttt

SEQ ID NO: 9144223 - DNA, 22 bp, Homo sapiens
ttttagaagttcacttgggttt

SEQ ID NO: 9144224 - DNA, 22 bp, Homo sapiens
ttttagaagttcatgtgggatt

SEQ ID NO: 9144225 - DNA, 22 bp, Homo sapiens
ttttagaagtgcctatcctatg

SEQ ID NO: 9144226 - DNA, 22 bp, Homo sapiens
tttgtttactcattcattgatg

SEQ ID NO: 9144227 - DNA, 22 bp, Homo sapiens
tttgtttagatggtaaatcagt

SEQ ID NO: 9144228 - DNA, 22 bp, Homo sapiens
tttgttttcaatgtgtcattca

SEQ ID NO: 9144229 - DNA, 22 bp, Homo sapiens
tttgtttggcaacttggtaaag

SEQ ID NO: 9144230 - DNA, 22 bp, Homo sapiens
tttgtttgcggcacatagtttg

SEQ ID NO: 9144231 - DNA, 22 bp, Homo sapiens
tttgtttgccacacaaaacagt

SEQ ID NO: 9144232 - DNA, 22 bp, Homo sapiens
tttgtttgcggcacatagtttg

SEQ ID NO: 9144233 - DNA, 22 bp, Homo sapiens
tttgttgtgataatggtctgca

SEQ ID NO: 9144234 - DNA, 22 bp, Homo sapiens
tttgttgtgaacagaataatat

SEQ ID NO: 9144235 - DNA, 22 bp, Homo sapiens
tttgttgtactgggattagact

SEQ ID NO: 9144236 - DNA, 22 bp, Homo sapiens
tttgtttacaaaaataagcagt

SEQ ID NO: 9144237 - DNA, 22 bp, Homo sapiens
tttgtttacaaaaataagcagt

SEQ ID NO: 9144238 - DNA, 22 bp, Homo sapiens
tttgttgggagaaacattattt

SEQ ID NO: 9144239 - DNA, 22 bp, Homo sapiens
tttgttcttagtatctgtgtgc

SEQ ID NO: 9144240 - DNA, 22 bp, Homo sapiens
tttgttcttagtatctgtgtgc

SEQ ID NO: 9144241 - DNA, 22 bp, Homo sapiens
tttgtcagtcatgtctgctttt

SEQ ID NO: 9144242 - DNA, 22 bp, Homo sapiens
tttgtatttttcccagctagct

SEQ ID NO: 9144243 - DNA, 22 bp, Homo sapiens
tttgtattacaaagtcacagta

SEQ ID NO: 9144244 - DNA, 22 bp, Homo sapiens
tttgtatgtgataagactattc

SEQ ID NO: 9144245 - DNA, 22 bp, Homo sapiens
tttgtatgtgataagactattc

SEQ ID NO: 9144246 - DNA, 22 bp, Homo sapiens
tttgtagatagaaaaatgatta

SEQ ID NO: 9144247 - DNA, 22 bp, Homo sapiens
tttgtagcagcatgatttataa

SEQ ID NO: 9144248 - DNA, 22 bp, Homo sapiens
tttgtagattcattgaactttt

SEQ ID NO: 9144249 - DNA, 22 bp, Homo sapiens
tttgtagttgtggatgctgaag

SEQ ID NO: 9144250 - DNA, 22 bp, Homo sapiens
tttgtataagaacattctagca

SEQ ID NO: 9144251 - DNA, 22 bp, Homo sapiens
tttgtataaatgaagatgctgg

SEQ ID NO: 9144252 - DNA, 22 bp, Homo sapiens
tttgtataaattggagcaatgt

SEQ ID NO: 9144253 - DNA, 22 bp, Homo sapiens
tttgtacttcattggttctact

SEQ ID NO: 9144254 - DNA, 22 bp, Homo sapiens
tttgtagagggtaattgacaga

SEQ ID NO: 9144255 - DNA, 22 bp, Homo sapiens
tttgtagagggtaattgacaga

SEQ ID NO: 9144256 - DNA, 22 bp, Homo sapiens
tttgtactggaagaacatgcaa

SEQ ID NO: 9144257 - DNA, 22 bp, Homo sapiens
tttgtactgttgaaattgctgg

SEQ ID NO: 9144258 - DNA, 22 bp, Homo sapiens
tttgtactgttgaaattgctgg

SEQ ID NO: 9144259 - DNA, 22 bp, Homo sapiens
tttgtactgaagattgtaaact

SEQ ID NO: 9144260 - DNA, 23 bp, Homo sapiens
tttgtactgcattatgagacaca

SEQ ID NO: 9144261 - DNA, 22 bp, Homo sapiens
tttgtactgaccaattatttga

SEQ ID NO: 9144262 - DNA, 22 bp, Homo sapiens
tttgtactagtcagtaaatagt

SEQ ID NO: 9144263 - DNA, 22 bp, Homo sapiens
tttgtactctcagaattcagaa

SEQ ID NO: 9144264 - DNA, 22 bp, Homo sapiens
tttgtactctcagaattcagaa

SEQ ID NO: 9144265 - DNA, 22 bp, Homo sapiens
tttgcacttaacttatttgaaa

SEQ ID NO: 9144266 - DNA, 22 bp, Homo sapiens
tttgcactctaagtagtttgga

SEQ ID NO: 9144267 - DNA, 22 bp, Homo sapiens
tttgcagagtgcagaagcatct

SEQ ID NO: 9144268 - DNA, 22 bp, Homo sapiens
tttgcagtagacatcttatttt

SEQ ID NO: 9144269 - DNA, 22 bp, Homo sapiens
tttgcagtcaaatttgctaaat

SEQ ID NO: 9144270 - DNA, 22 bp, Homo sapiens
tttgcagtagacatcttatttt

SEQ ID NO: 9144271 - DNA, 22 bp, Homo sapiens
tttgcaagtatcaaacatgtca

SEQ ID NO: 9144272 - DNA, 22 bp, Homo sapiens
tttgcaatagtcctggcctgta

SEQ ID NO: 9144273 - DNA, 22 bp, Homo sapiens
tttgcaatagtcctggcctgta

SEQ ID NO: 9144274 - DNA, 22 bp, Homo sapiens
tttgcaatttgtgctgcaaatg

SEQ ID NO: 9144275 - DNA, 22 bp, Homo sapiens
tttgcaatttgtgctgcaaatg

SEQ ID NO: 9144276 - DNA, 22 bp, Homo sapiens
tttgcaaggattttctggctca

SEQ ID NO: 9144277 - DNA, 22 bp, Homo sapiens
tttgcaagatgaaaaagttcta

SEQ ID NO: 9144278 - DNA, 22 bp, Homo sapiens
tttgcaaattcttgtctagcct

SEQ ID NO: 9144279 - DNA, 23 bp, Homo sapiens
tttgcaaattggacacaaccaca

SEQ ID NO: 9144280 - DNA, 23 bp, Homo sapiens
tttgcaaattggacacaaccaca

SEQ ID NO: 9144281 - DNA, 22 bp, Homo sapiens
tttgcaaatgctctgcagagct

SEQ ID NO: 9144282 - DNA, 22 bp, Homo sapiens
tttgcaaatgaagctctgagga

SEQ ID NO: 9144283 - DNA, 22 bp, Homo sapiens
tttctttcaattctcctaatgc

SEQ ID NO: 9144284 - DNA, 22 bp, Homo sapiens
tttctttatcctcctttgcaca

SEQ ID NO: 9144285 - DNA, 22 bp, Homo sapiens
tttctttatcctcctttgcaca

SEQ ID NO: 9144286 - DNA, 22 bp, Homo sapiens
tttctttccatacatattgcta

SEQ ID NO: 9144287 - DNA, 22 bp, Homo sapiens
tttctttccagagtgattggca

SEQ ID NO: 9144288 - DNA, 22 bp, Homo sapiens
tttgcaaatacagaggtcttgc

SEQ ID NO: 9144289 - DNA, 22 bp, Homo sapiens
tttgcaaatgaagctctgagga

SEQ ID NO: 9144290 - DNA, 22 bp, Homo sapiens
tttggacacattatttatcttc

SEQ ID NO: 9144291 - DNA, 22 bp, Homo sapiens
tttggaagggaaccaaaacatg

SEQ ID NO: 9144292 - DNA, 22 bp, Homo sapiens
tttgcagtctggcctgctttgg

SEQ ID NO: 9144293 - DNA, 22 bp, Homo sapiens
tttgcagtcaaatttgctaaat

SEQ ID NO: 9144294 - DNA, 22 bp, Homo sapiens
tttgcagtctggcctgctttgg

SEQ ID NO: 9144295 - DNA, 22 bp, Homo sapiens
tttggcaaagatcaacatgtta

SEQ ID NO: 9144296 - DNA, 22 bp, Homo sapiens
tttgtacacaggatgttataat

SEQ ID NO: 9144297 - DNA, 22 bp, Homo sapiens
tttgtacaattagcagaggcta

SEQ ID NO: 9144298 - DNA, 23 bp, Homo sapiens
tttgtacattgaggaggcagaat

SEQ ID NO: 9144299 - DNA, 22 bp, Homo sapiens
ttagagctgatagtacactggt

SEQ ID NO: 9144300 - DNA, 22 bp, Homo sapiens
ttagagccccagaaaacagtgg

SEQ ID NO: 9144301 - DNA, 22 bp, Homo sapiens
ttagagccagttacaaggtcaa

SEQ ID NO: 9144302 - DNA, 22 bp, Homo sapiens
ttagagcaggagttgacagatt

SEQ ID NO: 9144303 - DNA, 22 bp, Homo sapiens
ttagaggggctgctgaatggga

SEQ ID NO: 9144304 - DNA, 22 bp, Homo sapiens
ttagagaagctgtaattattca

SEQ ID NO: 9144305 - DNA, 23 bp, Homo sapiens
ttagagatgattaaaaaatcttg

SEQ ID NO: 9144306 - DNA, 22 bp, Homo sapiens
ttagacatgtttgctaaaatga

SEQ ID NO: 9144307 - DNA, 22 bp, Homo sapiens
ttagagaaagggtttgattccg

SEQ ID NO: 9144308 - DNA, 22 bp, Homo sapiens
ttagaaagctttccatagtcaa

SEQ ID NO: 9144309 - DNA, 22 bp, Homo sapiens
ttagaagccaggatggagcagg

SEQ ID NO: 9144310 - DNA, 22 bp, Homo sapiens
ttactttatctcctagattcca

SEQ ID NO: 9144311 - DNA, 22 bp, Homo sapiens
ttactttgatgatcaatgagcg

SEQ ID NO: 9144312 - DNA, 22 bp, Homo sapiens
ttactttgatgatcaatgagcg

SEQ ID NO: 9144313 - DNA, 22 bp, Homo sapiens
ttactttgggtcctgcttataa

SEQ ID NO: 9144314 - DNA, 22 bp, Homo sapiens
ttactttgggtcctgcttataa

SEQ ID NO: 9144315 - DNA, 18 bp, Homo sapiens
ttactttgtatagcctag

SEQ ID NO: 9144316 - DNA, 22 bp, Homo sapiens
ttactttgctttctcattacag

SEQ ID NO: 9144317 - DNA, 22 bp, Homo sapiens
ttactttgccttttagtgtagg

SEQ ID NO: 9144318 - DNA, 22 bp, Homo sapiens
ttactttgcagatgtgtatgtc

SEQ ID NO: 9144319 - DNA, 22 bp, Homo sapiens
ttagaaagaactttagatatca

SEQ ID NO: 9144320 - DNA, 21 bp, Homo sapiens
ttagaaagctcactacagtta

SEQ ID NO: 9144321 - DNA, 22 bp, Homo sapiens
ttacttttctattcgatatgtg

SEQ ID NO: 9144322 - DNA, 22 bp, Homo sapiens
ttactttagatcatactgtgtg

SEQ ID NO: 9144323 - DNA, 22 bp, Homo sapiens
ttactttagaaatagtcatcaa

SEQ ID NO: 9144324 - DNA, 21 bp, Homo sapiens
ttactttagaaattgcctttt

SEQ ID NO: 9144325 - DNA, 19 bp, Homo sapiens
ttacttggcaaagtcagtc

SEQ ID NO: 9144326 - DNA, 22 bp, Homo sapiens
ttacttgtgcaccaccctaata

SEQ ID NO: 9144327 - DNA, 22 bp, Homo sapiens
ttacttgacataaatgagttta

SEQ ID NO: 9144328 - DNA, 22 bp, Homo sapiens
ttacttgagctgctttttgtat

SEQ ID NO: 9144329 - DNA, 22 bp, Homo sapiens
ttacttgaatgttttgggtgtc

SEQ ID NO: 9144330 - DNA, 18 bp, Homo sapiens
ttacttgacccctctgaa

SEQ ID NO: 9144331 - DNA, 22 bp, Homo sapiens
ttacttgaatgactagtgggat

SEQ ID NO: 9144332 - DNA, 22 bp, Homo sapiens
ttacttgaatgctgtgatctca

SEQ ID NO: 9144333 - DNA, 22 bp, Homo sapiens
ttacttgaaatggcttcttgga

SEQ ID NO: 9144334 - DNA, 22 bp, Homo sapiens
ttacttgaaatgtgataagaga

SEQ ID NO: 9144335 - DNA, 22 bp, Homo sapiens
ttacttgaaggcagaaaagttt

SEQ ID NO: 9144336 - DNA, 19 bp, Homo sapiens
ttacttgaagcataggtga

SEQ ID NO: 9144337 - DNA, 22 bp, Homo sapiens
ttacttgaagcttgcttgatgg

SEQ ID NO: 9144338 - DNA, 22 bp, Homo sapiens
ttacttgattgtggagtctgag

SEQ ID NO: 9144339 - DNA, 22 bp, Homo sapiens
ttacttgatttgaaaatcatag

SEQ ID NO: 9144340 - DNA, 22 bp, Homo sapiens
ttacttgatttgaaaatcatag

SEQ ID NO: 9144341 - DNA, 22 bp, Homo sapiens
ttacttgatgtatgatgagtag

SEQ ID NO: 9144342 - DNA, 22 bp, Homo sapiens
ttacttgatgtatgatgagtag

SEQ ID NO: 9144343 - DNA, 22 bp, Homo sapiens
ttacttgaggaaaagtagtgtc

SEQ ID NO: 9144344 - DNA, 22 bp, Homo sapiens
ttacttgatgatgtataaagtc

SEQ ID NO: 9144345 - DNA, 22 bp, Homo sapiens
ttacttgatagggggatggggt

SEQ ID NO: 9144346 - DNA, 22 bp, Homo sapiens
ttacttgatagggggatggggt

SEQ ID NO: 9144347 - DNA, 22 bp, Homo sapiens
ttactgtgtttggctttagatg

SEQ ID NO: 9144348 - DNA, 22 bp, Homo sapiens
ttacttacaaaggcaaaggaag

SEQ ID NO: 9144349 - DNA, 22 bp, Homo sapiens
ttacttcttgtctcatgcctat

SEQ ID NO: 9144350 - DNA, 22 bp, Homo sapiens
ttacttgaaaaccaccagtatt

SEQ ID NO: 9144351 - DNA, 22 bp, Homo sapiens
ttacttgaaaaccaccagtatt

SEQ ID NO: 9144352 - DNA, 22 bp, Homo sapiens
ttacttgaaaggaaattaaggt

SEQ ID NO: 9144353 - DNA, 22 bp, Homo sapiens
ttacttgaaagcctttgattta

SEQ ID NO: 9144354 - DNA, 22 bp, Homo sapiens
ttactatctttccagtttggct

SEQ ID NO: 9144355 - DNA, 22 bp, Homo sapiens
ttactaggccagttttcacttt

SEQ ID NO: 9144356 - DNA, 22 bp, Homo sapiens
ttactcttccaaatgaatttca

SEQ ID NO: 9144357 - DNA, 22 bp, Homo sapiens
ttactctttggtgttaagttca

SEQ ID NO: 9144358 - DNA, 22 bp, Homo sapiens
ttaccaaatcccgtgcacattc

SEQ ID NO: 9144359 - DNA, 22 bp, Homo sapiens
ttaccaaatcccgtgcacattc

SEQ ID NO: 9144360 - DNA, 22 bp, Homo sapiens
ttaccaaatgaaatagagattt

SEQ ID NO: 9144361 - DNA, 22 bp, Homo sapiens
ttacattttggggtaaggataa

SEQ ID NO: 9144362 - DNA, 18 bp, Homo sapiens
ttactacagcactttctt

SEQ ID NO: 9144363 - DNA, 22 bp, Homo sapiens
ttactgaattgcactccagcgt

SEQ ID NO: 9144364 - DNA, 22 bp, Homo sapiens
ttactgtaaaggtcacatggtg

SEQ ID NO: 9144365 - DNA, 22 bp, Homo sapiens
ttactggctgggcctgagggct

SEQ ID NO: 9144366 - DNA, 22 bp, Homo sapiens
ttactgcaacataatgtagtct

SEQ ID NO: 9144367 - DNA, 22 bp, Homo sapiens
ttactgcacgtgggacatatat

SEQ ID NO: 9144368 - DNA, 20 bp, Homo sapiens
ttactgtagtactacatttt

SEQ ID NO: 9144369 - DNA, 22 bp, Homo sapiens
ttaatttgaccataaatatctt

SEQ ID NO: 9144370 - DNA, 22 bp, Homo sapiens
ttaatttgaccataaatatctt

SEQ ID NO: 9144371 - DNA, 22 bp, Homo sapiens
ttaattttaacctgtttgtgtc

SEQ ID NO: 9144372 - DNA, 22 bp, Homo sapiens
ttaatttttatgtatagtgtgt

SEQ ID NO: 9144373 - DNA, 22 bp, Homo sapiens
ttaatttttatgtatagtgtgt

SEQ ID NO: 9144374 - DNA, 22 bp, Homo sapiens
ttacacaacagtgcatcagcag

SEQ ID NO: 9144375 - DNA, 22 bp, Homo sapiens
ttacaaactgtcatatagtatt

SEQ ID NO: 9144376 - DNA, 22 bp, Homo sapiens
ttacacaaacacattccagata

SEQ ID NO: 9144377 - DNA, 22 bp, Homo sapiens
ttacaaacaagatcttattctt

SEQ ID NO: 9144378 - DNA, 22 bp, Homo sapiens
ttacacatgctttgtgtgtatg

SEQ ID NO: 9144379 - DNA, 22 bp, Homo sapiens
ttacactaagctacttctatat

SEQ ID NO: 9144380 - DNA, 22 bp, Homo sapiens
ttacatcagcaagagtgtatgt

SEQ ID NO: 9144381 - DNA, 22 bp, Homo sapiens
ttacatcatgcttatccctttc

SEQ ID NO: 9144382 - DNA, 22 bp, Homo sapiens
ttacatattatccaaaactgct

SEQ ID NO: 9144383 - DNA, 22 bp, Homo sapiens
ttacatcattgagacatacata

SEQ ID NO: 9144384 - DNA, 22 bp, Homo sapiens
ttacatgacaaagctttggctc

SEQ ID NO: 9144385 - DNA, 22 bp, Homo sapiens
ttacatattatccaaaactgct

SEQ ID NO: 9144386 - DNA, 22 bp, Homo sapiens
ttacaggaggaaattggctaca

SEQ ID NO: 9144387 - DNA, 22 bp, Homo sapiens
ttacacttctaaaaaaagcagg

SEQ ID NO: 9144388 - DNA, 22 bp, Homo sapiens
ttacacttagggtttgtcagag

SEQ ID NO: 9144389 - DNA, 22 bp, Homo sapiens
ttacacttacctgtccattgaa

SEQ ID NO: 9144390 - DNA, 19 bp, Homo sapiens
ttacacttctgctttgtga

SEQ ID NO: 9144391 - DNA, 22 bp, Homo sapiens
ttacacttctgaaagcctaggt

SEQ ID NO: 9144392 - DNA, 22 bp, Homo sapiens
ttacacttgtaaatggcatgta

SEQ ID NO: 9144393 - DNA, 22 bp, Homo sapiens
ttacagtaatgtattatttaac

SEQ ID NO: 9144394 - DNA, 22 bp, Homo sapiens
ttacagtacctgtatggccact

SEQ ID NO: 9144395 - DNA, 22 bp, Homo sapiens
ttacagtacagaaaataacaga

SEQ ID NO: 9144396 - DNA, 22 bp, Homo sapiens
ttaacatttgtgaagcatttag

SEQ ID NO: 9144397 - DNA, 22 bp, Homo sapiens
ttaaccaaataaaagcagactc

SEQ ID NO: 9144398 - DNA, 22 bp, Homo sapiens
ttaaccagtacttattgagcac

SEQ ID NO: 9144399 - DNA, 22 bp, Homo sapiens
ttaaccaggtcctttgaaaaca

SEQ ID NO: 9144400 - DNA, 22 bp, Homo sapiens
ttaacctaactcatggaaaaca

SEQ ID NO: 9144401 - DNA, 22 bp, Homo sapiens
ttaactgtgacagtttctcaga

SEQ ID NO: 9144402 - DNA, 22 bp, Homo sapiens
ttaacattaaaagcagcatttt

SEQ ID NO: 9144403 - DNA, 22 bp, Homo sapiens
ttaacattaaaagcagcatttt

SEQ ID NO: 9144404 - DNA, 22 bp, Homo sapiens
ttaacattgtccttagcagatt

SEQ ID NO: 9144405 - DNA, 22 bp, Homo sapiens
ttaacattgtccttagcagatt

SEQ ID NO: 9144406 - DNA, 22 bp, Homo sapiens
ttaacatttagtgtacccctgt

SEQ ID NO: 9144407 - DNA, 22 bp, Homo sapiens
ttaacatttcttttccactcat

SEQ ID NO: 9144408 - DNA, 22 bp, Homo sapiens
ttaacagctgttgcttctcttc

SEQ ID NO: 9144409 - DNA, 22 bp, Homo sapiens
ttaacttgtcagaaaatacagt

SEQ ID NO: 9144410 - DNA, 20 bp, Homo sapiens
ttaagaaaagcacatcctgc

SEQ ID NO: 9144411 - DNA, 22 bp, Homo sapiens
ttaagaagtgagtagaagtaat

SEQ ID NO: 9144412 - DNA, 22 bp, Homo sapiens
ttaagaaggtactcaaagatct

SEQ ID NO: 9144413 - DNA, 22 bp, Homo sapiens
ttaagactaaatgaggtcataa

SEQ ID NO: 9144414 - DNA, 22 bp, Homo sapiens
ttaagactattgtaatagggga

SEQ ID NO: 9144415 - DNA, 22 bp, Homo sapiens
ttaagacttttcaaaggcaaac

SEQ ID NO: 9144416 - DNA, 22 bp, Homo sapiens
ttaagagacaggagaatgatgt

SEQ ID NO: 9144417 - DNA, 22 bp, Homo sapiens
ttaagagatttaggaacattat

SEQ ID NO: 9144418 - DNA, 22 bp, Homo sapiens
ttaaggaacaattctacacacc

SEQ ID NO: 9144419 - DNA, 22 bp, Homo sapiens
ttaaggaaagccaaaatgaatt

SEQ ID NO: 9144420 - DNA, 22 bp, Homo sapiens
ttaagtgtgtattatctcatta

SEQ ID NO: 9144421 - DNA, 22 bp, Homo sapiens
ttaagtgtcataatttccaaga

SEQ ID NO: 9144422 - DNA, 22 bp, Homo sapiens
ttaagtgtagtgctaagggcag

SEQ ID NO: 9144423 - DNA, 21 bp, Homo sapiens
ttaagtgtttctccattgtta

SEQ ID NO: 9144424 - DNA, 21 bp, Homo sapiens
ttaagtgtttctccattgtta

SEQ ID NO: 9144425 - DNA, 22 bp, Homo sapiens
ttaagttgtgaataatccagtc

SEQ ID NO: 9144426 - DNA, 22 bp, Homo sapiens
ttaagttttaaagctagagtct

SEQ ID NO: 9144427 - DNA, 18 bp, Homo sapiens
ttaagttttactgcttta

SEQ ID NO: 9144428 - DNA, 23 bp, Homo sapiens
ttaagtggtcagttttagacaac

SEQ ID NO: 9144429 - DNA, 22 bp, Homo sapiens
ttaagtgagcttgaataatctt

SEQ ID NO: 9144430 - DNA, 22 bp, Homo sapiens
ttaagtaacttgtccaaatgag

SEQ ID NO: 9144431 - DNA, 22 bp, Homo sapiens
ttaagtacttccctgttggaca

SEQ ID NO: 9144432 - DNA, 22 bp, Homo sapiens
ttaagtatatccatttgactgg

SEQ ID NO: 9144433 - DNA, 22 bp, Homo sapiens
ttaagtatatccatttgactgg

SEQ ID NO: 9144434 - DNA, 22 bp, Homo sapiens
ttaaggaattacgaaaatattt

SEQ ID NO: 9144435 - DNA, 22 bp, Homo sapiens
ttaaggattagtcaaagagggc

SEQ ID NO: 9144436 - DNA, 22 bp, Homo sapiens
ttaagggccattatggatgggt

SEQ ID NO: 9144437 - DNA, 22 bp, Homo sapiens
ttaaggtagctcactaaatatg

SEQ ID NO: 9144438 - DNA, 22 bp, Homo sapiens
ttaaggtagtcagcctctgtgt

SEQ ID NO: 9144439 - DNA, 22 bp, Homo sapiens
ttaaggttaaataaggtcatat

SEQ ID NO: 9144440 - DNA, 23 bp, Homo sapiens
ttaaggttcagctttcccatgac

SEQ ID NO: 9144441 - DNA, 22 bp, Homo sapiens
ttaaggttaaataaggtcataa

SEQ ID NO: 9144442 - DNA, 22 bp, Homo sapiens
ttaaggttaaataaggtcatat

SEQ ID NO: 9144443 - DNA, 22 bp, Homo sapiens
ttaaggttaaataaggtcataa

SEQ ID NO: 9144444 - DNA, 23 bp, Homo sapiens
ttaaggttcagctttcccatgac

SEQ ID NO: 9144445 - DNA, 22 bp, Homo sapiens
ttaaggttcagtgtggcaggac

SEQ ID NO: 9144446 - DNA, 22 bp, Homo sapiens
ttaatttaagaaacggcaggcc

SEQ ID NO: 9144447 - DNA, 22 bp, Homo sapiens
ttaatttatgtccaaaccagat

SEQ ID NO: 9144448 - DNA, 22 bp, Homo sapiens
ttaatttatgtccaaaccagat

SEQ ID NO: 9144449 - DNA, 22 bp, Homo sapiens
ttaatttatacataatcacagg

SEQ ID NO: 9144450 - DNA, 22 bp, Homo sapiens
ttaattgtctgtgagtacctga

SEQ ID NO: 9144451 - DNA, 22 bp, Homo sapiens
ttaattgttggaaatagattat

SEQ ID NO: 9144452 - DNA, 22 bp, Homo sapiens
ttaattgtctgtgagtacctga

SEQ ID NO: 9144453 - DNA, 22 bp, Homo sapiens
ttaattggtaacctctggacta

SEQ ID NO: 9144454 - DNA, 22 bp, Homo sapiens
ttaattgatataaagaacttca

SEQ ID NO: 9144455 - DNA, 22 bp, Homo sapiens
ttaattgggtgcaacagctgaa

SEQ ID NO: 9144456 - DNA, 22 bp, Homo sapiens
ttaattggcctcttagaggtta

SEQ ID NO: 9144457 - DNA, 22 bp, Homo sapiens
ttaattcttccggactgtgaaa

SEQ ID NO: 9144458 - DNA, 22 bp, Homo sapiens
ttaattgagccagaaagtatct

SEQ ID NO: 9144459 - DNA, 22 bp, Homo sapiens
ttaattctagtttaacacttag

SEQ ID NO: 9144460 - DNA, 22 bp, Homo sapiens
ttaattctgcctttcatgtaac

SEQ ID NO: 9144461 - DNA, 22 bp, Homo sapiens
ttaattacaaaacacataggtt

SEQ ID NO: 9144462 - DNA, 22 bp, Homo sapiens
ttaattactaagcacaatgcaa

SEQ ID NO: 9144463 - DNA, 22 bp, Homo sapiens
ttaattcagtcaaagaaaccat

SEQ ID NO: 9144464 - DNA, 22 bp, Homo sapiens
ttaataaacaggtgcagctgaa

SEQ ID NO: 9144465 - DNA, 22 bp, Homo sapiens
ttaataaacaggtgcagctgaa

SEQ ID NO: 9144466 - DNA, 22 bp, Homo sapiens
ttaataaacaggtgcagctgaa

SEQ ID NO: 9144467 - DNA, 22 bp, Homo sapiens
ttaataaacaggtgcagctgaa

SEQ ID NO: 9144468 - DNA, 22 bp, Homo sapiens
ttaataaacaggtgcagctgaa

SEQ ID NO: 9144469 - DNA, 22 bp, Homo sapiens
tgttttcttcctaattgctcat

SEQ ID NO: 9144470 - DNA, 22 bp, Homo sapiens
tgttttctgtgtagagatcaca

SEQ ID NO: 9144471 - DNA, 22 bp, Homo sapiens
tgttttctgtgtagagatcaca

SEQ ID NO: 9144472 - DNA, 22 bp, Homo sapiens
tgttttctcttgaaaagcagtc

SEQ ID NO: 9144473 - DNA, 22 bp, Homo sapiens
tgttttctgatggttaatgagt

SEQ ID NO: 9144474 - DNA, 17 bp, Homo sapiens
tgttttctgctaccttt

SEQ ID NO: 9144475 - DNA, 23 bp, Homo sapiens
tgttttcttgtcctggtataatt

SEQ ID NO: 9144476 - DNA, 22 bp, Homo sapiens
tgttttgcttctctgtttccca

SEQ ID NO: 9144477 - DNA, 22 bp, Homo sapiens
tgttttggagtggactttgcat

SEQ ID NO: 9144478 - DNA, 22 bp, Homo sapiens
tgttttgtagctaatagctatt

SEQ ID NO: 9144479 - DNA, 22 bp, Homo sapiens
tgttttgtccttttctatatac

SEQ ID NO: 9144480 - DNA, 22 bp, Homo sapiens
tgttttgttagcactctgggaa

SEQ ID NO: 9144481 - DNA, 19 bp, Homo sapiens
tgttttgttaaagcagtcc

SEQ ID NO: 9144482 - DNA, 22 bp, Homo sapiens
tgttttgttcactgcattgtcc

SEQ ID NO: 9144483 - DNA, 22 bp, Homo sapiens
tgttttgtgcatttacaacatg

SEQ ID NO: 9144484 - DNA, 22 bp, Homo sapiens
tgttttgtgcacttctatagca

SEQ ID NO: 9144485 - DNA, 22 bp, Homo sapiens
tgttttgtctaatctaaattct

SEQ ID NO: 9144486 - DNA, 22 bp, Homo sapiens
tgttttgtccttttctatatac

SEQ ID NO: 9144487 - DNA, 22 bp, Homo sapiens
tgttttgtctaatagggcaggt

SEQ ID NO: 9144488 - DNA, 22 bp, Homo sapiens
tgttttgtttatgagagcacag

SEQ ID NO: 9144489 - DNA, 22 bp, Homo sapiens
tgttttgttcactgcattgtcc

SEQ ID NO: 9144490 - DNA, 22 bp, Homo sapiens
tgtttttaaataatgatagaaa

SEQ ID NO: 9144491 - DNA, 22 bp, Homo sapiens
ttaaagcatcctgtcagtctgt

SEQ ID NO: 9144492 - DNA, 22 bp, Homo sapiens
ttaaagcatgttgcttaacagg

SEQ ID NO: 9144493 - DNA, 22 bp, Homo sapiens
tgtttttactgtgatccagaaa

SEQ ID NO: 9144494 - DNA, 22 bp, Homo sapiens
ttaaagcatcacactattaatt

SEQ ID NO: 9144495 - DNA, 22 bp, Homo sapiens
ttaaatattatgttgtctgcaa

SEQ ID NO: 9144496 - DNA, 22 bp, Homo sapiens
ttaaatattatgttgtctgcaa

SEQ ID NO: 9144497 - DNA, 22 bp, Homo sapiens
ttaaatattatgttgtctgcaa

SEQ ID NO: 9144498 - DNA, 22 bp, Homo sapiens
ttaaatattatgttgtctgcaa

SEQ ID NO: 9144499 - DNA, 22 bp, Homo sapiens
ttaaatagtaggtctattttgg

SEQ ID NO: 9144500 - DNA, 22 bp, Homo sapiens
ttaacacatatttatcaattgc

SEQ ID NO: 9144501 - DNA, 22 bp, Homo sapiens
ttaacacagggggagacaaagt

SEQ ID NO: 9144502 - DNA, 22 bp, Homo sapiens
ttaacaatagagtttcttcagg

SEQ ID NO: 9144503 - DNA, 22 bp, Homo sapiens
ttaacaatagagtttcttcagg

SEQ ID NO: 9144504 - DNA, 22 bp, Homo sapiens
ttaacaatagagtttcttcagg

SEQ ID NO: 9144505 - DNA, 22 bp, Homo sapiens
ttaaattaggactctagttctg

SEQ ID NO: 9144506 - DNA, 22 bp, Homo sapiens
ttaaatgtgatttcatttatgt

SEQ ID NO: 9144507 - DNA, 22 bp, Homo sapiens
ttaaatgtgatttcatttatgt

SEQ ID NO: 9144508 - DNA, 22 bp, Homo sapiens
ttaaatgtgatcctggtatgca

SEQ ID NO: 9144509 - DNA, 22 bp, Homo sapiens
ttaaatggagggggaaatacgt

SEQ ID NO: 9144510 - DNA, 22 bp, Homo sapiens
ttaaatgtcaatagattgcttg

SEQ ID NO: 9144511 - DNA, 22 bp, Homo sapiens
ttaaatggggatgagtagatgg

SEQ ID NO: 9144512 - DNA, 22 bp, Homo sapiens
ttaaatgaggctgatgtagatt

SEQ ID NO: 9144513 - DNA, 22 bp, Homo sapiens
ttaaatgagatgttcagatatt

SEQ ID NO: 9144514 - DNA, 22 bp, Homo sapiens
ttaaatattttcagcagggtca

SEQ ID NO: 9144515 - DNA, 22 bp, Homo sapiens
tgtggcatacacatgaggtggt

SEQ ID NO: 9144516 - DNA, 22 bp, Homo sapiens
tgtggccaccagagctgctatt

SEQ ID NO: 9144517 - DNA, 22 bp, Homo sapiens
tgtggccaaaataaaatgaggt

SEQ ID NO: 9144518 - DNA, 22 bp, Homo sapiens
tgtggcattccaagacgcttaa

SEQ ID NO: 9144519 - DNA, 22 bp, Homo sapiens
tgtggcatggttgcaaggacaa

SEQ ID NO: 9144520 - DNA, 18 bp, Homo sapiens
tgtggcaggggtgggaga

SEQ ID NO: 9144521 - DNA, 22 bp, Homo sapiens
tgtggcagtaaaattgggcaac

SEQ ID NO: 9144522 - DNA, 22 bp, Homo sapiens
tgtggcagtataagagctagaa

SEQ ID NO: 9144523 - DNA, 22 bp, Homo sapiens
tgtggcagtataagagctagaa

SEQ ID NO: 9144524 - DNA, 19 bp, Homo sapiens
tgtggccatggttcagctg

SEQ ID NO: 9144525 - DNA, 22 bp, Homo sapiens
tgtggcccagatgagtgtgcta

SEQ ID NO: 9144526 - DNA, 22 bp, Homo sapiens
tgtggccagcaggtggctgtgt

SEQ ID NO: 9144527 - DNA, 22 bp, Homo sapiens
tgtggccagccacaggcatggt

SEQ ID NO: 9144528 - DNA, 22 bp, Homo sapiens
tgtggccaggcccctgatggtg

SEQ ID NO: 9144529 - DNA, 22 bp, Homo sapiens
tgtggccagggggccatgtccc

SEQ ID NO: 9144530 - DNA, 22 bp, Homo sapiens
tgtggccaggaaaaggagatgg

SEQ ID NO: 9144531 - DNA, 22 bp, Homo sapiens
tgtggccaggaaaaggagatgg

SEQ ID NO: 9144532 - DNA, 22 bp, Homo sapiens
tgtggcacttctctccttgtaa

SEQ ID NO: 9144533 - DNA, 22 bp, Homo sapiens
tgtggcagaaccagaattcaaa

SEQ ID NO: 9144534 - DNA, 22 bp, Homo sapiens
tgtggcagaactgggactcaaa

SEQ ID NO: 9144535 - DNA, 22 bp, Homo sapiens
tgtggaggattctgatgccagc

SEQ ID NO: 9144536 - DNA, 22 bp, Homo sapiens
tgtggcagagtaaggacccagt

SEQ ID NO: 9144537 - DNA, 21 bp, Homo sapiens
tgtggcagatgttgggaggca

SEQ ID NO: 9144538 - DNA, 22 bp, Homo sapiens
tccccaggtcctgtcggctcct

SEQ ID NO: 9144539 - DNA, 22 bp, Homo sapiens
tccccaggtcctgtcggctcct

SEQ ID NO: 9144540 - DNA, 22 bp, Homo sapiens
tccccaggtcctgtcggctcct

SEQ ID NO: 9144541 - DNA, 22 bp, Homo sapiens
tccccaggtcctgtcggctcct

SEQ ID NO: 9144542 - DNA, 22 bp, Homo sapiens
tccccaggtcctgtcggctcct

SEQ ID NO: 9144543 - DNA, 22 bp, Homo sapiens
tccccctccaattgccatgtta

SEQ ID NO: 9144544 - DNA, 22 bp, Homo sapiens
tccccctcattacctcattcaa

SEQ ID NO: 9144545 - DNA, 22 bp, Homo sapiens
tccccccagcctttcacatgag

SEQ ID NO: 9144546 - DNA, 17 bp, Homo sapiens
tcccccagggctctctc

SEQ ID NO: 9144547 - DNA, 22 bp, Homo sapiens
tcccctcccttccaacagagct

SEQ ID NO: 9144548 - DNA, 22 bp, Homo sapiens
tcccctcccttccaacagagct

SEQ ID NO: 9144549 - DNA, 22 bp, Homo sapiens
tcccctcctctcctgatatggg

SEQ ID NO: 9144550 - DNA, 22 bp, Homo sapiens
tcccctccaactccaactatgg

SEQ ID NO: 9144551 - DNA, 22 bp, Homo sapiens
tcccctccaactccaactatgg

SEQ ID NO: 9144552 - DNA, 22 bp, Homo sapiens
tgtggagaagaaggccactgca

SEQ ID NO: 9144553 - DNA, 22 bp, Homo sapiens
tgtggagatgtgagcaagggga

SEQ ID NO: 9144554 - DNA, 22 bp, Homo sapiens
tcccctctggaggctgcagggg

SEQ ID NO: 9144555 - DNA, 22 bp, Homo sapiens
tcccctctggaggctgcagggg

SEQ ID NO: 9144556 - DNA, 22 bp, Homo sapiens
tcccctctggaggctgcagggg

SEQ ID NO: 9144557 - DNA, 22 bp, Homo sapiens
tcccctctggaggctgcagggg

SEQ ID NO: 9144558 - DNA, 22 bp, Homo sapiens
tcccctctctgcgctcccaggt

SEQ ID NO: 9144559 - DNA, 22 bp, Homo sapiens
tgtggcctcctgttcctgggta

SEQ ID NO: 9144560 - DNA, 22 bp, Homo sapiens
tgtggcctctaagctcacgaag

SEQ ID NO: 9144561 - DNA, 19 bp, Homo sapiens
tgtggggagtcagggggct

SEQ ID NO: 9144562 - DNA, 22 bp, Homo sapiens
tgtggggaggctgcagtgctgc

SEQ ID NO: 9144563 - DNA, 22 bp, Homo sapiens
tgtggggaggctgcagtgctgc

SEQ ID NO: 9144564 - DNA, 22 bp, Homo sapiens
tgtggggaggctgcagtgctgc

SEQ ID NO: 9144565 - DNA, 22 bp, Homo sapiens
tgtggggaggctgcagtgctgc

SEQ ID NO: 9144566 - DNA, 22 bp, Homo sapiens
tgtggggactttcaaagccaat

SEQ ID NO: 9144567 - DNA, 22 bp, Homo sapiens
tgtggggactgagtggaggctt

SEQ ID NO: 9144568 - DNA, 18 bp, Homo sapiens
tgtggtggagctgccttc

SEQ ID NO: 9144569 - DNA, 22 bp, Homo sapiens
tgtggtctccccagtgccagct

SEQ ID NO: 9144570 - DNA, 22 bp, Homo sapiens
tgtgggtttaagaggcagcatg

SEQ ID NO: 9144571 - DNA, 22 bp, Homo sapiens
tgtggtggtaatgagccagatg

SEQ ID NO: 9144572 - DNA, 22 bp, Homo sapiens
tgtggttggaatgcagccatgc

SEQ ID NO: 9144573 - DNA, 21 bp, Homo sapiens
tgtgtaattttttaaatggcc

SEQ ID NO: 9144574 - DNA, 22 bp, Homo sapiens
tgtgtcagcacagtatcaatta

SEQ ID NO: 9144575 - DNA, 21 bp, Homo sapiens
tgtgtaattggccaaatgcac

SEQ ID NO: 9144576 - DNA, 21 bp, Homo sapiens
tgtgtaatatgtataagaata

SEQ ID NO: 9144577 - DNA, 22 bp, Homo sapiens
tgtgtccattcaggcactgacc

SEQ ID NO: 9144578 - DNA, 22 bp, Homo sapiens
tgtgtccattcaggcactgacc

SEQ ID NO: 9144579 - DNA, 22 bp, Homo sapiens
tgtgtccattcaggcactgacc

SEQ ID NO: 9144580 - DNA, 22 bp, Homo sapiens
tgtgtccacgcactggcatgat

SEQ ID NO: 9144581 - DNA, 22 bp, Homo sapiens
tgtgtccacgcactggcatgat

SEQ ID NO: 9144582 - DNA, 22 bp, Homo sapiens
tgtgtccactgaatgtgtatta

SEQ ID NO: 9144583 - DNA, 22 bp, Homo sapiens
tgtgtccaacccagggacaagt

SEQ ID NO: 9144584 - DNA, 20 bp, Homo sapiens
tgtgtccatcatctgggcac

SEQ ID NO: 9144585 - DNA, 20 bp, Homo sapiens
tgtgtccatcatctgggcac

SEQ ID NO: 9144586 - DNA, 22 bp, Homo sapiens
tgtgtccatctgacaggagagg

SEQ ID NO: 9144587 - DNA, 22 bp, Homo sapiens
tgtgtcatctgtgttacataat

SEQ ID NO: 9144588 - DNA, 21 bp, Homo sapiens
tgtgtcagtctttggaagcaa

SEQ ID NO: 9144589 - DNA, 22 bp, Homo sapiens
tgtgtcagcatcctttgggaca

SEQ ID NO: 9144590 - DNA, 22 bp, Homo sapiens
tgtgtcgcaccctacacccagg

SEQ ID NO: 9144591 - DNA, 22 bp, Homo sapiens
tgtgtgagtaaggctgagagag

SEQ ID NO: 9144592 - DNA, 22 bp, Homo sapiens
tgtgtgattgcacttatatgag

SEQ ID NO: 9144593 - DNA, 19 bp, Homo sapiens
tgtgtgcaaatggaagcca

SEQ ID NO: 9144594 - DNA, 22 bp, Homo sapiens
tgtgtgattgcacttatatgag

SEQ ID NO: 9144595 - DNA, 22 bp, Homo sapiens
tgtgtgattccacttatatggg

SEQ ID NO: 9144596 - DNA, 22 bp, Homo sapiens
tgtgtgattccacttatatggg

SEQ ID NO: 9144597 - DNA, 22 bp, Homo sapiens
tgtgtctgttttgctcaccatt

SEQ ID NO: 9144598 - DNA, 22 bp, Homo sapiens
tgtgtttatagtgtatcttcca

SEQ ID NO: 9144599 - DNA, 21 bp, Homo sapiens
tgtgtttgagactatgtttcc

SEQ ID NO: 9144600 - DNA, 22 bp, Homo sapiens
tgtgttgttttaagctgctgca

SEQ ID NO: 9144601 - DNA, 22 bp, Homo sapiens
tgtgttgttagtaccagcagtc

SEQ ID NO: 9144602 - DNA, 22 bp, Homo sapiens
tgtgtttagagagcacattcag

SEQ ID NO: 9144603 - DNA, 22 bp, Homo sapiens
tgtgttttatctattgtatctt

SEQ ID NO: 9144604 - DNA, 22 bp, Homo sapiens
tgtgttttacaaattctcttaa

SEQ ID NO: 9144605 - DNA, 22 bp, Homo sapiens
tgtgttttacaaattctcttaa

SEQ ID NO: 9144606 - DNA, 21 bp, Homo sapiens
tgtgttttaatgatattctgt

SEQ ID NO: 9144607 - DNA, 22 bp, Homo sapiens
tgtgttttaaatggaaatttga

SEQ ID NO: 9144608 - DNA, 22 bp, Homo sapiens
tgtgttttaaatggaaatttga

SEQ ID NO: 9144609 - DNA, 22 bp, Homo sapiens
tgtgtttgttagactaatgtta

SEQ ID NO: 9144610 - DNA, 22 bp, Homo sapiens
tgtgtttgggggagatgcattt

SEQ ID NO: 9144611 - DNA, 22 bp, Homo sapiens
tgtgtttgggggagatgcattt

SEQ ID NO: 9144612 - DNA, 22 bp, Homo sapiens
tgtgtttgcaatgggaatgaga

SEQ ID NO: 9144613 - DNA, 22 bp, Homo sapiens
tgtgttcttaaaagcagtgata

SEQ ID NO: 9144614 - DNA, 22 bp, Homo sapiens
tgtgttctggaaagctcactga

SEQ ID NO: 9144615 - DNA, 22 bp, Homo sapiens
tgtgttattgccactgaagacc

SEQ ID NO: 9144616 - DNA, 22 bp, Homo sapiens
tgtgttctggaaagctcactga

SEQ ID NO: 9144617 - DNA, 22 bp, Homo sapiens
tgtgttcaagattagttctagt

SEQ ID NO: 9144618 - DNA, 22 bp, Homo sapiens
tgtgttcaagattagttctagt

SEQ ID NO: 9144619 - DNA, 20 bp, Homo sapiens
tgtgtgcatctgtatgtatt

SEQ ID NO: 9144620 - DNA, 22 bp, Homo sapiens
tgtgtgcaggcactgtgccaga

SEQ ID NO: 9144621 - DNA, 22 bp, Homo sapiens
tgtgtgcagcggcaggtgaagt

SEQ ID NO: 9144622 - DNA, 22 bp, Homo sapiens
tgtgtgcacaaagagtacatgg

SEQ ID NO: 9144623 - DNA, 20 bp, Homo sapiens
tgtgtgcacacatgacattc

SEQ ID NO: 9144624 - DNA, 22 bp, Homo sapiens
tgtgtgcaattcttaacataca

SEQ ID NO: 9144625 - DNA, 22 bp, Homo sapiens
tgttatttgggaaagttgtaca

SEQ ID NO: 9144626 - DNA, 21 bp, Homo sapiens
tgttcaaacgtacacatttct

SEQ ID NO: 9144627 - DNA, 21 bp, Homo sapiens
tgttcaaacgtacacatttct

SEQ ID NO: 9144628 - DNA, 22 bp, Homo sapiens
tgttcaaatcttttgcttattt

SEQ ID NO: 9144629 - DNA, 22 bp, Homo sapiens
tgttcaaatgatcttcttaaat

SEQ ID NO: 9144630 - DNA, 22 bp, Homo sapiens
tgttcctgaggcatgtgtcaat

SEQ ID NO: 9144631 - DNA, 22 bp, Homo sapiens
tgttcccatggatatctgcata

SEQ ID NO: 9144632 - DNA, 22 bp, Homo sapiens
tgttcagaaaacagataactaa

SEQ ID NO: 9144633 - DNA, 22 bp, Homo sapiens
tgttatcctcagctcacctcta

SEQ ID NO: 9144634 - DNA, 22 bp, Homo sapiens
tgttaaaaatgcagattcctat

SEQ ID NO: 9144635 - DNA, 20 bp, Homo sapiens
tgttattagcaagcttcttt

SEQ ID NO: 9144636 - DNA, 22 bp, Homo sapiens
tgttattaaataattctctctt

SEQ ID NO: 9144637 - DNA, 22 bp, Homo sapiens
tgttattatctgttaggtgttc

SEQ ID NO: 9144638 - DNA, 22 bp, Homo sapiens
tgttattctctgcctacaagtc

SEQ ID NO: 9144639 - DNA, 22 bp, Homo sapiens
tgttattgggtcccaactaggt

SEQ ID NO: 9144640 - DNA, 22 bp, Homo sapiens
tgttatttatctgagcatttat

SEQ ID NO: 9144641 - DNA, 22 bp, Homo sapiens
tgttatttatttcacctccaga

SEQ ID NO: 9144642 - DNA, 22 bp, Homo sapiens
tgttatttgggaaagttgtaca

SEQ ID NO: 9144643 - DNA, 22 bp, Homo sapiens
tgttatttctttgccatatctt

SEQ ID NO: 9144644 - DNA, 22 bp, Homo sapiens
tgttatttctttgccatatctt

SEQ ID NO: 9144645 - DNA, 19 bp, Homo sapiens
tgttttcaagtgggattat

SEQ ID NO: 9144646 - DNA, 22 bp, Homo sapiens
tgttttcacaatgatgtcagat

SEQ ID NO: 9144647 - DNA, 22 bp, Homo sapiens
tgttttcagtcatatagcaggt

SEQ ID NO: 9144648 - DNA, 22 bp, Homo sapiens
tgtttgaaaagtggagatttat

SEQ ID NO: 9144649 - DNA, 22 bp, Homo sapiens
tgtttgaaagcacctacatttt

SEQ ID NO: 9144650 - DNA, 22 bp, Homo sapiens
tgtttgaactgaataacatagt

SEQ ID NO: 9144651 - DNA, 16 bp, Homo sapiens
tgtttgcaaagcaatc

SEQ ID NO: 9144652 - DNA, 22 bp, Homo sapiens
tgtttgatgacgacattgtaga

SEQ ID NO: 9144653 - DNA, 22 bp, Homo sapiens
tgtttcctaagtgtctctgaag

SEQ ID NO: 9144654 - DNA, 22 bp, Homo sapiens
tgtttgaaaagtggagatttat

SEQ ID NO: 9144655 - DNA, 20 bp, Homo sapiens
tgtttcttttaatgagcggc

SEQ ID NO: 9144656 - DNA, 22 bp, Homo sapiens
tgtttcattagtactgacaata

SEQ ID NO: 9144657 - DNA, 22 bp, Homo sapiens
tgtttccatggtgacagcagct

SEQ ID NO: 9144658 - DNA, 22 bp, Homo sapiens
tgtttcatgtggacatagttgt

SEQ ID NO: 9144659 - DNA, 22 bp, Homo sapiens
tgtttcaggcttctgggatttt

SEQ ID NO: 9144660 - DNA, 22 bp, Homo sapiens
tgtttcatgaaacatgtttagg

SEQ ID NO: 9144661 - DNA, 22 bp, Homo sapiens
tgtttacatgcataagcttaag

SEQ ID NO: 9144662 - DNA, 22 bp, Homo sapiens
tgtttcaggcttctgggatttt

SEQ ID NO: 9144663 - DNA, 22 bp, Homo sapiens
tgtttcaagcaatagcatttca

SEQ ID NO: 9144664 - DNA, 22 bp, Homo sapiens
tgtttactccagctgatggaac

SEQ ID NO: 9144665 - DNA, 22 bp, Homo sapiens
tgtttaatttttcatgagccaa

SEQ ID NO: 9144666 - DNA, 21 bp, Homo sapiens
tgtttaatacatatttgtgga

SEQ ID NO: 9144667 - DNA, 22 bp, Homo sapiens
tgtttaataattctatgatagt

SEQ ID NO: 9144668 - DNA, 22 bp, Homo sapiens
tgtttaatgaagatggtttttc

SEQ ID NO: 9144669 - DNA, 22 bp, Homo sapiens
tgtttaatcttcaggacagtct

SEQ ID NO: 9144670 - DNA, 22 bp, Homo sapiens
tgtttaatctataaaatggaga

SEQ ID NO: 9144671 - DNA, 22 bp, Homo sapiens
tgtttaatgcattgaccttggg

SEQ ID NO: 9144672 - DNA, 22 bp, Homo sapiens
tgtttaattcaccatcatgttc

SEQ ID NO: 9144673 - DNA, 22 bp, Homo sapiens
tgtttaattgggccaacagcgg

SEQ ID NO: 9144674 - DNA, 22 bp, Homo sapiens
tgtttaattcaccatcatgttc

SEQ ID NO: 9144675 - DNA, 22 bp, Homo sapiens
tgtttaatttcacaaagttgac

SEQ ID NO: 9144676 - DNA, 22 bp, Homo sapiens
tgttctggagataagaggtaga

SEQ ID NO: 9144677 - DNA, 22 bp, Homo sapiens
tgttctgtacctgtcctggggc

SEQ ID NO: 9144678 - DNA, 22 bp, Homo sapiens
tgttctggtgaggccatggggt

SEQ ID NO: 9144679 - DNA, 22 bp, Homo sapiens
tgttctggggttgagagacaat

SEQ ID NO: 9144680 - DNA, 22 bp, Homo sapiens
tgttctggggacagcgtcccat

SEQ ID NO: 9144681 - DNA, 22 bp, Homo sapiens
tgttctggctccttttaaatgt

SEQ ID NO: 9144682 - DNA, 22 bp, Homo sapiens
tgttctggggttgagagacaat

SEQ ID NO: 9144683 - DNA, 22 bp, Homo sapiens
tgttctggggttgagagacaat

SEQ ID NO: 9144684 - DNA, 22 bp, Homo sapiens
tgttctgtgcatctagccagta

SEQ ID NO: 9144685 - DNA, 22 bp, Homo sapiens
tgttctcactggatgcttcaca

SEQ ID NO: 9144686 - DNA, 22 bp, Homo sapiens
tgttctctaagaaaagaagcat

SEQ ID NO: 9144687 - DNA, 22 bp, Homo sapiens
tgttccttctggcttttacatc

SEQ ID NO: 9144688 - DNA, 22 bp, Homo sapiens
tgttccttttactgcatgcgta

SEQ ID NO: 9144689 - DNA, 22 bp, Homo sapiens
ttctgcttctgtgtgtcccagg

SEQ ID NO: 9144690 - DNA, 22 bp, Homo sapiens
ttctgcttattctgtagccttt

SEQ ID NO: 9144691 - DNA, 22 bp, Homo sapiens
ttctgctttcagttcttctggg

SEQ ID NO: 9144692 - DNA, 22 bp, Homo sapiens
ttctgcttttctctgtctgagt

SEQ ID NO: 9144693 - DNA, 22 bp, Homo sapiens
ttctgggcaccaccacagactt

SEQ ID NO: 9144694 - DNA, 22 bp, Homo sapiens
ttctgggcacacaggccctggt

SEQ ID NO: 9144695 - DNA, 22 bp, Homo sapiens
ttctgggcagttggaaatttca

SEQ ID NO: 9144696 - DNA, 22 bp, Homo sapiens
ttctgggcaggactggggaccc

SEQ ID NO: 9144697 - DNA, 22 bp, Homo sapiens
ttctgggcatgttacattctgt

SEQ ID NO: 9144698 - DNA, 22 bp, Homo sapiens
ttctgggccaatctcttaatct

SEQ ID NO: 9144699 - DNA, 19 bp, Homo sapiens
ttctgggcattcatattta

SEQ ID NO: 9144700 - DNA, 20 bp, Homo sapiens
ttctgggcagccatgtactt

SEQ ID NO: 9144701 - DNA, 19 bp, Homo sapiens
ttctgggcagcacatgaat

SEQ ID NO: 9144702 - DNA, 22 bp, Homo sapiens
ttctgggcagagctggagctgc

SEQ ID NO: 9144703 - DNA, 19 bp, Homo sapiens
ttctgggcagcacatgaat

SEQ ID NO: 9144704 - DNA, 22 bp, Homo sapiens
ttctgagcacgttcatttaaat

SEQ ID NO: 9144705 - DNA, 22 bp, Homo sapiens
ttctgccttcagtcctctgact

SEQ ID NO: 9144706 - DNA, 22 bp, Homo sapiens
ttctgctgaagccagggagcaa

SEQ ID NO: 9144707 - DNA, 22 bp, Homo sapiens
ttctgctgagtgggcaggtgca

SEQ ID NO: 9144708 - DNA, 22 bp, Homo sapiens
ttctgctgcctactcctgggga

SEQ ID NO: 9144709 - DNA, 22 bp, Homo sapiens
ttctgctgaagtcactgggagc

SEQ ID NO: 9144710 - DNA, 22 bp, Homo sapiens
ttctgctgcgacccaggagtta

SEQ ID NO: 9144711 - DNA, 19 bp, Homo sapiens
ttctgctgttcctaggctg

SEQ ID NO: 9144712 - DNA, 22 bp, Homo sapiens
ttctgctgtttgtagtaatgta

SEQ ID NO: 9144713 - DNA, 17 bp, Homo sapiens
ttctgctgtttcccctt

SEQ ID NO: 9144714 - DNA, 22 bp, Homo sapiens
ttctcttttcaccagttgctaa

SEQ ID NO: 9144715 - DNA, 22 bp, Homo sapiens
ttctcttttagaggctccatga

SEQ ID NO: 9144716 - DNA, 22 bp, Homo sapiens
ttctcttttcaccagttgctaa

SEQ ID NO: 9144717 - DNA, 22 bp, Homo sapiens
ttctcttttagaggctccatga

SEQ ID NO: 9144718 - DNA, 22 bp, Homo sapiens
ttctagtgtccttggacttgct

SEQ ID NO: 9144719 - DNA, 22 bp, Homo sapiens
ttctgaatggcaagcattaggc

SEQ ID NO: 9144720 - DNA, 22 bp, Homo sapiens
ttctgagagtaaacatagcctg

SEQ ID NO: 9144721 - DNA, 22 bp, Homo sapiens
ttctgagaggcagagcttgtga

SEQ ID NO: 9144722 - DNA, 22 bp, Homo sapiens
ttctgagacaattgagagtcta

SEQ ID NO: 9144723 - DNA, 22 bp, Homo sapiens
ttctgagagtgccagaagttct

SEQ ID NO: 9144724 - DNA, 19 bp, Homo sapiens
ttctggtctggaatcaagg

SEQ ID NO: 9144725 - DNA, 22 bp, Homo sapiens
ttctgggtggccagtatttaga

SEQ ID NO: 9144726 - DNA, 18 bp, Homo sapiens
ttctgggtgttatgttta

SEQ ID NO: 9144727 - DNA, 22 bp, Homo sapiens
ttctgggtttacatctgacttc

SEQ ID NO: 9144728 - DNA, 23 bp, Homo sapiens
ttctgggttgctgtgcttggaat

SEQ ID NO: 9144729 - DNA, 21 bp, Homo sapiens
ttctgggttgttaatctgaac

SEQ ID NO: 9144730 - DNA, 22 bp, Homo sapiens
ttctgggtaacaaggcaagaat

SEQ ID NO: 9144731 - DNA, 22 bp, Homo sapiens
ttctgggtagtatggttagttt

SEQ ID NO: 9144732 - DNA, 22 bp, Homo sapiens
ttctgggtcacccttctgctca

SEQ ID NO: 9144733 - DNA, 22 bp, Homo sapiens
ttctgggtgccacctaagacat

SEQ ID NO: 9144734 - DNA, 22 bp, Homo sapiens
ttctgggtgcaactctgttctg

SEQ ID NO: 9144735 - DNA, 17 bp, Homo sapiens
ttctgggtcccagggcc

SEQ ID NO: 9144736 - DNA, 22 bp, Homo sapiens
ttctgggtgactcacgctcccc

SEQ ID NO: 9144737 - DNA, 22 bp, Homo sapiens
ttctggggctaatacagaggtc

SEQ ID NO: 9144738 - DNA, 19 bp, Homo sapiens
ttctggggcctggccttgg

SEQ ID NO: 9144739 - DNA, 22 bp, Homo sapiens
ttctgggctgtccagagggtga

SEQ ID NO: 9144740 - DNA, 23 bp, Homo sapiens
ttctgggctgtggaagcctcggg

SEQ ID NO: 9144741 - DNA, 22 bp, Homo sapiens
ttctgggctgtccagagggtga

SEQ ID NO: 9144742 - DNA, 22 bp, Homo sapiens
ttctgggctcccacatatttca

SEQ ID NO: 9144743 - DNA, 22 bp, Homo sapiens
ttctgggctctctttctgtgtg

SEQ ID NO: 9144744 - DNA, 22 bp, Homo sapiens
ttctgggcttggctgtttccat

SEQ ID NO: 9144745 - DNA, 22 bp, Homo sapiens
ttctgggcttgaaagtttaata

SEQ ID NO: 9144746 - DNA, 22 bp, Homo sapiens
ttctggggccaattgccactgc

SEQ ID NO: 9144747 - DNA, 22 bp, Homo sapiens
ttctgggcctcctaggacaggc

SEQ ID NO: 9144748 - DNA, 21 bp, Homo sapiens
ttctgggccggagaaggggcg

SEQ ID NO: 9144749 - DNA, 22 bp, Homo sapiens
ttctgggctcacagagcagcag

SEQ ID NO: 9144750 - DNA, 22 bp, Homo sapiens
ttctgggctaccttcccggcag

SEQ ID NO: 9144751 - DNA, 22 bp, Homo sapiens
ttctgggcccactgtagcatcc

SEQ ID NO: 9144752 - DNA, 22 bp, Homo sapiens
ttctgggcccaaccctagagtg

SEQ ID NO: 9144753 - DNA, 21 bp, Homo sapiens
ttctgggccggagaaggggcg

SEQ ID NO: 9144754 - DNA, 22 bp, Homo sapiens
ttctgggcccaaccctagagtg

SEQ ID NO: 9144755 - DNA, 21 bp, Homo sapiens
ttctgggccatgctgcttctc

SEQ ID NO: 9144756 - DNA, 22 bp, Homo sapiens
ttctggtgggactcaggctttc

SEQ ID NO: 9144757 - DNA, 22 bp, Homo sapiens
ttctgttacaagtgaaaaaatg

SEQ ID NO: 9144758 - DNA, 22 bp, Homo sapiens
ttctgttagaattttgaaaata

SEQ ID NO: 9144759 - DNA, 22 bp, Homo sapiens
ttctgtttataatttgcagttg

SEQ ID NO: 9144760 - DNA, 22 bp, Homo sapiens
ttctgtttactcagaaatacaa

SEQ ID NO: 9144761 - DNA, 22 bp, Homo sapiens
ttctgttttagaaataagtagt

SEQ ID NO: 9144762 - DNA, 22 bp, Homo sapiens
ttctgttttagaaataagtagt

SEQ ID NO: 9144763 - DNA, 22 bp, Homo sapiens
ttctgttttagaaataagtagt

SEQ ID NO: 9144764 - DNA, 22 bp, Homo sapiens
ttctgtttctggggtctctgac

SEQ ID NO: 9144765 - DNA, 22 bp, Homo sapiens
ttctgtttgccatatatagtag

SEQ ID NO: 9144766 - DNA, 22 bp, Homo sapiens
ttctgtttgccatatatagtag

SEQ ID NO: 9144767 - DNA, 22 bp, Homo sapiens
ttctgtttgccatatatagtag

SEQ ID NO: 9144768 - DNA, 22 bp, Homo sapiens
ttctgtttgccatatatagtag

SEQ ID NO: 9144769 - DNA, 22 bp, Homo sapiens
ttctgtttgccatatatagtag

SEQ ID NO: 9144770 - DNA, 22 bp, Homo sapiens
ttctgttttgcacagacttgaa

SEQ ID NO: 9144771 - DNA, 22 bp, Homo sapiens
ttcttaaaacttatggacaggt

SEQ ID NO: 9144772 - DNA, 18 bp, Homo sapiens
ttctttaattcagtttga

SEQ ID NO: 9144773 - DNA, 22 bp, Homo sapiens
ttctttagcaacttggatttag

SEQ ID NO: 9144774 - DNA, 22 bp, Homo sapiens
ttctttatcagttactcatagg

SEQ ID NO: 9144775 - DNA, 22 bp, Homo sapiens
ttctttatcagttactcatagg

SEQ ID NO: 9144776 - DNA, 22 bp, Homo sapiens
ttctttatatctgctagtgggt

SEQ ID NO: 9144777 - DNA, 22 bp, Homo sapiens
ttctttatatctgctagtgggt

SEQ ID NO: 9144778 - DNA, 22 bp, Homo sapiens
ttctttatagctattggatgag

SEQ ID NO: 9144779 - DNA, 23 bp, Homo sapiens
ttctttataaatcaatgggatgt

SEQ ID NO: 9144780 - DNA, 22 bp, Homo sapiens
ttctttaggtagatccagtttt

SEQ ID NO: 9144781 - DNA, 22 bp, Homo sapiens
ttctttaaaatagtgagaaaga

SEQ ID NO: 9144782 - DNA, 22 bp, Homo sapiens
ttcttgcatcactctgctgttc

SEQ ID NO: 9144783 - DNA, 22 bp, Homo sapiens
ttcttctttccccctgtggtac

SEQ ID NO: 9144784 - DNA, 22 bp, Homo sapiens
ttcttctttccccctgtggtac

SEQ ID NO: 9144785 - DNA, 22 bp, Homo sapiens
ttcttctttccaattacatggt

SEQ ID NO: 9144786 - DNA, 22 bp, Homo sapiens
ttcttctttccaattacatggt

SEQ ID NO: 9144787 - DNA, 22 bp, Homo sapiens
ttcttctttccaattacatggt

SEQ ID NO: 9144788 - DNA, 22 bp, Homo sapiens
ttcttctttcctataattaatt

SEQ ID NO: 9144789 - DNA, 22 bp, Homo sapiens
ttcttctttcctataattaatt

SEQ ID NO: 9144790 - DNA, 20 bp, Homo sapiens
ttcttgagccaaaaggcata

SEQ ID NO: 9144791 - DNA, 22 bp, Homo sapiens
ttcttgaaggggatataaatag

SEQ ID NO: 9144792 - DNA, 22 bp, Homo sapiens
ttcttgaaggggatataaatag

SEQ ID NO: 9144793 - DNA, 22 bp, Homo sapiens
ttcttgaatagggattgataaa

SEQ ID NO: 9144794 - DNA, 21 bp, Homo sapiens
ttcttcttggactgttttggc

SEQ ID NO: 9144795 - DNA, 22 bp, Homo sapiens
ttcttcttgtctgccctcacat

SEQ ID NO: 9144796 - DNA, 22 bp, Homo sapiens
ttcttcttgtctgccctcacat

SEQ ID NO: 9144797 - DNA, 22 bp, Homo sapiens
ttcttctttatctcagtatcct

SEQ ID NO: 9144798 - DNA, 22 bp, Homo sapiens
ttcttctttatctcagtatcct

SEQ ID NO: 9144799 - DNA, 22 bp, Homo sapiens
ttcttacagagtttacagagcc

SEQ ID NO: 9144800 - DNA, 22 bp, Homo sapiens
ttcttacatattttcatatggt

SEQ ID NO: 9144801 - DNA, 22 bp, Homo sapiens
ttcttacagccctattactaaa

SEQ ID NO: 9144802 - DNA, 22 bp, Homo sapiens
ttctttatcagttactcatagg

SEQ ID NO: 9144803 - DNA, 22 bp, Homo sapiens
ttctttatcctatttgtaggtg

SEQ ID NO: 9144804 - DNA, 22 bp, Homo sapiens
ttctttatcctatttgtaggtg

SEQ ID NO: 9144805 - DNA, 22 bp, Homo sapiens
ttctttatgcttctgtttaggc

SEQ ID NO: 9144806 - DNA, 22 bp, Homo sapiens
ttctttatgcttctgtttaggc

SEQ ID NO: 9144807 - DNA, 22 bp, Homo sapiens
ttctttatgcttctgtttaggc

SEQ ID NO: 9144808 - DNA, 22 bp, Homo sapiens
ttctttatgcttctgtttaggc

SEQ ID NO: 9144809 - DNA, 22 bp, Homo sapiens
ttctttatggaatggtgatagt

SEQ ID NO: 9144810 - DNA, 22 bp, Homo sapiens
ttctttattgagacttcattgt

SEQ ID NO: 9144811 - DNA, 22 bp, Homo sapiens
ttctttattagtttagtgagct

SEQ ID NO: 9144812 - DNA, 22 bp, Homo sapiens
ttctttattagtttagtgagct

SEQ ID NO: 9144813 - DNA, 22 bp, Homo sapiens
ttctttatgttaatgaatctat

SEQ ID NO: 9144814 - DNA, 22 bp, Homo sapiens
ttctttatgttaatgaatctat

SEQ ID NO: 9144815 - DNA, 20 bp, Homo sapiens
ttctttcatctacacgttgt

SEQ ID NO: 9144816 - DNA, 19 bp, Homo sapiens
ttctttccacatcttctct

SEQ ID NO: 9144817 - DNA, 22 bp, Homo sapiens
ttctttcagaacacaagtgatt

SEQ ID NO: 9144818 - DNA, 22 bp, Homo sapiens
ttctttcaatagctggcatatg

SEQ ID NO: 9144819 - DNA, 22 bp, Homo sapiens
ttctttattgagacttcattgt

SEQ ID NO: 9144820 - DNA, 22 bp, Homo sapiens
ttctttattgagacttcattgt

SEQ ID NO: 9144821 - DNA, 22 bp, Homo sapiens
ttgaagaaccatctgtgccact

SEQ ID NO: 9144822 - DNA, 21 bp, Homo sapiens
ttctttccccagaggactaaa

SEQ ID NO: 9144823 - DNA, 22 bp, Homo sapiens
ttgaagagtttgatagagttga

SEQ ID NO: 9144824 - DNA, 22 bp, Homo sapiens
ttgaagagttttatgccaacct

SEQ ID NO: 9144825 - DNA, 22 bp, Homo sapiens
ttgaagagtgtccttgtaaaaa

SEQ ID NO: 9144826 - DNA, 22 bp, Homo sapiens
ttgaagagtgccttccagacat

SEQ ID NO: 9144827 - DNA, 22 bp, Homo sapiens
ttgaagagtctagattggttat

SEQ ID NO: 9144828 - DNA, 22 bp, Homo sapiens
ttgaagagtctttctttccccc

SEQ ID NO: 9144829 - DNA, 22 bp, Homo sapiens
ttgaagagtgcattagcatatt

SEQ ID NO: 9144830 - DNA, 22 bp, Homo sapiens
ttgaagagaaccgcggcttatt

SEQ ID NO: 9144831 - DNA, 22 bp, Homo sapiens
ttgaagagaatcagaaggttga

SEQ ID NO: 9144832 - DNA, 22 bp, Homo sapiens
ttgaagagctgcttgataccct

SEQ ID NO: 9144833 - DNA, 22 bp, Homo sapiens
ttgaagagacaatttggaaagc

SEQ ID NO: 9144834 - DNA, 22 bp, Homo sapiens
ttgaagagacgatttttccacc

SEQ ID NO: 9144835 - DNA, 20 bp, Homo sapiens
ttgaagaggatatatcgctc

SEQ ID NO: 9144836 - DNA, 22 bp, Homo sapiens
ttgaagagtaaagtgttttctc

SEQ ID NO: 9144837 - DNA, 22 bp, Homo sapiens
ttgaagagcaccagcattttga

SEQ ID NO: 9144838 - DNA, 22 bp, Homo sapiens
ttgaagaggactttgcagctgt

SEQ ID NO: 9144839 - DNA, 22 bp, Homo sapiens
ttgaagagtagaaaatgcaaat

SEQ ID NO: 9144840 - DNA, 20 bp, Homo sapiens
ttgaagagtcaggtagggcc

SEQ ID NO: 9144841 - DNA, 22 bp, Homo sapiens
ttgaagagtcgcttaacctgtg

SEQ ID NO: 9144842 - DNA, 22 bp, Homo sapiens
ttgaattataagtgtgtctact

SEQ ID NO: 9144843 - DNA, 22 bp, Homo sapiens
ttgagatattcagttccattga

SEQ ID NO: 9144844 - DNA, 22 bp, Homo sapiens
ttgaatgcagtcatgaaaagtt

SEQ ID NO: 9144845 - DNA, 17 bp, Homo sapiens
ttgaatgcattacttgg

SEQ ID NO: 9144846 - DNA, 22 bp, Homo sapiens
ttgaagcaaggcgaatcttgtg

SEQ ID NO: 9144847 - DNA, 22 bp, Homo sapiens
ttgaggagtgtttagggtgagg

SEQ ID NO: 9144848 - DNA, 22 bp, Homo sapiens
ttgaggagttgtgacagatact

SEQ ID NO: 9144849 - DNA, 22 bp, Homo sapiens
ttgagcatttgttttgaaagag

SEQ ID NO: 9144850 - DNA, 22 bp, Homo sapiens
ttgagcatgtaactacacaggg

SEQ ID NO: 9144851 - DNA, 22 bp, Homo sapiens
ttgagcccaggaggcctgggtg

SEQ ID NO: 9144852 - DNA, 22 bp, Homo sapiens
ttgagccctacctcagactttc

SEQ ID NO: 9144853 - DNA, 22 bp, Homo sapiens
ttgagatttggaggtaattccc

SEQ ID NO: 9144854 - DNA, 22 bp, Homo sapiens
ttgagcaatgctgcaaagagat

SEQ ID NO: 9144855 - DNA, 22 bp, Homo sapiens
ttgagcaggatggctatgcaca

SEQ ID NO: 9144856 - DNA, 19 bp, Homo sapiens
ttgagcagtgcttagcacc

SEQ ID NO: 9144857 - DNA, 22 bp, Homo sapiens
ttgagcacattccctttcatgg

SEQ ID NO: 9144858 - DNA, 22 bp, Homo sapiens
ttgcaaataaacaagtatacat

SEQ ID NO: 9144859 - DNA, 22 bp, Homo sapiens
ttgcaaataaacaagtatacat

SEQ ID NO: 9144860 - DNA, 20 bp, Homo sapiens
ttgcaaatatctattgattg

SEQ ID NO: 9144861 - DNA, 22 bp, Homo sapiens
ttgcaaatgtgaataattacac

SEQ ID NO: 9144862 - DNA, 22 bp, Homo sapiens
ttgcaaatgtgaataattacac

SEQ ID NO: 9144863 - DNA, 22 bp, Homo sapiens
ttgcaaatgtttcataacagta

SEQ ID NO: 9144864 - DNA, 22 bp, Homo sapiens
ttgcaaatgtttcataacagta

SEQ ID NO: 9144865 - DNA, 22 bp, Homo sapiens
ttgattgaattttgaaaatcta

SEQ ID NO: 9144866 - DNA, 22 bp, Homo sapiens
ttgattgtactccaagtacctg

SEQ ID NO: 9144867 - DNA, 22 bp, Homo sapiens
ttgatttctattcagatgtaga

SEQ ID NO: 9144868 - DNA, 22 bp, Homo sapiens
ttgatttcttactcttccaagg

SEQ ID NO: 9144869 - DNA, 22 bp, Homo sapiens
ttgatttgtattgcaggcccct

SEQ ID NO: 9144870 - DNA, 22 bp, Homo sapiens
ttgatttgtaggaatggagacc

SEQ ID NO: 9144871 - DNA, 22 bp, Homo sapiens
ttgcaaaggggaataaagcaat

SEQ ID NO: 9144872 - DNA, 20 bp, Homo sapiens
ttgcaaagtgaatagcaatt

SEQ ID NO: 9144873 - DNA, 22 bp, Homo sapiens
ttgcaaagagataatcctaggc

SEQ ID NO: 9144874 - DNA, 22 bp, Homo sapiens
ttgcaaaggggaataaagcaat

SEQ ID NO: 9144875 - DNA, 21 bp, Homo sapiens
ttgattttaggaagtttgtca

SEQ ID NO: 9144876 - DNA, 22 bp, Homo sapiens
ttgagtctctgccaaaacacaa

SEQ ID NO: 9144877 - DNA, 22 bp, Homo sapiens
ttgagtgtaaggaatgtggggc

SEQ ID NO: 9144878 - DNA, 22 bp, Homo sapiens
ttgagtggttcctcagttgact

SEQ ID NO: 9144879 - DNA, 22 bp, Homo sapiens
ttgagtctgcaatacataacac

SEQ ID NO: 9144880 - DNA, 22 bp, Homo sapiens
ttgatgcttaaggtaaaacaga

SEQ ID NO: 9144881 - DNA, 22 bp, Homo sapiens
ttgatgcactatgtaacttaca

SEQ ID NO: 9144882 - DNA, 22 bp, Homo sapiens
ttgattacaaagtagatacatt

SEQ ID NO: 9144883 - DNA, 22 bp, Homo sapiens
ttgattaaacaggcatattcaa

SEQ ID NO: 9144884 - DNA, 20 bp, Homo sapiens
ttgattcaagggctgatgga

SEQ ID NO: 9144885 - DNA, 22 bp, Homo sapiens
ttgatgtcagtattatgagttt

SEQ ID NO: 9144886 - DNA, 22 bp, Homo sapiens
ttgatgttcataaatgatacag

SEQ ID NO: 9144887 - DNA, 22 bp, Homo sapiens
ttgatgtttccccttggacatt

SEQ ID NO: 9144888 - DNA, 22 bp, Homo sapiens
ttgattctgggctcatttcttt

SEQ ID NO: 9144889 - DNA, 22 bp, Homo sapiens
ttgattctgatcctttgctagc

SEQ ID NO: 9144890 - DNA, 22 bp, Homo sapiens
ttctagattgcctgtaagtaaa

SEQ ID NO: 9144891 - DNA, 22 bp, Homo sapiens
ttctagattgcctgtaagtaaa

SEQ ID NO: 9144892 - DNA, 22 bp, Homo sapiens
ttctagatgcttataggcatat

SEQ ID NO: 9144893 - DNA, 22 bp, Homo sapiens
ttctagatagagtgcaaattat

SEQ ID NO: 9144894 - DNA, 22 bp, Homo sapiens
ttctagatatctagtgtataac

SEQ ID NO: 9144895 - DNA, 22 bp, Homo sapiens
ttctaggatgctgatgagaccc

SEQ ID NO: 9144896 - DNA, 22 bp, Homo sapiens
ttctaggggagaggaagaagtg

SEQ ID NO: 9144897 - DNA, 22 bp, Homo sapiens
ttctagaaccatgacttcaggg

SEQ ID NO: 9144898 - DNA, 19 bp, Homo sapiens
ttctagaactgttctctca

SEQ ID NO: 9144899 - DNA, 19 bp, Homo sapiens
ttctaagttttgcttgctg

SEQ ID NO: 9144900 - DNA, 22 bp, Homo sapiens
ttctaattgaccttaggctgtg

SEQ ID NO: 9144901 - DNA, 22 bp, Homo sapiens
ttctaattaaatctacgctagg

SEQ ID NO: 9144902 - DNA, 22 bp, Homo sapiens
ttctaattgcaagttttagtat

SEQ ID NO: 9144903 - DNA, 20 bp, Homo sapiens
ttctaatttgatggagtagc

SEQ ID NO: 9144904 - DNA, 22 bp, Homo sapiens
ttctaattgtgtttgcatatct

SEQ ID NO: 9144905 - DNA, 20 bp, Homo sapiens
ttctaatttgatggagtagc

SEQ ID NO: 9144906 - DNA, 16 bp, Homo sapiens
ttctagaaaagaaggt

SEQ ID NO: 9144907 - DNA, 22 bp, Homo sapiens
ttctacttctgacactgtttgt

SEQ ID NO: 9144908 - DNA, 22 bp, Homo sapiens
ttctactttggacataaaggac

SEQ ID NO: 9144909 - DNA, 22 bp, Homo sapiens
ttctactttctctgtcattaaa

SEQ ID NO: 9144910 - DNA, 22 bp, Homo sapiens
ttctacaaatatttactgttcc

SEQ ID NO: 9144911 - DNA, 22 bp, Homo sapiens
ttctaagctctgaaataaatct

SEQ ID NO: 9144912 - DNA, 20 bp, Homo sapiens
ttctaaggttttggtgcaca

SEQ ID NO: 9144913 - DNA, 22 bp, Homo sapiens
ttctaaggggttcacaggcata

SEQ ID NO: 9144914 - DNA, 22 bp, Homo sapiens
ttccttctgaagcctttgtgtt

SEQ ID NO: 9144915 - DNA, 22 bp, Homo sapiens
ttccttctagagcttgtttagg

SEQ ID NO: 9144916 - DNA, 22 bp, Homo sapiens
ttccttcaaacgcctcctgcac

SEQ ID NO: 9144917 - DNA, 22 bp, Homo sapiens
ttccttctaattttacacctga

SEQ ID NO: 9144918 - DNA, 22 bp, Homo sapiens
ttccttagttgactgtcttagt

SEQ ID NO: 9144919 - DNA, 22 bp, Homo sapiens
ttccttagtgttagattctgtg

SEQ ID NO: 9144920 - DNA, 23 bp, Homo sapiens
ttccttaactgttaagattgtct

SEQ ID NO: 9144921 - DNA, 22 bp, Homo sapiens
ttccttaggctgtttgcagtgc

SEQ ID NO: 9144922 - DNA, 22 bp, Homo sapiens
ttcctgtggtgtttcccagaca

SEQ ID NO: 9144923 - DNA, 22 bp, Homo sapiens
ttcctctttagggctggccagg

SEQ ID NO: 9144924 - DNA, 21 bp, Homo sapiens
ttcctcttgcttccgccttgc

SEQ ID NO: 9144925 - DNA, 22 bp, Homo sapiens
ttcctcttattttcccagtgat

SEQ ID NO: 9144926 - DNA, 22 bp, Homo sapiens
ttcctctttgcatcctcaactc

SEQ ID NO: 9144927 - DNA, 22 bp, Homo sapiens
ttcctctttctctgtgctatgt

SEQ ID NO: 9144928 - DNA, 22 bp, Homo sapiens
ttcctctttctctgtgctatgt

SEQ ID NO: 9144929 - DNA, 22 bp, Homo sapiens
ttccagagagagaaaatttgat

SEQ ID NO: 9144930 - DNA, 22 bp, Homo sapiens
ttccagactatcagcagcagga

SEQ ID NO: 9144931 - DNA, 22 bp, Homo sapiens
ttccagagaggctcatgttccc

SEQ ID NO: 9144932 - DNA, 22 bp, Homo sapiens
ttccagagagttattcccctgg

SEQ ID NO: 9144933 - DNA, 21 bp, Homo sapiens
ttccagagattgtttcacctg

SEQ ID NO: 9144934 - DNA, 22 bp, Homo sapiens
ttccagagcctagaatcttgat

SEQ ID NO: 9144935 - DNA, 22 bp, Homo sapiens
ttccagagcccatgctctaggc

SEQ ID NO: 9144936 - DNA, 22 bp, Homo sapiens
ttccctggaaagccatgcagtc

SEQ ID NO: 9144937 - DNA, 22 bp, Homo sapiens
ttccctggaacatcatggtcta

SEQ ID NO: 9144938 - DNA, 22 bp, Homo sapiens
ttccctggctcttctacatcgt

SEQ ID NO: 9144939 - DNA, 22 bp, Homo sapiens
ttccctggccctggcacgctct

SEQ ID NO: 9144940 - DNA, 19 bp, Homo sapiens
ttccacacagctctcgggc

SEQ ID NO: 9144941 - DNA, 22 bp, Homo sapiens
ttccacaagtgatatctagctg

SEQ ID NO: 9144942 - DNA, 22 bp, Homo sapiens
ttccacaacaaccaagcatata

SEQ ID NO: 9144943 - DNA, 22 bp, Homo sapiens
ttccacaaatacactccacatt

SEQ ID NO: 9144944 - DNA, 22 bp, Homo sapiens
ttccacaaacacatcctgagca

SEQ ID NO: 9144945 - DNA, 22 bp, Homo sapiens
ttccacagtcatcctgggaatt

SEQ ID NO: 9144946 - DNA, 22 bp, Homo sapiens
ttccacaggtttcagactgttc

SEQ ID NO: 9144947 - DNA, 22 bp, Homo sapiens
ttccacagcccaagctggtggc

SEQ ID NO: 9144948 - DNA, 22 bp, Homo sapiens
ttccacagatgaaaattaagtt

SEQ ID NO: 9144949 - DNA, 22 bp, Homo sapiens
ttccacagccatcactgttgct

SEQ ID NO: 9144950 - DNA, 22 bp, Homo sapiens
ttccacagccatcactgttgct

SEQ ID NO: 9144951 - DNA, 20 bp, Homo sapiens
ttccacatctttgcacatgc

SEQ ID NO: 9144952 - DNA, 22 bp, Homo sapiens
ttcctctgtagttgctgatgaa

SEQ ID NO: 9144953 - DNA, 22 bp, Homo sapiens
ttcctcttatatagccttggcc

SEQ ID NO: 9144954 - DNA, 22 bp, Homo sapiens
ttcctctggggccaggccaaca

SEQ ID NO: 9144955 - DNA, 22 bp, Homo sapiens
ttcctctggaggctctaggaga

SEQ ID NO: 9144956 - DNA, 22 bp, Homo sapiens
ttcctctggaggctctaggaga

SEQ ID NO: 9144957 - DNA, 22 bp, Homo sapiens
ttcctcatggggttccttcaga

SEQ ID NO: 9144958 - DNA, 22 bp, Homo sapiens
ttcctcagttagtgcctgaggc

SEQ ID NO: 9144959 - DNA, 22 bp, Homo sapiens
ttcctcatctgtgcacctcact

SEQ ID NO: 9144960 - DNA, 22 bp, Homo sapiens
ttcctcatctgtgcacctcact

SEQ ID NO: 9144961 - DNA, 22 bp, Homo sapiens
ttcctcagttagtgcctgaggc

SEQ ID NO: 9144962 - DNA, 22 bp, Homo sapiens
ttcctcagggaggctagcagta

SEQ ID NO: 9144963 - DNA, 22 bp, Homo sapiens
ttcctcaggcttccctttgtcc

SEQ ID NO: 9144964 - DNA, 22 bp, Homo sapiens
ttcctcagctgtgtcctggcga

SEQ ID NO: 9144965 - DNA, 22 bp, Homo sapiens
ttcctcagctggcctgattggg

SEQ ID NO: 9144966 - DNA, 22 bp, Homo sapiens
ttcctcagagggcgctggggaa

SEQ ID NO: 9144967 - DNA, 22 bp, Homo sapiens
ttcctcagcacaaagccaagat

SEQ ID NO: 9144968 - DNA, 22 bp, Homo sapiens
ttcctcagccaaggctgggatc

SEQ ID NO: 9144969 - DNA, 22 bp, Homo sapiens
ttcctcagccagcacttagggg

SEQ ID NO: 9144970 - DNA, 22 bp, Homo sapiens
ttcctcagctcagcgagagaga

SEQ ID NO: 9144971 - DNA, 22 bp, Homo sapiens
ttcctcagagggcgctggggaa

SEQ ID NO: 9144972 - DNA, 22 bp, Homo sapiens
ttcctcagagggcgctggggaa

SEQ ID NO: 9144973 - DNA, 22 bp, Homo sapiens
ttcctcagaccctcattgtgag

SEQ ID NO: 9144974 - DNA, 22 bp, Homo sapiens
ttcctcagaaaatactgtccaa

SEQ ID NO: 9144975 - DNA, 22 bp, Homo sapiens
ttcctatagaaagctgtgtaga

SEQ ID NO: 9144976 - DNA, 22 bp, Homo sapiens
ttcctcaacaacttccctacag

SEQ ID NO: 9144977 - DNA, 22 bp, Homo sapiens
ttcatgtaattccataaggtaa

SEQ ID NO: 9144978 - DNA, 22 bp, Homo sapiens
ttcatgtaattccataaggtaa

SEQ ID NO: 9144979 - DNA, 20 bp, Homo sapiens
ttcatgggagcaaagaggcc

SEQ ID NO: 9144980 - DNA, 22 bp, Homo sapiens
ttcatgtaggctgcaatgcaca

SEQ ID NO: 9144981 - DNA, 22 bp, Homo sapiens
ttcatgtagtgtaatgtcttca

SEQ ID NO: 9144982 - DNA, 22 bp, Homo sapiens
ttcatgtctgccttttcaagtg

SEQ ID NO: 9144983 - DNA, 22 bp, Homo sapiens
ttcatgtccagaggaagttgag

SEQ ID NO: 9144984 - DNA, 22 bp, Homo sapiens
ttcatgtatttatcatgtaaat

SEQ ID NO: 9144985 - DNA, 22 bp, Homo sapiens
ttcatgtatttatcatgtaaat

SEQ ID NO: 9144986 - DNA, 22 bp, Homo sapiens
ttcatgtagtgtaatgtcttca

SEQ ID NO: 9144987 - DNA, 22 bp, Homo sapiens
ttcatgttcatatgtgtatatc

SEQ ID NO: 9144988 - DNA, 22 bp, Homo sapiens
ttcatgttggattcactgtgag

SEQ ID NO: 9144989 - DNA, 22 bp, Homo sapiens
ttcatgtttcatttgttactat

SEQ ID NO: 9144990 - DNA, 22 bp, Homo sapiens
ttcatgtttcctcttgtgctgc

SEQ ID NO: 9144991 - DNA, 22 bp, Homo sapiens
ttcatcattacagtcatgttat

SEQ ID NO: 9144992 - DNA, 21 bp, Homo sapiens
ttcatcattggtaaaaagtgg

SEQ ID NO: 9144993 - DNA, 22 bp, Homo sapiens
ttcatgcatggccttactccct

SEQ ID NO: 9144994 - DNA, 20 bp, Homo sapiens
ttcatgcagtggttgctgtg

SEQ ID NO: 9144995 - DNA, 20 bp, Homo sapiens
ttcatgcagtggttgctgtg

SEQ ID NO: 9144996 - DNA, 22 bp, Homo sapiens
ttcatgcttttaccgctgttaa

SEQ ID NO: 9144997 - DNA, 22 bp, Homo sapiens
ttcatggcatacatgtttccca

SEQ ID NO: 9144998 - DNA, 22 bp, Homo sapiens
ttcatggcctactttgcttcaa

SEQ ID NO: 9144999 - DNA, 22 bp, Homo sapiens
ttcatgctgtgtctacaactta

SEQ ID NO: 9145000 - DNA, 22 bp, Homo sapiens
ttcatgcttgttcctccacctg

SEQ ID NO: 9145001 - DNA, 22 bp, Homo sapiens
ttcatgctagtatgtgctgttc

SEQ ID NO: 9145002 - DNA, 22 bp, Homo sapiens
ttcatgctagtatgtgctgttc

SEQ ID NO: 9145003 - DNA, 22 bp, Homo sapiens
ttcatgctcctgccctttttgg

SEQ ID NO: 9145004 - DNA, 22 bp, Homo sapiens
ttcatgccaccccttgaggagt

SEQ ID NO: 9145005 - DNA, 22 bp, Homo sapiens
ttcatcatcagaactgttcact

SEQ ID NO: 9145006 - DNA, 22 bp, Homo sapiens
ttcacattataatcagttctgc

SEQ ID NO: 9145007 - DNA, 22 bp, Homo sapiens
ttcacattccgcggctattttc

SEQ ID NO: 9145008 - DNA, 22 bp, Homo sapiens
ttcacattctcacaagaggaaa

SEQ ID NO: 9145009 - DNA, 19 bp, Homo sapiens
ttcacattggaagaagtag

SEQ ID NO: 9145010 - DNA, 19 bp, Homo sapiens
ttcacattggaagaagtag

SEQ ID NO: 9145011 - DNA, 22 bp, Homo sapiens
ttcaggagaaagttcagtactt

SEQ ID NO: 9145012 - DNA, 22 bp, Homo sapiens
ttcacagtgctgcacctggctt

SEQ ID NO: 9145013 - DNA, 21 bp, Homo sapiens
ttcacagtggataactttctg

SEQ ID NO: 9145014 - DNA, 22 bp, Homo sapiens
ttcacagtggctaagttctgca

SEQ ID NO: 9145015 - DNA, 22 bp, Homo sapiens
ttcacagtggccctctctgagt

SEQ ID NO: 9145016 - DNA, 22 bp, Homo sapiens
ttcacattacaaggccatattt

SEQ ID NO: 9145017 - DNA, 22 bp, Homo sapiens
ttcacattacaaggccatattt

SEQ ID NO: 9145018 - DNA, 22 bp, Homo sapiens
ttcacattagccaagagatgga

SEQ ID NO: 9145019 - DNA, 22 bp, Homo sapiens
ttcagtctcctcattttacaaa

SEQ ID NO: 9145020 - DNA, 22 bp, Homo sapiens
ttcagtatacttcataacattt

SEQ ID NO: 9145021 - DNA, 18 bp, Homo sapiens
ttcaggtcagaaagatgg

SEQ ID NO: 9145022 - DNA, 18 bp, Homo sapiens
ttcaggtcagaaagatgg

SEQ ID NO: 9145023 - DNA, 22 bp, Homo sapiens
ttcagtaagcacttctagagct

SEQ ID NO: 9145024 - DNA, 22 bp, Homo sapiens
ttcagtaaaacactgcaatgtc

SEQ ID NO: 9145025 - DNA, 22 bp, Homo sapiens
ttcaggtttttaagttctgcct

SEQ ID NO: 9145026 - DNA, 22 bp, Homo sapiens
ttcaggaggtgagcaagaaggg

SEQ ID NO: 9145027 - DNA, 22 bp, Homo sapiens
ttcaggagctggctgcgaagga

SEQ ID NO: 9145028 - DNA, 22 bp, Homo sapiens
ttcaggaggtgagcaagaaggg

SEQ ID NO: 9145029 - DNA, 22 bp, Homo sapiens
ttcaggaggtgagcaagaaggg

SEQ ID NO: 9145030 - DNA, 22 bp, Homo sapiens
ttcaggagaattccaagaagta

SEQ ID NO: 9145031 - DNA, 22 bp, Homo sapiens
ttcaggagaaagttcagtactt

SEQ ID NO: 9145032 - DNA, 22 bp, Homo sapiens
ttcaggagaattccaagaagta

SEQ ID NO: 9145033 - DNA, 22 bp, Homo sapiens
ttcaggagaaagttcagtactt

SEQ ID NO: 9145034 - DNA, 22 bp, Homo sapiens
ttcaggagctggctgcgaagga

SEQ ID NO: 9145035 - DNA, 22 bp, Homo sapiens
ttcaggagaattccaagaagta

SEQ ID NO: 9145036 - DNA, 22 bp, Homo sapiens
ttcaggagctagggatgtgaaa

SEQ ID NO: 9145037 - DNA, 22 bp, Homo sapiens
ttcaacaaggctgtcaaaagtt

SEQ ID NO: 9145038 - DNA, 22 bp, Homo sapiens
ttcaacaatgaaagctaaggaa

SEQ ID NO: 9145039 - DNA, 22 bp, Homo sapiens
ttcaacaaggctgtcaaaagtt

SEQ ID NO: 9145040 - DNA, 22 bp, Homo sapiens
ttcaacaacttggttcaaatgg

SEQ ID NO: 9145041 - DNA, 21 bp, Homo sapiens
ttcaacaaagggaataagttt

SEQ ID NO: 9145042 - DNA, 21 bp, Homo sapiens
ttcaacaaagggaataagttt

SEQ ID NO: 9145043 - DNA, 22 bp, Homo sapiens
ttcaaagtaccgtacttaatgg

SEQ ID NO: 9145044 - DNA, 22 bp, Homo sapiens
ttcaacaaaatatatttttcca

SEQ ID NO: 9145045 - DNA, 22 bp, Homo sapiens
ttcaaagtaaaaatgtgttcac

SEQ ID NO: 9145046 - DNA, 17 bp, Homo sapiens
ttcaaagcttatcaagg

SEQ ID NO: 9145047 - DNA, 21 bp, Homo sapiens
ttagagttgccattatatgta

SEQ ID NO: 9145048 - DNA, 22 bp, Homo sapiens
ttagagtcaagctgcatgttct

SEQ ID NO: 9145049 - DNA, 22 bp, Homo sapiens
ttagagtcaaaatggcatgtta

SEQ ID NO: 9145050 - DNA, 22 bp, Homo sapiens
ttagataaattaagactttaca

SEQ ID NO: 9145051 - DNA, 22 bp, Homo sapiens
ttagataaattaagactttaca

SEQ ID NO: 9145052 - DNA, 22 bp, Homo sapiens
ttagataaaagtgttcaataaa

SEQ ID NO: 9145053 - DNA, 22 bp, Homo sapiens
ttagataaagtgatgtaggcta

SEQ ID NO: 9145054 - DNA, 22 bp, Homo sapiens
ttcaacatttgatacaagtcag

SEQ ID NO: 9145055 - DNA, 22 bp, Homo sapiens
ttcaacatttgaaatgaatgaa

SEQ ID NO: 9145056 - DNA, 22 bp, Homo sapiens
ttcaacatgttctacataaggg

SEQ ID NO: 9145057 - DNA, 22 bp, Homo sapiens
ttcaacattacacaggcaattc

SEQ ID NO: 9145058 - DNA, 22 bp, Homo sapiens
ttcaaccaggttaattcactac

SEQ ID NO: 9145059 - DNA, 22 bp, Homo sapiens
ttcaaccattgtgtaagacagt

SEQ ID NO: 9145060 - DNA, 22 bp, Homo sapiens
ttcaactagatttatacaattc

SEQ ID NO: 9145061 - DNA, 22 bp, Homo sapiens
ttcaactagatttatacaattc

SEQ ID NO: 9145062 - DNA, 22 bp, Homo sapiens
ttcaactttatgcatatgtatt

SEQ ID NO: 9145063 - DNA, 22 bp, Homo sapiens
ttcaacaattaagtatcagcct

SEQ ID NO: 9145064 - DNA, 22 bp, Homo sapiens
ttcaacaatgcacttgagtata

SEQ ID NO: 9145065 - DNA, 21 bp, Homo sapiens
ttcaacagcataatgtaggaa

SEQ ID NO: 9145066 - DNA, 22 bp, Homo sapiens
ttcaacatgctttatttctaaa

SEQ ID NO: 9145067 - DNA, 19 bp, Homo sapiens
ttcaacatgctgaggcagc

SEQ ID NO: 9145068 - DNA, 22 bp, Homo sapiens
ttcaacatgcaaacatgtttgt

SEQ ID NO: 9145069 - DNA, 22 bp, Homo sapiens
ttcaacatcattgtaagcctct

SEQ ID NO: 9145070 - DNA, 22 bp, Homo sapiens
ttcaacatagctgaggcatata

SEQ ID NO: 9145071 - DNA, 22 bp, Homo sapiens
ttcaacatcaagaatgcatgga

SEQ ID NO: 9145072 - DNA, 22 bp, Homo sapiens
ttcacaaaaatgctgaacagtt

SEQ ID NO: 9145073 - DNA, 22 bp, Homo sapiens
ttcaattctgctctgatcttag

SEQ ID NO: 9145074 - DNA, 22 bp, Homo sapiens
ttcacaaaacactattttctgg

SEQ ID NO: 9145075 - DNA, 22 bp, Homo sapiens
ttcacaaaacactattttctgg

SEQ ID NO: 9145076 - DNA, 22 bp, Homo sapiens
ttcaatgcctttctctaagctc

SEQ ID NO: 9145077 - DNA, 22 bp, Homo sapiens
ttcaatgtctatgtacatttta

SEQ ID NO: 9145078 - DNA, 22 bp, Homo sapiens
ttcaattctgatgaaggcaata

SEQ ID NO: 9145079 - DNA, 22 bp, Homo sapiens
ttcaatttagtgatgttgttgg

SEQ ID NO: 9145080 - DNA, 22 bp, Homo sapiens
ttcacagtgccagggggcaggc

SEQ ID NO: 9145081 - DNA, 22 bp, Homo sapiens
ttcacagtgagctatgtcttgt

SEQ ID NO: 9145082 - DNA, 22 bp, Homo sapiens
ttcacagtaatgtgcccaggta

SEQ ID NO: 9145083 - DNA, 22 bp, Homo sapiens
ttcacaaagctggagcatttcc

SEQ ID NO: 9145084 - DNA, 22 bp, Homo sapiens
ttcacaaagctggagcatttcc

SEQ ID NO: 9145085 - DNA, 22 bp, Homo sapiens
ttcacaaagctggagcatttcc

SEQ ID NO: 9145086 - DNA, 22 bp, Homo sapiens
ttcacaaagctggagcatttcc

SEQ ID NO: 9145087 - DNA, 22 bp, Homo sapiens
agggccagaatccctcagtcta

SEQ ID NO: 9145088 - DNA, 22 bp, Homo sapiens
agggccagagtacatcagggct

SEQ ID NO: 9145089 - DNA, 22 bp, Homo sapiens
agggccagagtacatcagggct

SEQ ID NO: 9145090 - DNA, 22 bp, Homo sapiens
ccctggaggcggagcttgcagt

SEQ ID NO: 9145091 - DNA, 22 bp, Homo sapiens
ccctggaggcggagcttgcagt

SEQ ID NO: 9145092 - DNA, 22 bp, Homo sapiens
ccctggaggcaaaggttgcagt

SEQ ID NO: 9145093 - DNA, 22 bp, Homo sapiens
ccctggaggcaaaggttgcagt

SEQ ID NO: 9145094 - DNA, 19 bp, Homo sapiens
ccctggaggagtgttggct

SEQ ID NO: 9145095 - DNA, 22 bp, Homo sapiens
ccctggagggacagctgctcta

SEQ ID NO: 9145096 - DNA, 22 bp, Homo sapiens
ccctggaggcggatgttgcagt

SEQ ID NO: 9145097 - DNA, 22 bp, Homo sapiens
ccctggaggcggatgttgcagt

SEQ ID NO: 9145098 - DNA, 22 bp, Homo sapiens
ccctggaggcggatgttgcagt

SEQ ID NO: 9145099 - DNA, 22 bp, Homo sapiens
ccctggaggctggaggcagtag

SEQ ID NO: 9145100 - DNA, 22 bp, Homo sapiens
ccctggaggctggaggcagtag

SEQ ID NO: 9145101 - DNA, 22 bp, Homo sapiens
ccctggaggctggaggcagtag

SEQ ID NO: 9145102 - DNA, 22 bp, Homo sapiens
ccctggaggctggaggcagtag

SEQ ID NO: 9145103 - DNA, 22 bp, Homo sapiens
ccgcccacactaaatatgagcg

SEQ ID NO: 9145104 - DNA, 22 bp, Homo sapiens
ccgcccacactaaatatgagcg

SEQ ID NO: 9145105 - DNA, 21 bp, Homo sapiens
ccgccgctgatagctctgggc

SEQ ID NO: 9145106 - DNA, 22 bp, Homo sapiens
ccgccgtgcaggccgcgacgtg

SEQ ID NO: 9145107 - DNA, 22 bp, Homo sapiens
ccgccgtgcaggccgcgacgtg

SEQ ID NO: 9145108 - DNA, 22 bp, Homo sapiens
ccgccgtgcaggccgcgacgtg

SEQ ID NO: 9145109 - DNA, 22 bp, Homo sapiens
ccgccgtgcaggccgcgacgtg

SEQ ID NO: 9145110 - DNA, 22 bp, Homo sapiens
ccgccgtgcaggccgcgacgtg

SEQ ID NO: 9145111 - DNA, 22 bp, Homo sapiens
agggccctaaggaaggcacaca

SEQ ID NO: 9145112 - DNA, 22 bp, Homo sapiens
cccttttttatgtcaagcattg

SEQ ID NO: 9145113 - DNA, 22 bp, Homo sapiens
ccgaggaagggacagggctctg

SEQ ID NO: 9145114 - DNA, 22 bp, Homo sapiens
ccgcaaggcagaggttgcagtg

SEQ ID NO: 9145115 - DNA, 22 bp, Homo sapiens
ccctttgcccagtatattctag

SEQ ID NO: 9145116 - DNA, 22 bp, Homo sapiens
ccctttcttccgtgacttctgc

SEQ ID NO: 9145117 - DNA, 22 bp, Homo sapiens
ccctttctgggacccctgtctc

SEQ ID NO: 9145118 - DNA, 22 bp, Homo sapiens
ccctttcttccgtgacttctgc

SEQ ID NO: 9145119 - DNA, 22 bp, Homo sapiens
ccctttctccagaactgtctga

SEQ ID NO: 9145120 - DNA, 22 bp, Homo sapiens
ccctttccatggctctcctagg

SEQ ID NO: 9145121 - DNA, 22 bp, Homo sapiens
cctcctctgtgcagctgtgggt

SEQ ID NO: 9145122 - DNA, 22 bp, Homo sapiens
cctccccacgggcagccggcgc

SEQ ID NO: 9145123 - DNA, 22 bp, Homo sapiens
agggctctgtccccagaggccc

SEQ ID NO: 9145124 - DNA, 22 bp, Homo sapiens
agggctctggggtggcagagat

SEQ ID NO: 9145125 - DNA, 18 bp, Homo sapiens
agggctctctgctgggtt

SEQ ID NO: 9145126 - DNA, 22 bp, Homo sapiens
agggctctcttcttggtttgca

SEQ ID NO: 9145127 - DNA, 22 bp, Homo sapiens
agggctcctccccggcctccac

SEQ ID NO: 9145128 - DNA, 23 bp, Homo sapiens
agggctccttgttgattagcatt

SEQ ID NO: 9145129 - DNA, 22 bp, Homo sapiens
agggctcctgaggcccttctgg

SEQ ID NO: 9145130 - DNA, 22 bp, Homo sapiens
agggctccgggcaggcgatgga

SEQ ID NO: 9145131 - DNA, 22 bp, Homo sapiens
agggctccgggccaccggcctg

SEQ ID NO: 9145132 - DNA, 22 bp, Homo sapiens
agggctccgggcaggcgatgga

SEQ ID NO: 9145133 - DNA, 22 bp, Homo sapiens
agggctcctatgatgctctgcc

SEQ ID NO: 9145134 - DNA, 22 bp, Homo sapiens
agggctcctatgatgctctgcc

SEQ ID NO: 9145135 - DNA, 22 bp, Homo sapiens
agggctcctatgatgctctgcc

SEQ ID NO: 9145136 - DNA, 22 bp, Homo sapiens
agggctcctatgatgctctgcc

SEQ ID NO: 9145137 - DNA, 22 bp, Homo sapiens
agggctcctatgatgctctgcc

SEQ ID NO: 9145138 - DNA, 22 bp, Homo sapiens
agggctcctatgccccatggac

SEQ ID NO: 9145139 - DNA, 22 bp, Homo sapiens
agggctccaaggaagtgtagct

SEQ ID NO: 9145140 - DNA, 22 bp, Homo sapiens
agggctccaggggaccatcagt

SEQ ID NO: 9145141 - DNA, 22 bp, Homo sapiens
agggctccaggggctgggtgac

SEQ ID NO: 9145142 - DNA, 22 bp, Homo sapiens
agggctcccgtgaggtgactgc

SEQ ID NO: 9145143 - DNA, 22 bp, Homo sapiens
agggctcccgtgaggtgactgc

SEQ ID NO: 9145144 - DNA, 22 bp, Homo sapiens
agggctcccgcggtgtccggga

SEQ ID NO: 9145145 - DNA, 22 bp, Homo sapiens
agggctccaggggctgggtgac

SEQ ID NO: 9145146 - DNA, 22 bp, Homo sapiens
agggctcccgcggtgtccggga

SEQ ID NO: 9145147 - DNA, 22 bp, Homo sapiens
agggctcccgcggtgtccggga

SEQ ID NO: 9145148 - DNA, 22 bp, Homo sapiens
agggctccaaggaagtgtagct

SEQ ID NO: 9145149 - DNA, 22 bp, Homo sapiens
agggctcagttgcctggagccc

SEQ ID NO: 9145150 - DNA, 22 bp, Homo sapiens
agggccctggggtgcactgaca

SEQ ID NO: 9145151 - DNA, 22 bp, Homo sapiens
agggcccttacgcaggcccttc

SEQ ID NO: 9145152 - DNA, 22 bp, Homo sapiens
agggccctctggcaggccaggc

SEQ ID NO: 9145153 - DNA, 22 bp, Homo sapiens
aggggctgcctggcttggcact

SEQ ID NO: 9145154 - DNA, 22 bp, Homo sapiens
aggggctggcttatctgagagt

SEQ ID NO: 9145155 - DNA, 22 bp, Homo sapiens
aggggctggcttatctgagagt

SEQ ID NO: 9145156 - DNA, 22 bp, Homo sapiens
cctgaggattgttggtgcttcc

SEQ ID NO: 9145157 - DNA, 22 bp, Homo sapiens
cctgaggcccctgaggatagca

SEQ ID NO: 9145158 - DNA, 22 bp, Homo sapiens
cctgaggagattgtggctgggg

SEQ ID NO: 9145159 - DNA, 22 bp, Homo sapiens
cctgaggaggtgaagtctccat

SEQ ID NO: 9145160 - DNA, 22 bp, Homo sapiens
cctgaggaggtgaagtctccat

SEQ ID NO: 9145161 - DNA, 22 bp, Homo sapiens
cctgaggaccagcacccatctg

SEQ ID NO: 9145162 - DNA, 22 bp, Homo sapiens
cctgaggaccagcacccatctg

SEQ ID NO: 9145163 - DNA, 22 bp, Homo sapiens
cctgaggatgccagcatgggtg

SEQ ID NO: 9145164 - DNA, 22 bp, Homo sapiens
cctgaggatgccagcatgggtg

SEQ ID NO: 9145165 - DNA, 22 bp, Homo sapiens
cctgaggatattcaccagcatg

SEQ ID NO: 9145166 - DNA, 22 bp, Homo sapiens
cctgaggatattcaccagcatg

SEQ ID NO: 9145167 - DNA, 22 bp, Homo sapiens
cctgaggatgccagcatgggtg

SEQ ID NO: 9145168 - DNA, 22 bp, Homo sapiens
aggggacacggcttctccaggg

SEQ ID NO: 9145169 - DNA, 22 bp, Homo sapiens
aggggaatgggtagactgttga

SEQ ID NO: 9145170 - DNA, 22 bp, Homo sapiens
aggggacacggcttctccaggg

SEQ ID NO: 9145171 - DNA, 22 bp, Homo sapiens
aggggagaatttcaactcaggt

SEQ ID NO: 9145172 - DNA, 22 bp, Homo sapiens
aggggagagaacataaggaagt

SEQ ID NO: 9145173 - DNA, 22 bp, Homo sapiens
cctgaggacatcagcatcacct

SEQ ID NO: 9145174 - DNA, 22 bp, Homo sapiens
cctgaggacacacgctgcagga

SEQ ID NO: 9145175 - DNA, 22 bp, Homo sapiens
cctgaggacacacgctgcagga

SEQ ID NO: 9145176 - DNA, 19 bp, Homo sapiens
cctgaggaaaagatgattg

SEQ ID NO: 9145177 - DNA, 19 bp, Homo sapiens
cctgaggaaaagatgattg

SEQ ID NO: 9145178 - DNA, 17 bp, Homo sapiens
aggggagagtgggaaga

SEQ ID NO: 9145179 - DNA, 22 bp, Homo sapiens
cctgagagtgcgtgcctcctta

SEQ ID NO: 9145180 - DNA, 22 bp, Homo sapiens
cctgagctttaaaagccatgta

SEQ ID NO: 9145181 - DNA, 22 bp, Homo sapiens
cctgagagtggtgtacaggaga

SEQ ID NO: 9145182 - DNA, 22 bp, Homo sapiens
cctctggcttactgttgggttt

SEQ ID NO: 9145183 - DNA, 21 bp, Homo sapiens
cctctggcttgtgctgtgccc

SEQ ID NO: 9145184 - DNA, 21 bp, Homo sapiens
cctctggcttgtgctgtgccc

SEQ ID NO: 9145185 - DNA, 22 bp, Homo sapiens
cctctgggaagccagtcctgct

SEQ ID NO: 9145186 - DNA, 22 bp, Homo sapiens
cctctgggaagccagtcctgct

SEQ ID NO: 9145187 - DNA, 16 bp, Homo sapiens
cctctgggcctgcaag

SEQ ID NO: 9145188 - DNA, 22 bp, Homo sapiens
cctctgggccagcctggaccct

SEQ ID NO: 9145189 - DNA, 22 bp, Homo sapiens
cctctgggccagcctggaccct

SEQ ID NO: 9145190 - DNA, 16 bp, Homo sapiens
cctctgggcctgcaag

SEQ ID NO: 9145191 - DNA, 22 bp, Homo sapiens
cctctgggcggagatctgctgc

SEQ ID NO: 9145192 - DNA, 22 bp, Homo sapiens
cctctgggcggagatctgctgc

SEQ ID NO: 9145193 - DNA, 22 bp, Homo sapiens
cctctgggcctggaagggcagt

SEQ ID NO: 9145194 - DNA, 22 bp, Homo sapiens
cctctgggcctggaagggcagt

SEQ ID NO: 9145195 - DNA, 22 bp, Homo sapiens
cctctgggcaggtagcagcagc

SEQ ID NO: 9145196 - DNA, 22 bp, Homo sapiens
cctctgggagactgctactgag

SEQ ID NO: 9145197 - DNA, 16 bp, Homo sapiens
cctctgggatgtttgc

SEQ ID NO: 9145198 - DNA, 22 bp, Homo sapiens
cctctgggccagcctggaccct

SEQ ID NO: 9145199 - DNA, 22 bp, Homo sapiens
cctctgggcaggtagcagcagc

SEQ ID NO: 9145200 - DNA, 22 bp, Homo sapiens
agggctgagtggtgcagtcaaa

SEQ ID NO: 9145201 - DNA, 22 bp, Homo sapiens
agggctgagtgggagagagttg

SEQ ID NO: 9145202 - DNA, 23 bp, Homo sapiens
agggctgatgccattgcagctct

SEQ ID NO: 9145203 - DNA, 22 bp, Homo sapiens
agggctgatgcaccatgtagcc

SEQ ID NO: 9145204 - DNA, 22 bp, Homo sapiens
cctcctggaaaaattccctggc

SEQ ID NO: 9145205 - DNA, 22 bp, Homo sapiens
cctcctgcacctccaggaactc

SEQ ID NO: 9145206 - DNA, 22 bp, Homo sapiens
cctcctgcacttgctttccttc

SEQ ID NO: 9145207 - DNA, 23 bp, Homo sapiens
agggaagaaacatgaagggctgt

SEQ ID NO: 9145208 - DNA, 23 bp, Homo sapiens
agggaagaaacatgaagggctgt

SEQ ID NO: 9145209 - DNA, 22 bp, Homo sapiens
agggaagaagctggtagtaggt

SEQ ID NO: 9145210 - DNA, 22 bp, Homo sapiens
cccagggaagccatttctgact

SEQ ID NO: 9145211 - DNA, 22 bp, Homo sapiens
agggaagaagctggtagtaggt

SEQ ID NO: 9145212 - DNA, 22 bp, Homo sapiens
cccagggccctggacagctaca

SEQ ID NO: 9145213 - DNA, 22 bp, Homo sapiens
cccagggccctggacagctaca

SEQ ID NO: 9145214 - DNA, 22 bp, Homo sapiens
cccagggccctggacagctaca

SEQ ID NO: 9145215 - DNA, 22 bp, Homo sapiens
cccagggctgcagatggaggct

SEQ ID NO: 9145216 - DNA, 22 bp, Homo sapiens
cccaggggaggtcctcagggaa

SEQ ID NO: 9145217 - DNA, 22 bp, Homo sapiens
cccagggcttttctcactagac

SEQ ID NO: 9145218 - DNA, 22 bp, Homo sapiens
cccagggcttttctcactagac

SEQ ID NO: 9145219 - DNA, 22 bp, Homo sapiens
cccagggcttgagtcatccatg

SEQ ID NO: 9145220 - DNA, 22 bp, Homo sapiens
cccaggatggggctgcagttat

SEQ ID NO: 9145221 - DNA, 21 bp, Homo sapiens
agggaaatccagtcacttttc

SEQ ID NO: 9145222 - DNA, 22 bp, Homo sapiens
cccaggagttggaggctgcagt

SEQ ID NO: 9145223 - DNA, 23 bp, Homo sapiens
cccaggagtttcactgcaaaggt

SEQ ID NO: 9145224 - DNA, 23 bp, Homo sapiens
cccaggagtttcactgcaaaggt

SEQ ID NO: 9145225 - DNA, 22 bp, Homo sapiens
cccaggagttggaggctgcagt

SEQ ID NO: 9145226 - DNA, 23 bp, Homo sapiens
cccaggagtttcactgcaaaggt

SEQ ID NO: 9145227 - DNA, 22 bp, Homo sapiens
aggcttcttagattggctggag

SEQ ID NO: 9145228 - DNA, 22 bp, Homo sapiens
aggcttcttagattggctggag

SEQ ID NO: 9145229 - DNA, 22 bp, Homo sapiens
aggcttcttgagccccacaggc

SEQ ID NO: 9145230 - DNA, 22 bp, Homo sapiens
aggcttcttgcttccaaatgca

SEQ ID NO: 9145231 - DNA, 22 bp, Homo sapiens
aggcttcttttagaggggatgg

SEQ ID NO: 9145232 - DNA, 18 bp, Homo sapiens
aggcttcttggctcagtc

SEQ ID NO: 9145233 - DNA, 22 bp, Homo sapiens
cccaggaggtggagcttgcagt

SEQ ID NO: 9145234 - DNA, 22 bp, Homo sapiens
cccaggagttggaggctacggt

SEQ ID NO: 9145235 - DNA, 22 bp, Homo sapiens
aggcttctcaataggtttgaag

SEQ ID NO: 9145236 - DNA, 21 bp, Homo sapiens
aggcttctccgtgcaggaaga

SEQ ID NO: 9145237 - DNA, 22 bp, Homo sapiens
aggcttctagggttggcagcgg

SEQ ID NO: 9145238 - DNA, 22 bp, Homo sapiens
aggcttctagggttggcagcgg

SEQ ID NO: 9145239 - DNA, 22 bp, Homo sapiens
aggcttctacgtggtcccaggg

SEQ ID NO: 9145240 - DNA, 19 bp, Homo sapiens
aggcttctaccctgtccag

SEQ ID NO: 9145241 - DNA, 19 bp, Homo sapiens
aggcttctaccctgtccag

SEQ ID NO: 9145242 - DNA, 22 bp, Homo sapiens
aggcttctgtctttaggagttg

SEQ ID NO: 9145243 - DNA, 22 bp, Homo sapiens
aggcttctggggcaccgagcga

SEQ ID NO: 9145244 - DNA, 22 bp, Homo sapiens
aggcttctgggattcccttggt

SEQ ID NO: 9145245 - DNA, 22 bp, Homo sapiens
aggcttctgataccatgagaga

SEQ ID NO: 9145246 - DNA, 22 bp, Homo sapiens
aggcttctctccttggcttgca

SEQ ID NO: 9145247 - DNA, 22 bp, Homo sapiens
aggcttcctggaggaagaggta

SEQ ID NO: 9145248 - DNA, 22 bp, Homo sapiens
aggctggctgagctgcagcctg

SEQ ID NO: 9145249 - DNA, 22 bp, Homo sapiens
aggctggctgacttctgaagca

SEQ ID NO: 9145250 - DNA, 19 bp, Homo sapiens
agggatatttaaaaagctc

SEQ ID NO: 9145251 - DNA, 22 bp, Homo sapiens
agggagtgtaaatggtgctcag

SEQ ID NO: 9145252 - DNA, 22 bp, Homo sapiens
agggatgatggaaagaagcagg

SEQ ID NO: 9145253 - DNA, 22 bp, Homo sapiens
agggatgatttcagtgtctgcc

SEQ ID NO: 9145254 - DNA, 22 bp, Homo sapiens
agggatggaagacttgaagacc

SEQ ID NO: 9145255 - DNA, 22 bp, Homo sapiens
agggatggagcccagctgttct

SEQ ID NO: 9145256 - DNA, 22 bp, Homo sapiens
agggatggagtgcggcccggac

SEQ ID NO: 9145257 - DNA, 22 bp, Homo sapiens
agggatggagcccagctgttct

SEQ ID NO: 9145258 - DNA, 22 bp, Homo sapiens
agggatggaagctcgtctgcaa

SEQ ID NO: 9145259 - DNA, 22 bp, Homo sapiens
agggatggagtgcggcccggac

SEQ ID NO: 9145260 - DNA, 22 bp, Homo sapiens
agggatggatcttggccctgga

SEQ ID NO: 9145261 - DNA, 22 bp, Homo sapiens
agggatggatcttggccctgga

SEQ ID NO: 9145262 - DNA, 22 bp, Homo sapiens
agggagaacagttgcagcagac

SEQ ID NO: 9145263 - DNA, 22 bp, Homo sapiens
agggagaagagaacaaagccct

SEQ ID NO: 9145264 - DNA, 22 bp, Homo sapiens
agggagaacagttgcagcagac

SEQ ID NO: 9145265 - DNA, 22 bp, Homo sapiens
agggagaaaattggatgcacaa

SEQ ID NO: 9145266 - DNA, 22 bp, Homo sapiens
agggagaacagttgcagcagac

SEQ ID NO: 9145267 - DNA, 22 bp, Homo sapiens
agggactgagctaggatctagt

SEQ ID NO: 9145268 - DNA, 22 bp, Homo sapiens
agggagaaaattggatgcacaa

SEQ ID NO: 9145269 - DNA, 22 bp, Homo sapiens
agggactggctctctgagcagg

SEQ ID NO: 9145270 - DNA, 17 bp, Homo sapiens
agggagtcagaggatcg

SEQ ID NO: 9145271 - DNA, 22 bp, Homo sapiens
agggagaagagaacaaagccct

SEQ ID NO: 9145272 - DNA, 22 bp, Homo sapiens
agggagaagagaacaaagccct

SEQ ID NO: 9145273 - DNA, 22 bp, Homo sapiens
agggagaaggtccatgcctgtc

SEQ ID NO: 9145274 - DNA, 22 bp, Homo sapiens
agggagaaggtttagctgtgag

SEQ ID NO: 9145275 - DNA, 22 bp, Homo sapiens
agggagtggttaagaaggtgca

SEQ ID NO: 9145276 - DNA, 22 bp, Homo sapiens
agggagtggttaagaaggtgca

SEQ ID NO: 9145277 - DNA, 22 bp, Homo sapiens
agggagtggttaagaaggtgca

SEQ ID NO: 9145278 - DNA, 17 bp, Homo sapiens
agggagtcagtaggagc

SEQ ID NO: 9145279 - DNA, 22 bp, Homo sapiens
agggaggagtcctcaaagtcat

SEQ ID NO: 9145280 - DNA, 22 bp, Homo sapiens
ccctctggctcttctcaggccg

SEQ ID NO: 9145281 - DNA, 22 bp, Homo sapiens
ccctctgcctgcgccctggtgt

SEQ ID NO: 9145282 - DNA, 22 bp, Homo sapiens
ccctctgctcaggtgcataggc

SEQ ID NO: 9145283 - DNA, 20 bp, Homo sapiens
ccctctgcacatggctgtgg

SEQ ID NO: 9145284 - DNA, 22 bp, Homo sapiens
ccctccccacaaagcttcacac

SEQ ID NO: 9145285 - DNA, 22 bp, Homo sapiens
ccctctctcggttgctgtggtt

SEQ ID NO: 9145286 - DNA, 22 bp, Homo sapiens
ccctctctcggttgctgtggtt

SEQ ID NO: 9145287 - DNA, 22 bp, Homo sapiens
ccctctctgctgcatagaggaa

SEQ ID NO: 9145288 - DNA, 20 bp, Homo sapiens
ccctctgcacatggctgtgg

SEQ ID NO: 9145289 - DNA, 20 bp, Homo sapiens
ccctctgcacatggctgtgg

SEQ ID NO: 9145290 - DNA, 22 bp, Homo sapiens
ccctctcttagaagaaacacag

SEQ ID NO: 9145291 - DNA, 22 bp, Homo sapiens
agggcagagatctgagtgggca

SEQ ID NO: 9145292 - DNA, 22 bp, Homo sapiens
agggcagagatctgagtgggca

SEQ ID NO: 9145293 - DNA, 22 bp, Homo sapiens
agggcagagcactgaattggga

SEQ ID NO: 9145294 - DNA, 22 bp, Homo sapiens
agggcagagcactgaattggga

SEQ ID NO: 9145295 - DNA, 22 bp, Homo sapiens
agggcagagagatgaatgggat

SEQ ID NO: 9145296 - DNA, 22 bp, Homo sapiens
agggcagagagatgaatgggat

SEQ ID NO: 9145297 - DNA, 22 bp, Homo sapiens
agggcagaggcggacacggaag

SEQ ID NO: 9145298 - DNA, 20 bp, Homo sapiens
agggcagagggattacaggc

SEQ ID NO: 9145299 - DNA, 22 bp, Homo sapiens
ccctggaggagcttagagcttg

SEQ ID NO: 9145300 - DNA, 19 bp, Homo sapiens
ccctggaggagtgttggct

SEQ ID NO: 9145301 - DNA, 22 bp, Homo sapiens
ccctggaggagcttagagcttg

SEQ ID NO: 9145302 - DNA, 22 bp, Homo sapiens
ccctggaggaccccaatgtggc

SEQ ID NO: 9145303 - DNA, 20 bp, Homo sapiens
ccctggactcctgagcaaac

SEQ ID NO: 9145304 - DNA, 22 bp, Homo sapiens
ccctggaggaccccaatgtggc

SEQ ID NO: 9145305 - DNA, 22 bp, Homo sapiens
ccaggagagcagaagcccaggc

SEQ ID NO: 9145306 - DNA, 22 bp, Homo sapiens
ccaggagagcagaagcccaggc

SEQ ID NO: 9145307 - DNA, 22 bp, Homo sapiens
ccaggagagcattgcacagagg

SEQ ID NO: 9145308 - DNA, 22 bp, Homo sapiens
ccaggagagcattgcacagagg

SEQ ID NO: 9145309 - DNA, 22 bp, Homo sapiens
ccaggagagctctaaatggctg

SEQ ID NO: 9145310 - DNA, 22 bp, Homo sapiens
ccaggagagctctcgttcagtg

SEQ ID NO: 9145311 - DNA, 22 bp, Homo sapiens
ccaggagcaaagatcactggga

SEQ ID NO: 9145312 - DNA, 22 bp, Homo sapiens
ccaggagatttttccatagcac

SEQ ID NO: 9145313 - DNA, 22 bp, Homo sapiens
ccaggagcgggaaaaggaagaa

SEQ ID NO: 9145314 - DNA, 22 bp, Homo sapiens
ccaggagatgggaaagtagcag

SEQ ID NO: 9145315 - DNA, 22 bp, Homo sapiens
ccaggagatgggaaagtagcag

SEQ ID NO: 9145316 - DNA, 20 bp, Homo sapiens
ccagctttccctgcagcatc

SEQ ID NO: 9145317 - DNA, 20 bp, Homo sapiens
ccagctttccctgcagcatc

SEQ ID NO: 9145318 - DNA, 22 bp, Homo sapiens
ccagcttttcctctcattgctt

SEQ ID NO: 9145319 - DNA, 22 bp, Homo sapiens
ccagcttttggggtgacaattt

SEQ ID NO: 9145320 - DNA, 22 bp, Homo sapiens
aggccctggcactgcctgggag

SEQ ID NO: 9145321 - DNA, 22 bp, Homo sapiens
aggccctggcactgcctgggag

SEQ ID NO: 9145322 - DNA, 22 bp, Homo sapiens
ccaggacaagtgtggccatggc

SEQ ID NO: 9145323 - DNA, 22 bp, Homo sapiens
ccaggacaagtgtggccatggc

SEQ ID NO: 9145324 - DNA, 22 bp, Homo sapiens
aggccctgggttagggcccact

SEQ ID NO: 9145325 - DNA, 22 bp, Homo sapiens
ccagcctcatcgcctgcctgtc

SEQ ID NO: 9145326 - DNA, 22 bp, Homo sapiens
ccagcctcatcgcctgcctgtc

SEQ ID NO: 9145327 - DNA, 22 bp, Homo sapiens
ccagccctgccagagagagctg

SEQ ID NO: 9145328 - DNA, 22 bp, Homo sapiens
ccagccctgccagagagagctg

SEQ ID NO: 9145329 - DNA, 22 bp, Homo sapiens
ccagcctcatcgcctgcctgtc

SEQ ID NO: 9145330 - DNA, 22 bp, Homo sapiens
aggcccagagcaggaaagggtt

SEQ ID NO: 9145331 - DNA, 22 bp, Homo sapiens
ccagctttatcaagtctgagct

SEQ ID NO: 9145332 - DNA, 19 bp, Homo sapiens
ccagctggcctgggacctc

SEQ ID NO: 9145333 - DNA, 22 bp, Homo sapiens
ccagcttctctctgatgcagct

SEQ ID NO: 9145334 - DNA, 22 bp, Homo sapiens
aggcaggggagctggaagggta

SEQ ID NO: 9145335 - DNA, 22 bp, Homo sapiens
aggcaggggagctggaagggta

SEQ ID NO: 9145336 - DNA, 22 bp, Homo sapiens
aggcaggggagctggaagggta

SEQ ID NO: 9145337 - DNA, 22 bp, Homo sapiens
aggcaggggagctggaagggta

SEQ ID NO: 9145338 - DNA, 22 bp, Homo sapiens
aggcaggggagctggaagggta

SEQ ID NO: 9145339 - DNA, 22 bp, Homo sapiens
aggcagggtgatgataatgatt

SEQ ID NO: 9145340 - DNA, 22 bp, Homo sapiens
aggcagggtcttgctatgttgc

SEQ ID NO: 9145341 - DNA, 22 bp, Homo sapiens
aggcagggtgatgataatgatt

SEQ ID NO: 9145342 - DNA, 22 bp, Homo sapiens
aggcagggtgatgataatgatt

SEQ ID NO: 9145343 - DNA, 22 bp, Homo sapiens
ccacagctgaccgcaggtgagc

SEQ ID NO: 9145344 - DNA, 17 bp, Homo sapiens
ccacagctgggtgcctt

SEQ ID NO: 9145345 - DNA, 21 bp, Homo sapiens
ccacagctggtctctgagccc

SEQ ID NO: 9145346 - DNA, 17 bp, Homo sapiens
ccacagctgggtgcctt

SEQ ID NO: 9145347 - DNA, 22 bp, Homo sapiens
ccacagcttcgcagtctgctgc

SEQ ID NO: 9145348 - DNA, 22 bp, Homo sapiens
ccacagcttcttatatcactgg

SEQ ID NO: 9145349 - DNA, 22 bp, Homo sapiens
ccacaggacacaactgctgacc

SEQ ID NO: 9145350 - DNA, 22 bp, Homo sapiens
ccacaggatccaagggaaggca

SEQ ID NO: 9145351 - DNA, 22 bp, Homo sapiens
ccacaggatccaagggaaggca

SEQ ID NO: 9145352 - DNA, 22 bp, Homo sapiens
ccacaggaggatgttcagacaa

SEQ ID NO: 9145353 - DNA, 22 bp, Homo sapiens
ccacaggaccagaggagatcac

SEQ ID NO: 9145354 - DNA, 22 bp, Homo sapiens
ccagagagtatcatggagagta

SEQ ID NO: 9145355 - DNA, 22 bp, Homo sapiens
ccagagagtatcatggagagta

SEQ ID NO: 9145356 - DNA, 17 bp, Homo sapiens
ccagagagtagttagga

SEQ ID NO: 9145357 - DNA, 20 bp, Homo sapiens
ccagagagtaggttagtgat

SEQ ID NO: 9145358 - DNA, 20 bp, Homo sapiens
ccagagagtaggttagtgat

SEQ ID NO: 9145359 - DNA, 22 bp, Homo sapiens
ccagagaggtagcttaccctct

SEQ ID NO: 9145360 - DNA, 21 bp, Homo sapiens
aggcatggaaatggcacactg

SEQ ID NO: 9145361 - DNA, 21 bp, Homo sapiens
aggcatggaaatggcacactg

SEQ ID NO: 9145362 - DNA, 21 bp, Homo sapiens
aggcatggaaatggcacactg

SEQ ID NO: 9145363 - DNA, 22 bp, Homo sapiens
ccagagcagatgtggccttggt

SEQ ID NO: 9145364 - DNA, 22 bp, Homo sapiens
aggcatggacatttcggcagct

SEQ ID NO: 9145365 - DNA, 22 bp, Homo sapiens
aggcatggatgtagcagtgacc

SEQ ID NO: 9145366 - DNA, 22 bp, Homo sapiens
aggcatggatgtagcagtgacc

SEQ ID NO: 9145367 - DNA, 22 bp, Homo sapiens
aggcatggcactgagcagcttc

SEQ ID NO: 9145368 - DNA, 22 bp, Homo sapiens
aggcatggcactgagcagcttc

SEQ ID NO: 9145369 - DNA, 22 bp, Homo sapiens
aggcatggcactgagcagcttc

SEQ ID NO: 9145370 - DNA, 22 bp, Homo sapiens
aggcatggcactgagcagcttc

SEQ ID NO: 9145371 - DNA, 23 bp, Homo sapiens
aggcatggcatggatggtggctc

SEQ ID NO: 9145372 - DNA, 23 bp, Homo sapiens
aggcatggcatggatggtggctc

SEQ ID NO: 9145373 - DNA, 22 bp, Homo sapiens
ccagcagagcatggggaggaag

SEQ ID NO: 9145374 - DNA, 22 bp, Homo sapiens
ccagcagagcatggggaggaag

SEQ ID NO: 9145375 - DNA, 22 bp, Homo sapiens
ccagcagagcatggggaggaag

SEQ ID NO: 9145376 - DNA, 22 bp, Homo sapiens
ccagcagagctcaaacttcctg

SEQ ID NO: 9145377 - DNA, 22 bp, Homo sapiens
ccagcagagctcaaacttcctg

SEQ ID NO: 9145378 - DNA, 19 bp, Homo sapiens
ccagcagacacagctgccc

SEQ ID NO: 9145379 - DNA, 19 bp, Homo sapiens
ccagcagacacagctgccc

SEQ ID NO: 9145380 - DNA, 19 bp, Homo sapiens
ccagcagacacagctgccc

SEQ ID NO: 9145381 - DNA, 19 bp, Homo sapiens
ccagcagaagccactcctg

SEQ ID NO: 9145382 - DNA, 19 bp, Homo sapiens
ccagcagaagccactcctg

SEQ ID NO: 9145383 - DNA, 22 bp, Homo sapiens
ccagcagacacacaggcgtggg

SEQ ID NO: 9145384 - DNA, 22 bp, Homo sapiens
ccagcagacacacaggcgtggg

SEQ ID NO: 9145385 - DNA, 22 bp, Homo sapiens
ccagcagacacacaggcgtggg

SEQ ID NO: 9145386 - DNA, 22 bp, Homo sapiens
ccagcagaagctcccgctgggt

SEQ ID NO: 9145387 - DNA, 22 bp, Homo sapiens
ccagcagaagctcccgctgggt

SEQ ID NO: 9145388 - DNA, 19 bp, Homo sapiens
ccagcagaagccactcctg

SEQ ID NO: 9145389 - DNA, 22 bp, Homo sapiens
aggccagagaggggaccagcct

SEQ ID NO: 9145390 - DNA, 22 bp, Homo sapiens
ccagcagagggcgcttcacacc

SEQ ID NO: 9145391 - DNA, 22 bp, Homo sapiens
ccagcagagctggaagtgtgct

SEQ ID NO: 9145392 - DNA, 22 bp, Homo sapiens
ccagcagagctggaagtgtgct

SEQ ID NO: 9145393 - DNA, 22 bp, Homo sapiens
ccagcagaggcatcatccttcc

SEQ ID NO: 9145394 - DNA, 22 bp, Homo sapiens
ccagcagaggcatcatccttcc

SEQ ID NO: 9145395 - DNA, 22 bp, Homo sapiens
ccagcagagctggaagtgtgct

SEQ ID NO: 9145396 - DNA, 22 bp, Homo sapiens
ccagcagagctggaagtgtgct

SEQ ID NO: 9145397 - DNA, 22 bp, Homo sapiens
ccagcagagggcgcttcacacc

SEQ ID NO: 9145398 - DNA, 22 bp, Homo sapiens
aggctcagtctgttcatgcact

SEQ ID NO: 9145399 - DNA, 22 bp, Homo sapiens
aggctcaggtgcctcattcaca

SEQ ID NO: 9145400 - DNA, 22 bp, Homo sapiens
ccaggaggatcatcctgttttc

SEQ ID NO: 9145401 - DNA, 22 bp, Homo sapiens
ccaggaggaaattctaaaggta

SEQ ID NO: 9145402 - DNA, 22 bp, Homo sapiens
ccaggaggaaattctaaaggta

SEQ ID NO: 9145403 - DNA, 22 bp, Homo sapiens
ccaggagctggcatgtggagag

SEQ ID NO: 9145404 - DNA, 22 bp, Homo sapiens
ccaggagctggcatgtggagag

SEQ ID NO: 9145405 - DNA, 22 bp, Homo sapiens
ccaggaggaaagaccagcccat

SEQ ID NO: 9145406 - DNA, 22 bp, Homo sapiens
ccaggagctggagggtgcagtg

SEQ ID NO: 9145407 - DNA, 17 bp, Homo sapiens
ccaggagcgtgggtctc

SEQ ID NO: 9145408 - DNA, 17 bp, Homo sapiens
ccaggagcgtgggtctc

SEQ ID NO: 9145409 - DNA, 17 bp, Homo sapiens
ccaggagcgtgggtctc

SEQ ID NO: 9145410 - DNA, 22 bp, Homo sapiens
aggctcagtttggtttccattg

SEQ ID NO: 9145411 - DNA, 22 bp, Homo sapiens
aggctcagttcacgtcaacttt

SEQ ID NO: 9145412 - DNA, 22 bp, Homo sapiens
aggctcagttcacgtcaacttt

SEQ ID NO: 9145413 - DNA, 22 bp, Homo sapiens
aggctcagtgcaaatcattctg

SEQ ID NO: 9145414 - DNA, 22 bp, Homo sapiens
aggctccaccagtcaggtgcat

SEQ ID NO: 9145415 - DNA, 22 bp, Homo sapiens
aggctccaccagtcaggtgcat

SEQ ID NO: 9145416 - DNA, 22 bp, Homo sapiens
ccagggaaggctctgcctgctt

SEQ ID NO: 9145417 - DNA, 22 bp, Homo sapiens
ccagggaaggctctgcctgctt

SEQ ID NO: 9145418 - DNA, 23 bp, Homo sapiens
ccagggaaggccatcttcaactg

SEQ ID NO: 9145419 - DNA, 22 bp, Homo sapiens
ccagggagcccacaggacaatg

SEQ ID NO: 9145420 - DNA, 22 bp, Homo sapiens
ccagggagcctggtgtgtcagc

SEQ ID NO: 9145421 - DNA, 22 bp, Homo sapiens
ccagggagcctggtgtgtcagc

SEQ ID NO: 9145422 - DNA, 22 bp, Homo sapiens
ccagggagcggggctgggtctc

SEQ ID NO: 9145423 - DNA, 22 bp, Homo sapiens
ccagggagcctggtgtgtcagc

SEQ ID NO: 9145424 - DNA, 22 bp, Homo sapiens
ccagggaagtcacattgtctag

SEQ ID NO: 9145425 - DNA, 22 bp, Homo sapiens
ccagggaagtcacattgtctag

SEQ ID NO: 9145426 - DNA, 22 bp, Homo sapiens
ccagggaaggctgctggctgtg

SEQ ID NO: 9145427 - DNA, 22 bp, Homo sapiens
ccagggaaggctgctggctgtg

SEQ ID NO: 9145428 - DNA, 22 bp, Homo sapiens
ccagggaagtagttgtgagagc

SEQ ID NO: 9145429 - DNA, 22 bp, Homo sapiens
ccagggaatctctgagtgtgtt

SEQ ID NO: 9145430 - DNA, 22 bp, Homo sapiens
ccagggaatctctgagtgtgtt

SEQ ID NO: 9145431 - DNA, 22 bp, Homo sapiens
ccagggaatcaggcagaagtca

SEQ ID NO: 9145432 - DNA, 22 bp, Homo sapiens
ccagggaatcaggcagaagtca

SEQ ID NO: 9145433 - DNA, 22 bp, Homo sapiens
ccagggaatgatatttttgcct

SEQ ID NO: 9145434 - DNA, 22 bp, Homo sapiens
ccagggaatgtgggatgactct

SEQ ID NO: 9145435 - DNA, 22 bp, Homo sapiens
ccagggaatgtgggatgactct

SEQ ID NO: 9145436 - DNA, 22 bp, Homo sapiens
aggctcctatcgctttcagcaa

SEQ ID NO: 9145437 - DNA, 22 bp, Homo sapiens
aggctcctcggggctgacggcg

SEQ ID NO: 9145438 - DNA, 22 bp, Homo sapiens
ccagggaggagcatttcatggt

SEQ ID NO: 9145439 - DNA, 17 bp, Homo sapiens
ccagggaggggccgcgc

SEQ ID NO: 9145440 - DNA, 22 bp, Homo sapiens
ccagggagcggggctgggtctc

SEQ ID NO: 9145441 - DNA, 18 bp, Homo sapiens
ccagggagcttattagga

SEQ ID NO: 9145442 - DNA, 22 bp, Homo sapiens
ccagggagcggggctgggtctc

SEQ ID NO: 9145443 - DNA, 22 bp, Homo sapiens
ccagggcttaacttttcaggag

SEQ ID NO: 9145444 - DNA, 22 bp, Homo sapiens
ccagggcttaacttttcaggag

SEQ ID NO: 9145445 - DNA, 20 bp, Homo sapiens
aggctcctgtacctgaggaa

SEQ ID NO: 9145446 - DNA, 20 bp, Homo sapiens
aggctcctgtacctgaggaa

SEQ ID NO: 9145447 - DNA, 22 bp, Homo sapiens
aggctcctgagaggcagaggct

SEQ ID NO: 9145448 - DNA, 22 bp, Homo sapiens
aggctcctgagaggcagaggct

SEQ ID NO: 9145449 - DNA, 22 bp, Homo sapiens
aggctcctgatcctggggtctg

SEQ ID NO: 9145450 - DNA, 22 bp, Homo sapiens
aggctcctgcaggtgaggtgct

SEQ ID NO: 9145451 - DNA, 22 bp, Homo sapiens
aggctcctgcaggccttgtagg

SEQ ID NO: 9145452 - DNA, 22 bp, Homo sapiens
aggctcctgggtgtggccgcca

SEQ ID NO: 9145453 - DNA, 20 bp, Homo sapiens
aggctcctgtacctgaggaa

SEQ ID NO: 9145454 - DNA, 22 bp, Homo sapiens
aggctgaggggcgagggaccct

SEQ ID NO: 9145455 - DNA, 22 bp, Homo sapiens
aggctgaggcgggtagatcacc

SEQ ID NO: 9145456 - DNA, 22 bp, Homo sapiens
aggctctgtgcagcctgcatct

SEQ ID NO: 9145457 - DNA, 22 bp, Homo sapiens
aggctctgtgcatcctccccaa

SEQ ID NO: 9145458 - DNA, 22 bp, Homo sapiens
aggctctgtgcagcctgcatct

SEQ ID NO: 9145459 - DNA, 20 bp, Homo sapiens
aggctgagggtgattgtgtc

SEQ ID NO: 9145460 - DNA, 22 bp, Homo sapiens
aggctgaggtaggaggatcgct

SEQ ID NO: 9145461 - DNA, 22 bp, Homo sapiens
aggctctgtgcagcctgcatct

SEQ ID NO: 9145462 - DNA, 22 bp, Homo sapiens
aggctctgtgatccacaatgag

SEQ ID NO: 9145463 - DNA, 22 bp, Homo sapiens
aggctctgtgatccacaatgag

SEQ ID NO: 9145464 - DNA, 22 bp, Homo sapiens
aggctgagtcaagttagggtga

SEQ ID NO: 9145465 - DNA, 22 bp, Homo sapiens
aggctgagtcgggaggatcact

SEQ ID NO: 9145466 - DNA, 22 bp, Homo sapiens
aggctgaggtgtgctgtgatcg

SEQ ID NO: 9145467 - DNA, 22 bp, Homo sapiens
aggctgaggtgtgctgtgatcg

SEQ ID NO: 9145468 - DNA, 22 bp, Homo sapiens
ccatggctccttgccctgtagc

SEQ ID NO: 9145469 - DNA, 18 bp, Homo sapiens
ccatggctccctcctgcc

SEQ ID NO: 9145470 - DNA, 22 bp, Homo sapiens
ccatggcttctttctctgccag

SEQ ID NO: 9145471 - DNA, 22 bp, Homo sapiens
ccatggcttacagatggagcat

SEQ ID NO: 9145472 - DNA, 23 bp, Homo sapiens
cccagagcacagcctccagatgc

SEQ ID NO: 9145473 - DNA, 22 bp, Homo sapiens
cccagagccgctcccctacttc

SEQ ID NO: 9145474 - DNA, 22 bp, Homo sapiens
cccagagccggtggtgctcaca

SEQ ID NO: 9145475 - DNA, 20 bp, Homo sapiens
cccagagccatagccagaca

SEQ ID NO: 9145476 - DNA, 22 bp, Homo sapiens
cccagagcatgtgctgcctttg

SEQ ID NO: 9145477 - DNA, 20 bp, Homo sapiens
cccagagccatagccagaca

SEQ ID NO: 9145478 - DNA, 21 bp, Homo sapiens
cccagagcctagggagggcac

SEQ ID NO: 9145479 - DNA, 22 bp, Homo sapiens
cccagagccggtggtgctcaca

SEQ ID NO: 9145480 - DNA, 22 bp, Homo sapiens
ccatgggaattgggaggtccca

SEQ ID NO: 9145481 - DNA, 22 bp, Homo sapiens
ccatgggaattgggaggtccca

SEQ ID NO: 9145482 - DNA, 21 bp, Homo sapiens
ccatgggaagcatcctcgcgg

SEQ ID NO: 9145483 - DNA, 22 bp, Homo sapiens
ccatgggacctacctcctgtgc

SEQ ID NO: 9145484 - DNA, 22 bp, Homo sapiens
cccactgctgctctccatggca

SEQ ID NO: 9145485 - DNA, 22 bp, Homo sapiens
cccactggcaatattatgagac

SEQ ID NO: 9145486 - DNA, 22 bp, Homo sapiens
cccactgctgctctccatggca

SEQ ID NO: 9145487 - DNA, 22 bp, Homo sapiens
aggctgcgttagcctcactccc

SEQ ID NO: 9145488 - DNA, 22 bp, Homo sapiens
aggctgcctcttttgagagggt

SEQ ID NO: 9145489 - DNA, 22 bp, Homo sapiens
aggctgcctcttttgagagggt

SEQ ID NO: 9145490 - DNA, 22 bp, Homo sapiens
aggctgcctggctgtgagtgaa

SEQ ID NO: 9145491 - DNA, 22 bp, Homo sapiens
cagttttagggcaatgtgaaga

SEQ ID NO: 9145492 - DNA, 22 bp, Homo sapiens
cagttttaaattgttagataat

SEQ ID NO: 9145493 - DNA, 22 bp, Homo sapiens
cagttttaaattgttagataat

SEQ ID NO: 9145494 - DNA, 22 bp, Homo sapiens
cagtttctctcaataagcatcg

SEQ ID NO: 9145495 - DNA, 22 bp, Homo sapiens
cagtttctctcaataagcatcg

SEQ ID NO: 9145496 - DNA, 22 bp, Homo sapiens
cagtttcagaatcaaaacatca

SEQ ID NO: 9145497 - DNA, 22 bp, Homo sapiens
cagtttatttccaagatgacaa

SEQ ID NO: 9145498 - DNA, 22 bp, Homo sapiens
cagtttatttccaagatgacaa

SEQ ID NO: 9145499 - DNA, 22 bp, Homo sapiens
cagtttcagaatcaaaacatca

SEQ ID NO: 9145500 - DNA, 22 bp, Homo sapiens
cagtttccctgcttgaaaacgt

SEQ ID NO: 9145501 - DNA, 22 bp, Homo sapiens
cagtttcaggacatcccattac

SEQ ID NO: 9145502 - DNA, 22 bp, Homo sapiens
cagtttatttccaagatgacaa

SEQ ID NO: 9145503 - DNA, 22 bp, Homo sapiens
cagtttattgttgcgttcacat

SEQ ID NO: 9145504 - DNA, 19 bp, Homo sapiens
cagtttatgctttggggac

SEQ ID NO: 9145505 - DNA, 22 bp, Homo sapiens
cagtttcagctcaagcactcag

SEQ ID NO: 9145506 - DNA, 22 bp, Homo sapiens
cagtttcctgaagagaaagaat

SEQ ID NO: 9145507 - DNA, 22 bp, Homo sapiens
cagtttctacgaaggtcaaccc

SEQ ID NO: 9145508 - DNA, 22 bp, Homo sapiens
cagtttctacgacttaagcaca

SEQ ID NO: 9145509 - DNA, 22 bp, Homo sapiens
cagtttctatggctgggctctg

SEQ ID NO: 9145510 - DNA, 22 bp, Homo sapiens
cagtttctcagacttcccttgt

SEQ ID NO: 9145511 - DNA, 22 bp, Homo sapiens
cagtttctatggctgggctctg

SEQ ID NO: 9145512 - DNA, 22 bp, Homo sapiens
cagtttctcaggcctctcccag

SEQ ID NO: 9145513 - DNA, 22 bp, Homo sapiens
cagtttctcaggcctctcccag

SEQ ID NO: 9145514 - DNA, 22 bp, Homo sapiens
cagtttctccaaacgcaggctg

SEQ ID NO: 9145515 - DNA, 22 bp, Homo sapiens
cagtggtgaagagcaggggctc

SEQ ID NO: 9145516 - DNA, 22 bp, Homo sapiens
cagtggtgaagagcaggggctc

SEQ ID NO: 9145517 - DNA, 22 bp, Homo sapiens
cagttctgactttcataatgtc

SEQ ID NO: 9145518 - DNA, 22 bp, Homo sapiens
cagtggttatacttactgtttc

SEQ ID NO: 9145519 - DNA, 22 bp, Homo sapiens
cagttctgagctttcccagaag

SEQ ID NO: 9145520 - DNA, 22 bp, Homo sapiens
cagttctgagctttcccagaag

SEQ ID NO: 9145521 - DNA, 22 bp, Homo sapiens
cagtttatatgtcagagctgta

SEQ ID NO: 9145522 - DNA, 22 bp, Homo sapiens
cagtttatattctagtgctgtt

SEQ ID NO: 9145523 - DNA, 22 bp, Homo sapiens
cagtttatgcagctggaataga

SEQ ID NO: 9145524 - DNA, 20 bp, Homo sapiens
cagtttatctttccggagct

SEQ ID NO: 9145525 - DNA, 22 bp, Homo sapiens
cagtttatattctagtgctgtt

SEQ ID NO: 9145526 - DNA, 23 bp, Homo sapiens
cagtggtcagaacgtgggagggt

SEQ ID NO: 9145527 - DNA, 22 bp, Homo sapiens
cagtggtatttgagagaatgga

SEQ ID NO: 9145528 - DNA, 22 bp, Homo sapiens
cagtggtacttatatgaagcat

SEQ ID NO: 9145529 - DNA, 22 bp, Homo sapiens
cagtggtatttgagagaatgga

SEQ ID NO: 9145530 - DNA, 22 bp, Homo sapiens
cagtggtactctcagatgttta

SEQ ID NO: 9145531 - DNA, 22 bp, Homo sapiens
cagtgggtggcctcttgagtca

SEQ ID NO: 9145532 - DNA, 22 bp, Homo sapiens
cagtggcctttcctgctgctca

SEQ ID NO: 9145533 - DNA, 22 bp, Homo sapiens
cagtggcctttcctgctgctca

SEQ ID NO: 9145534 - DNA, 22 bp, Homo sapiens
cagtggcctttcctgctgctca

SEQ ID NO: 9145535 - DNA, 22 bp, Homo sapiens
cagtggctcatgcctataatcc

SEQ ID NO: 9145536 - DNA, 22 bp, Homo sapiens
cagtggcgtgatctctgctcac

SEQ ID NO: 9145537 - DNA, 22 bp, Homo sapiens
catattaaggtctgtaaggggt

SEQ ID NO: 9145538 - DNA, 22 bp, Homo sapiens
catattcaaggggtaaggcaaa

SEQ ID NO: 9145539 - DNA, 22 bp, Homo sapiens
catatttagtgtttggagatcg

SEQ ID NO: 9145540 - DNA, 22 bp, Homo sapiens
catatttatagatctggcattt

SEQ ID NO: 9145541 - DNA, 22 bp, Homo sapiens
catatttattcttctgccagtg

SEQ ID NO: 9145542 - DNA, 22 bp, Homo sapiens
catatttattcttctgccagtg

SEQ ID NO: 9145543 - DNA, 22 bp, Homo sapiens
catatttcagtctaagatgtgt

SEQ ID NO: 9145544 - DNA, 22 bp, Homo sapiens
aggaggctgtggagcactccat

SEQ ID NO: 9145545 - DNA, 22 bp, Homo sapiens
catattttagttgctgaacagc

SEQ ID NO: 9145546 - DNA, 21 bp, Homo sapiens
aggaggctgtctctttcagct

SEQ ID NO: 9145547 - DNA, 22 bp, Homo sapiens
aggagggagcttaagccaggca

SEQ ID NO: 9145548 - DNA, 22 bp, Homo sapiens
aggagggagcttaagccaggca

SEQ ID NO: 9145549 - DNA, 22 bp, Homo sapiens
aggagggagcttaagccaggca

SEQ ID NO: 9145550 - DNA, 22 bp, Homo sapiens
catagagtgatgtaaggtatgt

SEQ ID NO: 9145551 - DNA, 22 bp, Homo sapiens
cagttttatacactgcagctcc

SEQ ID NO: 9145552 - DNA, 22 bp, Homo sapiens
catagctgtgtgccatgtaaaa

SEQ ID NO: 9145553 - DNA, 22 bp, Homo sapiens
catagcggtattccacgtggtt

SEQ ID NO: 9145554 - DNA, 22 bp, Homo sapiens
cataggccacggtcagcccaca

SEQ ID NO: 9145555 - DNA, 22 bp, Homo sapiens
catagtaaataatgcagatgat

SEQ ID NO: 9145556 - DNA, 22 bp, Homo sapiens
catagtaagtgcataataaatg

SEQ ID NO: 9145557 - DNA, 22 bp, Homo sapiens
catagttagtggttcagagcaa

SEQ ID NO: 9145558 - DNA, 22 bp, Homo sapiens
catagttataaggcaacactgt

SEQ ID NO: 9145559 - DNA, 22 bp, Homo sapiens
catataaatacaacatgtgtta

SEQ ID NO: 9145560 - DNA, 22 bp, Homo sapiens
catataaatacaacatgtgtta

SEQ ID NO: 9145561 - DNA, 22 bp, Homo sapiens
catataaatacaacatgtgtta

SEQ ID NO: 9145562 - DNA, 22 bp, Homo sapiens
catataaatacaacatgtgtta

SEQ ID NO: 9145563 - DNA, 22 bp, Homo sapiens
aggacggggacgcaagtcagca

SEQ ID NO: 9145564 - DNA, 22 bp, Homo sapiens
cagtgcaggtggcagaggacag

SEQ ID NO: 9145565 - DNA, 22 bp, Homo sapiens
cagtgcccttccaggactgcag

SEQ ID NO: 9145566 - DNA, 22 bp, Homo sapiens
cagtgcctcaggccagcctgca

SEQ ID NO: 9145567 - DNA, 20 bp, Homo sapiens
cagtgcctgccccttgggtt

SEQ ID NO: 9145568 - DNA, 22 bp, Homo sapiens
cagtgcctggcatagaggcggc

SEQ ID NO: 9145569 - DNA, 22 bp, Homo sapiens
cagtgcctggatagcaacatga

SEQ ID NO: 9145570 - DNA, 22 bp, Homo sapiens
aggagaaggaagtgcatcacta

SEQ ID NO: 9145571 - DNA, 22 bp, Homo sapiens
cagtggcctgagccaggcttcc

SEQ ID NO: 9145572 - DNA, 22 bp, Homo sapiens
cagtggccttgatgcctcattc

SEQ ID NO: 9145573 - DNA, 17 bp, Homo sapiens
cagtggcctatggcttt

SEQ ID NO: 9145574 - DNA, 17 bp, Homo sapiens
cagtggcctatggcttt

SEQ ID NO: 9145575 - DNA, 22 bp, Homo sapiens
cagtggcatggttgactgcagt

SEQ ID NO: 9145576 - DNA, 22 bp, Homo sapiens
cagtggccaacttcctgcctct

SEQ ID NO: 9145577 - DNA, 22 bp, Homo sapiens
cagtggagaggcatgcttggca

SEQ ID NO: 9145578 - DNA, 19 bp, Homo sapiens
aggagaagtagcagaaatt

SEQ ID NO: 9145579 - DNA, 19 bp, Homo sapiens
aggagaagtagcagaaatt

SEQ ID NO: 9145580 - DNA, 19 bp, Homo sapiens
aggagaagtagcagaaatt

SEQ ID NO: 9145581 - DNA, 22 bp, Homo sapiens
aggagaaggaggcccctcacac

SEQ ID NO: 9145582 - DNA, 22 bp, Homo sapiens
aggagaagtaaggctagatgat

SEQ ID NO: 9145583 - DNA, 22 bp, Homo sapiens
aggagaagtaaggctagatgat

SEQ ID NO: 9145584 - DNA, 22 bp, Homo sapiens
aggagaaggaggcccctcacac

SEQ ID NO: 9145585 - DNA, 22 bp, Homo sapiens
aggaccagaccgaactagctaa

SEQ ID NO: 9145586 - DNA, 22 bp, Homo sapiens
aggaccagaggccagagtcagc

SEQ ID NO: 9145587 - DNA, 22 bp, Homo sapiens
aggaccagcctccaggtctctt

SEQ ID NO: 9145588 - DNA, 22 bp, Homo sapiens
aggaccagtgagtctggcaagt

SEQ ID NO: 9145589 - DNA, 22 bp, Homo sapiens
aggaccagtatgagagcatctg

SEQ ID NO: 9145590 - DNA, 22 bp, Homo sapiens
aggaccaggtctaatgaagaca

SEQ ID NO: 9145591 - DNA, 22 bp, Homo sapiens
aggaccagtatgagagcatctg

SEQ ID NO: 9145592 - DNA, 19 bp, Homo sapiens
aggacccttatcctggctt

SEQ ID NO: 9145593 - DNA, 22 bp, Homo sapiens
aggaccctgctcaagcatctcc

SEQ ID NO: 9145594 - DNA, 22 bp, Homo sapiens
caggtggcttctccctaggcca

SEQ ID NO: 9145595 - DNA, 22 bp, Homo sapiens
caggtgcacattactgtgttgg

SEQ ID NO: 9145596 - DNA, 22 bp, Homo sapiens
caggtgcaatgagacagctctg

SEQ ID NO: 9145597 - DNA, 22 bp, Homo sapiens
caggtggcttctctgcagcctt

SEQ ID NO: 9145598 - DNA, 22 bp, Homo sapiens
caggtggcttctctgcagcctt

SEQ ID NO: 9145599 - DNA, 22 bp, Homo sapiens
caggtgggaccatgatagggca

SEQ ID NO: 9145600 - DNA, 22 bp, Homo sapiens
aggacaggattccttgccttgc

SEQ ID NO: 9145601 - DNA, 22 bp, Homo sapiens
aggacatgtgcctccagggcag

SEQ ID NO: 9145602 - DNA, 22 bp, Homo sapiens
caggtgggagcgaggagctact

SEQ ID NO: 9145603 - DNA, 22 bp, Homo sapiens
cattaaaatatctcatggtgtt

SEQ ID NO: 9145604 - DNA, 22 bp, Homo sapiens
cattaaacaaccttgaatcaat

SEQ ID NO: 9145605 - DNA, 22 bp, Homo sapiens
cattaacaaatggaagcatgaa

SEQ ID NO: 9145606 - DNA, 22 bp, Homo sapiens
cattaacaaatggaagcatgaa

SEQ ID NO: 9145607 - DNA, 22 bp, Homo sapiens
cattaaattccttgttctcaaa

SEQ ID NO: 9145608 - DNA, 22 bp, Homo sapiens
cattaaattccttgttctcaaa

SEQ ID NO: 9145609 - DNA, 22 bp, Homo sapiens
aggcactgtggaagacatggtt

SEQ ID NO: 9145610 - DNA, 21 bp, Homo sapiens
aggcagcaggatccagggaca

SEQ ID NO: 9145611 - DNA, 21 bp, Homo sapiens
aggcagcaggatccagggaca

SEQ ID NO: 9145612 - DNA, 19 bp, Homo sapiens
aggcagcaggccagggatg

SEQ ID NO: 9145613 - DNA, 19 bp, Homo sapiens
aggcagcaggccagggatg

SEQ ID NO: 9145614 - DNA, 22 bp, Homo sapiens
catttgtttagaagtctttata

SEQ ID NO: 9145615 - DNA, 22 bp, Homo sapiens
catttgtttagaagtctttata

SEQ ID NO: 9145616 - DNA, 22 bp, Homo sapiens
catttgttgggacaatgaaaag

SEQ ID NO: 9145617 - DNA, 22 bp, Homo sapiens
catttgaaattcttagaacaaa

SEQ ID NO: 9145618 - DNA, 22 bp, Homo sapiens
catttgttaatgctgcttttaa

SEQ ID NO: 9145619 - DNA, 22 bp, Homo sapiens
catttgttaatgctgcttttaa

SEQ ID NO: 9145620 - DNA, 22 bp, Homo sapiens
ccaagggctgctgaggtgtcca

SEQ ID NO: 9145621 - DNA, 22 bp, Homo sapiens
ccaagggctctgacttgcctgc

SEQ ID NO: 9145622 - DNA, 22 bp, Homo sapiens
ccaaggtgggcagatcacgagg

SEQ ID NO: 9145623 - DNA, 22 bp, Homo sapiens
ccaagcttctttcctactacag

SEQ ID NO: 9145624 - DNA, 23 bp, Homo sapiens
ccaagcttgtccctgcctgcttt

SEQ ID NO: 9145625 - DNA, 23 bp, Homo sapiens
ccaagcttctaatgctgctgagc

SEQ ID NO: 9145626 - DNA, 20 bp, Homo sapiens
ccaataaagctctataggga

SEQ ID NO: 9145627 - DNA, 22 bp, Homo sapiens
ccaagttaccagcaatataagt

SEQ ID NO: 9145628 - DNA, 18 bp, Homo sapiens
ccaagtatggcagaggct

SEQ ID NO: 9145629 - DNA, 23 bp, Homo sapiens
aggcagcaggttgtccagggtga

SEQ ID NO: 9145630 - DNA, 23 bp, Homo sapiens
aggcagcaggttgtccagggtga

SEQ ID NO: 9145631 - DNA, 22 bp, Homo sapiens
aggcagcagggccactggctga

SEQ ID NO: 9145632 - DNA, 23 bp, Homo sapiens
aggcagcaggttgtccagggtga

SEQ ID NO: 9145633 - DNA, 22 bp, Homo sapiens
aggcagcagggccactggctga

SEQ ID NO: 9145634 - DNA, 22 bp, Homo sapiens
aggcagcagggccactggctga

SEQ ID NO: 9145635 - DNA, 22 bp, Homo sapiens
aggcagcagggccactggctga

SEQ ID NO: 9145636 - DNA, 16 bp, Homo sapiens
ccaagcagcagcagct

SEQ ID NO: 9145637 - DNA, 22 bp, Homo sapiens
ccaagcaggatattctgtgtca

SEQ ID NO: 9145638 - DNA, 22 bp, Homo sapiens
ccaagcaaggctaattcacttg

SEQ ID NO: 9145639 - DNA, 22 bp, Homo sapiens
ccaagcagtctgctaggagttt

SEQ ID NO: 9145640 - DNA, 22 bp, Homo sapiens
ccaagcatttctagccagtcac

SEQ ID NO: 9145641 - DNA, 22 bp, Homo sapiens
ccaagctacttaggagtctgag

SEQ ID NO: 9145642 - DNA, 22 bp, Homo sapiens
aggatgtgtgtaggctggttaa

SEQ ID NO: 9145643 - DNA, 22 bp, Homo sapiens
catggcagaaacctgagctgct

SEQ ID NO: 9145644 - DNA, 22 bp, Homo sapiens
aggattaaagtatatttttgag

SEQ ID NO: 9145645 - DNA, 22 bp, Homo sapiens
aggattaactgacctagtgttt

SEQ ID NO: 9145646 - DNA, 23 bp, Homo sapiens
aggattctgcttttcagaaataa

SEQ ID NO: 9145647 - DNA, 22 bp, Homo sapiens
aggattctgacttaggaggttt

SEQ ID NO: 9145648 - DNA, 22 bp, Homo sapiens
catgctaaaccagaacatagga

SEQ ID NO: 9145649 - DNA, 22 bp, Homo sapiens
catggaggaccctcagggagct

SEQ ID NO: 9145650 - DNA, 22 bp, Homo sapiens
catggaggaccctcagggagct

SEQ ID NO: 9145651 - DNA, 22 bp, Homo sapiens
catggaggagttaggtgtgagt

SEQ ID NO: 9145652 - DNA, 22 bp, Homo sapiens
catggaggaggaagggcgttgt

SEQ ID NO: 9145653 - DNA, 22 bp, Homo sapiens
catggcaataaacctacacagt

SEQ ID NO: 9145654 - DNA, 22 bp, Homo sapiens
aggagggctaggaaaaccagga

SEQ ID NO: 9145655 - DNA, 22 bp, Homo sapiens
aggagggcaggctggctgccta

SEQ ID NO: 9145656 - DNA, 22 bp, Homo sapiens
aggagggcaggctggctgccta

SEQ ID NO: 9145657 - DNA, 21 bp, Homo sapiens
aggagggcacaaggccaggaa

SEQ ID NO: 9145658 - DNA, 22 bp, Homo sapiens
aggagggatagaaaaatacttg

SEQ ID NO: 9145659 - DNA, 21 bp, Homo sapiens
aggagggcacaaggccaggaa

SEQ ID NO: 9145660 - DNA, 22 bp, Homo sapiens
catgcggctctttccaaaccgg

SEQ ID NO: 9145661 - DNA, 22 bp, Homo sapiens
catgcggctctttccaaaccgg

SEQ ID NO: 9145662 - DNA, 22 bp, Homo sapiens
aggaggggcaatgatagtctgg

SEQ ID NO: 9145663 - DNA, 22 bp, Homo sapiens
aggaggggcaatgatagtctgg

SEQ ID NO: 9145664 - DNA, 22 bp, Homo sapiens
aggaggggcaatgatagtctgg

SEQ ID NO: 9145665 - DNA, 20 bp, Homo sapiens
aggaggggatagaatcaaag

SEQ ID NO: 9145666 - DNA, 20 bp, Homo sapiens
aggaggggatagaatcaaag

SEQ ID NO: 9145667 - DNA, 16 bp, Homo sapiens
aggaggggaattagga

SEQ ID NO: 9145668 - DNA, 16 bp, Homo sapiens
aggaggggaattagga

SEQ ID NO: 9145669 - DNA, 22 bp, Homo sapiens
catggctgaaattcttcgcttg

SEQ ID NO: 9145670 - DNA, 22 bp, Homo sapiens
aggatttgaaatatttagtaaa

SEQ ID NO: 9145671 - DNA, 22 bp, Homo sapiens
aggatttgaacctaggcaatca

SEQ ID NO: 9145672 - DNA, 22 bp, Homo sapiens
aggatttcccatatagctccat

SEQ ID NO: 9145673 - DNA, 22 bp, Homo sapiens
aggatttacaatgattctaggt

SEQ ID NO: 9145674 - DNA, 22 bp, Homo sapiens
aggattgtgcctccagtcagaa

SEQ ID NO: 9145675 - DNA, 22 bp, Homo sapiens
aggattgtgcctccagtcagaa

SEQ ID NO: 9145676 - DNA, 21 bp, Homo sapiens
aggatttactattaactgtgt

SEQ ID NO: 9145677 - DNA, 22 bp, Homo sapiens
catggggagacacctagggaaa

SEQ ID NO: 9145678 - DNA, 22 bp, Homo sapiens
catggggagacacctagggaaa

SEQ ID NO: 9145679 - DNA, 22 bp, Homo sapiens
catgggctttggaggctggagg

SEQ ID NO: 9145680 - DNA, 22 bp, Homo sapiens
catggggagacacctagggaaa

SEQ ID NO: 9145681 - DNA, 22 bp, Homo sapiens
catgggctgctgacaggggctc

SEQ ID NO: 9145682 - DNA, 22 bp, Homo sapiens
catggggatgaggctgagactt

SEQ ID NO: 9145683 - DNA, 22 bp, Homo sapiens
catgggggctgaggctgctgta

SEQ ID NO: 9145684 - DNA, 22 bp, Homo sapiens
catggggcccatgtgctccaag

SEQ ID NO: 9145685 - DNA, 22 bp, Homo sapiens
catgtcaacaggcccagaaaat

SEQ ID NO: 9145686 - DNA, 22 bp, Homo sapiens
catgtcaaccaagatgagatat

SEQ ID NO: 9145687 - DNA, 17 bp, Homo sapiens
catgtatttgaaacaga

SEQ ID NO: 9145688 - DNA, 22 bp, Homo sapiens
catgtatagttggaactacatc

SEQ ID NO: 9145689 - DNA, 22 bp, Homo sapiens
aggcactgcagattacaggcgc

SEQ ID NO: 9145690 - DNA, 22 bp, Homo sapiens
catgtcacaattcttaatggga

SEQ ID NO: 9145691 - DNA, 22 bp, Homo sapiens
catgtcactttaacaaattagt

SEQ ID NO: 9145692 - DNA, 22 bp, Homo sapiens
catgtcaataaatataactgca

SEQ ID NO: 9145693 - DNA, 18 bp, Homo sapiens
catgggtgacaggtggat

SEQ ID NO: 9145694 - DNA, 22 bp, Homo sapiens
caggctcagcaggagcctgacc

SEQ ID NO: 9145695 - DNA, 22 bp, Homo sapiens
caggctcagatgccctgcgctg

SEQ ID NO: 9145696 - DNA, 22 bp, Homo sapiens
caggctcagaagccagtggagc

SEQ ID NO: 9145697 - DNA, 22 bp, Homo sapiens
caggctcagctctggccagtgc

SEQ ID NO: 9145698 - DNA, 22 bp, Homo sapiens
agctgtgaattttatgctagtg

SEQ ID NO: 9145699 - DNA, 22 bp, Homo sapiens
agctgtgaccttcaagagctac

SEQ ID NO: 9145700 - DNA, 22 bp, Homo sapiens
caggctccacaggggaatccgg

SEQ ID NO: 9145701 - DNA, 22 bp, Homo sapiens
caggctcagtcagaaaatgtat

SEQ ID NO: 9145702 - DNA, 22 bp, Homo sapiens
caggctcactttctcagtcaca

SEQ ID NO: 9145703 - DNA, 22 bp, Homo sapiens
caggctcactgtaaggtcagct

SEQ ID NO: 9145704 - DNA, 22 bp, Homo sapiens
caggctcactgtaaggtcagct

SEQ ID NO: 9145705 - DNA, 22 bp, Homo sapiens
caggcctgtctgcacatgaggc

SEQ ID NO: 9145706 - DNA, 18 bp, Homo sapiens
agctggggcctctggtcc

SEQ ID NO: 9145707 - DNA, 18 bp, Homo sapiens
agctggggcctctggtcc

SEQ ID NO: 9145708 - DNA, 22 bp, Homo sapiens
agctggggcatttatccactaa

SEQ ID NO: 9145709 - DNA, 22 bp, Homo sapiens
agctggggcatttatccactaa

SEQ ID NO: 9145710 - DNA, 18 bp, Homo sapiens
agctggggcctctggtcc

SEQ ID NO: 9145711 - DNA, 18 bp, Homo sapiens
agctggggcctctggtcc

SEQ ID NO: 9145712 - DNA, 19 bp, Homo sapiens
agctggggcggtgtgtgtt

SEQ ID NO: 9145713 - DNA, 22 bp, Homo sapiens
caggctgagctctggcctgggc

SEQ ID NO: 9145714 - DNA, 22 bp, Homo sapiens
caggctgcggccgtgtgagcat

SEQ ID NO: 9145715 - DNA, 22 bp, Homo sapiens
caggctgcggccgtgtgagcat

SEQ ID NO: 9145716 - DNA, 22 bp, Homo sapiens
caggctgcggtcggctctggtc

SEQ ID NO: 9145717 - DNA, 22 bp, Homo sapiens
caggctgcgtttgtgaaaggta

SEQ ID NO: 9145718 - DNA, 22 bp, Homo sapiens
caggctgctccagggtaggaaa

SEQ ID NO: 9145719 - DNA, 22 bp, Homo sapiens
caggctgctccagggtaggaaa

SEQ ID NO: 9145720 - DNA, 22 bp, Homo sapiens
agctgtggaagactgtcagggt

SEQ ID NO: 9145721 - DNA, 22 bp, Homo sapiens
agctgtggaagactgtcagggt

SEQ ID NO: 9145722 - DNA, 22 bp, Homo sapiens
agctgtggcaaccttgtcagac

SEQ ID NO: 9145723 - DNA, 19 bp, Homo sapiens
agctgtgcagacacttcgc

SEQ ID NO: 9145724 - DNA, 22 bp, Homo sapiens
caggctggagtgcagttgtgca

SEQ ID NO: 9145725 - DNA, 22 bp, Homo sapiens
caggctggagtgcagttgtgca

SEQ ID NO: 9145726 - DNA, 22 bp, Homo sapiens
cagggagcggagtcccatgcct

SEQ ID NO: 9145727 - DNA, 22 bp, Homo sapiens
cagggagcggagtcccatgcct

SEQ ID NO: 9145728 - DNA, 22 bp, Homo sapiens
cagggagcggagtcccatgcct

SEQ ID NO: 9145729 - DNA, 22 bp, Homo sapiens
caggctggagtgcagtgtcgcc

SEQ ID NO: 9145730 - DNA, 22 bp, Homo sapiens
caggctggagtgcagtgtcgcc

SEQ ID NO: 9145731 - DNA, 22 bp, Homo sapiens
caggctggagtgcagtgtcgcc

SEQ ID NO: 9145732 - DNA, 22 bp, Homo sapiens
caggctggagtgcagtggtgcc

SEQ ID NO: 9145733 - DNA, 22 bp, Homo sapiens
caggctggagtgcagtggtgcc

SEQ ID NO: 9145734 - DNA, 22 bp, Homo sapiens
caggctggagtgcagtggtgcc

SEQ ID NO: 9145735 - DNA, 22 bp, Homo sapiens
caggctggagtgcagtggtgcc

SEQ ID NO: 9145736 - DNA, 22 bp, Homo sapiens
caggctggacattagatacata

SEQ ID NO: 9145737 - DNA, 22 bp, Homo sapiens
caggctgctgtccacaaagcat

SEQ ID NO: 9145738 - DNA, 22 bp, Homo sapiens
caggctggacattagatacata

SEQ ID NO: 9145739 - DNA, 22 bp, Homo sapiens
caggctgctgcctagaatgaca

SEQ ID NO: 9145740 - DNA, 22 bp, Homo sapiens
caggctgctgcctagaatgaca

SEQ ID NO: 9145741 - DNA, 22 bp, Homo sapiens
caggctgctgtccacaaagcat

SEQ ID NO: 9145742 - DNA, 22 bp, Homo sapiens
cagggagctggtgccagccgac

SEQ ID NO: 9145743 - DNA, 22 bp, Homo sapiens
cagggagctggtgccagccgac

SEQ ID NO: 9145744 - DNA, 22 bp, Homo sapiens
cagggatggcgctggctgcccg

SEQ ID NO: 9145745 - DNA, 22 bp, Homo sapiens
cagggatgggatggagtcagtt

SEQ ID NO: 9145746 - DNA, 22 bp, Homo sapiens
cagggatgggatggagtcagtt

SEQ ID NO: 9145747 - DNA, 22 bp, Homo sapiens
cagggatgggatggagtcagtt

SEQ ID NO: 9145748 - DNA, 19 bp, Homo sapiens
cagggatgggtagggactc

SEQ ID NO: 9145749 - DNA, 19 bp, Homo sapiens
cagggatgggtagggactc

SEQ ID NO: 9145750 - DNA, 19 bp, Homo sapiens
cagggatgggtagggactc

SEQ ID NO: 9145751 - DNA, 22 bp, Homo sapiens
cagggatggtaaatatgtaaag

SEQ ID NO: 9145752 - DNA, 19 bp, Homo sapiens
cagggatgggtagggactc

SEQ ID NO: 9145753 - DNA, 22 bp, Homo sapiens
cagggagctggctggctgtgcc

SEQ ID NO: 9145754 - DNA, 22 bp, Homo sapiens
cagggagctggctggctgtgcc

SEQ ID NO: 9145755 - DNA, 22 bp, Homo sapiens
cagggagctggctggctgtgcc

SEQ ID NO: 9145756 - DNA, 22 bp, Homo sapiens
cagggagctggctggctgtgcc

SEQ ID NO: 9145757 - DNA, 22 bp, Homo sapiens
cagggagctggctggcgtgagt

SEQ ID NO: 9145758 - DNA, 22 bp, Homo sapiens
cagggagctgacaaccaaggag

SEQ ID NO: 9145759 - DNA, 22 bp, Homo sapiens
cagggagctgacaaccaaggag

SEQ ID NO: 9145760 - DNA, 22 bp, Homo sapiens
cagggagctgacaaccaaggag

SEQ ID NO: 9145761 - DNA, 22 bp, Homo sapiens
cagggagctggagttggagtac

SEQ ID NO: 9145762 - DNA, 22 bp, Homo sapiens
cagggagctggagttggagtac

SEQ ID NO: 9145763 - DNA, 22 bp, Homo sapiens
cagggagctctgggccggactc

SEQ ID NO: 9145764 - DNA, 22 bp, Homo sapiens
cagggagctctgggccggactc

SEQ ID NO: 9145765 - DNA, 22 bp, Homo sapiens
cagggagctattagggttagtg

SEQ ID NO: 9145766 - DNA, 22 bp, Homo sapiens
cagggagctattagggttagtg

SEQ ID NO: 9145767 - DNA, 22 bp, Homo sapiens
caggtgagctctatctagggag

SEQ ID NO: 9145768 - DNA, 22 bp, Homo sapiens
caggtcctttagtgtccagaac

SEQ ID NO: 9145769 - DNA, 22 bp, Homo sapiens
caggtcctttagtgtccagaac

SEQ ID NO: 9145770 - DNA, 22 bp, Homo sapiens
cagggtgactgccctggccact

SEQ ID NO: 9145771 - DNA, 22 bp, Homo sapiens
cagggtgagcctctggagccct

SEQ ID NO: 9145772 - DNA, 23 bp, Homo sapiens
cagggtgaccaatgtggccatca

SEQ ID NO: 9145773 - DNA, 22 bp, Homo sapiens
caggggctgtttgcctcaggcc

SEQ ID NO: 9145774 - DNA, 22 bp, Homo sapiens
caggggctgtgggcggagcctc

SEQ ID NO: 9145775 - DNA, 22 bp, Homo sapiens
caggggctgtggcacatggtgt

SEQ ID NO: 9145776 - DNA, 22 bp, Homo sapiens
caggggctgaaatgttggggtt

SEQ ID NO: 9145777 - DNA, 22 bp, Homo sapiens
caggggctgaaatgttggggtt

SEQ ID NO: 9145778 - DNA, 22 bp, Homo sapiens
caggggctccctgggtgccagt

SEQ ID NO: 9145779 - DNA, 22 bp, Homo sapiens
caggggctgaaatgttggggtt

SEQ ID NO: 9145780 - DNA, 22 bp, Homo sapiens
cagggcctcgaagcctctgggc

SEQ ID NO: 9145781 - DNA, 22 bp, Homo sapiens
cagggcctgcaagagacctggg

SEQ ID NO: 9145782 - DNA, 22 bp, Homo sapiens
cagggcctgagggctgctctgc

SEQ ID NO: 9145783 - DNA, 22 bp, Homo sapiens
cagggcctgagggctgctctgc

SEQ ID NO: 9145784 - DNA, 22 bp, Homo sapiens
cagggcctccccggcagtcttt

SEQ ID NO: 9145785 - DNA, 22 bp, Homo sapiens
cagggatgtctctggaagggag

SEQ ID NO: 9145786 - DNA, 22 bp, Homo sapiens
cagggatgtctctggaagggag

SEQ ID NO: 9145787 - DNA, 22 bp, Homo sapiens
cagggatgtctctggaagggag

SEQ ID NO: 9145788 - DNA, 22 bp, Homo sapiens
cagggatgtctctggaagggag

SEQ ID NO: 9145789 - DNA, 22 bp, Homo sapiens
cagggatggttgagaattggta

SEQ ID NO: 9145790 - DNA, 22 bp, Homo sapiens
cagggatggttgagaattggta

SEQ ID NO: 9145791 - DNA, 22 bp, Homo sapiens
cagggctccccgcaccgcagcc

SEQ ID NO: 9145792 - DNA, 22 bp, Homo sapiens
cagggctccccagagagcctct

SEQ ID NO: 9145793 - DNA, 22 bp, Homo sapiens
cagggctccccagagagcctct

SEQ ID NO: 9145794 - DNA, 22 bp, Homo sapiens
cagggctccctgcagcctctgt

SEQ ID NO: 9145795 - DNA, 22 bp, Homo sapiens
cagggcttgcaggagaaagttt

SEQ ID NO: 9145796 - DNA, 22 bp, Homo sapiens
cagggcttgatctgcatcctgc

SEQ ID NO: 9145797 - DNA, 22 bp, Homo sapiens
cagggctcgctcgctcgctcgc

SEQ ID NO: 9145798 - DNA, 22 bp, Homo sapiens
cagggctcgctgccagcttcag

SEQ ID NO: 9145799 - DNA, 22 bp, Homo sapiens
cagggctcgctgccagcttcag

SEQ ID NO: 9145800 - DNA, 22 bp, Homo sapiens
caggaaggaccgtccagatcag

SEQ ID NO: 9145801 - DNA, 22 bp, Homo sapiens
caggaaggaccgtccagatcag

SEQ ID NO: 9145802 - DNA, 22 bp, Homo sapiens
agctgcagcactccagtagccg

SEQ ID NO: 9145803 - DNA, 17 bp, Homo sapiens
agctgcagatgaagttg

SEQ ID NO: 9145804 - DNA, 22 bp, Homo sapiens
agctgcagatcaataggctcac

SEQ ID NO: 9145805 - DNA, 22 bp, Homo sapiens
agctgcagcactccagtagccg

SEQ ID NO: 9145806 - DNA, 22 bp, Homo sapiens
agctgcagattctatctagaag

SEQ ID NO: 9145807 - DNA, 22 bp, Homo sapiens
agctgcagattctctacttcat

SEQ ID NO: 9145808 - DNA, 22 bp, Homo sapiens
agctgcagataggatgttattt

SEQ ID NO: 9145809 - DNA, 22 bp, Homo sapiens
agctgcagagaaaagaggctgg

SEQ ID NO: 9145810 - DNA, 18 bp, Homo sapiens
agctgcagaccaggaggt

SEQ ID NO: 9145811 - DNA, 18 bp, Homo sapiens
agctgcagaccaggaggt

SEQ ID NO: 9145812 - DNA, 22 bp, Homo sapiens
agctgcagagaaaagaggctgg

SEQ ID NO: 9145813 - DNA, 19 bp, Homo sapiens
agctgcagaccagaagtgc

SEQ ID NO: 9145814 - DNA, 19 bp, Homo sapiens
agctgcagaccagaagtgc

SEQ ID NO: 9145815 - DNA, 20 bp, Homo sapiens
agctgcagaacccactggac

SEQ ID NO: 9145816 - DNA, 19 bp, Homo sapiens
caggaaggggcgaatctgg

SEQ ID NO: 9145817 - DNA, 22 bp, Homo sapiens
caggaaggcgcggctgtgcctg

SEQ ID NO: 9145818 - DNA, 22 bp, Homo sapiens
caggaaggcgcggctgtgcctg

SEQ ID NO: 9145819 - DNA, 22 bp, Homo sapiens
caggaaggcgcggctgtgcctg

SEQ ID NO: 9145820 - DNA, 22 bp, Homo sapiens
caggaaggcgcggctgtgcctg

SEQ ID NO: 9145821 - DNA, 22 bp, Homo sapiens
caggaaggcccacctgtcctgt

SEQ ID NO: 9145822 - DNA, 22 bp, Homo sapiens
caggaaggcccacctgtcctgt

SEQ ID NO: 9145823 - DNA, 22 bp, Homo sapiens
caggaaggcccacctgtcctgt

SEQ ID NO: 9145824 - DNA, 22 bp, Homo sapiens
caggaaggcccacctgtcctgt

SEQ ID NO: 9145825 - DNA, 22 bp, Homo sapiens
caggaaggcccacctgtcctgt

SEQ ID NO: 9145826 - DNA, 22 bp, Homo sapiens
caggaaggcgcggctgtgcctg

SEQ ID NO: 9145827 - DNA, 22 bp, Homo sapiens
caggaaggcgcggctgtgcctg

SEQ ID NO: 9145828 - DNA, 22 bp, Homo sapiens
caggaaggcgcggctgtgcctg

SEQ ID NO: 9145829 - DNA, 22 bp, Homo sapiens
agctgcagttcgttccagctct

SEQ ID NO: 9145830 - DNA, 22 bp, Homo sapiens
caggaaggggctcactctggcc

SEQ ID NO: 9145831 - DNA, 22 bp, Homo sapiens
caggaaggggctcactctggcc

SEQ ID NO: 9145832 - DNA, 22 bp, Homo sapiens
caggaaggggctcactctggcc

SEQ ID NO: 9145833 - DNA, 22 bp, Homo sapiens
agctgcagttagccccagatga

SEQ ID NO: 9145834 - DNA, 22 bp, Homo sapiens
agctgcagtgaattcgctaact

SEQ ID NO: 9145835 - DNA, 22 bp, Homo sapiens
agctgcagtgaactgttttgtc

SEQ ID NO: 9145836 - DNA, 23 bp, Homo sapiens
agctgaggctgtgggtgtcagag

SEQ ID NO: 9145837 - DNA, 22 bp, Homo sapiens
agctgattccactttttcccca

SEQ ID NO: 9145838 - DNA, 22 bp, Homo sapiens
agctgattccactttttcccca

SEQ ID NO: 9145839 - DNA, 22 bp, Homo sapiens
cagctgagaaaggcaggctcac

SEQ ID NO: 9145840 - DNA, 22 bp, Homo sapiens
cagctgagaaatggggaaaggg

SEQ ID NO: 9145841 - DNA, 22 bp, Homo sapiens
cagctgagaagtgatagctgca

SEQ ID NO: 9145842 - DNA, 22 bp, Homo sapiens
cagctgagaagtgatagctgca

SEQ ID NO: 9145843 - DNA, 22 bp, Homo sapiens
agctgcaagataaaagtgatgt

SEQ ID NO: 9145844 - DNA, 22 bp, Homo sapiens
agctgcaagtccaaaggaatta

SEQ ID NO: 9145845 - DNA, 21 bp, Homo sapiens
agctgcaaaaacatacagttc

SEQ ID NO: 9145846 - DNA, 22 bp, Homo sapiens
agctgcaaagatctgtcagtca

SEQ ID NO: 9145847 - DNA, 23 bp, Homo sapiens
agctgcaagactccctgtctgag

SEQ ID NO: 9145848 - DNA, 22 bp, Homo sapiens
agctgcaaccttagctataggc

SEQ ID NO: 9145849 - DNA, 22 bp, Homo sapiens
cagctctgggtgacaggagggc

SEQ ID NO: 9145850 - DNA, 22 bp, Homo sapiens
cagctctgggtgacaggagggc

SEQ ID NO: 9145851 - DNA, 22 bp, Homo sapiens
cagctctgggtgacaggagggc

SEQ ID NO: 9145852 - DNA, 22 bp, Homo sapiens
cagctctgggtgacaggagggc

SEQ ID NO: 9145853 - DNA, 22 bp, Homo sapiens
cagctctggttcctgggcccag

SEQ ID NO: 9145854 - DNA, 22 bp, Homo sapiens
cagctctggtccagggagggca

SEQ ID NO: 9145855 - DNA, 22 bp, Homo sapiens
cagctctgggtaggaggaatct

SEQ ID NO: 9145856 - DNA, 22 bp, Homo sapiens
cagctctggggcagagtgacta

SEQ ID NO: 9145857 - DNA, 20 bp, Homo sapiens
cagctctgggcaggtcgagg

SEQ ID NO: 9145858 - DNA, 22 bp, Homo sapiens
cagctctgtaaattccttcatc

SEQ ID NO: 9145859 - DNA, 22 bp, Homo sapiens
cagctgaaggtaggaaccagga

SEQ ID NO: 9145860 - DNA, 22 bp, Homo sapiens
cagctgacgccagagtggaatt

SEQ ID NO: 9145861 - DNA, 22 bp, Homo sapiens
cagctgagaaaggcaggctcac

SEQ ID NO: 9145862 - DNA, 22 bp, Homo sapiens
cagctgacccgtgggaggcggg

SEQ ID NO: 9145863 - DNA, 22 bp, Homo sapiens
cagctgacccagtgaggaggca

SEQ ID NO: 9145864 - DNA, 22 bp, Homo sapiens
caggccagcagggcctccgtgg

SEQ ID NO: 9145865 - DNA, 22 bp, Homo sapiens
caggccagcggcccgcgcgttc

SEQ ID NO: 9145866 - DNA, 20 bp, Homo sapiens
caggccagaggtttgatggc

SEQ ID NO: 9145867 - DNA, 22 bp, Homo sapiens
agctgggctggagctccaagcg

SEQ ID NO: 9145868 - DNA, 19 bp, Homo sapiens
agctgggcttactcactcg

SEQ ID NO: 9145869 - DNA, 22 bp, Homo sapiens
agctgggcttggccaggtcgct

SEQ ID NO: 9145870 - DNA, 22 bp, Homo sapiens
caggcactgtgctgagctctgc

SEQ ID NO: 9145871 - DNA, 22 bp, Homo sapiens
caggcactgtgttaggcactgt

SEQ ID NO: 9145872 - DNA, 22 bp, Homo sapiens
caggcactgtgttaggcactgt

SEQ ID NO: 9145873 - DNA, 22 bp, Homo sapiens
caggcactgtgttaggcactgt

SEQ ID NO: 9145874 - DNA, 22 bp, Homo sapiens
caggcacttctgctgcttgtct

SEQ ID NO: 9145875 - DNA, 22 bp, Homo sapiens
agctggccattgtgagtggcct

SEQ ID NO: 9145876 - DNA, 22 bp, Homo sapiens
caggccagaggctgttgttgcg

SEQ ID NO: 9145877 - DNA, 20 bp, Homo sapiens
caggcagtttgtggttaggg

SEQ ID NO: 9145878 - DNA, 18 bp, Homo sapiens
agctggccctggctgccg

SEQ ID NO: 9145879 - DNA, 22 bp, Homo sapiens
caggagccccaggctgacaata

SEQ ID NO: 9145880 - DNA, 22 bp, Homo sapiens
caggagccccaggctgacaata

SEQ ID NO: 9145881 - DNA, 22 bp, Homo sapiens
caggagccccaggctgacaata

SEQ ID NO: 9145882 - DNA, 22 bp, Homo sapiens
agctgccacctctgcctttggg

SEQ ID NO: 9145883 - DNA, 21 bp, Homo sapiens
agctgccaccctagcttctga

SEQ ID NO: 9145884 - DNA, 22 bp, Homo sapiens
caggaggagcattagcgtctca

SEQ ID NO: 9145885 - DNA, 22 bp, Homo sapiens
caggaggacatactggctcaca

SEQ ID NO: 9145886 - DNA, 22 bp, Homo sapiens
caggaggagggtacaccatcag

SEQ ID NO: 9145887 - DNA, 22 bp, Homo sapiens
caggaggagggtacaccatcag

SEQ ID NO: 9145888 - DNA, 22 bp, Homo sapiens
caggaggaggtgaggtagaact

SEQ ID NO: 9145889 - DNA, 22 bp, Homo sapiens
caggaggaggtgaggtagaact

SEQ ID NO: 9145890 - DNA, 22 bp, Homo sapiens
caggaggaggtgaggtagaact

SEQ ID NO: 9145891 - DNA, 22 bp, Homo sapiens
agctgctgagccatgtcctgct

SEQ ID NO: 9145892 - DNA, 22 bp, Homo sapiens
caggaggattgcttgaggccag

SEQ ID NO: 9145893 - DNA, 19 bp, Homo sapiens
agctgctggcccagggacc

SEQ ID NO: 9145894 - DNA, 19 bp, Homo sapiens
agctgctggcccagggacc

SEQ ID NO: 9145895 - DNA, 22 bp, Homo sapiens
agctgctgggaccccagatcca

SEQ ID NO: 9145896 - DNA, 22 bp, Homo sapiens
agctgctgggaccccagatcca

SEQ ID NO: 9145897 - DNA, 22 bp, Homo sapiens
agctgctgcggaaagatgccac

SEQ ID NO: 9145898 - DNA, 19 bp, Homo sapiens
agctgctggcccagggacc

SEQ ID NO: 9145899 - DNA, 22 bp, Homo sapiens
agctgctgcccataggtgacat

SEQ ID NO: 9145900 - DNA, 22 bp, Homo sapiens
agctgctgccggtggccaccct

SEQ ID NO: 9145901 - DNA, 22 bp, Homo sapiens
caggcactgtgcctcgctccct

SEQ ID NO: 9145902 - DNA, 22 bp, Homo sapiens
caggcactgtgcctcgctccct

SEQ ID NO: 9145903 - DNA, 22 bp, Homo sapiens
caggcactgtgcaagggtctcg

SEQ ID NO: 9145904 - DNA, 22 bp, Homo sapiens
caggcactggccagtcagcaca

SEQ ID NO: 9145905 - DNA, 22 bp, Homo sapiens
caggcactgcactaccactttt

SEQ ID NO: 9145906 - DNA, 22 bp, Homo sapiens
agtaacaggtgtacagactatc

SEQ ID NO: 9145907 - DNA, 22 bp, Homo sapiens
agtaataatttatattagggag

SEQ ID NO: 9145908 - DNA, 22 bp, Homo sapiens
agtaacagggtatttgtgtggg

SEQ ID NO: 9145909 - DNA, 22 bp, Homo sapiens
agtaatctgattttatagctat

SEQ ID NO: 9145910 - DNA, 22 bp, Homo sapiens
agtaatcaatttttcggtggat

SEQ ID NO: 9145911 - DNA, 22 bp, Homo sapiens
agtacaaaggcccttgattact

SEQ ID NO: 9145912 - DNA, 22 bp, Homo sapiens
agtacaaactgtttcaaagtag

SEQ ID NO: 9145913 - DNA, 22 bp, Homo sapiens
cgcctgctctcactggacagct

SEQ ID NO: 9145914 - DNA, 22 bp, Homo sapiens
cgcctgctctcactggacagct

SEQ ID NO: 9145915 - DNA, 22 bp, Homo sapiens
aggtttattaagtaaatagagc

SEQ ID NO: 9145916 - DNA, 22 bp, Homo sapiens
aggtttctcctttaaagcatgg

SEQ ID NO: 9145917 - DNA, 21 bp, Homo sapiens
aggtttctcttttatggaggg

SEQ ID NO: 9145918 - DNA, 22 bp, Homo sapiens
aggtttctcctttaaagcatgg

SEQ ID NO: 9145919 - DNA, 22 bp, Homo sapiens
cctttagaatacagactttcta

SEQ ID NO: 9145920 - DNA, 22 bp, Homo sapiens
cctttagaattctgcccctcct

SEQ ID NO: 9145921 - DNA, 19 bp, Homo sapiens
aggtttctaactattcaag

SEQ ID NO: 9145922 - DNA, 19 bp, Homo sapiens
aggtttctaactattcaag

SEQ ID NO: 9145923 - DNA, 22 bp, Homo sapiens
aggtttctactgtgttaagaaa

SEQ ID NO: 9145924 - DNA, 20 bp, Homo sapiens
cctttattatttgtatgatg

SEQ ID NO: 9145925 - DNA, 20 bp, Homo sapiens
cctttattatttgtatgatg

SEQ ID NO: 9145926 - DNA, 20 bp, Homo sapiens
cctttattatttgtatgatg

SEQ ID NO: 9145927 - DNA, 20 bp, Homo sapiens
cctttattatttgtatgatg

SEQ ID NO: 9145928 - DNA, 20 bp, Homo sapiens
cctttattatttgtatgatg

SEQ ID NO: 9145929 - DNA, 22 bp, Homo sapiens
cctttaggagtgaggaccgagc

SEQ ID NO: 9145930 - DNA, 22 bp, Homo sapiens
cctttaggagtgaggaccgagc

SEQ ID NO: 9145931 - DNA, 23 bp, Homo sapiens
aggttcagctttcttactctggg

SEQ ID NO: 9145932 - DNA, 22 bp, Homo sapiens
aggttcagagttgttgatgttt

SEQ ID NO: 9145933 - DNA, 22 bp, Homo sapiens
aggttatttttgcttagaaaga

SEQ ID NO: 9145934 - DNA, 23 bp, Homo sapiens
aggttcaggagatggaggaacaa

SEQ ID NO: 9145935 - DNA, 17 bp, Homo sapiens
aggttcaggttacattc

SEQ ID NO: 9145936 - DNA, 22 bp, Homo sapiens
aggttcaggctgcacacctgag

SEQ ID NO: 9145937 - DNA, 22 bp, Homo sapiens
aggttccaagaaatcatcagtg

SEQ ID NO: 9145938 - DNA, 22 bp, Homo sapiens
aggtttatctcatagaaagaat

SEQ ID NO: 9145939 - DNA, 22 bp, Homo sapiens
aggttacagtgattataggttt

SEQ ID NO: 9145940 - DNA, 22 bp, Homo sapiens
aggtgtgtataaacatacatat

SEQ ID NO: 9145941 - DNA, 22 bp, Homo sapiens
aggttatcatcagttgagcact

SEQ ID NO: 9145942 - DNA, 22 bp, Homo sapiens
aggttatttaggaaggtagagc

SEQ ID NO: 9145943 - DNA, 22 bp, Homo sapiens
cctggtgaatgttcatggactg

SEQ ID NO: 9145944 - DNA, 22 bp, Homo sapiens
cctggtgcccccaagccagctg

SEQ ID NO: 9145945 - DNA, 22 bp, Homo sapiens
cctggtgcccccaagccagctg

SEQ ID NO: 9145946 - DNA, 22 bp, Homo sapiens
aggtgtctggatgggtgtcctt

SEQ ID NO: 9145947 - DNA, 22 bp, Homo sapiens
aggtgtctgggctttggagtca

SEQ ID NO: 9145948 - DNA, 22 bp, Homo sapiens
aggtggggttcagtctcagccg

SEQ ID NO: 9145949 - DNA, 22 bp, Homo sapiens
aggtggggttcagtctcagccg

SEQ ID NO: 9145950 - DNA, 22 bp, Homo sapiens
aggtgtctgtgatgggagcgat

SEQ ID NO: 9145951 - DNA, 22 bp, Homo sapiens
aggtgtcttcagggtgagacag

SEQ ID NO: 9145952 - DNA, 22 bp, Homo sapiens
aggtgtctttgcggcccgccgc

SEQ ID NO: 9145953 - DNA, 22 bp, Homo sapiens
aggtgtctttcagtcatggctt

SEQ ID NO: 9145954 - DNA, 22 bp, Homo sapiens
aggtgtggctggggcagaggcc

SEQ ID NO: 9145955 - DNA, 22 bp, Homo sapiens
aggtgtggctggggcagaggcc

SEQ ID NO: 9145956 - DNA, 22 bp, Homo sapiens
aggtgtggctatgctgtgttcc

SEQ ID NO: 9145957 - DNA, 19 bp, Homo sapiens
aggtgtgggggctgcagac

SEQ ID NO: 9145958 - DNA, 19 bp, Homo sapiens
aggtgtgggggctgcagac

SEQ ID NO: 9145959 - DNA, 22 bp, Homo sapiens
aggtgtggcttgaagtctctat

SEQ ID NO: 9145960 - DNA, 22 bp, Homo sapiens
agtcagagagctctcagcatag

SEQ ID NO: 9145961 - DNA, 23 bp, Homo sapiens
agtcagagagtgtgagacaactg

SEQ ID NO: 9145962 - DNA, 23 bp, Homo sapiens
agtcagagagtgtgagacaactg

SEQ ID NO: 9145963 - DNA, 23 bp, Homo sapiens
agtcagagcagaagggctgcttg

SEQ ID NO: 9145964 - DNA, 22 bp, Homo sapiens
agtcagagcaaactggacagac

SEQ ID NO: 9145965 - DNA, 22 bp, Homo sapiens
agtcagagcaaactggacagac

SEQ ID NO: 9145966 - DNA, 23 bp, Homo sapiens
agtcagagagtgtgagacaactg

SEQ ID NO: 9145967 - DNA, 23 bp, Homo sapiens
agtcagagagtgtgagacaactg

SEQ ID NO: 9145968 - DNA, 22 bp, Homo sapiens
agtcagactatcttggttgaga

SEQ ID NO: 9145969 - DNA, 22 bp, Homo sapiens
agtcagaatctgcattttaacc

SEQ ID NO: 9145970 - DNA, 22 bp, Homo sapiens
agtcagagaataaagaatgcat

SEQ ID NO: 9145971 - DNA, 22 bp, Homo sapiens
agtcaccaacatggttcccagg

SEQ ID NO: 9145972 - DNA, 22 bp, Homo sapiens
agtcagaagccggcctaaggga

SEQ ID NO: 9145973 - DNA, 18 bp, Homo sapiens
agtcagattccaaggtga

SEQ ID NO: 9145974 - DNA, 22 bp, Homo sapiens
agtcagagtcgccgacagtcaa

SEQ ID NO: 9145975 - DNA, 22 bp, Homo sapiens
agtcagaggaatgggccaggct

SEQ ID NO: 9145976 - DNA, 22 bp, Homo sapiens
agtcagagttttgaggtgtgac

SEQ ID NO: 9145977 - DNA, 22 bp, Homo sapiens
agtcagagttcttggggagaca

SEQ ID NO: 9145978 - DNA, 22 bp, Homo sapiens
agtcagagtctattgctgtggt

SEQ ID NO: 9145979 - DNA, 22 bp, Homo sapiens
agtcagagtgtgcaggccggct

SEQ ID NO: 9145980 - DNA, 22 bp, Homo sapiens
agtcagagttcttggggagaca

SEQ ID NO: 9145981 - DNA, 22 bp, Homo sapiens
agtcagtgtagaaagcccaggc

SEQ ID NO: 9145982 - DNA, 22 bp, Homo sapiens
agtcagttaacctcacagcatc

SEQ ID NO: 9145983 - DNA, 22 bp, Homo sapiens
agtcagtgtgattctcaggagg

SEQ ID NO: 9145984 - DNA, 22 bp, Homo sapiens
agtcagtgttctgggttgtaat

SEQ ID NO: 9145985 - DNA, 22 bp, Homo sapiens
agtcagtgtcaacaggaagtag

SEQ ID NO: 9145986 - DNA, 22 bp, Homo sapiens
agtcagtgtagaaagcccaggc

SEQ ID NO: 9145987 - DNA, 22 bp, Homo sapiens
agtcagtttccctggaaagcag

SEQ ID NO: 9145988 - DNA, 22 bp, Homo sapiens
agtcagttgcaaacatcaggca

SEQ ID NO: 9145989 - DNA, 22 bp, Homo sapiens
ctacactttggttgactttgtg

SEQ ID NO: 9145990 - DNA, 20 bp, Homo sapiens
ctacacttggcacctggcat

SEQ ID NO: 9145991 - DNA, 22 bp, Homo sapiens
cgcgctgcagacagcggaggcc

SEQ ID NO: 9145992 - DNA, 22 bp, Homo sapiens
cgcggtggcggcctccagcgcc

SEQ ID NO: 9145993 - DNA, 22 bp, Homo sapiens
cgtgagggcatggcagtgagga

SEQ ID NO: 9145994 - DNA, 22 bp, Homo sapiens
cgtgagcagctctgtgtctctg

SEQ ID NO: 9145995 - DNA, 22 bp, Homo sapiens
cgtgccccggtgaggagttcag

SEQ ID NO: 9145996 - DNA, 22 bp, Homo sapiens
cgtgcagcggagctggtcactg

SEQ ID NO: 9145997 - DNA, 22 bp, Homo sapiens
cgtgattggcttctgcattgga

SEQ ID NO: 9145998 - DNA, 20 bp, Homo sapiens
cgtgctgtgaccttgagcat

SEQ ID NO: 9145999 - DNA, 22 bp, Homo sapiens
cgtggccagtttcaagctacca

SEQ ID NO: 9146000 - DNA, 22 bp, Homo sapiens
cgtggctggggaggtcagccag

SEQ ID NO: 9146001 - DNA, 17 bp, Homo sapiens
cgtggctgagccataga

SEQ ID NO: 9146002 - DNA, 22 bp, Homo sapiens
cgtggctggggcgactccacgg

SEQ ID NO: 9146003 - DNA, 22 bp, Homo sapiens
ctaaaattatcaagataattcc

SEQ ID NO: 9146004 - DNA, 22 bp, Homo sapiens
ctaaaattatcaagataattcc

SEQ ID NO: 9146005 - DNA, 22 bp, Homo sapiens
ctaaacaatgaacaaagcactg

SEQ ID NO: 9146006 - DNA, 22 bp, Homo sapiens
ctaaacaggaaggagcacctga

SEQ ID NO: 9146007 - DNA, 22 bp, Homo sapiens
ctaaacatgaactacatttagg

SEQ ID NO: 9146008 - DNA, 22 bp, Homo sapiens
aggtataagtctcatttctgtt

SEQ ID NO: 9146009 - DNA, 22 bp, Homo sapiens
cctggctcattatgtgccccca

SEQ ID NO: 9146010 - DNA, 22 bp, Homo sapiens
cctggctcagtgttgaaggggt

SEQ ID NO: 9146011 - DNA, 22 bp, Homo sapiens
cctggctcaggcacgcatggct

SEQ ID NO: 9146012 - DNA, 22 bp, Homo sapiens
aggtagtgtagctgagtgggat

SEQ ID NO: 9146013 - DNA, 22 bp, Homo sapiens
cctggctcattatgtgccccca

SEQ ID NO: 9146014 - DNA, 22 bp, Homo sapiens
aggtataactttatgcatggaa

SEQ ID NO: 9146015 - DNA, 22 bp, Homo sapiens
aggtagtgtagctgagtgggat

SEQ ID NO: 9146016 - DNA, 22 bp, Homo sapiens
cctggctcagaccccagttctg

SEQ ID NO: 9146017 - DNA, 23 bp, Homo sapiens
cctggctcaccccttatgtccag

SEQ ID NO: 9146018 - DNA, 22 bp, Homo sapiens
cctggctcagcagctctttctc

SEQ ID NO: 9146019 - DNA, 22 bp, Homo sapiens
cctggctcagaccccagttctg

SEQ ID NO: 9146020 - DNA, 22 bp, Homo sapiens
cctggctcagagtatgtcatcg

SEQ ID NO: 9146021 - DNA, 22 bp, Homo sapiens
cctggctcagcagctctttctc

SEQ ID NO: 9146022 - DNA, 22 bp, Homo sapiens
cctggctcaaggcgaggactcc

SEQ ID NO: 9146023 - DNA, 22 bp, Homo sapiens
cctggagcgcgggtcaagctgg

SEQ ID NO: 9146024 - DNA, 22 bp, Homo sapiens
cctggagcgcgggtcaagctgg

SEQ ID NO: 9146025 - DNA, 22 bp, Homo sapiens
cctggagcgcgggtcaagctgg

SEQ ID NO: 9146026 - DNA, 22 bp, Homo sapiens
cctggagcccctctggccagcc

SEQ ID NO: 9146027 - DNA, 22 bp, Homo sapiens
cctggagcccctctggccagcc

SEQ ID NO: 9146028 - DNA, 22 bp, Homo sapiens
agggtggccatgagggagagat

SEQ ID NO: 9146029 - DNA, 22 bp, Homo sapiens
cctggccttaagggcagggagc

SEQ ID NO: 9146030 - DNA, 23 bp, Homo sapiens
agggtgagcaagctatggagacc

SEQ ID NO: 9146031 - DNA, 22 bp, Homo sapiens
agggtggagggagtccctgagc

SEQ ID NO: 9146032 - DNA, 22 bp, Homo sapiens
aggggcttatgtttctccaggc

SEQ ID NO: 9146033 - DNA, 22 bp, Homo sapiens
aggggcttcccttcctgggtag

SEQ ID NO: 9146034 - DNA, 22 bp, Homo sapiens
aggggcttgtggagttgctggt

SEQ ID NO: 9146035 - DNA, 22 bp, Homo sapiens
agggtggcacctggaagggatg

SEQ ID NO: 9146036 - DNA, 22 bp, Homo sapiens
agggtggcagttactggagcaa

SEQ ID NO: 9146037 - DNA, 22 bp, Homo sapiens
cctggagcaggagctgcagagg

SEQ ID NO: 9146038 - DNA, 18 bp, Homo sapiens
cctggacctgtctccttt

SEQ ID NO: 9146039 - DNA, 22 bp, Homo sapiens
cctgcctggctgtcagcagagc

SEQ ID NO: 9146040 - DNA, 22 bp, Homo sapiens
cctggagcccaaggcagtgaga

SEQ ID NO: 9146041 - DNA, 22 bp, Homo sapiens
cctggagcccaaggcagtgaga

SEQ ID NO: 9146042 - DNA, 22 bp, Homo sapiens
cctggagcatcaggaggaaggg

SEQ ID NO: 9146043 - DNA, 22 bp, Homo sapiens
cctgcctggatcagccatcctg

SEQ ID NO: 9146044 - DNA, 20 bp, Homo sapiens
cctgcctggccattccttgg

SEQ ID NO: 9146045 - DNA, 22 bp, Homo sapiens
cctgcctggagctgagtgtgga

SEQ ID NO: 9146046 - DNA, 22 bp, Homo sapiens
cctgcctggatcagccatcctg

SEQ ID NO: 9146047 - DNA, 22 bp, Homo sapiens
cctgcctggagctgagtgtgga

SEQ ID NO: 9146048 - DNA, 22 bp, Homo sapiens
cctgcctgcgtcctctgagggc

SEQ ID NO: 9146049 - DNA, 22 bp, Homo sapiens
aggtggagtgtgcagggagagc

SEQ ID NO: 9146050 - DNA, 21 bp, Homo sapiens
aggtggagtgcttagcatcca

SEQ ID NO: 9146051 - DNA, 22 bp, Homo sapiens
aggtggagtgaaggaaaggcag

SEQ ID NO: 9146052 - DNA, 22 bp, Homo sapiens
aggtggagtgaaggaaaggcag

SEQ ID NO: 9146053 - DNA, 23 bp, Homo sapiens
aggtggagctgtgcagccggggc

SEQ ID NO: 9146054 - DNA, 22 bp, Homo sapiens
cctgggttggagagcaatggtg

SEQ ID NO: 9146055 - DNA, 22 bp, Homo sapiens
cctgggtttggagcctgcagaa

SEQ ID NO: 9146056 - DNA, 22 bp, Homo sapiens
cctgggttggagagcaatggtg

SEQ ID NO: 9146057 - DNA, 22 bp, Homo sapiens
cctgggttccagcaccctctag

SEQ ID NO: 9146058 - DNA, 22 bp, Homo sapiens
cctggtcacccctctctctgca

SEQ ID NO: 9146059 - DNA, 22 bp, Homo sapiens
cctgggcaggatgggcccggtg

SEQ ID NO: 9146060 - DNA, 22 bp, Homo sapiens
cctgggcagggagaccaggctc

SEQ ID NO: 9146061 - DNA, 22 bp, Homo sapiens
cctgggcagggagaccaggctc

SEQ ID NO: 9146062 - DNA, 22 bp, Homo sapiens
cctgggcagtgctggagttgaa

SEQ ID NO: 9146063 - DNA, 19 bp, Homo sapiens
aggtgatgtgactctagaa

SEQ ID NO: 9146064 - DNA, 22 bp, Homo sapiens
aggtgatgtccacagcttgcag

SEQ ID NO: 9146065 - DNA, 22 bp, Homo sapiens
aggtgaggtttgggaggtgtca

SEQ ID NO: 9146066 - DNA, 22 bp, Homo sapiens
aggtgagtcctgggcacaggta

SEQ ID NO: 9146067 - DNA, 21 bp, Homo sapiens
aggtgcagagccagggaccag

SEQ ID NO: 9146068 - DNA, 19 bp, Homo sapiens
aggtgaggggcaccatgtc

SEQ ID NO: 9146069 - DNA, 19 bp, Homo sapiens
aggtgaggggcaccatgtc

SEQ ID NO: 9146070 - DNA, 18 bp, Homo sapiens
aggtctgtggtcaccagg

SEQ ID NO: 9146071 - DNA, 18 bp, Homo sapiens
aggtctgtggtcaccagg

SEQ ID NO: 9146072 - DNA, 22 bp, Homo sapiens
aggtctgtgaattcctgagaaa

SEQ ID NO: 9146073 - DNA, 22 bp, Homo sapiens
aggtctgtctggccccatgaat

SEQ ID NO: 9146074 - DNA, 22 bp, Homo sapiens
aggtctggtgttgatgaattcc

SEQ ID NO: 9146075 - DNA, 22 bp, Homo sapiens
aggtctggtgttgggcctgaaa

SEQ ID NO: 9146076 - DNA, 22 bp, Homo sapiens
aggtctgtctggccccatgaat

SEQ ID NO: 9146077 - DNA, 22 bp, Homo sapiens
aggtctggctcttctccacaga

SEQ ID NO: 9146078 - DNA, 22 bp, Homo sapiens
aggtctggagtgggatctgaga

SEQ ID NO: 9146079 - DNA, 22 bp, Homo sapiens
aggtctggaggcggagtcagga

SEQ ID NO: 9146080 - DNA, 22 bp, Homo sapiens
aggtctggaggcggagtcagga

SEQ ID NO: 9146081 - DNA, 22 bp, Homo sapiens
aggtctggtgggctttagattg

SEQ ID NO: 9146082 - DNA, 22 bp, Homo sapiens
aggtctggtatttttctatact

SEQ ID NO: 9146083 - DNA, 22 bp, Homo sapiens
aggtctgggcaccactggctgc

SEQ ID NO: 9146084 - DNA, 22 bp, Homo sapiens
aggtctgggcaccactggctgc

SEQ ID NO: 9146085 - DNA, 22 bp, Homo sapiens
aggtctgagtatggcctgagaa

SEQ ID NO: 9146086 - DNA, 22 bp, Homo sapiens
aggtctgagtagagaaaaggca

SEQ ID NO: 9146087 - DNA, 22 bp, Homo sapiens
aggtctgagcaggggagaacag

SEQ ID NO: 9146088 - DNA, 17 bp, Homo sapiens
aggtctgagagtatctg

SEQ ID NO: 9146089 - DNA, 22 bp, Homo sapiens
aggtctgagaactacctatagg

SEQ ID NO: 9146090 - DNA, 22 bp, Homo sapiens
aggtctgagctcagggcctggc

SEQ ID NO: 9146091 - DNA, 18 bp, Homo sapiens
aggtctgaggaagagcct

SEQ ID NO: 9146092 - DNA, 22 bp, Homo sapiens
aggtctgagctccttcctctga

SEQ ID NO: 9146093 - DNA, 22 bp, Homo sapiens
aggtctgagctcagggcctggc

SEQ ID NO: 9146094 - DNA, 20 bp, Homo sapiens
aggtctgattccagaatcag

SEQ ID NO: 9146095 - DNA, 20 bp, Homo sapiens
aggtctgattccagaatcag

SEQ ID NO: 9146096 - DNA, 22 bp, Homo sapiens
aggtctgatcatgggcccactt

SEQ ID NO: 9146097 - DNA, 22 bp, Homo sapiens
aggtctgattttttattcccag

SEQ ID NO: 9146098 - DNA, 22 bp, Homo sapiens
aggtctgatatttgttgtatga

SEQ ID NO: 9146099 - DNA, 22 bp, Homo sapiens
aggtctgagtatggcctgagaa

SEQ ID NO: 9146100 - DNA, 22 bp, Homo sapiens
aggtctgagtcccaggggtacc

SEQ ID NO: 9146101 - DNA, 22 bp, Homo sapiens
aggtctgagtctatatacattg

SEQ ID NO: 9146102 - DNA, 22 bp, Homo sapiens
aggtctgagtttgttgttggct

SEQ ID NO: 9146103 - DNA, 23 bp, Homo sapiens
aggtctggacccttggcccctgc

SEQ ID NO: 9146104 - DNA, 19 bp, Homo sapiens
aggtctgcagctgcagttt

SEQ ID NO: 9146105 - DNA, 22 bp, Homo sapiens
aggtctgactctttgccacata

SEQ ID NO: 9146106 - DNA, 22 bp, Homo sapiens
aggtctgactctttgccacata

SEQ ID NO: 9146107 - DNA, 20 bp, Homo sapiens
aggtctgaatgtcagggctg

SEQ ID NO: 9146108 - DNA, 22 bp, Homo sapiens
aggtctgagagccgctttcccc

SEQ ID NO: 9146109 - DNA, 22 bp, Homo sapiens
aggtctgacttcaagcctgtgg

SEQ ID NO: 9146110 - DNA, 22 bp, Homo sapiens
aggtctgacttcaagcctgtgg

SEQ ID NO: 9146111 - DNA, 22 bp, Homo sapiens
aggtcctgtccttggtctctga

SEQ ID NO: 9146112 - DNA, 22 bp, Homo sapiens
aggtcctgtccttggtctctga

SEQ ID NO: 9146113 - DNA, 22 bp, Homo sapiens
aggtctcttgctgtctctgggc

SEQ ID NO: 9146114 - DNA, 22 bp, Homo sapiens
aggtctgaaagcctcagtcaca

SEQ ID NO: 9146115 - DNA, 22 bp, Homo sapiens
aggtctcttgctgtctctgggc

SEQ ID NO: 9146116 - DNA, 22 bp, Homo sapiens
aggtatggcataaatcacaggg

SEQ ID NO: 9146117 - DNA, 22 bp, Homo sapiens
agtgactggtgtgaagttaaat

SEQ ID NO: 9146118 - DNA, 21 bp, Homo sapiens
agtgactatgacattattacc

SEQ ID NO: 9146119 - DNA, 22 bp, Homo sapiens
agtgactggtgtgaagttaaat

SEQ ID NO: 9146120 - DNA, 22 bp, Homo sapiens
agtgaccatctaacgcctgtga

SEQ ID NO: 9146121 - DNA, 22 bp, Homo sapiens
agtgactactgatttttacttt

SEQ ID NO: 9146122 - DNA, 22 bp, Homo sapiens
agtgactactggatttgtttct

SEQ ID NO: 9146123 - DNA, 22 bp, Homo sapiens
agtgactactgatttttacttt

SEQ ID NO: 9146124 - DNA, 22 bp, Homo sapiens
agtgactactggatttgtttct

SEQ ID NO: 9146125 - DNA, 22 bp, Homo sapiens
agtgactaaaggttttaatggc

SEQ ID NO: 9146126 - DNA, 22 bp, Homo sapiens
agtgcactggcaccatctcagc

SEQ ID NO: 9146127 - DNA, 22 bp, Homo sapiens
agtgatttgcagtatttactaa

SEQ ID NO: 9146128 - DNA, 22 bp, Homo sapiens
agtgatttgaggattattgctc

SEQ ID NO: 9146129 - DNA, 22 bp, Homo sapiens
agtgatttgaggattattgctc

SEQ ID NO: 9146130 - DNA, 22 bp, Homo sapiens
agtgcagagacctggtcaggca

SEQ ID NO: 9146131 - DNA, 22 bp, Homo sapiens
agtgcagagacctggtcaggca

SEQ ID NO: 9146132 - DNA, 22 bp, Homo sapiens
agtgcagagagcaatactctac

SEQ ID NO: 9146133 - DNA, 22 bp, Homo sapiens
agtgcagaggctgggaaatgct

SEQ ID NO: 9146134 - DNA, 22 bp, Homo sapiens
agtgcagagtacatttgtggca

SEQ ID NO: 9146135 - DNA, 22 bp, Homo sapiens
ctccagttggccccagttggtt

SEQ ID NO: 9146136 - DNA, 22 bp, Homo sapiens
ctccagttggccccagttggtt

SEQ ID NO: 9146137 - DNA, 22 bp, Homo sapiens
ctccatcagctgttggttgagg

SEQ ID NO: 9146138 - DNA, 22 bp, Homo sapiens
agtgacagtatttgttgccaat

SEQ ID NO: 9146139 - DNA, 22 bp, Homo sapiens
ctccatcatgtttgatcctgag

SEQ ID NO: 9146140 - DNA, 22 bp, Homo sapiens
agtgacagtttcaggcattttt

SEQ ID NO: 9146141 - DNA, 22 bp, Homo sapiens
agtgacagtctcagagatcagg

SEQ ID NO: 9146142 - DNA, 22 bp, Homo sapiens
ctccagtgtctcagagcagatg

SEQ ID NO: 9146143 - DNA, 22 bp, Homo sapiens
ctccagtgtctcagagcagatg

SEQ ID NO: 9146144 - DNA, 20 bp, Homo sapiens
ctccagtgttcaggggagtg

SEQ ID NO: 9146145 - DNA, 22 bp, Homo sapiens
ctccagtggtgatggggaagaa

SEQ ID NO: 9146146 - DNA, 22 bp, Homo sapiens
ctccagtggcaagtccgggcgg

SEQ ID NO: 9146147 - DNA, 22 bp, Homo sapiens
ctccagtgggggtgagcctaga

SEQ ID NO: 9146148 - DNA, 22 bp, Homo sapiens
ctccagtggcacaaatgggtgc

SEQ ID NO: 9146149 - DNA, 18 bp, Homo sapiens
ctccagggaactcagtca

SEQ ID NO: 9146150 - DNA, 22 bp, Homo sapiens
ctcaggcagttgtttgcatagt

SEQ ID NO: 9146151 - DNA, 22 bp, Homo sapiens
ctcaggcagttctgtagcctcc

SEQ ID NO: 9146152 - DNA, 22 bp, Homo sapiens
ctcccaggttacatctgagcct

SEQ ID NO: 9146153 - DNA, 22 bp, Homo sapiens
ctcccaggttccgacgcctctt

SEQ ID NO: 9146154 - DNA, 22 bp, Homo sapiens
ctcctcagagagcagcttgggg

SEQ ID NO: 9146155 - DNA, 22 bp, Homo sapiens
ctcctcagctgggaggagtccc

SEQ ID NO: 9146156 - DNA, 22 bp, Homo sapiens
ctcctcccacggtctcaggaag

SEQ ID NO: 9146157 - DNA, 22 bp, Homo sapiens
ctcccaggtgtcccttctgcca

SEQ ID NO: 9146158 - DNA, 22 bp, Homo sapiens
ctcccaggtgtcccttctgcca

SEQ ID NO: 9146159 - DNA, 22 bp, Homo sapiens
ctcccaggtgtcccttctgcca

SEQ ID NO: 9146160 - DNA, 22 bp, Homo sapiens
ctcccaggttacatctgagcct

SEQ ID NO: 9146161 - DNA, 22 bp, Homo sapiens
ctcccaggttacatctgagcct

SEQ ID NO: 9146162 - DNA, 21 bp, Homo sapiens
ctcccagggtgactgttcaac

SEQ ID NO: 9146163 - DNA, 21 bp, Homo sapiens
ctcccagggtgactgttcaac

SEQ ID NO: 9146164 - DNA, 21 bp, Homo sapiens
ctcccagggtgactgttcaac

SEQ ID NO: 9146165 - DNA, 22 bp, Homo sapiens
ctcccagggtctaggctgctgg

SEQ ID NO: 9146166 - DNA, 22 bp, Homo sapiens
ctcccagggtagggagagacta

SEQ ID NO: 9146167 - DNA, 22 bp, Homo sapiens
ctcccagggtagggagagacta

SEQ ID NO: 9146168 - DNA, 22 bp, Homo sapiens
ctcccagggtagggagagacta

SEQ ID NO: 9146169 - DNA, 22 bp, Homo sapiens
ctcccaggggagtcatctgctt

SEQ ID NO: 9146170 - DNA, 22 bp, Homo sapiens
ctcccaggggagtcatctgctt

SEQ ID NO: 9146171 - DNA, 22 bp, Homo sapiens
ctcccaggggagtcatctgctt

SEQ ID NO: 9146172 - DNA, 22 bp, Homo sapiens
agtgcagcaccatgttacagag

SEQ ID NO: 9146173 - DNA, 22 bp, Homo sapiens
agtgcagcaacaaactgccctc

SEQ ID NO: 9146174 - DNA, 22 bp, Homo sapiens
agtgcagcatgctggggaggct

SEQ ID NO: 9146175 - DNA, 22 bp, Homo sapiens
agtgcagcatgctggggaggct

SEQ ID NO: 9146176 - DNA, 22 bp, Homo sapiens
agtgcagcatgaagcacatgtg

SEQ ID NO: 9146177 - DNA, 22 bp, Homo sapiens
agtgcagccgagatcaggtgct

SEQ ID NO: 9146178 - DNA, 22 bp, Homo sapiens
agtgcagccgagatcaggtgct

SEQ ID NO: 9146179 - DNA, 22 bp, Homo sapiens
agtgcagccttctgggccgctt

SEQ ID NO: 9146180 - DNA, 22 bp, Homo sapiens
agtgcagccttctgggccgctt

SEQ ID NO: 9146181 - DNA, 22 bp, Homo sapiens
ctcctccctctttgccacacat

SEQ ID NO: 9146182 - DNA, 22 bp, Homo sapiens
ctcctccctgcgattgctctgc

SEQ ID NO: 9146183 - DNA, 22 bp, Homo sapiens
ctcctcccacggtctcaggaag

SEQ ID NO: 9146184 - DNA, 22 bp, Homo sapiens
ctcctcctggacacaggctgtg

SEQ ID NO: 9146185 - DNA, 22 bp, Homo sapiens
ctcctcctggacacaggctgtg

SEQ ID NO: 9146186 - DNA, 22 bp, Homo sapiens
ctcctcctggacacaggctgtg

SEQ ID NO: 9146187 - DNA, 22 bp, Homo sapiens
ctcctctcaggctggatggcgc

SEQ ID NO: 9146188 - DNA, 22 bp, Homo sapiens
ctcctctcaggctggatggcgc

SEQ ID NO: 9146189 - DNA, 22 bp, Homo sapiens
ctcctctcaaaagtaggttgac

SEQ ID NO: 9146190 - DNA, 22 bp, Homo sapiens
ctcctctcaaaagtaggttgac

SEQ ID NO: 9146191 - DNA, 22 bp, Homo sapiens
agtgcagcttataaagcatcaa

SEQ ID NO: 9146192 - DNA, 22 bp, Homo sapiens
agtgcagctttttctttacatg

SEQ ID NO: 9146193 - DNA, 22 bp, Homo sapiens
agtgcagctgggactgtagggt

SEQ ID NO: 9146194 - DNA, 22 bp, Homo sapiens
agtgcagctattacaacagtgt

SEQ ID NO: 9146195 - DNA, 22 bp, Homo sapiens
agtgcagctccctcacctgctt

SEQ ID NO: 9146196 - DNA, 22 bp, Homo sapiens
agtgcagctccctcacctgctt

SEQ ID NO: 9146197 - DNA, 23 bp, Homo sapiens
agtctggaagtgcagtggctgga

SEQ ID NO: 9146198 - DNA, 22 bp, Homo sapiens
agtctggaataaaactacttac

SEQ ID NO: 9146199 - DNA, 22 bp, Homo sapiens
agtctggaaaatgcatgtttca

SEQ ID NO: 9146200 - DNA, 22 bp, Homo sapiens
agtctggaatttggcctgagca

SEQ ID NO: 9146201 - DNA, 22 bp, Homo sapiens
agtctggaatttggcctgagca

SEQ ID NO: 9146202 - DNA, 20 bp, Homo sapiens
agtctgcctgctccttctcc

SEQ ID NO: 9146203 - DNA, 22 bp, Homo sapiens
agtctgcctttccaatcccgtg

SEQ ID NO: 9146204 - DNA, 22 bp, Homo sapiens
agtctgcctttccaatcccgtg

SEQ ID NO: 9146205 - DNA, 22 bp, Homo sapiens
agtctgcttcctggagaactca

SEQ ID NO: 9146206 - DNA, 21 bp, Homo sapiens
agtctggaaaacacattcatg

SEQ ID NO: 9146207 - DNA, 19 bp, Homo sapiens
agtctggagtaaaaggaat

SEQ ID NO: 9146208 - DNA, 22 bp, Homo sapiens
agtctggaggtggcaggtgtgt

SEQ ID NO: 9146209 - DNA, 22 bp, Homo sapiens
agtctggagctcagacttggga

SEQ ID NO: 9146210 - DNA, 22 bp, Homo sapiens
agtctggagcagcagtattggt

SEQ ID NO: 9146211 - DNA, 22 bp, Homo sapiens
agtctggagcagcagtattggt

SEQ ID NO: 9146212 - DNA, 22 bp, Homo sapiens
agtctggacctgctgggtctcc

SEQ ID NO: 9146213 - DNA, 22 bp, Homo sapiens
agtctggacatgctgaacttgg

SEQ ID NO: 9146214 - DNA, 19 bp, Homo sapiens
agtctggagtaaaaggaat

SEQ ID NO: 9146215 - DNA, 22 bp, Homo sapiens
agtctggagtagagcctagaaa

SEQ ID NO: 9146216 - DNA, 22 bp, Homo sapiens
agtctggagtgcggcggcagga

SEQ ID NO: 9146217 - DNA, 22 bp, Homo sapiens
agtctggagtagagcctagaaa

SEQ ID NO: 9146218 - DNA, 22 bp, Homo sapiens
agtctggagtgattatgtggga

SEQ ID NO: 9146219 - DNA, 22 bp, Homo sapiens
agtctgtctctgctaatcacta

SEQ ID NO: 9146220 - DNA, 22 bp, Homo sapiens
agtctgtctgtcacttctgcag

SEQ ID NO: 9146221 - DNA, 22 bp, Homo sapiens
agtctgtctacttaaagtctgt

SEQ ID NO: 9146222 - DNA, 22 bp, Homo sapiens
agtctggatttagaggtgggcc

SEQ ID NO: 9146223 - DNA, 22 bp, Homo sapiens
agtctggattagttgggggcaa

SEQ ID NO: 9146224 - DNA, 22 bp, Homo sapiens
agtctggagtgttttgtagcaa

SEQ ID NO: 9146225 - DNA, 22 bp, Homo sapiens
agtctggagtttgctactggac

SEQ ID NO: 9146226 - DNA, 22 bp, Homo sapiens
agtctggagtgcggcggcagga

SEQ ID NO: 9146227 - DNA, 22 bp, Homo sapiens
agtctgtgactcattggatctc

SEQ ID NO: 9146228 - DNA, 22 bp, Homo sapiens
agtctgtgctgttggtgaggat

SEQ ID NO: 9146229 - DNA, 22 bp, Homo sapiens
agtctgtgagtgatgtacctgc

SEQ ID NO: 9146230 - DNA, 22 bp, Homo sapiens
ctcaggcacttttgtcacagac

SEQ ID NO: 9146231 - DNA, 18 bp, Homo sapiens
ctcaggcagagaagcttt

SEQ ID NO: 9146232 - DNA, 22 bp, Homo sapiens
ctcaggcagtgccctctggccg

SEQ ID NO: 9146233 - DNA, 22 bp, Homo sapiens
ctcaggatttaaaggggcactc

SEQ ID NO: 9146234 - DNA, 22 bp, Homo sapiens
ctcaggatttactaatttcaag

SEQ ID NO: 9146235 - DNA, 22 bp, Homo sapiens
ctcaggatttactaatttcaag

SEQ ID NO: 9146236 - DNA, 22 bp, Homo sapiens
ctcaggatgtactacagaaggc

SEQ ID NO: 9146237 - DNA, 22 bp, Homo sapiens
ctcaggattaaggaatctaaat

SEQ ID NO: 9146238 - DNA, 22 bp, Homo sapiens
ctcaggatgtcggtgactattg

SEQ ID NO: 9146239 - DNA, 21 bp, Homo sapiens
agtctgttaggatgactctga

SEQ ID NO: 9146240 - DNA, 21 bp, Homo sapiens
agtctgttaggatgactctga

SEQ ID NO: 9146241 - DNA, 22 bp, Homo sapiens
agtctgtgtgaatgtgggcttt

SEQ ID NO: 9146242 - DNA, 19 bp, Homo sapiens
agtctgtggatttgtgggt

SEQ ID NO: 9146243 - DNA, 22 bp, Homo sapiens
agtctgtggggtccctggggca

SEQ ID NO: 9146244 - DNA, 22 bp, Homo sapiens
agtctgtgtactgggtttctgt

SEQ ID NO: 9146245 - DNA, 22 bp, Homo sapiens
agtcttaatagagaaaaactgt

SEQ ID NO: 9146246 - DNA, 22 bp, Homo sapiens
agtcttacatgagaaagaacct

SEQ ID NO: 9146247 - DNA, 23 bp, Homo sapiens
agtcttactgtcccagaacaggg

SEQ ID NO: 9146248 - DNA, 21 bp, Homo sapiens
ctcaggatcttatatattagt

SEQ ID NO: 9146249 - DNA, 22 bp, Homo sapiens
ctcaggagttggaggctacagt

SEQ ID NO: 9146250 - DNA, 23 bp, Homo sapiens
agtctgaattgagatgtgctgtg

SEQ ID NO: 9146251 - DNA, 21 bp, Homo sapiens
agtctgaggtggggcctagga

SEQ ID NO: 9146252 - DNA, 22 bp, Homo sapiens
agtctgaagactcatgtctgaa

SEQ ID NO: 9146253 - DNA, 22 bp, Homo sapiens
agtctgaagatattcttgcagg

SEQ ID NO: 9146254 - DNA, 22 bp, Homo sapiens
agtctgaaggatggaaggtacc

SEQ ID NO: 9146255 - DNA, 22 bp, Homo sapiens
agtctgaagtagtctttagtgt

SEQ ID NO: 9146256 - DNA, 22 bp, Homo sapiens
agtctgaaggcaatctgctgac

SEQ ID NO: 9146257 - DNA, 22 bp, Homo sapiens
agtctgaagtagtctttagtgt

SEQ ID NO: 9146258 - DNA, 22 bp, Homo sapiens
agtctgagtatctctgagccag

SEQ ID NO: 9146259 - DNA, 22 bp, Homo sapiens
agtctgccaagccagatcatgt

SEQ ID NO: 9146260 - DNA, 22 bp, Homo sapiens
agtctgcactcaggtggaggtc

SEQ ID NO: 9146261 - DNA, 22 bp, Homo sapiens
agtctgaaccagatggcaaggt

SEQ ID NO: 9146262 - DNA, 22 bp, Homo sapiens
agtctgaaataatgtcactaag

SEQ ID NO: 9146263 - DNA, 22 bp, Homo sapiens
agtctgaaagtatgttgtaatg

SEQ ID NO: 9146264 - DNA, 22 bp, Homo sapiens
agtctcttttgcgaagagtgtt

SEQ ID NO: 9146265 - DNA, 22 bp, Homo sapiens
agtctctttgtggactctgcct

SEQ ID NO: 9146266 - DNA, 22 bp, Homo sapiens
agtctctttaatcacagtgtct

SEQ ID NO: 9146267 - DNA, 22 bp, Homo sapiens
agtctctccacattgttataaa

SEQ ID NO: 9146268 - DNA, 22 bp, Homo sapiens
agtcattattatttgtcaaagg

SEQ ID NO: 9146269 - DNA, 22 bp, Homo sapiens
agtcattacagcaggcagaagg

SEQ ID NO: 9146270 - DNA, 22 bp, Homo sapiens
agtcatatttatataatttccc

SEQ ID NO: 9146271 - DNA, 22 bp, Homo sapiens
agtcatccaagagcctgggcag

SEQ ID NO: 9146272 - DNA, 22 bp, Homo sapiens
agtcatatgacccttcacaaac

SEQ ID NO: 9146273 - DNA, 22 bp, Homo sapiens
agtcattttgccagtcttcagg

SEQ ID NO: 9146274 - DNA, 22 bp, Homo sapiens
agtccaaagcagatgagggcca

SEQ ID NO: 9146275 - DNA, 22 bp, Homo sapiens
agtccaaagcagatgagggcca

SEQ ID NO: 9146276 - DNA, 22 bp, Homo sapiens
agtcatttcccattcttcatat

SEQ ID NO: 9146277 - DNA, 22 bp, Homo sapiens
agtcatttatcttagccattat

SEQ ID NO: 9146278 - DNA, 18 bp, Homo sapiens
agtcatttacttttgtga

SEQ ID NO: 9146279 - DNA, 18 bp, Homo sapiens
agtcatttacttttgtga

SEQ ID NO: 9146280 - DNA, 22 bp, Homo sapiens
agtcattttctgcctgtaatct

SEQ ID NO: 9146281 - DNA, 22 bp, Homo sapiens
agtcatttggagcaccttatta

SEQ ID NO: 9146282 - DNA, 22 bp, Homo sapiens
agtcatttctgtagtcatgttt

SEQ ID NO: 9146283 - DNA, 21 bp, Homo sapiens
agtgtgtgataggcaggaaga

SEQ ID NO: 9146284 - DNA, 22 bp, Homo sapiens
agtgtgggggctttggtgtcac

SEQ ID NO: 9146285 - DNA, 21 bp, Homo sapiens
agtgtgtgtggaatgagaata

SEQ ID NO: 9146286 - DNA, 22 bp, Homo sapiens
agtgtgtgctgttccccggagg

SEQ ID NO: 9146287 - DNA, 22 bp, Homo sapiens
ctgagaaaggacctcaaacagg

SEQ ID NO: 9146288 - DNA, 22 bp, Homo sapiens
ctgagaaagtgagggttaaaca

SEQ ID NO: 9146289 - DNA, 22 bp, Homo sapiens
ctgaagcttagtttacgctcca

SEQ ID NO: 9146290 - DNA, 22 bp, Homo sapiens
ctgaagctgggcacttcctttt

SEQ ID NO: 9146291 - DNA, 22 bp, Homo sapiens
ctgaagctgcataccaaagact

SEQ ID NO: 9146292 - DNA, 22 bp, Homo sapiens
ctgagaggcggagcttgcagtg

SEQ ID NO: 9146293 - DNA, 22 bp, Homo sapiens
ctgagaggcacaaggcatttcg

SEQ ID NO: 9146294 - DNA, 22 bp, Homo sapiens
ctgagaggcagccagagaaaat

SEQ ID NO: 9146295 - DNA, 22 bp, Homo sapiens
ctgagaggcggagcttgcagtg

SEQ ID NO: 9146296 - DNA, 22 bp, Homo sapiens
ctgagaggatgctgcagtggag

SEQ ID NO: 9146297 - DNA, 22 bp, Homo sapiens
ctgagaggatgctgcagtggag

SEQ ID NO: 9146298 - DNA, 19 bp, Homo sapiens
ctgagagatgcttcacaca

SEQ ID NO: 9146299 - DNA, 22 bp, Homo sapiens
ctcttaaagaatgttccagctg

SEQ ID NO: 9146300 - DNA, 22 bp, Homo sapiens
agtgtctgcctatttttcaagc

SEQ ID NO: 9146301 - DNA, 22 bp, Homo sapiens
agtgtctgccagctgccaggtg

SEQ ID NO: 9146302 - DNA, 22 bp, Homo sapiens
agtgtctgccagctgccaggtg

SEQ ID NO: 9146303 - DNA, 22 bp, Homo sapiens
agtgtctgccaactgcatggtc

SEQ ID NO: 9146304 - DNA, 22 bp, Homo sapiens
ctcttaaagcttccagtttcaa

SEQ ID NO: 9146305 - DNA, 22 bp, Homo sapiens
ctcttacacagattcctctagc

SEQ ID NO: 9146306 - DNA, 19 bp, Homo sapiens
ctcttacagaatagacaca

SEQ ID NO: 9146307 - DNA, 22 bp, Homo sapiens
ctcttaatgttttatagattga

SEQ ID NO: 9146308 - DNA, 22 bp, Homo sapiens
agtgtctgatgcacagttgtcc

SEQ ID NO: 9146309 - DNA, 22 bp, Homo sapiens
agtggggaggtccaggccaccc

SEQ ID NO: 9146310 - DNA, 22 bp, Homo sapiens
agtggggaggtccaggccaccc

SEQ ID NO: 9146311 - DNA, 22 bp, Homo sapiens
agtggggaggtccaggccaccc

SEQ ID NO: 9146312 - DNA, 20 bp, Homo sapiens
agtggggagtcaggagtgcc

SEQ ID NO: 9146313 - DNA, 20 bp, Homo sapiens
agtggggagtcaggagtgcc

SEQ ID NO: 9146314 - DNA, 22 bp, Homo sapiens
agtggggacaatgagagcaggt

SEQ ID NO: 9146315 - DNA, 22 bp, Homo sapiens
agtggggacaatgagagcaggt

SEQ ID NO: 9146316 - DNA, 22 bp, Homo sapiens
agtggggacttatgccagcatt

SEQ ID NO: 9146317 - DNA, 23 bp, Homo sapiens
agtggggaatcaacagattcttt

SEQ ID NO: 9146318 - DNA, 22 bp, Homo sapiens
agtggggaagattttgcagtca

SEQ ID NO: 9146319 - DNA, 22 bp, Homo sapiens
agtggctgtcttccaaaatctg

SEQ ID NO: 9146320 - DNA, 22 bp, Homo sapiens
agtggctgtcctggctctaact

SEQ ID NO: 9146321 - DNA, 21 bp, Homo sapiens
agtggctgtcaagggggcctt

SEQ ID NO: 9146322 - DNA, 21 bp, Homo sapiens
agtggctgtcaagggggcctt

SEQ ID NO: 9146323 - DNA, 22 bp, Homo sapiens
agtggctgtactattttttcat

SEQ ID NO: 9146324 - DNA, 22 bp, Homo sapiens
agtggctggtctaaggtcacag

SEQ ID NO: 9146325 - DNA, 22 bp, Homo sapiens
agtggctgtatcagtcaaccct

SEQ ID NO: 9146326 - DNA, 22 bp, Homo sapiens
agtggctgtaggctatgagaga

SEQ ID NO: 9146327 - DNA, 19 bp, Homo sapiens
agtggctgggcagaagcaa

SEQ ID NO: 9146328 - DNA, 22 bp, Homo sapiens
agtggctggtagttactgagca

SEQ ID NO: 9146329 - DNA, 22 bp, Homo sapiens
ctctgagactcaagtgagtggg

SEQ ID NO: 9146330 - DNA, 22 bp, Homo sapiens
ctctgagaggtgagaagcagca

SEQ ID NO: 9146331 - DNA, 22 bp, Homo sapiens
agtgggcccgagccagtggtct

SEQ ID NO: 9146332 - DNA, 22 bp, Homo sapiens
agtgggccaaatggaggcaagt

SEQ ID NO: 9146333 - DNA, 21 bp, Homo sapiens
agtgggccatgtgtaatattt

SEQ ID NO: 9146334 - DNA, 22 bp, Homo sapiens
agtgggccaagtgtatgtgtct

SEQ ID NO: 9146335 - DNA, 22 bp, Homo sapiens
agtgggccggacagcccaggcc

SEQ ID NO: 9146336 - DNA, 22 bp, Homo sapiens
agtgggccggacagcccaggcc

SEQ ID NO: 9146337 - DNA, 22 bp, Homo sapiens
agtgggcccttgtcacactgat

SEQ ID NO: 9146338 - DNA, 22 bp, Homo sapiens
agtgggccggacagcccaggcc

SEQ ID NO: 9146339 - DNA, 22 bp, Homo sapiens
agtgggcctgagtgaccagttc

SEQ ID NO: 9146340 - DNA, 22 bp, Homo sapiens
agtgggccttagaaggttccct

SEQ ID NO: 9146341 - DNA, 22 bp, Homo sapiens
agtgggccttagaaggttccct

SEQ ID NO: 9146342 - DNA, 22 bp, Homo sapiens
agtggggaagagcatgggccct

SEQ ID NO: 9146343 - DNA, 22 bp, Homo sapiens
agtgggctggtggcagggagaa

SEQ ID NO: 9146344 - DNA, 22 bp, Homo sapiens
agtgggcaaaacagctcagagc

SEQ ID NO: 9146345 - DNA, 22 bp, Homo sapiens
agtgggcaggcagggtgcgcag

SEQ ID NO: 9146346 - DNA, 22 bp, Homo sapiens
agtgggagagaagcaagtagta

SEQ ID NO: 9146347 - DNA, 20 bp, Homo sapiens
agtgggagagggcagactgc

SEQ ID NO: 9146348 - DNA, 22 bp, Homo sapiens
agtggcaggaaagtggaagaga

SEQ ID NO: 9146349 - DNA, 22 bp, Homo sapiens
agtggcaggaaagtggaagaga

SEQ ID NO: 9146350 - DNA, 22 bp, Homo sapiens
agtggcaggaaagtggaagaga

SEQ ID NO: 9146351 - DNA, 17 bp, Homo sapiens
agtggcaggcagatggg

SEQ ID NO: 9146352 - DNA, 17 bp, Homo sapiens
agtggcaggcagatggg

SEQ ID NO: 9146353 - DNA, 22 bp, Homo sapiens
ctctctggtcccagattccaga

SEQ ID NO: 9146354 - DNA, 22 bp, Homo sapiens
ctctctggtacatagagtttgg

SEQ ID NO: 9146355 - DNA, 22 bp, Homo sapiens
agtggcagccgagcaggagatg

SEQ ID NO: 9146356 - DNA, 22 bp, Homo sapiens
agtggcagccgagcaggagatg

SEQ ID NO: 9146357 - DNA, 22 bp, Homo sapiens
agtggcagccgagcaggagatg

SEQ ID NO: 9146358 - DNA, 22 bp, Homo sapiens
agtggcagccgagcaggagatg

SEQ ID NO: 9146359 - DNA, 22 bp, Homo sapiens
agtggcagccgagcaggagatg

SEQ ID NO: 9146360 - DNA, 22 bp, Homo sapiens
agtggctgacaactgggttaac

SEQ ID NO: 9146361 - DNA, 22 bp, Homo sapiens
agtggctgaatatattttacta

SEQ ID NO: 9146362 - DNA, 23 bp, Homo sapiens
agtggctggacagactttcctgg

SEQ ID NO: 9146363 - DNA, 22 bp, Homo sapiens
agtggctggacgacaagggtga

SEQ ID NO: 9146364 - DNA, 22 bp, Homo sapiens
agtggcaggcggagatgtagga

SEQ ID NO: 9146365 - DNA, 17 bp, Homo sapiens
agtggcaggcagatggg

SEQ ID NO: 9146366 - DNA, 17 bp, Homo sapiens
agtggcaggcagatggg

SEQ ID NO: 9146367 - DNA, 17 bp, Homo sapiens
agtggcaggcagatggg

SEQ ID NO: 9146368 - DNA, 22 bp, Homo sapiens
agtggctgaagcatcaaaggca

SEQ ID NO: 9146369 - DNA, 22 bp, Homo sapiens
agtggctggcataggaacagac

SEQ ID NO: 9146370 - DNA, 22 bp, Homo sapiens
agtggctggcataggaacagac

SEQ ID NO: 9146371 - DNA, 22 bp, Homo sapiens
agtggctggagccccaggctgg

SEQ ID NO: 9146372 - DNA, 22 bp, Homo sapiens
ctctctccttagctgcagacca

SEQ ID NO: 9146373 - DNA, 22 bp, Homo sapiens
ctctctccttagctgcagacca

SEQ ID NO: 9146374 - DNA, 23 bp, Homo sapiens
ctctctctaccatgtgaggacac

SEQ ID NO: 9146375 - DNA, 22 bp, Homo sapiens
agtgcaggccccaggccaggcc

SEQ ID NO: 9146376 - DNA, 22 bp, Homo sapiens
ctctctggggttccagacgtgg

SEQ ID NO: 9146377 - DNA, 22 bp, Homo sapiens
ctctctggggttccagacgtgg

SEQ ID NO: 9146378 - DNA, 22 bp, Homo sapiens
ctctctgggtcctcttttatag

SEQ ID NO: 9146379 - DNA, 18 bp, Homo sapiens
ctctctgggtgaggacaa

SEQ ID NO: 9146380 - DNA, 22 bp, Homo sapiens
ctctctggtacatagagtttgg

SEQ ID NO: 9146381 - DNA, 22 bp, Homo sapiens
ctctctgggaatattttattct

SEQ ID NO: 9146382 - DNA, 22 bp, Homo sapiens
ctctctggcttggcacggagat

SEQ ID NO: 9146383 - DNA, 22 bp, Homo sapiens
ctctctggcttggcacggagat

SEQ ID NO: 9146384 - DNA, 22 bp, Homo sapiens
ctctctgggcccagttggcacc

SEQ ID NO: 9146385 - DNA, 22 bp, Homo sapiens
ctctctgggggccatgccaaga

SEQ ID NO: 9146386 - DNA, 22 bp, Homo sapiens
atctatttctgctaataacaat

SEQ ID NO: 9146387 - DNA, 22 bp, Homo sapiens
atctatttctgctaataacaat

SEQ ID NO: 9146388 - DNA, 22 bp, Homo sapiens
atctatttctgctaataacaat

SEQ ID NO: 9146389 - DNA, 22 bp, Homo sapiens
atctcagtcaggttgaatttgg

SEQ ID NO: 9146390 - DNA, 22 bp, Homo sapiens
atctccagaacatttataaacg

SEQ ID NO: 9146391 - DNA, 22 bp, Homo sapiens
atctccagaatggcttgttaat

SEQ ID NO: 9146392 - DNA, 22 bp, Homo sapiens
atctccagaacatttataaacg

SEQ ID NO: 9146393 - DNA, 22 bp, Homo sapiens
atctccagaatggcttgttaat

SEQ ID NO: 9146394 - DNA, 22 bp, Homo sapiens
atctccagaggagtcatggtct

SEQ ID NO: 9146395 - DNA, 22 bp, Homo sapiens
atctccagaggagtcatggtct

SEQ ID NO: 9146396 - DNA, 22 bp, Homo sapiens
atctccagaggagtcatggtct

SEQ ID NO: 9146397 - DNA, 22 bp, Homo sapiens
atctccagatgcctggaaatga

SEQ ID NO: 9146398 - DNA, 22 bp, Homo sapiens
atctccagatgcctggaaatga

SEQ ID NO: 9146399 - DNA, 22 bp, Homo sapiens
atctccagattgtgatcatcag

SEQ ID NO: 9146400 - DNA, 22 bp, Homo sapiens
atctccagattgtgatcatcag

SEQ ID NO: 9146401 - DNA, 22 bp, Homo sapiens
atctccagcaatggggagctct

SEQ ID NO: 9146402 - DNA, 22 bp, Homo sapiens
atctccagcaatggggagctct

SEQ ID NO: 9146403 - DNA, 22 bp, Homo sapiens
atctccagctggctgtgataaa

SEQ ID NO: 9146404 - DNA, 22 bp, Homo sapiens
atctccagctggctgtgataaa

SEQ ID NO: 9146405 - DNA, 22 bp, Homo sapiens
atctccaggaagtgtcatttac

SEQ ID NO: 9146406 - DNA, 22 bp, Homo sapiens
atctccaggaagtgtcatttac

SEQ ID NO: 9146407 - DNA, 22 bp, Homo sapiens
atctccaggattttcacactca

SEQ ID NO: 9146408 - DNA, 22 bp, Homo sapiens
atctccagctcgcagagctcct

SEQ ID NO: 9146409 - DNA, 22 bp, Homo sapiens
atctccagctcgcagagctcct

SEQ ID NO: 9146410 - DNA, 22 bp, Homo sapiens
atctccagctcgcagagctcct

SEQ ID NO: 9146411 - DNA, 22 bp, Homo sapiens
atctccagcagtgcttttgagc

SEQ ID NO: 9146412 - DNA, 22 bp, Homo sapiens
atctccagcagtgcttttgagc

SEQ ID NO: 9146413 - DNA, 22 bp, Homo sapiens
atctccagcaatggggagctct

SEQ ID NO: 9146414 - DNA, 22 bp, Homo sapiens
atctcccaattccctgataaat

SEQ ID NO: 9146415 - DNA, 22 bp, Homo sapiens
atctcccagccacagcattctt

SEQ ID NO: 9146416 - DNA, 22 bp, Homo sapiens
cttcagtttacaatgcattggc

SEQ ID NO: 9146417 - DNA, 22 bp, Homo sapiens
cttcagttctaaagtagaatgt

SEQ ID NO: 9146418 - DNA, 22 bp, Homo sapiens
atctccagtgcccaaaggaaat

SEQ ID NO: 9146419 - DNA, 22 bp, Homo sapiens
atctccagtgaggcagattctg

SEQ ID NO: 9146420 - DNA, 22 bp, Homo sapiens
atctccagtcctggtttcctgg

SEQ ID NO: 9146421 - DNA, 22 bp, Homo sapiens
atctccagtcctggtttcctgg

SEQ ID NO: 9146422 - DNA, 22 bp, Homo sapiens
atctccagtatcctagtattgt

SEQ ID NO: 9146423 - DNA, 22 bp, Homo sapiens
atctccagtgaggcagattctg

SEQ ID NO: 9146424 - DNA, 22 bp, Homo sapiens
atctccagttagcagtactgat

SEQ ID NO: 9146425 - DNA, 22 bp, Homo sapiens
atctccagtgcccaaaggaaat

SEQ ID NO: 9146426 - DNA, 22 bp, Homo sapiens
atctccagttagcagtactgat

SEQ ID NO: 9146427 - DNA, 22 bp, Homo sapiens
atctccaggcatttcaagagac

SEQ ID NO: 9146428 - DNA, 22 bp, Homo sapiens
atctccaggcatttcaagagac

SEQ ID NO: 9146429 - DNA, 22 bp, Homo sapiens
atctccagggtgcccttgttct

SEQ ID NO: 9146430 - DNA, 22 bp, Homo sapiens
atctccaggattttcacactca

SEQ ID NO: 9146431 - DNA, 22 bp, Homo sapiens
atctccaggattttcacactca

SEQ ID NO: 9146432 - DNA, 22 bp, Homo sapiens
atctccaggattttcacactca

SEQ ID NO: 9146433 - DNA, 22 bp, Homo sapiens
atctccagggtgcccttgttct

SEQ ID NO: 9146434 - DNA, 22 bp, Homo sapiens
atctccaggttgtgcctgcgtc

SEQ ID NO: 9146435 - DNA, 22 bp, Homo sapiens
atctccaggttgtgcctgcgtc

SEQ ID NO: 9146436 - DNA, 22 bp, Homo sapiens
atctccagtatcctagtattgt

SEQ ID NO: 9146437 - DNA, 22 bp, Homo sapiens
atctccaggttgtgcctgcgtc

SEQ ID NO: 9146438 - DNA, 22 bp, Homo sapiens
cttcatagaacagaaatttaat

SEQ ID NO: 9146439 - DNA, 22 bp, Homo sapiens
cttcagtttatcccatcatcca

SEQ ID NO: 9146440 - DNA, 22 bp, Homo sapiens
cttcatagtgagtttaatgatg

SEQ ID NO: 9146441 - DNA, 22 bp, Homo sapiens
cttcatagggttgtaaggatta

SEQ ID NO: 9146442 - DNA, 22 bp, Homo sapiens
cttcataggcttacttgagaaa

SEQ ID NO: 9146443 - DNA, 22 bp, Homo sapiens
cttcatgctgagaagctgaatg

SEQ ID NO: 9146444 - DNA, 22 bp, Homo sapiens
cttcatgctgagaagctgaatg

SEQ ID NO: 9146445 - DNA, 22 bp, Homo sapiens
cttcatgctgagaagctgaatg

SEQ ID NO: 9146446 - DNA, 22 bp, Homo sapiens
cttcatgctcccatttcctaca

SEQ ID NO: 9146447 - DNA, 22 bp, Homo sapiens
cttcagaatgggactgtgtttg

SEQ ID NO: 9146448 - DNA, 22 bp, Homo sapiens
cttcagagaacttgatcgctgc

SEQ ID NO: 9146449 - DNA, 22 bp, Homo sapiens
cttcagagagtccagggactgc

SEQ ID NO: 9146450 - DNA, 22 bp, Homo sapiens
cttcacacccactaaaatgatg

SEQ ID NO: 9146451 - DNA, 22 bp, Homo sapiens
cttcagaagcctgcagcctttg

SEQ ID NO: 9146452 - DNA, 22 bp, Homo sapiens
cttcagagtgcagaagattggg

SEQ ID NO: 9146453 - DNA, 22 bp, Homo sapiens
cttcagatcctaatttgtcttt

SEQ ID NO: 9146454 - DNA, 22 bp, Homo sapiens
cttcagatccctctgccactgt

SEQ ID NO: 9146455 - DNA, 22 bp, Homo sapiens
cttcagatattaatatcaatta

SEQ ID NO: 9146456 - DNA, 22 bp, Homo sapiens
ctgtttcaagtgaagtcagaca

SEQ ID NO: 9146457 - DNA, 19 bp, Homo sapiens
ctgtttcaagtaggaggag

SEQ ID NO: 9146458 - DNA, 22 bp, Homo sapiens
ctgtttcagaacttcttaaaaa

SEQ ID NO: 9146459 - DNA, 22 bp, Homo sapiens
ctgtttcagctactgttccatg

SEQ ID NO: 9146460 - DNA, 22 bp, Homo sapiens
cttcagcagatgtgctagagat

SEQ ID NO: 9146461 - DNA, 22 bp, Homo sapiens
cttcagcaactttggaatgttt

SEQ ID NO: 9146462 - DNA, 21 bp, Homo sapiens
cttcagcaaatacttggcagg

SEQ ID NO: 9146463 - DNA, 22 bp, Homo sapiens
cttcagcaactttggaatgttt

SEQ ID NO: 9146464 - DNA, 22 bp, Homo sapiens
cttcagcaccatagctccttct

SEQ ID NO: 9146465 - DNA, 22 bp, Homo sapiens
cttcagcacctcagctggagag

SEQ ID NO: 9146466 - DNA, 22 bp, Homo sapiens
atccttcagctgccctgttacc

SEQ ID NO: 9146467 - DNA, 19 bp, Homo sapiens
cttcagcatctccggagct

SEQ ID NO: 9146468 - DNA, 22 bp, Homo sapiens
atccttaatttacttgcatctt

SEQ ID NO: 9146469 - DNA, 22 bp, Homo sapiens
atccttgagccttatcttttgt

SEQ ID NO: 9146470 - DNA, 22 bp, Homo sapiens
atccttggatgtgtctttttgt

SEQ ID NO: 9146471 - DNA, 22 bp, Homo sapiens
atcattataatggtatagttgt

SEQ ID NO: 9146472 - DNA, 22 bp, Homo sapiens
ctgtgtgtgaacacagcccagc

SEQ ID NO: 9146473 - DNA, 22 bp, Homo sapiens
atcattccacatgtaccactag

SEQ ID NO: 9146474 - DNA, 22 bp, Homo sapiens
ctgtgtcccagccaggataatg

SEQ ID NO: 9146475 - DNA, 22 bp, Homo sapiens
ctgtgtccatttatcattgtca

SEQ ID NO: 9146476 - DNA, 22 bp, Homo sapiens
ctgtgtcccacacgaggtgtat

SEQ ID NO: 9146477 - DNA, 22 bp, Homo sapiens
ctgtgtcccacacgaggtgtat

SEQ ID NO: 9146478 - DNA, 22 bp, Homo sapiens
ctgtgtcccacacgaggtgtat

SEQ ID NO: 9146479 - DNA, 22 bp, Homo sapiens
ctgtgtcccagtaccttgggta

SEQ ID NO: 9146480 - DNA, 22 bp, Homo sapiens
ctgtgtcccttgtcccagagcc

SEQ ID NO: 9146481 - DNA, 22 bp, Homo sapiens
ctgtgtccccctcagccaggtg

SEQ ID NO: 9146482 - DNA, 22 bp, Homo sapiens
ctgtgtccccctcagccaggtg

SEQ ID NO: 9146483 - DNA, 22 bp, Homo sapiens
ctgtgtccccctcagccaggtg

SEQ ID NO: 9146484 - DNA, 22 bp, Homo sapiens
ctgtgtccccctcagccaggtg

SEQ ID NO: 9146485 - DNA, 22 bp, Homo sapiens
ctgtgtccccctcagccaggtg

SEQ ID NO: 9146486 - DNA, 22 bp, Homo sapiens
ctgtgtccccctcagccaggtg

SEQ ID NO: 9146487 - DNA, 22 bp, Homo sapiens
atcattactcctgtaaaattgt

SEQ ID NO: 9146488 - DNA, 22 bp, Homo sapiens
ctgtgtcccttgtcccagagcc

SEQ ID NO: 9146489 - DNA, 22 bp, Homo sapiens
ctgtttatgaagctgtggttta

SEQ ID NO: 9146490 - DNA, 22 bp, Homo sapiens
ctgttattttataattcaagaa

SEQ ID NO: 9146491 - DNA, 22 bp, Homo sapiens
ctgttatttgctggaagagttt

SEQ ID NO: 9146492 - DNA, 22 bp, Homo sapiens
ctgttatttggaggatgcttgg

SEQ ID NO: 9146493 - DNA, 23 bp, Homo sapiens
ctgttatgtaaatatgtttagtg

SEQ ID NO: 9146494 - DNA, 22 bp, Homo sapiens
ctgtgcctttgtagctgtgcct

SEQ ID NO: 9146495 - DNA, 22 bp, Homo sapiens
ctgtgccttggcgctgtgccac

SEQ ID NO: 9146496 - DNA, 22 bp, Homo sapiens
ctgtgccttctgcctggaacat

SEQ ID NO: 9146497 - DNA, 22 bp, Homo sapiens
ctgtgcctttgtagctgtgcct

SEQ ID NO: 9146498 - DNA, 23 bp, Homo sapiens
ctgtgctcagagggagggagagc

SEQ ID NO: 9146499 - DNA, 23 bp, Homo sapiens
ctgtgctcagagggagggagagc

SEQ ID NO: 9146500 - DNA, 20 bp, Homo sapiens
ctgtgcctcctgctagtcct

SEQ ID NO: 9146501 - DNA, 20 bp, Homo sapiens
ctgtgcctcctgctagtcct

SEQ ID NO: 9146502 - DNA, 22 bp, Homo sapiens
ctgtgccttagtattctcattt

SEQ ID NO: 9146503 - DNA, 22 bp, Homo sapiens
ctgtgcctggggggcagagctg

SEQ ID NO: 9146504 - DNA, 20 bp, Homo sapiens
ctgtgcctaaacctccgggt

SEQ ID NO: 9146505 - DNA, 22 bp, Homo sapiens
ctgtgcctaagatgcatgtctc

SEQ ID NO: 9146506 - DNA, 22 bp, Homo sapiens
ctgtgcagtaggtcagggctgg

SEQ ID NO: 9146507 - DNA, 18 bp, Homo sapiens
ctgtccagtagactctgc

SEQ ID NO: 9146508 - DNA, 18 bp, Homo sapiens
ctgtccagtagactctgc

SEQ ID NO: 9146509 - DNA, 21 bp, Homo sapiens
ctgtccagtaattcctggcac

SEQ ID NO: 9146510 - DNA, 21 bp, Homo sapiens
ctgtccagtaattcctggcac

SEQ ID NO: 9146511 - DNA, 22 bp, Homo sapiens
ctgtccagggtgtgcaggggct

SEQ ID NO: 9146512 - DNA, 22 bp, Homo sapiens
ctgtccaggctgaggagtttat

SEQ ID NO: 9146513 - DNA, 22 bp, Homo sapiens
ctgtccagggtgtgcaggggct

SEQ ID NO: 9146514 - DNA, 23 bp, Homo sapiens
ctgtccaggattcttgagagaac

SEQ ID NO: 9146515 - DNA, 22 bp, Homo sapiens
ctgtccagcttggctcctgggg

SEQ ID NO: 9146516 - DNA, 22 bp, Homo sapiens
atcaggatgacaactgctgggt

SEQ ID NO: 9146517 - DNA, 22 bp, Homo sapiens
ctgtgggagcactggggaccga

SEQ ID NO: 9146518 - DNA, 22 bp, Homo sapiens
ctgtgtccaatggccttagcag

SEQ ID NO: 9146519 - DNA, 22 bp, Homo sapiens
ctgtgtccatgttctaatttgg

SEQ ID NO: 9146520 - DNA, 22 bp, Homo sapiens
ctgtgtccaatggccttagcag

SEQ ID NO: 9146521 - DNA, 22 bp, Homo sapiens
atcaggaatgaatacttttgga

SEQ ID NO: 9146522 - DNA, 22 bp, Homo sapiens
atcaggaagccagtctaatgga

SEQ ID NO: 9146523 - DNA, 22 bp, Homo sapiens
atcaggaagatctagcgaatgt

SEQ ID NO: 9146524 - DNA, 22 bp, Homo sapiens
atcaggaagccagtctaatgga

SEQ ID NO: 9146525 - DNA, 22 bp, Homo sapiens
atcaggaaatacttatttataa

SEQ ID NO: 9146526 - DNA, 22 bp, Homo sapiens
atcaggaaatacttatttataa

SEQ ID NO: 9146527 - DNA, 22 bp, Homo sapiens
atcaggaagaagaatgtgttgg

SEQ ID NO: 9146528 - DNA, 22 bp, Homo sapiens
atcaggaacgttcatggactgt

SEQ ID NO: 9146529 - DNA, 22 bp, Homo sapiens
atagtacagatccattaattat

SEQ ID NO: 9146530 - DNA, 22 bp, Homo sapiens
atagtatttccagaaatagtct

SEQ ID NO: 9146531 - DNA, 23 bp, Homo sapiens
atagtctgcgcaactgagagagg

SEQ ID NO: 9146532 - DNA, 22 bp, Homo sapiens
atagtcttagatcagataaagt

SEQ ID NO: 9146533 - DNA, 22 bp, Homo sapiens
atagtcttagatcagataaagt

SEQ ID NO: 9146534 - DNA, 22 bp, Homo sapiens
atagtcttagatcagataaagt

SEQ ID NO: 9146535 - DNA, 22 bp, Homo sapiens
atatattttgcggtcacgtggc

SEQ ID NO: 9146536 - DNA, 22 bp, Homo sapiens
atatattttttgagacagagtc

SEQ ID NO: 9146537 - DNA, 22 bp, Homo sapiens
atatatgtatgtggcggagagg

SEQ ID NO: 9146538 - DNA, 20 bp, Homo sapiens
atatatgtatgcgtgtggtt

SEQ ID NO: 9146539 - DNA, 22 bp, Homo sapiens
atagtgattattattgctattg

SEQ ID NO: 9146540 - DNA, 22 bp, Homo sapiens
atagtcttccaggtcttctact

SEQ ID NO: 9146541 - DNA, 22 bp, Homo sapiens
atatcaaacgaagttattttaa

SEQ ID NO: 9146542 - DNA, 22 bp, Homo sapiens
atatcaaacgaagttattttaa

SEQ ID NO: 9146543 - DNA, 22 bp, Homo sapiens
atatcaaagctagtggaaattt

SEQ ID NO: 9146544 - DNA, 22 bp, Homo sapiens
atatcaaagctagtggaaattt

SEQ ID NO: 9146545 - DNA, 22 bp, Homo sapiens
atatcaaaataaacagcatgca

SEQ ID NO: 9146546 - DNA, 23 bp, Homo sapiens
atatcacacccagtacagtctcc

SEQ ID NO: 9146547 - DNA, 22 bp, Homo sapiens
atatcacaaacaagtctgtact

SEQ ID NO: 9146548 - DNA, 21 bp, Homo sapiens
atatcacaaacatatggtctg

SEQ ID NO: 9146549 - DNA, 22 bp, Homo sapiens
atatcaagattattagggtcat

SEQ ID NO: 9146550 - DNA, 21 bp, Homo sapiens
atatcaatacagcaggacttc

SEQ ID NO: 9146551 - DNA, 22 bp, Homo sapiens
atatcaaagctagtggaaattt

SEQ ID NO: 9146552 - DNA, 22 bp, Homo sapiens
atatcataaatcggtgcatgaa

SEQ ID NO: 9146553 - DNA, 22 bp, Homo sapiens
atatcattatgttatgagcaca

SEQ ID NO: 9146554 - DNA, 22 bp, Homo sapiens
ctgggccagggaggtgtctgta

SEQ ID NO: 9146555 - DNA, 22 bp, Homo sapiens
ctgggcagttcgctttcgtttt

SEQ ID NO: 9146556 - DNA, 22 bp, Homo sapiens
ctgggcagttcgctttcgtttt

SEQ ID NO: 9146557 - DNA, 22 bp, Homo sapiens
ctgggccatctcctttgtgtgg

SEQ ID NO: 9146558 - DNA, 20 bp, Homo sapiens
ctgggccatccttttacaat

SEQ ID NO: 9146559 - DNA, 22 bp, Homo sapiens
ctgggccatcagaggggctgga

SEQ ID NO: 9146560 - DNA, 22 bp, Homo sapiens
ctgggccagtctcggccgctct

SEQ ID NO: 9146561 - DNA, 22 bp, Homo sapiens
ctgggccagttatgtctcatct

SEQ ID NO: 9146562 - DNA, 22 bp, Homo sapiens
ctgggccatggaagtctctgcc

SEQ ID NO: 9146563 - DNA, 22 bp, Homo sapiens
ctgggccatctctctgcaagtg

SEQ ID NO: 9146564 - DNA, 17 bp, Homo sapiens
ctgggcctctgcccttt

SEQ ID NO: 9146565 - DNA, 17 bp, Homo sapiens
ctgggcctctgcccttt

SEQ ID NO: 9146566 - DNA, 22 bp, Homo sapiens
ctgggcctctcagctcccgcgg

SEQ ID NO: 9146567 - DNA, 22 bp, Homo sapiens
ctgggccatgggccagcgaggc

SEQ ID NO: 9146568 - DNA, 17 bp, Homo sapiens
ctgggcctctgcccttt

SEQ ID NO: 9146569 - DNA, 22 bp, Homo sapiens
ctgggcctgccaccatcttagg

SEQ ID NO: 9146570 - DNA, 22 bp, Homo sapiens
ctgggcctggacgggcagatct

SEQ ID NO: 9146571 - DNA, 22 bp, Homo sapiens
ctgggcctggcgttccaggctg

SEQ ID NO: 9146572 - DNA, 22 bp, Homo sapiens
ctgggcctggcgttccaggctg

SEQ ID NO: 9146573 - DNA, 22 bp, Homo sapiens
ctgggcctggcgttccaggctg

SEQ ID NO: 9146574 - DNA, 22 bp, Homo sapiens
ctgggcctgggaggccaggtct

SEQ ID NO: 9146575 - DNA, 22 bp, Homo sapiens
ctgggcctgggaggccaggtct

SEQ ID NO: 9146576 - DNA, 22 bp, Homo sapiens
ctgggctgatttagtcacgttt

SEQ ID NO: 9146577 - DNA, 22 bp, Homo sapiens
ctgggctgatttagtcacgttt

SEQ ID NO: 9146578 - DNA, 22 bp, Homo sapiens
ctgggctgtaatgtggcactga

SEQ ID NO: 9146579 - DNA, 22 bp, Homo sapiens
ctgggctgtaatgtggcactga

SEQ ID NO: 9146580 - DNA, 22 bp, Homo sapiens
ctgggctgtaatgtggcactga

SEQ ID NO: 9146581 - DNA, 20 bp, Homo sapiens
ctgggctgggctacagggtc

SEQ ID NO: 9146582 - DNA, 22 bp, Homo sapiens
atattttcacagaacttgcaaa

SEQ ID NO: 9146583 - DNA, 22 bp, Homo sapiens
atattttcactgaaccaaagta

SEQ ID NO: 9146584 - DNA, 22 bp, Homo sapiens
atattttccgaacttgaggtag

SEQ ID NO: 9146585 - DNA, 22 bp, Homo sapiens
atattttctggaactatgcctg

SEQ ID NO: 9146586 - DNA, 22 bp, Homo sapiens
atattttgaagttaataatgtg

SEQ ID NO: 9146587 - DNA, 22 bp, Homo sapiens
ctgtaatcccagctactcggga

SEQ ID NO: 9146588 - DNA, 22 bp, Homo sapiens
ctgtatctgtgttggatgagtt

SEQ ID NO: 9146589 - DNA, 22 bp, Homo sapiens
ctgtatctgtgttggatgagtt

SEQ ID NO: 9146590 - DNA, 22 bp, Homo sapiens
ctgtatcagttcagaggtgcag

SEQ ID NO: 9146591 - DNA, 22 bp, Homo sapiens
ctgtatatgtgcatacacacac

SEQ ID NO: 9146592 - DNA, 22 bp, Homo sapiens
ctgtattcaaagtgaggatgta

SEQ ID NO: 9146593 - DNA, 22 bp, Homo sapiens
ctgtattctgggcagggaagga

SEQ ID NO: 9146594 - DNA, 22 bp, Homo sapiens
ctgtattcaagcttctgcccaa

SEQ ID NO: 9146595 - DNA, 22 bp, Homo sapiens
ctgtatttagttaaaatgctaa

SEQ ID NO: 9146596 - DNA, 22 bp, Homo sapiens
ctgtatttagttaaaatgctaa

SEQ ID NO: 9146597 - DNA, 22 bp, Homo sapiens
ctgtatttcttggacagttgct

SEQ ID NO: 9146598 - DNA, 22 bp, Homo sapiens
ctgtatttcccacattctctat

SEQ ID NO: 9146599 - DNA, 22 bp, Homo sapiens
ctgtatttcccacattctctat

SEQ ID NO: 9146600 - DNA, 22 bp, Homo sapiens
ctgtatttcttggacagttgct

SEQ ID NO: 9146601 - DNA, 22 bp, Homo sapiens
ctgtatttcccacattctctat

SEQ ID NO: 9146602 - DNA, 22 bp, Homo sapiens
ctgtccagctgaccagagcagc

SEQ ID NO: 9146603 - DNA, 22 bp, Homo sapiens
ctgtccagcttggctcctgggg

SEQ ID NO: 9146604 - DNA, 16 bp, Homo sapiens
ctgtccagcatctgcc

SEQ ID NO: 9146605 - DNA, 22 bp, Homo sapiens
ctgtccagcgactaggggatgg

SEQ ID NO: 9146606 - DNA, 22 bp, Homo sapiens
ctgtccagcgactaggggatgg

SEQ ID NO: 9146607 - DNA, 22 bp, Homo sapiens
ctgtccagctgaccagagcagc

SEQ ID NO: 9146608 - DNA, 22 bp, Homo sapiens
ctgtccagaataggcaaatcca

SEQ ID NO: 9146609 - DNA, 22 bp, Homo sapiens
ctgtccagcacatgtctgcccc

SEQ ID NO: 9146610 - DNA, 22 bp, Homo sapiens
ctgtccagaaagggggcaacaa

SEQ ID NO: 9146611 - DNA, 22 bp, Homo sapiens
ctgtcatttaagacattctgga

SEQ ID NO: 9146612 - DNA, 22 bp, Homo sapiens
ctggggaggcagggctgcccct

SEQ ID NO: 9146613 - DNA, 22 bp, Homo sapiens
ctggggaggatgctacgacctg

SEQ ID NO: 9146614 - DNA, 22 bp, Homo sapiens
ctgggctgtggtgtggcccaaa

SEQ ID NO: 9146615 - DNA, 22 bp, Homo sapiens
ctgggctgtggtgtggcccaaa

SEQ ID NO: 9146616 - DNA, 23 bp, Homo sapiens
ctgggctgtcctgaggtcacctc

SEQ ID NO: 9146617 - DNA, 23 bp, Homo sapiens
ctgggctgtcctgaggtcacctc

SEQ ID NO: 9146618 - DNA, 22 bp, Homo sapiens
ctgggctgtcccagggcggcag

SEQ ID NO: 9146619 - DNA, 22 bp, Homo sapiens
ctgggctgtcaatggccctctg

SEQ ID NO: 9146620 - DNA, 22 bp, Homo sapiens
ctgggctgtcaatggccctctg

SEQ ID NO: 9146621 - DNA, 22 bp, Homo sapiens
ctgggctgtcccaaccccatcc

SEQ ID NO: 9146622 - DNA, 22 bp, Homo sapiens
ctggtggaagcctgggctcaga

SEQ ID NO: 9146623 - DNA, 22 bp, Homo sapiens
ctggtggaagcctgggctcaga

SEQ ID NO: 9146624 - DNA, 22 bp, Homo sapiens
ctggtggagagtgggctctgga

SEQ ID NO: 9146625 - DNA, 22 bp, Homo sapiens
ctggtggaatggcagagggaac

SEQ ID NO: 9146626 - DNA, 22 bp, Homo sapiens
ctggggcatcatccattctttc

SEQ ID NO: 9146627 - DNA, 22 bp, Homo sapiens
ctggggcagagcctttagcaaa

SEQ ID NO: 9146628 - DNA, 22 bp, Homo sapiens
ctggtcctctccagcaggcatt

SEQ ID NO: 9146629 - DNA, 22 bp, Homo sapiens
ctggggcagagcccagcaattt

SEQ ID NO: 9146630 - DNA, 22 bp, Homo sapiens
ctggggcagagcccagcaattt

SEQ ID NO: 9146631 - DNA, 22 bp, Homo sapiens
ctggggcagagcccagcaattt

SEQ ID NO: 9146632 - DNA, 22 bp, Homo sapiens
ctggtgggagcagcaggcagct

SEQ ID NO: 9146633 - DNA, 22 bp, Homo sapiens
ctggtgggagcagcaggcagct

SEQ ID NO: 9146634 - DNA, 22 bp, Homo sapiens
ctggtgggagcagcaggcagct

SEQ ID NO: 9146635 - DNA, 22 bp, Homo sapiens
atatttgttagagtctatgtgt

SEQ ID NO: 9146636 - DNA, 22 bp, Homo sapiens
ctggtgggaggcaaggtggaag

SEQ ID NO: 9146637 - DNA, 22 bp, Homo sapiens
ctggtgggaggcaaggtggaag

SEQ ID NO: 9146638 - DNA, 22 bp, Homo sapiens
ctggtgggaggcaaggtggaag

SEQ ID NO: 9146639 - DNA, 22 bp, Homo sapiens
ctggtgggagataattgaatca

SEQ ID NO: 9146640 - DNA, 22 bp, Homo sapiens
ctggtgggaagatggaaaacat

SEQ ID NO: 9146641 - DNA, 22 bp, Homo sapiens
ctggtggcatcttgagatggtt

SEQ ID NO: 9146642 - DNA, 22 bp, Homo sapiens
ctggtggagatgcctggcccct

SEQ ID NO: 9146643 - DNA, 22 bp, Homo sapiens
ctggtggagatgcctggcccct

SEQ ID NO: 9146644 - DNA, 22 bp, Homo sapiens
ataataaaccaggatgggtctg

SEQ ID NO: 9146645 - DNA, 22 bp, Homo sapiens
ataataactcctgttgaagaac

SEQ ID NO: 9146646 - DNA, 22 bp, Homo sapiens
ataataatgaaagccactgtgt

SEQ ID NO: 9146647 - DNA, 23 bp, Homo sapiens
ataataattatggcagcaaagtg

SEQ ID NO: 9146648 - DNA, 22 bp, Homo sapiens
ctgcctgctctatccaggcctg

SEQ ID NO: 9146649 - DNA, 22 bp, Homo sapiens
ctgcctgctgcctgtggagggt

SEQ ID NO: 9146650 - DNA, 22 bp, Homo sapiens
ctgcctgctgccctccagagcc

SEQ ID NO: 9146651 - DNA, 22 bp, Homo sapiens
ctgcctgctgccctccagagcc

SEQ ID NO: 9146652 - DNA, 22 bp, Homo sapiens
ataagtgactgcagggaattca

SEQ ID NO: 9146653 - DNA, 22 bp, Homo sapiens
ataagtttgtctttgtaaagat

SEQ ID NO: 9146654 - DNA, 22 bp, Homo sapiens
ataagtgctgtgctttaagact

SEQ ID NO: 9146655 - DNA, 22 bp, Homo sapiens
ataagtgcttgttgaataatag

SEQ ID NO: 9146656 - DNA, 22 bp, Homo sapiens
ctgccctgtagctgttctagca

SEQ ID NO: 9146657 - DNA, 22 bp, Homo sapiens
ctgccctgtatcttctcccaat

SEQ ID NO: 9146658 - DNA, 22 bp, Homo sapiens
ctgccctgtgcacaggaaactg

SEQ ID NO: 9146659 - DNA, 22 bp, Homo sapiens
agttttctgcctctggatgcgt

SEQ ID NO: 9146660 - DNA, 22 bp, Homo sapiens
agttttctgcctctggatgcgt

SEQ ID NO: 9146661 - DNA, 21 bp, Homo sapiens
agttttctgagttataaaata

SEQ ID NO: 9146662 - DNA, 21 bp, Homo sapiens
agttttctgagttataaaata

SEQ ID NO: 9146663 - DNA, 22 bp, Homo sapiens
agttttctttcatctatcagca

SEQ ID NO: 9146664 - DNA, 22 bp, Homo sapiens
agttttctttcatctatcagca

SEQ ID NO: 9146665 - DNA, 22 bp, Homo sapiens
agttttctttcatctatcagca

SEQ ID NO: 9146666 - DNA, 22 bp, Homo sapiens
agttttctgttctacaatttga

SEQ ID NO: 9146667 - DNA, 22 bp, Homo sapiens
agttttctgacccctgctctat

SEQ ID NO: 9146668 - DNA, 22 bp, Homo sapiens
agttttctgacccctgctctat

SEQ ID NO: 9146669 - DNA, 22 bp, Homo sapiens
agttttctcacatcaaaaatga

SEQ ID NO: 9146670 - DNA, 22 bp, Homo sapiens
agttttctctgtgttctgctta

SEQ ID NO: 9146671 - DNA, 22 bp, Homo sapiens
agttttcctggtcacagcttgg

SEQ ID NO: 9146672 - DNA, 22 bp, Homo sapiens
agttttcctctcatttatcaat

SEQ ID NO: 9146673 - DNA, 22 bp, Homo sapiens
ctgcccgtccctttgctctcgc

SEQ ID NO: 9146674 - DNA, 22 bp, Homo sapiens
ctgccctctagaggaggactga

SEQ ID NO: 9146675 - DNA, 18 bp, Homo sapiens
ctgccccttctctgagat

SEQ ID NO: 9146676 - DNA, 18 bp, Homo sapiens
ctgccccttctctgagat

SEQ ID NO: 9146677 - DNA, 18 bp, Homo sapiens
ctgccccttctctgagat

SEQ ID NO: 9146678 - DNA, 18 bp, Homo sapiens
ctgcccagagcatttcat

SEQ ID NO: 9146679 - DNA, 22 bp, Homo sapiens
ctgccctcgggccctcccatag

SEQ ID NO: 9146680 - DNA, 22 bp, Homo sapiens
ctgccctgacctgcctcagagt

SEQ ID NO: 9146681 - DNA, 22 bp, Homo sapiens
ctgccctgacctgcctcagagt

SEQ ID NO: 9146682 - DNA, 22 bp, Homo sapiens
agtttctagcaaggattgttga

SEQ ID NO: 9146683 - DNA, 22 bp, Homo sapiens
agtttctctcagtatagaatag

SEQ ID NO: 9146684 - DNA, 22 bp, Homo sapiens
agtttctctagagtctttgaaa

SEQ ID NO: 9146685 - DNA, 22 bp, Homo sapiens
agtttctctagagtctttgaaa

SEQ ID NO: 9146686 - DNA, 22 bp, Homo sapiens
agtttcatattaccatgtcacc

SEQ ID NO: 9146687 - DNA, 21 bp, Homo sapiens
agtttcaggaagttcagctgc

SEQ ID NO: 9146688 - DNA, 22 bp, Homo sapiens
ctgagtctcctggggaggtgaa

SEQ ID NO: 9146689 - DNA, 22 bp, Homo sapiens
agtttctttagatagaaagttc

SEQ ID NO: 9146690 - DNA, 22 bp, Homo sapiens
agtttcttgaagactgatgttt

SEQ ID NO: 9146691 - DNA, 22 bp, Homo sapiens
agtttctttagatagaaagttc

SEQ ID NO: 9146692 - DNA, 22 bp, Homo sapiens
agtttctgtgactcttggcata

SEQ ID NO: 9146693 - DNA, 22 bp, Homo sapiens
agtttctgtgactcttggcata

SEQ ID NO: 9146694 - DNA, 22 bp, Homo sapiens
agtttctcttaatctagtatct

SEQ ID NO: 9146695 - DNA, 22 bp, Homo sapiens
agtttcttcatccaaaaaatgg

SEQ ID NO: 9146696 - DNA, 22 bp, Homo sapiens
agtttcttcatccaaaaaatgg

SEQ ID NO: 9146697 - DNA, 22 bp, Homo sapiens
agtttctgcaaatcatttttat

SEQ ID NO: 9146698 - DNA, 22 bp, Homo sapiens
agtttcttattcttagttatgt

SEQ ID NO: 9146699 - DNA, 22 bp, Homo sapiens
ctgatatggtaactgtgtttct

SEQ ID NO: 9146700 - DNA, 22 bp, Homo sapiens
agttttatgttcacagaaggat

SEQ ID NO: 9146701 - DNA, 22 bp, Homo sapiens
agttttattaaatccacagaag

SEQ ID NO: 9146702 - DNA, 22 bp, Homo sapiens
ctgataatgtcctgcagtaaat

SEQ ID NO: 9146703 - DNA, 22 bp, Homo sapiens
ctgagtgggtttctgcttgtca

SEQ ID NO: 9146704 - DNA, 22 bp, Homo sapiens
ctgatatgatgggtgattttca

SEQ ID NO: 9146705 - DNA, 22 bp, Homo sapiens
ctgatacatagtagcatgtcat

SEQ ID NO: 9146706 - DNA, 22 bp, Homo sapiens
ctgatacactccctaaaatata

SEQ ID NO: 9146707 - DNA, 22 bp, Homo sapiens
agtttattctgcttggccctcc

SEQ ID NO: 9146708 - DNA, 22 bp, Homo sapiens
agtttattctctggtcttagta

SEQ ID NO: 9146709 - DNA, 22 bp, Homo sapiens
agtttattctctggtcttagta

SEQ ID NO: 9146710 - DNA, 20 bp, Homo sapiens
agtttattccaggagaactg

SEQ ID NO: 9146711 - DNA, 22 bp, Homo sapiens
agtttattctctggtcttagta

SEQ ID NO: 9146712 - DNA, 20 bp, Homo sapiens
agtttattccaggagaactg

SEQ ID NO: 9146713 - DNA, 22 bp, Homo sapiens
agtttattgtatatggtagttt

SEQ ID NO: 9146714 - DNA, 17 bp, Homo sapiens
agtttatttagccttct

SEQ ID NO: 9146715 - DNA, 17 bp, Homo sapiens
agtttatttagccttct

SEQ ID NO: 9146716 - DNA, 22 bp, Homo sapiens
agtttattctgcttggccctcc

SEQ ID NO: 9146717 - DNA, 22 bp, Homo sapiens
agtttattctgcttggccctcc

SEQ ID NO: 9146718 - DNA, 22 bp, Homo sapiens
agtttattctgcttggccctcc

SEQ ID NO: 9146719 - DNA, 22 bp, Homo sapiens
agtttattgtatatggtagttt

SEQ ID NO: 9146720 - DNA, 22 bp, Homo sapiens
agtttcacacaacatttgcatg

SEQ ID NO: 9146721 - DNA, 22 bp, Homo sapiens
agtttcacaaattgtcaatagc

SEQ ID NO: 9146722 - DNA, 22 bp, Homo sapiens
agtttcaaattactgcccatgg

SEQ ID NO: 9146723 - DNA, 22 bp, Homo sapiens
agtttatttttgataagtcttg

SEQ ID NO: 9146724 - DNA, 22 bp, Homo sapiens
agtttatttttgataagtcttg

SEQ ID NO: 9146725 - DNA, 22 bp, Homo sapiens
agtttatttttgataagtcttg

SEQ ID NO: 9146726 - DNA, 22 bp, Homo sapiens
agtttatttctccatttaccta

SEQ ID NO: 9146727 - DNA, 22 bp, Homo sapiens
agtttatttctccatttaccta

SEQ ID NO: 9146728 - DNA, 22 bp, Homo sapiens
agtttatttctccatttaccta

SEQ ID NO: 9146729 - DNA, 22 bp, Homo sapiens
agtttatttctccatttaccta

SEQ ID NO: 9146730 - DNA, 17 bp, Homo sapiens
agtttatttagccttct

SEQ ID NO: 9146731 - DNA, 17 bp, Homo sapiens
agtttatttagccttct

SEQ ID NO: 9146732 - DNA, 20 bp, Homo sapiens
agtgttccggaagactggca

SEQ ID NO: 9146733 - DNA, 22 bp, Homo sapiens
agtgttccacacatctggggaa

SEQ ID NO: 9146734 - DNA, 22 bp, Homo sapiens
agtgttcatttattcattcact

SEQ ID NO: 9146735 - DNA, 22 bp, Homo sapiens
agtgttcagtgattgtcaaccg

SEQ ID NO: 9146736 - DNA, 19 bp, Homo sapiens
agtttattataggtgattc

SEQ ID NO: 9146737 - DNA, 19 bp, Homo sapiens
agtttattataggtgattc

SEQ ID NO: 9146738 - DNA, 19 bp, Homo sapiens
agtttattataggtgattc

SEQ ID NO: 9146739 - DNA, 22 bp, Homo sapiens
ctgagaggcggaggttgcagtg

SEQ ID NO: 9146740 - DNA, 21 bp, Homo sapiens
agtgttaatggaaattatatt

SEQ ID NO: 9146741 - DNA, 18 bp, Homo sapiens
agtgttaagtaagtagca

SEQ ID NO: 9146742 - DNA, 22 bp, Homo sapiens
agtgttaatggtgtatattagg

SEQ ID NO: 9146743 - DNA, 22 bp, Homo sapiens
agtgttattgaggcaaaactgt

SEQ ID NO: 9146744 - DNA, 22 bp, Homo sapiens
ctggaaagttcaagataaagct

SEQ ID NO: 9146745 - DNA, 19 bp, Homo sapiens
ctggaaagttggcagtgag

SEQ ID NO: 9146746 - DNA, 22 bp, Homo sapiens
ctggaaatcactactagtcaat

SEQ ID NO: 9146747 - DNA, 22 bp, Homo sapiens
ctggaacaagtggccttgcaag

SEQ ID NO: 9146748 - DNA, 22 bp, Homo sapiens
ctggaaattggagatgatgttt

SEQ ID NO: 9146749 - DNA, 21 bp, Homo sapiens
ctggaagaagcagcaggattc

SEQ ID NO: 9146750 - DNA, 22 bp, Homo sapiens
atacatctatgcctttctgaca

SEQ ID NO: 9146751 - DNA, 22 bp, Homo sapiens
atacatatatggtacttcctgg

SEQ ID NO: 9146752 - DNA, 22 bp, Homo sapiens
ctggagctgccagggctgccgc

SEQ ID NO: 9146753 - DNA, 22 bp, Homo sapiens
ctggagctggcccaggctggcc

SEQ ID NO: 9146754 - DNA, 22 bp, Homo sapiens
ctggagctggcccaggctggcc

SEQ ID NO: 9146755 - DNA, 22 bp, Homo sapiens
ctggagctggcttccttccact

SEQ ID NO: 9146756 - DNA, 22 bp, Homo sapiens
ctggagctggtatagggacaaa

SEQ ID NO: 9146757 - DNA, 22 bp, Homo sapiens
atacatctctttgaagtgcttt

SEQ ID NO: 9146758 - DNA, 22 bp, Homo sapiens
atacatctcatgtaagagataa

SEQ ID NO: 9146759 - DNA, 22 bp, Homo sapiens
atacatcttccttttaaaatgc

SEQ ID NO: 9146760 - DNA, 22 bp, Homo sapiens
atacatgactcacacattctgc

SEQ ID NO: 9146761 - DNA, 22 bp, Homo sapiens
atacatcttgtcagattcatgt

SEQ ID NO: 9146762 - DNA, 22 bp, Homo sapiens
ataatgtgatatttcatttaca

SEQ ID NO: 9146763 - DNA, 22 bp, Homo sapiens
ataatgtaggctcctgggagaa

SEQ ID NO: 9146764 - DNA, 22 bp, Homo sapiens
ataatggccgggggctgaatgc

SEQ ID NO: 9146765 - DNA, 21 bp, Homo sapiens
ataatgtacaaaaactgtctt

SEQ ID NO: 9146766 - DNA, 22 bp, Homo sapiens
ataattaatttcagtaatctcc

SEQ ID NO: 9146767 - DNA, 20 bp, Homo sapiens
ataattacatagagattgcc

SEQ ID NO: 9146768 - DNA, 22 bp, Homo sapiens
ataattacattatactgttaga

SEQ ID NO: 9146769 - DNA, 22 bp, Homo sapiens
ataattaatttcagtaatctcc

SEQ ID NO: 9146770 - DNA, 22 bp, Homo sapiens
ataattaatttcagtaatctcc

SEQ ID NO: 9146771 - DNA, 22 bp, Homo sapiens
ataatttaaattagtatgtgat

SEQ ID NO: 9146772 - DNA, 22 bp, Homo sapiens
ataatttaaattagtatgtgat

SEQ ID NO: 9146773 - DNA, 22 bp, Homo sapiens
ataattgatgaggctttggaca

SEQ ID NO: 9146774 - DNA, 22 bp, Homo sapiens
atacacttgtacattttttaat

SEQ ID NO: 9146775 - DNA, 22 bp, Homo sapiens
atacactttagaaaaacgctgc

SEQ ID NO: 9146776 - DNA, 20 bp, Homo sapiens
atacacattcatagaaaaat

SEQ ID NO: 9146777 - DNA, 22 bp, Homo sapiens
atacactttagaaaaacgctgc

SEQ ID NO: 9146778 - DNA, 20 bp, Homo sapiens
ataatttaccctgcaccact

SEQ ID NO: 9146779 - DNA, 20 bp, Homo sapiens
ataatttaccctgcaccact

SEQ ID NO: 9146780 - DNA, 20 bp, Homo sapiens
ataatttaccctgcaccact

SEQ ID NO: 9146781 - DNA, 22 bp, Homo sapiens
ataatttacaactgcttttaat

SEQ ID NO: 9146782 - DNA, 22 bp, Homo sapiens
ataatttacaactgcttttaat

SEQ ID NO: 9146783 - DNA, 22 bp, Homo sapiens
ataatttacaactgcttttaat

SEQ ID NO: 9146784 - DNA, 22 bp, Homo sapiens
ataatttaattttcacagtggt

SEQ ID NO: 9146785 - DNA, 22 bp, Homo sapiens
ataatttaattttcacagtggt

SEQ ID NO: 9146786 - DNA, 22 bp, Homo sapiens
ataatttaattttcacagtggt

SEQ ID NO: 9146787 - DNA, 21 bp, Homo sapiens
ctggagcttggtgagaagtgt

SEQ ID NO: 9146788 - DNA, 22 bp, Homo sapiens
ctggagcttattgggagcagaa

SEQ ID NO: 9146789 - DNA, 22 bp, Homo sapiens
ctggagcttattgggagcagaa

SEQ ID NO: 9146790 - DNA, 22 bp, Homo sapiens
ctggccagaggttcctctgccc

SEQ ID NO: 9146791 - DNA, 22 bp, Homo sapiens
ctggccaggttttgaacagttg

SEQ ID NO: 9146792 - DNA, 22 bp, Homo sapiens
ctggccagtgcctgtgggcccc

SEQ ID NO: 9146793 - DNA, 22 bp, Homo sapiens
atagaaaacagatgtccttaaa

SEQ ID NO: 9146794 - DNA, 22 bp, Homo sapiens
atagaaacagatgcacttctct

SEQ ID NO: 9146795 - DNA, 19 bp, Homo sapiens
atagaaagggttaaagaca

SEQ ID NO: 9146796 - DNA, 22 bp, Homo sapiens
atagaaatggcagctggtgcta

SEQ ID NO: 9146797 - DNA, 22 bp, Homo sapiens
atagtacaatcagttaattagt

SEQ ID NO: 9146798 - DNA, 22 bp, Homo sapiens
atagtacaagggaagagtgaag

SEQ ID NO: 9146799 - DNA, 22 bp, Homo sapiens
atagtacaatcagttaattagt

SEQ ID NO: 9146800 - DNA, 22 bp, Homo sapiens
atagtacacatcctacaatgtt

SEQ ID NO: 9146801 - DNA, 22 bp, Homo sapiens
atagtaaattatcgtggagaga

SEQ ID NO: 9146802 - DNA, 22 bp, Homo sapiens
ataggggcagatgaggaatggg

SEQ ID NO: 9146803 - DNA, 22 bp, Homo sapiens
atagggcctaaaaagtattgct

SEQ ID NO: 9146804 - DNA, 22 bp, Homo sapiens
ataggtccaaggagaggtcttt

SEQ ID NO: 9146805 - DNA, 22 bp, Homo sapiens
atagacattttgcattcaagca

SEQ ID NO: 9146806 - DNA, 22 bp, Homo sapiens
atagcagtgacattttaatgtg

SEQ ID NO: 9146807 - DNA, 22 bp, Homo sapiens
ataggcaagcacaaagtcagga

SEQ ID NO: 9146808 - DNA, 22 bp, Homo sapiens
ataggctgtaataattcacatt

SEQ ID NO: 9146809 - DNA, 22 bp, Homo sapiens
ataggccagatatgctcgcagt

SEQ ID NO: 9146810 - DNA, 22 bp, Homo sapiens
ataggccagtgtcctttcttaa

SEQ ID NO: 9146811 - DNA, 22 bp, Homo sapiens
ataggccaatactgtagagttt

SEQ ID NO: 9146812 - DNA, 22 bp, Homo sapiens
ataggccatttgagggccaggt

SEQ ID NO: 9146813 - DNA, 22 bp, Homo sapiens
atagaatttgcactaaatctgc

SEQ ID NO: 9146814 - DNA, 22 bp, Homo sapiens
atagaattacagtgtgtttgga

SEQ ID NO: 9146815 - DNA, 22 bp, Homo sapiens
atagaattatggaaagcatctt

SEQ ID NO: 9146816 - DNA, 20 bp, Homo sapiens
atagacaaagacatgccaga

SEQ ID NO: 9146817 - DNA, 22 bp, Homo sapiens
atagacaatcccccatcctacc

SEQ ID NO: 9146818 - DNA, 22 bp, Homo sapiens
atagacatatggctttgtttct

SEQ ID NO: 9146819 - DNA, 22 bp, Homo sapiens
caagaaattctgttcagatagc

SEQ ID NO: 9146820 - DNA, 22 bp, Homo sapiens
caagaacattgtgatcacttca

SEQ ID NO: 9146821 - DNA, 17 bp, Homo sapiens
gctgcctgcaactgact

SEQ ID NO: 9146822 - DNA, 22 bp, Homo sapiens
gctgcctgcacagagctgcttt

SEQ ID NO: 9146823 - DNA, 22 bp, Homo sapiens
gctgcctgatgtccagcaggac

SEQ ID NO: 9146824 - DNA, 22 bp, Homo sapiens
gctgcctgatgtccagcaggac

SEQ ID NO: 9146825 - DNA, 22 bp, Homo sapiens
caagaaatgtttactgagcatc

SEQ ID NO: 9146826 - DNA, 22 bp, Homo sapiens
caagaaatgggatttgactgcc

SEQ ID NO: 9146827 - DNA, 22 bp, Homo sapiens
caagaaatctagaagtcagtgg

SEQ ID NO: 9146828 - DNA, 22 bp, Homo sapiens
caagaaatctagaagtcagtgg

SEQ ID NO: 9146829 - DNA, 22 bp, Homo sapiens
caacacattgaagctatgatga

SEQ ID NO: 9146830 - DNA, 22 bp, Homo sapiens
caacaatttcccagtttcccat

SEQ ID NO: 9146831 - DNA, 22 bp, Homo sapiens
caacacaggggttatgccatgg

SEQ ID NO: 9146832 - DNA, 22 bp, Homo sapiens
caacactgacaatggactgatt

SEQ ID NO: 9146833 - DNA, 22 bp, Homo sapiens
caactatagatcaaatgagttt

SEQ ID NO: 9146834 - DNA, 22 bp, Homo sapiens
caactatagatcaaatgagttt

SEQ ID NO: 9146835 - DNA, 22 bp, Homo sapiens
caacaagcgctcagagcaaagc

SEQ ID NO: 9146836 - DNA, 22 bp, Homo sapiens
gctgccctgtctgcagcaggac

SEQ ID NO: 9146837 - DNA, 22 bp, Homo sapiens
caaatttaggtaacagtctgta

SEQ ID NO: 9146838 - DNA, 22 bp, Homo sapiens
gctgccctgtccggctctcctg

SEQ ID NO: 9146839 - DNA, 22 bp, Homo sapiens
gctgccctccagttcccacagt

SEQ ID NO: 9146840 - DNA, 18 bp, Homo sapiens
gctgccctagctcccctc

SEQ ID NO: 9146841 - DNA, 22 bp, Homo sapiens
gctgccacgaggtttccttatc

SEQ ID NO: 9146842 - DNA, 17 bp, Homo sapiens
gctgccacctttggagc

SEQ ID NO: 9146843 - DNA, 22 bp, Homo sapiens
gctgccacgaggtttccttatc

SEQ ID NO: 9146844 - DNA, 22 bp, Homo sapiens
caaagtgagagaatggcagaaa

SEQ ID NO: 9146845 - DNA, 22 bp, Homo sapiens
gctgccctctgtgtttgtcctt

SEQ ID NO: 9146846 - DNA, 22 bp, Homo sapiens
gctgccctgacaagctactccc

SEQ ID NO: 9146847 - DNA, 22 bp, Homo sapiens
gctgccctctctggccccacac

SEQ ID NO: 9146848 - DNA, 22 bp, Homo sapiens
gctgccctctgtgacccggccc

SEQ ID NO: 9146849 - DNA, 21 bp, Homo sapiens
gctgccctggctcagcattca

SEQ ID NO: 9146850 - DNA, 22 bp, Homo sapiens
gctgccctgcatctgtgccttc

SEQ ID NO: 9146851 - DNA, 22 bp, Homo sapiens
gctgccctgcctcagactcctc

SEQ ID NO: 9146852 - DNA, 22 bp, Homo sapiens
gctctgcttgcatcatgactgc

SEQ ID NO: 9146853 - DNA, 22 bp, Homo sapiens
gctctggaacctgccaggatgc

SEQ ID NO: 9146854 - DNA, 22 bp, Homo sapiens
gctctggaccctgccagcctta

SEQ ID NO: 9146855 - DNA, 22 bp, Homo sapiens
gctctggaagcatctgagagga

SEQ ID NO: 9146856 - DNA, 22 bp, Homo sapiens
gctctggactggggcctgagaa

SEQ ID NO: 9146857 - DNA, 22 bp, Homo sapiens
gctctggaccctggagtggctg

SEQ ID NO: 9146858 - DNA, 22 bp, Homo sapiens
gctctggaccctggagtggctg

SEQ ID NO: 9146859 - DNA, 22 bp, Homo sapiens
gctctggagagccataggccct

SEQ ID NO: 9146860 - DNA, 22 bp, Homo sapiens
gctctggagatggagccttgag

SEQ ID NO: 9146861 - DNA, 22 bp, Homo sapiens
gctctggagcactggaaacact

SEQ ID NO: 9146862 - DNA, 22 bp, Homo sapiens
caaagtcatggggatgcaggtc

SEQ ID NO: 9146863 - DNA, 22 bp, Homo sapiens
caaagtcttcagttgattctga

SEQ ID NO: 9146864 - DNA, 17 bp, Homo sapiens
gctctggcacaggattg

SEQ ID NO: 9146865 - DNA, 22 bp, Homo sapiens
caaagtcagccagctagtaggt

SEQ ID NO: 9146866 - DNA, 22 bp, Homo sapiens
gctctggatccggctgggtctg

SEQ ID NO: 9146867 - DNA, 23 bp, Homo sapiens
gctctggagctgggcctggcagg

SEQ ID NO: 9146868 - DNA, 23 bp, Homo sapiens
gctctggagctgggcctggcagg

SEQ ID NO: 9146869 - DNA, 23 bp, Homo sapiens
gctctggagctgggcctggcagg

SEQ ID NO: 9146870 - DNA, 22 bp, Homo sapiens
gctggagaaacaggaggaggaa

SEQ ID NO: 9146871 - DNA, 22 bp, Homo sapiens
caagaagtgtcagctttttaaa

SEQ ID NO: 9146872 - DNA, 22 bp, Homo sapiens
caagaaggctatatgggccagg

SEQ ID NO: 9146873 - DNA, 22 bp, Homo sapiens
gctggactcaggggactcaggg

SEQ ID NO: 9146874 - DNA, 22 bp, Homo sapiens
gctggaccaggtgtgcacaggc

SEQ ID NO: 9146875 - DNA, 22 bp, Homo sapiens
caagacaagatctaagcatgct

SEQ ID NO: 9146876 - DNA, 22 bp, Homo sapiens
gctgctttgtctgtaaaatgga

SEQ ID NO: 9146877 - DNA, 22 bp, Homo sapiens
gctggaaatcaaagaagtggat

SEQ ID NO: 9146878 - DNA, 18 bp, Homo sapiens
gctgcctgcattcctcac

SEQ ID NO: 9146879 - DNA, 21 bp, Homo sapiens
gctgcctgcccctcgggggct

SEQ ID NO: 9146880 - DNA, 22 bp, Homo sapiens
gctgcctgcctagttccacagt

SEQ ID NO: 9146881 - DNA, 22 bp, Homo sapiens
gctgctggccccacatgctcca

SEQ ID NO: 9146882 - DNA, 22 bp, Homo sapiens
gctgcctgccttgcctggagga

SEQ ID NO: 9146883 - DNA, 22 bp, Homo sapiens
gctgctggccgcccagcttctc

SEQ ID NO: 9146884 - DNA, 22 bp, Homo sapiens
caagccctgttaggggtctcta

SEQ ID NO: 9146885 - DNA, 22 bp, Homo sapiens
caagcccagatcctgcgtgtct

SEQ ID NO: 9146886 - DNA, 22 bp, Homo sapiens
caagcccactgctcagagccaa

SEQ ID NO: 9146887 - DNA, 22 bp, Homo sapiens
gctggctgaggtctagctcttt

SEQ ID NO: 9146888 - DNA, 22 bp, Homo sapiens
gctggctgaggtctagctcttt

SEQ ID NO: 9146889 - DNA, 22 bp, Homo sapiens
gctggctgaggtctagctcttt

SEQ ID NO: 9146890 - DNA, 22 bp, Homo sapiens
gctggctgagttctgtcgtctg

SEQ ID NO: 9146891 - DNA, 22 bp, Homo sapiens
gctggctgagttctgtcgtctg

SEQ ID NO: 9146892 - DNA, 22 bp, Homo sapiens
gctggctctttttgccgggctc

SEQ ID NO: 9146893 - DNA, 22 bp, Homo sapiens
gctggctctttttgccgggctc

SEQ ID NO: 9146894 - DNA, 22 bp, Homo sapiens
gctggcccagggtcacctagga

SEQ ID NO: 9146895 - DNA, 22 bp, Homo sapiens
gctggctcttcagtggagatag

SEQ ID NO: 9146896 - DNA, 17 bp, Homo sapiens
gctggctgacccatgcc

SEQ ID NO: 9146897 - DNA, 22 bp, Homo sapiens
gctggctgaatcttctgcaata

SEQ ID NO: 9146898 - DNA, 17 bp, Homo sapiens
gctggctgacccatgcc

SEQ ID NO: 9146899 - DNA, 22 bp, Homo sapiens
gctggctgagatctgttttcct

SEQ ID NO: 9146900 - DNA, 22 bp, Homo sapiens
caagctctgcgggctccaagat

SEQ ID NO: 9146901 - DNA, 22 bp, Homo sapiens
caagctccttacatccacaggg

SEQ ID NO: 9146902 - DNA, 22 bp, Homo sapiens
caagctgcagcgcctgcgccgg

SEQ ID NO: 9146903 - DNA, 22 bp, Homo sapiens
gctgggctcaccaggccactag

SEQ ID NO: 9146904 - DNA, 22 bp, Homo sapiens
gctgggctcaccaggccactag

SEQ ID NO: 9146905 - DNA, 22 bp, Homo sapiens
gctgggctcaccaggccactag

SEQ ID NO: 9146906 - DNA, 22 bp, Homo sapiens
gctgggcttggtttccctgctt

SEQ ID NO: 9146907 - DNA, 22 bp, Homo sapiens
gctggggaccagctgtctctga

SEQ ID NO: 9146908 - DNA, 22 bp, Homo sapiens
gctggggaccagctgtctctga

SEQ ID NO: 9146909 - DNA, 22 bp, Homo sapiens
gctggggaccagctgtctctga

SEQ ID NO: 9146910 - DNA, 22 bp, Homo sapiens
gctgggcttgtggccagctggg

SEQ ID NO: 9146911 - DNA, 22 bp, Homo sapiens
gctgggcttgtggccagctggg

SEQ ID NO: 9146912 - DNA, 20 bp, Homo sapiens
gctgggctttgactgacaca

SEQ ID NO: 9146913 - DNA, 22 bp, Homo sapiens
gctggggactccccaccatagc

SEQ ID NO: 9146914 - DNA, 22 bp, Homo sapiens
gctggggagcaagagtagtgag

SEQ ID NO: 9146915 - DNA, 22 bp, Homo sapiens
gctggggagaattgggttatct

SEQ ID NO: 9146916 - DNA, 22 bp, Homo sapiens
gctggggagcaagagtagtgag

SEQ ID NO: 9146917 - DNA, 22 bp, Homo sapiens
ggagagatggaaaacctcccag

SEQ ID NO: 9146918 - DNA, 22 bp, Homo sapiens
ggagagatggtaaccctggggc

SEQ ID NO: 9146919 - DNA, 20 bp, Homo sapiens
ggagagccacatagtctccc

SEQ ID NO: 9146920 - DNA, 22 bp, Homo sapiens
ggagaagggacagactcagctt

SEQ ID NO: 9146921 - DNA, 22 bp, Homo sapiens
ggagaagggacagactcagctt

SEQ ID NO: 9146922 - DNA, 22 bp, Homo sapiens
ggagaaggtgctggtcactgtg

SEQ ID NO: 9146923 - DNA, 22 bp, Homo sapiens
ggagaaggtgctggtcactgtg

SEQ ID NO: 9146924 - DNA, 22 bp, Homo sapiens
ggagaaggtgctggtcactgtg

SEQ ID NO: 9146925 - DNA, 22 bp, Homo sapiens
cacacaggatgaagcagcagaa

SEQ ID NO: 9146926 - DNA, 22 bp, Homo sapiens
cacacaggcaggatcccttccc

SEQ ID NO: 9146927 - DNA, 22 bp, Homo sapiens
cacacaggatgaagcagcagaa

SEQ ID NO: 9146928 - DNA, 22 bp, Homo sapiens
cacacaggtaagcctctttcaa

SEQ ID NO: 9146929 - DNA, 22 bp, Homo sapiens
ggaccagctatcaatgccaggg

SEQ ID NO: 9146930 - DNA, 22 bp, Homo sapiens
cacacaggatgaagcagcagaa

SEQ ID NO: 9146931 - DNA, 22 bp, Homo sapiens
ggaccagagctcgggcttctca

SEQ ID NO: 9146932 - DNA, 22 bp, Homo sapiens
ggaccagagaagtgagcacctg

SEQ ID NO: 9146933 - DNA, 22 bp, Homo sapiens
ggaccagagaagtgagcacctg

SEQ ID NO: 9146934 - DNA, 22 bp, Homo sapiens
ggaccagatgaagagttggagg

SEQ ID NO: 9146935 - DNA, 22 bp, Homo sapiens
ggaccagcaatcaagaacctac

SEQ ID NO: 9146936 - DNA, 22 bp, Homo sapiens
ggagaaggcacacccacctctg

SEQ ID NO: 9146937 - DNA, 22 bp, Homo sapiens
ggactgggtaggagcccagggc

SEQ ID NO: 9146938 - DNA, 22 bp, Homo sapiens
cacacagtaggcactcattaat

SEQ ID NO: 9146939 - DNA, 21 bp, Homo sapiens
cacacagtgatctatccacat

SEQ ID NO: 9146940 - DNA, 22 bp, Homo sapiens
ggaagagcctggggtgtcaggc

SEQ ID NO: 9146941 - DNA, 22 bp, Homo sapiens
ggaagagctgcttagttttgat

SEQ ID NO: 9146942 - DNA, 22 bp, Homo sapiens
ggaagctgaacttagcaaggaa

SEQ ID NO: 9146943 - DNA, 22 bp, Homo sapiens
ggaagctccccaagcctgccct

SEQ ID NO: 9146944 - DNA, 23 bp, Homo sapiens
ggaagctcacgtagtcctgcact

SEQ ID NO: 9146945 - DNA, 22 bp, Homo sapiens
ggaagctgggatctctctcccg

SEQ ID NO: 9146946 - DNA, 22 bp, Homo sapiens
cacaaataccagtttcctaaca

SEQ ID NO: 9146947 - DNA, 22 bp, Homo sapiens
cacaaataccagtttcctaaca

SEQ ID NO: 9146948 - DNA, 22 bp, Homo sapiens
cacaaatgactgaaacgactgt

SEQ ID NO: 9146949 - DNA, 23 bp, Homo sapiens
cacaactaatcagaatctctagg

SEQ ID NO: 9146950 - DNA, 22 bp, Homo sapiens
cacaaatggttgtagacattaa

SEQ ID NO: 9146951 - DNA, 20 bp, Homo sapiens
cacaactgtccacatgctcc

SEQ ID NO: 9146952 - DNA, 22 bp, Homo sapiens
cacaactgccatctgagcagca

SEQ ID NO: 9146953 - DNA, 20 bp, Homo sapiens
ggacaggaagacaacctacc

SEQ ID NO: 9146954 - DNA, 22 bp, Homo sapiens
ggacatttagaacagagtattt

SEQ ID NO: 9146955 - DNA, 22 bp, Homo sapiens
ggacatttagtttcattgggca

SEQ ID NO: 9146956 - DNA, 22 bp, Homo sapiens
ggacatttctattgagctaaga

SEQ ID NO: 9146957 - DNA, 22 bp, Homo sapiens
ggacatttgcacctacctcagc

SEQ ID NO: 9146958 - DNA, 22 bp, Homo sapiens
ggacatttttcttcctacaatg

SEQ ID NO: 9146959 - DNA, 22 bp, Homo sapiens
ggaccacaatatttgtgaggtt

SEQ ID NO: 9146960 - DNA, 22 bp, Homo sapiens
ggacattgaagctggaaaggga

SEQ ID NO: 9146961 - DNA, 22 bp, Homo sapiens
ggacatgttccttttcatcttt

SEQ ID NO: 9146962 - DNA, 22 bp, Homo sapiens
caatagttcggtcctgaaggcc

SEQ ID NO: 9146963 - DNA, 22 bp, Homo sapiens
caatagtaaattacggaggaga

SEQ ID NO: 9146964 - DNA, 22 bp, Homo sapiens
caatagtaaattacggaggaga

SEQ ID NO: 9146965 - DNA, 22 bp, Homo sapiens
caatagcaggtctacagagaga

SEQ ID NO: 9146966 - DNA, 22 bp, Homo sapiens
caatatataggaacaacttagg

SEQ ID NO: 9146967 - DNA, 19 bp, Homo sapiens
caatatatagtgagtggat

SEQ ID NO: 9146968 - DNA, 22 bp, Homo sapiens
caatagaaggcacagataggta

SEQ ID NO: 9146969 - DNA, 22 bp, Homo sapiens
caatagaaaactcaatacttaa

SEQ ID NO: 9146970 - DNA, 22 bp, Homo sapiens
caatagaaaactcaatacttaa

SEQ ID NO: 9146971 - DNA, 22 bp, Homo sapiens
caatagaaaactcaatacttaa

SEQ ID NO: 9146972 - DNA, 22 bp, Homo sapiens
gctggggagctagacctcagca

SEQ ID NO: 9146973 - DNA, 22 bp, Homo sapiens
gctggggagctagacctcagca

SEQ ID NO: 9146974 - DNA, 22 bp, Homo sapiens
gctggggagctagacctcagca

SEQ ID NO: 9146975 - DNA, 22 bp, Homo sapiens
gctggggaggcagcagagaaca

SEQ ID NO: 9146976 - DNA, 22 bp, Homo sapiens
caaggccttgctgtctcctcct

SEQ ID NO: 9146977 - DNA, 22 bp, Homo sapiens
caaggccttgctgtctcctcct

SEQ ID NO: 9146978 - DNA, 22 bp, Homo sapiens
caaggctgctggcttctgagct

SEQ ID NO: 9146979 - DNA, 22 bp, Homo sapiens
caaggctgctgcgggtcgcacc

SEQ ID NO: 9146980 - DNA, 22 bp, Homo sapiens
caaggctgctgcgggtcgcacc

SEQ ID NO: 9146981 - DNA, 22 bp, Homo sapiens
caaggctgtctccagcttccaa

SEQ ID NO: 9146982 - DNA, 22 bp, Homo sapiens
caaggctgtctccagcttccaa

SEQ ID NO: 9146983 - DNA, 22 bp, Homo sapiens
caaggctgtgcagggtccatat

SEQ ID NO: 9146984 - DNA, 22 bp, Homo sapiens
caaggctgctggcttctgagct

SEQ ID NO: 9146985 - DNA, 22 bp, Homo sapiens
caataactttgatattttgcgg

SEQ ID NO: 9146986 - DNA, 22 bp, Homo sapiens
caaggctgtgttagctgccctc

SEQ ID NO: 9146987 - DNA, 22 bp, Homo sapiens
caatactgagtttacattcatc

SEQ ID NO: 9146988 - DNA, 22 bp, Homo sapiens
caatactgggcaggagagtaca

SEQ ID NO: 9146989 - DNA, 22 bp, Homo sapiens
caatactgcatctttgcccttt

SEQ ID NO: 9146990 - DNA, 22 bp, Homo sapiens
caattcttggagaagaagcata

SEQ ID NO: 9146991 - DNA, 22 bp, Homo sapiens
caattgaacagatgagttaaat

SEQ ID NO: 9146992 - DNA, 22 bp, Homo sapiens
caattgacaatgacagtgtcaa

SEQ ID NO: 9146993 - DNA, 22 bp, Homo sapiens
caattctttgtagaagctctcc

SEQ ID NO: 9146994 - DNA, 22 bp, Homo sapiens
caattgctttgtggaagccttt

SEQ ID NO: 9146995 - DNA, 22 bp, Homo sapiens
caatttcaagattctgttcttt

SEQ ID NO: 9146996 - DNA, 22 bp, Homo sapiens
caatcactccacaatatggttc

SEQ ID NO: 9146997 - DNA, 22 bp, Homo sapiens
caatgttttgttgaatgaatag

SEQ ID NO: 9146998 - DNA, 22 bp, Homo sapiens
caatttcaatacaaaatacatt

SEQ ID NO: 9146999 - DNA, 22 bp, Homo sapiens
caatttcactaataatatttac

SEQ ID NO: 9147000 - DNA, 22 bp, Homo sapiens
caatttcactaataatatttac

SEQ ID NO: 9147001 - DNA, 22 bp, Homo sapiens
caattgtcagtgctgtttaaat

SEQ ID NO: 9147002 - DNA, 22 bp, Homo sapiens
caatttcagtgctgtggagagg

SEQ ID NO: 9147003 - DNA, 23 bp, Homo sapiens
caatttcatatgattctacctaa

SEQ ID NO: 9147004 - DNA, 22 bp, Homo sapiens
caatttcagtctcagagagttc

SEQ ID NO: 9147005 - DNA, 22 bp, Homo sapiens
caatttcagtgctgtggagagg

SEQ ID NO: 9147006 - DNA, 22 bp, Homo sapiens
caatttcatcttgtgcttcaat

SEQ ID NO: 9147007 - DNA, 22 bp, Homo sapiens
caatttctaacattccatggat

SEQ ID NO: 9147008 - DNA, 22 bp, Homo sapiens
caccaggataaaacctctagat

SEQ ID NO: 9147009 - DNA, 22 bp, Homo sapiens
caccaggagtgagaatgaaggg

SEQ ID NO: 9147010 - DNA, 22 bp, Homo sapiens
caccaggcacatagtaggcact

SEQ ID NO: 9147011 - DNA, 22 bp, Homo sapiens
caccaggcacagctctcctgct

SEQ ID NO: 9147012 - DNA, 22 bp, Homo sapiens
caccaggctgaaccagagggga

SEQ ID NO: 9147013 - DNA, 22 bp, Homo sapiens
caccaggctggagtgcagaggt

SEQ ID NO: 9147014 - DNA, 22 bp, Homo sapiens
caccaggctgcccaggacaggg

SEQ ID NO: 9147015 - DNA, 22 bp, Homo sapiens
caccaggctgcccaggacaggg

SEQ ID NO: 9147016 - DNA, 22 bp, Homo sapiens
caccaggctgcccaggacaggg

SEQ ID NO: 9147017 - DNA, 22 bp, Homo sapiens
caccaggctgaaccagagggga

SEQ ID NO: 9147018 - DNA, 22 bp, Homo sapiens
caccaggctgagcctctcatct

SEQ ID NO: 9147019 - DNA, 22 bp, Homo sapiens
caccaggctggagtgcagaggt

SEQ ID NO: 9147020 - DNA, 22 bp, Homo sapiens
caccctgggctgggcctgttaa

SEQ ID NO: 9147021 - DNA, 22 bp, Homo sapiens
cacctgcctgctagagcctgac

SEQ ID NO: 9147022 - DNA, 22 bp, Homo sapiens
cacctgcctgcaggggctccac

SEQ ID NO: 9147023 - DNA, 22 bp, Homo sapiens
cacctgccctttcttgctccac

SEQ ID NO: 9147024 - DNA, 22 bp, Homo sapiens
cacctgccccagtcttggagct

SEQ ID NO: 9147025 - DNA, 22 bp, Homo sapiens
ggccaggctggttccttgacct

SEQ ID NO: 9147026 - DNA, 22 bp, Homo sapiens
ggccaggctgctgggaccccgc

SEQ ID NO: 9147027 - DNA, 22 bp, Homo sapiens
ggccaggctggtctcagacttc

SEQ ID NO: 9147028 - DNA, 22 bp, Homo sapiens
ggccaggctgctgggaccccgc

SEQ ID NO: 9147029 - DNA, 22 bp, Homo sapiens
ggccaggctgccctgggagcag

SEQ ID NO: 9147030 - DNA, 22 bp, Homo sapiens
ggccaggctgccctgggagcag

SEQ ID NO: 9147031 - DNA, 22 bp, Homo sapiens
cacctgggctaaactatgcagg

SEQ ID NO: 9147032 - DNA, 23 bp, Homo sapiens
cacctggcttgagttggtgggtc

SEQ ID NO: 9147033 - DNA, 20 bp, Homo sapiens
cacctggctgactgtctcca

SEQ ID NO: 9147034 - DNA, 22 bp, Homo sapiens
cacctggctgtgaagcctgggt

SEQ ID NO: 9147035 - DNA, 22 bp, Homo sapiens
cacctggctggaagtgctccgg

SEQ ID NO: 9147036 - DNA, 22 bp, Homo sapiens
cacctgcctggtccttagggct

SEQ ID NO: 9147037 - DNA, 22 bp, Homo sapiens
cacctggaccctgggaggaggg

SEQ ID NO: 9147038 - DNA, 22 bp, Homo sapiens
cacctggaccctgggaggaggg

SEQ ID NO: 9147039 - DNA, 22 bp, Homo sapiens
cacctggaccctgggaggaggg

SEQ ID NO: 9147040 - DNA, 22 bp, Homo sapiens
cacctggagtagcaaggtaatt

SEQ ID NO: 9147041 - DNA, 20 bp, Homo sapiens
cacctggatatgacccagct

SEQ ID NO: 9147042 - DNA, 22 bp, Homo sapiens
cacctggatatgtttcagcttg

SEQ ID NO: 9147043 - DNA, 22 bp, Homo sapiens
cacctggatatgtttcagcttg

SEQ ID NO: 9147044 - DNA, 22 bp, Homo sapiens
cacctggatatgtttcagcttg

SEQ ID NO: 9147045 - DNA, 22 bp, Homo sapiens
cacctggatgccacaaagccac

SEQ ID NO: 9147046 - DNA, 20 bp, Homo sapiens
cacctggatatgacccagct

SEQ ID NO: 9147047 - DNA, 22 bp, Homo sapiens
cacctggcagctgttggccacg

SEQ ID NO: 9147048 - DNA, 21 bp, Homo sapiens
cactccacttagaacagggtt

SEQ ID NO: 9147049 - DNA, 22 bp, Homo sapiens
cactcccttcaggagcctagga

SEQ ID NO: 9147050 - DNA, 22 bp, Homo sapiens
cactctaacctccatcttccat

SEQ ID NO: 9147051 - DNA, 20 bp, Homo sapiens
cactctaaccatatttcctc

SEQ ID NO: 9147052 - DNA, 22 bp, Homo sapiens
cactgcactccagcctgggaga

SEQ ID NO: 9147053 - DNA, 22 bp, Homo sapiens
cactgcactccagcctgggaga

SEQ ID NO: 9147054 - DNA, 22 bp, Homo sapiens
cactctctcaggctttccttgt

SEQ ID NO: 9147055 - DNA, 22 bp, Homo sapiens
cactgcactccagcctgggaga

SEQ ID NO: 9147056 - DNA, 21 bp, Homo sapiens
cactccacttagaacagggtt

SEQ ID NO: 9147057 - DNA, 21 bp, Homo sapiens
cactccacttagaacagggtt

SEQ ID NO: 9147058 - DNA, 21 bp, Homo sapiens
cactccacttagaacagggtt

SEQ ID NO: 9147059 - DNA, 22 bp, Homo sapiens
cactcagaggtttgattgctca

SEQ ID NO: 9147060 - DNA, 22 bp, Homo sapiens
cactcaggctgtgtcaggagga

SEQ ID NO: 9147061 - DNA, 22 bp, Homo sapiens
cactagtggccccatgtggttg

SEQ ID NO: 9147062 - DNA, 23 bp, Homo sapiens
cacggcagcctccgagggtgctg

SEQ ID NO: 9147063 - DNA, 22 bp, Homo sapiens
cactatatctctttcatctttt

SEQ ID NO: 9147064 - DNA, 22 bp, Homo sapiens
cactataatcctgttttagaac

SEQ ID NO: 9147065 - DNA, 22 bp, Homo sapiens
cactatatgcctttgaaataca

SEQ ID NO: 9147066 - DNA, 22 bp, Homo sapiens
cacttgttggtggtgaaatcac

SEQ ID NO: 9147067 - DNA, 22 bp, Homo sapiens
cacttgttggtggtgaaatcac

SEQ ID NO: 9147068 - DNA, 22 bp, Homo sapiens
cacttgttggtggtgaaatcac

SEQ ID NO: 9147069 - DNA, 22 bp, Homo sapiens
cactttaaaactgacagccctt

SEQ ID NO: 9147070 - DNA, 17 bp, Homo sapiens
ggctgctgtgctggtgc

SEQ ID NO: 9147071 - DNA, 17 bp, Homo sapiens
ggctgctgtgctggtgc

SEQ ID NO: 9147072 - DNA, 22 bp, Homo sapiens
cacttgatggaagagcagaaga

SEQ ID NO: 9147073 - DNA, 22 bp, Homo sapiens
cacttccgcacagtgagagcca

SEQ ID NO: 9147074 - DNA, 23 bp, Homo sapiens
cacttcccctgtggcgagcctgc

SEQ ID NO: 9147075 - DNA, 23 bp, Homo sapiens
cacttcccctgtggcgagcctgc

SEQ ID NO: 9147076 - DNA, 22 bp, Homo sapiens
cacttcattgggaccagggctg

SEQ ID NO: 9147077 - DNA, 22 bp, Homo sapiens
cacttcattgggaccagggctg

SEQ ID NO: 9147078 - DNA, 22 bp, Homo sapiens
cacttcagctacaatcacatga

SEQ ID NO: 9147079 - DNA, 22 bp, Homo sapiens
cacttcagctacaatcacatga

SEQ ID NO: 9147080 - DNA, 22 bp, Homo sapiens
cacttcaaatatggcttcatga

SEQ ID NO: 9147081 - DNA, 22 bp, Homo sapiens
cacttagatactagatcacaaa

SEQ ID NO: 9147082 - DNA, 20 bp, Homo sapiens
ggctctggaatctggtgggc

SEQ ID NO: 9147083 - DNA, 20 bp, Homo sapiens
ggctctggaatctggtgggc

SEQ ID NO: 9147084 - DNA, 20 bp, Homo sapiens
ggctctggaatctggtgggc

SEQ ID NO: 9147085 - DNA, 20 bp, Homo sapiens
ggctctggaatctggtgggc

SEQ ID NO: 9147086 - DNA, 22 bp, Homo sapiens
cactgtgctccttccttagcac

SEQ ID NO: 9147087 - DNA, 22 bp, Homo sapiens
cactgtggcaacctgtgcccaa

SEQ ID NO: 9147088 - DNA, 22 bp, Homo sapiens
ggctctggaaagtgtccttgat

SEQ ID NO: 9147089 - DNA, 22 bp, Homo sapiens
ggctctggaaagtgtccttgat

SEQ ID NO: 9147090 - DNA, 22 bp, Homo sapiens
cactggtgccagagaacagaat

SEQ ID NO: 9147091 - DNA, 22 bp, Homo sapiens
cactgggagtacaaagaatggg

SEQ ID NO: 9147092 - DNA, 22 bp, Homo sapiens
cactggtgtattagagctagaa

SEQ ID NO: 9147093 - DNA, 22 bp, Homo sapiens
cactggttttgctgataaggca

SEQ ID NO: 9147094 - DNA, 22 bp, Homo sapiens
cactggttgggaaaggcagagg

SEQ ID NO: 9147095 - DNA, 22 bp, Homo sapiens
cactgtaatagcattataagtg

SEQ ID NO: 9147096 - DNA, 22 bp, Homo sapiens
cactgtaatagcattataagtg

SEQ ID NO: 9147097 - DNA, 22 bp, Homo sapiens
cactgcactccagcctgggtca

SEQ ID NO: 9147098 - DNA, 22 bp, Homo sapiens
cactgcactccagcctgggaga

SEQ ID NO: 9147099 - DNA, 22 bp, Homo sapiens
cactgcactccagcctgggcaa

SEQ ID NO: 9147100 - DNA, 22 bp, Homo sapiens
cactgcactccagcctgggtca

SEQ ID NO: 9147101 - DNA, 22 bp, Homo sapiens
cactgcactccagcctgggtga

SEQ ID NO: 9147102 - DNA, 22 bp, Homo sapiens
cactgcactccagcctgggtca

SEQ ID NO: 9147103 - DNA, 22 bp, Homo sapiens
cactgcactccagcctgggtga

SEQ ID NO: 9147104 - DNA, 22 bp, Homo sapiens
cactgcactccagcttgggtga

SEQ ID NO: 9147105 - DNA, 22 bp, Homo sapiens
cactgcactccagcctgggtga

SEQ ID NO: 9147106 - DNA, 22 bp, Homo sapiens
caccaggagccatcaggagtcc

SEQ ID NO: 9147107 - DNA, 22 bp, Homo sapiens
caccagcttctcattgcgggtc

SEQ ID NO: 9147108 - DNA, 22 bp, Homo sapiens
caccagcttgggctgtggaaat

SEQ ID NO: 9147109 - DNA, 22 bp, Homo sapiens
caccagcttgcagtcttaaccc

SEQ ID NO: 9147110 - DNA, 22 bp, Homo sapiens
cacattcatggagtttgcctgt

SEQ ID NO: 9147111 - DNA, 22 bp, Homo sapiens
cacattcaggtggcatgttaga

SEQ ID NO: 9147112 - DNA, 22 bp, Homo sapiens
cacattcaggtggcatgttaga

SEQ ID NO: 9147113 - DNA, 22 bp, Homo sapiens
cacattcagggcagaccactca

SEQ ID NO: 9147114 - DNA, 22 bp, Homo sapiens
cacattcagggaacattggagg

SEQ ID NO: 9147115 - DNA, 22 bp, Homo sapiens
cacattcaggattttccatgtc

SEQ ID NO: 9147116 - DNA, 22 bp, Homo sapiens
caccactgcttcctgccatctg

SEQ ID NO: 9147117 - DNA, 22 bp, Homo sapiens
cacattcctggtgctcagcagc

SEQ ID NO: 9147118 - DNA, 22 bp, Homo sapiens
caccactggaggtcttggcttt

SEQ ID NO: 9147119 - DNA, 22 bp, Homo sapiens
cacattaagaataatgagacta

SEQ ID NO: 9147120 - DNA, 22 bp, Homo sapiens
cacattaagaataatgagacta

SEQ ID NO: 9147121 - DNA, 22 bp, Homo sapiens
cacattaaaatcctaacttcca

SEQ ID NO: 9147122 - DNA, 22 bp, Homo sapiens
cacattaaaatcctaacttcca

SEQ ID NO: 9147123 - DNA, 22 bp, Homo sapiens
cacattaaaatcctaacttcca

SEQ ID NO: 9147124 - DNA, 22 bp, Homo sapiens
cacattattctaaagaggtact

SEQ ID NO: 9147125 - DNA, 22 bp, Homo sapiens
cacattcaattacacagatagg

SEQ ID NO: 9147126 - DNA, 22 bp, Homo sapiens
cacattcaggattttccatgtc

SEQ ID NO: 9147127 - DNA, 22 bp, Homo sapiens
cacattcacttctctgtccacc

SEQ ID NO: 9147128 - DNA, 22 bp, Homo sapiens
cacattcacatttttccctcta

SEQ ID NO: 9147129 - DNA, 22 bp, Homo sapiens
cacattcacatttttccctcta

SEQ ID NO: 9147130 - DNA, 22 bp, Homo sapiens
cacatgttcttaacttctgttt

SEQ ID NO: 9147131 - DNA, 22 bp, Homo sapiens
cacatgtttgctacatttttct

SEQ ID NO: 9147132 - DNA, 22 bp, Homo sapiens
cacatgtttcaggccatatttg

SEQ ID NO: 9147133 - DNA, 20 bp, Homo sapiens
cacatgctgtgtgtttctct

SEQ ID NO: 9147134 - DNA, 22 bp, Homo sapiens
cacatgtgcaaatactgaggct

SEQ ID NO: 9147135 - DNA, 22 bp, Homo sapiens
cacatgtgcagttacatgaatt

SEQ ID NO: 9147136 - DNA, 18 bp, Homo sapiens
ggcagatgacaggagaga

SEQ ID NO: 9147137 - DNA, 22 bp, Homo sapiens
ggcagatggaagaggctgggtc

SEQ ID NO: 9147138 - DNA, 22 bp, Homo sapiens
ggcagagttggtggagtcagtt

SEQ ID NO: 9147139 - DNA, 22 bp, Homo sapiens
ggcagagtgctctgggcagggg

SEQ ID NO: 9147140 - DNA, 22 bp, Homo sapiens
ggcagagtggagtgcggcctcc

SEQ ID NO: 9147141 - DNA, 22 bp, Homo sapiens
ggcagaggtgacagtgtctttt

SEQ ID NO: 9147142 - DNA, 22 bp, Homo sapiens
ggcagaggtgacagtgtctttt

SEQ ID NO: 9147143 - DNA, 22 bp, Homo sapiens
ggcagaggtgacagtgtctttt

SEQ ID NO: 9147144 - DNA, 22 bp, Homo sapiens
ggcagaggtgacagtgtctttt

SEQ ID NO: 9147145 - DNA, 22 bp, Homo sapiens
cacatgagtcctgccaggtatg

SEQ ID NO: 9147146 - DNA, 22 bp, Homo sapiens
cacatgagtgagaacatgcagt

SEQ ID NO: 9147147 - DNA, 22 bp, Homo sapiens
cacatgcaagtcctcagttcta

SEQ ID NO: 9147148 - DNA, 22 bp, Homo sapiens
cacatgaaggctggggtcgtga

SEQ ID NO: 9147149 - DNA, 22 bp, Homo sapiens
cacatgaaggctggggtcgtga

SEQ ID NO: 9147150 - DNA, 22 bp, Homo sapiens
cacatgaagattcaactggatg

SEQ ID NO: 9147151 - DNA, 22 bp, Homo sapiens
cacatgaattcacatgtatttt

SEQ ID NO: 9147152 - DNA, 22 bp, Homo sapiens
cacatgaattcacatgtatttt

SEQ ID NO: 9147153 - DNA, 22 bp, Homo sapiens
cacatgagagcccccaagagca

SEQ ID NO: 9147154 - DNA, 22 bp, Homo sapiens
cacatgagagcccccaagagca

SEQ ID NO: 9147155 - DNA, 22 bp, Homo sapiens
cacatgaggtgacttccaagct

SEQ ID NO: 9147156 - DNA, 22 bp, Homo sapiens
cacatgagacaattaaagactt

SEQ ID NO: 9147157 - DNA, 22 bp, Homo sapiens
cacatgactctggctacccaga

SEQ ID NO: 9147158 - DNA, 22 bp, Homo sapiens
ggcaattttcatgaattattga

SEQ ID NO: 9147159 - DNA, 22 bp, Homo sapiens
ggcaatttggtcatttgtattg

SEQ ID NO: 9147160 - DNA, 22 bp, Homo sapiens
ggcaatttgcagtttgtcttat

SEQ ID NO: 9147161 - DNA, 22 bp, Homo sapiens
ggcaatttcatgtggtttaaac

SEQ ID NO: 9147162 - DNA, 22 bp, Homo sapiens
cacaggggcaaactgtagggga

SEQ ID NO: 9147163 - DNA, 22 bp, Homo sapiens
cacaggggcaaactgtagggga

SEQ ID NO: 9147164 - DNA, 22 bp, Homo sapiens
cacaggggcaaactgtagggga

SEQ ID NO: 9147165 - DNA, 22 bp, Homo sapiens
cacagggctttgatggctgagt

SEQ ID NO: 9147166 - DNA, 22 bp, Homo sapiens
cacagggcaggtactctcagag

SEQ ID NO: 9147167 - DNA, 22 bp, Homo sapiens
cacagggcaggccccaggcctc

SEQ ID NO: 9147168 - DNA, 20 bp, Homo sapiens
cacaggccccaagacctgta

SEQ ID NO: 9147169 - DNA, 22 bp, Homo sapiens
cacaggccaataccctctctct

SEQ ID NO: 9147170 - DNA, 22 bp, Homo sapiens
cacaggaggttaggaagtggtc

SEQ ID NO: 9147171 - DNA, 22 bp, Homo sapiens
cacaggagtgctgctattgttg

SEQ ID NO: 9147172 - DNA, 22 bp, Homo sapiens
cacaggagtgctgctattgttg

SEQ ID NO: 9147173 - DNA, 22 bp, Homo sapiens
ggagagctgaagcatggacagg

SEQ ID NO: 9147174 - DNA, 22 bp, Homo sapiens
ggagagctgaagcatggacagg

SEQ ID NO: 9147175 - DNA, 22 bp, Homo sapiens
ggagagctctgggtctccgaca

SEQ ID NO: 9147176 - DNA, 22 bp, Homo sapiens
ggagagctctgggtctccgaca

SEQ ID NO: 9147177 - DNA, 23 bp, Homo sapiens
ggagagctcctcgtgactcactg

SEQ ID NO: 9147178 - DNA, 22 bp, Homo sapiens
ggagagctagtgcctgccagta

SEQ ID NO: 9147179 - DNA, 22 bp, Homo sapiens
cacaggcaggaggttctccagt

SEQ ID NO: 9147180 - DNA, 18 bp, Homo sapiens
cacaggcaggtgataggt

SEQ ID NO: 9147181 - DNA, 22 bp, Homo sapiens
cacaggcagccttgtagaagaa

SEQ ID NO: 9147182 - DNA, 22 bp, Homo sapiens
cacaggcagccttgtagaagaa

SEQ ID NO: 9147183 - DNA, 22 bp, Homo sapiens
cacaggcagccttgtagaagaa

SEQ ID NO: 9147184 - DNA, 23 bp, Homo sapiens
cacaggcagaaatcaagacggta

SEQ ID NO: 9147185 - DNA, 23 bp, Homo sapiens
cacaggcagaaatcaagacggta

SEQ ID NO: 9147186 - DNA, 22 bp, Homo sapiens
cacaggatacattgtctatatc

SEQ ID NO: 9147187 - DNA, 22 bp, Homo sapiens
cacaggttagcagcttgaaact

SEQ ID NO: 9147188 - DNA, 22 bp, Homo sapiens
cacaggtgtccaatacctgctt

SEQ ID NO: 9147189 - DNA, 22 bp, Homo sapiens
cacagtctcctctcttagcctg

SEQ ID NO: 9147190 - DNA, 22 bp, Homo sapiens
cacagtctcctctcttagcctg

SEQ ID NO: 9147191 - DNA, 22 bp, Homo sapiens
cacaggttaggtattatactat

SEQ ID NO: 9147192 - DNA, 22 bp, Homo sapiens
cacagtgattgatttttacttt

SEQ ID NO: 9147193 - DNA, 22 bp, Homo sapiens
cacagtgcactaagctccgggg

SEQ ID NO: 9147194 - DNA, 22 bp, Homo sapiens
ggcaaggtactctagagcacat

SEQ ID NO: 9147195 - DNA, 22 bp, Homo sapiens
ggcaagtcaggaagttgacatt

SEQ ID NO: 9147196 - DNA, 22 bp, Homo sapiens
ggcaagtgatcctggagcaccg

SEQ ID NO: 9147197 - DNA, 22 bp, Homo sapiens
ggcaaggggtcaggctgagaca

SEQ ID NO: 9147198 - DNA, 22 bp, Homo sapiens
ggcaaggggtcaggctgagaca

SEQ ID NO: 9147199 - DNA, 22 bp, Homo sapiens
cacagtgcatgatgggcagaag

SEQ ID NO: 9147200 - DNA, 22 bp, Homo sapiens
ggcaaggggtcaggctgagaca

SEQ ID NO: 9147201 - DNA, 22 bp, Homo sapiens
gtcacacaatagtaagtggtcc

SEQ ID NO: 9147202 - DNA, 22 bp, Homo sapiens
gtcacacaggttgaaatgcagt

SEQ ID NO: 9147203 - DNA, 22 bp, Homo sapiens
gtcacacagggcctccaaatca

SEQ ID NO: 9147204 - DNA, 22 bp, Homo sapiens
gtattttacttacgcatgactt

SEQ ID NO: 9147205 - DNA, 22 bp, Homo sapiens
gtattttacttacgcatgactt

SEQ ID NO: 9147206 - DNA, 22 bp, Homo sapiens
gtagggacttgttttactagta

SEQ ID NO: 9147207 - DNA, 22 bp, Homo sapiens
gtaggctgtgtgaggctagaga

SEQ ID NO: 9147208 - DNA, 20 bp, Homo sapiens
gtagggaaggaatctgcagg

SEQ ID NO: 9147209 - DNA, 22 bp, Homo sapiens
gtcacaggaagcagcaggcact

SEQ ID NO: 9147210 - DNA, 22 bp, Homo sapiens
gtcacaggaagcagcaggcact

SEQ ID NO: 9147211 - DNA, 22 bp, Homo sapiens
gtcacaggcagtaactaggacc

SEQ ID NO: 9147212 - DNA, 22 bp, Homo sapiens
gtcagatctttggggatgctgt

SEQ ID NO: 9147213 - DNA, 22 bp, Homo sapiens
gtcagagttccaaattaatcaa

SEQ ID NO: 9147214 - DNA, 22 bp, Homo sapiens
gtcacaggaaagggtgtaaggg

SEQ ID NO: 9147215 - DNA, 22 bp, Homo sapiens
cagcatccctcaggggcctctg

SEQ ID NO: 9147216 - DNA, 22 bp, Homo sapiens
cagcagtgtctccagcatcaca

SEQ ID NO: 9147217 - DNA, 22 bp, Homo sapiens
cagcatcccagagcccagagct

SEQ ID NO: 9147218 - DNA, 22 bp, Homo sapiens
cagcatccctcaggggcctctg

SEQ ID NO: 9147219 - DNA, 22 bp, Homo sapiens
cagcatctaatcttcatgccgg

SEQ ID NO: 9147220 - DNA, 22 bp, Homo sapiens
cagcatctcacttcccagaagg

SEQ ID NO: 9147221 - DNA, 22 bp, Homo sapiens
cagcatctcatttgacttctgc

SEQ ID NO: 9147222 - DNA, 22 bp, Homo sapiens
cagcatctcattcattcatgtt

SEQ ID NO: 9147223 - DNA, 22 bp, Homo sapiens
gtcagatgatacactgttgtca

SEQ ID NO: 9147224 - DNA, 22 bp, Homo sapiens
gtcagcaatagttagtttacaa

SEQ ID NO: 9147225 - DNA, 22 bp, Homo sapiens
gtcagcagaaacgccacatgca

SEQ ID NO: 9147226 - DNA, 22 bp, Homo sapiens
gtcagcacctctttggggagct

SEQ ID NO: 9147227 - DNA, 22 bp, Homo sapiens
gtcagcacttttccgaggcaga

SEQ ID NO: 9147228 - DNA, 22 bp, Homo sapiens
gtcagcaattcaagagctctta

SEQ ID NO: 9147229 - DNA, 19 bp, Homo sapiens
gtcagcaccatggacaggg

SEQ ID NO: 9147230 - DNA, 22 bp, Homo sapiens
gtcagcagtggcagctcccggg

SEQ ID NO: 9147231 - DNA, 17 bp, Homo sapiens
gtcagcagcttgcttgt

SEQ ID NO: 9147232 - DNA, 22 bp, Homo sapiens
gtccagagtattcaagtaactt

SEQ ID NO: 9147233 - DNA, 22 bp, Homo sapiens
gtccagagttagaaatgaatat

SEQ ID NO: 9147234 - DNA, 22 bp, Homo sapiens
cagccagaacctaggatgagct

SEQ ID NO: 9147235 - DNA, 22 bp, Homo sapiens
cagccagaacctaggatgagct

SEQ ID NO: 9147236 - DNA, 22 bp, Homo sapiens
cagccagaaagtctgttaggga

SEQ ID NO: 9147237 - DNA, 22 bp, Homo sapiens
cagccagaaagtatgttaggga

SEQ ID NO: 9147238 - DNA, 22 bp, Homo sapiens
gtccagccaccctggaggcacg

SEQ ID NO: 9147239 - DNA, 22 bp, Homo sapiens
cagccagcttcagatccaagcc

SEQ ID NO: 9147240 - DNA, 22 bp, Homo sapiens
cagccagctgtcccaagtgcct

SEQ ID NO: 9147241 - DNA, 22 bp, Homo sapiens
cagccagctgtcccaagtgcct

SEQ ID NO: 9147242 - DNA, 22 bp, Homo sapiens
cagccagctggtgcggcagagc

SEQ ID NO: 9147243 - DNA, 22 bp, Homo sapiens
cagccagctggtgcggcagagc

SEQ ID NO: 9147244 - DNA, 22 bp, Homo sapiens
cagccaggagcctctgcaacta

SEQ ID NO: 9147245 - DNA, 22 bp, Homo sapiens
cagccaggactcccatttagga

SEQ ID NO: 9147246 - DNA, 22 bp, Homo sapiens
cagccaggcccagatcatgctg

SEQ ID NO: 9147247 - DNA, 22 bp, Homo sapiens
cagccaggatggagaactgttg

SEQ ID NO: 9147248 - DNA, 22 bp, Homo sapiens
cagccaggatggagaactgttg

SEQ ID NO: 9147249 - DNA, 22 bp, Homo sapiens
gtccagaggtccaggatcaagg

SEQ ID NO: 9147250 - DNA, 22 bp, Homo sapiens
gtccagagctggcacactgtca

SEQ ID NO: 9147251 - DNA, 22 bp, Homo sapiens
gtccagagaggcaggaggctac

SEQ ID NO: 9147252 - DNA, 22 bp, Homo sapiens
cagcatctgtatcctaggctga

SEQ ID NO: 9147253 - DNA, 22 bp, Homo sapiens
cagcatctgaccaatatctaca

SEQ ID NO: 9147254 - DNA, 22 bp, Homo sapiens
cagcatctctgcctgcctgcaa

SEQ ID NO: 9147255 - DNA, 22 bp, Homo sapiens
cagcatctctgcctgcctgcaa

SEQ ID NO: 9147256 - DNA, 22 bp, Homo sapiens
cagattgggtgagatgatttca

SEQ ID NO: 9147257 - DNA, 22 bp, Homo sapiens
cagattgggtgagatgatttca

SEQ ID NO: 9147258 - DNA, 22 bp, Homo sapiens
cagattggattaaatagctgcc

SEQ ID NO: 9147259 - DNA, 22 bp, Homo sapiens
cagattggagagagttaaagca

SEQ ID NO: 9147260 - DNA, 22 bp, Homo sapiens
cagattcttcattgccccattc

SEQ ID NO: 9147261 - DNA, 22 bp, Homo sapiens
cagattctgggcccagcttgtc

SEQ ID NO: 9147262 - DNA, 22 bp, Homo sapiens
cagattctgaagtctagctgct

SEQ ID NO: 9147263 - DNA, 22 bp, Homo sapiens
cagattaacacggagcttaaca

SEQ ID NO: 9147264 - DNA, 22 bp, Homo sapiens
cagattctccaggggctgcaga

SEQ ID NO: 9147265 - DNA, 22 bp, Homo sapiens
cagattctcactgtattcaggt

SEQ ID NO: 9147266 - DNA, 22 bp, Homo sapiens
cagatttaggtcactagaattt

SEQ ID NO: 9147267 - DNA, 22 bp, Homo sapiens
cagattttgatgaatgtggaaa

SEQ ID NO: 9147268 - DNA, 22 bp, Homo sapiens
cagcaaaacagccgttgcctgg

SEQ ID NO: 9147269 - DNA, 22 bp, Homo sapiens
cagatttgccacttactcgttg

SEQ ID NO: 9147270 - DNA, 20 bp, Homo sapiens
cagcaaaatgaaaatggatt

SEQ ID NO: 9147271 - DNA, 20 bp, Homo sapiens
cagcagccattctagtagta

SEQ ID NO: 9147272 - DNA, 22 bp, Homo sapiens
cagcaaaggtagaagcacagga

SEQ ID NO: 9147273 - DNA, 22 bp, Homo sapiens
cagcaaaggtagaagcacagga

SEQ ID NO: 9147274 - DNA, 22 bp, Homo sapiens
cagcagcagattcagcgtctgg

SEQ ID NO: 9147275 - DNA, 22 bp, Homo sapiens
cagcagcagattcagcgtctgg

SEQ ID NO: 9147276 - DNA, 22 bp, Homo sapiens
cagcagccactagagggctcac

SEQ ID NO: 9147277 - DNA, 22 bp, Homo sapiens
cagcaaaatttgaggattgcct

SEQ ID NO: 9147278 - DNA, 22 bp, Homo sapiens
cagcaaagcaggctcctagaac

SEQ ID NO: 9147279 - DNA, 22 bp, Homo sapiens
cagcaaagcttgttccttcctg

SEQ ID NO: 9147280 - DNA, 22 bp, Homo sapiens
cagcaaagcttgttccttcctg

SEQ ID NO: 9147281 - DNA, 22 bp, Homo sapiens
gtaggcaggtggaggagtgaag

SEQ ID NO: 9147282 - DNA, 22 bp, Homo sapiens
gtaggcaggtggaggagtgaag

SEQ ID NO: 9147283 - DNA, 22 bp, Homo sapiens
gtaggcagggctgtggggagaa

SEQ ID NO: 9147284 - DNA, 22 bp, Homo sapiens
gtaggcagataggagtgcagcc

SEQ ID NO: 9147285 - DNA, 22 bp, Homo sapiens
gtaggcagtggttggaagagaa

SEQ ID NO: 9147286 - DNA, 22 bp, Homo sapiens
gtaggcagtctctcaggtgatc

SEQ ID NO: 9147287 - DNA, 22 bp, Homo sapiens
gtaggcagtggttggaagagaa

SEQ ID NO: 9147288 - DNA, 22 bp, Homo sapiens
gtaggccatggtggttgtctct

SEQ ID NO: 9147289 - DNA, 22 bp, Homo sapiens
gtactttcaggctttcccttaa

SEQ ID NO: 9147290 - DNA, 22 bp, Homo sapiens
gtagaaatagtggttgacagga

SEQ ID NO: 9147291 - DNA, 22 bp, Homo sapiens
gtagaaaattaggatgaggctt

SEQ ID NO: 9147292 - DNA, 22 bp, Homo sapiens
gtacttgaaatgtccctccatt

SEQ ID NO: 9147293 - DNA, 22 bp, Homo sapiens
gtactgtgctagttgatgggag

SEQ ID NO: 9147294 - DNA, 22 bp, Homo sapiens
gtacacattatgcttctctaaa

SEQ ID NO: 9147295 - DNA, 22 bp, Homo sapiens
gtacactccccctgtgaagttg

SEQ ID NO: 9147296 - DNA, 22 bp, Homo sapiens
gtacactccccctgtgaagttg

SEQ ID NO: 9147297 - DNA, 20 bp, Homo sapiens
gtacacatatatgtatgtgt

SEQ ID NO: 9147298 - DNA, 22 bp, Homo sapiens
gtacacatatattaaaaattgt

SEQ ID NO: 9147299 - DNA, 22 bp, Homo sapiens
gtactaagtcaggagaagaatt

SEQ ID NO: 9147300 - DNA, 22 bp, Homo sapiens
gtacacttgactcataggaaat

SEQ ID NO: 9147301 - DNA, 20 bp, Homo sapiens
gtacacttcatgtttcacct

SEQ ID NO: 9147302 - DNA, 22 bp, Homo sapiens
gtacacttgtcttgaacagcct

SEQ ID NO: 9147303 - DNA, 22 bp, Homo sapiens
gtactgaacttaaaaatcccct

SEQ ID NO: 9147304 - DNA, 22 bp, Homo sapiens
gtactgctgtaaatattcttca

SEQ ID NO: 9147305 - DNA, 22 bp, Homo sapiens
gtactgaataacaaagtctgtc

SEQ ID NO: 9147306 - DNA, 22 bp, Homo sapiens
gtactacagtttctcattaaat

SEQ ID NO: 9147307 - DNA, 22 bp, Homo sapiens
gtactcagtaatataacatatt

SEQ ID NO: 9147308 - DNA, 22 bp, Homo sapiens
gtacacactatgtattgtacac

SEQ ID NO: 9147309 - DNA, 22 bp, Homo sapiens
gtacacactatttaaagtgttt

SEQ ID NO: 9147310 - DNA, 22 bp, Homo sapiens
gtacacactgtttgatcatttc

SEQ ID NO: 9147311 - DNA, 22 bp, Homo sapiens
cagccctctctgggccccaagg

SEQ ID NO: 9147312 - DNA, 22 bp, Homo sapiens
cagccctctctgggccccaagg

SEQ ID NO: 9147313 - DNA, 22 bp, Homo sapiens
cagccctctgaagaggcgcttg

SEQ ID NO: 9147314 - DNA, 22 bp, Homo sapiens
cagccctctgaagaggcgcttg

SEQ ID NO: 9147315 - DNA, 19 bp, Homo sapiens
cagccctcttaccactgtg

SEQ ID NO: 9147316 - DNA, 19 bp, Homo sapiens
cagccctcttaccactgtg

SEQ ID NO: 9147317 - DNA, 22 bp, Homo sapiens
cagccctcctttcactcccagg

SEQ ID NO: 9147318 - DNA, 20 bp, Homo sapiens
cagccctccagtggaggcag

SEQ ID NO: 9147319 - DNA, 20 bp, Homo sapiens
cagccctccagtggaggcag

SEQ ID NO: 9147320 - DNA, 22 bp, Homo sapiens
cagccctcctaccctgccaggc

SEQ ID NO: 9147321 - DNA, 22 bp, Homo sapiens
cagccctcatcccgcctgcgtt

SEQ ID NO: 9147322 - DNA, 23 bp, Homo sapiens
gtgagcagcaccatgaggctaga

SEQ ID NO: 9147323 - DNA, 22 bp, Homo sapiens
gtgagcagaataagggttgaga

SEQ ID NO: 9147324 - DNA, 22 bp, Homo sapiens
gtgagcaatttggtattaattt

SEQ ID NO: 9147325 - DNA, 18 bp, Homo sapiens
gtgagcagagagcatcac

SEQ ID NO: 9147326 - DNA, 22 bp, Homo sapiens
gtgagagtggtttatgtccatg

SEQ ID NO: 9147327 - DNA, 22 bp, Homo sapiens
gtgagagtgtttggaaatagaa

SEQ ID NO: 9147328 - DNA, 22 bp, Homo sapiens
gtgagattccttagattcatgg

SEQ ID NO: 9147329 - DNA, 22 bp, Homo sapiens
gtgagattccttagattcatgg

SEQ ID NO: 9147330 - DNA, 22 bp, Homo sapiens
gtgagagatcccccactcatct

SEQ ID NO: 9147331 - DNA, 22 bp, Homo sapiens
gtgagagggctgggctcatgat

SEQ ID NO: 9147332 - DNA, 22 bp, Homo sapiens
gtgagagggctgggctcatgat

SEQ ID NO: 9147333 - DNA, 22 bp, Homo sapiens
gtgaatttagtttgtaagaagg

SEQ ID NO: 9147334 - DNA, 22 bp, Homo sapiens
gtcctgtgcctggccaaaagct

SEQ ID NO: 9147335 - DNA, 17 bp, Homo sapiens
gtcctggtgtgtgagga

SEQ ID NO: 9147336 - DNA, 22 bp, Homo sapiens
gtcctgtgacctgcatcctgag

SEQ ID NO: 9147337 - DNA, 22 bp, Homo sapiens
gtcctgtgatgagtaccaggtg

SEQ ID NO: 9147338 - DNA, 22 bp, Homo sapiens
cagccctgtccagcagagggtg

SEQ ID NO: 9147339 - DNA, 22 bp, Homo sapiens
cagccctgtccagcagagggtg

SEQ ID NO: 9147340 - DNA, 22 bp, Homo sapiens
cagccctgtccaatgtctgctc

SEQ ID NO: 9147341 - DNA, 22 bp, Homo sapiens
cagccctggcccaggtgcctta

SEQ ID NO: 9147342 - DNA, 22 bp, Homo sapiens
cagccctggccccaggtggtct

SEQ ID NO: 9147343 - DNA, 22 bp, Homo sapiens
cagccctgtccctgagggacct

SEQ ID NO: 9147344 - DNA, 22 bp, Homo sapiens
cagccctgtctatgactgatga

SEQ ID NO: 9147345 - DNA, 18 bp, Homo sapiens
ggtcaagaaagtaaggca

SEQ ID NO: 9147346 - DNA, 22 bp, Homo sapiens
ggtcaacttcttatggtagctt

SEQ ID NO: 9147347 - DNA, 22 bp, Homo sapiens
ggtcaacttgagaagctagtac

SEQ ID NO: 9147348 - DNA, 22 bp, Homo sapiens
ggtcacagctttttcagcagca

SEQ ID NO: 9147349 - DNA, 22 bp, Homo sapiens
ggtcacagggaagggctctcaa

SEQ ID NO: 9147350 - DNA, 22 bp, Homo sapiens
ggtcaacttagataagatggag

SEQ ID NO: 9147351 - DNA, 22 bp, Homo sapiens
ggtcaaagggtgagatggcagg

SEQ ID NO: 9147352 - DNA, 22 bp, Homo sapiens
ggtcaaagttgaagaagggcat

SEQ ID NO: 9147353 - DNA, 22 bp, Homo sapiens
cagatgaggcaacctcattgct

SEQ ID NO: 9147354 - DNA, 22 bp, Homo sapiens
cagatgagcatgggcacaagca

SEQ ID NO: 9147355 - DNA, 22 bp, Homo sapiens
cagatgaataaatgatgaggta

SEQ ID NO: 9147356 - DNA, 22 bp, Homo sapiens
cagatgaccaggctccacccag

SEQ ID NO: 9147357 - DNA, 22 bp, Homo sapiens
cagatgaccgtcttccagccag

SEQ ID NO: 9147358 - DNA, 22 bp, Homo sapiens
cagatgtggttaacatgtacat

SEQ ID NO: 9147359 - DNA, 22 bp, Homo sapiens
cagatgtggaatgcagcaggct

SEQ ID NO: 9147360 - DNA, 20 bp, Homo sapiens
cagatggcacgtcagggcat

SEQ ID NO: 9147361 - DNA, 22 bp, Homo sapiens
cagatggcacagatttagagtg

SEQ ID NO: 9147362 - DNA, 22 bp, Homo sapiens
ggtcctggaagtgtaagtggca

SEQ ID NO: 9147363 - DNA, 22 bp, Homo sapiens
ggtcctgcgtctggctcgcccg

SEQ ID NO: 9147364 - DNA, 22 bp, Homo sapiens
ggtcctggcagctctgtgtcca

SEQ ID NO: 9147365 - DNA, 22 bp, Homo sapiens
ggtccctggttccctctgagct

SEQ ID NO: 9147366 - DNA, 22 bp, Homo sapiens
cagatgcagcaaaatgacaggc

SEQ ID NO: 9147367 - DNA, 18 bp, Homo sapiens
ggtcctgaatgcctgcta

SEQ ID NO: 9147368 - DNA, 22 bp, Homo sapiens
ggtcctgcattgccagcaagct

SEQ ID NO: 9147369 - DNA, 22 bp, Homo sapiens
ggtcctgagtacctatgtttat

SEQ ID NO: 9147370 - DNA, 23 bp, Homo sapiens
ggtcctgcccccggtcgcccaaa

SEQ ID NO: 9147371 - DNA, 22 bp, Homo sapiens
ggtcctgcctgctgtccttcaa

SEQ ID NO: 9147372 - DNA, 20 bp, Homo sapiens
ggtcctgccttcatcacttc

SEQ ID NO: 9147373 - DNA, 22 bp, Homo sapiens
gggtcccagcataggggaagca

SEQ ID NO: 9147374 - DNA, 18 bp, Homo sapiens
gggtccccagctgcaggg

SEQ ID NO: 9147375 - DNA, 22 bp, Homo sapiens
gggtccaggtcttcaggcagag

SEQ ID NO: 9147376 - DNA, 22 bp, Homo sapiens
gggtacagttcttccagtgtca

SEQ ID NO: 9147377 - DNA, 22 bp, Homo sapiens
gggtacagttcttccagtgtca

SEQ ID NO: 9147378 - DNA, 22 bp, Homo sapiens
gggtaccaagctgcttgggggc

SEQ ID NO: 9147379 - DNA, 22 bp, Homo sapiens
gggtagcatgtgtcagagtttg

SEQ ID NO: 9147380 - DNA, 22 bp, Homo sapiens
gggtcccctcatcatggagact

SEQ ID NO: 9147381 - DNA, 20 bp, Homo sapiens
gggtccctccggcctgctat

SEQ ID NO: 9147382 - DNA, 20 bp, Homo sapiens
gggtccctccggcctgctat

SEQ ID NO: 9147383 - DNA, 22 bp, Homo sapiens
gggtccctcgttctgggatctg

SEQ ID NO: 9147384 - DNA, 22 bp, Homo sapiens
gggtccctcgttctgggatctg

SEQ ID NO: 9147385 - DNA, 22 bp, Homo sapiens
gggtccctggaattacttgaca

SEQ ID NO: 9147386 - DNA, 20 bp, Homo sapiens
gggtcctgacttggtctcct

SEQ ID NO: 9147387 - DNA, 22 bp, Homo sapiens
gggtcctgcgtgggcccaggac

SEQ ID NO: 9147388 - DNA, 22 bp, Homo sapiens
gggtcctggaatctgcatttta

SEQ ID NO: 9147389 - DNA, 22 bp, Homo sapiens
gggtcctgcgtgggcccaggac

SEQ ID NO: 9147390 - DNA, 22 bp, Homo sapiens
gggtcctgcgtgggcccaggac

SEQ ID NO: 9147391 - DNA, 21 bp, Homo sapiens
gggtcctgggatgggatccag

SEQ ID NO: 9147392 - DNA, 21 bp, Homo sapiens
gggtcctgggatgggatccag

SEQ ID NO: 9147393 - DNA, 18 bp, Homo sapiens
gggtcctgtgggagacag

SEQ ID NO: 9147394 - DNA, 18 bp, Homo sapiens
gggtcctgtgggagacag

SEQ ID NO: 9147395 - DNA, 18 bp, Homo sapiens
gggtcctgttcttggaag

SEQ ID NO: 9147396 - DNA, 18 bp, Homo sapiens
gggtcctgtgggagacag

SEQ ID NO: 9147397 - DNA, 22 bp, Homo sapiens
gggtgggatctgtggagcctca

SEQ ID NO: 9147398 - DNA, 22 bp, Homo sapiens
gggtgggatctgtggagcctca

SEQ ID NO: 9147399 - DNA, 22 bp, Homo sapiens
gggttccaaacatagtcttcct

SEQ ID NO: 9147400 - DNA, 22 bp, Homo sapiens
gggttcagtgatgccttcagga

SEQ ID NO: 9147401 - DNA, 22 bp, Homo sapiens
gggttcaggttggcctgagcac

SEQ ID NO: 9147402 - DNA, 22 bp, Homo sapiens
gggttaggttctagaggcacaa

SEQ ID NO: 9147403 - DNA, 22 bp, Homo sapiens
gggttcttatagtatcagagct

SEQ ID NO: 9147404 - DNA, 22 bp, Homo sapiens
gggttccagtctgaaactacag

SEQ ID NO: 9147405 - DNA, 22 bp, Homo sapiens
gggttccaatgatgagcaagag

SEQ ID NO: 9147406 - DNA, 22 bp, Homo sapiens
gggttcatcaaaggacagactc

SEQ ID NO: 9147407 - DNA, 22 bp, Homo sapiens
ggtatagtattatttgaaagag

SEQ ID NO: 9147408 - DNA, 22 bp, Homo sapiens
ggtagtcggccttgccctgggc

SEQ ID NO: 9147409 - DNA, 22 bp, Homo sapiens
ggtatgaattcactacttccaa

SEQ ID NO: 9147410 - DNA, 22 bp, Homo sapiens
ggtatgaaatgattccatgtta

SEQ ID NO: 9147411 - DNA, 22 bp, Homo sapiens
gggctgtgaggtgagaacttac

SEQ ID NO: 9147412 - DNA, 22 bp, Homo sapiens
gggctgtggagccgcgagggct

SEQ ID NO: 9147413 - DNA, 22 bp, Homo sapiens
gggctgtggagccgcgagggct

SEQ ID NO: 9147414 - DNA, 22 bp, Homo sapiens
gggctgtgtaatgtgctctttt

SEQ ID NO: 9147415 - DNA, 22 bp, Homo sapiens
gggctgtcacgcccctgcacct

SEQ ID NO: 9147416 - DNA, 22 bp, Homo sapiens
gggctgtccgcacatctggaat

SEQ ID NO: 9147417 - DNA, 22 bp, Homo sapiens
gggctgtaggagctggaatggg

SEQ ID NO: 9147418 - DNA, 22 bp, Homo sapiens
gggctggaggtgagcaggacag

SEQ ID NO: 9147419 - DNA, 22 bp, Homo sapiens
gggctggaggagatccagaggc

SEQ ID NO: 9147420 - DNA, 22 bp, Homo sapiens
cagagccagagacctgctgtgc

SEQ ID NO: 9147421 - DNA, 22 bp, Homo sapiens
cagagccagcagtggggacagg

SEQ ID NO: 9147422 - DNA, 22 bp, Homo sapiens
gggctggaggaccggcctcgga

SEQ ID NO: 9147423 - DNA, 22 bp, Homo sapiens
gggctggaggagatccagaggc

SEQ ID NO: 9147424 - DNA, 22 bp, Homo sapiens
cagagccacttggagatgagaa

SEQ ID NO: 9147425 - DNA, 22 bp, Homo sapiens
cagagccacttggagatgagaa

SEQ ID NO: 9147426 - DNA, 22 bp, Homo sapiens
ggggttggtttaaatgcttgag

SEQ ID NO: 9147427 - DNA, 20 bp, Homo sapiens
ggggttggctggcacaggga

SEQ ID NO: 9147428 - DNA, 22 bp, Homo sapiens
gggtaaatctcttttcatggct

SEQ ID NO: 9147429 - DNA, 22 bp, Homo sapiens
gggtacagagagatgaggtaac

SEQ ID NO: 9147430 - DNA, 22 bp, Homo sapiens
gggtacagaaactgaggcttag

SEQ ID NO: 9147431 - DNA, 22 bp, Homo sapiens
gggtacagagagatgaggtaac

SEQ ID NO: 9147432 - DNA, 22 bp, Homo sapiens
ggggccttggatctgtgccccg

SEQ ID NO: 9147433 - DNA, 19 bp, Homo sapiens
ggggcctgtgatggtcaca

SEQ ID NO: 9147434 - DNA, 19 bp, Homo sapiens
ggggcctgtgatggtcaca

SEQ ID NO: 9147435 - DNA, 22 bp, Homo sapiens
ggggcctgtagagcttcaggga

SEQ ID NO: 9147436 - DNA, 22 bp, Homo sapiens
ggggtgagctgggcctgtgcct

SEQ ID NO: 9147437 - DNA, 22 bp, Homo sapiens
ggggccttttctgaatgtggaa

SEQ ID NO: 9147438 - DNA, 22 bp, Homo sapiens
ggggccttttctgaatgtggaa

SEQ ID NO: 9147439 - DNA, 22 bp, Homo sapiens
ggggccttttctgaatgtggaa

SEQ ID NO: 9147440 - DNA, 22 bp, Homo sapiens
ggggccttggatctgtgccccg

SEQ ID NO: 9147441 - DNA, 22 bp, Homo sapiens
ggggccttggatctgtgccccg

SEQ ID NO: 9147442 - DNA, 22 bp, Homo sapiens
ggggccttggatctgtgccccg

SEQ ID NO: 9147443 - DNA, 21 bp, Homo sapiens
ggggcagagctaggccctgca

SEQ ID NO: 9147444 - DNA, 21 bp, Homo sapiens
ggggcagagctaggccctgca

SEQ ID NO: 9147445 - DNA, 22 bp, Homo sapiens
ggggcagagtagctggggtgtg

SEQ ID NO: 9147446 - DNA, 22 bp, Homo sapiens
ggggcagagtagctggggtgtg

SEQ ID NO: 9147447 - DNA, 22 bp, Homo sapiens
ggggcctcgccgccgcctctgc

SEQ ID NO: 9147448 - DNA, 22 bp, Homo sapiens
ggggcctctgcagtcacgctgg

SEQ ID NO: 9147449 - DNA, 23 bp, Homo sapiens
ggggcctgcaccggtctgcgcgg

SEQ ID NO: 9147450 - DNA, 23 bp, Homo sapiens
ggggcctgcaccggtctgcgcgg

SEQ ID NO: 9147451 - DNA, 22 bp, Homo sapiens
ggggcagagtctggactgttgt

SEQ ID NO: 9147452 - DNA, 22 bp, Homo sapiens
ggggcagatggaacagagcaca

SEQ ID NO: 9147453 - DNA, 22 bp, Homo sapiens
ggggcagatggaacagagcaca

SEQ ID NO: 9147454 - DNA, 22 bp, Homo sapiens
ggggcagatggaacagagcaca

SEQ ID NO: 9147455 - DNA, 22 bp, Homo sapiens
ggggcagctaccggaagtaggg

SEQ ID NO: 9147456 - DNA, 22 bp, Homo sapiens
cagaaacagacatgacgcagta

SEQ ID NO: 9147457 - DNA, 22 bp, Homo sapiens
cagaaacacttgtagagaagtt

SEQ ID NO: 9147458 - DNA, 22 bp, Homo sapiens
cagacaaagcggaaactgttta

SEQ ID NO: 9147459 - DNA, 22 bp, Homo sapiens
cagaatttagaaaacaacataa

SEQ ID NO: 9147460 - DNA, 22 bp, Homo sapiens
cagaatttcagtgatgttttct

SEQ ID NO: 9147461 - DNA, 22 bp, Homo sapiens
ggctggcacctgccctccgctg

SEQ ID NO: 9147462 - DNA, 22 bp, Homo sapiens
ggctggcacccttggggatagg

SEQ ID NO: 9147463 - DNA, 22 bp, Homo sapiens
ggctggcacagagggctggtgt

SEQ ID NO: 9147464 - DNA, 22 bp, Homo sapiens
ggctggcacgaagccctgctgg

SEQ ID NO: 9147465 - DNA, 22 bp, Homo sapiens
ggctggcaagtgtctgctcatg

SEQ ID NO: 9147466 - DNA, 22 bp, Homo sapiens
ggctggcaagtcagtgctgatg

SEQ ID NO: 9147467 - DNA, 22 bp, Homo sapiens
cagaaacacttgtagagaagtt

SEQ ID NO: 9147468 - DNA, 22 bp, Homo sapiens
cagaaaatagagtttctctgag

SEQ ID NO: 9147469 - DNA, 22 bp, Homo sapiens
gggaggagggtgctggctaaac

SEQ ID NO: 9147470 - DNA, 22 bp, Homo sapiens
gggaggagtgaagattcacctg

SEQ ID NO: 9147471 - DNA, 22 bp, Homo sapiens
gggaggagtgaagattcacctg

SEQ ID NO: 9147472 - DNA, 22 bp, Homo sapiens
gggaggagtgaagattcacctg

SEQ ID NO: 9147473 - DNA, 21 bp, Homo sapiens
gggagctggaaactgggtgac

SEQ ID NO: 9147474 - DNA, 21 bp, Homo sapiens
gggagctggaaactgggtgac

SEQ ID NO: 9147475 - DNA, 20 bp, Homo sapiens
gggagctggaattgtcttag

SEQ ID NO: 9147476 - DNA, 22 bp, Homo sapiens
gggagctgctgaacacaagggt

SEQ ID NO: 9147477 - DNA, 22 bp, Homo sapiens
gggagctgcggtcttgcgaaga

SEQ ID NO: 9147478 - DNA, 22 bp, Homo sapiens
cagacacttattgagcaagtac

SEQ ID NO: 9147479 - DNA, 22 bp, Homo sapiens
cagacagaaggaaggccaacat

SEQ ID NO: 9147480 - DNA, 22 bp, Homo sapiens
gggagctgatgatgtaagtccc

SEQ ID NO: 9147481 - DNA, 22 bp, Homo sapiens
gggagccaaggagagaggcctt

SEQ ID NO: 9147482 - DNA, 22 bp, Homo sapiens
cagacactaggtgacagagtgc

SEQ ID NO: 9147483 - DNA, 22 bp, Homo sapiens
cagacactatgctaaggtacta

SEQ ID NO: 9147484 - DNA, 22 bp, Homo sapiens
gggatgagagctgggacagaag

SEQ ID NO: 9147485 - DNA, 22 bp, Homo sapiens
gggatgacaattcaagggctgg

SEQ ID NO: 9147486 - DNA, 22 bp, Homo sapiens
gggatgacagctatggaactct

SEQ ID NO: 9147487 - DNA, 23 bp, Homo sapiens
gggatctgtaagttgaagacaaa

SEQ ID NO: 9147488 - DNA, 23 bp, Homo sapiens
gggatctgtaaacctggagaacc

SEQ ID NO: 9147489 - DNA, 22 bp, Homo sapiens
gggatctggaattttggtatgt

SEQ ID NO: 9147490 - DNA, 22 bp, Homo sapiens
gggatctgggacaacaggtggt

SEQ ID NO: 9147491 - DNA, 22 bp, Homo sapiens
gggatctgtgttgcgatggatt

SEQ ID NO: 9147492 - DNA, 22 bp, Homo sapiens
cagagcacccaaggagcatttg

SEQ ID NO: 9147493 - DNA, 22 bp, Homo sapiens
cagagaggatggattccatagc

SEQ ID NO: 9147494 - DNA, 22 bp, Homo sapiens
cagagcacctgctcattgccag

SEQ ID NO: 9147495 - DNA, 22 bp, Homo sapiens
cagagcactgcttggaggattt

SEQ ID NO: 9147496 - DNA, 22 bp, Homo sapiens
cagagaggaggctatatgcaaa

SEQ ID NO: 9147497 - DNA, 22 bp, Homo sapiens
cagagaggaggctatatgcaaa

SEQ ID NO: 9147498 - DNA, 22 bp, Homo sapiens
cagagcactgcttggaggattt

SEQ ID NO: 9147499 - DNA, 22 bp, Homo sapiens
cagagcagaaacctgggtgatt

SEQ ID NO: 9147500 - DNA, 22 bp, Homo sapiens
cagagacaacctggtagagaaa

SEQ ID NO: 9147501 - DNA, 22 bp, Homo sapiens
cagagacaacctggtagagaaa

SEQ ID NO: 9147502 - DNA, 22 bp, Homo sapiens
cagagacaacctggtagagaaa

SEQ ID NO: 9147503 - DNA, 22 bp, Homo sapiens
cagagacaccccagaaaataag

SEQ ID NO: 9147504 - DNA, 22 bp, Homo sapiens
cagagacacttaacaggaatgg

SEQ ID NO: 9147505 - DNA, 22 bp, Homo sapiens
cagagacacttaacaggaatgg

SEQ ID NO: 9147506 - DNA, 22 bp, Homo sapiens
gggatctgatttaggatgggag

SEQ ID NO: 9147507 - DNA, 22 bp, Homo sapiens
gggatctgctccagagggaaaa

SEQ ID NO: 9147508 - DNA, 22 bp, Homo sapiens
cagagaagagtctggcctctct

SEQ ID NO: 9147509 - DNA, 22 bp, Homo sapiens
cagagaagagtctggcctctct

SEQ ID NO: 9147510 - DNA, 22 bp, Homo sapiens
cagagaagaaagtgactataat

SEQ ID NO: 9147511 - DNA, 22 bp, Homo sapiens
cagagaagaaagtgactataat

SEQ ID NO: 9147512 - DNA, 22 bp, Homo sapiens
cagagccacagcctccagattt

SEQ ID NO: 9147513 - DNA, 20 bp, Homo sapiens
cagagccaagagcagcatct

SEQ ID NO: 9147514 - DNA, 22 bp, Homo sapiens
cagagcagtggagagtaggtct

SEQ ID NO: 9147515 - DNA, 22 bp, Homo sapiens
cagagcagtgaggagttgtgta

SEQ ID NO: 9147516 - DNA, 22 bp, Homo sapiens
cagagcagtgaggagttgtgta

SEQ ID NO: 9147517 - DNA, 22 bp, Homo sapiens
cagagcagtgaggagttgtgta

SEQ ID NO: 9147518 - DNA, 20 bp, Homo sapiens
cagagcagtgcccaggcggc

SEQ ID NO: 9147519 - DNA, 19 bp, Homo sapiens
cagagcagtggttcctgaa

SEQ ID NO: 9147520 - DNA, 22 bp, Homo sapiens
cagagcataattgacatgaggt

SEQ ID NO: 9147521 - DNA, 19 bp, Homo sapiens
cagagcagtggttcctgaa

SEQ ID NO: 9147522 - DNA, 22 bp, Homo sapiens
cagagcagtggggttggtcaga

SEQ ID NO: 9147523 - DNA, 17 bp, Homo sapiens
gggcagggactcctggg

SEQ ID NO: 9147524 - DNA, 22 bp, Homo sapiens
gggcaggggtagcattccaagt

SEQ ID NO: 9147525 - DNA, 22 bp, Homo sapiens
gggcaggggtcagtggccccaa

SEQ ID NO: 9147526 - DNA, 22 bp, Homo sapiens
cagagcagacgttgagattaag

SEQ ID NO: 9147527 - DNA, 22 bp, Homo sapiens
cagagcagaaggtccaagcctg

SEQ ID NO: 9147528 - DNA, 22 bp, Homo sapiens
cagagcaggggtttcccaggtt

SEQ ID NO: 9147529 - DNA, 22 bp, Homo sapiens
cagagcaggcccactgccctcc

SEQ ID NO: 9147530 - DNA, 22 bp, Homo sapiens
gggcaggggtcagtggccccaa

SEQ ID NO: 9147531 - DNA, 22 bp, Homo sapiens
atgagacacatgtgacttcttt

SEQ ID NO: 9147532 - DNA, 22 bp, Homo sapiens
atgagaaagttaatcatcatga

SEQ ID NO: 9147533 - DNA, 22 bp, Homo sapiens
atgagaaatttattacaagcta

SEQ ID NO: 9147534 - DNA, 22 bp, Homo sapiens
atgagataattcatgtggaatg

SEQ ID NO: 9147535 - DNA, 22 bp, Homo sapiens
atgagcaagccagttccagagt

SEQ ID NO: 9147536 - DNA, 22 bp, Homo sapiens
atgagcaagagctatgtacaga

SEQ ID NO: 9147537 - DNA, 22 bp, Homo sapiens
atgagatgttcaggagtctgag

SEQ ID NO: 9147538 - DNA, 22 bp, Homo sapiens
ctttttcattggctttaggaca

SEQ ID NO: 9147539 - DNA, 19 bp, Homo sapiens
ctttttcaccttctagaag

SEQ ID NO: 9147540 - DNA, 22 bp, Homo sapiens
ctttttatctcttaatgatgtt

SEQ ID NO: 9147541 - DNA, 22 bp, Homo sapiens
ctttttatctcttaatgatgtt

SEQ ID NO: 9147542 - DNA, 22 bp, Homo sapiens
atgacagaccctctaaagacaa

SEQ ID NO: 9147543 - DNA, 22 bp, Homo sapiens
atgacagaggattgtaaagagg

SEQ ID NO: 9147544 - DNA, 22 bp, Homo sapiens
atgacagaggattgtaaagagg

SEQ ID NO: 9147545 - DNA, 19 bp, Homo sapiens
atgacagagttgataagtg

SEQ ID NO: 9147546 - DNA, 22 bp, Homo sapiens
ctttttatagctatgtcctatg

SEQ ID NO: 9147547 - DNA, 22 bp, Homo sapiens
ctttttataccgtgccagttga

SEQ ID NO: 9147548 - DNA, 18 bp, Homo sapiens
cttttgttttccctcctc

SEQ ID NO: 9147549 - DNA, 22 bp, Homo sapiens
cttttgttgcccttgtcgcagg

SEQ ID NO: 9147550 - DNA, 22 bp, Homo sapiens
ctttggctaacaaatcagcttg

SEQ ID NO: 9147551 - DNA, 22 bp, Homo sapiens
ctttggctacaagcgctgcaat

SEQ ID NO: 9147552 - DNA, 22 bp, Homo sapiens
ctttggctgacaggtttctggt

SEQ ID NO: 9147553 - DNA, 22 bp, Homo sapiens
ctttggctctttagaattccct

SEQ ID NO: 9147554 - DNA, 22 bp, Homo sapiens
ctttgctttactcccactgtgt

SEQ ID NO: 9147555 - DNA, 22 bp, Homo sapiens
ctttgcttactggtgtctgcat

SEQ ID NO: 9147556 - DNA, 22 bp, Homo sapiens
ctttgcttactggtgtctgcat

SEQ ID NO: 9147557 - DNA, 22 bp, Homo sapiens
ctttgcttctccaacctgctca

SEQ ID NO: 9147558 - DNA, 22 bp, Homo sapiens
ctttctttcgaagacgtgatta

SEQ ID NO: 9147559 - DNA, 19 bp, Homo sapiens
ctttgccaaaagaggccat

SEQ ID NO: 9147560 - DNA, 22 bp, Homo sapiens
ctttgccatgttgcctgcagaa

SEQ ID NO: 9147561 - DNA, 22 bp, Homo sapiens
ctttgccagagaggctggcaca

SEQ ID NO: 9147562 - DNA, 19 bp, Homo sapiens
ctttgccactgataggagt

SEQ ID NO: 9147563 - DNA, 22 bp, Homo sapiens
ctttgccagagaggctggcaca

SEQ ID NO: 9147564 - DNA, 19 bp, Homo sapiens
ctttgccaaaagaggccat

SEQ ID NO: 9147565 - DNA, 23 bp, Homo sapiens
ctttgccacccagagcctgacag

SEQ ID NO: 9147566 - DNA, 23 bp, Homo sapiens
ctttgccacccagagcctgacag

SEQ ID NO: 9147567 - DNA, 22 bp, Homo sapiens
ctttgccatgttgcctgcagaa

SEQ ID NO: 9147568 - DNA, 18 bp, Homo sapiens
ctttgctataaattgtat

SEQ ID NO: 9147569 - DNA, 22 bp, Homo sapiens
ctttgctgttataatgatagct

SEQ ID NO: 9147570 - DNA, 22 bp, Homo sapiens
ctttgctgagctggttgttcaa

SEQ ID NO: 9147571 - DNA, 21 bp, Homo sapiens
ctttggtatttcactcacata

SEQ ID NO: 9147572 - DNA, 22 bp, Homo sapiens
ctttggtacgctttacatgttt

SEQ ID NO: 9147573 - DNA, 22 bp, Homo sapiens
ctttggtaaatgtcaaaaagtt

SEQ ID NO: 9147574 - DNA, 22 bp, Homo sapiens
ctttggcttttagatatccatt

SEQ ID NO: 9147575 - DNA, 22 bp, Homo sapiens
ctttggcttgccctggcagtac

SEQ ID NO: 9147576 - DNA, 22 bp, Homo sapiens
ctttggctgggcaaagggaggt

SEQ ID NO: 9147577 - DNA, 22 bp, Homo sapiens
atgacactcgaaaaattgatgc

SEQ ID NO: 9147578 - DNA, 22 bp, Homo sapiens
atgacacataaaacaaggactg

SEQ ID NO: 9147579 - DNA, 22 bp, Homo sapiens
atctttcaatcaggaaaaatct

SEQ ID NO: 9147580 - DNA, 22 bp, Homo sapiens
atctttcagggccatttgtatt

SEQ ID NO: 9147581 - DNA, 21 bp, Homo sapiens
atctttattacgcagagaaga

SEQ ID NO: 9147582 - DNA, 22 bp, Homo sapiens
atctttatttattgagcactta

SEQ ID NO: 9147583 - DNA, 22 bp, Homo sapiens
atctttcaatcaggaaaaatct

SEQ ID NO: 9147584 - DNA, 22 bp, Homo sapiens
cttctcctgtaagaagatcaaa

SEQ ID NO: 9147585 - DNA, 22 bp, Homo sapiens
cttctcctgtaagaagatcaaa

SEQ ID NO: 9147586 - DNA, 22 bp, Homo sapiens
atctttcatctctattatttga

SEQ ID NO: 9147587 - DNA, 22 bp, Homo sapiens
atctttctatttctaaaaacta

SEQ ID NO: 9147588 - DNA, 22 bp, Homo sapiens
atctttctatggtactttctcc

SEQ ID NO: 9147589 - DNA, 22 bp, Homo sapiens
atctttctatttctaaaaacta

SEQ ID NO: 9147590 - DNA, 22 bp, Homo sapiens
atctttctctgcactatacaat

SEQ ID NO: 9147591 - DNA, 22 bp, Homo sapiens
atctttcttatttgaagaaaga

SEQ ID NO: 9147592 - DNA, 22 bp, Homo sapiens
atctggagaataaatgtccaag

SEQ ID NO: 9147593 - DNA, 22 bp, Homo sapiens
atctggagaaaccgccaaggga

SEQ ID NO: 9147594 - DNA, 22 bp, Homo sapiens
atctggagaataaatgtccaag

SEQ ID NO: 9147595 - DNA, 22 bp, Homo sapiens
atctggagaaaccgccaaggga

SEQ ID NO: 9147596 - DNA, 22 bp, Homo sapiens
cttctccagccacgcccactcc

SEQ ID NO: 9147597 - DNA, 22 bp, Homo sapiens
cttctccagccacgcccactcc

SEQ ID NO: 9147598 - DNA, 18 bp, Homo sapiens
cttctcccatcttggcca

SEQ ID NO: 9147599 - DNA, 22 bp, Homo sapiens
cttctccctggcttctgcacac

SEQ ID NO: 9147600 - DNA, 17 bp, Homo sapiens
cttgttttccactggga

SEQ ID NO: 9147601 - DNA, 22 bp, Homo sapiens
ctttacataaggataaacctgg

SEQ ID NO: 9147602 - DNA, 22 bp, Homo sapiens
ctttacataaggataaacctgg

SEQ ID NO: 9147603 - DNA, 22 bp, Homo sapiens
atctttgcccagagactcagcc

SEQ ID NO: 9147604 - DNA, 22 bp, Homo sapiens
atctttgctattgtaaatcacg

SEQ ID NO: 9147605 - DNA, 22 bp, Homo sapiens
atctttggaaagccaagcacag

SEQ ID NO: 9147606 - DNA, 20 bp, Homo sapiens
atctttggctcagaagcctt

SEQ ID NO: 9147607 - DNA, 20 bp, Homo sapiens
atctttggctcagaagcctt

SEQ ID NO: 9147608 - DNA, 22 bp, Homo sapiens
atctttggccacttgtgctgca

SEQ ID NO: 9147609 - DNA, 22 bp, Homo sapiens
atctttggatcgctcccccttc

SEQ ID NO: 9147610 - DNA, 22 bp, Homo sapiens
cttgttttaaactgttgtggct

SEQ ID NO: 9147611 - DNA, 22 bp, Homo sapiens
ctttattagatgtagactttct

SEQ ID NO: 9147612 - DNA, 22 bp, Homo sapiens
ctttattagatgtagactttct

SEQ ID NO: 9147613 - DNA, 22 bp, Homo sapiens
ctttattcctacaagattttct

SEQ ID NO: 9147614 - DNA, 22 bp, Homo sapiens
ctttattcctacaagattttct

SEQ ID NO: 9147615 - DNA, 22 bp, Homo sapiens
ctttattcctacaagattttct

SEQ ID NO: 9147616 - DNA, 22 bp, Homo sapiens
ctttattgtccttcttaggtgg

SEQ ID NO: 9147617 - DNA, 22 bp, Homo sapiens
ctttattgtccttcttaggtgg

SEQ ID NO: 9147618 - DNA, 22 bp, Homo sapiens
ctttattgtccttcttaggtgg

SEQ ID NO: 9147619 - DNA, 22 bp, Homo sapiens
ctttattctgcaaattgccttg

SEQ ID NO: 9147620 - DNA, 22 bp, Homo sapiens
ctttattctgcaaattgccttg

SEQ ID NO: 9147621 - DNA, 22 bp, Homo sapiens
ctttacatcctgtttcccgttt

SEQ ID NO: 9147622 - DNA, 22 bp, Homo sapiens
ctttacattaatttctactgat

SEQ ID NO: 9147623 - DNA, 22 bp, Homo sapiens
ctttacttctcaaaataaagca

SEQ ID NO: 9147624 - DNA, 22 bp, Homo sapiens
ctttacttcagcaagctttcct

SEQ ID NO: 9147625 - DNA, 22 bp, Homo sapiens
ctttactgtttggtgctctatt

SEQ ID NO: 9147626 - DNA, 22 bp, Homo sapiens
ctttatgtgtactttccatttt

SEQ ID NO: 9147627 - DNA, 22 bp, Homo sapiens
ctttagaaatctggatgtattt

SEQ ID NO: 9147628 - DNA, 22 bp, Homo sapiens
atgccactgcactccagcctag

SEQ ID NO: 9147629 - DNA, 22 bp, Homo sapiens
atgccactgcactccagcctag

SEQ ID NO: 9147630 - DNA, 22 bp, Homo sapiens
atgccactgcactccagcctag

SEQ ID NO: 9147631 - DNA, 22 bp, Homo sapiens
atgccactgcactccagcctgg

SEQ ID NO: 9147632 - DNA, 22 bp, Homo sapiens
atgccactgcactccagcctgg

SEQ ID NO: 9147633 - DNA, 22 bp, Homo sapiens
atgccactgcactccagcctgg

SEQ ID NO: 9147634 - DNA, 22 bp, Homo sapiens
gaatttcagaggtaacatcatc

SEQ ID NO: 9147635 - DNA, 22 bp, Homo sapiens
gaatttcagaggtaacatcatc

SEQ ID NO: 9147636 - DNA, 19 bp, Homo sapiens
gaatttatctcttcagtcc

SEQ ID NO: 9147637 - DNA, 22 bp, Homo sapiens
atgccactgcacttcagcctgg

SEQ ID NO: 9147638 - DNA, 22 bp, Homo sapiens
gaagtccaagatcaaggcccca

SEQ ID NO: 9147639 - DNA, 22 bp, Homo sapiens
atgcagttttaggggaagggtt

SEQ ID NO: 9147640 - DNA, 22 bp, Homo sapiens
atgcagttttaaatcatttcag

SEQ ID NO: 9147641 - DNA, 18 bp, Homo sapiens
atgcagttggtactctca

SEQ ID NO: 9147642 - DNA, 22 bp, Homo sapiens
atgcagttccacaggcgcatgg

SEQ ID NO: 9147643 - DNA, 22 bp, Homo sapiens
gaatttcatttgtttcctacca

SEQ ID NO: 9147644 - DNA, 22 bp, Homo sapiens
gaatttcctctaaacccctgag

SEQ ID NO: 9147645 - DNA, 22 bp, Homo sapiens
gaatttgaaaagtgatgggaat

SEQ ID NO: 9147646 - DNA, 22 bp, Homo sapiens
gaatttggggtgtgttatttca

SEQ ID NO: 9147647 - DNA, 22 bp, Homo sapiens
gaattttagaatatgtgggctt

SEQ ID NO: 9147648 - DNA, 22 bp, Homo sapiens
gaattttaataaaggtttatca

SEQ ID NO: 9147649 - DNA, 22 bp, Homo sapiens
gaattttaagtgttcgcctctt

SEQ ID NO: 9147650 - DNA, 22 bp, Homo sapiens
atgctacagagataggttgggt

SEQ ID NO: 9147651 - DNA, 22 bp, Homo sapiens
atgctacactccgcgaaaatgt

SEQ ID NO: 9147652 - DNA, 22 bp, Homo sapiens
atgctacagagtttgaatatgt

SEQ ID NO: 9147653 - DNA, 22 bp, Homo sapiens
atgctacaacattatctggggt

SEQ ID NO: 9147654 - DNA, 23 bp, Homo sapiens
atgctacaccaacacaggggaat

SEQ ID NO: 9147655 - DNA, 22 bp, Homo sapiens
atgctacactatttgctgagca

SEQ ID NO: 9147656 - DNA, 22 bp, Homo sapiens
atgctaaatggccagtaccaaa

SEQ ID NO: 9147657 - DNA, 22 bp, Homo sapiens
atgctaaactatgatcattttc

SEQ ID NO: 9147658 - DNA, 22 bp, Homo sapiens
atgctaaactatgatcattttc

SEQ ID NO: 9147659 - DNA, 16 bp, Homo sapiens
atgctgctattagagg

SEQ ID NO: 9147660 - DNA, 16 bp, Homo sapiens
atgctgctattagagg

SEQ ID NO: 9147661 - DNA, 22 bp, Homo sapiens
atgctcttgaggctaaagacat

SEQ ID NO: 9147662 - DNA, 22 bp, Homo sapiens
gacaggaaacaagaaggcagga

SEQ ID NO: 9147663 - DNA, 22 bp, Homo sapiens
gacagcttgcctggtactgcaa

SEQ ID NO: 9147664 - DNA, 22 bp, Homo sapiens
gacagcttgcctggtactgcaa

SEQ ID NO: 9147665 - DNA, 22 bp, Homo sapiens
atgctagaagggagcactatgt

SEQ ID NO: 9147666 - DNA, 22 bp, Homo sapiens
atgctatagaaatatttaaatt

SEQ ID NO: 9147667 - DNA, 22 bp, Homo sapiens
atgctacaggaagacgtcaggc

SEQ ID NO: 9147668 - DNA, 22 bp, Homo sapiens
atgctacagccctctttgcata

SEQ ID NO: 9147669 - DNA, 22 bp, Homo sapiens
atgctacagcatctctcatcag

SEQ ID NO: 9147670 - DNA, 18 bp, Homo sapiens
atgctacaggcaggtgtc

SEQ ID NO: 9147671 - DNA, 22 bp, Homo sapiens
atgctacaggattctccttatc

SEQ ID NO: 9147672 - DNA, 22 bp, Homo sapiens
atgctacaggagccccacttag

SEQ ID NO: 9147673 - DNA, 22 bp, Homo sapiens
atgctacattttggtttataaa

SEQ ID NO: 9147674 - DNA, 22 bp, Homo sapiens
atgctacatagatacaaaaatg

SEQ ID NO: 9147675 - DNA, 22 bp, Homo sapiens
atgctactatccttctgcttaa

SEQ ID NO: 9147676 - DNA, 22 bp, Homo sapiens
gaagccttgaactgcaaacccc

SEQ ID NO: 9147677 - DNA, 22 bp, Homo sapiens
gaagccttgaactgcaaacccc

SEQ ID NO: 9147678 - DNA, 22 bp, Homo sapiens
gaagctaaaccacagctaagaa

SEQ ID NO: 9147679 - DNA, 22 bp, Homo sapiens
gaagcctggttcgctggccacc

SEQ ID NO: 9147680 - DNA, 22 bp, Homo sapiens
gaagcctgtcacttcccttgct

SEQ ID NO: 9147681 - DNA, 22 bp, Homo sapiens
gaagcctggtccagagctccca

SEQ ID NO: 9147682 - DNA, 22 bp, Homo sapiens
gaagcctgctgtgcagccaaat

SEQ ID NO: 9147683 - DNA, 22 bp, Homo sapiens
gaagcctgacactggccatcag

SEQ ID NO: 9147684 - DNA, 22 bp, Homo sapiens
gaagctgggtcgctgggatcct

SEQ ID NO: 9147685 - DNA, 22 bp, Homo sapiens
gaagctgtgctgggggatctgt

SEQ ID NO: 9147686 - DNA, 22 bp, Homo sapiens
gaagctggggtgctgagggcaa

SEQ ID NO: 9147687 - DNA, 22 bp, Homo sapiens
gaagctggctgaagttcagcta

SEQ ID NO: 9147688 - DNA, 22 bp, Homo sapiens
gaaggaggcgttagccctagga

SEQ ID NO: 9147689 - DNA, 22 bp, Homo sapiens
gaaggagggagcggcgcggatt

SEQ ID NO: 9147690 - DNA, 22 bp, Homo sapiens
atgcaggagaccaattggatgg

SEQ ID NO: 9147691 - DNA, 22 bp, Homo sapiens
gaaggcaacaccaggatgcact

SEQ ID NO: 9147692 - DNA, 22 bp, Homo sapiens
atgcaggagaccaattggatgg

SEQ ID NO: 9147693 - DNA, 22 bp, Homo sapiens
atgcaggagagcatgtttaaga

SEQ ID NO: 9147694 - DNA, 22 bp, Homo sapiens
atgcaggagccctcttgagggc

SEQ ID NO: 9147695 - DNA, 22 bp, Homo sapiens
atgcaggaggactaaagggatg

SEQ ID NO: 9147696 - DNA, 22 bp, Homo sapiens
atgcaggagttcgaggctgtat

SEQ ID NO: 9147697 - DNA, 22 bp, Homo sapiens
atgcagttaggtaatagtctca

SEQ ID NO: 9147698 - DNA, 22 bp, Homo sapiens
atgcagttagcagtagctcccc

SEQ ID NO: 9147699 - DNA, 22 bp, Homo sapiens
atgcagttatgtgagggcatga

SEQ ID NO: 9147700 - DNA, 22 bp, Homo sapiens
atgcagttagtatacttccagt

SEQ ID NO: 9147701 - DNA, 22 bp, Homo sapiens
atgcagtgtttggaagcttaag

SEQ ID NO: 9147702 - DNA, 23 bp, Homo sapiens
atgcagtatatgtcagtagttta

SEQ ID NO: 9147703 - DNA, 22 bp, Homo sapiens
atgcagtataaatcatttctgg

SEQ ID NO: 9147704 - DNA, 22 bp, Homo sapiens
atgcagtagataggcactttta

SEQ ID NO: 9147705 - DNA, 22 bp, Homo sapiens
atgcagtactgatacatgccac

SEQ ID NO: 9147706 - DNA, 22 bp, Homo sapiens
atgcagtaaatgttaagaaaaa

SEQ ID NO: 9147707 - DNA, 22 bp, Homo sapiens
atgcagtaaaataggaggtaat

SEQ ID NO: 9147708 - DNA, 22 bp, Homo sapiens
atgcagtaaatgttctagtttg

SEQ ID NO: 9147709 - DNA, 22 bp, Homo sapiens
atgcagtacatacaaacactga

SEQ ID NO: 9147710 - DNA, 22 bp, Homo sapiens
atgcagtacagataattctaca

SEQ ID NO: 9147711 - DNA, 22 bp, Homo sapiens
atgatgtaatggaaagaacaga

SEQ ID NO: 9147712 - DNA, 22 bp, Homo sapiens
gaagagccaggtgtcgctgtgg

SEQ ID NO: 9147713 - DNA, 22 bp, Homo sapiens
gaagagctaaaggcacaggctt

SEQ ID NO: 9147714 - DNA, 21 bp, Homo sapiens
gaagagagtcctcatcctgag

SEQ ID NO: 9147715 - DNA, 21 bp, Homo sapiens
gaagagagtcctcatcctgag

SEQ ID NO: 9147716 - DNA, 22 bp, Homo sapiens
gaagagatgacaaaggagcatg

SEQ ID NO: 9147717 - DNA, 22 bp, Homo sapiens
gaagagcatatgaagagcatat

SEQ ID NO: 9147718 - DNA, 22 bp, Homo sapiens
gaagagcatatgaagagcatat

SEQ ID NO: 9147719 - DNA, 22 bp, Homo sapiens
gaagagagcagcaaactggagt

SEQ ID NO: 9147720 - DNA, 22 bp, Homo sapiens
gaagagagcagcaaactggagt

SEQ ID NO: 9147721 - DNA, 22 bp, Homo sapiens
gaagagagagtggggttctgcg

SEQ ID NO: 9147722 - DNA, 22 bp, Homo sapiens
gaagagagccgcgggacatcag

SEQ ID NO: 9147723 - DNA, 22 bp, Homo sapiens
gaagagagaacattacataaac

SEQ ID NO: 9147724 - DNA, 22 bp, Homo sapiens
gaagagagaacattacataaac

SEQ ID NO: 9147725 - DNA, 22 bp, Homo sapiens
gaagagagagccctggggtccg

SEQ ID NO: 9147726 - DNA, 22 bp, Homo sapiens
gaagagagagccctggggtccg

SEQ ID NO: 9147727 - DNA, 22 bp, Homo sapiens
gaagagaaggtgtaggccatcc

SEQ ID NO: 9147728 - DNA, 22 bp, Homo sapiens
gaagaaagggaattaacttgag

SEQ ID NO: 9147729 - DNA, 22 bp, Homo sapiens
atgagcagtttttaagtagcaa

SEQ ID NO: 9147730 - DNA, 22 bp, Homo sapiens
atgagctaagcagaaagcacac

SEQ ID NO: 9147731 - DNA, 22 bp, Homo sapiens
atgagctagaaaaccatgtgga

SEQ ID NO: 9147732 - DNA, 19 bp, Homo sapiens
atgagctggcatttcaggt

SEQ ID NO: 9147733 - DNA, 22 bp, Homo sapiens
atgagctgtaaggtggcttcct

SEQ ID NO: 9147734 - DNA, 22 bp, Homo sapiens
atgagctgggccatccagtgat

SEQ ID NO: 9147735 - DNA, 22 bp, Homo sapiens
atgagctgggccatccagtgat

SEQ ID NO: 9147736 - DNA, 22 bp, Homo sapiens
atgctgtggaagttcctgaagc

SEQ ID NO: 9147737 - DNA, 22 bp, Homo sapiens
atgctgtgctggctaaccatgg

SEQ ID NO: 9147738 - DNA, 22 bp, Homo sapiens
atgctgtgccttctctgtgcca

SEQ ID NO: 9147739 - DNA, 22 bp, Homo sapiens
atgctgtgcctggaaagcggct

SEQ ID NO: 9147740 - DNA, 22 bp, Homo sapiens
atgctgtgcctggaaagcggct

SEQ ID NO: 9147741 - DNA, 22 bp, Homo sapiens
atgctgtgagtgtgccgcagag

SEQ ID NO: 9147742 - DNA, 22 bp, Homo sapiens
atgctgtgattgtagaaatatt

SEQ ID NO: 9147743 - DNA, 22 bp, Homo sapiens
atgctgtgaaaaagaaggctga

SEQ ID NO: 9147744 - DNA, 22 bp, Homo sapiens
atgctgtgaaaaagaaggctga

SEQ ID NO: 9147745 - DNA, 22 bp, Homo sapiens
atgctgtccactcttggtgttt

SEQ ID NO: 9147746 - DNA, 22 bp, Homo sapiens
atgctgtctctgctatccaaag

SEQ ID NO: 9147747 - DNA, 22 bp, Homo sapiens
atgctgtggtagacagcattcc

SEQ ID NO: 9147748 - DNA, 22 bp, Homo sapiens
atgctgtgtattttactctttc

SEQ ID NO: 9147749 - DNA, 22 bp, Homo sapiens
atgctgtgtattttactctttc

SEQ ID NO: 9147750 - DNA, 22 bp, Homo sapiens
atgctgtgtcaggaatttgata

SEQ ID NO: 9147751 - DNA, 22 bp, Homo sapiens
atgctgtgtcaccttaggattt

SEQ ID NO: 9147752 - DNA, 22 bp, Homo sapiens
atgctgtggccagagttcaact

SEQ ID NO: 9147753 - DNA, 22 bp, Homo sapiens
atgctgtggatgccttgcccca

SEQ ID NO: 9147754 - DNA, 22 bp, Homo sapiens
atgctgtggggagtgagggtag

SEQ ID NO: 9147755 - DNA, 22 bp, Homo sapiens
atgctgggacgtacttgttcat

SEQ ID NO: 9147756 - DNA, 22 bp, Homo sapiens
atgctgggaagacaaggtggag

SEQ ID NO: 9147757 - DNA, 22 bp, Homo sapiens
atgctgggaagtcctaaccaca

SEQ ID NO: 9147758 - DNA, 16 bp, Homo sapiens
atgctgctattagagg

SEQ ID NO: 9147759 - DNA, 16 bp, Homo sapiens
atgctgctattagagg

SEQ ID NO: 9147760 - DNA, 22 bp, Homo sapiens
atgctggtctcattgggttagg

SEQ ID NO: 9147761 - DNA, 22 bp, Homo sapiens
atgctggtctgcagagttggga

SEQ ID NO: 9147762 - DNA, 22 bp, Homo sapiens
atgctgggagtgaagcccctgg

SEQ ID NO: 9147763 - DNA, 22 bp, Homo sapiens
atgctggtctgcagagttggga

SEQ ID NO: 9147764 - DNA, 22 bp, Homo sapiens
atgctggtggttgatggcagga

SEQ ID NO: 9147765 - DNA, 22 bp, Homo sapiens
atgctgtcgaaaccaaacatct

SEQ ID NO: 9147766 - DNA, 22 bp, Homo sapiens
atgctgtcagtattatgtgcag

SEQ ID NO: 9147767 - DNA, 22 bp, Homo sapiens
atgcttaacttcctagtctata

SEQ ID NO: 9147768 - DNA, 22 bp, Homo sapiens
atgcttaaccttggtgtacaat

SEQ ID NO: 9147769 - DNA, 22 bp, Homo sapiens
atgcttaactctgtacatagtt

SEQ ID NO: 9147770 - DNA, 22 bp, Homo sapiens
atgctgtgttttaaatggaaat

SEQ ID NO: 9147771 - DNA, 22 bp, Homo sapiens
atgctgtgtggtcaagttaatt

SEQ ID NO: 9147772 - DNA, 22 bp, Homo sapiens
atgctgtgtttgagaacctagg

SEQ ID NO: 9147773 - DNA, 22 bp, Homo sapiens
atgctgtgtctagcaggaacac

SEQ ID NO: 9147774 - DNA, 22 bp, Homo sapiens
atgctgtgtctagcaggaacac

SEQ ID NO: 9147775 - DNA, 22 bp, Homo sapiens
atgctgtgtggccacctccatg

SEQ ID NO: 9147776 - DNA, 22 bp, Homo sapiens
atgctgtgtcctagtgaaagaa

SEQ ID NO: 9147777 - DNA, 22 bp, Homo sapiens
gagaaggggtgatgtgggtaat

SEQ ID NO: 9147778 - DNA, 22 bp, Homo sapiens
gagaaggtggacctgaaggagc

SEQ ID NO: 9147779 - DNA, 22 bp, Homo sapiens
gagaaggtggatttcgtatccc

SEQ ID NO: 9147780 - DNA, 23 bp, Homo sapiens
gagaacagccacagagagctgtg

SEQ ID NO: 9147781 - DNA, 22 bp, Homo sapiens
gagaatacaaccagaagctgag

SEQ ID NO: 9147782 - DNA, 22 bp, Homo sapiens
gagaataaatctaaagtttctt

SEQ ID NO: 9147783 - DNA, 22 bp, Homo sapiens
gagaagtttttcttattacatg

SEQ ID NO: 9147784 - DNA, 22 bp, Homo sapiens
gagaagtttctggtttgcatag

SEQ ID NO: 9147785 - DNA, 22 bp, Homo sapiens
gagaagtttcttcctaggtttg

SEQ ID NO: 9147786 - DNA, 22 bp, Homo sapiens
gagaagttctaattggctcttt

SEQ ID NO: 9147787 - DNA, 22 bp, Homo sapiens
gagaagttcattactctgccca

SEQ ID NO: 9147788 - DNA, 22 bp, Homo sapiens
gagaagttgtgtggatttaaag

SEQ ID NO: 9147789 - DNA, 22 bp, Homo sapiens
gagaagtttaatcattagacca

SEQ ID NO: 9147790 - DNA, 22 bp, Homo sapiens
gagaagtttctggtttgcatag

SEQ ID NO: 9147791 - DNA, 22 bp, Homo sapiens
gagacagcagggccagggcctg

SEQ ID NO: 9147792 - DNA, 22 bp, Homo sapiens
gagacaggatttaaccaaagct

SEQ ID NO: 9147793 - DNA, 22 bp, Homo sapiens
gagacagcctactccagtctca

SEQ ID NO: 9147794 - DNA, 21 bp, Homo sapiens
gagacagcccagtgccagggc

SEQ ID NO: 9147795 - DNA, 22 bp, Homo sapiens
gagaatcatggcaacagaatga

SEQ ID NO: 9147796 - DNA, 22 bp, Homo sapiens
gagaatcatttacagaatgatt

SEQ ID NO: 9147797 - DNA, 22 bp, Homo sapiens
gagaatatcttggcagtctctg

SEQ ID NO: 9147798 - DNA, 22 bp, Homo sapiens
gagacaggatttaaccaaagct

SEQ ID NO: 9147799 - DNA, 22 bp, Homo sapiens
atggatctaccttcaggctctg

SEQ ID NO: 9147800 - DNA, 22 bp, Homo sapiens
atggatcccactattttaagac

SEQ ID NO: 9147801 - DNA, 22 bp, Homo sapiens
gagacagtgaggaaggctaggt

SEQ ID NO: 9147802 - DNA, 22 bp, Homo sapiens
atggataatggtgatagttgca

SEQ ID NO: 9147803 - DNA, 22 bp, Homo sapiens
atggcaagcaagctgaagagat

SEQ ID NO: 9147804 - DNA, 22 bp, Homo sapiens
atggcaaaaattaacagatcaa

SEQ ID NO: 9147805 - DNA, 22 bp, Homo sapiens
atggcaagcaagctgaagagat

SEQ ID NO: 9147806 - DNA, 22 bp, Homo sapiens
atggcacagatgttctgattat

SEQ ID NO: 9147807 - DNA, 22 bp, Homo sapiens
atggcacaggagaggagggctg

SEQ ID NO: 9147808 - DNA, 22 bp, Homo sapiens
atggatgaaggcgaggatgagg

SEQ ID NO: 9147809 - DNA, 21 bp, Homo sapiens
atggatttaaacaggccacaa

SEQ ID NO: 9147810 - DNA, 22 bp, Homo sapiens
atggatttgcttatacacatgt

SEQ ID NO: 9147811 - DNA, 22 bp, Homo sapiens
atggatttggatgagattactt

SEQ ID NO: 9147812 - DNA, 22 bp, Homo sapiens
atggcacatgaccttgatggat

SEQ ID NO: 9147813 - DNA, 22 bp, Homo sapiens
atggcacagtgggaaatgacct

SEQ ID NO: 9147814 - DNA, 23 bp, Homo sapiens
atggcacatgggacagtaagtag

SEQ ID NO: 9147815 - DNA, 22 bp, Homo sapiens
atggcagaaagaatagaggcta

SEQ ID NO: 9147816 - DNA, 22 bp, Homo sapiens
atggcagaagtcaagatgagtt

SEQ ID NO: 9147817 - DNA, 22 bp, Homo sapiens
atggcagacctcctggccacaa

SEQ ID NO: 9147818 - DNA, 22 bp, Homo sapiens
atggcagaattaggatttcaag

SEQ ID NO: 9147819 - DNA, 22 bp, Homo sapiens
atgggcagagctggtgggaggc

SEQ ID NO: 9147820 - DNA, 21 bp, Homo sapiens
atgggcagaggcagagaggct

SEQ ID NO: 9147821 - DNA, 22 bp, Homo sapiens
atgggcagagctggtgggaggc

SEQ ID NO: 9147822 - DNA, 22 bp, Homo sapiens
atgggcagagctggtgggaggc

SEQ ID NO: 9147823 - DNA, 22 bp, Homo sapiens
gagcccatcctcgaggggctgc

SEQ ID NO: 9147824 - DNA, 22 bp, Homo sapiens
atgggcagacagggagctcacg

SEQ ID NO: 9147825 - DNA, 22 bp, Homo sapiens
atgggatgcatggctgtggcca

SEQ ID NO: 9147826 - DNA, 22 bp, Homo sapiens
atgggatgaacttgatctgctt

SEQ ID NO: 9147827 - DNA, 22 bp, Homo sapiens
atgggagttttctctgatgctc

SEQ ID NO: 9147828 - DNA, 22 bp, Homo sapiens
gagccctcaatgaatctgcatt

SEQ ID NO: 9147829 - DNA, 22 bp, Homo sapiens
gagccccttctgcagtcaggtt

SEQ ID NO: 9147830 - DNA, 22 bp, Homo sapiens
gagccccaggacagctctagtt

SEQ ID NO: 9147831 - DNA, 22 bp, Homo sapiens
gagccctcaatgaatctgcatt

SEQ ID NO: 9147832 - DNA, 22 bp, Homo sapiens
gagccctcattgaatctgcatt

SEQ ID NO: 9147833 - DNA, 22 bp, Homo sapiens
gagccctcattgaatctgcatt

SEQ ID NO: 9147834 - DNA, 22 bp, Homo sapiens
gagccctccatggagccaggca

SEQ ID NO: 9147835 - DNA, 22 bp, Homo sapiens
gagctgcagcggctgacgcaac

SEQ ID NO: 9147836 - DNA, 22 bp, Homo sapiens
gagctgccagacatgggaatga

SEQ ID NO: 9147837 - DNA, 22 bp, Homo sapiens
gagctgccagacatgggaatga

SEQ ID NO: 9147838 - DNA, 22 bp, Homo sapiens
gagctgcatgcggaaacctgtt

SEQ ID NO: 9147839 - DNA, 22 bp, Homo sapiens
atgggcagagtggggacaggaa

SEQ ID NO: 9147840 - DNA, 22 bp, Homo sapiens
gagccctctctgtaggcaagta

SEQ ID NO: 9147841 - DNA, 17 bp, Homo sapiens
gagctctgtggcacaag

SEQ ID NO: 9147842 - DNA, 22 bp, Homo sapiens
gagctgagtgtcctaggcatgg

SEQ ID NO: 9147843 - DNA, 20 bp, Homo sapiens
gagctgagtgtggtcatggg

SEQ ID NO: 9147844 - DNA, 22 bp, Homo sapiens
gagctgcagaaggggttttcct

SEQ ID NO: 9147845 - DNA, 22 bp, Homo sapiens
gagctgcagagctcgaaggaac

SEQ ID NO: 9147846 - DNA, 22 bp, Homo sapiens
gagctgagttacctccagatca

SEQ ID NO: 9147847 - DNA, 22 bp, Homo sapiens
gagctgcacatctgaggctaat

SEQ ID NO: 9147848 - DNA, 22 bp, Homo sapiens
gagctgcacatctgaggctaat

SEQ ID NO: 9147849 - DNA, 22 bp, Homo sapiens
gagcacagctgtcttgcaagct

SEQ ID NO: 9147850 - DNA, 22 bp, Homo sapiens
gagcacagctgtcttgcaagct

SEQ ID NO: 9147851 - DNA, 22 bp, Homo sapiens
gagcacagcgcagtttgtaatt

SEQ ID NO: 9147852 - DNA, 19 bp, Homo sapiens
gagcacagcggcatttggt

SEQ ID NO: 9147853 - DNA, 22 bp, Homo sapiens
gagcacagcagggctctgggtg

SEQ ID NO: 9147854 - DNA, 22 bp, Homo sapiens
gagcacagcagggctctgggtg

SEQ ID NO: 9147855 - DNA, 22 bp, Homo sapiens
gagcacagccaaagtaagaagg

SEQ ID NO: 9147856 - DNA, 22 bp, Homo sapiens
gagcacagccaaagtaagaagg

SEQ ID NO: 9147857 - DNA, 22 bp, Homo sapiens
gagcacaggctttggtggacac

SEQ ID NO: 9147858 - DNA, 22 bp, Homo sapiens
gagcacagggaatagacagata

SEQ ID NO: 9147859 - DNA, 22 bp, Homo sapiens
gagcacagggaatagacagata

SEQ ID NO: 9147860 - DNA, 22 bp, Homo sapiens
atggcagacgaggcagcagggg

SEQ ID NO: 9147861 - DNA, 22 bp, Homo sapiens
atggcagagaaagcgagccaca

SEQ ID NO: 9147862 - DNA, 22 bp, Homo sapiens
atggctccaagatggagagcca

SEQ ID NO: 9147863 - DNA, 22 bp, Homo sapiens
atggctctatctagaattctgg

SEQ ID NO: 9147864 - DNA, 22 bp, Homo sapiens
atggctccttctgtgcagtttt

SEQ ID NO: 9147865 - DNA, 22 bp, Homo sapiens
atggctccatagcttcgtttag

SEQ ID NO: 9147866 - DNA, 22 bp, Homo sapiens
atggctctctccttactgctgc

SEQ ID NO: 9147867 - DNA, 22 bp, Homo sapiens
atggctctgagaacctgagcta

SEQ ID NO: 9147868 - DNA, 20 bp, Homo sapiens
atggctctgattctgagccc

SEQ ID NO: 9147869 - DNA, 19 bp, Homo sapiens
atggctctgggatcactgc

SEQ ID NO: 9147870 - DNA, 22 bp, Homo sapiens
atggctcttgaattgatactct

SEQ ID NO: 9147871 - DNA, 22 bp, Homo sapiens
atggctcttgaattgatactct

SEQ ID NO: 9147872 - DNA, 22 bp, Homo sapiens
atggctgaggctggaggtggca

SEQ ID NO: 9147873 - DNA, 21 bp, Homo sapiens
atggctgatgatattgaacat

SEQ ID NO: 9147874 - DNA, 22 bp, Homo sapiens
atgtcagatgtttatctgattt

SEQ ID NO: 9147875 - DNA, 22 bp, Homo sapiens
atgtcagatattttttggttgc

SEQ ID NO: 9147876 - DNA, 22 bp, Homo sapiens
atgtcagatcctcagaaagtct

SEQ ID NO: 9147877 - DNA, 22 bp, Homo sapiens
atgtcagatcctcagaaagtct

SEQ ID NO: 9147878 - DNA, 22 bp, Homo sapiens
gaggctcttttctgctgtgtct

SEQ ID NO: 9147879 - DNA, 22 bp, Homo sapiens
gaggctcttttctgctgtgtct

SEQ ID NO: 9147880 - DNA, 22 bp, Homo sapiens
atgtcaccttcggtggcacggt

SEQ ID NO: 9147881 - DNA, 22 bp, Homo sapiens
atgtcactgttgttattgttat

SEQ ID NO: 9147882 - DNA, 22 bp, Homo sapiens
atgtgaggtatctaggtcttcg

SEQ ID NO: 9147883 - DNA, 22 bp, Homo sapiens
atgtgccaacgtgcaggtttgt

SEQ ID NO: 9147884 - DNA, 21 bp, Homo sapiens
atgtcaggcacttatgaggaa

SEQ ID NO: 9147885 - DNA, 21 bp, Homo sapiens
atgtcaggcacttatgaggaa

SEQ ID NO: 9147886 - DNA, 20 bp, Homo sapiens
atgtcaggaagggagtcagg

SEQ ID NO: 9147887 - DNA, 22 bp, Homo sapiens
atgtggcccagcggtcaggctg

SEQ ID NO: 9147888 - DNA, 22 bp, Homo sapiens
atgtggcagtgggaggtgaatt

SEQ ID NO: 9147889 - DNA, 22 bp, Homo sapiens
atgtgctttgctggaaatgtca

SEQ ID NO: 9147890 - DNA, 22 bp, Homo sapiens
atgtggaatgaacaaaggaggc

SEQ ID NO: 9147891 - DNA, 22 bp, Homo sapiens
atgtgcttggaaaagcagtggt

SEQ ID NO: 9147892 - DNA, 19 bp, Homo sapiens
atgtgcttgggccatgcta

SEQ ID NO: 9147893 - DNA, 22 bp, Homo sapiens
atgtgcttggacattctaggaa

SEQ ID NO: 9147894 - DNA, 22 bp, Homo sapiens
atgtgctttattaagtaaaaat

SEQ ID NO: 9147895 - DNA, 22 bp, Homo sapiens
atgtgctttattaagtaaaaat

SEQ ID NO: 9147896 - DNA, 22 bp, Homo sapiens
atgtgcttcaggatgtcagtgt

SEQ ID NO: 9147897 - DNA, 20 bp, Homo sapiens
atgtgctgggcaatatgtta

SEQ ID NO: 9147898 - DNA, 20 bp, Homo sapiens
atgtgctgggcaatatgtta

SEQ ID NO: 9147899 - DNA, 22 bp, Homo sapiens
atgtgctgagtgtgtatataca

SEQ ID NO: 9147900 - DNA, 22 bp, Homo sapiens
atgtggctagtgcagatgaata

SEQ ID NO: 9147901 - DNA, 22 bp, Homo sapiens
atgtggctcagcaggctcccgt

SEQ ID NO: 9147902 - DNA, 22 bp, Homo sapiens
atgtggctcacatagctggaaa

SEQ ID NO: 9147903 - DNA, 21 bp, Homo sapiens
atgtggctcccttcctcagga

SEQ ID NO: 9147904 - DNA, 22 bp, Homo sapiens
atgttagcttgtgtgaaaatgc

SEQ ID NO: 9147905 - DNA, 22 bp, Homo sapiens
atgttagaaggaatgttaaaag

SEQ ID NO: 9147906 - DNA, 22 bp, Homo sapiens
atgttacatagtccttatttgt

SEQ ID NO: 9147907 - DNA, 23 bp, Homo sapiens
atgttaaacataactgaagagcc

SEQ ID NO: 9147908 - DNA, 22 bp, Homo sapiens
gaggttctgggggtctgcctgg

SEQ ID NO: 9147909 - DNA, 22 bp, Homo sapiens
gaggttctgggggtctgcctgg

SEQ ID NO: 9147910 - DNA, 22 bp, Homo sapiens
gagtgcagtatcttctgtgtcc

SEQ ID NO: 9147911 - DNA, 22 bp, Homo sapiens
gaggttggcgccctgcctggcc

SEQ ID NO: 9147912 - DNA, 22 bp, Homo sapiens
gaggttggagggctggcctgca

SEQ ID NO: 9147913 - DNA, 22 bp, Homo sapiens
atgttagtgatagtaaatagtg

SEQ ID NO: 9147914 - DNA, 22 bp, Homo sapiens
gaggtgtgatgcagagtggtgg

SEQ ID NO: 9147915 - DNA, 22 bp, Homo sapiens
gaggtgtgaggaatgaatgggg

SEQ ID NO: 9147916 - DNA, 22 bp, Homo sapiens
gaggtgtgcacagcgtgctgac

SEQ ID NO: 9147917 - DNA, 22 bp, Homo sapiens
gaggtgtggtcctcagccccca

SEQ ID NO: 9147918 - DNA, 22 bp, Homo sapiens
gaggtgtgttacagattgtcat

SEQ ID NO: 9147919 - DNA, 22 bp, Homo sapiens
gaggtgtgctgcggcccggtgc

SEQ ID NO: 9147920 - DNA, 22 bp, Homo sapiens
gaggcacagagccctaggagct

SEQ ID NO: 9147921 - DNA, 22 bp, Homo sapiens
gaggcacagagccctaggagct

SEQ ID NO: 9147922 - DNA, 22 bp, Homo sapiens
gaggcacaccagggagtcttgt

SEQ ID NO: 9147923 - DNA, 22 bp, Homo sapiens
gaggcacaccagggagtcttgt

SEQ ID NO: 9147924 - DNA, 22 bp, Homo sapiens
gaggaggggcacttgtctccta

SEQ ID NO: 9147925 - DNA, 22 bp, Homo sapiens
gaggaggggacagtacttgtgc

SEQ ID NO: 9147926 - DNA, 23 bp, Homo sapiens
gaggagggtcgtgctgtgttcct

SEQ ID NO: 9147927 - DNA, 22 bp, Homo sapiens
gaggcacaatacatgtctcaag

SEQ ID NO: 9147928 - DNA, 22 bp, Homo sapiens
gaggcacagttcttcctccaga

SEQ ID NO: 9147929 - DNA, 22 bp, Homo sapiens
gaggcacagagtaggtgcacac

SEQ ID NO: 9147930 - DNA, 22 bp, Homo sapiens
gaggcacagtcccgaggcaagg

SEQ ID NO: 9147931 - DNA, 22 bp, Homo sapiens
gaggcacagtgtttggtcagtg

SEQ ID NO: 9147932 - DNA, 22 bp, Homo sapiens
gaggcacatatatacagagccc

SEQ ID NO: 9147933 - DNA, 22 bp, Homo sapiens
gaggagggcctggtgtcccttc

SEQ ID NO: 9147934 - DNA, 22 bp, Homo sapiens
gaggagggcctggtgtcccttc

SEQ ID NO: 9147935 - DNA, 22 bp, Homo sapiens
gaggagctgtcaccgtgactca

SEQ ID NO: 9147936 - DNA, 22 bp, Homo sapiens
gaggagggagctggaagctctt

SEQ ID NO: 9147937 - DNA, 22 bp, Homo sapiens
atgggcagagtggggacaggaa

SEQ ID NO: 9147938 - DNA, 22 bp, Homo sapiens
atgggcagctgcagcagtggtg

SEQ ID NO: 9147939 - DNA, 22 bp, Homo sapiens
gaggagctgggtcagggagaca

SEQ ID NO: 9147940 - DNA, 22 bp, Homo sapiens
atgggcaggcaaggtggcgagt

SEQ ID NO: 9147941 - DNA, 22 bp, Homo sapiens
atgggcagctgcagcagtggtg

SEQ ID NO: 9147942 - DNA, 22 bp, Homo sapiens
atgggcagctgcagcagtggtg

SEQ ID NO: 9147943 - DNA, 22 bp, Homo sapiens
gaggctctgtgatgtgccaggc

SEQ ID NO: 9147944 - DNA, 22 bp, Homo sapiens
gaggctctttaaatcttttgga

SEQ ID NO: 9147945 - DNA, 22 bp, Homo sapiens
gaggctcctcattcagtatgct

SEQ ID NO: 9147946 - DNA, 22 bp, Homo sapiens
gaggctcccaaggggctaggcc

SEQ ID NO: 9147947 - DNA, 22 bp, Homo sapiens
gaggctcccaaggggctaggcc

SEQ ID NO: 9147948 - DNA, 22 bp, Homo sapiens
gaggctccctttaggtccagat

SEQ ID NO: 9147949 - DNA, 22 bp, Homo sapiens
gaggctccggtagtagccttga

SEQ ID NO: 9147950 - DNA, 22 bp, Homo sapiens
gaggctccgtgctgctgccctg

SEQ ID NO: 9147951 - DNA, 22 bp, Homo sapiens
gaggctccctttaggtccagat

SEQ ID NO: 9147952 - DNA, 22 bp, Homo sapiens
atgtatttctatgtagtgaaga

SEQ ID NO: 9147953 - DNA, 22 bp, Homo sapiens
atgtatttactgagaaggaaac

SEQ ID NO: 9147954 - DNA, 23 bp, Homo sapiens
atgtatttaaatttcagtgatga

SEQ ID NO: 9147955 - DNA, 22 bp, Homo sapiens
atgtatttctatgtagtgaaga

SEQ ID NO: 9147956 - DNA, 22 bp, Homo sapiens
gaggcctgggttacctactcgt

SEQ ID NO: 9147957 - DNA, 22 bp, Homo sapiens
gaggctccagcgacacctaggc

SEQ ID NO: 9147958 - DNA, 22 bp, Homo sapiens
gaggcctgggttggaggtgcat

SEQ ID NO: 9147959 - DNA, 22 bp, Homo sapiens
gaggcctgggttggaggtgcat

SEQ ID NO: 9147960 - DNA, 22 bp, Homo sapiens
atgtatcagataaagcatgtgg

SEQ ID NO: 9147961 - DNA, 22 bp, Homo sapiens
atgtatgtttctatatatgaca

SEQ ID NO: 9147962 - DNA, 22 bp, Homo sapiens
atgtattgaccatactactaaa

SEQ ID NO: 9147963 - DNA, 22 bp, Homo sapiens
atttcttcaggtcagaaataga

SEQ ID NO: 9147964 - DNA, 22 bp, Homo sapiens
gccctgtgccagtcacgctgtg

SEQ ID NO: 9147965 - DNA, 22 bp, Homo sapiens
gccctgtgcaggtgtgcagcag

SEQ ID NO: 9147966 - DNA, 22 bp, Homo sapiens
gccctgtgagtcatgcggcaga

SEQ ID NO: 9147967 - DNA, 22 bp, Homo sapiens
gccctgcctgccggtgtgggtc

SEQ ID NO: 9147968 - DNA, 22 bp, Homo sapiens
atttcctaatttatgcaggagt

SEQ ID NO: 9147969 - DNA, 22 bp, Homo sapiens
gccctgggctccctgctccaca

SEQ ID NO: 9147970 - DNA, 22 bp, Homo sapiens
gccctggggaaggtgtctccaa

SEQ ID NO: 9147971 - DNA, 22 bp, Homo sapiens
gccctgggctccctgctccaca

SEQ ID NO: 9147972 - DNA, 22 bp, Homo sapiens
gcccagtgctgagggtgctgct

SEQ ID NO: 9147973 - DNA, 22 bp, Homo sapiens
gcccagtgctgagggtgctgct

SEQ ID NO: 9147974 - DNA, 22 bp, Homo sapiens
gcccagtggtaaaagcaggcct

SEQ ID NO: 9147975 - DNA, 22 bp, Homo sapiens
atttcccaatacgctaagtgga

SEQ ID NO: 9147976 - DNA, 22 bp, Homo sapiens
atttcccactcaggccgcggcg

SEQ ID NO: 9147977 - DNA, 22 bp, Homo sapiens
atttcccactctactacatgct

SEQ ID NO: 9147978 - DNA, 22 bp, Homo sapiens
atttcccagataaacagctgga

SEQ ID NO: 9147979 - DNA, 22 bp, Homo sapiens
atttcccagggccctcatagtt

SEQ ID NO: 9147980 - DNA, 22 bp, Homo sapiens
atttcccagggccctcatagtt

SEQ ID NO: 9147981 - DNA, 22 bp, Homo sapiens
atttcccagggcctgggatttg

SEQ ID NO: 9147982 - DNA, 22 bp, Homo sapiens
atttcccactctactacatgct

SEQ ID NO: 9147983 - DNA, 22 bp, Homo sapiens
atttcccagctttgatcagttt

SEQ ID NO: 9147984 - DNA, 22 bp, Homo sapiens
atttattggtttgcatggtgaa

SEQ ID NO: 9147985 - DNA, 19 bp, Homo sapiens
atttattgtatgattccat

SEQ ID NO: 9147986 - DNA, 22 bp, Homo sapiens
atttcaacacttttggaattag

SEQ ID NO: 9147987 - DNA, 19 bp, Homo sapiens
atttattgtatgattccat

SEQ ID NO: 9147988 - DNA, 22 bp, Homo sapiens
atttattggtttgcatggtgaa

SEQ ID NO: 9147989 - DNA, 22 bp, Homo sapiens
gccatgaactcgggcatggaga

SEQ ID NO: 9147990 - DNA, 19 bp, Homo sapiens
gccatcccaagcattttgg

SEQ ID NO: 9147991 - DNA, 20 bp, Homo sapiens
gccatccagcctcccaggag

SEQ ID NO: 9147992 - DNA, 22 bp, Homo sapiens
gccatctgctgctctccagtgt

SEQ ID NO: 9147993 - DNA, 22 bp, Homo sapiens
gccatctgcgcggtgtccagct

SEQ ID NO: 9147994 - DNA, 22 bp, Homo sapiens
gccatctggcattgcagcacct

SEQ ID NO: 9147995 - DNA, 19 bp, Homo sapiens
atttcaagaggtttattgg

SEQ ID NO: 9147996 - DNA, 22 bp, Homo sapiens
atttcaacgttagatgtaatag

SEQ ID NO: 9147997 - DNA, 22 bp, Homo sapiens
atttcaacattctcagttgtag

SEQ ID NO: 9147998 - DNA, 22 bp, Homo sapiens
gcccaggagttgaagggctgac

SEQ ID NO: 9147999 - DNA, 19 bp, Homo sapiens
gcccaggggcccgatgctg

SEQ ID NO: 9148000 - DNA, 22 bp, Homo sapiens
gcccagggtctacaaaaatatt

SEQ ID NO: 9148001 - DNA, 22 bp, Homo sapiens
gcccaggagttgaatgcagcag

SEQ ID NO: 9148002 - DNA, 22 bp, Homo sapiens
gcccagggtgaagtgcagttgt

SEQ ID NO: 9148003 - DNA, 22 bp, Homo sapiens
gcccagggtgaagtgcagttgt

SEQ ID NO: 9148004 - DNA, 22 bp, Homo sapiens
gcccagggtgaagtgcagttgt

SEQ ID NO: 9148005 - DNA, 22 bp, Homo sapiens
gcccagggtgcttagaacccat

SEQ ID NO: 9148006 - DNA, 22 bp, Homo sapiens
gcccagtagttcaaggttgcag

SEQ ID NO: 9148007 - DNA, 22 bp, Homo sapiens
gcccagtctcttctggccctgt

SEQ ID NO: 9148008 - DNA, 22 bp, Homo sapiens
atttatcaccagttagctgact

SEQ ID NO: 9148009 - DNA, 18 bp, Homo sapiens
atttatcctttgtattac

SEQ ID NO: 9148010 - DNA, 22 bp, Homo sapiens
atttatattttgggagctcctg

SEQ ID NO: 9148011 - DNA, 22 bp, Homo sapiens
atttatcaacatgtaccattgg

SEQ ID NO: 9148012 - DNA, 22 bp, Homo sapiens
atttatgacagaagatatgctg

SEQ ID NO: 9148013 - DNA, 22 bp, Homo sapiens
atttatctctggaaactaagca

SEQ ID NO: 9148014 - DNA, 22 bp, Homo sapiens
gccagctgcttctccagaattt

SEQ ID NO: 9148015 - DNA, 22 bp, Homo sapiens
gccagctgcttctccagaattt

SEQ ID NO: 9148016 - DNA, 22 bp, Homo sapiens
gccagctgcttctccagaattt

SEQ ID NO: 9148017 - DNA, 22 bp, Homo sapiens
gccagctggagactggcagggg

SEQ ID NO: 9148018 - DNA, 21 bp, Homo sapiens
atttagaaggaaattttgcaa

SEQ ID NO: 9148019 - DNA, 21 bp, Homo sapiens
atttagaaggaaattttgcaa

SEQ ID NO: 9148020 - DNA, 22 bp, Homo sapiens
atttagaagttggagggcaaga

SEQ ID NO: 9148021 - DNA, 22 bp, Homo sapiens
atttagtttaggaaaagtaggt

SEQ ID NO: 9148022 - DNA, 22 bp, Homo sapiens
atttataacgtgcagccagggt

SEQ ID NO: 9148023 - DNA, 22 bp, Homo sapiens
atttataacgtgcagccagggt

SEQ ID NO: 9148024 - DNA, 22 bp, Homo sapiens
atttatgattagcctattgttg

SEQ ID NO: 9148025 - DNA, 22 bp, Homo sapiens
atttatgtatctgtgtagatca

SEQ ID NO: 9148026 - DNA, 22 bp, Homo sapiens
atttattaagcatctgctatgt

SEQ ID NO: 9148027 - DNA, 22 bp, Homo sapiens
atttattaagcatctgctatgt

SEQ ID NO: 9148028 - DNA, 22 bp, Homo sapiens
atttattatgggatttggcaca

SEQ ID NO: 9148029 - DNA, 22 bp, Homo sapiens
atttattatgggatttggcaca

SEQ ID NO: 9148030 - DNA, 22 bp, Homo sapiens
atttattaagcatctgctatgt

SEQ ID NO: 9148031 - DNA, 22 bp, Homo sapiens
atttattacctcggagtttctg

SEQ ID NO: 9148032 - DNA, 22 bp, Homo sapiens
gccatcatatcccctgtgacct

SEQ ID NO: 9148033 - DNA, 22 bp, Homo sapiens
gccaggtggctgagcagctgca

SEQ ID NO: 9148034 - DNA, 22 bp, Homo sapiens
gccagatattcagaggtgaaag

SEQ ID NO: 9148035 - DNA, 19 bp, Homo sapiens
attgtacattgagtttggc

SEQ ID NO: 9148036 - DNA, 22 bp, Homo sapiens
attgtacatgcagtgagtcatc

SEQ ID NO: 9148037 - DNA, 22 bp, Homo sapiens
attgtactacaccatagtactg

SEQ ID NO: 9148038 - DNA, 22 bp, Homo sapiens
attgtacatgcagtgagtcatc

SEQ ID NO: 9148039 - DNA, 22 bp, Homo sapiens
gcatggcatttgaaggtagaag

SEQ ID NO: 9148040 - DNA, 22 bp, Homo sapiens
gcatggcattaacaagatggaa

SEQ ID NO: 9148041 - DNA, 22 bp, Homo sapiens
gcatggcatttgaaggtagaag

SEQ ID NO: 9148042 - DNA, 22 bp, Homo sapiens
attgtacactagtggcagcagt

SEQ ID NO: 9148043 - DNA, 22 bp, Homo sapiens
attgtacagacatgggaaacaa

SEQ ID NO: 9148044 - DNA, 22 bp, Homo sapiens
attgtacagatgaacctcactc

SEQ ID NO: 9148045 - DNA, 22 bp, Homo sapiens
gccagccagtttgctgatggct

SEQ ID NO: 9148046 - DNA, 21 bp, Homo sapiens
gccagctgcagggcttccttg

SEQ ID NO: 9148047 - DNA, 22 bp, Homo sapiens
gccagctgccctctgctggtcc

SEQ ID NO: 9148048 - DNA, 20 bp, Homo sapiens
gccagctgcccttccaccct

SEQ ID NO: 9148049 - DNA, 22 bp, Homo sapiens
gccagctgctggaacagcgcga

SEQ ID NO: 9148050 - DNA, 22 bp, Homo sapiens
gccagctgctggaacagcgcga

SEQ ID NO: 9148051 - DNA, 18 bp, Homo sapiens
gccagccaggcgttgctc

SEQ ID NO: 9148052 - DNA, 18 bp, Homo sapiens
gccagccaggcgttgctc

SEQ ID NO: 9148053 - DNA, 22 bp, Homo sapiens
gccagccagagtggctgtgtgt

SEQ ID NO: 9148054 - DNA, 22 bp, Homo sapiens
gccagccagagtccatctgaga

SEQ ID NO: 9148055 - DNA, 22 bp, Homo sapiens
gccagccagagaggcatggtta

SEQ ID NO: 9148056 - DNA, 22 bp, Homo sapiens
gccagccacgttagactggccc

SEQ ID NO: 9148057 - DNA, 22 bp, Homo sapiens
gccagccacttcccagactggc

SEQ ID NO: 9148058 - DNA, 23 bp, Homo sapiens
gccagccagaatttctccactgt

SEQ ID NO: 9148059 - DNA, 22 bp, Homo sapiens
gccagccagaaacgtcacactg

SEQ ID NO: 9148060 - DNA, 22 bp, Homo sapiens
attttagagctccaagtacagc

SEQ ID NO: 9148061 - DNA, 22 bp, Homo sapiens
attttagatttaagaataaggt

SEQ ID NO: 9148062 - DNA, 22 bp, Homo sapiens
atttgtagtgaagtgaaaataa

SEQ ID NO: 9148063 - DNA, 22 bp, Homo sapiens
atttgtatcaatctcaatatat

SEQ ID NO: 9148064 - DNA, 22 bp, Homo sapiens
atttggttcccaagctacgtgt

SEQ ID NO: 9148065 - DNA, 22 bp, Homo sapiens
atttggttatggtcatggacac

SEQ ID NO: 9148066 - DNA, 22 bp, Homo sapiens
atttggtttcaggattctcagg

SEQ ID NO: 9148067 - DNA, 22 bp, Homo sapiens
atttgtaaagtgcttaaaagta

SEQ ID NO: 9148068 - DNA, 22 bp, Homo sapiens
atttggttactcagttgtctga

SEQ ID NO: 9148069 - DNA, 22 bp, Homo sapiens
atttggtctgtaattacatgga

SEQ ID NO: 9148070 - DNA, 22 bp, Homo sapiens
atttgtaacacgtgacaggttg

SEQ ID NO: 9148071 - DNA, 17 bp, Homo sapiens
atttgtaactagctctt

SEQ ID NO: 9148072 - DNA, 22 bp, Homo sapiens
atttgtaaagtgcttaaaagta

SEQ ID NO: 9148073 - DNA, 22 bp, Homo sapiens
atttgtaatttcttatctgtgt

SEQ ID NO: 9148074 - DNA, 22 bp, Homo sapiens
atttgtaatttcttatctgtgt

SEQ ID NO: 9148075 - DNA, 22 bp, Homo sapiens
atttgtaagctagagccatgat

SEQ ID NO: 9148076 - DNA, 22 bp, Homo sapiens
atttgtaagctagagccatgat

SEQ ID NO: 9148077 - DNA, 22 bp, Homo sapiens
atttggcttacacgatattttc

SEQ ID NO: 9148078 - DNA, 22 bp, Homo sapiens
atttcttcctctgtcagtaact

SEQ ID NO: 9148079 - DNA, 22 bp, Homo sapiens
atttcttccattgcctcttcaa

SEQ ID NO: 9148080 - DNA, 22 bp, Homo sapiens
atttggtagtgattgaaattat

SEQ ID NO: 9148081 - DNA, 22 bp, Homo sapiens
atttggtctacattttccaaat

SEQ ID NO: 9148082 - DNA, 22 bp, Homo sapiens
atttggtcagaactctctttag

SEQ ID NO: 9148083 - DNA, 22 bp, Homo sapiens
attttcatcatgggtttaacat

SEQ ID NO: 9148084 - DNA, 22 bp, Homo sapiens
attttcatgactaccttaaata

SEQ ID NO: 9148085 - DNA, 21 bp, Homo sapiens
attttcattaattcagtgtgg

SEQ ID NO: 9148086 - DNA, 21 bp, Homo sapiens
attttcattaattcagtgtgg

SEQ ID NO: 9148087 - DNA, 22 bp, Homo sapiens
attttcccttctaaagggctga

SEQ ID NO: 9148088 - DNA, 22 bp, Homo sapiens
gccttcctgcagctctgagcgt

SEQ ID NO: 9148089 - DNA, 22 bp, Homo sapiens
gccttcctgcagctctgagcgt

SEQ ID NO: 9148090 - DNA, 22 bp, Homo sapiens
gcctgtgctgttccctctgcca

SEQ ID NO: 9148091 - DNA, 22 bp, Homo sapiens
attttcctctggtttccccaga

SEQ ID NO: 9148092 - DNA, 22 bp, Homo sapiens
attttcctcaagcctctggaag

SEQ ID NO: 9148093 - DNA, 22 bp, Homo sapiens
gccttccttttaccaccagcca

SEQ ID NO: 9148094 - DNA, 22 bp, Homo sapiens
gccttccttttaccaccagcca

SEQ ID NO: 9148095 - DNA, 17 bp, Homo sapiens
gccttccttcctccaca

SEQ ID NO: 9148096 - DNA, 22 bp, Homo sapiens
attttgacattgcggcattgct

SEQ ID NO: 9148097 - DNA, 22 bp, Homo sapiens
attttgacagaagaggccctaa

SEQ ID NO: 9148098 - DNA, 22 bp, Homo sapiens
attttgactgcattacagaaca

SEQ ID NO: 9148099 - DNA, 22 bp, Homo sapiens
attttgactgcattacagaaca

SEQ ID NO: 9148100 - DNA, 22 bp, Homo sapiens
attttgctgtggtacattagga

SEQ ID NO: 9148101 - DNA, 19 bp, Homo sapiens
gctcagagacacctgttgc

SEQ ID NO: 9148102 - DNA, 22 bp, Homo sapiens
gctcagagagaggctcaccatt

SEQ ID NO: 9148103 - DNA, 22 bp, Homo sapiens
gctcagagaatttactgctgcc

SEQ ID NO: 9148104 - DNA, 22 bp, Homo sapiens
caaaagaagctcttggggctag

SEQ ID NO: 9148105 - DNA, 22 bp, Homo sapiens
caaaagaagctcttggggctag

SEQ ID NO: 9148106 - DNA, 22 bp, Homo sapiens
caaaagatacttgcatctaact

SEQ ID NO: 9148107 - DNA, 20 bp, Homo sapiens
caaaagcaatgaagttatga

SEQ ID NO: 9148108 - DNA, 20 bp, Homo sapiens
caaaagcaatgaagttatga

SEQ ID NO: 9148109 - DNA, 20 bp, Homo sapiens
caaaagcaatgaagttatga

SEQ ID NO: 9148110 - DNA, 22 bp, Homo sapiens
caaagaatcactcatctttagc

SEQ ID NO: 9148111 - DNA, 22 bp, Homo sapiens
caaacttttgaggagttcagga

SEQ ID NO: 9148112 - DNA, 22 bp, Homo sapiens
caaagaagagatttacagagct

SEQ ID NO: 9148113 - DNA, 22 bp, Homo sapiens
caaagaaggaactataatccca

SEQ ID NO: 9148114 - DNA, 22 bp, Homo sapiens
caaagaagagatttacagagct

SEQ ID NO: 9148115 - DNA, 22 bp, Homo sapiens
caaagaatcactcatctttagc

SEQ ID NO: 9148116 - DNA, 22 bp, Homo sapiens
caaagaatcactcatctttagc

SEQ ID NO: 9148117 - DNA, 22 bp, Homo sapiens
caaagaaggaactataatccca

SEQ ID NO: 9148118 - DNA, 22 bp, Homo sapiens
gctctgctgggtgggcagttat

SEQ ID NO: 9148119 - DNA, 22 bp, Homo sapiens
gctctgagataaacgttgccct

SEQ ID NO: 9148120 - DNA, 22 bp, Homo sapiens
gctctgctgtggaatcctctcc

SEQ ID NO: 9148121 - DNA, 22 bp, Homo sapiens
gctctgctgtcttcttgcaggc

SEQ ID NO: 9148122 - DNA, 22 bp, Homo sapiens
caaagacacgggaaacaacgtt

SEQ ID NO: 9148123 - DNA, 22 bp, Homo sapiens
gctccccagcttagccctggct

SEQ ID NO: 9148124 - DNA, 22 bp, Homo sapiens
gctccccagcttagccctggct

SEQ ID NO: 9148125 - DNA, 22 bp, Homo sapiens
gctccccagcttagccctggct

SEQ ID NO: 9148126 - DNA, 22 bp, Homo sapiens
gctccccaaaagctccaggaaa

SEQ ID NO: 9148127 - DNA, 22 bp, Homo sapiens
gctcccagtctgatggaggaga

SEQ ID NO: 9148128 - DNA, 22 bp, Homo sapiens
gctcccaggttcttgggccttg

SEQ ID NO: 9148129 - DNA, 22 bp, Homo sapiens
gctcccagggaccgcagggcag

SEQ ID NO: 9148130 - DNA, 22 bp, Homo sapiens
gctccagggaacagaatgtact

SEQ ID NO: 9148131 - DNA, 22 bp, Homo sapiens
gctcccaggatgaggagccagg

SEQ ID NO: 9148132 - DNA, 22 bp, Homo sapiens
gctccagggaacagaatgtact

SEQ ID NO: 9148133 - DNA, 22 bp, Homo sapiens
gctcccagggacactggccact

SEQ ID NO: 9148134 - DNA, 22 bp, Homo sapiens
attatctaggaattgacagaag

SEQ ID NO: 9148135 - DNA, 22 bp, Homo sapiens
attatctcaagggatagcagat

SEQ ID NO: 9148136 - DNA, 22 bp, Homo sapiens
gcacccagaataaggacaggac

SEQ ID NO: 9148137 - DNA, 22 bp, Homo sapiens
attatctatgtagaatgatttt

SEQ ID NO: 9148138 - DNA, 22 bp, Homo sapiens
gcagaatttgggggtaaccttt

SEQ ID NO: 9148139 - DNA, 22 bp, Homo sapiens
gcagacaatttattagcagatt

SEQ ID NO: 9148140 - DNA, 22 bp, Homo sapiens
gcagaattttctgttttctaga

SEQ ID NO: 9148141 - DNA, 22 bp, Homo sapiens
gcagaatttaggaattaggaaa

SEQ ID NO: 9148142 - DNA, 22 bp, Homo sapiens
attatgtctttagatatttggt

SEQ ID NO: 9148143 - DNA, 22 bp, Homo sapiens
gcagagatctgagaaggctgcc

SEQ ID NO: 9148144 - DNA, 22 bp, Homo sapiens
gcagagataagtagacaggatg

SEQ ID NO: 9148145 - DNA, 19 bp, Homo sapiens
gcagagatgtggtagcttg

SEQ ID NO: 9148146 - DNA, 22 bp, Homo sapiens
gcagagaggaatgaagccatcc

SEQ ID NO: 9148147 - DNA, 22 bp, Homo sapiens
gcagagaggaatgaagccatcc

SEQ ID NO: 9148148 - DNA, 22 bp, Homo sapiens
gcagagagttgggctgcgccag

SEQ ID NO: 9148149 - DNA, 22 bp, Homo sapiens
gcagagacagactaatgaaaag

SEQ ID NO: 9148150 - DNA, 23 bp, Homo sapiens
gcagagacagccccagcgcgatg

SEQ ID NO: 9148151 - DNA, 22 bp, Homo sapiens
gcagagacaggataatgggttc

SEQ ID NO: 9148152 - DNA, 22 bp, Homo sapiens
gcagagaaggattgaaaccaga

SEQ ID NO: 9148153 - DNA, 21 bp, Homo sapiens
gcagagaatgaactttggctt

SEQ ID NO: 9148154 - DNA, 22 bp, Homo sapiens
gcagagactagtagtgcagact

SEQ ID NO: 9148155 - DNA, 22 bp, Homo sapiens
gcagagaccccgcagtgaggcc

SEQ ID NO: 9148156 - DNA, 22 bp, Homo sapiens
gcagagaccccgcagtgaggcc

SEQ ID NO: 9148157 - DNA, 22 bp, Homo sapiens
gcacagggctgccaggcggctt

SEQ ID NO: 9148158 - DNA, 22 bp, Homo sapiens
gcacacaggcagtttccagcca

SEQ ID NO: 9148159 - DNA, 22 bp, Homo sapiens
gcaccaggcagctgagcaggcc

SEQ ID NO: 9148160 - DNA, 22 bp, Homo sapiens
gcaccaggcagctgagcaggcc

SEQ ID NO: 9148161 - DNA, 22 bp, Homo sapiens
gcaccaggcagctgagcaggcc

SEQ ID NO: 9148162 - DNA, 22 bp, Homo sapiens
gcaccaggcttagagccccagg

SEQ ID NO: 9148163 - DNA, 22 bp, Homo sapiens
gcaccaggcagctgagcaggcc

SEQ ID NO: 9148164 - DNA, 22 bp, Homo sapiens
gcaccaggcttagagccccagg

SEQ ID NO: 9148165 - DNA, 22 bp, Homo sapiens
gcacacagattaggaaacagaa

SEQ ID NO: 9148166 - DNA, 22 bp, Homo sapiens
gcacacagaattgattcactgt

SEQ ID NO: 9148167 - DNA, 22 bp, Homo sapiens
gcacacagccagctgagggcta

SEQ ID NO: 9148168 - DNA, 22 bp, Homo sapiens
gcacacagccagctgagggcta

SEQ ID NO: 9148169 - DNA, 22 bp, Homo sapiens
gcacacagccagctgagggcta

SEQ ID NO: 9148170 - DNA, 22 bp, Homo sapiens
gcacacagccagctgagggcta

SEQ ID NO: 9148171 - DNA, 22 bp, Homo sapiens
gcacacagctagattaccattc

SEQ ID NO: 9148172 - DNA, 22 bp, Homo sapiens
attatattgagtataaccagag

SEQ ID NO: 9148173 - DNA, 22 bp, Homo sapiens
attatattgagtataaccagag

SEQ ID NO: 9148174 - DNA, 22 bp, Homo sapiens
attatattgagtataaccagag

SEQ ID NO: 9148175 - DNA, 22 bp, Homo sapiens
attatataaaattctggaagct

SEQ ID NO: 9148176 - DNA, 22 bp, Homo sapiens
attagtttggtgcaaaagtaat

SEQ ID NO: 9148177 - DNA, 22 bp, Homo sapiens
attaagatcattgtagaagatt

SEQ ID NO: 9148178 - DNA, 21 bp, Homo sapiens
attaacttgttaacctaaagt

SEQ ID NO: 9148179 - DNA, 22 bp, Homo sapiens
attaactgtactttctaatttt

SEQ ID NO: 9148180 - DNA, 22 bp, Homo sapiens
gatgtgacaaaccaagaggact

SEQ ID NO: 9148181 - DNA, 20 bp, Homo sapiens
gatgtcttttctggtctcct

SEQ ID NO: 9148182 - DNA, 22 bp, Homo sapiens
gatgtctttttccaggctcttt

SEQ ID NO: 9148183 - DNA, 22 bp, Homo sapiens
gatgtctttctgtgtgcctaga

SEQ ID NO: 9148184 - DNA, 22 bp, Homo sapiens
gatgtctttctaatactggctt

SEQ ID NO: 9148185 - DNA, 22 bp, Homo sapiens
gatgtctttgaggctcactgct

SEQ ID NO: 9148186 - DNA, 22 bp, Homo sapiens
gatgtctttgctgttatccact

SEQ ID NO: 9148187 - DNA, 22 bp, Homo sapiens
gatgtctttgccatgcatgtgt

SEQ ID NO: 9148188 - DNA, 22 bp, Homo sapiens
gatgtcttctcaactgtagacc

SEQ ID NO: 9148189 - DNA, 22 bp, Homo sapiens
gatgtcttcccatgttcatgtg

SEQ ID NO: 9148190 - DNA, 22 bp, Homo sapiens
gatgtcttcagatggcaagaga

SEQ ID NO: 9148191 - DNA, 22 bp, Homo sapiens
gatgtcttcagatggcaagaga

SEQ ID NO: 9148192 - DNA, 22 bp, Homo sapiens
gatgtcttgttgatttcattct

SEQ ID NO: 9148193 - DNA, 20 bp, Homo sapiens
gatgtcttggtcacagtggc

SEQ ID NO: 9148194 - DNA, 22 bp, Homo sapiens
gatgtctttagggcaaaatatt

SEQ ID NO: 9148195 - DNA, 22 bp, Homo sapiens
gatgtctttagggcaaaatatt

SEQ ID NO: 9148196 - DNA, 22 bp, Homo sapiens
gatgtcttggcttgctctctgt

SEQ ID NO: 9148197 - DNA, 22 bp, Homo sapiens
gatgtcttggtcaacttgggct

SEQ ID NO: 9148198 - DNA, 22 bp, Homo sapiens
gatgtggcatagaatgatggtt

SEQ ID NO: 9148199 - DNA, 22 bp, Homo sapiens
gattccacagcttcgaggtctt

SEQ ID NO: 9148200 - DNA, 22 bp, Homo sapiens
gattccacagcttcgaggtctt

SEQ ID NO: 9148201 - DNA, 22 bp, Homo sapiens
gattccacggctcagcctcaac

SEQ ID NO: 9148202 - DNA, 22 bp, Homo sapiens
gattcccatcctcagcagcagc

SEQ ID NO: 9148203 - DNA, 22 bp, Homo sapiens
gattcccatgtctgaggaggtg

SEQ ID NO: 9148204 - DNA, 22 bp, Homo sapiens
gattcctttggtgaactgccga

SEQ ID NO: 9148205 - DNA, 22 bp, Homo sapiens
gattcctttcgcctgccgagct

SEQ ID NO: 9148206 - DNA, 22 bp, Homo sapiens
gattccttccctacccaggcct

SEQ ID NO: 9148207 - DNA, 22 bp, Homo sapiens
gattctcttcatatggcaaagg

SEQ ID NO: 9148208 - DNA, 22 bp, Homo sapiens
gattctcttggatgtaggcata

SEQ ID NO: 9148209 - DNA, 22 bp, Homo sapiens
gattctgatgctggtggaggaa

SEQ ID NO: 9148210 - DNA, 22 bp, Homo sapiens
attaaattggatctgcatagtt

SEQ ID NO: 9148211 - DNA, 22 bp, Homo sapiens
attaaattggatctgcatagtt

SEQ ID NO: 9148212 - DNA, 22 bp, Homo sapiens
gattcttgggccttctgaagtt

SEQ ID NO: 9148213 - DNA, 22 bp, Homo sapiens
gattctggcaaaatcctggctt

SEQ ID NO: 9148214 - DNA, 22 bp, Homo sapiens
gattctgggtcctgtgtcttgc

SEQ ID NO: 9148215 - DNA, 22 bp, Homo sapiens
attaacatgcagccagacacac

SEQ ID NO: 9148216 - DNA, 22 bp, Homo sapiens
attaactgtactttctaatttt

SEQ ID NO: 9148217 - DNA, 22 bp, Homo sapiens
attaacagcagcatccccagcc

SEQ ID NO: 9148218 - DNA, 22 bp, Homo sapiens
attaacagtttatgatgtgcct

SEQ ID NO: 9148219 - DNA, 22 bp, Homo sapiens
gatggccacatacatggctggg

SEQ ID NO: 9148220 - DNA, 22 bp, Homo sapiens
gatggcagtcaaccaggtgagg

SEQ ID NO: 9148221 - DNA, 22 bp, Homo sapiens
gatggcagtcaaccaggtgagg

SEQ ID NO: 9148222 - DNA, 22 bp, Homo sapiens
gatggcagcagcagccagggat

SEQ ID NO: 9148223 - DNA, 22 bp, Homo sapiens
gatggcaggcaggtgagtagag

SEQ ID NO: 9148224 - DNA, 22 bp, Homo sapiens
gatggcaggtagtggtctcatc

SEQ ID NO: 9148225 - DNA, 22 bp, Homo sapiens
gatggaggagatggcagggtgc

SEQ ID NO: 9148226 - DNA, 22 bp, Homo sapiens
gatggcacacagacatccccgc

SEQ ID NO: 9148227 - DNA, 22 bp, Homo sapiens
gatggcaccttgaacgctgcgt

SEQ ID NO: 9148228 - DNA, 22 bp, Homo sapiens
gatgatggacaaagcattggtg

SEQ ID NO: 9148229 - DNA, 22 bp, Homo sapiens
atgttatttctgaaagatcatt

SEQ ID NO: 9148230 - DNA, 22 bp, Homo sapiens
atgttatttcaaaattcccttg

SEQ ID NO: 9148231 - DNA, 22 bp, Homo sapiens
atgttatttattgaaacacttt

SEQ ID NO: 9148232 - DNA, 21 bp, Homo sapiens
atgttattctgttcctccagc

SEQ ID NO: 9148233 - DNA, 22 bp, Homo sapiens
atgttattaaagtacagattct

SEQ ID NO: 9148234 - DNA, 22 bp, Homo sapiens
atgttatgtctgggaaggggta

SEQ ID NO: 9148235 - DNA, 22 bp, Homo sapiens
gagtggggcccactgctgggtg

SEQ ID NO: 9148236 - DNA, 22 bp, Homo sapiens
gagtggggcccactgctgggtg

SEQ ID NO: 9148237 - DNA, 23 bp, Homo sapiens
gagtggggagaaattggttaaac

SEQ ID NO: 9148238 - DNA, 20 bp, Homo sapiens
gagtgggccatggagtgaga

SEQ ID NO: 9148239 - DNA, 22 bp, Homo sapiens
gagtggggaaagccaggacaga

SEQ ID NO: 9148240 - DNA, 21 bp, Homo sapiens
gagtgggctgagatggggctg

SEQ ID NO: 9148241 - DNA, 20 bp, Homo sapiens
gcatgcttggagagagagaa

SEQ ID NO: 9148242 - DNA, 22 bp, Homo sapiens
gcatcagttactaggagggaaa

SEQ ID NO: 9148243 - DNA, 22 bp, Homo sapiens
gcatcagtagctatagttacaa

SEQ ID NO: 9148244 - DNA, 22 bp, Homo sapiens
attgcactccggcctgggtgac

SEQ ID NO: 9148245 - DNA, 22 bp, Homo sapiens
attgcactccggcctgggtgac

SEQ ID NO: 9148246 - DNA, 22 bp, Homo sapiens
attgcactccggcctgggtgac

SEQ ID NO: 9148247 - DNA, 22 bp, Homo sapiens
attgcactccagcctgggtgac

SEQ ID NO: 9148248 - DNA, 22 bp, Homo sapiens
attgcactccagcctgggtgac

SEQ ID NO: 9148249 - DNA, 22 bp, Homo sapiens
attgcaatctggtgaaaacagt

SEQ ID NO: 9148250 - DNA, 22 bp, Homo sapiens
attgcactccagcctgggtgac

SEQ ID NO: 9148251 - DNA, 22 bp, Homo sapiens
attgcactccagcctgggggac

SEQ ID NO: 9148252 - DNA, 22 bp, Homo sapiens
attgcactccagcctgggggac

SEQ ID NO: 9148253 - DNA, 22 bp, Homo sapiens
attgcactccagcctgggggac

SEQ ID NO: 9148254 - DNA, 22 bp, Homo sapiens
gcatggaattcccttatgggcc

SEQ ID NO: 9148255 - DNA, 22 bp, Homo sapiens
gcatggcaagatcaggagacca

SEQ ID NO: 9148256 - DNA, 22 bp, Homo sapiens
gcatggcaagaccctgtctcta

SEQ ID NO: 9148257 - DNA, 22 bp, Homo sapiens
gcatggcaaatatcgagggcag

SEQ ID NO: 9148258 - DNA, 22 bp, Homo sapiens
gcatggcaagatcaggagacca

SEQ ID NO: 9148259 - DNA, 22 bp, Homo sapiens
gcatggcagtgaggatggtgct

SEQ ID NO: 9148260 - DNA, 22 bp, Homo sapiens
attgcaaataatgcgagccagt

SEQ ID NO: 9148261 - DNA, 22 bp, Homo sapiens
gcagtaagaaagtcaagcagtt

SEQ ID NO: 9148262 - DNA, 22 bp, Homo sapiens
attgcaaagcgtagactctaaa

SEQ ID NO: 9148263 - DNA, 22 bp, Homo sapiens
attcttttttaaggaatagaac

SEQ ID NO: 9148264 - DNA, 22 bp, Homo sapiens
attcttttttaaggaatagaac

SEQ ID NO: 9148265 - DNA, 22 bp, Homo sapiens
gcagtaaaaaaggatatgtgca

SEQ ID NO: 9148266 - DNA, 22 bp, Homo sapiens
attctttggacaataagtggtg

SEQ ID NO: 9148267 - DNA, 22 bp, Homo sapiens
attctttgcatctctgggtggc

SEQ ID NO: 9148268 - DNA, 21 bp, Homo sapiens
attctttgatgtgcaataagt

SEQ ID NO: 9148269 - DNA, 22 bp, Homo sapiens
attcttttaaatggcagtagta

SEQ ID NO: 9148270 - DNA, 19 bp, Homo sapiens
attctttggtgtccatttc

SEQ ID NO: 9148271 - DNA, 22 bp, Homo sapiens
attcttttaagccccagggatt

SEQ ID NO: 9148272 - DNA, 22 bp, Homo sapiens
attcttttcccaactgctttaa

SEQ ID NO: 9148273 - DNA, 22 bp, Homo sapiens
attcttttcccaactgctttaa

SEQ ID NO: 9148274 - DNA, 22 bp, Homo sapiens
attcttttgtcctagcttgata

SEQ ID NO: 9148275 - DNA, 22 bp, Homo sapiens
attcttttttaaggaatagaac

SEQ ID NO: 9148276 - DNA, 22 bp, Homo sapiens
gcagggcatagaggcacggagg

SEQ ID NO: 9148277 - DNA, 22 bp, Homo sapiens
gcagggcagtgtgtctgtgggg

SEQ ID NO: 9148278 - DNA, 22 bp, Homo sapiens
gcagggcatagaggcacggagg

SEQ ID NO: 9148279 - DNA, 22 bp, Homo sapiens
gcagggcagtgtgtctgtgggg

SEQ ID NO: 9148280 - DNA, 20 bp, Homo sapiens
gcagggcatcttggccccca

SEQ ID NO: 9148281 - DNA, 20 bp, Homo sapiens
gcagggcatcttggccccca

SEQ ID NO: 9148282 - DNA, 22 bp, Homo sapiens
gcagggcatccctgagcgggtg

SEQ ID NO: 9148283 - DNA, 22 bp, Homo sapiens
gcagggcatccctgagcgggtg

SEQ ID NO: 9148284 - DNA, 22 bp, Homo sapiens
gcagggattgtgcagggggcta

SEQ ID NO: 9148285 - DNA, 22 bp, Homo sapiens
gcagggattgtgcagggggcta

SEQ ID NO: 9148286 - DNA, 22 bp, Homo sapiens
gcagggcagtaagagctagagt

SEQ ID NO: 9148287 - DNA, 22 bp, Homo sapiens
attctgcatgtaggtttgctca

SEQ ID NO: 9148288 - DNA, 22 bp, Homo sapiens
attctgatatcttattctagct

SEQ ID NO: 9148289 - DNA, 19 bp, Homo sapiens
gcagctgtgggaagagcca

SEQ ID NO: 9148290 - DNA, 19 bp, Homo sapiens
gcagctgtgggaagagcca

SEQ ID NO: 9148291 - DNA, 19 bp, Homo sapiens
gcagctgtgggaagagcca

SEQ ID NO: 9148292 - DNA, 22 bp, Homo sapiens
gcagctgtgtaatgagcccaca

SEQ ID NO: 9148293 - DNA, 22 bp, Homo sapiens
gcagctgtgtaatgagcccaca

SEQ ID NO: 9148294 - DNA, 22 bp, Homo sapiens
attctgagacaattgccgtcag

SEQ ID NO: 9148295 - DNA, 22 bp, Homo sapiens
attctctttgtataacatcttg

SEQ ID NO: 9148296 - DNA, 22 bp, Homo sapiens
attctcttctgatgtcttgcca

SEQ ID NO: 9148297 - DNA, 22 bp, Homo sapiens
attctcttctgatgtcttgcca

SEQ ID NO: 9148298 - DNA, 22 bp, Homo sapiens
attctctgtttccaagatgaaa

SEQ ID NO: 9148299 - DNA, 22 bp, Homo sapiens
attctcatttttatagatgaga

SEQ ID NO: 9148300 - DNA, 17 bp, Homo sapiens
attctcagtgtacagtg

SEQ ID NO: 9148301 - DNA, 22 bp, Homo sapiens
gcagcttcagccagagggccag

SEQ ID NO: 9148302 - DNA, 22 bp, Homo sapiens
gcagctgttcagctggccagat

SEQ ID NO: 9148303 - DNA, 22 bp, Homo sapiens
gcagcttagaaaaatgaaattg

SEQ ID NO: 9148304 - DNA, 22 bp, Homo sapiens
gcagcttcctgagtgtggacag

SEQ ID NO: 9148305 - DNA, 22 bp, Homo sapiens
gcagcttcagtaggtgaagaca

SEQ ID NO: 9148306 - DNA, 23 bp, Homo sapiens
gcagcttgtggtttagtagaggg

SEQ ID NO: 9148307 - DNA, 22 bp, Homo sapiens
gcagcttggggacatgaaaaga

SEQ ID NO: 9148308 - DNA, 22 bp, Homo sapiens
gcaggcaaggtagacagaggaa

SEQ ID NO: 9148309 - DNA, 22 bp, Homo sapiens
gcaggcaggaaggactaagtaa

SEQ ID NO: 9148310 - DNA, 22 bp, Homo sapiens
gcaggcaggagcccaactgcct

SEQ ID NO: 9148311 - DNA, 22 bp, Homo sapiens
gcaggcaggcttccttgaactg

SEQ ID NO: 9148312 - DNA, 19 bp, Homo sapiens
attcatttttgccttctaa

SEQ ID NO: 9148313 - DNA, 22 bp, Homo sapiens
attccaaactctttccctgtcg

SEQ ID NO: 9148314 - DNA, 22 bp, Homo sapiens
attccaaactctttccctgtcg

SEQ ID NO: 9148315 - DNA, 22 bp, Homo sapiens
attccaaacgcctcgcggactt

SEQ ID NO: 9148316 - DNA, 22 bp, Homo sapiens
attccaaacttaccccagagga

SEQ ID NO: 9148317 - DNA, 22 bp, Homo sapiens
attccaaacttaccccagagga

SEQ ID NO: 9148318 - DNA, 22 bp, Homo sapiens
attccaaaaggatgttagaatg

SEQ ID NO: 9148319 - DNA, 22 bp, Homo sapiens
attccaaaaggatgttagaatg

SEQ ID NO: 9148320 - DNA, 22 bp, Homo sapiens
attccaaacagtgctgcagact

SEQ ID NO: 9148321 - DNA, 22 bp, Homo sapiens
attccaaacagtgctgcagact

SEQ ID NO: 9148322 - DNA, 22 bp, Homo sapiens
attccaaacagtgctgcagact

SEQ ID NO: 9148323 - DNA, 22 bp, Homo sapiens
attccaaacgcctcgcggactt

SEQ ID NO: 9148324 - DNA, 22 bp, Homo sapiens
attcacaaagaagggaagtaca

SEQ ID NO: 9148325 - DNA, 22 bp, Homo sapiens
attcacaaagaagggaagtaca

SEQ ID NO: 9148326 - DNA, 22 bp, Homo sapiens
attccacaggactaccaatgtg

SEQ ID NO: 9148327 - DNA, 22 bp, Homo sapiens
attccacagccgataccatgac

SEQ ID NO: 9148328 - DNA, 22 bp, Homo sapiens
attccacagctacatcaatcta

SEQ ID NO: 9148329 - DNA, 22 bp, Homo sapiens
attccacagctacatcaatcta

SEQ ID NO: 9148330 - DNA, 22 bp, Homo sapiens
attccacataggccttcatgac

SEQ ID NO: 9148331 - DNA, 22 bp, Homo sapiens
attccactgttataaaatgtcc

SEQ ID NO: 9148332 - DNA, 22 bp, Homo sapiens
attccacttatatgaagtaacg

SEQ ID NO: 9148333 - DNA, 22 bp, Homo sapiens
attccactgccgaatgatacat

SEQ ID NO: 9148334 - DNA, 22 bp, Homo sapiens
attccactccaataagtgtcaa

SEQ ID NO: 9148335 - DNA, 22 bp, Homo sapiens
attccaaagcctgaataatgga

SEQ ID NO: 9148336 - DNA, 22 bp, Homo sapiens
attccaaaggctggcctggagg

SEQ ID NO: 9148337 - DNA, 22 bp, Homo sapiens
attccaaaggttaatgcccatt

SEQ ID NO: 9148338 - DNA, 22 bp, Homo sapiens
attccaaagcctgaataatgga

SEQ ID NO: 9148339 - DNA, 22 bp, Homo sapiens
attccaaagcctgaataatgga

SEQ ID NO: 9148340 - DNA, 22 bp, Homo sapiens
attccaaagacagaagcagctg

SEQ ID NO: 9148341 - DNA, 22 bp, Homo sapiens
attccaaagacagaagcagctg

SEQ ID NO: 9148342 - DNA, 22 bp, Homo sapiens
attccaaagcacatcagaacta

SEQ ID NO: 9148343 - DNA, 22 bp, Homo sapiens
attccaaagcacatcagaacta

SEQ ID NO: 9148344 - DNA, 22 bp, Homo sapiens
attccaaagcacatcagaacta

SEQ ID NO: 9148345 - DNA, 22 bp, Homo sapiens
attccaaaggctggcctggagg

SEQ ID NO: 9148346 - DNA, 22 bp, Homo sapiens
attccaaaggttaatgcccatt

SEQ ID NO: 9148347 - DNA, 22 bp, Homo sapiens
attccaaaggttaatgcccatt

SEQ ID NO: 9148348 - DNA, 22 bp, Homo sapiens
attccacacagtaatactcaat

SEQ ID NO: 9148349 - DNA, 22 bp, Homo sapiens
attccacacagtaatactcaat

SEQ ID NO: 9148350 - DNA, 22 bp, Homo sapiens
attccacaagaccataaattag

SEQ ID NO: 9148351 - DNA, 22 bp, Homo sapiens
aaaaaagattgatggtggatgc

SEQ ID NO: 9148352 - DNA, 22 bp, Homo sapiens
aaaaaagattgatggtggatgc

SEQ ID NO: 9148353 - DNA, 22 bp, Homo sapiens
aaaaaagattgatggtggatgc

SEQ ID NO: 9148354 - DNA, 22 bp, Homo sapiens
aaaaaagattgatggtggatgc

SEQ ID NO: 9148355 - DNA, 23 bp, Homo sapiens
aaaaaaccatgtaggcactcagt

SEQ ID NO: 9148356 - DNA, 22 bp, Homo sapiens
aaaaaatcagatctttggttaa

SEQ ID NO: 9148357 - DNA, 22 bp, Homo sapiens
aaaaaattatcatagttcctga

SEQ ID NO: 9148358 - DNA, 22 bp, Homo sapiens
aaaaaattccattctgtgcctt

SEQ ID NO: 9148359 - DNA, 22 bp, Homo sapiens
aaaaacactgggctgggagtca

SEQ ID NO: 9148360 - DNA, 22 bp, Homo sapiens
aaaaacagaatgtgtctaactc

SEQ ID NO: 9148361 - DNA, 23 bp, Homo sapiens
aaaatcttctgcctatgaagaaa

SEQ ID NO: 9148362 - DNA, 23 bp, Homo sapiens
aaaatcttctgcctatgaagaaa

SEQ ID NO: 9148363 - DNA, 22 bp, Homo sapiens
aaaatcttgtgacttaggaagg

SEQ ID NO: 9148364 - DNA, 22 bp, Homo sapiens
aaaatgaacagaacaatgggga

SEQ ID NO: 9148365 - DNA, 22 bp, Homo sapiens
aaaatgaacagaacaatgggga

SEQ ID NO: 9148366 - DNA, 22 bp, Homo sapiens
aaaatgaagcaaaggcattcag

SEQ ID NO: 9148367 - DNA, 20 bp, Homo sapiens
aaaaacagtaatgctgaaga

SEQ ID NO: 9148368 - DNA, 22 bp, Homo sapiens
aaaaacctcaattacttttgca

SEQ ID NO: 9148369 - DNA, 22 bp, Homo sapiens
aaaaacctttcattgcaaatgt

SEQ ID NO: 9148370 - DNA, 22 bp, Homo sapiens
aaaaacctcaattacttttgca

SEQ ID NO: 9148371 - DNA, 22 bp, Homo sapiens
aaaatagttaacgttcagagta

SEQ ID NO: 9148372 - DNA, 22 bp, Homo sapiens
aaaatctggcaacactaagttt

SEQ ID NO: 9148373 - DNA, 22 bp, Homo sapiens
aaaatagttaacgttcagagta

SEQ ID NO: 9148374 - DNA, 22 bp, Homo sapiens
aaaaacctttcattgcaaatgt

SEQ ID NO: 9148375 - DNA, 22 bp, Homo sapiens
aaaaacctttcattgcaaatgt

SEQ ID NO: 9148376 - DNA, 22 bp, Homo sapiens
aaaaacctttcattgcaaatgt

SEQ ID NO: 9148377 - DNA, 22 bp, Homo sapiens
aaaaacctttcccatactaaga

SEQ ID NO: 9148378 - DNA, 22 bp, Homo sapiens
aaacagactgcactgccagtca

SEQ ID NO: 9148379 - DNA, 22 bp, Homo sapiens
aaacagactgaagagttgaagc

SEQ ID NO: 9148380 - DNA, 22 bp, Homo sapiens
aaacagagggccactgaggctc

SEQ ID NO: 9148381 - DNA, 22 bp, Homo sapiens
aaacacttcaaggacttctgtc

SEQ ID NO: 9148382 - DNA, 22 bp, Homo sapiens
aaacactgtgtcaaactggggc

SEQ ID NO: 9148383 - DNA, 22 bp, Homo sapiens
aaacacttcaaggacttctgtc

SEQ ID NO: 9148384 - DNA, 22 bp, Homo sapiens
aaacagaaatttcctcatgctc

SEQ ID NO: 9148385 - DNA, 22 bp, Homo sapiens
aaaatgaataagttaacccagg

SEQ ID NO: 9148386 - DNA, 22 bp, Homo sapiens
aaaatgacattccagtgatatt

SEQ ID NO: 9148387 - DNA, 22 bp, Homo sapiens
aaaatgaataagttaacccagg

SEQ ID NO: 9148388 - DNA, 22 bp, Homo sapiens
aaaatgaataagttaacccagg

SEQ ID NO: 9148389 - DNA, 22 bp, Homo sapiens
aaaaatagcttctcttgtccct

SEQ ID NO: 9148390 - DNA, 22 bp, Homo sapiens
aaaaatagaaggattgactgag

SEQ ID NO: 9148391 - DNA, 22 bp, Homo sapiens
aaaaatagaaggattgactgag

SEQ ID NO: 9148392 - DNA, 22 bp, Homo sapiens
aaaaatcacttttataggcagc

SEQ ID NO: 9148393 - DNA, 22 bp, Homo sapiens
aaaaatcacttttataggcagc

SEQ ID NO: 9148394 - DNA, 22 bp, Homo sapiens
aaaaatcacttttataggcagc

SEQ ID NO: 9148395 - DNA, 22 bp, Homo sapiens
aaaaataggtcaaccgtgtatg

SEQ ID NO: 9148396 - DNA, 22 bp, Homo sapiens
aaaaatcacttttataggcagc

SEQ ID NO: 9148397 - DNA, 22 bp, Homo sapiens
aaacacaggtactgcagaagtg

SEQ ID NO: 9148398 - DNA, 22 bp, Homo sapiens
aaacactgtgggacatcttact

SEQ ID NO: 9148399 - DNA, 22 bp, Homo sapiens
aaacactgtgggacatcttact

SEQ ID NO: 9148400 - DNA, 22 bp, Homo sapiens
aaacaatgaaattcattcttca

SEQ ID NO: 9148401 - DNA, 22 bp, Homo sapiens
aaacaatccaggaacctgttta

SEQ ID NO: 9148402 - DNA, 22 bp, Homo sapiens
aaacaatccaggaacctgttta

SEQ ID NO: 9148403 - DNA, 22 bp, Homo sapiens
aaacaagtgtaaactagtctgt

SEQ ID NO: 9148404 - DNA, 23 bp, Homo sapiens
aaacaagtctctcaatggcttgc

SEQ ID NO: 9148405 - DNA, 22 bp, Homo sapiens
aaaatctcattatcaggaaggg

SEQ ID NO: 9148406 - DNA, 20 bp, Homo sapiens
aaaatctcccagaaacttat

SEQ ID NO: 9148407 - DNA, 22 bp, Homo sapiens
aaaattttgccctatccttcat

SEQ ID NO: 9148408 - DNA, 22 bp, Homo sapiens
aaaatccttagccgagtgaggt

SEQ ID NO: 9148409 - DNA, 22 bp, Homo sapiens
aaaatcctgctgactcgagatg

SEQ ID NO: 9148410 - DNA, 22 bp, Homo sapiens
aaaatcctctaattctagaata

SEQ ID NO: 9148411 - DNA, 22 bp, Homo sapiens
aaaatcctctaattctagaata

SEQ ID NO: 9148412 - DNA, 22 bp, Homo sapiens
aaaatccacaacgctcatttca

SEQ ID NO: 9148413 - DNA, 22 bp, Homo sapiens
aaaatcacaagcttgggtcact

SEQ ID NO: 9148414 - DNA, 22 bp, Homo sapiens
aaaatcagtacactttattttg

SEQ ID NO: 9148415 - DNA, 21 bp, Homo sapiens
aaaatcaccttaggtcactgg

SEQ ID NO: 9148416 - DNA, 22 bp, Homo sapiens
aaagacattagattaacgtaca

SEQ ID NO: 9148417 - DNA, 22 bp, Homo sapiens
aaagacattagattaacgtaca

SEQ ID NO: 9148418 - DNA, 22 bp, Homo sapiens
aaagacattagattaacgtaca

SEQ ID NO: 9148419 - DNA, 22 bp, Homo sapiens
aaagacattagcttagatgtca

SEQ ID NO: 9148420 - DNA, 22 bp, Homo sapiens
aaagacattagcttagatgtca

SEQ ID NO: 9148421 - DNA, 22 bp, Homo sapiens
aaagacattgaagaaggactta

SEQ ID NO: 9148422 - DNA, 22 bp, Homo sapiens
aaagacctgaaatataatctag

SEQ ID NO: 9148423 - DNA, 23 bp, Homo sapiens
aaagacctaggatgagggagacg

SEQ ID NO: 9148424 - DNA, 22 bp, Homo sapiens
aaagaccgtggttgtggagcta

SEQ ID NO: 9148425 - DNA, 22 bp, Homo sapiens
aaaagtaattgtggtttttgcc

SEQ ID NO: 9148426 - DNA, 22 bp, Homo sapiens
aaaagtaattgtggtttttgct

SEQ ID NO: 9148427 - DNA, 22 bp, Homo sapiens
aaaagtaattgtggtttttgct

SEQ ID NO: 9148428 - DNA, 22 bp, Homo sapiens
aaaagtactattttaacaaagt

SEQ ID NO: 9148429 - DNA, 22 bp, Homo sapiens
aaactctactgaggaaataaga

SEQ ID NO: 9148430 - DNA, 22 bp, Homo sapiens
aaactctaagacactgtacaat

SEQ ID NO: 9148431 - DNA, 22 bp, Homo sapiens
aaactctaatcaaatatagcat

SEQ ID NO: 9148432 - DNA, 22 bp, Homo sapiens
aaactctacatggtcgcaaaaa

SEQ ID NO: 9148433 - DNA, 22 bp, Homo sapiens
aaaagtatagggtttggagtca

SEQ ID NO: 9148434 - DNA, 22 bp, Homo sapiens
aaaagtattggccaccatttct

SEQ ID NO: 9148435 - DNA, 22 bp, Homo sapiens
aaagaaggggtctacatccaat

SEQ ID NO: 9148436 - DNA, 22 bp, Homo sapiens
aaagacatggaactagagatgg

SEQ ID NO: 9148437 - DNA, 22 bp, Homo sapiens
aaagacatggaactagagatgg

SEQ ID NO: 9148438 - DNA, 22 bp, Homo sapiens
aaaagagaatcctgtacagaga

SEQ ID NO: 9148439 - DNA, 22 bp, Homo sapiens
aaaagagagctgaggagctcca

SEQ ID NO: 9148440 - DNA, 22 bp, Homo sapiens
aaaagagaaagtggcaggcttt

SEQ ID NO: 9148441 - DNA, 22 bp, Homo sapiens
aaacccagagactagaaagacc

SEQ ID NO: 9148442 - DNA, 22 bp, Homo sapiens
aaactagatgattatgaagcat

SEQ ID NO: 9148443 - DNA, 22 bp, Homo sapiens
aaaccatttgaattattactga

SEQ ID NO: 9148444 - DNA, 22 bp, Homo sapiens
aaaagagagttgccagtctgta

SEQ ID NO: 9148445 - DNA, 22 bp, Homo sapiens
aaactcaagtctatgaacaagg

SEQ ID NO: 9148446 - DNA, 22 bp, Homo sapiens
aaactcaaattaaactagctta

SEQ ID NO: 9148447 - DNA, 22 bp, Homo sapiens
aaactcaaggatttagacgaag

SEQ ID NO: 9148448 - DNA, 22 bp, Homo sapiens
aaactagccaaggagagataga

SEQ ID NO: 9148449 - DNA, 22 bp, Homo sapiens
aaactagattaccactgctaga

SEQ ID NO: 9148450 - DNA, 22 bp, Homo sapiens
aaactatccctgccataatttt

SEQ ID NO: 9148451 - DNA, 22 bp, Homo sapiens
aaatgcactgaacacatgttgt

SEQ ID NO: 9148452 - DNA, 22 bp, Homo sapiens
aaatgcagattgtcattcagga

SEQ ID NO: 9148453 - DNA, 22 bp, Homo sapiens
aaatgcagattgtcattcagga

SEQ ID NO: 9148454 - DNA, 22 bp, Homo sapiens
aaagaggaaccaagagcacgtg

SEQ ID NO: 9148455 - DNA, 22 bp, Homo sapiens
aaagaggaaccaagagcacgtg

SEQ ID NO: 9148456 - DNA, 22 bp, Homo sapiens
aaagaggatggagtagtcagct

SEQ ID NO: 9148457 - DNA, 22 bp, Homo sapiens
aaagaggatggagtagtcagct

SEQ ID NO: 9148458 - DNA, 22 bp, Homo sapiens
aaagaggaaccaagagcacgtg

SEQ ID NO: 9148459 - DNA, 22 bp, Homo sapiens
aaatgcagcagctaattgaaaa

SEQ ID NO: 9148460 - DNA, 21 bp, Homo sapiens
aaagagcttttgtgctagtta

SEQ ID NO: 9148461 - DNA, 21 bp, Homo sapiens
aaagagcttttgtgctagtta

SEQ ID NO: 9148462 - DNA, 22 bp, Homo sapiens
aaagagctttccacactagtca

SEQ ID NO: 9148463 - DNA, 22 bp, Homo sapiens
aaagagctttccacactagtca

SEQ ID NO: 9148464 - DNA, 22 bp, Homo sapiens
aaagagcaccctcaatgtctga

SEQ ID NO: 9148465 - DNA, 22 bp, Homo sapiens
aaattacagatcaccaatgcat

SEQ ID NO: 9148466 - DNA, 22 bp, Homo sapiens
aaattaccattgtaaagtattt

SEQ ID NO: 9148467 - DNA, 22 bp, Homo sapiens
aaagagttcacggaggccaaag

SEQ ID NO: 9148468 - DNA, 22 bp, Homo sapiens
aaagagttggactttctcaggc

SEQ ID NO: 9148469 - DNA, 22 bp, Homo sapiens
aaagagttctgtttgagctgaa

SEQ ID NO: 9148470 - DNA, 22 bp, Homo sapiens
aaagagttgttgtataacagga

SEQ ID NO: 9148471 - DNA, 21 bp, Homo sapiens
aaactgaccttgcctgagaca

SEQ ID NO: 9148472 - DNA, 22 bp, Homo sapiens
aaactgaggcccagagaggcag

SEQ ID NO: 9148473 - DNA, 22 bp, Homo sapiens
aaactgaggctcccgagggtgt

SEQ ID NO: 9148474 - DNA, 22 bp, Homo sapiens
aaactgaggcccagagaggcag

SEQ ID NO: 9148475 - DNA, 21 bp, Homo sapiens
aaactgaggagatgaggacta

SEQ ID NO: 9148476 - DNA, 22 bp, Homo sapiens
aaactgaggaatgacagcatta

SEQ ID NO: 9148477 - DNA, 22 bp, Homo sapiens
aaactgaggaacaaggaaggat

SEQ ID NO: 9148478 - DNA, 21 bp, Homo sapiens
aaactgaccttgcctgagaca

SEQ ID NO: 9148479 - DNA, 22 bp, Homo sapiens
aaactcttttgcatattagagg

SEQ ID NO: 9148480 - DNA, 22 bp, Homo sapiens
aaactctggattggagtccagc

SEQ ID NO: 9148481 - DNA, 22 bp, Homo sapiens
aaactcttcatatacatatgct

SEQ ID NO: 9148482 - DNA, 22 bp, Homo sapiens
aaactcttggtcaacatgagga

SEQ ID NO: 9148483 - DNA, 22 bp, Homo sapiens
aaagaatgtctgaacagctggc

SEQ ID NO: 9148484 - DNA, 22 bp, Homo sapiens
aaagaatgcagtgccttccagc

SEQ ID NO: 9148485 - DNA, 21 bp, Homo sapiens
aaagaatcatgggtaatttca

SEQ ID NO: 9148486 - DNA, 22 bp, Homo sapiens
aaagaatcagaagtctcaaaca

SEQ ID NO: 9148487 - DNA, 22 bp, Homo sapiens
aaagaatcgtgtgtagtttgaa

SEQ ID NO: 9148488 - DNA, 22 bp, Homo sapiens
aaagaatagcctttgtccaaat

SEQ ID NO: 9148489 - DNA, 22 bp, Homo sapiens
aaagaatagttaagtttagggc

SEQ ID NO: 9148490 - DNA, 22 bp, Homo sapiens
aaagaatactccttttgccttg

SEQ ID NO: 9148491 - DNA, 22 bp, Homo sapiens
aaagaatactccttttgccttg

SEQ ID NO: 9148492 - DNA, 22 bp, Homo sapiens
aaactgataaaataagtacatt

SEQ ID NO: 9148493 - DNA, 21 bp, Homo sapiens
aaagaacaggcagatgttctt

SEQ ID NO: 9148494 - DNA, 21 bp, Homo sapiens
aaactgaggcttcaagcagtg

SEQ ID NO: 9148495 - DNA, 23 bp, Homo sapiens
aaactgaggcttgatgaggcggt

SEQ ID NO: 9148496 - DNA, 22 bp, Homo sapiens
aaagaagtgttgaatttgcaag

SEQ ID NO: 9148497 - DNA, 22 bp, Homo sapiens
aaagaagtgttgaatttgcaag

SEQ ID NO: 9148498 - DNA, 22 bp, Homo sapiens
aaagaaggtagggctggtgact

SEQ ID NO: 9148499 - DNA, 22 bp, Homo sapiens
aaacaatgtagattaccattta

SEQ ID NO: 9148500 - DNA, 22 bp, Homo sapiens
aaacaatttccacctctcctga

SEQ ID NO: 9148501 - DNA, 22 bp, Homo sapiens
aaacagtgatgttgagtgtaaa

SEQ ID NO: 9148502 - DNA, 22 bp, Homo sapiens
aaacagtgccaggcagatgcca

SEQ ID NO: 9148503 - DNA, 22 bp, Homo sapiens
aaacagtgactggtacataata

SEQ ID NO: 9148504 - DNA, 22 bp, Homo sapiens
aaacaatgtacatttataatgc

SEQ ID NO: 9148505 - DNA, 22 bp, Homo sapiens
aaacaatgtagattaccattta

SEQ ID NO: 9148506 - DNA, 22 bp, Homo sapiens
aaacaatgagcttttacacact

SEQ ID NO: 9148507 - DNA, 22 bp, Homo sapiens
aaacagtgtgtttcagagaggc

SEQ ID NO: 9148508 - DNA, 22 bp, Homo sapiens
aaacagtttataacatgatact

SEQ ID NO: 9148509 - DNA, 22 bp, Homo sapiens
aaacagtttataacatgatact

SEQ ID NO: 9148510 - DNA, 22 bp, Homo sapiens
aaacagttgttatttttatatg

SEQ ID NO: 9148511 - DNA, 22 bp, Homo sapiens
aaaggtcagacttaggctgggc

SEQ ID NO: 9148512 - DNA, 22 bp, Homo sapiens
aaaggtcaagctggactcaggt

SEQ ID NO: 9148513 - DNA, 22 bp, Homo sapiens
aaaggtcaagctggactcaggt

SEQ ID NO: 9148514 - DNA, 22 bp, Homo sapiens
aaaggtcagacttaggctgggc

SEQ ID NO: 9148515 - DNA, 22 bp, Homo sapiens
aaaggtcagctgccatcgttct

SEQ ID NO: 9148516 - DNA, 22 bp, Homo sapiens
aaaggtcattgaaaaggaggaa

SEQ ID NO: 9148517 - DNA, 22 bp, Homo sapiens
aaaggtcattgaaaaggaggaa

SEQ ID NO: 9148518 - DNA, 22 bp, Homo sapiens
aaaggtcattgaaaaggaggaa

SEQ ID NO: 9148519 - DNA, 22 bp, Homo sapiens
aaaggtcaaaatcgtgacattg

SEQ ID NO: 9148520 - DNA, 22 bp, Homo sapiens
aaagggctgtcaaataagcaac

SEQ ID NO: 9148521 - DNA, 22 bp, Homo sapiens
aaagggctgtcaaataagcaac

SEQ ID NO: 9148522 - DNA, 22 bp, Homo sapiens
aaacagtttcattttcatgacc

SEQ ID NO: 9148523 - DNA, 22 bp, Homo sapiens
aaacagtttctaatcatggaga

SEQ ID NO: 9148524 - DNA, 22 bp, Homo sapiens
aaagggctttgtaaacttcaag

SEQ ID NO: 9148525 - DNA, 22 bp, Homo sapiens
aaacctttctgctctcagcgta

SEQ ID NO: 9148526 - DNA, 22 bp, Homo sapiens
aaaccttttcagctgaatggag

SEQ ID NO: 9148527 - DNA, 22 bp, Homo sapiens
aaacctttgcctggaagggagt

SEQ ID NO: 9148528 - DNA, 22 bp, Homo sapiens
aaaccttagctagagtgtgtca

SEQ ID NO: 9148529 - DNA, 22 bp, Homo sapiens
aaacctggacttgtaatgataa

SEQ ID NO: 9148530 - DNA, 22 bp, Homo sapiens
aaacctggaacatttgactagg

SEQ ID NO: 9148531 - DNA, 22 bp, Homo sapiens
aaacctggtggaacggtgaata

SEQ ID NO: 9148532 - DNA, 22 bp, Homo sapiens
aaacctgtagcagtttgttaca

SEQ ID NO: 9148533 - DNA, 22 bp, Homo sapiens
aaacctaggtttcctcattcag

SEQ ID NO: 9148534 - DNA, 22 bp, Homo sapiens
aaaccgggtccagatcttcagg

SEQ ID NO: 9148535 - DNA, 22 bp, Homo sapiens
aaaccggggcctttccacaatg

SEQ ID NO: 9148536 - DNA, 22 bp, Homo sapiens
aaacctagaaggaagggtctct

SEQ ID NO: 9148537 - DNA, 22 bp, Homo sapiens
aaaggtgttctcactgggggtc

SEQ ID NO: 9148538 - DNA, 22 bp, Homo sapiens
aaactagaaatcagcaagatag

SEQ ID NO: 9148539 - DNA, 21 bp, Homo sapiens
aaactagagtgtggcaaagct

SEQ ID NO: 9148540 - DNA, 22 bp, Homo sapiens
aaactctataggcagaagcaat

SEQ ID NO: 9148541 - DNA, 19 bp, Homo sapiens
aaactctgaaggccactgg

SEQ ID NO: 9148542 - DNA, 22 bp, Homo sapiens
aaagttactttgctgtgcttca

SEQ ID NO: 9148543 - DNA, 22 bp, Homo sapiens
aaagttcagtgccttctataca

SEQ ID NO: 9148544 - DNA, 22 bp, Homo sapiens
aaatgtacgggagtagaattag

SEQ ID NO: 9148545 - DNA, 22 bp, Homo sapiens
aaatgtacgggagtagaattag

SEQ ID NO: 9148546 - DNA, 22 bp, Homo sapiens
aaatgtagtatgttgcatgtat

SEQ ID NO: 9148547 - DNA, 22 bp, Homo sapiens
aaatgtagttgaaaagttaagg

SEQ ID NO: 9148548 - DNA, 22 bp, Homo sapiens
aaatgtagttgaaaagttaagg

SEQ ID NO: 9148549 - DNA, 22 bp, Homo sapiens
aaatgtatcctacttcctgagt

SEQ ID NO: 9148550 - DNA, 22 bp, Homo sapiens
aaatgtattgcataggatattt

SEQ ID NO: 9148551 - DNA, 22 bp, Homo sapiens
aaatgtcaaagacgtgtttttg

SEQ ID NO: 9148552 - DNA, 22 bp, Homo sapiens
aagctctttaatagtctaaaaa

SEQ ID NO: 9148553 - DNA, 22 bp, Homo sapiens
aagctcttttcataagagcaaa

SEQ ID NO: 9148554 - DNA, 22 bp, Homo sapiens
aagctcttttcaccattaaagt

SEQ ID NO: 9148555 - DNA, 22 bp, Homo sapiens
aagctctttccctcttcagaac

SEQ ID NO: 9148556 - DNA, 22 bp, Homo sapiens
aagctgaaataatatctatgtt

SEQ ID NO: 9148557 - DNA, 22 bp, Homo sapiens
aagctgaagacacagctccagt

SEQ ID NO: 9148558 - DNA, 22 bp, Homo sapiens
aagctgaatctgaaatagaatt

SEQ ID NO: 9148559 - DNA, 22 bp, Homo sapiens
aagctgaagccggatcaaaaag

SEQ ID NO: 9148560 - DNA, 22 bp, Homo sapiens
aagctgaattttctaaaagaat

SEQ ID NO: 9148561 - DNA, 22 bp, Homo sapiens
aagcatcttctatcagttagac

SEQ ID NO: 9148562 - DNA, 23 bp, Homo sapiens
aagcatcttttcctagctccatc

SEQ ID NO: 9148563 - DNA, 22 bp, Homo sapiens
aagcatgcaatctgtgataagg

SEQ ID NO: 9148564 - DNA, 20 bp, Homo sapiens
aagcatctggatgtagcaat

SEQ ID NO: 9148565 - DNA, 22 bp, Homo sapiens
aagcatctatattccactgtga

SEQ ID NO: 9148566 - DNA, 22 bp, Homo sapiens
aagcatccggggctccaggtgc

SEQ ID NO: 9148567 - DNA, 21 bp, Homo sapiens
aagcatcctctcaggagctgt

SEQ ID NO: 9148568 - DNA, 22 bp, Homo sapiens
aagcatctataggttctaggag

SEQ ID NO: 9148569 - DNA, 22 bp, Homo sapiens
aaatggcagcccagaggtaagg

SEQ ID NO: 9148570 - DNA, 22 bp, Homo sapiens
aaatgtaagtctttgtttctta

SEQ ID NO: 9148571 - DNA, 22 bp, Homo sapiens
aaatgtacactttgcatcttga

SEQ ID NO: 9148572 - DNA, 22 bp, Homo sapiens
aaatgtacactttgcatcttga

SEQ ID NO: 9148573 - DNA, 22 bp, Homo sapiens
aaatgtacaacatccatatata

SEQ ID NO: 9148574 - DNA, 22 bp, Homo sapiens
aaatgtaagtctttgtttctta

SEQ ID NO: 9148575 - DNA, 20 bp, Homo sapiens
aagcatggtcaaaacttatg

SEQ ID NO: 9148576 - DNA, 19 bp, Homo sapiens
aagcatggtgcctcacctc

SEQ ID NO: 9148577 - DNA, 22 bp, Homo sapiens
aagcatgggaggcctggaggag

SEQ ID NO: 9148578 - DNA, 22 bp, Homo sapiens
aagcatgggaatcccacagggt

SEQ ID NO: 9148579 - DNA, 22 bp, Homo sapiens
aagcatggctgttctagctata

SEQ ID NO: 9148580 - DNA, 22 bp, Homo sapiens
aagcatggcctctccgctcccc

SEQ ID NO: 9148581 - DNA, 22 bp, Homo sapiens
aagcatggctgagtgcaatggt

SEQ ID NO: 9148582 - DNA, 22 bp, Homo sapiens
aagcatggagcaatagaatgac

SEQ ID NO: 9148583 - DNA, 22 bp, Homo sapiens
aaatgcaggttcttgagccaag

SEQ ID NO: 9148584 - DNA, 22 bp, Homo sapiens
aagcatcaacctgtatgctgca

SEQ ID NO: 9148585 - DNA, 22 bp, Homo sapiens
aaatgcatgagaaagtattctg

SEQ ID NO: 9148586 - DNA, 22 bp, Homo sapiens
aaatgcatcagctcataagaga

SEQ ID NO: 9148587 - DNA, 22 bp, Homo sapiens
aagcacagataaaacaggattc

SEQ ID NO: 9148588 - DNA, 22 bp, Homo sapiens
aagcacagatgcaagggggacc

SEQ ID NO: 9148589 - DNA, 22 bp, Homo sapiens
aaatcccagatagtaatgtatt

SEQ ID NO: 9148590 - DNA, 22 bp, Homo sapiens
aaatccgtcattggcctggttg

SEQ ID NO: 9148591 - DNA, 22 bp, Homo sapiens
aaatcctaaggagaatatgatt

SEQ ID NO: 9148592 - DNA, 22 bp, Homo sapiens
aaatcctaatgacaagtttagt

SEQ ID NO: 9148593 - DNA, 22 bp, Homo sapiens
aaatcctaccaagaaattccct

SEQ ID NO: 9148594 - DNA, 22 bp, Homo sapiens
aaatctagtacctttttgatta

SEQ ID NO: 9148595 - DNA, 22 bp, Homo sapiens
aaatctcaaaggcttagcatct

SEQ ID NO: 9148596 - DNA, 22 bp, Homo sapiens
aagcacagaaaaggagcatgga

SEQ ID NO: 9148597 - DNA, 23 bp, Homo sapiens
aagcacagaatggtttaggagtt

SEQ ID NO: 9148598 - DNA, 22 bp, Homo sapiens
aagcacagaaaaggagcatgga

SEQ ID NO: 9148599 - DNA, 22 bp, Homo sapiens
aagcacagacacaaaaggcttt

SEQ ID NO: 9148600 - DNA, 22 bp, Homo sapiens
aagcacagacacaaaaggcttt

SEQ ID NO: 9148601 - DNA, 22 bp, Homo sapiens
aagcacagactccctctgagtg

SEQ ID NO: 9148602 - DNA, 22 bp, Homo sapiens
aagcacagactccctctgagtg

SEQ ID NO: 9148603 - DNA, 22 bp, Homo sapiens
aagcacagagaggtaaagtaac

SEQ ID NO: 9148604 - DNA, 22 bp, Homo sapiens
aagcacagactccctctgagtg

SEQ ID NO: 9148605 - DNA, 22 bp, Homo sapiens
aagcacagagatgggcacgcct

SEQ ID NO: 9148606 - DNA, 22 bp, Homo sapiens
aaataacttggtttcatcagag

SEQ ID NO: 9148607 - DNA, 22 bp, Homo sapiens
aaataagcacttaactgtatca

SEQ ID NO: 9148608 - DNA, 22 bp, Homo sapiens
aaataagaggacagatgtttgg

SEQ ID NO: 9148609 - DNA, 22 bp, Homo sapiens
aaataagaggacagatgtttgg

SEQ ID NO: 9148610 - DNA, 22 bp, Homo sapiens
aaataagaaattcttctttgca

SEQ ID NO: 9148611 - DNA, 22 bp, Homo sapiens
aaataagaaattcttctttgca

SEQ ID NO: 9148612 - DNA, 22 bp, Homo sapiens
aaataagtagtttagtgttgtg

SEQ ID NO: 9148613 - DNA, 22 bp, Homo sapiens
aaataagtagtttagtgttgtg

SEQ ID NO: 9148614 - DNA, 22 bp, Homo sapiens
aaataagtaatgtcttcctttt

SEQ ID NO: 9148615 - DNA, 22 bp, Homo sapiens
aaataagttaaactagaatgat

SEQ ID NO: 9148616 - DNA, 22 bp, Homo sapiens
aaataagtgtgggccagtcaaa

SEQ ID NO: 9148617 - DNA, 22 bp, Homo sapiens
aaataagttagcagattccagt

SEQ ID NO: 9148618 - DNA, 22 bp, Homo sapiens
aaataagttagcagattccagt

SEQ ID NO: 9148619 - DNA, 22 bp, Homo sapiens
aaataatcaatttttgtagata

SEQ ID NO: 9148620 - DNA, 22 bp, Homo sapiens
aaataattatagcgagtctatc

SEQ ID NO: 9148621 - DNA, 22 bp, Homo sapiens
aaagtgtggcacaagtcacatc

SEQ ID NO: 9148622 - DNA, 22 bp, Homo sapiens
aaagtgtttacattgctataag

SEQ ID NO: 9148623 - DNA, 22 bp, Homo sapiens
aaagtgttttccatgcaatgaa

SEQ ID NO: 9148624 - DNA, 22 bp, Homo sapiens
aaagtgttttccatgcaatgaa

SEQ ID NO: 9148625 - DNA, 19 bp, Homo sapiens
aaagtgttttaaagaggat

SEQ ID NO: 9148626 - DNA, 22 bp, Homo sapiens
aaagtgttgggattacaggcat

SEQ ID NO: 9148627 - DNA, 22 bp, Homo sapiens
aaagtgttttgtgagcagtctg

SEQ ID NO: 9148628 - DNA, 22 bp, Homo sapiens
aaagttttatatgctgcagcga

SEQ ID NO: 9148629 - DNA, 22 bp, Homo sapiens
aaataacttatgatcgtctggc

SEQ ID NO: 9148630 - DNA, 22 bp, Homo sapiens
aaataacagtcagggacaacat

SEQ ID NO: 9148631 - DNA, 22 bp, Homo sapiens
aaatagcagcctttagttaaca

SEQ ID NO: 9148632 - DNA, 22 bp, Homo sapiens
aaatagcaatgtgaaaagagga

SEQ ID NO: 9148633 - DNA, 22 bp, Homo sapiens
aaatagcaatgtgaaaagagga

SEQ ID NO: 9148634 - DNA, 22 bp, Homo sapiens
aaatagatttcctagcattgga

SEQ ID NO: 9148635 - DNA, 22 bp, Homo sapiens
aaatagattgctgaggcattac

SEQ ID NO: 9148636 - DNA, 22 bp, Homo sapiens
aaatagatttaacatccatccc

SEQ ID NO: 9148637 - DNA, 22 bp, Homo sapiens
aaatactggttttggagatgct

SEQ ID NO: 9148638 - DNA, 22 bp, Homo sapiens
aaatagaattggaagcagagtt

SEQ ID NO: 9148639 - DNA, 22 bp, Homo sapiens
aaatagacacttggacagacaa

SEQ ID NO: 9148640 - DNA, 22 bp, Homo sapiens
aaatactgtagataatagagtt

SEQ ID NO: 9148641 - DNA, 22 bp, Homo sapiens
aaataattgagttggtcaatat

SEQ ID NO: 9148642 - DNA, 22 bp, Homo sapiens
aaataattgagttggtcaatat

SEQ ID NO: 9148643 - DNA, 22 bp, Homo sapiens
aaataattgagttggtcaatat

SEQ ID NO: 9148644 - DNA, 22 bp, Homo sapiens
aaataattatagcgagtctatc

SEQ ID NO: 9148645 - DNA, 22 bp, Homo sapiens
aaatagcataaaataggaagct

SEQ ID NO: 9148646 - DNA, 22 bp, Homo sapiens
aaatagcagcctttagttaaca

SEQ ID NO: 9148647 - DNA, 22 bp, Homo sapiens
aaatagcacagcagctgaggct

SEQ ID NO: 9148648 - DNA, 22 bp, Homo sapiens
aaatagcagcctttagttaaca

SEQ ID NO: 9148649 - DNA, 22 bp, Homo sapiens
aaataggagcttaagcacttct

SEQ ID NO: 9148650 - DNA, 22 bp, Homo sapiens
aaatagcattgtatttagctga

SEQ ID NO: 9148651 - DNA, 22 bp, Homo sapiens
aaatcagatgcttcctagttgg

SEQ ID NO: 9148652 - DNA, 23 bp, Homo sapiens
aaataggagtatctggatcatga

SEQ ID NO: 9148653 - DNA, 22 bp, Homo sapiens
aacagataagtatatctatgta

SEQ ID NO: 9148654 - DNA, 22 bp, Homo sapiens
aacagatataggcagaactttg

SEQ ID NO: 9148655 - DNA, 22 bp, Homo sapiens
aacagcaagggcggggtcaaga

SEQ ID NO: 9148656 - DNA, 22 bp, Homo sapiens
aacagatttgtgaagctactca

SEQ ID NO: 9148657 - DNA, 19 bp, Homo sapiens
aacagcaacttcctagtca

SEQ ID NO: 9148658 - DNA, 19 bp, Homo sapiens
aacagcaacttcctagtca

SEQ ID NO: 9148659 - DNA, 22 bp, Homo sapiens
aaagctacctttgtgttcatag

SEQ ID NO: 9148660 - DNA, 22 bp, Homo sapiens
aaagctacctttgtgttcatag

SEQ ID NO: 9148661 - DNA, 22 bp, Homo sapiens
aaagcgcatagggggcagcaag

SEQ ID NO: 9148662 - DNA, 22 bp, Homo sapiens
aacagcagcatgacagctgggt

SEQ ID NO: 9148663 - DNA, 22 bp, Homo sapiens
aacagcagcaagtaagcaggtc

SEQ ID NO: 9148664 - DNA, 22 bp, Homo sapiens
aacagcagcaagtaagcaggtc

SEQ ID NO: 9148665 - DNA, 22 bp, Homo sapiens
aacagcagcaagtaagcaggtc

SEQ ID NO: 9148666 - DNA, 22 bp, Homo sapiens
aacagcagaaactgcaagctac

SEQ ID NO: 9148667 - DNA, 22 bp, Homo sapiens
aacagcagaaactgcaagctac

SEQ ID NO: 9148668 - DNA, 20 bp, Homo sapiens
aacagcacacattcgcatta

SEQ ID NO: 9148669 - DNA, 22 bp, Homo sapiens
aacagcaatagcactattcatt

SEQ ID NO: 9148670 - DNA, 22 bp, Homo sapiens
aacagcaatagcactattcatt

SEQ ID NO: 9148671 - DNA, 22 bp, Homo sapiens
aaagctgttaaatgcataatgc

SEQ ID NO: 9148672 - DNA, 23 bp, Homo sapiens
aaagcttaactgggtaataaagc

SEQ ID NO: 9148673 - DNA, 23 bp, Homo sapiens
aaagcttaactgggtaataaagc

SEQ ID NO: 9148674 - DNA, 22 bp, Homo sapiens
aaagctgtagaatcatcttaat

SEQ ID NO: 9148675 - DNA, 22 bp, Homo sapiens
aaagcttgtgctgtagtattta

SEQ ID NO: 9148676 - DNA, 22 bp, Homo sapiens
aaagctttctagctatgttcta

SEQ ID NO: 9148677 - DNA, 22 bp, Homo sapiens
aaagctttgggtaggaatggga

SEQ ID NO: 9148678 - DNA, 22 bp, Homo sapiens
aaagctttgctggaaggaagag

SEQ ID NO: 9148679 - DNA, 22 bp, Homo sapiens
aaagctttgcatattcggcccg

SEQ ID NO: 9148680 - DNA, 22 bp, Homo sapiens
aaagcttaggatagggaatata

SEQ ID NO: 9148681 - DNA, 22 bp, Homo sapiens
aaagcttatttgtatgcatgtt

SEQ ID NO: 9148682 - DNA, 22 bp, Homo sapiens
aaagcttaccttttcagtcttt

SEQ ID NO: 9148683 - DNA, 22 bp, Homo sapiens
aaagcttaaggtaggtacagag

SEQ ID NO: 9148684 - DNA, 22 bp, Homo sapiens
aaagcttagcattttcaaaatg

SEQ ID NO: 9148685 - DNA, 22 bp, Homo sapiens
aaagcttagaggccagtggagg

SEQ ID NO: 9148686 - DNA, 22 bp, Homo sapiens
aaagcttagaggccagtggagg

SEQ ID NO: 9148687 - DNA, 22 bp, Homo sapiens
aaagctctttcttctttggcat

SEQ ID NO: 9148688 - DNA, 22 bp, Homo sapiens
aaagctgcccttgtgaaacaag

SEQ ID NO: 9148689 - DNA, 22 bp, Homo sapiens
aaagccagtttctggaagtacc

SEQ ID NO: 9148690 - DNA, 22 bp, Homo sapiens
aaagccagtttctggaagtacc

SEQ ID NO: 9148691 - DNA, 22 bp, Homo sapiens
aaagccagttcttagagaaagc

SEQ ID NO: 9148692 - DNA, 22 bp, Homo sapiens
aaagccagttcttagagaaagc

SEQ ID NO: 9148693 - DNA, 22 bp, Homo sapiens
aaagccagtggtatgagagaaa

SEQ ID NO: 9148694 - DNA, 22 bp, Homo sapiens
aaagccaggttgtgtgcaggaa

SEQ ID NO: 9148695 - DNA, 22 bp, Homo sapiens
aaagccagggtccaggcctgcc

SEQ ID NO: 9148696 - DNA, 22 bp, Homo sapiens
aaagatatgtctccaaagagat

SEQ ID NO: 9148697 - DNA, 22 bp, Homo sapiens
aaagatatgtctccaaagagat

SEQ ID NO: 9148698 - DNA, 22 bp, Homo sapiens
aaagatatgtctccaaagagat

SEQ ID NO: 9148699 - DNA, 22 bp, Homo sapiens
aaagatcacgtcccaggactcg

SEQ ID NO: 9148700 - DNA, 22 bp, Homo sapiens
aaagatcaatagataaagctac

SEQ ID NO: 9148701 - DNA, 22 bp, Homo sapiens
aaagccacgtggcctggggagc

SEQ ID NO: 9148702 - DNA, 22 bp, Homo sapiens
aaagagtttggagacaagatca

SEQ ID NO: 9148703 - DNA, 22 bp, Homo sapiens
aaagataatgtttccttattct

SEQ ID NO: 9148704 - DNA, 22 bp, Homo sapiens
aacaaaacatttgtcttgtttc

SEQ ID NO: 9148705 - DNA, 22 bp, Homo sapiens
aacaaaacatttgtcttgtttc

SEQ ID NO: 9148706 - DNA, 22 bp, Homo sapiens
aaattttcagagcactagagaa

SEQ ID NO: 9148707 - DNA, 22 bp, Homo sapiens
aaattttagtaaggaagttgag

SEQ ID NO: 9148708 - DNA, 22 bp, Homo sapiens
aaattttctctctaagacttaa

SEQ ID NO: 9148709 - DNA, 22 bp, Homo sapiens
aaattttagtaaggaagttgag

SEQ ID NO: 9148710 - DNA, 22 bp, Homo sapiens
aaattttagactcctgggtcta

SEQ ID NO: 9148711 - DNA, 22 bp, Homo sapiens
aaattttagactcctgggtcta

SEQ ID NO: 9148712 - DNA, 22 bp, Homo sapiens
aaagtatatttacttactgtga

SEQ ID NO: 9148713 - DNA, 22 bp, Homo sapiens
aaagtagagttgtggaattact

SEQ ID NO: 9148714 - DNA, 22 bp, Homo sapiens
aaagtagcagtaattatgaaat

SEQ ID NO: 9148715 - DNA, 22 bp, Homo sapiens
aaagtagctttgtaggtacagt

SEQ ID NO: 9148716 - DNA, 22 bp, Homo sapiens
aaagtagctttgtaggtacagt

SEQ ID NO: 9148717 - DNA, 22 bp, Homo sapiens
aaagtagcttagttgatatttc

SEQ ID NO: 9148718 - DNA, 22 bp, Homo sapiens
aaagtattcttgactgtttttc

SEQ ID NO: 9148719 - DNA, 22 bp, Homo sapiens
aaagtattcttgactgtttttc

SEQ ID NO: 9148720 - DNA, 22 bp, Homo sapiens
aaagtatttgtgatttttacca

SEQ ID NO: 9148721 - DNA, 22 bp, Homo sapiens
aaagtcaaggtttagactagag

SEQ ID NO: 9148722 - DNA, 22 bp, Homo sapiens
aaagtgtaaaagcatgttaggg

SEQ ID NO: 9148723 - DNA, 22 bp, Homo sapiens
aaagtgtactatgtcatgaaca

SEQ ID NO: 9148724 - DNA, 22 bp, Homo sapiens
aaagtgcttccttttagaggct

SEQ ID NO: 9148725 - DNA, 22 bp, Homo sapiens
aaagtcaaggtttagactagag

SEQ ID NO: 9148726 - DNA, 22 bp, Homo sapiens
aaagggcagagttcactagaaa

SEQ ID NO: 9148727 - DNA, 22 bp, Homo sapiens
aaaggaaaataagtagttccat

SEQ ID NO: 9148728 - DNA, 22 bp, Homo sapiens
aaagctttgtaaataaacaggt

SEQ ID NO: 9148729 - DNA, 22 bp, Homo sapiens
aaagctttgcatattcggcccg

SEQ ID NO: 9148730 - DNA, 22 bp, Homo sapiens
aaaggtttattgattctgctct

SEQ ID NO: 9148731 - DNA, 22 bp, Homo sapiens
aaaggtttatttgttgctcaca

SEQ ID NO: 9148732 - DNA, 22 bp, Homo sapiens
aaaggtttgccgacctctgctt

SEQ ID NO: 9148733 - DNA, 22 bp, Homo sapiens
aaaggtttccgagctttaattt

SEQ ID NO: 9148734 - DNA, 22 bp, Homo sapiens
aactaaatctggcatttagagc

SEQ ID NO: 9148735 - DNA, 22 bp, Homo sapiens
aactaaatctggcatttagagc

SEQ ID NO: 9148736 - DNA, 22 bp, Homo sapiens
aactaaatctggcatttagagc

SEQ ID NO: 9148737 - DNA, 22 bp, Homo sapiens
aaaggttttcatcacagcaaga

SEQ ID NO: 9148738 - DNA, 22 bp, Homo sapiens
aaaggttttattctgagctctg

SEQ ID NO: 9148739 - DNA, 22 bp, Homo sapiens
aacgttttatcgtgtgctcttc

SEQ ID NO: 9148740 - DNA, 22 bp, Homo sapiens
aactaaaactggtttgttctct

SEQ ID NO: 9148741 - DNA, 22 bp, Homo sapiens
aactaaaagtgtgtctcttgta

SEQ ID NO: 9148742 - DNA, 22 bp, Homo sapiens
aactaacagtcattaaaagaac

SEQ ID NO: 9148743 - DNA, 22 bp, Homo sapiens
aactaacagtcattaaaagaac

SEQ ID NO: 9148744 - DNA, 22 bp, Homo sapiens
aaagtaattgtggtttctgtca

SEQ ID NO: 9148745 - DNA, 22 bp, Homo sapiens
aaagtaattgtggttcttgcca

SEQ ID NO: 9148746 - DNA, 22 bp, Homo sapiens
aaagtagaacattttcttatct

SEQ ID NO: 9148747 - DNA, 22 bp, Homo sapiens
aaggtcaagacacaggaatcta

SEQ ID NO: 9148748 - DNA, 22 bp, Homo sapiens
aaggtcaacactgattttagtc

SEQ ID NO: 9148749 - DNA, 22 bp, Homo sapiens
aaggtcaaagacagtaactttt

SEQ ID NO: 9148750 - DNA, 22 bp, Homo sapiens
aaggtatttagtgtgaaagcta

SEQ ID NO: 9148751 - DNA, 23 bp, Homo sapiens
aaggtatttattttaaaggtaag

SEQ ID NO: 9148752 - DNA, 22 bp, Homo sapiens
aaggtattttctaatgtatact

SEQ ID NO: 9148753 - DNA, 22 bp, Homo sapiens
aaggtattgttccctagtttct

SEQ ID NO: 9148754 - DNA, 22 bp, Homo sapiens
aaggtattggcagggctgagtt

SEQ ID NO: 9148755 - DNA, 22 bp, Homo sapiens
aaggtattggggaatatttgac

SEQ ID NO: 9148756 - DNA, 22 bp, Homo sapiens
aaggtattggtctggtcttcct

SEQ ID NO: 9148757 - DNA, 22 bp, Homo sapiens
aaggtattatttgcaatcattt

SEQ ID NO: 9148758 - DNA, 22 bp, Homo sapiens
aaggtattattgtctatgtact

SEQ ID NO: 9148759 - DNA, 22 bp, Homo sapiens
aaggtcacttttattcctgaga

SEQ ID NO: 9148760 - DNA, 23 bp, Homo sapiens
aaggtcacagaacttagcaagcc

SEQ ID NO: 9148761 - DNA, 22 bp, Homo sapiens
aaggtcagagcaggaaggagtc

SEQ ID NO: 9148762 - DNA, 22 bp, Homo sapiens
aaggtcagagtgagctgtggcc

SEQ ID NO: 9148763 - DNA, 22 bp, Homo sapiens
aaggtcattgttgcatgttctc

SEQ ID NO: 9148764 - DNA, 22 bp, Homo sapiens
aacactgacgacgtgaactaaa

SEQ ID NO: 9148765 - DNA, 22 bp, Homo sapiens
aacactgacgacgtgaactaaa

SEQ ID NO: 9148766 - DNA, 22 bp, Homo sapiens
aaggtatagcttgcatacagaa

SEQ ID NO: 9148767 - DNA, 22 bp, Homo sapiens
aaggtatatctgatccatgagg

SEQ ID NO: 9148768 - DNA, 22 bp, Homo sapiens
aaggtatatgtacaatagacat

SEQ ID NO: 9148769 - DNA, 22 bp, Homo sapiens
aacactgacctctaccctcagt

SEQ ID NO: 9148770 - DNA, 22 bp, Homo sapiens
aacactgaaatgtcttaagatt

SEQ ID NO: 9148771 - DNA, 22 bp, Homo sapiens
aacaaatgacctgatttcttcc

SEQ ID NO: 9148772 - DNA, 22 bp, Homo sapiens
aacaaatcttaaagtaattcaa

SEQ ID NO: 9148773 - DNA, 22 bp, Homo sapiens
aacaaatgacctgatttcttcc

SEQ ID NO: 9148774 - DNA, 22 bp, Homo sapiens
aacaaatggaacacaaatcttt

SEQ ID NO: 9148775 - DNA, 22 bp, Homo sapiens
aacaaatggggccttgtatgaa

SEQ ID NO: 9148776 - DNA, 22 bp, Homo sapiens
aacaaatggggccttgtatgaa

SEQ ID NO: 9148777 - DNA, 22 bp, Homo sapiens
aacaaatggaacacaaatcttt

SEQ ID NO: 9148778 - DNA, 22 bp, Homo sapiens
aacacctaaaaatcattgttga

SEQ ID NO: 9148779 - DNA, 22 bp, Homo sapiens
aacaccttctccttgcaggcca

SEQ ID NO: 9148780 - DNA, 22 bp, Homo sapiens
aacacatagacgtttgatatca

SEQ ID NO: 9148781 - DNA, 22 bp, Homo sapiens
aacacatagacgtttgatatca

SEQ ID NO: 9148782 - DNA, 22 bp, Homo sapiens
aacacatagacgtttgatatca

SEQ ID NO: 9148783 - DNA, 22 bp, Homo sapiens
aacaaatgtaaaatgcagatgc

SEQ ID NO: 9148784 - DNA, 22 bp, Homo sapiens
aacactcaatttacaaactctg

SEQ ID NO: 9148785 - DNA, 22 bp, Homo sapiens
aacactctacgtgcagctccta

SEQ ID NO: 9148786 - DNA, 22 bp, Homo sapiens
aacactctctgttggtaaggct

SEQ ID NO: 9148787 - DNA, 22 bp, Homo sapiens
aacactctgagtatagaccact

SEQ ID NO: 9148788 - DNA, 22 bp, Homo sapiens
aacagcagctgcctgaatttgc

SEQ ID NO: 9148789 - DNA, 22 bp, Homo sapiens
aacagcaggcaccaaggctatg

SEQ ID NO: 9148790 - DNA, 22 bp, Homo sapiens
aacagcaggcatttcttagctc

SEQ ID NO: 9148791 - DNA, 22 bp, Homo sapiens
aaggtccttttgcagtgtgatc

SEQ ID NO: 9148792 - DNA, 22 bp, Homo sapiens
aaggtcctgtagccacagagcc

SEQ ID NO: 9148793 - DNA, 22 bp, Homo sapiens
aaggtctgagttttgccaggcc

SEQ ID NO: 9148794 - DNA, 22 bp, Homo sapiens
aacagcagggatgacatggcca

SEQ ID NO: 9148795 - DNA, 22 bp, Homo sapiens
aacagcagggatgacatggcca

SEQ ID NO: 9148796 - DNA, 22 bp, Homo sapiens
aacagcagggatggggtggcca

SEQ ID NO: 9148797 - DNA, 22 bp, Homo sapiens
aacagcagggggacctgctggt

SEQ ID NO: 9148798 - DNA, 22 bp, Homo sapiens
aacagcagggggacctgctggt

SEQ ID NO: 9148799 - DNA, 22 bp, Homo sapiens
aacagcaggtcctggcatgggt

SEQ ID NO: 9148800 - DNA, 22 bp, Homo sapiens
aacagcaggcatttcttagctc

SEQ ID NO: 9148801 - DNA, 22 bp, Homo sapiens
aacagcataccaatgtacatat

SEQ ID NO: 9148802 - DNA, 22 bp, Homo sapiens
aacagcatatttcatatattga

SEQ ID NO: 9148803 - DNA, 22 bp, Homo sapiens
aacagcatcaccccataacatt

SEQ ID NO: 9148804 - DNA, 22 bp, Homo sapiens
aacagcataccaatgtacatat

SEQ ID NO: 9148805 - DNA, 22 bp, Homo sapiens
aacagcagttacttttgcatca

SEQ ID NO: 9148806 - DNA, 22 bp, Homo sapiens
aacagcagttacttttgcatca

SEQ ID NO: 9148807 - DNA, 22 bp, Homo sapiens
aacagcttgagactggatatgc

SEQ ID NO: 9148808 - DNA, 22 bp, Homo sapiens
aacaggaatgaggagaaaaggt

SEQ ID NO: 9148809 - DNA, 22 bp, Homo sapiens
aagtccaggtccaggaggttcc

SEQ ID NO: 9148810 - DNA, 22 bp, Homo sapiens
aagtccaggctggcgtagagtc

SEQ ID NO: 9148811 - DNA, 22 bp, Homo sapiens
aagtccagctgtagctcaacag

SEQ ID NO: 9148812 - DNA, 22 bp, Homo sapiens
aagtccagcatttgggtagatt

SEQ ID NO: 9148813 - DNA, 17 bp, Homo sapiens
aagtccagagttgagca

SEQ ID NO: 9148814 - DNA, 17 bp, Homo sapiens
aagtccagagttgagca

SEQ ID NO: 9148815 - DNA, 22 bp, Homo sapiens
aagtccagaactcctgtgatag

SEQ ID NO: 9148816 - DNA, 22 bp, Homo sapiens
aagtccagacctgaggccctca

SEQ ID NO: 9148817 - DNA, 22 bp, Homo sapiens
aacagcatgctgggtaacattg

SEQ ID NO: 9148818 - DNA, 23 bp, Homo sapiens
aacagccacactgctgagattca

SEQ ID NO: 9148819 - DNA, 23 bp, Homo sapiens
aacagccacactgctgagattca

SEQ ID NO: 9148820 - DNA, 22 bp, Homo sapiens
aacagcctcagtgagattagga

SEQ ID NO: 9148821 - DNA, 22 bp, Homo sapiens
aacagccactgatactgaatag

SEQ ID NO: 9148822 - DNA, 22 bp, Homo sapiens
aacagcctcagtgagattagga

SEQ ID NO: 9148823 - DNA, 22 bp, Homo sapiens
aagtcattatctcttctaatct

SEQ ID NO: 9148824 - DNA, 22 bp, Homo sapiens
aagtcattcctgcttgttgccc

SEQ ID NO: 9148825 - DNA, 22 bp, Homo sapiens
aacaaagtagctgctgttctta

SEQ ID NO: 9148826 - DNA, 22 bp, Homo sapiens
aacaaaggccgttaataaccac

SEQ ID NO: 9148827 - DNA, 22 bp, Homo sapiens
aacaaaggccgttaataaccac

SEQ ID NO: 9148828 - DNA, 22 bp, Homo sapiens
aacaaacctgggtggagaaagg

SEQ ID NO: 9148829 - DNA, 22 bp, Homo sapiens
aaattttagaccaggcaaaact

SEQ ID NO: 9148830 - DNA, 22 bp, Homo sapiens
aaattttagaccaggcaaaact

SEQ ID NO: 9148831 - DNA, 22 bp, Homo sapiens
aaattgaatttgggaaacattg

SEQ ID NO: 9148832 - DNA, 22 bp, Homo sapiens
aaattgaatttgggaaacattg

SEQ ID NO: 9148833 - DNA, 22 bp, Homo sapiens
aaattgaatgattaagtggtga

SEQ ID NO: 9148834 - DNA, 22 bp, Homo sapiens
aaattctttggcctactttgaa

SEQ ID NO: 9148835 - DNA, 22 bp, Homo sapiens
aaattctttggcctactttgaa

SEQ ID NO: 9148836 - DNA, 22 bp, Homo sapiens
aaattctctaaagaaaacatga

SEQ ID NO: 9148837 - DNA, 22 bp, Homo sapiens
aaattctctaaagaaaacatga

SEQ ID NO: 9148838 - DNA, 22 bp, Homo sapiens
aaattctcaagtgatcctgttg

SEQ ID NO: 9148839 - DNA, 22 bp, Homo sapiens
aaattctatgtcaatgtttatt

SEQ ID NO: 9148840 - DNA, 22 bp, Homo sapiens
aaattctaaggtcacaatgttg

SEQ ID NO: 9148841 - DNA, 22 bp, Homo sapiens
aaattcttcaggtaattttgat

SEQ ID NO: 9148842 - DNA, 22 bp, Homo sapiens
aaattctcttcagaggaaccag

SEQ ID NO: 9148843 - DNA, 22 bp, Homo sapiens
aaatgtttctacttgtgagcat

SEQ ID NO: 9148844 - DNA, 22 bp, Homo sapiens
aaatgtttaagtgtaggagcaa

SEQ ID NO: 9148845 - DNA, 22 bp, Homo sapiens
aaatgtttaagtgtaggagcaa

SEQ ID NO: 9148846 - DNA, 22 bp, Homo sapiens
aaatgtttctacttgtgagcat

SEQ ID NO: 9148847 - DNA, 22 bp, Homo sapiens
aaatgttttgctcccatgtggt

SEQ ID NO: 9148848 - DNA, 22 bp, Homo sapiens
aaattcctgtcatttgcacttt

SEQ ID NO: 9148849 - DNA, 22 bp, Homo sapiens
aaattcacttgcctgcttagct

SEQ ID NO: 9148850 - DNA, 22 bp, Homo sapiens
aaattccattttgtgactattc

SEQ ID NO: 9148851 - DNA, 22 bp, Homo sapiens
aaatgtgttcctttgctacaga

SEQ ID NO: 9148852 - DNA, 22 bp, Homo sapiens
aaatgttaggttgtactgagtc

SEQ ID NO: 9148853 - DNA, 22 bp, Homo sapiens
aaatgtgtttctttgtgaatgg

SEQ ID NO: 9148854 - DNA, 22 bp, Homo sapiens
aaatgtgcttgtgatcagctgt

SEQ ID NO: 9148855 - DNA, 22 bp, Homo sapiens
aaatgtgcttgtgatcagctgt

SEQ ID NO: 9148856 - DNA, 22 bp, Homo sapiens
aaatgtgcttcttactctcaat

SEQ ID NO: 9148857 - DNA, 22 bp, Homo sapiens
aaatgtgtatatgaaacatgat

SEQ ID NO: 9148858 - DNA, 22 bp, Homo sapiens
aaatgtctatctggcatattcc

SEQ ID NO: 9148859 - DNA, 22 bp, Homo sapiens
aaatgtgcatgagtcagaagtg

SEQ ID NO: 9148860 - DNA, 22 bp, Homo sapiens
aaatgtgcatgagtcagaagtg

SEQ ID NO: 9148861 - DNA, 22 bp, Homo sapiens
aagctgaggcccatggcaaggt

SEQ ID NO: 9148862 - DNA, 22 bp, Homo sapiens
aaatgtctacttcccatctgta

SEQ ID NO: 9148863 - DNA, 22 bp, Homo sapiens
aatcatgtttacgtgacatgtc

SEQ ID NO: 9148864 - DNA, 22 bp, Homo sapiens
aatcattctcatgccagtttcc

SEQ ID NO: 9148865 - DNA, 22 bp, Homo sapiens
aatcatcccaactgagaatccc

SEQ ID NO: 9148866 - DNA, 22 bp, Homo sapiens
aatcatcctgaagtcaataaag

SEQ ID NO: 9148867 - DNA, 22 bp, Homo sapiens
aatcatggcgtgtttagcttaa

SEQ ID NO: 9148868 - DNA, 22 bp, Homo sapiens
aactgcattcagaaagctcact

SEQ ID NO: 9148869 - DNA, 22 bp, Homo sapiens
aactgcattgtactaaacttgt

SEQ ID NO: 9148870 - DNA, 22 bp, Homo sapiens
aactgcattagctaacgtgagt

SEQ ID NO: 9148871 - DNA, 22 bp, Homo sapiens
aactgcataatatatcatgcag

SEQ ID NO: 9148872 - DNA, 22 bp, Homo sapiens
aactgcagttaacaagtcttca

SEQ ID NO: 9148873 - DNA, 22 bp, Homo sapiens
aactgcagttacctttgcacca

SEQ ID NO: 9148874 - DNA, 22 bp, Homo sapiens
aactgcagttacttttgcacca

SEQ ID NO: 9148875 - DNA, 22 bp, Homo sapiens
aatataaattcctgggcccagc

SEQ ID NO: 9148876 - DNA, 22 bp, Homo sapiens
aatataatgctgttttatgcca

SEQ ID NO: 9148877 - DNA, 22 bp, Homo sapiens
aatataatgctgttttatgcca

SEQ ID NO: 9148878 - DNA, 22 bp, Homo sapiens
aatataatgctgttttatgcca

SEQ ID NO: 9148879 - DNA, 20 bp, Homo sapiens
aatataattctctgaattta

SEQ ID NO: 9148880 - DNA, 20 bp, Homo sapiens
aatataattctctgaattta

SEQ ID NO: 9148881 - DNA, 22 bp, Homo sapiens
aactacaatatgtatgtatgta

SEQ ID NO: 9148882 - DNA, 22 bp, Homo sapiens
aactacaatatgtatgtatgta

SEQ ID NO: 9148883 - DNA, 22 bp, Homo sapiens
aacggctgtggctggcggcagc

SEQ ID NO: 9148884 - DNA, 21 bp, Homo sapiens
aactacagttgttccttcatt

SEQ ID NO: 9148885 - DNA, 22 bp, Homo sapiens
aactacatagaaattagtattt

SEQ ID NO: 9148886 - DNA, 22 bp, Homo sapiens
aactacccacgtttctgtcctt

SEQ ID NO: 9148887 - DNA, 22 bp, Homo sapiens
aactacattttacagaagatga

SEQ ID NO: 9148888 - DNA, 22 bp, Homo sapiens
aactacattttacagaagatga

SEQ ID NO: 9148889 - DNA, 22 bp, Homo sapiens
aactacagtagtttgcccttct

SEQ ID NO: 9148890 - DNA, 22 bp, Homo sapiens
aatgataagacatgagtagagg

SEQ ID NO: 9148891 - DNA, 16 bp, Homo sapiens
aactgcatgagtgggt

SEQ ID NO: 9148892 - DNA, 22 bp, Homo sapiens
aactgcatttgcataagtccat

SEQ ID NO: 9148893 - DNA, 22 bp, Homo sapiens
aactgcctcaggtcatatatca

SEQ ID NO: 9148894 - DNA, 20 bp, Homo sapiens
aactgcctgcccagaggtgg

SEQ ID NO: 9148895 - DNA, 22 bp, Homo sapiens
aactgctgtggcctagtactta

SEQ ID NO: 9148896 - DNA, 22 bp, Homo sapiens
aactgctgtggcctagtactta

SEQ ID NO: 9148897 - DNA, 22 bp, Homo sapiens
aatgatcacctggtaaagagag

SEQ ID NO: 9148898 - DNA, 22 bp, Homo sapiens
aactggtgagataaattattta

SEQ ID NO: 9148899 - DNA, 22 bp, Homo sapiens
aatgatcctacacatggaattc

SEQ ID NO: 9148900 - DNA, 22 bp, Homo sapiens
aatgatccttgttgtttaacca

SEQ ID NO: 9148901 - DNA, 22 bp, Homo sapiens
aatgatcccatttagaaacaga

SEQ ID NO: 9148902 - DNA, 22 bp, Homo sapiens
aatgatatagcagacatagcct

SEQ ID NO: 9148903 - DNA, 22 bp, Homo sapiens
aactgttgcttgtaatatgtgc

SEQ ID NO: 9148904 - DNA, 18 bp, Homo sapiens
aactgttgaaatagcttg

SEQ ID NO: 9148905 - DNA, 19 bp, Homo sapiens
aactgtaaagatctgtagc

SEQ ID NO: 9148906 - DNA, 22 bp, Homo sapiens
aacttaggaaaataaggcatga

SEQ ID NO: 9148907 - DNA, 22 bp, Homo sapiens
aacttagtctttcaatttgata

SEQ ID NO: 9148908 - DNA, 22 bp, Homo sapiens
aacttagtacccaggcgttcgg

SEQ ID NO: 9148909 - DNA, 22 bp, Homo sapiens
aacttagtgagccactcttgca

SEQ ID NO: 9148910 - DNA, 22 bp, Homo sapiens
aacttaccagctgtgcactgaa

SEQ ID NO: 9148911 - DNA, 23 bp, Homo sapiens
aacttaccaaccaatacttggta

SEQ ID NO: 9148912 - DNA, 22 bp, Homo sapiens
aacttacaaggatgatagctgc

SEQ ID NO: 9148913 - DNA, 23 bp, Homo sapiens
aacttaatactgggataagatgc

SEQ ID NO: 9148914 - DNA, 22 bp, Homo sapiens
aacttaaacccactcatgtaga

SEQ ID NO: 9148915 - DNA, 22 bp, Homo sapiens
aataagaacaactaaggtttat

SEQ ID NO: 9148916 - DNA, 22 bp, Homo sapiens
aataagaacaactaaggtttat

SEQ ID NO: 9148917 - DNA, 22 bp, Homo sapiens
aataagaactccatttactcgt

SEQ ID NO: 9148918 - DNA, 22 bp, Homo sapiens
aataagaaagagtcagcttcag

SEQ ID NO: 9148919 - DNA, 22 bp, Homo sapiens
aataagaaagagtcagcttcag

SEQ ID NO: 9148920 - DNA, 22 bp, Homo sapiens
aacatttttaagaccaagtgct

SEQ ID NO: 9148921 - DNA, 22 bp, Homo sapiens
aacatttttaagaccaagtgct

SEQ ID NO: 9148922 - DNA, 22 bp, Homo sapiens
aataacttcagttcttacatta

SEQ ID NO: 9148923 - DNA, 22 bp, Homo sapiens
aacatgcttgcttagaatcagc

SEQ ID NO: 9148924 - DNA, 22 bp, Homo sapiens
aataacttcatgtaacatttaa

SEQ ID NO: 9148925 - DNA, 22 bp, Homo sapiens
aataacttcatcttcaggatag

SEQ ID NO: 9148926 - DNA, 22 bp, Homo sapiens
aataacttcatcttcaggatag

SEQ ID NO: 9148927 - DNA, 22 bp, Homo sapiens
aataacttgaagatctcttcca

SEQ ID NO: 9148928 - DNA, 22 bp, Homo sapiens
aatagtctctcccacaccatcc

SEQ ID NO: 9148929 - DNA, 17 bp, Homo sapiens
aatagtgtattatacat

SEQ ID NO: 9148930 - DNA, 22 bp, Homo sapiens
aatagttaagcaactttttcca

SEQ ID NO: 9148931 - DNA, 22 bp, Homo sapiens
aatagtgtatttttcaaaatta

SEQ ID NO: 9148932 - DNA, 22 bp, Homo sapiens
aatagtgtttgaagcatgatag

SEQ ID NO: 9148933 - DNA, 22 bp, Homo sapiens
aatagttaagcaactttttcca

SEQ ID NO: 9148934 - DNA, 22 bp, Homo sapiens
aatagtttgaatttatcagatg

SEQ ID NO: 9148935 - DNA, 22 bp, Homo sapiens
aatataaattcctgggcccagc

SEQ ID NO: 9148936 - DNA, 22 bp, Homo sapiens
aatataaattcctgggcccagc

SEQ ID NO: 9148937 - DNA, 22 bp, Homo sapiens
aatagttctagctcagaagctc

SEQ ID NO: 9148938 - DNA, 22 bp, Homo sapiens
aaccactggtctgaggtacaag

SEQ ID NO: 9148939 - DNA, 22 bp, Homo sapiens
aaccactggctctaacattttg

SEQ ID NO: 9148940 - DNA, 22 bp, Homo sapiens
aaccactggtctgaggtacaag

SEQ ID NO: 9148941 - DNA, 22 bp, Homo sapiens
aaccagaaggaatctgagctga

SEQ ID NO: 9148942 - DNA, 22 bp, Homo sapiens
aaccagaaggaatctgagctga

SEQ ID NO: 9148943 - DNA, 22 bp, Homo sapiens
aaccaccattctctcctcttcc

SEQ ID NO: 9148944 - DNA, 22 bp, Homo sapiens
aaccaccaccgtaatttaccca

SEQ ID NO: 9148945 - DNA, 22 bp, Homo sapiens
aaccaatttaaatataaagact

SEQ ID NO: 9148946 - DNA, 22 bp, Homo sapiens
aaccaatttaaatataaagact

SEQ ID NO: 9148947 - DNA, 22 bp, Homo sapiens
aacatgctgcctttctacgagt

SEQ ID NO: 9148948 - DNA, 22 bp, Homo sapiens
aacatgctctgtttcttggatg

SEQ ID NO: 9148949 - DNA, 22 bp, Homo sapiens
aacatgctctggattgctgtga

SEQ ID NO: 9148950 - DNA, 18 bp, Homo sapiens
aacatgcattagaactgc

SEQ ID NO: 9148951 - DNA, 18 bp, Homo sapiens
aacatgcattagaactgc

SEQ ID NO: 9148952 - DNA, 20 bp, Homo sapiens
aacagggggctgcagagggc

SEQ ID NO: 9148953 - DNA, 22 bp, Homo sapiens
aacaggggattagatagcaggc

SEQ ID NO: 9148954 - DNA, 22 bp, Homo sapiens
aacaggggctggttgaaagagc

SEQ ID NO: 9148955 - DNA, 22 bp, Homo sapiens
aacaggtagggttttccttaga

SEQ ID NO: 9148956 - DNA, 22 bp, Homo sapiens
aacaggggtgggtgctactgga

SEQ ID NO: 9148957 - DNA, 22 bp, Homo sapiens
aacatgaaaagcccagagaggt

SEQ ID NO: 9148958 - DNA, 22 bp, Homo sapiens
aacatgcacatcatagctcgtg

SEQ ID NO: 9148959 - DNA, 22 bp, Homo sapiens
aacatgcatataggtaaatgga

SEQ ID NO: 9148960 - DNA, 22 bp, Homo sapiens
aacaggcctatggtttattcat

SEQ ID NO: 9148961 - DNA, 22 bp, Homo sapiens
aacaggctcactctgacttcta

SEQ ID NO: 9148962 - DNA, 22 bp, Homo sapiens
aacaggcaggagaattctgcct

SEQ ID NO: 9148963 - DNA, 15 bp, Homo sapiens
aacaggcatttatat

SEQ ID NO: 9148964 - DNA, 22 bp, Homo sapiens
aacaggccctgccatttatcca

SEQ ID NO: 9148965 - DNA, 22 bp, Homo sapiens
aacaggcaggagaattctgcct

SEQ ID NO: 9148966 - DNA, 22 bp, Homo sapiens
aacaggcagcagactgaatctg

SEQ ID NO: 9148967 - DNA, 22 bp, Homo sapiens
aacaggcagcagactgaatctg

SEQ ID NO: 9148968 - DNA, 22 bp, Homo sapiens
aacaggaattgatgggagtcct

SEQ ID NO: 9148969 - DNA, 22 bp, Homo sapiens
aacaggcaaactgtgggatccc

SEQ ID NO: 9148970 - DNA, 22 bp, Homo sapiens
aacaggcaaactgtgggatccc

SEQ ID NO: 9148971 - DNA, 22 bp, Homo sapiens
aacaggcaacagttgactctga

SEQ ID NO: 9148972 - DNA, 22 bp, Homo sapiens
aacaggcaacagttgactctga

SEQ ID NO: 9148973 - DNA, 22 bp, Homo sapiens
aacaggcaacagttgactctga

SEQ ID NO: 9148974 - DNA, 22 bp, Homo sapiens
aacaggcaacagttgactctga

SEQ ID NO: 9148975 - DNA, 22 bp, Homo sapiens
aacaggcaatttaggactcttt

SEQ ID NO: 9148976 - DNA, 22 bp, Homo sapiens
aacaggcactaagcatgtgggg

SEQ ID NO: 9148977 - DNA, 22 bp, Homo sapiens
aagaaatgcacacaactgctgg

SEQ ID NO: 9148978 - DNA, 22 bp, Homo sapiens
aagaaatattgggccttataaa

SEQ ID NO: 9148979 - DNA, 22 bp, Homo sapiens
aagaaatattgggccttataaa

SEQ ID NO: 9148980 - DNA, 22 bp, Homo sapiens
aagaaatattgggccttataaa

SEQ ID NO: 9148981 - DNA, 22 bp, Homo sapiens
aagaaatattgggccttataaa

SEQ ID NO: 9148982 - DNA, 22 bp, Homo sapiens
aagaaatattgggccttataaa

SEQ ID NO: 9148983 - DNA, 22 bp, Homo sapiens
aagaaagcattagacaggcatt

SEQ ID NO: 9148984 - DNA, 22 bp, Homo sapiens
aagaaagcattagacaggcatt

SEQ ID NO: 9148985 - DNA, 22 bp, Homo sapiens
aagaaataagacttctctgtcc

SEQ ID NO: 9148986 - DNA, 22 bp, Homo sapiens
aagaaataagacttctctgtcc

SEQ ID NO: 9148987 - DNA, 22 bp, Homo sapiens
aagaaatacatggtttttgagt

SEQ ID NO: 9148988 - DNA, 22 bp, Homo sapiens
aagaaatacatggtttttgagt

SEQ ID NO: 9148989 - DNA, 22 bp, Homo sapiens
aagaaatacatggtttttgagt

SEQ ID NO: 9148990 - DNA, 21 bp, Homo sapiens
aagaaagataattaaggaccc

SEQ ID NO: 9148991 - DNA, 21 bp, Homo sapiens
aagaaagataattaaggaccc

SEQ ID NO: 9148992 - DNA, 21 bp, Homo sapiens
aagaaagataattaaggaccc

SEQ ID NO: 9148993 - DNA, 22 bp, Homo sapiens
aacttcagggggcacattcaag

SEQ ID NO: 9148994 - DNA, 18 bp, Homo sapiens
aacttcaactacaatgga

SEQ ID NO: 9148995 - DNA, 18 bp, Homo sapiens
aacttcaactacaatgga

SEQ ID NO: 9148996 - DNA, 22 bp, Homo sapiens
aacttcagagctgtgtggtttg

SEQ ID NO: 9148997 - DNA, 22 bp, Homo sapiens
aacttagttaagattaagtctc

SEQ ID NO: 9148998 - DNA, 22 bp, Homo sapiens
aacttagttcaatatcagtgct

SEQ ID NO: 9148999 - DNA, 22 bp, Homo sapiens
aacttatacccagggcagaaat

SEQ ID NO: 9149000 - DNA, 22 bp, Homo sapiens
aatgttttagattactgctggg

SEQ ID NO: 9149001 - DNA, 22 bp, Homo sapiens
aatgttttaaaagagattgaga

SEQ ID NO: 9149002 - DNA, 22 bp, Homo sapiens
aagaaatggaagatccatggtg

SEQ ID NO: 9149003 - DNA, 22 bp, Homo sapiens
aagaaatggcttcatctgagta

SEQ ID NO: 9149004 - DNA, 22 bp, Homo sapiens
aagaaatggaagatccatggtg

SEQ ID NO: 9149005 - DNA, 22 bp, Homo sapiens
aagaaatgcagaaatgtgctgg

SEQ ID NO: 9149006 - DNA, 22 bp, Homo sapiens
aagaaatgctgatgttggatgg

SEQ ID NO: 9149007 - DNA, 22 bp, Homo sapiens
aagaaatgcacacaactgctgg

SEQ ID NO: 9149008 - DNA, 22 bp, Homo sapiens
aagaaatgcagaaatgtgctgg

SEQ ID NO: 9149009 - DNA, 22 bp, Homo sapiens
aagaaatgcagaaatgtgctgg

SEQ ID NO: 9149010 - DNA, 22 bp, Homo sapiens
aatgttttatagctcaagcaat

SEQ ID NO: 9149011 - DNA, 22 bp, Homo sapiens
aatgttttatagctcaagcaat

SEQ ID NO: 9149012 - DNA, 22 bp, Homo sapiens
aagaagcactttcctacatgtt

SEQ ID NO: 9149013 - DNA, 22 bp, Homo sapiens
aatgttttgcattagttttcta

SEQ ID NO: 9149014 - DNA, 18 bp, Homo sapiens
aagaagttggccaaagag

SEQ ID NO: 9149015 - DNA, 22 bp, Homo sapiens
aagaagttggaaatgattgaga

SEQ ID NO: 9149016 - DNA, 20 bp, Homo sapiens
aagaagttggtaagcagtgc

SEQ ID NO: 9149017 - DNA, 18 bp, Homo sapiens
aagaagttggccaaagag

SEQ ID NO: 9149018 - DNA, 21 bp, Homo sapiens
aagaagtttggattttgtcct

SEQ ID NO: 9149019 - DNA, 20 bp, Homo sapiens
aagaagttggtaagcagtgc

SEQ ID NO: 9149020 - DNA, 23 bp, Homo sapiens
aagaataaatgacattaaaggtg

SEQ ID NO: 9149021 - DNA, 23 bp, Homo sapiens
aagaataaatgacattaaaggtg

SEQ ID NO: 9149022 - DNA, 21 bp, Homo sapiens
aagaagtttggattttgtcct

SEQ ID NO: 9149023 - DNA, 21 bp, Homo sapiens
aagaagtttggattttgtcct

SEQ ID NO: 9149024 - DNA, 22 bp, Homo sapiens
aagaataacacttaggttttgc

SEQ ID NO: 9149025 - DNA, 22 bp, Homo sapiens
aattggtttgaataaataaaga

SEQ ID NO: 9149026 - DNA, 22 bp, Homo sapiens
aattggcttccattttctgttt

SEQ ID NO: 9149027 - DNA, 22 bp, Homo sapiens
aagaatacttcgtaagtaggat

SEQ ID NO: 9149028 - DNA, 22 bp, Homo sapiens
aagaataagaggatttagaaca

SEQ ID NO: 9149029 - DNA, 22 bp, Homo sapiens
aagaatacgtatcaacaatggt

SEQ ID NO: 9149030 - DNA, 22 bp, Homo sapiens
aagaatacgtatcaacaatggt

SEQ ID NO: 9149031 - DNA, 22 bp, Homo sapiens
aagaataagtagatgggagaag

SEQ ID NO: 9149032 - DNA, 22 bp, Homo sapiens
aagacagctcaggacagattca

SEQ ID NO: 9149033 - DNA, 22 bp, Homo sapiens
aagacaggaacatagcaaatcc

SEQ ID NO: 9149034 - DNA, 22 bp, Homo sapiens
aagacaggaacatagcaaatcc

SEQ ID NO: 9149035 - DNA, 20 bp, Homo sapiens
aagacaccagtggcagcccc

SEQ ID NO: 9149036 - DNA, 22 bp, Homo sapiens
aattgtaagtgctgagttaagg

SEQ ID NO: 9149037 - DNA, 22 bp, Homo sapiens
aattgtaactacattgagaaca

SEQ ID NO: 9149038 - DNA, 22 bp, Homo sapiens
aattgtaactacattgagaaca

SEQ ID NO: 9149039 - DNA, 22 bp, Homo sapiens
aattgtcatgtttggtagataa

SEQ ID NO: 9149040 - DNA, 22 bp, Homo sapiens
aattgtcaaacacaaataagag

SEQ ID NO: 9149041 - DNA, 17 bp, Homo sapiens
aattgtcagcagtagct

SEQ ID NO: 9149042 - DNA, 22 bp, Homo sapiens
aattgtcaaaaattgcaattgt

SEQ ID NO: 9149043 - DNA, 22 bp, Homo sapiens
aatttaactgagagtactttta

SEQ ID NO: 9149044 - DNA, 22 bp, Homo sapiens
aattgtgaacctttacagttgt

SEQ ID NO: 9149045 - DNA, 22 bp, Homo sapiens
acaaagatgtttaaagcattta

SEQ ID NO: 9149046 - DNA, 22 bp, Homo sapiens
acaaagatcttgctttcctact

SEQ ID NO: 9149047 - DNA, 22 bp, Homo sapiens
acaaagatgtttaaagcattta

SEQ ID NO: 9149048 - DNA, 22 bp, Homo sapiens
acaaagataagtcagaaagtca

SEQ ID NO: 9149049 - DNA, 22 bp, Homo sapiens
acaaagatcttgctttcctact

SEQ ID NO: 9149050 - DNA, 22 bp, Homo sapiens
acaaagattcatttgcattatt

SEQ ID NO: 9149051 - DNA, 22 bp, Homo sapiens
acaaagcacgagtgccatggac

SEQ ID NO: 9149052 - DNA, 22 bp, Homo sapiens
aagagagaacacagcttgggca

SEQ ID NO: 9149053 - DNA, 22 bp, Homo sapiens
aagacatgcagtttgttccatt

SEQ ID NO: 9149054 - DNA, 22 bp, Homo sapiens
aagacatacagacagtgagcca

SEQ ID NO: 9149055 - DNA, 22 bp, Homo sapiens
acaaagagaccatgagccaaac

SEQ ID NO: 9149056 - DNA, 20 bp, Homo sapiens
acaaagactggaaaagcaag

SEQ ID NO: 9149057 - DNA, 22 bp, Homo sapiens
aagacattactggaatctgact

SEQ ID NO: 9149058 - DNA, 22 bp, Homo sapiens
acaaagacgggataaggtttgg

SEQ ID NO: 9149059 - DNA, 22 bp, Homo sapiens
aagagatgctttacatcggatg

SEQ ID NO: 9149060 - DNA, 22 bp, Homo sapiens
aagagatgctttacatcggatg

SEQ ID NO: 9149061 - DNA, 22 bp, Homo sapiens
aagagatgatggcagccagagg

SEQ ID NO: 9149062 - DNA, 22 bp, Homo sapiens
aagagatgatggcagccagagg

SEQ ID NO: 9149063 - DNA, 22 bp, Homo sapiens
aagagatgtgggctgctgtgca

SEQ ID NO: 9149064 - DNA, 22 bp, Homo sapiens
aagagatgtgggctgctgtgca

SEQ ID NO: 9149065 - DNA, 22 bp, Homo sapiens
aagagaggggttgcatggaaat

SEQ ID NO: 9149066 - DNA, 22 bp, Homo sapiens
aagagaggggttgcatggaaat

SEQ ID NO: 9149067 - DNA, 22 bp, Homo sapiens
aagagagggatttggtttattg

SEQ ID NO: 9149068 - DNA, 22 bp, Homo sapiens
aagagagggatttggtttattg

SEQ ID NO: 9149069 - DNA, 22 bp, Homo sapiens
aagagagggacttattaaagtc

SEQ ID NO: 9149070 - DNA, 22 bp, Homo sapiens
aagagaggacatggtgaacctg

SEQ ID NO: 9149071 - DNA, 22 bp, Homo sapiens
aagagaggacatggtgaacctg

SEQ ID NO: 9149072 - DNA, 17 bp, Homo sapiens
aagagaggctgagctgg

SEQ ID NO: 9149073 - DNA, 23 bp, Homo sapiens
aagagcagggaatatttatttgc

SEQ ID NO: 9149074 - DNA, 19 bp, Homo sapiens
aagagcagggaaagaattg

SEQ ID NO: 9149075 - DNA, 19 bp, Homo sapiens
aagagcagggaaagaattg

SEQ ID NO: 9149076 - DNA, 22 bp, Homo sapiens
acaaggctgttggtcacaaacc

SEQ ID NO: 9149077 - DNA, 22 bp, Homo sapiens
acaaggctgttggtcacaaacc

SEQ ID NO: 9149078 - DNA, 20 bp, Homo sapiens
aagagctgactcacagtggt

SEQ ID NO: 9149079 - DNA, 22 bp, Homo sapiens
aagagctgcacatatttatatc

SEQ ID NO: 9149080 - DNA, 22 bp, Homo sapiens
aagagctgcatctaagccatga

SEQ ID NO: 9149081 - DNA, 22 bp, Homo sapiens
aagagctgcccaaggtgaacag

SEQ ID NO: 9149082 - DNA, 22 bp, Homo sapiens
aagagctgattaagtcatgagg

SEQ ID NO: 9149083 - DNA, 20 bp, Homo sapiens
aagagctgactcacagtggt

SEQ ID NO: 9149084 - DNA, 22 bp, Homo sapiens
aagagctgattaagtcatgagg

SEQ ID NO: 9149085 - DNA, 20 bp, Homo sapiens
aagagctgactcacagtggt

SEQ ID NO: 9149086 - DNA, 22 bp, Homo sapiens
acaaggcactttatgaagagga

SEQ ID NO: 9149087 - DNA, 22 bp, Homo sapiens
acaaggcagtacaatgatgaca

SEQ ID NO: 9149088 - DNA, 22 bp, Homo sapiens
aagagctggagtttgcagccct

SEQ ID NO: 9149089 - DNA, 22 bp, Homo sapiens
aagagctggagctgctacagga

SEQ ID NO: 9149090 - DNA, 22 bp, Homo sapiens
aagagctggagctgctacagga

SEQ ID NO: 9149091 - DNA, 22 bp, Homo sapiens
aagagctggagtttgcagccct

SEQ ID NO: 9149092 - DNA, 22 bp, Homo sapiens
aagagctggagtttgcagccct

SEQ ID NO: 9149093 - DNA, 22 bp, Homo sapiens
aagagctggaagtgaagataac

SEQ ID NO: 9149094 - DNA, 22 bp, Homo sapiens
aagagctggcccaatctgagca

SEQ ID NO: 9149095 - DNA, 22 bp, Homo sapiens
aagagctggcccaatctgagca

SEQ ID NO: 9149096 - DNA, 22 bp, Homo sapiens
aagagctggattgtgctgcaga

SEQ ID NO: 9149097 - DNA, 22 bp, Homo sapiens
aagagctggattgtgctgcaga

SEQ ID NO: 9149098 - DNA, 21 bp, Homo sapiens
aagagctggatcaaggataag

SEQ ID NO: 9149099 - DNA, 22 bp, Homo sapiens
aagagctggatgaagaaatcaa

SEQ ID NO: 9149100 - DNA, 22 bp, Homo sapiens
aagagctggatgaagaaatcaa

SEQ ID NO: 9149101 - DNA, 22 bp, Homo sapiens
aagagctggatggaatctggga

SEQ ID NO: 9149102 - DNA, 22 bp, Homo sapiens
aagagctggctcttgcagcagc

SEQ ID NO: 9149103 - DNA, 22 bp, Homo sapiens
aagagctggctcttgcagcagc

SEQ ID NO: 9149104 - DNA, 22 bp, Homo sapiens
aagagctggtcacaggtccatt

SEQ ID NO: 9149105 - DNA, 22 bp, Homo sapiens
aagagctggctcttgcagcagc

SEQ ID NO: 9149106 - DNA, 22 bp, Homo sapiens
aagagctgtatgccatatgatt

SEQ ID NO: 9149107 - DNA, 22 bp, Homo sapiens
aagagctgtgggtggtagtcct

SEQ ID NO: 9149108 - DNA, 21 bp, Homo sapiens
aagagctgtcaggaaggctgc

SEQ ID NO: 9149109 - DNA, 22 bp, Homo sapiens
aagagctggtcacaggtccatt

SEQ ID NO: 9149110 - DNA, 22 bp, Homo sapiens
aagaggaactgggggctgagtc

SEQ ID NO: 9149111 - DNA, 22 bp, Homo sapiens
aagaggaactgggggctgagtc

SEQ ID NO: 9149112 - DNA, 22 bp, Homo sapiens
aagaggaaatgattgactatat

SEQ ID NO: 9149113 - DNA, 22 bp, Homo sapiens
aagagctgtgggtggtagtcct

SEQ ID NO: 9149114 - DNA, 22 bp, Homo sapiens
aagagctgttgtctgcttactg

SEQ ID NO: 9149115 - DNA, 22 bp, Homo sapiens
aagagctgttgtctgcttactg

SEQ ID NO: 9149116 - DNA, 22 bp, Homo sapiens
aagcagcatcctgggcagacct

SEQ ID NO: 9149117 - DNA, 22 bp, Homo sapiens
aagcagcatcctgggcagacct

SEQ ID NO: 9149118 - DNA, 22 bp, Homo sapiens
aagcagcatcctgggcagacct

SEQ ID NO: 9149119 - DNA, 22 bp, Homo sapiens
aagcagagtccccttcccatgg

SEQ ID NO: 9149120 - DNA, 22 bp, Homo sapiens
aagcagagtccccttcccatgg

SEQ ID NO: 9149121 - DNA, 22 bp, Homo sapiens
aagcagcattgtaaccaatgcc

SEQ ID NO: 9149122 - DNA, 22 bp, Homo sapiens
aagcagcattcagtgaaatgtg

SEQ ID NO: 9149123 - DNA, 22 bp, Homo sapiens
aagcagcattcagtgaaatgtg

SEQ ID NO: 9149124 - DNA, 22 bp, Homo sapiens
aagcagcatgattgtaatacta

SEQ ID NO: 9149125 - DNA, 22 bp, Homo sapiens
aagcagcatgtgggttatcggg

SEQ ID NO: 9149126 - DNA, 22 bp, Homo sapiens
aagcagcatgctatgctggtgg

SEQ ID NO: 9149127 - DNA, 22 bp, Homo sapiens
acagaattgatggaaatctcag

SEQ ID NO: 9149128 - DNA, 22 bp, Homo sapiens
acagagtattggaaaggcagtg

SEQ ID NO: 9149129 - DNA, 22 bp, Homo sapiens
aagcagctgaaggattcagggt

SEQ ID NO: 9149130 - DNA, 22 bp, Homo sapiens
aagcagctgatttcacagctca

SEQ ID NO: 9149131 - DNA, 22 bp, Homo sapiens
aagcagctgatttcacagctca

SEQ ID NO: 9149132 - DNA, 22 bp, Homo sapiens
aagcagcattgtaaccaatgcc

SEQ ID NO: 9149133 - DNA, 22 bp, Homo sapiens
aagcagcattgtggtaggggag

SEQ ID NO: 9149134 - DNA, 22 bp, Homo sapiens
aagcagcattgtggtaggggag

SEQ ID NO: 9149135 - DNA, 22 bp, Homo sapiens
aagcagcctggacttgggctgg

SEQ ID NO: 9149136 - DNA, 22 bp, Homo sapiens
acagcagcttgcgtgtctggtc

SEQ ID NO: 9149137 - DNA, 22 bp, Homo sapiens
acagcagcttcctgactgtact

SEQ ID NO: 9149138 - DNA, 22 bp, Homo sapiens
acagcagcttgcgtgtctggtc

SEQ ID NO: 9149139 - DNA, 22 bp, Homo sapiens
acagcagcttgcgtgtctggtc

SEQ ID NO: 9149140 - DNA, 22 bp, Homo sapiens
acagcagcttgtctgttcttta

SEQ ID NO: 9149141 - DNA, 22 bp, Homo sapiens
acagcagctgccttcaggctct

SEQ ID NO: 9149142 - DNA, 19 bp, Homo sapiens
aagccagctgccagctcgg

SEQ ID NO: 9149143 - DNA, 22 bp, Homo sapiens
aagccagcctgtttccttcttc

SEQ ID NO: 9149144 - DNA, 22 bp, Homo sapiens
aagccagcctgtttccttcttc

SEQ ID NO: 9149145 - DNA, 22 bp, Homo sapiens
aagccagctccagcatatcact

SEQ ID NO: 9149146 - DNA, 22 bp, Homo sapiens
aagccaagtgctggccatgggc

SEQ ID NO: 9149147 - DNA, 21 bp, Homo sapiens
aagccagcccacagtggtttg

SEQ ID NO: 9149148 - DNA, 22 bp, Homo sapiens
aagccaatcgtgtgaacttagt

SEQ ID NO: 9149149 - DNA, 22 bp, Homo sapiens
aagccaatgagagaggcctcag

SEQ ID NO: 9149150 - DNA, 21 bp, Homo sapiens
aagccagcccacagtggtttg

SEQ ID NO: 9149151 - DNA, 19 bp, Homo sapiens
aagcattagccaaagcatt

SEQ ID NO: 9149152 - DNA, 22 bp, Homo sapiens
aagcatgtacaatgagtgtctc

SEQ ID NO: 9149153 - DNA, 22 bp, Homo sapiens
aagcatggtttctgacgtcatg

SEQ ID NO: 9149154 - DNA, 22 bp, Homo sapiens
aagcatcaacactatattgatg

SEQ ID NO: 9149155 - DNA, 22 bp, Homo sapiens
aagcatatattttatatgttgt

SEQ ID NO: 9149156 - DNA, 22 bp, Homo sapiens
aagcattgtaagcagaagatgc

SEQ ID NO: 9149157 - DNA, 22 bp, Homo sapiens
aagcatttatagataagaattt

SEQ ID NO: 9149158 - DNA, 22 bp, Homo sapiens
aagcatttcaggtagagatatt

SEQ ID NO: 9149159 - DNA, 22 bp, Homo sapiens
aagcatttcaggtagagatatt

SEQ ID NO: 9149160 - DNA, 22 bp, Homo sapiens
aagcatttcaatataatattca

SEQ ID NO: 9149161 - DNA, 22 bp, Homo sapiens
aagcatttcaatataatattca

SEQ ID NO: 9149162 - DNA, 22 bp, Homo sapiens
aagcatttctgtttatctatcg

SEQ ID NO: 9149163 - DNA, 22 bp, Homo sapiens
aagcatttctgtttatctatcg

SEQ ID NO: 9149164 - DNA, 22 bp, Homo sapiens
aagcatttggttctgaagactc

SEQ ID NO: 9149165 - DNA, 22 bp, Homo sapiens
aagcatttggttctgaagactc

SEQ ID NO: 9149166 - DNA, 22 bp, Homo sapiens
aagcatttggcatgaaactctt

SEQ ID NO: 9149167 - DNA, 22 bp, Homo sapiens
aagcatttgtgaaattcagatg

SEQ ID NO: 9149168 - DNA, 22 bp, Homo sapiens
aagatgttctattttcactttt

SEQ ID NO: 9149169 - DNA, 22 bp, Homo sapiens
aagatgttctattttcactttt

SEQ ID NO: 9149170 - DNA, 22 bp, Homo sapiens
aagatttaccactttattcaag

SEQ ID NO: 9149171 - DNA, 22 bp, Homo sapiens
aagatttaccactttattcaag

SEQ ID NO: 9149172 - DNA, 22 bp, Homo sapiens
aagatgttattgtcttccttgc

SEQ ID NO: 9149173 - DNA, 20 bp, Homo sapiens
aagaggctgtggatcctact

SEQ ID NO: 9149174 - DNA, 22 bp, Homo sapiens
aagaggctggcattgatggtag

SEQ ID NO: 9149175 - DNA, 22 bp, Homo sapiens
aagaggctagccggctcactaa

SEQ ID NO: 9149176 - DNA, 22 bp, Homo sapiens
acacagggggcattctaggagt

SEQ ID NO: 9149177 - DNA, 22 bp, Homo sapiens
acacagggggcattctaggagt

SEQ ID NO: 9149178 - DNA, 22 bp, Homo sapiens
acacaggggctcggctgggtgc

SEQ ID NO: 9149179 - DNA, 22 bp, Homo sapiens
acacaggggctcggctgggtgc

SEQ ID NO: 9149180 - DNA, 22 bp, Homo sapiens
acacaggggaaagtggagctga

SEQ ID NO: 9149181 - DNA, 22 bp, Homo sapiens
acacagggtctagagttaggcc

SEQ ID NO: 9149182 - DNA, 22 bp, Homo sapiens
acacaggggaaagtggagctga

SEQ ID NO: 9149183 - DNA, 22 bp, Homo sapiens
acacagctttgtgttgctccac

SEQ ID NO: 9149184 - DNA, 22 bp, Homo sapiens
acacaggaaatggtttagtttt

SEQ ID NO: 9149185 - DNA, 22 bp, Homo sapiens
acacagctttcagtcattatct

SEQ ID NO: 9149186 - DNA, 20 bp, Homo sapiens
acacagtagcaattagtgca

SEQ ID NO: 9149187 - DNA, 22 bp, Homo sapiens
acacagtaggatagtttgagga

SEQ ID NO: 9149188 - DNA, 22 bp, Homo sapiens
aagaggcatctcagcttcctct

SEQ ID NO: 9149189 - DNA, 22 bp, Homo sapiens
acacagtaaatatgtattgaat

SEQ ID NO: 9149190 - DNA, 22 bp, Homo sapiens
acacaggttccatctccacctt

SEQ ID NO: 9149191 - DNA, 22 bp, Homo sapiens
aagcacagtgggcagagcagcc

SEQ ID NO: 9149192 - DNA, 22 bp, Homo sapiens
aagcacagtgggcagagcagcc

SEQ ID NO: 9149193 - DNA, 22 bp, Homo sapiens
aagcacagtgggcagagcagcc

SEQ ID NO: 9149194 - DNA, 22 bp, Homo sapiens
aagcacagtgccaagttctatt

SEQ ID NO: 9149195 - DNA, 22 bp, Homo sapiens
aagcacagtgccaagttctatt

SEQ ID NO: 9149196 - DNA, 22 bp, Homo sapiens
aagcacagtgccaagttctatt

SEQ ID NO: 9149197 - DNA, 22 bp, Homo sapiens
aagcacagtaaaagcagatttt

SEQ ID NO: 9149198 - DNA, 22 bp, Homo sapiens
aagcacagggactttaggaata

SEQ ID NO: 9149199 - DNA, 22 bp, Homo sapiens
aagcacagggactttaggaata

SEQ ID NO: 9149200 - DNA, 22 bp, Homo sapiens
aagcacagggactcaggaccgg

SEQ ID NO: 9149201 - DNA, 22 bp, Homo sapiens
aagcacagggactcaggaccgg

SEQ ID NO: 9149202 - DNA, 22 bp, Homo sapiens
acactgggttacctgtactatt

SEQ ID NO: 9149203 - DNA, 22 bp, Homo sapiens
acactgggtaacatatctgtta

SEQ ID NO: 9149204 - DNA, 22 bp, Homo sapiens
aagcacaggagacgcacagcca

SEQ ID NO: 9149205 - DNA, 22 bp, Homo sapiens
aagcacaggagacgcacagcca

SEQ ID NO: 9149206 - DNA, 22 bp, Homo sapiens
aagcacaggatcttgaggagcg

SEQ ID NO: 9149207 - DNA, 22 bp, Homo sapiens
aagcacaggatcttgaggagcg

SEQ ID NO: 9149208 - DNA, 22 bp, Homo sapiens
aagcacaggatcttgaggagcg

SEQ ID NO: 9149209 - DNA, 22 bp, Homo sapiens
aagcacaggatcttgaggagcg

SEQ ID NO: 9149210 - DNA, 22 bp, Homo sapiens
aagcacaggatcttgaggagcg

SEQ ID NO: 9149211 - DNA, 22 bp, Homo sapiens
aagatttagggccagtttacat

SEQ ID NO: 9149212 - DNA, 22 bp, Homo sapiens
aagatttactttctttgtaata

SEQ ID NO: 9149213 - DNA, 22 bp, Homo sapiens
aagatttactttctttgtaata

SEQ ID NO: 9149214 - DNA, 21 bp, Homo sapiens
aagatttatgggacttgccaa

SEQ ID NO: 9149215 - DNA, 22 bp, Homo sapiens
aagatttagggccagtttacat

SEQ ID NO: 9149216 - DNA, 22 bp, Homo sapiens
aagatttactttctttgtaata

SEQ ID NO: 9149217 - DNA, 22 bp, Homo sapiens
aagatttattagatgcttacct

SEQ ID NO: 9149218 - DNA, 22 bp, Homo sapiens
aagatttattagatgcttacct

SEQ ID NO: 9149219 - DNA, 22 bp, Homo sapiens
acactgcagcatcagctacgga

SEQ ID NO: 9149220 - DNA, 22 bp, Homo sapiens
acactggagcttctagcccacg

SEQ ID NO: 9149221 - DNA, 22 bp, Homo sapiens
acactggagatggacctcacaa

SEQ ID NO: 9149222 - DNA, 22 bp, Homo sapiens
acactggactcagaggccagaa

SEQ ID NO: 9149223 - DNA, 22 bp, Homo sapiens
acactggagcttctagcccacg

SEQ ID NO: 9149224 - DNA, 22 bp, Homo sapiens
acactggaggagagctgttgct

SEQ ID NO: 9149225 - DNA, 22 bp, Homo sapiens
acactggacactgaactccctg

SEQ ID NO: 9149226 - DNA, 22 bp, Homo sapiens
acactggaccatttaaacttga

SEQ ID NO: 9149227 - DNA, 22 bp, Homo sapiens
acactggagggtccagggatgt

SEQ ID NO: 9149228 - DNA, 22 bp, Homo sapiens
acactggataccactgttatta

SEQ ID NO: 9149229 - DNA, 22 bp, Homo sapiens
acactggatgaagcaagctaaa

SEQ ID NO: 9149230 - DNA, 22 bp, Homo sapiens
acactggattcttgtagtgaag

SEQ ID NO: 9149231 - DNA, 22 bp, Homo sapiens
acactggataccactgttatta

SEQ ID NO: 9149232 - DNA, 19 bp, Homo sapiens
acactgggagaagactgct

SEQ ID NO: 9149233 - DNA, 22 bp, Homo sapiens
acactggaaatagggaggtttt

SEQ ID NO: 9149234 - DNA, 21 bp, Homo sapiens
acactgctgtagcatattggg

SEQ ID NO: 9149235 - DNA, 21 bp, Homo sapiens
acactgcaggtgaagtgcact

SEQ ID NO: 9149236 - DNA, 22 bp, Homo sapiens
aattgcttttcaagggtacagc

SEQ ID NO: 9149237 - DNA, 22 bp, Homo sapiens
aattgcttttgggggcagttac

SEQ ID NO: 9149238 - DNA, 22 bp, Homo sapiens
aattatattgtggtgtgaatgt

SEQ ID NO: 9149239 - DNA, 22 bp, Homo sapiens
aattatattgtggtgtgaatgt

SEQ ID NO: 9149240 - DNA, 22 bp, Homo sapiens
aattatacaattgtcaagttct

SEQ ID NO: 9149241 - DNA, 22 bp, Homo sapiens
aattagtattgcgattcattag

SEQ ID NO: 9149242 - DNA, 22 bp, Homo sapiens
aattatacatgaaggcattata

SEQ ID NO: 9149243 - DNA, 22 bp, Homo sapiens
aattatacatgaaggcattata

SEQ ID NO: 9149244 - DNA, 20 bp, Homo sapiens
aattatataactccaacatt

SEQ ID NO: 9149245 - DNA, 22 bp, Homo sapiens
aattatatgttaatcttcaatt

SEQ ID NO: 9149246 - DNA, 20 bp, Homo sapiens
aattatataactccaacatt

SEQ ID NO: 9149247 - DNA, 22 bp, Homo sapiens
aattatatgttaatcttcaatt

SEQ ID NO: 9149248 - DNA, 22 bp, Homo sapiens
aattatattgaagttgaatgtc

SEQ ID NO: 9149249 - DNA, 22 bp, Homo sapiens
aattatattgaagttgaatgtc

SEQ ID NO: 9149250 - DNA, 22 bp, Homo sapiens
aatttatatgtaattaggcaca

SEQ ID NO: 9149251 - DNA, 22 bp, Homo sapiens
aatttatatgtaattaggcaca

SEQ ID NO: 9149252 - DNA, 22 bp, Homo sapiens
agagctgggacttggactcaat

SEQ ID NO: 9149253 - DNA, 22 bp, Homo sapiens
agagctgggacttggactcaat

SEQ ID NO: 9149254 - DNA, 22 bp, Homo sapiens
agagctggggcataaatgccac

SEQ ID NO: 9149255 - DNA, 22 bp, Homo sapiens
agagctggggcataaatgccac

SEQ ID NO: 9149256 - DNA, 22 bp, Homo sapiens
agagctggggccagagtcaagg

SEQ ID NO: 9149257 - DNA, 19 bp, Homo sapiens
aatttagttcttgtttaga

SEQ ID NO: 9149258 - DNA, 22 bp, Homo sapiens
aatttataataaatagggcttt

SEQ ID NO: 9149259 - DNA, 21 bp, Homo sapiens
aatttagtcaacagactgtgg

SEQ ID NO: 9149260 - DNA, 22 bp, Homo sapiens
aatttagaattcgctagctaat

SEQ ID NO: 9149261 - DNA, 22 bp, Homo sapiens
aatttacctctaaacaggagcc

SEQ ID NO: 9149262 - DNA, 22 bp, Homo sapiens
aatttacacttcatttggaggg

SEQ ID NO: 9149263 - DNA, 22 bp, Homo sapiens
aatgttcattgattaaatgaat

SEQ ID NO: 9149264 - DNA, 22 bp, Homo sapiens
aatgttcagtgcctttaaacat

SEQ ID NO: 9149265 - DNA, 22 bp, Homo sapiens
aatgttcagtagaataggaatg

SEQ ID NO: 9149266 - DNA, 22 bp, Homo sapiens
aatgttctgggagagaagctgt

SEQ ID NO: 9149267 - DNA, 22 bp, Homo sapiens
aatgttctgcaactgttttcat

SEQ ID NO: 9149268 - DNA, 22 bp, Homo sapiens
aatgttgcagagtgattgtcca

SEQ ID NO: 9149269 - DNA, 22 bp, Homo sapiens
aatgttgcagagtgattgtcca

SEQ ID NO: 9149270 - DNA, 22 bp, Homo sapiens
aatgtgtttagttaatgagttg

SEQ ID NO: 9149271 - DNA, 22 bp, Homo sapiens
aatgtgtttagttaatgagttg

SEQ ID NO: 9149272 - DNA, 22 bp, Homo sapiens
aatgttatttctgcatagtagt

SEQ ID NO: 9149273 - DNA, 22 bp, Homo sapiens
aatgttcagtagaataggaatg

SEQ ID NO: 9149274 - DNA, 22 bp, Homo sapiens
aatgttcaacagatggatattt

SEQ ID NO: 9149275 - DNA, 22 bp, Homo sapiens
aatgttcagaggacaatataaa

SEQ ID NO: 9149276 - DNA, 19 bp, Homo sapiens
aatgtttaagagaaaaagg

SEQ ID NO: 9149277 - DNA, 22 bp, Homo sapiens
aatgtttcatttagttgtctcc

SEQ ID NO: 9149278 - DNA, 22 bp, Homo sapiens
aatgtttcattcttgcccattg

SEQ ID NO: 9149279 - DNA, 22 bp, Homo sapiens
aatgtttcgtaaattgtctatg

SEQ ID NO: 9149280 - DNA, 22 bp, Homo sapiens
aattacctcatacccggactat

SEQ ID NO: 9149281 - DNA, 22 bp, Homo sapiens
aattacccataggcagccgagc

SEQ ID NO: 9149282 - DNA, 22 bp, Homo sapiens
aattacctgtcatacatcaagc

SEQ ID NO: 9149283 - DNA, 22 bp, Homo sapiens
aattaccttttccacttaggcc

SEQ ID NO: 9149284 - DNA, 22 bp, Homo sapiens
aattaccatcgtcaaatcatat

SEQ ID NO: 9149285 - DNA, 22 bp, Homo sapiens
aattagtattgcgattcattag

SEQ ID NO: 9149286 - DNA, 22 bp, Homo sapiens
aatgcaagatcaaatctaacac

SEQ ID NO: 9149287 - DNA, 21 bp, Homo sapiens
agacactggtttagcattcat

SEQ ID NO: 9149288 - DNA, 19 bp, Homo sapiens
agacagagactgaaataga

SEQ ID NO: 9149289 - DNA, 19 bp, Homo sapiens
agacagagctcagtgggtt

SEQ ID NO: 9149290 - DNA, 21 bp, Homo sapiens
agacagagtgcagtctacata

SEQ ID NO: 9149291 - DNA, 22 bp, Homo sapiens
agacaggccactctggtctggt

SEQ ID NO: 9149292 - DNA, 22 bp, Homo sapiens
agacaggccactctggtctggt

SEQ ID NO: 9149293 - DNA, 22 bp, Homo sapiens
aatgcaaagcaagcagagattt

SEQ ID NO: 9149294 - DNA, 22 bp, Homo sapiens
aatgcaaacagcccagaatcca

SEQ ID NO: 9149295 - DNA, 22 bp, Homo sapiens
aatgcaaactccactggagcag

SEQ ID NO: 9149296 - DNA, 23 bp, Homo sapiens
agaaggtgggcctgctgagttat

SEQ ID NO: 9149297 - DNA, 23 bp, Homo sapiens
agaagggtccttggcagcgacag

SEQ ID NO: 9149298 - DNA, 22 bp, Homo sapiens
agaagtataaagaatgtttatg

SEQ ID NO: 9149299 - DNA, 22 bp, Homo sapiens
agaagggtagttgtaagagtga

SEQ ID NO: 9149300 - DNA, 22 bp, Homo sapiens
agaaggggcccaaggatgtcag

SEQ ID NO: 9149301 - DNA, 22 bp, Homo sapiens
agaagggctacacgggctctcc

SEQ ID NO: 9149302 - DNA, 22 bp, Homo sapiens
agaagggccagctggacacctg

SEQ ID NO: 9149303 - DNA, 22 bp, Homo sapiens
agaagggccagctggacacctg

SEQ ID NO: 9149304 - DNA, 22 bp, Homo sapiens
aatgtcatagcaaagagagtga

SEQ ID NO: 9149305 - DNA, 22 bp, Homo sapiens
aatgtcactctgtttcctctgc

SEQ ID NO: 9149306 - DNA, 22 bp, Homo sapiens
aatgtcacatacaatggcaagt

SEQ ID NO: 9149307 - DNA, 22 bp, Homo sapiens
aatgtcaatctcagagaacaca

SEQ ID NO: 9149308 - DNA, 22 bp, Homo sapiens
aatgtattctctttataagata

SEQ ID NO: 9149309 - DNA, 22 bp, Homo sapiens
aatgtcaattaccagaacagaa

SEQ ID NO: 9149310 - DNA, 22 bp, Homo sapiens
aatgtcacagaagaactcccca

SEQ ID NO: 9149311 - DNA, 22 bp, Homo sapiens
aatgtcatattagtttgtgcct

SEQ ID NO: 9149312 - DNA, 22 bp, Homo sapiens
aatgtcatagcatttcttcaat

SEQ ID NO: 9149313 - DNA, 22 bp, Homo sapiens
agacagggtcttgatcagagct

SEQ ID NO: 9149314 - DNA, 22 bp, Homo sapiens
agacagggtcttgatcagagct

SEQ ID NO: 9149315 - DNA, 22 bp, Homo sapiens
agacagggagggagcgcggctg

SEQ ID NO: 9149316 - DNA, 22 bp, Homo sapiens
aatgtattcctcatgcaagagt

SEQ ID NO: 9149317 - DNA, 22 bp, Homo sapiens
agacagggtgatcgcttgagcc

SEQ ID NO: 9149318 - DNA, 22 bp, Homo sapiens
aatgtctgcctgaactttatat

SEQ ID NO: 9149319 - DNA, 22 bp, Homo sapiens
aatgtctgaaaatcagactgca

SEQ ID NO: 9149320 - DNA, 22 bp, Homo sapiens
aatgtcttaaagtcgtgttaca

SEQ ID NO: 9149321 - DNA, 22 bp, Homo sapiens
aatgtcttacatttactgagca

SEQ ID NO: 9149322 - DNA, 22 bp, Homo sapiens
aatgtgttactgtgtaagagca

SEQ ID NO: 9149323 - DNA, 22 bp, Homo sapiens
aatgtgttactgtgtaagagca

SEQ ID NO: 9149324 - DNA, 22 bp, Homo sapiens
aatgtgttcacaggaaatacag

SEQ ID NO: 9149325 - DNA, 22 bp, Homo sapiens
aatgtgttatttcagaatccag

SEQ ID NO: 9149326 - DNA, 22 bp, Homo sapiens
aatgtgttcagttaaatgaact

SEQ ID NO: 9149327 - DNA, 22 bp, Homo sapiens
aatgtctacattctgaattcgt

SEQ ID NO: 9149328 - DNA, 22 bp, Homo sapiens
aatgtctagacatgttaatgca

SEQ ID NO: 9149329 - DNA, 18 bp, Homo sapiens
aatgtccagtgttcatat

SEQ ID NO: 9149330 - DNA, 22 bp, Homo sapiens
aatgtcctaggcatgattttgt

SEQ ID NO: 9149331 - DNA, 22 bp, Homo sapiens
aatgtcattggtaaagattagg

SEQ ID NO: 9149332 - DNA, 22 bp, Homo sapiens
acaaatgtggacatggataatg

SEQ ID NO: 9149333 - DNA, 22 bp, Homo sapiens
acaaatgtggacatggataatg

SEQ ID NO: 9149334 - DNA, 22 bp, Homo sapiens
acaaatggaacaatgaagactg

SEQ ID NO: 9149335 - DNA, 22 bp, Homo sapiens
acaaatggagaaactgaggccc

SEQ ID NO: 9149336 - DNA, 22 bp, Homo sapiens
acaaatgtgtctaattgtgcct

SEQ ID NO: 9149337 - DNA, 22 bp, Homo sapiens
acaaatgttacataagtttgga

SEQ ID NO: 9149338 - DNA, 22 bp, Homo sapiens
acaaatgttggatttgtcttcc

SEQ ID NO: 9149339 - DNA, 22 bp, Homo sapiens
acaaattaccatggaatttggg

SEQ ID NO: 9149340 - DNA, 22 bp, Homo sapiens
acaaggaacaagcatgtagttt

SEQ ID NO: 9149341 - DNA, 22 bp, Homo sapiens
acaagctttgtgatagtagaga

SEQ ID NO: 9149342 - DNA, 22 bp, Homo sapiens
acaagctttgtgatagtagaga

SEQ ID NO: 9149343 - DNA, 22 bp, Homo sapiens
agatggggcagaatggagccat

SEQ ID NO: 9149344 - DNA, 22 bp, Homo sapiens
agatggggcagaatggagccat

SEQ ID NO: 9149345 - DNA, 22 bp, Homo sapiens
agatggggctcagtgtggaggc

SEQ ID NO: 9149346 - DNA, 22 bp, Homo sapiens
acaagttaccaaaaaagattca

SEQ ID NO: 9149347 - DNA, 22 bp, Homo sapiens
acaagtttatttgattagaaca

SEQ ID NO: 9149348 - DNA, 19 bp, Homo sapiens
agatggggaagagtgtgag

SEQ ID NO: 9149349 - DNA, 19 bp, Homo sapiens
agatggggaagagtgtgag

SEQ ID NO: 9149350 - DNA, 22 bp, Homo sapiens
acaagtgggtcctacataaagc

SEQ ID NO: 9149351 - DNA, 23 bp, Homo sapiens
acaagtgtttccaatatggctgg

SEQ ID NO: 9149352 - DNA, 22 bp, Homo sapiens
acaagtctgttatgcacctgga

SEQ ID NO: 9149353 - DNA, 22 bp, Homo sapiens
agatgggtaactggagtctgct

SEQ ID NO: 9149354 - DNA, 22 bp, Homo sapiens
agatggggctcagtgtggaggc

SEQ ID NO: 9149355 - DNA, 22 bp, Homo sapiens
agatggggtttcatcatgttgg

SEQ ID NO: 9149356 - DNA, 22 bp, Homo sapiens
acaattctctcatatcttatta

SEQ ID NO: 9149357 - DNA, 22 bp, Homo sapiens
acaattcctgagaatacttgtt

SEQ ID NO: 9149358 - DNA, 22 bp, Homo sapiens
acaattctctcatatcttatta

SEQ ID NO: 9149359 - DNA, 22 bp, Homo sapiens
acaattagtgatcagtgatgcc

SEQ ID NO: 9149360 - DNA, 22 bp, Homo sapiens
acaattagctgtgtgtctatct

SEQ ID NO: 9149361 - DNA, 22 bp, Homo sapiens
acaattagcaaggggaagattt

SEQ ID NO: 9149362 - DNA, 22 bp, Homo sapiens
acaattaccctggcttgataaa

SEQ ID NO: 9149363 - DNA, 22 bp, Homo sapiens
agcaagatttttcaggttagta

SEQ ID NO: 9149364 - DNA, 22 bp, Homo sapiens
agcaagcagaaatgccatggca

SEQ ID NO: 9149365 - DNA, 22 bp, Homo sapiens
agcaagattgaggcttcctcag

SEQ ID NO: 9149366 - DNA, 22 bp, Homo sapiens
agcaagatttaaacccaggtca

SEQ ID NO: 9149367 - DNA, 22 bp, Homo sapiens
agcaagattttccttgaatgtt

SEQ ID NO: 9149368 - DNA, 22 bp, Homo sapiens
agcaagattttccttgaatgtt

SEQ ID NO: 9149369 - DNA, 22 bp, Homo sapiens
agcaagatttaaacccaggtca

SEQ ID NO: 9149370 - DNA, 18 bp, Homo sapiens
agcaagcagttttcatgt

SEQ ID NO: 9149371 - DNA, 20 bp, Homo sapiens
agcaccagtgggggcagccc

SEQ ID NO: 9149372 - DNA, 21 bp, Homo sapiens
agcaccagttttatgccaggc

SEQ ID NO: 9149373 - DNA, 21 bp, Homo sapiens
agcaaggcagcctctcagcct

SEQ ID NO: 9149374 - DNA, 22 bp, Homo sapiens
acaaaatttttagacaaggctt

SEQ ID NO: 9149375 - DNA, 22 bp, Homo sapiens
acaaacacgagacgccactgtg

SEQ ID NO: 9149376 - DNA, 22 bp, Homo sapiens
acaaaattgtgttaaactttat

SEQ ID NO: 9149377 - DNA, 23 bp, Homo sapiens
acaaaatgttctgctgggaggtg

SEQ ID NO: 9149378 - DNA, 22 bp, Homo sapiens
acaaaattacctagttattttc

SEQ ID NO: 9149379 - DNA, 22 bp, Homo sapiens
acaaaattatgaagaggccttg

SEQ ID NO: 9149380 - DNA, 22 bp, Homo sapiens
acaaaccagcttaagcaagatg

SEQ ID NO: 9149381 - DNA, 22 bp, Homo sapiens
acaaaccagcttaagcaagatg

SEQ ID NO: 9149382 - DNA, 22 bp, Homo sapiens
acaaaattgtgttaaactttat

SEQ ID NO: 9149383 - DNA, 22 bp, Homo sapiens
acaaacagagttgaaaaatagg

SEQ ID NO: 9149384 - DNA, 21 bp, Homo sapiens
acaaactgaaatgagtttcct

SEQ ID NO: 9149385 - DNA, 22 bp, Homo sapiens
acaaacttatgtttcatatgta

SEQ ID NO: 9149386 - DNA, 22 bp, Homo sapiens
acaaacttccatcatgaatttt

SEQ ID NO: 9149387 - DNA, 22 bp, Homo sapiens
acaaatgactatttggtacagg

SEQ ID NO: 9149388 - DNA, 22 bp, Homo sapiens
acaaacttcccagacaagctcc

SEQ ID NO: 9149389 - DNA, 22 bp, Homo sapiens
acaaatgattttccaagccagt

SEQ ID NO: 9149390 - DNA, 22 bp, Homo sapiens
acaaatgagaatgtagacagag

SEQ ID NO: 9149391 - DNA, 22 bp, Homo sapiens
acaaatgattatcacagaggag

SEQ ID NO: 9149392 - DNA, 22 bp, Homo sapiens
aatttgttaaaagtgagtgaca

SEQ ID NO: 9149393 - DNA, 22 bp, Homo sapiens
agagctgggtggacttgtagtt

SEQ ID NO: 9149394 - DNA, 22 bp, Homo sapiens
agagctgggtggtggtgactca

SEQ ID NO: 9149395 - DNA, 22 bp, Homo sapiens
agagctggggccagagtcaagg

SEQ ID NO: 9149396 - DNA, 22 bp, Homo sapiens
agagctggggcccgtaaagcca

SEQ ID NO: 9149397 - DNA, 22 bp, Homo sapiens
agagctggggccagagtcaagg

SEQ ID NO: 9149398 - DNA, 22 bp, Homo sapiens
agagctgggtgaagtgccatca

SEQ ID NO: 9149399 - DNA, 22 bp, Homo sapiens
agagctggggcccgtaaagcca

SEQ ID NO: 9149400 - DNA, 22 bp, Homo sapiens
agagctggggctctgggtttaa

SEQ ID NO: 9149401 - DNA, 22 bp, Homo sapiens
agagctgggtgaagtgccatca

SEQ ID NO: 9149402 - DNA, 22 bp, Homo sapiens
agagctgggtgaagtgccatca

SEQ ID NO: 9149403 - DNA, 22 bp, Homo sapiens
aattttcacagtgctgtgagat

SEQ ID NO: 9149404 - DNA, 22 bp, Homo sapiens
aattttccatccaaagtaacat

SEQ ID NO: 9149405 - DNA, 22 bp, Homo sapiens
aattttcacagtgctgtgagat

SEQ ID NO: 9149406 - DNA, 22 bp, Homo sapiens
aattttatgccttgcacgttgg

SEQ ID NO: 9149407 - DNA, 22 bp, Homo sapiens
aattttattaactggatgtagc

SEQ ID NO: 9149408 - DNA, 22 bp, Homo sapiens
agaggccccatgggatggcggt

SEQ ID NO: 9149409 - DNA, 22 bp, Homo sapiens
agaggccccaggtgagcatgcc

SEQ ID NO: 9149410 - DNA, 22 bp, Homo sapiens
agaggccccaggtgagcatgcc

SEQ ID NO: 9149411 - DNA, 20 bp, Homo sapiens
acaaaataggtactgggtag

SEQ ID NO: 9149412 - DNA, 20 bp, Homo sapiens
agaggccagttaggagtcta

SEQ ID NO: 9149413 - DNA, 22 bp, Homo sapiens
aattttctgatgatgaagcacg

SEQ ID NO: 9149414 - DNA, 22 bp, Homo sapiens
acaccagggatatgaggaagga

SEQ ID NO: 9149415 - DNA, 22 bp, Homo sapiens
agcagggcagtgcttcagctct

SEQ ID NO: 9149416 - DNA, 23 bp, Homo sapiens
acacatttttcccgttctgaggt

SEQ ID NO: 9149417 - DNA, 22 bp, Homo sapiens
acacattttcaacactgtcaag

SEQ ID NO: 9149418 - DNA, 22 bp, Homo sapiens
acacatttctctttttgtaagt

SEQ ID NO: 9149419 - DNA, 22 bp, Homo sapiens
acacattatctcattaaatact

SEQ ID NO: 9149420 - DNA, 23 bp, Homo sapiens
agcaggaaaccgagggtgatgtt

SEQ ID NO: 9149421 - DNA, 22 bp, Homo sapiens
acacatttgctaaaatgagctc

SEQ ID NO: 9149422 - DNA, 22 bp, Homo sapiens
acacatttgcataatacctcat

SEQ ID NO: 9149423 - DNA, 19 bp, Homo sapiens
acacatttgcacaatccac

SEQ ID NO: 9149424 - DNA, 22 bp, Homo sapiens
agcagggcagttaaagggtcct

SEQ ID NO: 9149425 - DNA, 22 bp, Homo sapiens
acaccaaagtagaattaatgta

SEQ ID NO: 9149426 - DNA, 22 bp, Homo sapiens
acactgcagatgaaagcataag

SEQ ID NO: 9149427 - DNA, 22 bp, Homo sapiens
acactgcagatgtaatttgagt

SEQ ID NO: 9149428 - DNA, 22 bp, Homo sapiens
agcagggcccactaggggagat

SEQ ID NO: 9149429 - DNA, 22 bp, Homo sapiens
agcagggcccactaggggagat

SEQ ID NO: 9149430 - DNA, 18 bp, Homo sapiens
acactgcagcagtctgct

SEQ ID NO: 9149431 - DNA, 19 bp, Homo sapiens
acactgtagatatagctat

SEQ ID NO: 9149432 - DNA, 22 bp, Homo sapiens
acactgtagatatagagttagt

SEQ ID NO: 9149433 - DNA, 22 bp, Homo sapiens
acactgtagatatagagttagt

SEQ ID NO: 9149434 - DNA, 22 bp, Homo sapiens
acactgtgagctgaagggctgc

SEQ ID NO: 9149435 - DNA, 23 bp, Homo sapiens
acactgtctcatggatagactgc

SEQ ID NO: 9149436 - DNA, 22 bp, Homo sapiens
acactgtctgggactcaggagt

SEQ ID NO: 9149437 - DNA, 22 bp, Homo sapiens
acactgtatgaaaacaggaaat

SEQ ID NO: 9149438 - DNA, 22 bp, Homo sapiens
acactgtctcatatgaggggac

SEQ ID NO: 9149439 - DNA, 23 bp, Homo sapiens
acactgtctcatggatagactgc

SEQ ID NO: 9149440 - DNA, 19 bp, Homo sapiens
acagaaattagttattttc

SEQ ID NO: 9149441 - DNA, 19 bp, Homo sapiens
acagaaattagttattttc

SEQ ID NO: 9149442 - DNA, 22 bp, Homo sapiens
acagaaattagcagtgagttta

SEQ ID NO: 9149443 - DNA, 22 bp, Homo sapiens
acagaaattagcagtgagttta

SEQ ID NO: 9149444 - DNA, 22 bp, Homo sapiens
acagaaattcaaactggaattt

SEQ ID NO: 9149445 - DNA, 22 bp, Homo sapiens
acagaaattcaaactggaattt

SEQ ID NO: 9149446 - DNA, 19 bp, Homo sapiens
acagaaattagttattttc

SEQ ID NO: 9149447 - DNA, 22 bp, Homo sapiens
acagaaattgctaatagctcat

SEQ ID NO: 9149448 - DNA, 22 bp, Homo sapiens
acagaaattgctaatagctcat

SEQ ID NO: 9149449 - DNA, 22 bp, Homo sapiens
acagaaattgctaatagctcat

SEQ ID NO: 9149450 - DNA, 22 bp, Homo sapiens
acagaaattctgggacagaaaa

SEQ ID NO: 9149451 - DNA, 22 bp, Homo sapiens
acagaaattctgggacagaaaa

SEQ ID NO: 9149452 - DNA, 22 bp, Homo sapiens
acagaaattctgggacagaaaa

SEQ ID NO: 9149453 - DNA, 22 bp, Homo sapiens
acagaaattctgggacagaaaa

SEQ ID NO: 9149454 - DNA, 22 bp, Homo sapiens
acagaacaacaaggtggaccag

SEQ ID NO: 9149455 - DNA, 22 bp, Homo sapiens
acagaaattgggcaaatggaag

SEQ ID NO: 9149456 - DNA, 22 bp, Homo sapiens
acagaaattgggcaaatggaag

SEQ ID NO: 9149457 - DNA, 22 bp, Homo sapiens
agcagtgttcaatgatacactg

SEQ ID NO: 9149458 - DNA, 22 bp, Homo sapiens
agcagtggtgtgaggagggctc

SEQ ID NO: 9149459 - DNA, 22 bp, Homo sapiens
agcagtggtgtgaggagggctc

SEQ ID NO: 9149460 - DNA, 22 bp, Homo sapiens
agcagtgtggccttagacccgg

SEQ ID NO: 9149461 - DNA, 22 bp, Homo sapiens
acactgtgcagattccctgtga

SEQ ID NO: 9149462 - DNA, 22 bp, Homo sapiens
acactgtgtctagcattttaca

SEQ ID NO: 9149463 - DNA, 22 bp, Homo sapiens
agcagtgggtgacagagctgag

SEQ ID NO: 9149464 - DNA, 22 bp, Homo sapiens
agcagtggctggatggtgtgct

SEQ ID NO: 9149465 - DNA, 22 bp, Homo sapiens
agcagtggtgtgaggagggctc

SEQ ID NO: 9149466 - DNA, 22 bp, Homo sapiens
acaattttccccataggttatc

SEQ ID NO: 9149467 - DNA, 22 bp, Homo sapiens
acaatttctaatatagatctta

SEQ ID NO: 9149468 - DNA, 22 bp, Homo sapiens
acacaggacggccctgtggctt

SEQ ID NO: 9149469 - DNA, 23 bp, Homo sapiens
acacaggatacatacggaagcaa

SEQ ID NO: 9149470 - DNA, 22 bp, Homo sapiens
acacaggcaagagtgcaggtct

SEQ ID NO: 9149471 - DNA, 22 bp, Homo sapiens
acacaggagatatgtaatggct

SEQ ID NO: 9149472 - DNA, 22 bp, Homo sapiens
agcaccctggggaagcacaaag

SEQ ID NO: 9149473 - DNA, 22 bp, Homo sapiens
agcaccctcccaccctctcaga

SEQ ID NO: 9149474 - DNA, 22 bp, Homo sapiens
agcaccatgaccttgccattga

SEQ ID NO: 9149475 - DNA, 22 bp, Homo sapiens
agcaccattgcaaatatggcag

SEQ ID NO: 9149476 - DNA, 22 bp, Homo sapiens
agcacctccgtgcagcgtggcc

SEQ ID NO: 9149477 - DNA, 22 bp, Homo sapiens
agcaccgttcaaacccaggtta

SEQ ID NO: 9149478 - DNA, 22 bp, Homo sapiens
agcaccgtcatagccaggtaag

SEQ ID NO: 9149479 - DNA, 22 bp, Homo sapiens
acaatttatccattgtatagtt

SEQ ID NO: 9149480 - DNA, 22 bp, Homo sapiens
acaatttatccattgtatagtt

SEQ ID NO: 9149481 - DNA, 22 bp, Homo sapiens
acaatttatccattgtatagtt

SEQ ID NO: 9149482 - DNA, 22 bp, Homo sapiens
acaatttatccattgtatagtt

SEQ ID NO: 9149483 - DNA, 22 bp, Homo sapiens
agcacctgcctgcattggctat

SEQ ID NO: 9149484 - DNA, 22 bp, Homo sapiens
agcacctgcctgcattggctat

SEQ ID NO: 9149485 - DNA, 22 bp, Homo sapiens
agcacctgctatgtgtcaggga

SEQ ID NO: 9149486 - DNA, 22 bp, Homo sapiens
acaattctgatggtttcccagt

SEQ ID NO: 9149487 - DNA, 22 bp, Homo sapiens
acaattctgatggtttcccagt

SEQ ID NO: 9149488 - DNA, 22 bp, Homo sapiens
acaattctgatggtttcccagt

SEQ ID NO: 9149489 - DNA, 22 bp, Homo sapiens
acaattctgtggttgtctgtgg

SEQ ID NO: 9149490 - DNA, 22 bp, Homo sapiens
acaattctgggtatttatatag

SEQ ID NO: 9149491 - DNA, 22 bp, Homo sapiens
agcagcagtgtgtggtcatgtt

SEQ ID NO: 9149492 - DNA, 22 bp, Homo sapiens
agcagcagtgtgtggtcatgtt

SEQ ID NO: 9149493 - DNA, 22 bp, Homo sapiens
agcagcagtgttctggaattct

SEQ ID NO: 9149494 - DNA, 22 bp, Homo sapiens
acacataagaaactacaaagag

SEQ ID NO: 9149495 - DNA, 22 bp, Homo sapiens
acacatatatgtgcgtgtatat

SEQ ID NO: 9149496 - DNA, 22 bp, Homo sapiens
acacatatatgtgcgtgtatat

SEQ ID NO: 9149497 - DNA, 22 bp, Homo sapiens
acacataagaaactacaaagag

SEQ ID NO: 9149498 - DNA, 22 bp, Homo sapiens
acacataagaaactacaaagag

SEQ ID NO: 9149499 - DNA, 22 bp, Homo sapiens
agcagcagtcctttgtgtaatt

SEQ ID NO: 9149500 - DNA, 22 bp, Homo sapiens
agcagcagtcctttgtgtaatt

SEQ ID NO: 9149501 - DNA, 22 bp, Homo sapiens
agcagcagtgacagccgaaagc

SEQ ID NO: 9149502 - DNA, 23 bp, Homo sapiens
agcagcagtgagaggtgtcttac

SEQ ID NO: 9149503 - DNA, 22 bp, Homo sapiens
agcagcagtgtggtttggggaa

SEQ ID NO: 9149504 - DNA, 22 bp, Homo sapiens
agcagcaggtgacctcgatgcc

SEQ ID NO: 9149505 - DNA, 22 bp, Homo sapiens
agcagcaggtgacctcgatgcc

SEQ ID NO: 9149506 - DNA, 22 bp, Homo sapiens
agcagcaggtgacctcgatgcc

SEQ ID NO: 9149507 - DNA, 22 bp, Homo sapiens
acacaggcatagccatacatgt

SEQ ID NO: 9149508 - DNA, 22 bp, Homo sapiens
agcagcagtcatgcctatgctc

SEQ ID NO: 9149509 - DNA, 22 bp, Homo sapiens
agcagcagtcatgcctatgctc

SEQ ID NO: 9149510 - DNA, 22 bp, Homo sapiens
agcagcagtatccttccccggc

SEQ ID NO: 9149511 - DNA, 22 bp, Homo sapiens
agcagcagtacatataagacta

SEQ ID NO: 9149512 - DNA, 22 bp, Homo sapiens
agcagcagtacatataagacta

SEQ ID NO: 9149513 - DNA, 22 bp, Homo sapiens
agcagcagtacatataagacta

SEQ ID NO: 9149514 - DNA, 22 bp, Homo sapiens
agcagcagtacatataagacta

SEQ ID NO: 9149515 - DNA, 20 bp, Homo sapiens
agcaggaaaagtgccagtct

SEQ ID NO: 9149516 - DNA, 23 bp, Homo sapiens
agcaggaaaccgagggtgatgtt

SEQ ID NO: 9149517 - DNA, 22 bp, Homo sapiens
agcagctttaagtcactggtta

SEQ ID NO: 9149518 - DNA, 22 bp, Homo sapiens
acacatatgtatgcatcatgtg

SEQ ID NO: 9149519 - DNA, 23 bp, Homo sapiens
acacatatattcagatacagatg

SEQ ID NO: 9149520 - DNA, 22 bp, Homo sapiens
acacatatatttgcatatacac

SEQ ID NO: 9149521 - DNA, 22 bp, Homo sapiens
acacatatggttgctgcagtga

SEQ ID NO: 9149522 - DNA, 22 bp, Homo sapiens
acacatatggttgctgcagtga

SEQ ID NO: 9149523 - DNA, 22 bp, Homo sapiens
acacatatatttgcatatacac

SEQ ID NO: 9149524 - DNA, 22 bp, Homo sapiens
acacatatctaagatagatgac

SEQ ID NO: 9149525 - DNA, 22 bp, Homo sapiens
acagagtcattcattgtccagt

SEQ ID NO: 9149526 - DNA, 22 bp, Homo sapiens
agcccctctgtggctctgcctc

SEQ ID NO: 9149527 - DNA, 22 bp, Homo sapiens
agcccctgctgggtgtagctca

SEQ ID NO: 9149528 - DNA, 22 bp, Homo sapiens
agcccctgtaccctgagtgctt

SEQ ID NO: 9149529 - DNA, 22 bp, Homo sapiens
agcccctgggagtagctgctgc

SEQ ID NO: 9149530 - DNA, 22 bp, Homo sapiens
acagataaagaaacaatcacag

SEQ ID NO: 9149531 - DNA, 22 bp, Homo sapiens
acagataaagaaacaatcacag

SEQ ID NO: 9149532 - DNA, 22 bp, Homo sapiens
agccccctccctagtgactgga

SEQ ID NO: 9149533 - DNA, 22 bp, Homo sapiens
agcccccaggagtctccacgcc

SEQ ID NO: 9149534 - DNA, 22 bp, Homo sapiens
agcccccaggagtctccacgcc

SEQ ID NO: 9149535 - DNA, 23 bp, Homo sapiens
agcccctcatggtgtctagacag

SEQ ID NO: 9149536 - DNA, 23 bp, Homo sapiens
agcccctcatatctgctttctct

SEQ ID NO: 9149537 - DNA, 17 bp, Homo sapiens
agcccctcagcgtcacc

SEQ ID NO: 9149538 - DNA, 22 bp, Homo sapiens
agcccctctccgccctgagtcg

SEQ ID NO: 9149539 - DNA, 22 bp, Homo sapiens
agcccctccagtggcataaaat

SEQ ID NO: 9149540 - DNA, 22 bp, Homo sapiens
agcccctctgtagctaatagta

SEQ ID NO: 9149541 - DNA, 22 bp, Homo sapiens
acagagcagttctggagctggc

SEQ ID NO: 9149542 - DNA, 22 bp, Homo sapiens
acagagcagttctggagctggc

SEQ ID NO: 9149543 - DNA, 22 bp, Homo sapiens
agcccagctgcctgcctgctgt

SEQ ID NO: 9149544 - DNA, 22 bp, Homo sapiens
agcccagctcctccacagaata

SEQ ID NO: 9149545 - DNA, 22 bp, Homo sapiens
agcccaaacctgcgagcagagc

SEQ ID NO: 9149546 - DNA, 22 bp, Homo sapiens
agcccaaacctgcgagcagagc

SEQ ID NO: 9149547 - DNA, 22 bp, Homo sapiens
agcccagcctgattctacaccc

SEQ ID NO: 9149548 - DNA, 22 bp, Homo sapiens
acagagagggagtgataaatcc

SEQ ID NO: 9149549 - DNA, 22 bp, Homo sapiens
agcccagcttccttctgtctct

SEQ ID NO: 9149550 - DNA, 22 bp, Homo sapiens
agcccagctgctatgtacctgg

SEQ ID NO: 9149551 - DNA, 22 bp, Homo sapiens
acagagcagtaagaacacagct

SEQ ID NO: 9149552 - DNA, 17 bp, Homo sapiens
acagagcacatcaagat

SEQ ID NO: 9149553 - DNA, 22 bp, Homo sapiens
agccatcctcccacctcagcct

SEQ ID NO: 9149554 - DNA, 22 bp, Homo sapiens
agccatcctactacctcagcat

SEQ ID NO: 9149555 - DNA, 22 bp, Homo sapiens
agccacagtctgatgcctgaga

SEQ ID NO: 9149556 - DNA, 22 bp, Homo sapiens
agccacagtcaacctgtccata

SEQ ID NO: 9149557 - DNA, 22 bp, Homo sapiens
agccacaggtgttggccagtgt

SEQ ID NO: 9149558 - DNA, 22 bp, Homo sapiens
agccacagtcaacctgtccata

SEQ ID NO: 9149559 - DNA, 22 bp, Homo sapiens
agccatgaccttgcagacctgc

SEQ ID NO: 9149560 - DNA, 22 bp, Homo sapiens
agccatgcaccttactcttgct

SEQ ID NO: 9149561 - DNA, 22 bp, Homo sapiens
agccatggcgccactagaggga

SEQ ID NO: 9149562 - DNA, 22 bp, Homo sapiens
agccatttcatacacctgcagc

SEQ ID NO: 9149563 - DNA, 22 bp, Homo sapiens
agctctgggggaaagtctgctc

SEQ ID NO: 9149564 - DNA, 22 bp, Homo sapiens
agctctgggggaaagtctgctc

SEQ ID NO: 9149565 - DNA, 22 bp, Homo sapiens
agctctggggtagggcccaaca

SEQ ID NO: 9149566 - DNA, 22 bp, Homo sapiens
agctctccacacataggactag

SEQ ID NO: 9149567 - DNA, 22 bp, Homo sapiens
agctctccacacataggactag

SEQ ID NO: 9149568 - DNA, 22 bp, Homo sapiens
agctctccatctatctgtgatg

SEQ ID NO: 9149569 - DNA, 22 bp, Homo sapiens
agctctccatctatctgtgatg

SEQ ID NO: 9149570 - DNA, 18 bp, Homo sapiens
agctctggggagatgggc

SEQ ID NO: 9149571 - DNA, 18 bp, Homo sapiens
agctctggggagatgggc

SEQ ID NO: 9149572 - DNA, 22 bp, Homo sapiens
agctctgggctgacatgctccc

SEQ ID NO: 9149573 - DNA, 22 bp, Homo sapiens
agctctgggctgacatgctccc

SEQ ID NO: 9149574 - DNA, 22 bp, Homo sapiens
agctcctgtgtgcccacctgct

SEQ ID NO: 9149575 - DNA, 19 bp, Homo sapiens
agctcctgttcagcagctc

SEQ ID NO: 9149576 - DNA, 19 bp, Homo sapiens
agctcctgttcagcagctc

SEQ ID NO: 9149577 - DNA, 19 bp, Homo sapiens
agctcctgttcagcagctc

SEQ ID NO: 9149578 - DNA, 22 bp, Homo sapiens
agctccttgaaggcagtagctg

SEQ ID NO: 9149579 - DNA, 22 bp, Homo sapiens
agctcctgttctgagagcagga

SEQ ID NO: 9149580 - DNA, 22 bp, Homo sapiens
agctccttgaagggctctggga

SEQ ID NO: 9149581 - DNA, 23 bp, Homo sapiens
agctcctttgaaagtatgttttt

SEQ ID NO: 9149582 - DNA, 22 bp, Homo sapiens
agctccttgcaggttgccttgg

SEQ ID NO: 9149583 - DNA, 22 bp, Homo sapiens
acagcaggagccttcatatgct

SEQ ID NO: 9149584 - DNA, 22 bp, Homo sapiens
acagcaggagccttcatatgct

SEQ ID NO: 9149585 - DNA, 22 bp, Homo sapiens
acagcagctaaaggtgtctcct

SEQ ID NO: 9149586 - DNA, 22 bp, Homo sapiens
acagcaggaattaacatataag

SEQ ID NO: 9149587 - DNA, 22 bp, Homo sapiens
acagcaggaattaacatataag

SEQ ID NO: 9149588 - DNA, 22 bp, Homo sapiens
agctatttcaggaaatttgtga

SEQ ID NO: 9149589 - DNA, 22 bp, Homo sapiens
agctcctgtgtgaagcctccct

SEQ ID NO: 9149590 - DNA, 22 bp, Homo sapiens
agctcctgtgtgcccacctgct

SEQ ID NO: 9149591 - DNA, 22 bp, Homo sapiens
acagcaggcatgaagaaatgtt

SEQ ID NO: 9149592 - DNA, 22 bp, Homo sapiens
acagcaggatttggcgatgttg

SEQ ID NO: 9149593 - DNA, 22 bp, Homo sapiens
acagcaggcacacaaggataga

SEQ ID NO: 9149594 - DNA, 22 bp, Homo sapiens
acagcaggcacacaaggataga

SEQ ID NO: 9149595 - DNA, 23 bp, Homo sapiens
acagcaagaggaccagatgtgag

SEQ ID NO: 9149596 - DNA, 22 bp, Homo sapiens
acagcaatcaatatggcattct

SEQ ID NO: 9149597 - DNA, 22 bp, Homo sapiens
agctaggggaccaaggtggccc

SEQ ID NO: 9149598 - DNA, 19 bp, Homo sapiens
agctagtgctcagctgtca

SEQ ID NO: 9149599 - DNA, 22 bp, Homo sapiens
agctaggataagcagagactgg

SEQ ID NO: 9149600 - DNA, 22 bp, Homo sapiens
agcctgagtgcttaggactgtt

SEQ ID NO: 9149601 - DNA, 21 bp, Homo sapiens
agcctgcaatgtaggtaccgg

SEQ ID NO: 9149602 - DNA, 22 bp, Homo sapiens
agcctgcaggatgggcagcacc

SEQ ID NO: 9149603 - DNA, 22 bp, Homo sapiens
agcctgccaggcgctgcctgga

SEQ ID NO: 9149604 - DNA, 22 bp, Homo sapiens
agcctgcgatcccacctggcct

SEQ ID NO: 9149605 - DNA, 22 bp, Homo sapiens
agcctgcgatcccacctggcct

SEQ ID NO: 9149606 - DNA, 22 bp, Homo sapiens
acagattgcttagaattgaatg

SEQ ID NO: 9149607 - DNA, 22 bp, Homo sapiens
acagcaaatggttttctgtctg

SEQ ID NO: 9149608 - DNA, 22 bp, Homo sapiens
aataagagcactggctttggag

SEQ ID NO: 9149609 - DNA, 22 bp, Homo sapiens
aataagatcctgaagatatgtt

SEQ ID NO: 9149610 - DNA, 22 bp, Homo sapiens
aagtttctattattacattcgt

SEQ ID NO: 9149611 - DNA, 22 bp, Homo sapiens
aagtttctattattacattcgt

SEQ ID NO: 9149612 - DNA, 22 bp, Homo sapiens
aataacttaagaaatttcccca

SEQ ID NO: 9149613 - DNA, 22 bp, Homo sapiens
aagtttattaattgacttgtgc

SEQ ID NO: 9149614 - DNA, 22 bp, Homo sapiens
aagtttattaattgacttgtgc

SEQ ID NO: 9149615 - DNA, 22 bp, Homo sapiens
aagtttcaaatataaaattaca

SEQ ID NO: 9149616 - DNA, 22 bp, Homo sapiens
aagtttatgttggtaagatatc

SEQ ID NO: 9149617 - DNA, 22 bp, Homo sapiens
aagtttatgttggtaagatatc

SEQ ID NO: 9149618 - DNA, 22 bp, Homo sapiens
aagtttatgttggtaagatatc

SEQ ID NO: 9149619 - DNA, 22 bp, Homo sapiens
aagtttatgttggtaagatatc

SEQ ID NO: 9149620 - DNA, 22 bp, Homo sapiens
aagtttctacatctccatcata

SEQ ID NO: 9149621 - DNA, 22 bp, Homo sapiens
aagtttctacatctccatcata

SEQ ID NO: 9149622 - DNA, 22 bp, Homo sapiens
aagtttcatgacttggttatta

SEQ ID NO: 9149623 - DNA, 20 bp, Homo sapiens
aagttggctcctcctagcaa

SEQ ID NO: 9149624 - DNA, 22 bp, Homo sapiens
aagtttaacttgaattctttct

SEQ ID NO: 9149625 - DNA, 22 bp, Homo sapiens
aagtttaacttgaattctttct

SEQ ID NO: 9149626 - DNA, 22 bp, Homo sapiens
aagtttaaggtggaagtggtgg

SEQ ID NO: 9149627 - DNA, 22 bp, Homo sapiens
aagtttatgttctttgaaggca

SEQ ID NO: 9149628 - DNA, 22 bp, Homo sapiens
aagtttatgttctttgaaggca

SEQ ID NO: 9149629 - DNA, 22 bp, Homo sapiens
aagtttatccctctcacagtta

SEQ ID NO: 9149630 - DNA, 22 bp, Homo sapiens
aagtttatctttgctgggtact

SEQ ID NO: 9149631 - DNA, 22 bp, Homo sapiens
aagtttatctttgctgggtact

SEQ ID NO: 9149632 - DNA, 22 bp, Homo sapiens
aagtttatgaagtctaagccaa

SEQ ID NO: 9149633 - DNA, 22 bp, Homo sapiens
aagtttatccctctcacagtta

SEQ ID NO: 9149634 - DNA, 22 bp, Homo sapiens
aagtttactgtccctggaaact

SEQ ID NO: 9149635 - DNA, 22 bp, Homo sapiens
aataattagtgggacagagaac

SEQ ID NO: 9149636 - DNA, 22 bp, Homo sapiens
aataattagtgggacagagaac

SEQ ID NO: 9149637 - DNA, 22 bp, Homo sapiens
aataattagtgggacagagaac

SEQ ID NO: 9149638 - DNA, 19 bp, Homo sapiens
aataatgttcatgagattg

SEQ ID NO: 9149639 - DNA, 22 bp, Homo sapiens
aataatgtgatagataagggaa

SEQ ID NO: 9149640 - DNA, 22 bp, Homo sapiens
aataatttccagccaactggaa

SEQ ID NO: 9149641 - DNA, 22 bp, Homo sapiens
aataatttccagccaactggaa

SEQ ID NO: 9149642 - DNA, 22 bp, Homo sapiens
aataatttccagccaactggaa

SEQ ID NO: 9149643 - DNA, 22 bp, Homo sapiens
aataattttgagagcctggaaa

SEQ ID NO: 9149644 - DNA, 22 bp, Homo sapiens
aataattttgagagcctggaaa

SEQ ID NO: 9149645 - DNA, 22 bp, Homo sapiens
aataattttgagagcctggaaa

SEQ ID NO: 9149646 - DNA, 22 bp, Homo sapiens
aataattttagctcagagttgt

SEQ ID NO: 9149647 - DNA, 22 bp, Homo sapiens
aataattttagctcagagttgt

SEQ ID NO: 9149648 - DNA, 22 bp, Homo sapiens
actgcctgtttggcatggcccc

SEQ ID NO: 9149649 - DNA, 22 bp, Homo sapiens
aataagattgacacaagtacct

SEQ ID NO: 9149650 - DNA, 22 bp, Homo sapiens
aataagatcttaaaggttatat

SEQ ID NO: 9149651 - DNA, 22 bp, Homo sapiens
aataagatgtgcttgagtttgg

SEQ ID NO: 9149652 - DNA, 22 bp, Homo sapiens
aataagattgacacaagtacct

SEQ ID NO: 9149653 - DNA, 22 bp, Homo sapiens
aataagattgacacaagtacct

SEQ ID NO: 9149654 - DNA, 22 bp, Homo sapiens
aataagattgacacaagtacct

SEQ ID NO: 9149655 - DNA, 22 bp, Homo sapiens
aataagattgacacaagtacct

SEQ ID NO: 9149656 - DNA, 22 bp, Homo sapiens
actgcgctccagcctgggtgac

SEQ ID NO: 9149657 - DNA, 22 bp, Homo sapiens
aataatattcctctgtgtgcgt

SEQ ID NO: 9149658 - DNA, 22 bp, Homo sapiens
actgccttcaaacagcgccacc

SEQ ID NO: 9149659 - DNA, 22 bp, Homo sapiens
aagtggactaatacaaggacta

SEQ ID NO: 9149660 - DNA, 22 bp, Homo sapiens
aagtggactaatacaaggacta

SEQ ID NO: 9149661 - DNA, 21 bp, Homo sapiens
aagtggagaagaaaagctgga

SEQ ID NO: 9149662 - DNA, 22 bp, Homo sapiens
aagtggagagccctggaggtct

SEQ ID NO: 9149663 - DNA, 21 bp, Homo sapiens
aagtggagaagaaaagctgga

SEQ ID NO: 9149664 - DNA, 22 bp, Homo sapiens
aagtggagccagggaaactgaa

SEQ ID NO: 9149665 - DNA, 22 bp, Homo sapiens
aagtggagctataggctcagat

SEQ ID NO: 9149666 - DNA, 22 bp, Homo sapiens
actaacatgttaatcaaaagaa

SEQ ID NO: 9149667 - DNA, 22 bp, Homo sapiens
actaacatttgtgtatgtcttg

SEQ ID NO: 9149668 - DNA, 20 bp, Homo sapiens
actaacatttgcaaggggct

SEQ ID NO: 9149669 - DNA, 22 bp, Homo sapiens
actaacatgttaatcaaaagaa

SEQ ID NO: 9149670 - DNA, 23 bp, Homo sapiens
actaaatggggctttgcttaaag

SEQ ID NO: 9149671 - DNA, 22 bp, Homo sapiens
actaaatggaatgattactata

SEQ ID NO: 9149672 - DNA, 22 bp, Homo sapiens
actaaatgctgcataaatgctt

SEQ ID NO: 9149673 - DNA, 22 bp, Homo sapiens
aagtggagccagggaaactgaa

SEQ ID NO: 9149674 - DNA, 22 bp, Homo sapiens
actaaatgaactattaatactt

SEQ ID NO: 9149675 - DNA, 22 bp, Homo sapiens
aagtgctttacaaatgtctgtt

SEQ ID NO: 9149676 - DNA, 21 bp, Homo sapiens
aagtcagtcagttctatacta

SEQ ID NO: 9149677 - DNA, 22 bp, Homo sapiens
aagtcagagcaactgagacatt

SEQ ID NO: 9149678 - DNA, 22 bp, Homo sapiens
aagtcagagatcaaggtgtcta

SEQ ID NO: 9149679 - DNA, 22 bp, Homo sapiens
aagtcagagatgccaaagatta

SEQ ID NO: 9149680 - DNA, 23 bp, Homo sapiens
aagtcagagccaagtcaatgaga

SEQ ID NO: 9149681 - DNA, 22 bp, Homo sapiens
aagtcagagcaactgagacatt

SEQ ID NO: 9149682 - DNA, 22 bp, Homo sapiens
aagtcagataggtgagtccaaa

SEQ ID NO: 9149683 - DNA, 22 bp, Homo sapiens
aagtcagcactccaggaagcca

SEQ ID NO: 9149684 - DNA, 22 bp, Homo sapiens
aagtcagacagctgagctgcct

SEQ ID NO: 9149685 - DNA, 22 bp, Homo sapiens
aagtcagaaaacagagcaatta

SEQ ID NO: 9149686 - DNA, 22 bp, Homo sapiens
aagtcagaaaacagagcaatta

SEQ ID NO: 9149687 - DNA, 22 bp, Homo sapiens
aagtcagaaaacagagcaatta

SEQ ID NO: 9149688 - DNA, 22 bp, Homo sapiens
actccaggttttttcactgaag

SEQ ID NO: 9149689 - DNA, 22 bp, Homo sapiens
actccaggttttctctcaagtt

SEQ ID NO: 9149690 - DNA, 22 bp, Homo sapiens
actccaggttttctctcaagtt

SEQ ID NO: 9149691 - DNA, 22 bp, Homo sapiens
actcccagaacatgctcttctt

SEQ ID NO: 9149692 - DNA, 22 bp, Homo sapiens
actcccagctcagggctttccc

SEQ ID NO: 9149693 - DNA, 22 bp, Homo sapiens
actcccaggttgcctggcaggc

SEQ ID NO: 9149694 - DNA, 22 bp, Homo sapiens
actcccaggttgcctggcaggc

SEQ ID NO: 9149695 - DNA, 22 bp, Homo sapiens
actcccaggttgcctggcaggc

SEQ ID NO: 9149696 - DNA, 18 bp, Homo sapiens
actccccacaggctctgt

SEQ ID NO: 9149697 - DNA, 22 bp, Homo sapiens
actccccagactgccatgctgg

SEQ ID NO: 9149698 - DNA, 22 bp, Homo sapiens
actccaggtaggcacattgaca

SEQ ID NO: 9149699 - DNA, 20 bp, Homo sapiens
actccaggtggcatgaggac

SEQ ID NO: 9149700 - DNA, 22 bp, Homo sapiens
actccaggtgtgttggactcta

SEQ ID NO: 9149701 - DNA, 22 bp, Homo sapiens
actccaggtgtgttggactcta

SEQ ID NO: 9149702 - DNA, 22 bp, Homo sapiens
aagttatttcctcgtgactgaa

SEQ ID NO: 9149703 - DNA, 22 bp, Homo sapiens
aagttagagattccatcatgct

SEQ ID NO: 9149704 - DNA, 22 bp, Homo sapiens
aagttaccttcttcccagtgat

SEQ ID NO: 9149705 - DNA, 22 bp, Homo sapiens
aagtgttttgtaaacagaaaag

SEQ ID NO: 9149706 - DNA, 22 bp, Homo sapiens
aagtgttttgtaaacagaaaag

SEQ ID NO: 9149707 - DNA, 22 bp, Homo sapiens
aagttatatcatctcattgacg

SEQ ID NO: 9149708 - DNA, 20 bp, Homo sapiens
aagtgttttgacttctgacc

SEQ ID NO: 9149709 - DNA, 22 bp, Homo sapiens
aagtgttttggcttctgtacac

SEQ ID NO: 9149710 - DNA, 22 bp, Homo sapiens
actaacttgctgagtgaccatg

SEQ ID NO: 9149711 - DNA, 20 bp, Homo sapiens
actaatcatccagtcacagt

SEQ ID NO: 9149712 - DNA, 22 bp, Homo sapiens
aatgagcttctataatcttgtc

SEQ ID NO: 9149713 - DNA, 21 bp, Homo sapiens
aatgaggcaaggaggaggata

SEQ ID NO: 9149714 - DNA, 22 bp, Homo sapiens
aatgagctgctgctgttccacc

SEQ ID NO: 9149715 - DNA, 20 bp, Homo sapiens
aatgaggcaatggagggcat

SEQ ID NO: 9149716 - DNA, 22 bp, Homo sapiens
aatgagggagtggggcttgtcc

SEQ ID NO: 9149717 - DNA, 22 bp, Homo sapiens
aatgagggggatgggaaagtgt

SEQ ID NO: 9149718 - DNA, 22 bp, Homo sapiens
aatgaggtgaggaaggcctcag

SEQ ID NO: 9149719 - DNA, 22 bp, Homo sapiens
aatgagatggcaatgacttaaa

SEQ ID NO: 9149720 - DNA, 23 bp, Homo sapiens
aatgagagaccatgtggagcaga

SEQ ID NO: 9149721 - DNA, 22 bp, Homo sapiens
aatgagatggaggactcttaat

SEQ ID NO: 9149722 - DNA, 22 bp, Homo sapiens
aatgagattccaatagctcctg

SEQ ID NO: 9149723 - DNA, 18 bp, Homo sapiens
agaaggagctatgggcag

SEQ ID NO: 9149724 - DNA, 22 bp, Homo sapiens
aatgagttctgacacttcacga

SEQ ID NO: 9149725 - DNA, 21 bp, Homo sapiens
agaagggattgtggtaaagat

SEQ ID NO: 9149726 - DNA, 21 bp, Homo sapiens
agaagggattgtggtaaagat

SEQ ID NO: 9149727 - DNA, 22 bp, Homo sapiens
agaagggagagaaagttggtta

SEQ ID NO: 9149728 - DNA, 22 bp, Homo sapiens
agaagggagagaaagttggtta

SEQ ID NO: 9149729 - DNA, 22 bp, Homo sapiens
agaagggaactcagagatgatt

SEQ ID NO: 9149730 - DNA, 22 bp, Homo sapiens
agaagggaactcagagatgatt

SEQ ID NO: 9149731 - DNA, 22 bp, Homo sapiens
aatgactgtagtcatattaagg

SEQ ID NO: 9149732 - DNA, 22 bp, Homo sapiens
aatgagaatgtaagtgaagaga

SEQ ID NO: 9149733 - DNA, 22 bp, Homo sapiens
aatgagagaagacaggcaagtg

SEQ ID NO: 9149734 - DNA, 22 bp, Homo sapiens
aatgagatcagagataactcaa

SEQ ID NO: 9149735 - DNA, 23 bp, Homo sapiens
aatgagagaccatgtggagcaga

SEQ ID NO: 9149736 - DNA, 22 bp, Homo sapiens
aatgagagaagacaggcaagtg

SEQ ID NO: 9149737 - DNA, 22 bp, Homo sapiens
aatgagaatgtaagtgaagaga

SEQ ID NO: 9149738 - DNA, 22 bp, Homo sapiens
aatgacctcagagcacccagaa

SEQ ID NO: 9149739 - DNA, 22 bp, Homo sapiens
aatgacctcagagcacccagaa

SEQ ID NO: 9149740 - DNA, 22 bp, Homo sapiens
aatgacctgggtgtcatttcat

SEQ ID NO: 9149741 - DNA, 22 bp, Homo sapiens
aatgactgaagcaattgcagtg

SEQ ID NO: 9149742 - DNA, 22 bp, Homo sapiens
agaaatactgcctaagactgta

SEQ ID NO: 9149743 - DNA, 22 bp, Homo sapiens
agaaatactgcctaagactgta

SEQ ID NO: 9149744 - DNA, 22 bp, Homo sapiens
agaaatactgtgagagcagcct

SEQ ID NO: 9149745 - DNA, 22 bp, Homo sapiens
agaaatacttaatctttgcagg

SEQ ID NO: 9149746 - DNA, 20 bp, Homo sapiens
agaaatactttggtataatg

SEQ ID NO: 9149747 - DNA, 22 bp, Homo sapiens
agaaataagagctttccttggg

SEQ ID NO: 9149748 - DNA, 22 bp, Homo sapiens
agaaataagagctttccttggg

SEQ ID NO: 9149749 - DNA, 22 bp, Homo sapiens
agaaataatcagcttaggggca

SEQ ID NO: 9149750 - DNA, 22 bp, Homo sapiens
agaaataagagctttccttggg

SEQ ID NO: 9149751 - DNA, 22 bp, Homo sapiens
agaaatacaaagtactaagata

SEQ ID NO: 9149752 - DNA, 22 bp, Homo sapiens
agaaatacaaagtactaagata

SEQ ID NO: 9149753 - DNA, 21 bp, Homo sapiens
agaaatacagcagggatgatc

SEQ ID NO: 9149754 - DNA, 22 bp, Homo sapiens
agaaatacaaagtactaagata

SEQ ID NO: 9149755 - DNA, 22 bp, Homo sapiens
agaaatactaggaatattcata

SEQ ID NO: 9149756 - DNA, 22 bp, Homo sapiens
agaaatactaggaatattcata

SEQ ID NO: 9149757 - DNA, 22 bp, Homo sapiens
agaaatactaggaatattcata

SEQ ID NO: 9149758 - DNA, 22 bp, Homo sapiens
agaaatacattctctggtgtgt

SEQ ID NO: 9149759 - DNA, 20 bp, Homo sapiens
agaaatacatgcatgcatga

SEQ ID NO: 9149760 - DNA, 20 bp, Homo sapiens
agaaataccacatttggcaa

SEQ ID NO: 9149761 - DNA, 20 bp, Homo sapiens
agaaataccacatttggcaa

SEQ ID NO: 9149762 - DNA, 18 bp, Homo sapiens
agaaataccagtattgga

SEQ ID NO: 9149763 - DNA, 22 bp, Homo sapiens
aatgaacatggacaagttaata

SEQ ID NO: 9149764 - DNA, 22 bp, Homo sapiens
aatgaacatgggagtactaata

SEQ ID NO: 9149765 - DNA, 22 bp, Homo sapiens
aatgaacggtgtccatctgttt

SEQ ID NO: 9149766 - DNA, 22 bp, Homo sapiens
aatgaacatggacaagttaata

SEQ ID NO: 9149767 - DNA, 22 bp, Homo sapiens
aatgaacagatacacataggca

SEQ ID NO: 9149768 - DNA, 22 bp, Homo sapiens
aatgaacaggtgaatgtcagat

SEQ ID NO: 9149769 - DNA, 22 bp, Homo sapiens
agaaaacattacataggtgtgt

SEQ ID NO: 9149770 - DNA, 22 bp, Homo sapiens
agaaaacattacataggtgtgt

SEQ ID NO: 9149771 - DNA, 22 bp, Homo sapiens
agaaaactgcagagtagcctca

SEQ ID NO: 9149772 - DNA, 22 bp, Homo sapiens
aatgaaactagtagaatctttg

SEQ ID NO: 9149773 - DNA, 22 bp, Homo sapiens
aatgaaactagtagaatctttg

SEQ ID NO: 9149774 - DNA, 22 bp, Homo sapiens
agaaaacataggagacaggaaa

SEQ ID NO: 9149775 - DNA, 22 bp, Homo sapiens
agaaaacataggagacaggaaa

SEQ ID NO: 9149776 - DNA, 22 bp, Homo sapiens
agaaaacataggagacaggaaa

SEQ ID NO: 9149777 - DNA, 22 bp, Homo sapiens
agaaaacataggagacaggaaa

SEQ ID NO: 9149778 - DNA, 22 bp, Homo sapiens
agaaaacagaaagtcattggtg

SEQ ID NO: 9149779 - DNA, 22 bp, Homo sapiens
agaaaacagaaagtcattggtg

SEQ ID NO: 9149780 - DNA, 22 bp, Homo sapiens
agaaaacactgccccctctctc

SEQ ID NO: 9149781 - DNA, 22 bp, Homo sapiens
agaaaaatcttggcgcttgtct

SEQ ID NO: 9149782 - DNA, 22 bp, Homo sapiens
agaaaaatcttggcgcttgtct

SEQ ID NO: 9149783 - DNA, 22 bp, Homo sapiens
aatcccattgtggaattaagga

SEQ ID NO: 9149784 - DNA, 22 bp, Homo sapiens
aatcccttcccttctctgggac

SEQ ID NO: 9149785 - DNA, 20 bp, Homo sapiens
aatcccttctctggactctt

SEQ ID NO: 9149786 - DNA, 22 bp, Homo sapiens
aatccctttttcatttaataga

SEQ ID NO: 9149787 - DNA, 22 bp, Homo sapiens
aatccgattcgtgtacattaat

SEQ ID NO: 9149788 - DNA, 22 bp, Homo sapiens
aatcctcacattggcccagcca

SEQ ID NO: 9149789 - DNA, 22 bp, Homo sapiens
aatccatttactctttacaaga

SEQ ID NO: 9149790 - DNA, 22 bp, Homo sapiens
aatccatctcaatttattccta

SEQ ID NO: 9149791 - DNA, 22 bp, Homo sapiens
aatccattcagaaattgggaat

SEQ ID NO: 9149792 - DNA, 22 bp, Homo sapiens
acttgtttgaatctctctagag

SEQ ID NO: 9149793 - DNA, 22 bp, Homo sapiens
aatccagggtgtggcctttcca

SEQ ID NO: 9149794 - DNA, 19 bp, Homo sapiens
aatccaggataagcccctt

SEQ ID NO: 9149795 - DNA, 22 bp, Homo sapiens
aatcaaagaatgggctagttgg

SEQ ID NO: 9149796 - DNA, 22 bp, Homo sapiens
aatcaaagaatgggctagttgg

SEQ ID NO: 9149797 - DNA, 22 bp, Homo sapiens
aatcaacaggatgtgcattgta

SEQ ID NO: 9149798 - DNA, 22 bp, Homo sapiens
aatattttaggctttccaggct

SEQ ID NO: 9149799 - DNA, 22 bp, Homo sapiens
aatcaagagctgactatatttt

SEQ ID NO: 9149800 - DNA, 22 bp, Homo sapiens
acttggttggtctcaccctgtt

SEQ ID NO: 9149801 - DNA, 22 bp, Homo sapiens
acttggttgttttaacttggca

SEQ ID NO: 9149802 - DNA, 22 bp, Homo sapiens
acttggttggtctcaccctgtt

SEQ ID NO: 9149803 - DNA, 22 bp, Homo sapiens
acttgttagatataaagtttgt

SEQ ID NO: 9149804 - DNA, 22 bp, Homo sapiens
acttgtctggcagatcatgcaa

SEQ ID NO: 9149805 - DNA, 22 bp, Homo sapiens
aatacaatcaaattcactagca

SEQ ID NO: 9149806 - DNA, 22 bp, Homo sapiens
aatacaatcaaattcactagca

SEQ ID NO: 9149807 - DNA, 22 bp, Homo sapiens
aatacaatcaaattcactagca

SEQ ID NO: 9149808 - DNA, 22 bp, Homo sapiens
aatacaatcaaattcactagca

SEQ ID NO: 9149809 - DNA, 22 bp, Homo sapiens
aatacaatcaaattcactagca

SEQ ID NO: 9149810 - DNA, 22 bp, Homo sapiens
aatacactattttgtgctcagt

SEQ ID NO: 9149811 - DNA, 22 bp, Homo sapiens
acttcctggattcccaagggct

SEQ ID NO: 9149812 - DNA, 21 bp, Homo sapiens
aatacagaaatgagtagttgc

SEQ ID NO: 9149813 - DNA, 22 bp, Homo sapiens
acttcttttcaaatcatgcaaa

SEQ ID NO: 9149814 - DNA, 19 bp, Homo sapiens
acttcttttcaacacagga

SEQ ID NO: 9149815 - DNA, 19 bp, Homo sapiens
acttcttttcaacacagga

SEQ ID NO: 9149816 - DNA, 22 bp, Homo sapiens
acttgaaaagctcagcagtagt

SEQ ID NO: 9149817 - DNA, 22 bp, Homo sapiens
acttgaaacatctttaaatgta

SEQ ID NO: 9149818 - DNA, 22 bp, Homo sapiens
acttgaaaccctgagatgataa

SEQ ID NO: 9149819 - DNA, 19 bp, Homo sapiens
acttgaaagcagagagttt

SEQ ID NO: 9149820 - DNA, 21 bp, Homo sapiens
acttgaagttggagtttctgt

SEQ ID NO: 9149821 - DNA, 22 bp, Homo sapiens
acttgaagcctggttatgtcaa

SEQ ID NO: 9149822 - DNA, 22 bp, Homo sapiens
acttgaattaggccttgagaga

SEQ ID NO: 9149823 - DNA, 22 bp, Homo sapiens
acttgaataggaaagccacaaa

SEQ ID NO: 9149824 - DNA, 22 bp, Homo sapiens
acttgaattatatttctagaga

SEQ ID NO: 9149825 - DNA, 22 bp, Homo sapiens
acttgaattaggccttgagaga

SEQ ID NO: 9149826 - DNA, 22 bp, Homo sapiens
acttgaattcaaagcgaaagca

SEQ ID NO: 9149827 - DNA, 22 bp, Homo sapiens
aatatatgactccactgcatga

SEQ ID NO: 9149828 - DNA, 21 bp, Homo sapiens
aatatatgcaatgctttctgc

SEQ ID NO: 9149829 - DNA, 22 bp, Homo sapiens
aatatatgaccaggaagttctg

SEQ ID NO: 9149830 - DNA, 22 bp, Homo sapiens
acttgacacttatattactcac

SEQ ID NO: 9149831 - DNA, 22 bp, Homo sapiens
acttgagaaaccaagtagaaag

SEQ ID NO: 9149832 - DNA, 22 bp, Homo sapiens
acttgataaacaattactgtta

SEQ ID NO: 9149833 - DNA, 22 bp, Homo sapiens
aatatatagaagtacccgttgt

SEQ ID NO: 9149834 - DNA, 22 bp, Homo sapiens
aatatatagaagtacccgttgt

SEQ ID NO: 9149835 - DNA, 23 bp, Homo sapiens
aatatcaaggtgatgttcccaga

SEQ ID NO: 9149836 - DNA, 22 bp, Homo sapiens
aatatcaacagtgtccttctaa

SEQ ID NO: 9149837 - DNA, 22 bp, Homo sapiens
aatatttgttagtgttttaatg

SEQ ID NO: 9149838 - DNA, 23 bp, Homo sapiens
aatattcctgccattaatgactc

SEQ ID NO: 9149839 - DNA, 22 bp, Homo sapiens
aatatcacaggaggagaccaag

SEQ ID NO: 9149840 - DNA, 23 bp, Homo sapiens
acagggctgtccagggctaggtc

SEQ ID NO: 9149841 - DNA, 23 bp, Homo sapiens
acagggctgtccagggctaggtc

SEQ ID NO: 9149842 - DNA, 22 bp, Homo sapiens
acagggctccttgggctgacac

SEQ ID NO: 9149843 - DNA, 22 bp, Homo sapiens
acagggctcctaggtggtgtgc

SEQ ID NO: 9149844 - DNA, 22 bp, Homo sapiens
acagggctggcgttgggacaga

SEQ ID NO: 9149845 - DNA, 22 bp, Homo sapiens
acagggctggggaaagaggcta

SEQ ID NO: 9149846 - DNA, 22 bp, Homo sapiens
acagggctgaggctggcttctt

SEQ ID NO: 9149847 - DNA, 19 bp, Homo sapiens
acagggctctggacgccat

SEQ ID NO: 9149848 - DNA, 23 bp, Homo sapiens
acagggctggcagctgcaagacc

SEQ ID NO: 9149849 - DNA, 22 bp, Homo sapiens
aaggaaagctgtggttctgaga

SEQ ID NO: 9149850 - DNA, 22 bp, Homo sapiens
aaggaaaggatgagcatgcatt

SEQ ID NO: 9149851 - DNA, 22 bp, Homo sapiens
aaggaaagctgtggttctgaga

SEQ ID NO: 9149852 - DNA, 22 bp, Homo sapiens
aaggaaagctgtggttctgaga

SEQ ID NO: 9149853 - DNA, 22 bp, Homo sapiens
aaggaaagattctctctctaga

SEQ ID NO: 9149854 - DNA, 22 bp, Homo sapiens
aaggaaagattctctctctaga

SEQ ID NO: 9149855 - DNA, 22 bp, Homo sapiens
aaggaaaggatgagcatgcatt

SEQ ID NO: 9149856 - DNA, 22 bp, Homo sapiens
aaggaaaggatgagcatgcatt

SEQ ID NO: 9149857 - DNA, 22 bp, Homo sapiens
aaggaaaggatgagcatgcatt

SEQ ID NO: 9149858 - DNA, 22 bp, Homo sapiens
aaggaaaggatgagcatgcatt

SEQ ID NO: 9149859 - DNA, 22 bp, Homo sapiens
aaggaaagacatataaatgact

SEQ ID NO: 9149860 - DNA, 22 bp, Homo sapiens
aaggaaagacatataaatgact

SEQ ID NO: 9149861 - DNA, 22 bp, Homo sapiens
aaggaaagacatataaatgact

SEQ ID NO: 9149862 - DNA, 22 bp, Homo sapiens
aagctttaagtgtcagtcagcc

SEQ ID NO: 9149863 - DNA, 22 bp, Homo sapiens
acaggcattgggatggaggttg

SEQ ID NO: 9149864 - DNA, 22 bp, Homo sapiens
aagctttaaggaattttatgga

SEQ ID NO: 9149865 - DNA, 22 bp, Homo sapiens
acaggcagtgggccagatttgt

SEQ ID NO: 9149866 - DNA, 22 bp, Homo sapiens
acaggcagtgggccagatttgt

SEQ ID NO: 9149867 - DNA, 22 bp, Homo sapiens
acaggccacagtggagtctctg

SEQ ID NO: 9149868 - DNA, 22 bp, Homo sapiens
acaggcattgggatggaggttg

SEQ ID NO: 9149869 - DNA, 22 bp, Homo sapiens
acaggcatatttctagattaca

SEQ ID NO: 9149870 - DNA, 22 bp, Homo sapiens
acaggcatccaggactaggcct

SEQ ID NO: 9149871 - DNA, 22 bp, Homo sapiens
aagctcttgaatgggatcaagg

SEQ ID NO: 9149872 - DNA, 21 bp, Homo sapiens
aagctcttctcagggtcacct

SEQ ID NO: 9149873 - DNA, 22 bp, Homo sapiens
aagctcttcctggagcgcccac

SEQ ID NO: 9149874 - DNA, 22 bp, Homo sapiens
aagccaggtgtttaggccagcg

SEQ ID NO: 9149875 - DNA, 18 bp, Homo sapiens
aagccaggtcaagataag

SEQ ID NO: 9149876 - DNA, 22 bp, Homo sapiens
aagccagggtttgtggatctat

SEQ ID NO: 9149877 - DNA, 22 bp, Homo sapiens
aagccagggtttgtggatctat

SEQ ID NO: 9149878 - DNA, 22 bp, Homo sapiens
aagccaggtgttgtggtaagag

SEQ ID NO: 9149879 - DNA, 22 bp, Homo sapiens
aagccaggtgttgtggtaagag

SEQ ID NO: 9149880 - DNA, 22 bp, Homo sapiens
aagccaggtgttgtggtaagag

SEQ ID NO: 9149881 - DNA, 22 bp, Homo sapiens
aagccaggccattctctggttc

SEQ ID NO: 9149882 - DNA, 22 bp, Homo sapiens
aagccaggcatgcttggacagt

SEQ ID NO: 9149883 - DNA, 22 bp, Homo sapiens
aagccaggccattctctggttc

SEQ ID NO: 9149884 - DNA, 22 bp, Homo sapiens
aagccaggctgcacttgctggg

SEQ ID NO: 9149885 - DNA, 22 bp, Homo sapiens
aagccagggatggaatgatagg

SEQ ID NO: 9149886 - DNA, 22 bp, Homo sapiens
aagccagggattcctgagggag

SEQ ID NO: 9149887 - DNA, 22 bp, Homo sapiens
aagccagggattcctgagggag

SEQ ID NO: 9149888 - DNA, 22 bp, Homo sapiens
aagccaggggctgcttaggaga

SEQ ID NO: 9149889 - DNA, 22 bp, Homo sapiens
aagccagggtcagaatttgggc

SEQ ID NO: 9149890 - DNA, 22 bp, Homo sapiens
aagccagggtcagaatttgggc

SEQ ID NO: 9149891 - DNA, 22 bp, Homo sapiens
aagccaggggttggtatgctat

SEQ ID NO: 9149892 - DNA, 23 bp, Homo sapiens
aagctgccagtctgaagcctggg

SEQ ID NO: 9149893 - DNA, 22 bp, Homo sapiens
acaggcaggttgagaaacattt

SEQ ID NO: 9149894 - DNA, 22 bp, Homo sapiens
aagctgccagctgagctgaggc

SEQ ID NO: 9149895 - DNA, 22 bp, Homo sapiens
aagctgccacacggtgagtact

SEQ ID NO: 9149896 - DNA, 22 bp, Homo sapiens
aaggcaggtattgatgccacag

SEQ ID NO: 9149897 - DNA, 22 bp, Homo sapiens
aaggcagcttcaccacagcatt

SEQ ID NO: 9149898 - DNA, 22 bp, Homo sapiens
aaggcagcttcaccacagcatt

SEQ ID NO: 9149899 - DNA, 22 bp, Homo sapiens
aaggcagcttcaccacagcatt

SEQ ID NO: 9149900 - DNA, 22 bp, Homo sapiens
aaggcagctcagctcatggcag

SEQ ID NO: 9149901 - DNA, 22 bp, Homo sapiens
aaggcagctttaaaaaagatgc

SEQ ID NO: 9149902 - DNA, 22 bp, Homo sapiens
aaggcaggatgggaaaagattt

SEQ ID NO: 9149903 - DNA, 22 bp, Homo sapiens
aaggcagggaaagtggattagg

SEQ ID NO: 9149904 - DNA, 22 bp, Homo sapiens
aaggcagcctctgccagccggg

SEQ ID NO: 9149905 - DNA, 22 bp, Homo sapiens
aaggcagcctctgccagccggg

SEQ ID NO: 9149906 - DNA, 22 bp, Homo sapiens
aaggcagccgtgtgactgcatg

SEQ ID NO: 9149907 - DNA, 22 bp, Homo sapiens
aaggcagccgtgtgactgcatg

SEQ ID NO: 9149908 - DNA, 22 bp, Homo sapiens
acagttgggctgtagcatgctt

SEQ ID NO: 9149909 - DNA, 22 bp, Homo sapiens
acagttggttaacacaaatatt

SEQ ID NO: 9149910 - DNA, 22 bp, Homo sapiens
aaggcagatataaagactagag

SEQ ID NO: 9149911 - DNA, 22 bp, Homo sapiens
acagttctgcctgtttgagaag

SEQ ID NO: 9149912 - DNA, 22 bp, Homo sapiens
acagttcttaaaacttgaatta

SEQ ID NO: 9149913 - DNA, 21 bp, Homo sapiens
acagtagctgacacacagttt

SEQ ID NO: 9149914 - DNA, 22 bp, Homo sapiens
acagtagatggctcagagacag

SEQ ID NO: 9149915 - DNA, 22 bp, Homo sapiens
acagtagaaacaggcaggcaga

SEQ ID NO: 9149916 - DNA, 22 bp, Homo sapiens
acagtataaactcctaaaagcc

SEQ ID NO: 9149917 - DNA, 22 bp, Homo sapiens
acagtataactccatgccaccc

SEQ ID NO: 9149918 - DNA, 22 bp, Homo sapiens
aaggaagaaatgaataggtgga

SEQ ID NO: 9149919 - DNA, 22 bp, Homo sapiens
aaggaacttgccacagaaaaga

SEQ ID NO: 9149920 - DNA, 22 bp, Homo sapiens
aaggaactgatgctcaaagaat

SEQ ID NO: 9149921 - DNA, 22 bp, Homo sapiens
aaggaagaagactctttactcc

SEQ ID NO: 9149922 - DNA, 22 bp, Homo sapiens
aaggaagaagactctttactcc

SEQ ID NO: 9149923 - DNA, 22 bp, Homo sapiens
aaggcacttgcccagagctgca

SEQ ID NO: 9149924 - DNA, 22 bp, Homo sapiens
aaggcacttgcccagagctgca

SEQ ID NO: 9149925 - DNA, 22 bp, Homo sapiens
aaggcagaaagggatgtgagtg

SEQ ID NO: 9149926 - DNA, 22 bp, Homo sapiens
aaggcagaaagggatgtgagtg

SEQ ID NO: 9149927 - DNA, 22 bp, Homo sapiens
aaggcacttttctaaagacctt

SEQ ID NO: 9149928 - DNA, 22 bp, Homo sapiens
aaggcacttttcctgagatgat

SEQ ID NO: 9149929 - DNA, 19 bp, Homo sapiens
aaggcagaagttggatatg

SEQ ID NO: 9149930 - DNA, 22 bp, Homo sapiens
aaggcagaaattcaactactgg

SEQ ID NO: 9149931 - DNA, 22 bp, Homo sapiens
accatgtcatttattggccaaa

SEQ ID NO: 9149932 - DNA, 22 bp, Homo sapiens
accatgtcatttattggccaaa

SEQ ID NO: 9149933 - DNA, 22 bp, Homo sapiens
accatgttggccaagctggtct

SEQ ID NO: 9149934 - DNA, 22 bp, Homo sapiens
accatgttggccaagctggtct

SEQ ID NO: 9149935 - DNA, 22 bp, Homo sapiens
accatgatctgctctggtgttt

SEQ ID NO: 9149936 - DNA, 22 bp, Homo sapiens
accatgatgccactatgcagaa

SEQ ID NO: 9149937 - DNA, 22 bp, Homo sapiens
accatgacgtcacagaggcttc

SEQ ID NO: 9149938 - DNA, 22 bp, Homo sapiens
accatgccagtggcagccagac

SEQ ID NO: 9149939 - DNA, 22 bp, Homo sapiens
accatgggtcagccacctcagc

SEQ ID NO: 9149940 - DNA, 22 bp, Homo sapiens
accatggaccatagttcctatt

SEQ ID NO: 9149941 - DNA, 22 bp, Homo sapiens
accatcttagtggccagctctc

SEQ ID NO: 9149942 - DNA, 22 bp, Homo sapiens
accatcttagcagactgcagtg

SEQ ID NO: 9149943 - DNA, 22 bp, Homo sapiens
accatcttagtggccagctctc

SEQ ID NO: 9149944 - DNA, 21 bp, Homo sapiens
accatcttccatgcattatat

SEQ ID NO: 9149945 - DNA, 22 bp, Homo sapiens
accatccaaactgctttctgtg

SEQ ID NO: 9149946 - DNA, 22 bp, Homo sapiens
accatcagtcattgtcagtggg

SEQ ID NO: 9149947 - DNA, 22 bp, Homo sapiens
accatcttaaggggacttctta

SEQ ID NO: 9149948 - DNA, 22 bp, Homo sapiens
accatctgagtagagagaagta

SEQ ID NO: 9149949 - DNA, 22 bp, Homo sapiens
aaggtgctcgttatggccagtg

SEQ ID NO: 9149950 - DNA, 22 bp, Homo sapiens
aaggtgctcacgggctcaggga

SEQ ID NO: 9149951 - DNA, 22 bp, Homo sapiens
aaggtctgtggccacctctggg

SEQ ID NO: 9149952 - DNA, 22 bp, Homo sapiens
aaggtctgttctaggtgagggt

SEQ ID NO: 9149953 - DNA, 18 bp, Homo sapiens
aaggtctgtctggtaggt

SEQ ID NO: 9149954 - DNA, 22 bp, Homo sapiens
aaggtatagagtttggaaaaat

SEQ ID NO: 9149955 - DNA, 22 bp, Homo sapiens
aaggtcttaagaactgctacat

SEQ ID NO: 9149956 - DNA, 22 bp, Homo sapiens
aaggtgaaactggaagctggcc

SEQ ID NO: 9149957 - DNA, 22 bp, Homo sapiens
aagggctgaaagaccttgggca

SEQ ID NO: 9149958 - DNA, 22 bp, Homo sapiens
aagggctgaatgaagggttgaa

SEQ ID NO: 9149959 - DNA, 22 bp, Homo sapiens
aagggctgagaagtggggctgg

SEQ ID NO: 9149960 - DNA, 22 bp, Homo sapiens
aagggctgaatgaagggttgaa

SEQ ID NO: 9149961 - DNA, 22 bp, Homo sapiens
aagggctgagcacagtgagcca

SEQ ID NO: 9149962 - DNA, 22 bp, Homo sapiens
aagggctgagaagtggggctgg

SEQ ID NO: 9149963 - DNA, 22 bp, Homo sapiens
aagggctgagcacagtgagcca

SEQ ID NO: 9149964 - DNA, 22 bp, Homo sapiens
aagggctgagcacagtgagcca

SEQ ID NO: 9149965 - DNA, 22 bp, Homo sapiens
acccccaaacatgatcatggtg

SEQ ID NO: 9149966 - DNA, 22 bp, Homo sapiens
accccaggtcatctgagagtcc

SEQ ID NO: 9149967 - DNA, 22 bp, Homo sapiens
accccaggtccaggttacagag

SEQ ID NO: 9149968 - DNA, 22 bp, Homo sapiens
accccaggtcatctgagagtcc

SEQ ID NO: 9149969 - DNA, 22 bp, Homo sapiens
accccaggtccaggttacagag

SEQ ID NO: 9149970 - DNA, 22 bp, Homo sapiens
accccaggtctccaggctctgg

SEQ ID NO: 9149971 - DNA, 22 bp, Homo sapiens
accccagggctgccagcctcct

SEQ ID NO: 9149972 - DNA, 22 bp, Homo sapiens
accccagggctgccagcctcct

SEQ ID NO: 9149973 - DNA, 22 bp, Homo sapiens
accccaggcccagggaagaggc

SEQ ID NO: 9149974 - DNA, 23 bp, Homo sapiens
accccaggcatcgcattcctctt

SEQ ID NO: 9149975 - DNA, 22 bp, Homo sapiens
aagtcacaagcatatatgcatt

SEQ ID NO: 9149976 - DNA, 22 bp, Homo sapiens
aagtcacacagttaacatgagg

SEQ ID NO: 9149977 - DNA, 22 bp, Homo sapiens
aagtcacaagcatatatgcatt

SEQ ID NO: 9149978 - DNA, 21 bp, Homo sapiens
aagtagaagggagaagggtta

SEQ ID NO: 9149979 - DNA, 22 bp, Homo sapiens
accccaggagctgtgcctagtc

SEQ ID NO: 9149980 - DNA, 22 bp, Homo sapiens
aagtactgtttaaattgcagaa

SEQ ID NO: 9149981 - DNA, 22 bp, Homo sapiens
aagtacatttttaacttacagc

SEQ ID NO: 9149982 - DNA, 22 bp, Homo sapiens
aagtacatttttaacttacagc

SEQ ID NO: 9149983 - DNA, 22 bp, Homo sapiens
aagtacatttttaacttacagc

SEQ ID NO: 9149984 - DNA, 22 bp, Homo sapiens
aagtaccctcgggcttaggagt

SEQ ID NO: 9149985 - DNA, 22 bp, Homo sapiens
aagtacatgctgtaatgattgg

SEQ ID NO: 9149986 - DNA, 22 bp, Homo sapiens
aagtacatgctgtaatgattgg

SEQ ID NO: 9149987 - DNA, 22 bp, Homo sapiens
aagtacatgctttattcagagt

SEQ ID NO: 9149988 - DNA, 22 bp, Homo sapiens
aagtacatgctttattcagagt

SEQ ID NO: 9149989 - DNA, 22 bp, Homo sapiens
aagtacatgttgctcaacagcc

SEQ ID NO: 9149990 - DNA, 22 bp, Homo sapiens
aagtacatgttgctcaacagcc

SEQ ID NO: 9149991 - DNA, 22 bp, Homo sapiens
aagtacatgttgttcaaaagcc

SEQ ID NO: 9149992 - DNA, 22 bp, Homo sapiens
aagtacatgttgttcaaaagcc

SEQ ID NO: 9149993 - DNA, 22 bp, Homo sapiens
aagtacatatatttatgattct

SEQ ID NO: 9149994 - DNA, 22 bp, Homo sapiens
aagtacatatatttatgattct

SEQ ID NO: 9149995 - DNA, 22 bp, Homo sapiens
aagtacatatatttatgattct

SEQ ID NO: 9149996 - DNA, 22 bp, Homo sapiens
aagtacataaaggaattagcca

SEQ ID NO: 9149997 - DNA, 22 bp, Homo sapiens
aagggccataacttgcagtgtt

SEQ ID NO: 9149998 - DNA, 22 bp, Homo sapiens
aagggccatgcctctactttct

SEQ ID NO: 9149999 - DNA, 22 bp, Homo sapiens
aagggcattgaggctgagagac

SEQ ID NO: 9150000 - DNA, 22 bp, Homo sapiens
aagggcatgagaagcttgaaag

SEQ ID NO: 9150001 - DNA, 22 bp, Homo sapiens
aagggcaggtgggcatttctgg

SEQ ID NO: 9150002 - DNA, 22 bp, Homo sapiens
aagggccttcactgtctaagca

SEQ ID NO: 9150003 - DNA, 22 bp, Homo sapiens
aagggcctttcaaaggtgatta

SEQ ID NO: 9150004 - DNA, 22 bp, Homo sapiens
aagggccttgccaggtgaagag

SEQ ID NO: 9150005 - DNA, 22 bp, Homo sapiens
aagggccttgccaggtgaagag

SEQ ID NO: 9150006 - DNA, 22 bp, Homo sapiens
aagggctccacttgaatcacac

SEQ ID NO: 9150007 - DNA, 22 bp, Homo sapiens
aagggaaggttccattatactt

SEQ ID NO: 9150008 - DNA, 22 bp, Homo sapiens
aagggaaatggccaggcagaga

SEQ ID NO: 9150009 - DNA, 22 bp, Homo sapiens
aagggaaatggccaggcagaga

SEQ ID NO: 9150010 - DNA, 22 bp, Homo sapiens
aagggaaatggccaggcagaga

SEQ ID NO: 9150011 - DNA, 22 bp, Homo sapiens
aagggaagtttgcatcctcact

SEQ ID NO: 9150012 - DNA, 22 bp, Homo sapiens
aagggaagtttgcatcctcact

SEQ ID NO: 9150013 - DNA, 22 bp, Homo sapiens
aagggaagtttgcatcctcact

SEQ ID NO: 9150014 - DNA, 22 bp, Homo sapiens
aagggaagtttgcatcctcact

SEQ ID NO: 9150015 - DNA, 22 bp, Homo sapiens
aagggcaggaaaagatggatgt

SEQ ID NO: 9150016 - DNA, 22 bp, Homo sapiens
aaggctttccttgggcggttac

SEQ ID NO: 9150017 - DNA, 22 bp, Homo sapiens
aaggcttttgacggttgcctct

SEQ ID NO: 9150018 - DNA, 22 bp, Homo sapiens
aaggcttcctggaggaggtgtc

SEQ ID NO: 9150019 - DNA, 22 bp, Homo sapiens
aaggcttaaataataatttctg

SEQ ID NO: 9150020 - DNA, 22 bp, Homo sapiens
aaggcttccactttgttgggtc

SEQ ID NO: 9150021 - DNA, 22 bp, Homo sapiens
aaggctgtttgagcactggagc

SEQ ID NO: 9150022 - DNA, 22 bp, Homo sapiens
aaggctgtttattagaaaaagt

SEQ ID NO: 9150023 - DNA, 22 bp, Homo sapiens
aaggctgttgtttcacaacaaa

SEQ ID NO: 9150024 - DNA, 22 bp, Homo sapiens
aaggctgtgtcagaagctccct

SEQ ID NO: 9150025 - DNA, 22 bp, Homo sapiens
aaggctgtttattagaaaaagt

SEQ ID NO: 9150026 - DNA, 22 bp, Homo sapiens
aaggctgtttgagcactggagc

SEQ ID NO: 9150027 - DNA, 22 bp, Homo sapiens
aaggctgtcttttcctcttccc

SEQ ID NO: 9150028 - DNA, 22 bp, Homo sapiens
aaggctgtgtcagaagctccct

SEQ ID NO: 9150029 - DNA, 22 bp, Homo sapiens
aaggctgtggttctatacagaa

SEQ ID NO: 9150030 - DNA, 22 bp, Homo sapiens
aaggcttctttgcaggctttag

SEQ ID NO: 9150031 - DNA, 22 bp, Homo sapiens
aaggctgggaaacatgcaggcc

SEQ ID NO: 9150032 - DNA, 22 bp, Homo sapiens
aaggctggtttccttgatgttt

SEQ ID NO: 9150033 - DNA, 22 bp, Homo sapiens
aaggctgtccaggagaaaatag

SEQ ID NO: 9150034 - DNA, 22 bp, Homo sapiens
acatgtgtggacatgaatctac

SEQ ID NO: 9150035 - DNA, 22 bp, Homo sapiens
aaggctgaaagaccttgaacct

SEQ ID NO: 9150036 - DNA, 22 bp, Homo sapiens
aaggctcttgagtggtgatagt

SEQ ID NO: 9150037 - DNA, 22 bp, Homo sapiens
aaggctgaggagggcctgcagg

SEQ ID NO: 9150038 - DNA, 22 bp, Homo sapiens
aaggctgaggctggagaattac

SEQ ID NO: 9150039 - DNA, 22 bp, Homo sapiens
aaggctgaggcagtgaggcaga

SEQ ID NO: 9150040 - DNA, 22 bp, Homo sapiens
aaggctgaggcagtgaggcaga

SEQ ID NO: 9150041 - DNA, 22 bp, Homo sapiens
aaggcatctggatggaggagga

SEQ ID NO: 9150042 - DNA, 22 bp, Homo sapiens
aaggcataggacaaatcagtga

SEQ ID NO: 9150043 - DNA, 22 bp, Homo sapiens
aaggcatacctgaatgtttgtg

SEQ ID NO: 9150044 - DNA, 22 bp, Homo sapiens
aaggcatagtctttaagttctg

SEQ ID NO: 9150045 - DNA, 22 bp, Homo sapiens
aaggcatatattctaaacagga

SEQ ID NO: 9150046 - DNA, 22 bp, Homo sapiens
aaggcatatgctgtgtacagtt

SEQ ID NO: 9150047 - DNA, 22 bp, Homo sapiens
aaggctgagggctgtacctggc

SEQ ID NO: 9150048 - DNA, 22 bp, Homo sapiens
aaggctgaggtagggcctaaaa

SEQ ID NO: 9150049 - DNA, 22 bp, Homo sapiens
aaggctgagtaaaacagagaac

SEQ ID NO: 9150050 - DNA, 22 bp, Homo sapiens
aaggctgattagactgatagct

SEQ ID NO: 9150051 - DNA, 22 bp, Homo sapiens
aaggctgagtaaaacagagaac

SEQ ID NO: 9150052 - DNA, 22 bp, Homo sapiens
aaggctgcttttaacatgcata

SEQ ID NO: 9150053 - DNA, 22 bp, Homo sapiens
acatgtgtacatatatatgtgc

SEQ ID NO: 9150054 - DNA, 16 bp, Homo sapiens
aaggctgattttccct

SEQ ID NO: 9150055 - DNA, 22 bp, Homo sapiens
accaggctctgccagtgtttac

SEQ ID NO: 9150056 - DNA, 22 bp, Homo sapiens
accaggctccccttggatcctg

SEQ ID NO: 9150057 - DNA, 22 bp, Homo sapiens
accaggctggagtgcagtggcg

SEQ ID NO: 9150058 - DNA, 22 bp, Homo sapiens
accaggcctggctgggcagcca

SEQ ID NO: 9150059 - DNA, 22 bp, Homo sapiens
acccagagcagagcttggcttc

SEQ ID NO: 9150060 - DNA, 22 bp, Homo sapiens
acccagagccagggtcaggagc

SEQ ID NO: 9150061 - DNA, 22 bp, Homo sapiens
accaggctggagtgcagtggcg

SEQ ID NO: 9150062 - DNA, 22 bp, Homo sapiens
accaggctgtgaagtgagacta

SEQ ID NO: 9150063 - DNA, 22 bp, Homo sapiens
acccagccacagcattgaggga

SEQ ID NO: 9150064 - DNA, 22 bp, Homo sapiens
acccagagccagggtcaggagc

SEQ ID NO: 9150065 - DNA, 22 bp, Homo sapiens
acccagcctacaaagctcacct

SEQ ID NO: 9150066 - DNA, 19 bp, Homo sapiens
acccagcccaggagtggca

SEQ ID NO: 9150067 - DNA, 22 bp, Homo sapiens
acccagccatgttcagttctct

SEQ ID NO: 9150068 - DNA, 22 bp, Homo sapiens
acccagcccagaatctggggcc

SEQ ID NO: 9150069 - DNA, 19 bp, Homo sapiens
acccagcccaggagtggca

SEQ ID NO: 9150070 - DNA, 22 bp, Homo sapiens
acccaggaaaacatggtgcaga

SEQ ID NO: 9150071 - DNA, 22 bp, Homo sapiens
acccaggacaaaataaccaggt

SEQ ID NO: 9150072 - DNA, 22 bp, Homo sapiens
acccaggacacagagatgaccc

SEQ ID NO: 9150073 - DNA, 22 bp, Homo sapiens
agggctgcccagtgtgagagct

SEQ ID NO: 9150074 - DNA, 22 bp, Homo sapiens
agggctgcccagtgtgagagct

SEQ ID NO: 9150075 - DNA, 22 bp, Homo sapiens
acccaggagacggaggtgcagt

SEQ ID NO: 9150076 - DNA, 22 bp, Homo sapiens
agggggctcagtgactgaagtg

SEQ ID NO: 9150077 - DNA, 22 bp, Homo sapiens
agggggctcctccggtgcttcc

SEQ ID NO: 9150078 - DNA, 22 bp, Homo sapiens
accctcatgaagctggcctgga

SEQ ID NO: 9150079 - DNA, 22 bp, Homo sapiens
accctccaggcgggcttgtgac

SEQ ID NO: 9150080 - DNA, 20 bp, Homo sapiens
accctccactgttcactgtg

SEQ ID NO: 9150081 - DNA, 22 bp, Homo sapiens
agggggctcagcatggatggag

SEQ ID NO: 9150082 - DNA, 22 bp, Homo sapiens
agggggctcagcaggctctgga

SEQ ID NO: 9150083 - DNA, 22 bp, Homo sapiens
agggggctcagcatggatggag

SEQ ID NO: 9150084 - DNA, 22 bp, Homo sapiens
agggggagtttcagttagaaag

SEQ ID NO: 9150085 - DNA, 22 bp, Homo sapiens
agggggcaggagagacctgctg

SEQ ID NO: 9150086 - DNA, 22 bp, Homo sapiens
acccaggctggcagaggctcct

SEQ ID NO: 9150087 - DNA, 22 bp, Homo sapiens
aggggcctggcactgagctggc

SEQ ID NO: 9150088 - DNA, 22 bp, Homo sapiens
agggctgctgaggaagccttgc

SEQ ID NO: 9150089 - DNA, 22 bp, Homo sapiens
agggctgctcctccttcaggcc

SEQ ID NO: 9150090 - DNA, 22 bp, Homo sapiens
agggctgctcctccttcaggcc

SEQ ID NO: 9150091 - DNA, 22 bp, Homo sapiens
agggctgcctgactccagagcc

SEQ ID NO: 9150092 - DNA, 21 bp, Homo sapiens
accagcaggagatcagaagga

SEQ ID NO: 9150093 - DNA, 21 bp, Homo sapiens
accagcaggagatcagaagga

SEQ ID NO: 9150094 - DNA, 22 bp, Homo sapiens
accagcagctgcgggccactgc

SEQ ID NO: 9150095 - DNA, 22 bp, Homo sapiens
accagcagctgccagagtggag

SEQ ID NO: 9150096 - DNA, 22 bp, Homo sapiens
accagcagagttgaggaggaca

SEQ ID NO: 9150097 - DNA, 22 bp, Homo sapiens
accagcagagttgaggaggaca

SEQ ID NO: 9150098 - DNA, 22 bp, Homo sapiens
accagcagcctagagcgttctt

SEQ ID NO: 9150099 - DNA, 22 bp, Homo sapiens
accagcagcctagagcgttctt

SEQ ID NO: 9150100 - DNA, 22 bp, Homo sapiens
accagagctcttcagcacagga

SEQ ID NO: 9150101 - DNA, 22 bp, Homo sapiens
accagagctcttcagcacagga

SEQ ID NO: 9150102 - DNA, 22 bp, Homo sapiens
accagagctggctctgagcacc

SEQ ID NO: 9150103 - DNA, 19 bp, Homo sapiens
acatttgtcaagagaaggt

SEQ ID NO: 9150104 - DNA, 22 bp, Homo sapiens
acatttgtaggacagaggaaga

SEQ ID NO: 9150105 - DNA, 22 bp, Homo sapiens
accagcagggctgggccaatgg

SEQ ID NO: 9150106 - DNA, 22 bp, Homo sapiens
accagcaggccaggggcactgc

SEQ ID NO: 9150107 - DNA, 22 bp, Homo sapiens
accagcaggccaggggcactgc

SEQ ID NO: 9150108 - DNA, 22 bp, Homo sapiens
accagcagttatgaggccagga

SEQ ID NO: 9150109 - DNA, 22 bp, Homo sapiens
accagcaggtggcagtatgtat

SEQ ID NO: 9150110 - DNA, 22 bp, Homo sapiens
accagcaggtggcagtatgtat

SEQ ID NO: 9150111 - DNA, 22 bp, Homo sapiens
accagcaggtggcagtatgtat

SEQ ID NO: 9150112 - DNA, 19 bp, Homo sapiens
accagcccactcccagttt

SEQ ID NO: 9150113 - DNA, 22 bp, Homo sapiens
aggcttggtgccaaggagcctg

SEQ ID NO: 9150114 - DNA, 19 bp, Homo sapiens
agggagaattccaagagga

SEQ ID NO: 9150115 - DNA, 22 bp, Homo sapiens
aggcttgtggattggagcgagt

SEQ ID NO: 9150116 - DNA, 22 bp, Homo sapiens
aggctttaagtggcctacagct

SEQ ID NO: 9150117 - DNA, 22 bp, Homo sapiens
aggctttaattatctacaggag

SEQ ID NO: 9150118 - DNA, 21 bp, Homo sapiens
aggctttacctctgggtaggt

SEQ ID NO: 9150119 - DNA, 22 bp, Homo sapiens
agggagagaagttatacaagat

SEQ ID NO: 9150120 - DNA, 18 bp, Homo sapiens
agggagagaccgcgggtc

SEQ ID NO: 9150121 - DNA, 18 bp, Homo sapiens
agggagagaccgcgggtc

SEQ ID NO: 9150122 - DNA, 22 bp, Homo sapiens
agggagagacatttccttcttg

SEQ ID NO: 9150123 - DNA, 16 bp, Homo sapiens
agggagagaggaacat

SEQ ID NO: 9150124 - DNA, 22 bp, Homo sapiens
agggagaggagggtcttgttga

SEQ ID NO: 9150125 - DNA, 22 bp, Homo sapiens
agggagaggagggtcttgttga

SEQ ID NO: 9150126 - DNA, 22 bp, Homo sapiens
accagccctcaggtcagatact

SEQ ID NO: 9150127 - DNA, 22 bp, Homo sapiens
accagccccaccgggactgcag

SEQ ID NO: 9150128 - DNA, 22 bp, Homo sapiens
agggcagcaatgcagctgctgc

SEQ ID NO: 9150129 - DNA, 22 bp, Homo sapiens
agggcagcaaagtttgacctca

SEQ ID NO: 9150130 - DNA, 21 bp, Homo sapiens
agggcagattagctgtaagag

SEQ ID NO: 9150131 - DNA, 22 bp, Homo sapiens
agggcacttcctctgggtccct

SEQ ID NO: 9150132 - DNA, 22 bp, Homo sapiens
agggcacttcctctgggtccct

SEQ ID NO: 9150133 - DNA, 22 bp, Homo sapiens
agggcacttgaggctgggcctg

SEQ ID NO: 9150134 - DNA, 22 bp, Homo sapiens
agggcagcagcggcccaggcct

SEQ ID NO: 9150135 - DNA, 22 bp, Homo sapiens
agggcagcagcccatggctctg

SEQ ID NO: 9150136 - DNA, 22 bp, Homo sapiens
agggcagcacagctgtgctcct

SEQ ID NO: 9150137 - DNA, 22 bp, Homo sapiens
agggcagcacaaggcatggact

SEQ ID NO: 9150138 - DNA, 22 bp, Homo sapiens
agggcagcacaaggcatggact

SEQ ID NO: 9150139 - DNA, 22 bp, Homo sapiens
agggcagcaatttggttcctgg

SEQ ID NO: 9150140 - DNA, 22 bp, Homo sapiens
agggcagcacaaggcatggact

SEQ ID NO: 9150141 - DNA, 22 bp, Homo sapiens
agggcagcaatgcagctgctgc

SEQ ID NO: 9150142 - DNA, 22 bp, Homo sapiens
agggcagcaatgcagctgctgc

SEQ ID NO: 9150143 - DNA, 22 bp, Homo sapiens
aggctgagctggtagtgagtac

SEQ ID NO: 9150144 - DNA, 22 bp, Homo sapiens
aggctgaggagggatgttgctt

SEQ ID NO: 9150145 - DNA, 18 bp, Homo sapiens
acatttctatgcttctgg

SEQ ID NO: 9150146 - DNA, 22 bp, Homo sapiens
aggctgagctggcccttgaaat

SEQ ID NO: 9150147 - DNA, 22 bp, Homo sapiens
acatttctttctattcagtagc

SEQ ID NO: 9150148 - DNA, 22 bp, Homo sapiens
acatttctttctattcagtagc

SEQ ID NO: 9150149 - DNA, 22 bp, Homo sapiens
acatttgattgatgaatcaaat

SEQ ID NO: 9150150 - DNA, 22 bp, Homo sapiens
acatttggcatcttgtaacact

SEQ ID NO: 9150151 - DNA, 18 bp, Homo sapiens
acatttggggagttaagt

SEQ ID NO: 9150152 - DNA, 23 bp, Homo sapiens
acatttggccaaaaattatttct

SEQ ID NO: 9150153 - DNA, 23 bp, Homo sapiens
acatttggccaaaaattatttct

SEQ ID NO: 9150154 - DNA, 23 bp, Homo sapiens
acatttggccaaaaattatttct

SEQ ID NO: 9150155 - DNA, 22 bp, Homo sapiens
acatttgaggatgttaagaatg

SEQ ID NO: 9150156 - DNA, 22 bp, Homo sapiens
acatttgataattataaagaca

SEQ ID NO: 9150157 - DNA, 22 bp, Homo sapiens
acatttgaaatgccatgtgagg

SEQ ID NO: 9150158 - DNA, 22 bp, Homo sapiens
acatttgaaatgccatgtgagg

SEQ ID NO: 9150159 - DNA, 22 bp, Homo sapiens
acatttcttttcatctctatat

SEQ ID NO: 9150160 - DNA, 22 bp, Homo sapiens
acatttgacatttagtatcagc

SEQ ID NO: 9150161 - DNA, 22 bp, Homo sapiens
acatttgaaatgccatgtgagg

SEQ ID NO: 9150162 - DNA, 22 bp, Homo sapiens
acatttgaaatgccatgtgagg

SEQ ID NO: 9150163 - DNA, 22 bp, Homo sapiens
acatttgaagacgacagtggaa

SEQ ID NO: 9150164 - DNA, 22 bp, Homo sapiens
acatttctagttgttcatctcc

SEQ ID NO: 9150165 - DNA, 22 bp, Homo sapiens
acatttctatagtgcatctgtt

SEQ ID NO: 9150166 - DNA, 22 bp, Homo sapiens
acatttcactgttcacagcagg

SEQ ID NO: 9150167 - DNA, 22 bp, Homo sapiens
acatttcatttgcagtatggat

SEQ ID NO: 9150168 - DNA, 22 bp, Homo sapiens
acattgtatacagacttagtca

SEQ ID NO: 9150169 - DNA, 22 bp, Homo sapiens
acattgtataatgattatcaca

SEQ ID NO: 9150170 - DNA, 22 bp, Homo sapiens
acattgctgcattctccttccc

SEQ ID NO: 9150171 - DNA, 22 bp, Homo sapiens
acattgtaaatacctttatcac

SEQ ID NO: 9150172 - DNA, 22 bp, Homo sapiens
acattgtaagcatattagctga

SEQ ID NO: 9150173 - DNA, 22 bp, Homo sapiens
acattgtagttgttctgcagca

SEQ ID NO: 9150174 - DNA, 22 bp, Homo sapiens
aggctgagactgtgcattagtg

SEQ ID NO: 9150175 - DNA, 22 bp, Homo sapiens
aggctgagaaagtgggaagatg

SEQ ID NO: 9150176 - DNA, 22 bp, Homo sapiens
aggctgaaaacgagatggcaat

SEQ ID NO: 9150177 - DNA, 22 bp, Homo sapiens
aggctctgtttgctgtggtacc

SEQ ID NO: 9150178 - DNA, 18 bp, Homo sapiens
aggcctgcccagcactgt

SEQ ID NO: 9150179 - DNA, 22 bp, Homo sapiens
aggcctgcagcaggagcaaacc

SEQ ID NO: 9150180 - DNA, 22 bp, Homo sapiens
aggcctgaggttcctgtgctca

SEQ ID NO: 9150181 - DNA, 22 bp, Homo sapiens
aggcctgcccgtgggacctgtg

SEQ ID NO: 9150182 - DNA, 22 bp, Homo sapiens
acatgtttaagtttgttatatg

SEQ ID NO: 9150183 - DNA, 22 bp, Homo sapiens
acatgtttggctctatgctata

SEQ ID NO: 9150184 - DNA, 22 bp, Homo sapiens
acatgtttggctctatgctata

SEQ ID NO: 9150185 - DNA, 22 bp, Homo sapiens
acatgtttaagtttaatgaaaa

SEQ ID NO: 9150186 - DNA, 22 bp, Homo sapiens
acatgtttaagtttaatgaaaa

SEQ ID NO: 9150187 - DNA, 22 bp, Homo sapiens
acatgtttaagtttgttatatg

SEQ ID NO: 9150188 - DNA, 22 bp, Homo sapiens
acatgtttacattaggtgatat

SEQ ID NO: 9150189 - DNA, 22 bp, Homo sapiens
aggcctgaaggaagatgagctg

SEQ ID NO: 9150190 - DNA, 22 bp, Homo sapiens
aggcctgaaggaagatgagctg

SEQ ID NO: 9150191 - DNA, 22 bp, Homo sapiens
aggcctgaggaccagataaatg

SEQ ID NO: 9150192 - DNA, 20 bp, Homo sapiens
aggcctgagagatgactggg

SEQ ID NO: 9150193 - DNA, 22 bp, Homo sapiens
aggcctctgttccccatgtttt

SEQ ID NO: 9150194 - DNA, 22 bp, Homo sapiens
aggcctcttcagggagcatgga

SEQ ID NO: 9150195 - DNA, 21 bp, Homo sapiens
aggcctcttcatggccatgat

SEQ ID NO: 9150196 - DNA, 22 bp, Homo sapiens
aggccagggccagattagccac

SEQ ID NO: 9150197 - DNA, 22 bp, Homo sapiens
aggccaggggtgagcacttctg

SEQ ID NO: 9150198 - DNA, 22 bp, Homo sapiens
aggccaggcctttctccattcc

SEQ ID NO: 9150199 - DNA, 22 bp, Homo sapiens
acatgcttttcccacaattata

SEQ ID NO: 9150200 - DNA, 22 bp, Homo sapiens
acatgttaaacatcatggaatg

SEQ ID NO: 9150201 - DNA, 22 bp, Homo sapiens
acatgtttaagtttaatgaaaa

SEQ ID NO: 9150202 - DNA, 22 bp, Homo sapiens
acatcagagggctcacatgatc

SEQ ID NO: 9150203 - DNA, 22 bp, Homo sapiens
acatcagtaactgtaaaacagg

SEQ ID NO: 9150204 - DNA, 22 bp, Homo sapiens
acatcacagtagttaagccaga

SEQ ID NO: 9150205 - DNA, 22 bp, Homo sapiens
acatcacagagcccagataaag

SEQ ID NO: 9150206 - DNA, 22 bp, Homo sapiens
acatcacacgccttccaggagg

SEQ ID NO: 9150207 - DNA, 22 bp, Homo sapiens
acatcagtgctcttggttcttg

SEQ ID NO: 9150208 - DNA, 22 bp, Homo sapiens
acatcagtcttttgcatacata

SEQ ID NO: 9150209 - DNA, 18 bp, Homo sapiens
acatcagttaccaggcca

SEQ ID NO: 9150210 - DNA, 22 bp, Homo sapiens
acatcagtccaccactgcagtt

SEQ ID NO: 9150211 - DNA, 22 bp, Homo sapiens
acatcagtaattaagtctcaag

SEQ ID NO: 9150212 - DNA, 21 bp, Homo sapiens
acatccagggtcctcactgcc

SEQ ID NO: 9150213 - DNA, 17 bp, Homo sapiens
acatccagcttatgtgg

SEQ ID NO: 9150214 - DNA, 22 bp, Homo sapiens
acatgctttgatgtattttgca

SEQ ID NO: 9150215 - DNA, 22 bp, Homo sapiens
acatgctttaacttattttgat

SEQ ID NO: 9150216 - DNA, 22 bp, Homo sapiens
acatgctttatcggattgacac

SEQ ID NO: 9150217 - DNA, 22 bp, Homo sapiens
acatgctgggcaatgttgtttt

SEQ ID NO: 9150218 - DNA, 22 bp, Homo sapiens
acatgcttcatattataaccaa

SEQ ID NO: 9150219 - DNA, 22 bp, Homo sapiens
acatgcttctgtttcaagaact

SEQ ID NO: 9150220 - DNA, 20 bp, Homo sapiens
acatgcttgagaggatgcag

SEQ ID NO: 9150221 - DNA, 22 bp, Homo sapiens
acatgcatacaagcacatgtag

SEQ ID NO: 9150222 - DNA, 22 bp, Homo sapiens
acatgcatacaagcacatgtag

SEQ ID NO: 9150223 - DNA, 22 bp, Homo sapiens
acatgcataagcctagccatca

SEQ ID NO: 9150224 - DNA, 22 bp, Homo sapiens
acatgcatacaagcacatgtag

SEQ ID NO: 9150225 - DNA, 22 bp, Homo sapiens
acatgctacacagagctcctcg

SEQ ID NO: 9150226 - DNA, 22 bp, Homo sapiens
aggatgaggctggcaggtcttg

SEQ ID NO: 9150227 - DNA, 21 bp, Homo sapiens
aggatgccgcaggcggagaag

SEQ ID NO: 9150228 - DNA, 22 bp, Homo sapiens
aggatgagattgctgtgttgta

SEQ ID NO: 9150229 - DNA, 22 bp, Homo sapiens
aggatgagattgctgtgttgta

SEQ ID NO: 9150230 - DNA, 20 bp, Homo sapiens
acagtttatccagttagcag

SEQ ID NO: 9150231 - DNA, 22 bp, Homo sapiens
acagtttatcgattcacctacc

SEQ ID NO: 9150232 - DNA, 22 bp, Homo sapiens
acagtttataaaaataatgagg

SEQ ID NO: 9150233 - DNA, 22 bp, Homo sapiens
acagtttaggatgagagaacac

SEQ ID NO: 9150234 - DNA, 22 bp, Homo sapiens
acagtttaggatgagagaacac

SEQ ID NO: 9150235 - DNA, 22 bp, Homo sapiens
acagtttataaaaataatgagg

SEQ ID NO: 9150236 - DNA, 22 bp, Homo sapiens
acagttcccgtcttgcacagct

SEQ ID NO: 9150237 - DNA, 22 bp, Homo sapiens
acagtttagaatgccacatagt

SEQ ID NO: 9150238 - DNA, 21 bp, Homo sapiens
acagtttattagagtaagtgc

SEQ ID NO: 9150239 - DNA, 22 bp, Homo sapiens
acagtttatcgattcacctacc

SEQ ID NO: 9150240 - DNA, 17 bp, Homo sapiens
acagtttgattttagca

SEQ ID NO: 9150241 - DNA, 22 bp, Homo sapiens
acagtttgagaaccactagcct

SEQ ID NO: 9150242 - DNA, 22 bp, Homo sapiens
acagtttgaataatttagatag

SEQ ID NO: 9150243 - DNA, 22 bp, Homo sapiens
acagtttattgcacaggtaacc

SEQ ID NO: 9150244 - DNA, 22 bp, Homo sapiens
acagtttgaagtttagaagtct

SEQ ID NO: 9150245 - DNA, 22 bp, Homo sapiens
aggcactgcttctaagtaggaa

SEQ ID NO: 9150246 - DNA, 22 bp, Homo sapiens
aggcactgcttctaagtaggaa

SEQ ID NO: 9150247 - DNA, 22 bp, Homo sapiens
aggcactgcagattacaggcgc

SEQ ID NO: 9150248 - DNA, 22 bp, Homo sapiens
aggcactgggaatatgctgagg

SEQ ID NO: 9150249 - DNA, 21 bp, Homo sapiens
acatacattatctttttaaaa

SEQ ID NO: 9150250 - DNA, 21 bp, Homo sapiens
acataggcgaatgttcgggag

SEQ ID NO: 9150251 - DNA, 22 bp, Homo sapiens
acatagtaagtgctcagtaaat

SEQ ID NO: 9150252 - DNA, 17 bp, Homo sapiens
aggcagctcagaacatc

SEQ ID NO: 9150253 - DNA, 17 bp, Homo sapiens
aggcagctcagaacatc

SEQ ID NO: 9150254 - DNA, 17 bp, Homo sapiens
aggcagctcagaacatc

SEQ ID NO: 9150255 - DNA, 22 bp, Homo sapiens
aggcagctagagagtgaaactg

SEQ ID NO: 9150256 - DNA, 22 bp, Homo sapiens
acatagagttcaattttcagtc

SEQ ID NO: 9150257 - DNA, 22 bp, Homo sapiens
acatagaacttcgatgtctttt

SEQ ID NO: 9150258 - DNA, 18 bp, Homo sapiens
acatacattctgtctgca

SEQ ID NO: 9150259 - DNA, 22 bp, Homo sapiens
aggcagctggaggcagagacta

SEQ ID NO: 9150260 - DNA, 22 bp, Homo sapiens
aggcagctggaggcagagacta

SEQ ID NO: 9150261 - DNA, 22 bp, Homo sapiens
acatattaactgcactacacta

SEQ ID NO: 9150262 - DNA, 22 bp, Homo sapiens
aggcagctgaccacagtatgat

SEQ ID NO: 9150263 - DNA, 22 bp, Homo sapiens
aggcagctctgtggcctcccag

SEQ ID NO: 9150264 - DNA, 21 bp, Homo sapiens
aggcagctcaggcccagagag

SEQ ID NO: 9150265 - DNA, 22 bp, Homo sapiens
aggcagctgaggtctggcgccc

SEQ ID NO: 9150266 - DNA, 22 bp, Homo sapiens
aggcagctggaaaactccaggc

SEQ ID NO: 9150267 - DNA, 22 bp, Homo sapiens
aggcagctgccctctccttcct

SEQ ID NO: 9150268 - DNA, 22 bp, Homo sapiens
aggcagctggaaaactccaggc

SEQ ID NO: 9150269 - DNA, 22 bp, Homo sapiens
aggcagctggaaaactccaggc

SEQ ID NO: 9150270 - DNA, 22 bp, Homo sapiens
acagtaaatattaagcctgagt

SEQ ID NO: 9150271 - DNA, 22 bp, Homo sapiens
acagtaaataatgcatgttgat

SEQ ID NO: 9150272 - DNA, 18 bp, Homo sapiens
acagtaaagaaaggaatt

SEQ ID NO: 9150273 - DNA, 18 bp, Homo sapiens
acagtaaagaaaggaatt

SEQ ID NO: 9150274 - DNA, 22 bp, Homo sapiens
acaggtttttggataatccttt

SEQ ID NO: 9150275 - DNA, 22 bp, Homo sapiens
acaggtttgctgctgttttagg

SEQ ID NO: 9150276 - DNA, 22 bp, Homo sapiens
acaggtttttgtggatatatgt

SEQ ID NO: 9150277 - DNA, 22 bp, Homo sapiens
acaggttttggactccagattt

SEQ ID NO: 9150278 - DNA, 22 bp, Homo sapiens
acagtaaaaagccttagaattt

SEQ ID NO: 9150279 - DNA, 22 bp, Homo sapiens
aggacacacttctgaggtcttt

SEQ ID NO: 9150280 - DNA, 21 bp, Homo sapiens
aggacacagagacacctattg

SEQ ID NO: 9150281 - DNA, 22 bp, Homo sapiens
aggacacaggcaggaggagatc

SEQ ID NO: 9150282 - DNA, 22 bp, Homo sapiens
acaggtgttgactcacaggccc

SEQ ID NO: 9150283 - DNA, 20 bp, Homo sapiens
acaggttcattctgtgtgac

SEQ ID NO: 9150284 - DNA, 22 bp, Homo sapiens
acaggtttagctcttagtagtc

SEQ ID NO: 9150285 - DNA, 22 bp, Homo sapiens
acaggtttgcagcttgttacct

SEQ ID NO: 9150286 - DNA, 22 bp, Homo sapiens
acaggtgttgaatgatgtcaca

SEQ ID NO: 9150287 - DNA, 22 bp, Homo sapiens
aggagatggagctcagtgggca

SEQ ID NO: 9150288 - DNA, 22 bp, Homo sapiens
acagtaaatcaacagaatatct

SEQ ID NO: 9150289 - DNA, 22 bp, Homo sapiens
aggagatggagctcagtgggca

SEQ ID NO: 9150290 - DNA, 22 bp, Homo sapiens
aggagcaaatgatgagacagca

SEQ ID NO: 9150291 - DNA, 22 bp, Homo sapiens
aggagcaaatgatgagacagca

SEQ ID NO: 9150292 - DNA, 22 bp, Homo sapiens
aggagcactaattcctgcagag

SEQ ID NO: 9150293 - DNA, 22 bp, Homo sapiens
aggagcagaactgttgtggagg

SEQ ID NO: 9150294 - DNA, 22 bp, Homo sapiens
aggagcagaactgttgtggagg

SEQ ID NO: 9150295 - DNA, 22 bp, Homo sapiens
aggagcagaactgattctgact

SEQ ID NO: 9150296 - DNA, 22 bp, Homo sapiens
acagtatatatagtctaaaagc

SEQ ID NO: 9150297 - DNA, 22 bp, Homo sapiens
aggagcagaatttaatgtgcag

SEQ ID NO: 9150298 - DNA, 22 bp, Homo sapiens
aggagcagaccgtagtcctgca

SEQ ID NO: 9150299 - DNA, 22 bp, Homo sapiens
aggagcagaatttaatgtgcag

SEQ ID NO: 9150300 - DNA, 22 bp, Homo sapiens
acagtacaccactgtgtacagt

SEQ ID NO: 9150301 - DNA, 22 bp, Homo sapiens
acagtctgcctctcagagcagc

SEQ ID NO: 9150302 - DNA, 17 bp, Homo sapiens
acagtctgcctgacagt

SEQ ID NO: 9150303 - DNA, 22 bp, Homo sapiens
acagtctgcttgtctccatggt

SEQ ID NO: 9150304 - DNA, 22 bp, Homo sapiens
acagtgggatgaggctggcccc

SEQ ID NO: 9150305 - DNA, 22 bp, Homo sapiens
acagtctgcatatgacctgtag

SEQ ID NO: 9150306 - DNA, 22 bp, Homo sapiens
acagtctgcagggtgaacatgt

SEQ ID NO: 9150307 - DNA, 22 bp, Homo sapiens
acagtctgcaggcaagttctac

SEQ ID NO: 9150308 - DNA, 22 bp, Homo sapiens
acagtctgagaattactgctct

SEQ ID NO: 9150309 - DNA, 22 bp, Homo sapiens
acagtgggatgaggctggcccc

SEQ ID NO: 9150310 - DNA, 20 bp, Homo sapiens
acagtgggtggggagcactg

SEQ ID NO: 9150311 - DNA, 22 bp, Homo sapiens
acagtgtgatgggcctgcctga

SEQ ID NO: 9150312 - DNA, 22 bp, Homo sapiens
acagtgtgacaattgtgtcaga

SEQ ID NO: 9150313 - DNA, 22 bp, Homo sapiens
acagtgtggggtgagatggaac

SEQ ID NO: 9150314 - DNA, 22 bp, Homo sapiens
acagtgtggggtgagatggaac

SEQ ID NO: 9150315 - DNA, 22 bp, Homo sapiens
acagtgtgtgggaaatgtgact

SEQ ID NO: 9150316 - DNA, 22 bp, Homo sapiens
acagtgtgtgggaaatgtgact

SEQ ID NO: 9150317 - DNA, 22 bp, Homo sapiens
acagtgtggtttgagcactggg

SEQ ID NO: 9150318 - DNA, 22 bp, Homo sapiens
acagtgtggtttgagcactggg

SEQ ID NO: 9150319 - DNA, 22 bp, Homo sapiens
acagtcagacagttaataacct

SEQ ID NO: 9150320 - DNA, 22 bp, Homo sapiens
acagtcaggaatttgtaaaacg

SEQ ID NO: 9150321 - DNA, 22 bp, Homo sapiens
acagtcaatcagaacagcatgt

SEQ ID NO: 9150322 - DNA, 22 bp, Homo sapiens
acagtatttgcgatactgatga

SEQ ID NO: 9150323 - DNA, 22 bp, Homo sapiens
acagtcagtatcccaggcaaat

SEQ ID NO: 9150324 - DNA, 22 bp, Homo sapiens
acagtcaggccgagatgggcct

SEQ ID NO: 9150325 - DNA, 20 bp, Homo sapiens
acagtcagggaatagaaaaa

SEQ ID NO: 9150326 - DNA, 22 bp, Homo sapiens
acagtcagggcttactcaggga

SEQ ID NO: 9150327 - DNA, 22 bp, Homo sapiens
acagtcatagcagcctttgtta

SEQ ID NO: 9150328 - DNA, 23 bp, Homo sapiens
acaggaggggacaggtggccgtg

SEQ ID NO: 9150329 - DNA, 22 bp, Homo sapiens
acaggagggacaccttcctgct

SEQ ID NO: 9150330 - DNA, 22 bp, Homo sapiens
acaggaggagctgtttcaggga

SEQ ID NO: 9150331 - DNA, 22 bp, Homo sapiens
acaggaggagctgtttcaggga

SEQ ID NO: 9150332 - DNA, 22 bp, Homo sapiens
acaggaggggcatgaaagacgg

SEQ ID NO: 9150333 - DNA, 22 bp, Homo sapiens
acaggaggggcatgaaagacgg

SEQ ID NO: 9150334 - DNA, 22 bp, Homo sapiens
acaggagtagggctggtggaga

SEQ ID NO: 9150335 - DNA, 22 bp, Homo sapiens
acaggagtggctctaccagacc

SEQ ID NO: 9150336 - DNA, 22 bp, Homo sapiens
acaggagtggagaggtgcctct

SEQ ID NO: 9150337 - DNA, 21 bp, Homo sapiens
agctggcagatatggtgtctg

SEQ ID NO: 9150338 - DNA, 22 bp, Homo sapiens
agctggcaatctttctaaatac

SEQ ID NO: 9150339 - DNA, 22 bp, Homo sapiens
agctggcaatgtaagtccctgg

SEQ ID NO: 9150340 - DNA, 22 bp, Homo sapiens
agctggcaatgtaagtccctgg

SEQ ID NO: 9150341 - DNA, 21 bp, Homo sapiens
agctggcaatgttgtcctctt

SEQ ID NO: 9150342 - DNA, 22 bp, Homo sapiens
agctggcacagaccaggagatc

SEQ ID NO: 9150343 - DNA, 21 bp, Homo sapiens
acaggcaccatgcctgtgcct

SEQ ID NO: 9150344 - DNA, 21 bp, Homo sapiens
acaggcaccatgcctgtgcct

SEQ ID NO: 9150345 - DNA, 22 bp, Homo sapiens
acaggcagagtcaggttgggtt

SEQ ID NO: 9150346 - DNA, 22 bp, Homo sapiens
acaggcacaggtgtgccccacc

SEQ ID NO: 9150347 - DNA, 22 bp, Homo sapiens
agctggtgtgccagttccagtt

SEQ ID NO: 9150348 - DNA, 21 bp, Homo sapiens
agctggtgtcagagctctggg

SEQ ID NO: 9150349 - DNA, 22 bp, Homo sapiens
agctggtgtcctcctggagctg

SEQ ID NO: 9150350 - DNA, 22 bp, Homo sapiens
agctggtgtcctcctggagctg

SEQ ID NO: 9150351 - DNA, 22 bp, Homo sapiens
acaggatcgccctgttgcccag

SEQ ID NO: 9150352 - DNA, 18 bp, Homo sapiens
agctggtggggagacagc

SEQ ID NO: 9150353 - DNA, 22 bp, Homo sapiens
agctggtgtcacctccagtcca

SEQ ID NO: 9150354 - DNA, 18 bp, Homo sapiens
agctggtggggagacagc

SEQ ID NO: 9150355 - DNA, 18 bp, Homo sapiens
agctggtggggagacagc

SEQ ID NO: 9150356 - DNA, 18 bp, Homo sapiens
agctggtggggagacagc

SEQ ID NO: 9150357 - DNA, 22 bp, Homo sapiens
agctggtggggaagctgcaggt

SEQ ID NO: 9150358 - DNA, 21 bp, Homo sapiens
acagctgcctgccatgggggt

SEQ ID NO: 9150359 - DNA, 22 bp, Homo sapiens
acagctggcaggggggcatgaa

SEQ ID NO: 9150360 - DNA, 22 bp, Homo sapiens
acagctgggaactcacacagca

SEQ ID NO: 9150361 - DNA, 22 bp, Homo sapiens
acagctgggtgtcccacttctg

SEQ ID NO: 9150362 - DNA, 22 bp, Homo sapiens
acagctggtgaatgttctctgt

SEQ ID NO: 9150363 - DNA, 22 bp, Homo sapiens
acagctggtgaatgttctctgt

SEQ ID NO: 9150364 - DNA, 21 bp, Homo sapiens
acagctggtgcagggcgggga

SEQ ID NO: 9150365 - DNA, 23 bp, Homo sapiens
agctggaggctgtctactcccaa

SEQ ID NO: 9150366 - DNA, 23 bp, Homo sapiens
agctggaggctgtctactcccaa

SEQ ID NO: 9150367 - DNA, 22 bp, Homo sapiens
acagctgtatccccagagctca

SEQ ID NO: 9150368 - DNA, 22 bp, Homo sapiens
agctgacagtgcatggagggac

SEQ ID NO: 9150369 - DNA, 22 bp, Homo sapiens
agctgacaggatggcattatta

SEQ ID NO: 9150370 - DNA, 22 bp, Homo sapiens
agctgaatctcaggcatccttt

SEQ ID NO: 9150371 - DNA, 22 bp, Homo sapiens
agctgaagttcagtccagagaa

SEQ ID NO: 9150372 - DNA, 22 bp, Homo sapiens
agctgagaatcttccccagtgt

SEQ ID NO: 9150373 - DNA, 22 bp, Homo sapiens
agctgagacacttgagagacta

SEQ ID NO: 9150374 - DNA, 22 bp, Homo sapiens
agctgagacacttgagagacta

SEQ ID NO: 9150375 - DNA, 22 bp, Homo sapiens
agctgagagctgtgtcaagata

SEQ ID NO: 9150376 - DNA, 22 bp, Homo sapiens
agctctggttattgaagcaggg

SEQ ID NO: 9150377 - DNA, 22 bp, Homo sapiens
agctctggttattgaagcaggg

SEQ ID NO: 9150378 - DNA, 22 bp, Homo sapiens
agctctggtgagatgttattca

SEQ ID NO: 9150379 - DNA, 22 bp, Homo sapiens
agctctggtactgctgaccgaa

SEQ ID NO: 9150380 - DNA, 22 bp, Homo sapiens
agctctggtatttctttaatcc

SEQ ID NO: 9150381 - DNA, 22 bp, Homo sapiens
agctctgggtcacggctgccga

SEQ ID NO: 9150382 - DNA, 22 bp, Homo sapiens
agctctgggtcacggctgccga

SEQ ID NO: 9150383 - DNA, 22 bp, Homo sapiens
agctctggggtggagcccagga

SEQ ID NO: 9150384 - DNA, 22 bp, Homo sapiens
agctctggggtggagcccagga

SEQ ID NO: 9150385 - DNA, 17 bp, Homo sapiens
acaggcagatcacctga

SEQ ID NO: 9150386 - DNA, 17 bp, Homo sapiens
acaggcagatcacctga

SEQ ID NO: 9150387 - DNA, 22 bp, Homo sapiens
acaggcagattaagggtaggca

SEQ ID NO: 9150388 - DNA, 22 bp, Homo sapiens
acaggcagattaagggtaggca

SEQ ID NO: 9150389 - DNA, 22 bp, Homo sapiens
acaggcagcaaaatcagcctca

SEQ ID NO: 9150390 - DNA, 22 bp, Homo sapiens
acaggcaggcgggacagcccga

SEQ ID NO: 9150391 - DNA, 22 bp, Homo sapiens
acaggcaggcttcggccagagc

SEQ ID NO: 9150392 - DNA, 22 bp, Homo sapiens
acaggcaggagctccccattcc

SEQ ID NO: 9150393 - DNA, 22 bp, Homo sapiens
acaggcagccctctccctggtt

SEQ ID NO: 9150394 - DNA, 22 bp, Homo sapiens
acaggcagggaccttggctaag

SEQ ID NO: 9150395 - DNA, 22 bp, Homo sapiens
acaggctgttggggtccagggt

SEQ ID NO: 9150396 - DNA, 22 bp, Homo sapiens
acaggcaggcttcggccagagc

SEQ ID NO: 9150397 - DNA, 22 bp, Homo sapiens
acagggaaggagcatagaaaaa

SEQ ID NO: 9150398 - DNA, 22 bp, Homo sapiens
acagggaaggagcatagaaaaa

SEQ ID NO: 9150399 - DNA, 22 bp, Homo sapiens
acagggaaggatttagtgggaa

SEQ ID NO: 9150400 - DNA, 22 bp, Homo sapiens
acagggaaggcatccgcgaatg

SEQ ID NO: 9150401 - DNA, 22 bp, Homo sapiens
acagggaagttctgcaacagga

SEQ ID NO: 9150402 - DNA, 22 bp, Homo sapiens
acagggaagttctgcaacagga

SEQ ID NO: 9150403 - DNA, 22 bp, Homo sapiens
acagggaagttctgcaacagga

SEQ ID NO: 9150404 - DNA, 22 bp, Homo sapiens
acagggaagttctgcaacagga

SEQ ID NO: 9150405 - DNA, 22 bp, Homo sapiens
acagggagatgggtgaaagcgg

SEQ ID NO: 9150406 - DNA, 22 bp, Homo sapiens
acagggagatatcttcaatatc

SEQ ID NO: 9150407 - DNA, 19 bp, Homo sapiens
acagggaatttccacagaa

SEQ ID NO: 9150408 - DNA, 22 bp, Homo sapiens
acagggaatggagggatcagta

SEQ ID NO: 9150409 - DNA, 22 bp, Homo sapiens
acagggaatggagggatcagta

SEQ ID NO: 9150410 - DNA, 22 bp, Homo sapiens
aggacacacttctgaggtcttt

SEQ ID NO: 9150411 - DNA, 22 bp, Homo sapiens
aggacacactgcaagagcctgg

SEQ ID NO: 9150412 - DNA, 22 bp, Homo sapiens
aggacacaccaggtccagctgt

SEQ ID NO: 9150413 - DNA, 22 bp, Homo sapiens
aggacacacccagctcacgggg

SEQ ID NO: 9150414 - DNA, 22 bp, Homo sapiens
aggacacaccaggtccagctgt

SEQ ID NO: 9150415 - DNA, 22 bp, Homo sapiens
aggacacacagaatacaaatcc

SEQ ID NO: 9150416 - DNA, 19 bp, Homo sapiens
acaggggctagcggaagca

SEQ ID NO: 9150417 - DNA, 19 bp, Homo sapiens
acaggggcctttccagggt

SEQ ID NO: 9150418 - DNA, 22 bp, Homo sapiens
aggacacacaaagagtgagaac

SEQ ID NO: 9150419 - DNA, 22 bp, Homo sapiens
aggacacacaaagagtgagaac

SEQ ID NO: 9150420 - DNA, 22 bp, Homo sapiens
acagggcttttaatcagtagtt

SEQ ID NO: 9150421 - DNA, 22 bp, Homo sapiens
acaggggcaggcaggacccttt

SEQ ID NO: 9150422 - DNA, 22 bp, Homo sapiens
aggaagaatgtttacatatcaa

SEQ ID NO: 9150423 - DNA, 22 bp, Homo sapiens
aggaagaatgtttacatatcaa

SEQ ID NO: 9150424 - DNA, 19 bp, Homo sapiens
acagggcttggcctgacat

SEQ ID NO: 9150425 - DNA, 22 bp, Homo sapiens
acagggctatattcctcagagt

SEQ ID NO: 9150426 - DNA, 21 bp, Homo sapiens
acagggcttcagggagggtta

SEQ ID NO: 9150427 - DNA, 22 bp, Homo sapiens
aggaagagcatctttgggtctg

SEQ ID NO: 9150428 - DNA, 21 bp, Homo sapiens
aggaagaaaggttggaggttg

SEQ ID NO: 9150429 - DNA, 22 bp, Homo sapiens
aggaagaaatgtgacttcaaac

SEQ ID NO: 9150430 - DNA, 22 bp, Homo sapiens
aggaagaacagataatggacgc

SEQ ID NO: 9150431 - DNA, 22 bp, Homo sapiens
aggaagaacctaagaaagtctc

SEQ ID NO: 9150432 - DNA, 22 bp, Homo sapiens
aggaagaaactgagctctgaca

SEQ ID NO: 9150433 - DNA, 22 bp, Homo sapiens
aggaagaaacctactagagttt

SEQ ID NO: 9150434 - DNA, 22 bp, Homo sapiens
acagggagatgggtgaaagcgg

SEQ ID NO: 9150435 - DNA, 22 bp, Homo sapiens
acagggagatgggtgaaagcgg

SEQ ID NO: 9150436 - DNA, 22 bp, Homo sapiens
acagggagatgggtgaaagcgg

SEQ ID NO: 9150437 - DNA, 22 bp, Homo sapiens
acagggagatgggtgaaagcgg

SEQ ID NO: 9150438 - DNA, 22 bp, Homo sapiens
acagggagccccagcatttcca

SEQ ID NO: 9150439 - DNA, 22 bp, Homo sapiens
acagggagccccagcatttcca

SEQ ID NO: 9150440 - DNA, 18 bp, Homo sapiens
acagggagggcgctgggg

SEQ ID NO: 9150441 - DNA, 22 bp, Homo sapiens
actgtgcatttgtcatggggtt

SEQ ID NO: 9150442 - DNA, 22 bp, Homo sapiens
actgtgcattccccaacctgtg

SEQ ID NO: 9150443 - DNA, 22 bp, Homo sapiens
actgtgcaccctggacagtgtc

SEQ ID NO: 9150444 - DNA, 21 bp, Homo sapiens
actgtgcagcctgaggatgtg

SEQ ID NO: 9150445 - DNA, 22 bp, Homo sapiens
actgtgcagctgagtgctaatt

SEQ ID NO: 9150446 - DNA, 22 bp, Homo sapiens
actgtgcaggggaagagagaaa

SEQ ID NO: 9150447 - DNA, 22 bp, Homo sapiens
actgtgcagtgttgtaacccga

SEQ ID NO: 9150448 - DNA, 22 bp, Homo sapiens
actgtgcaggtagatgcctggg

SEQ ID NO: 9150449 - DNA, 22 bp, Homo sapiens
ataatgaaatatgaggaaggtc

SEQ ID NO: 9150450 - DNA, 22 bp, Homo sapiens
ataatgacattcttagactgga

SEQ ID NO: 9150451 - DNA, 23 bp, Homo sapiens
ataatgacattggcttaggtatg

SEQ ID NO: 9150452 - DNA, 22 bp, Homo sapiens
ataatgacagcatttaaggact

SEQ ID NO: 9150453 - DNA, 22 bp, Homo sapiens
ataatctggtctttgtatgagt

SEQ ID NO: 9150454 - DNA, 22 bp, Homo sapiens
ataatcttgtatttcctaaagt

SEQ ID NO: 9150455 - DNA, 22 bp, Homo sapiens
ataatctttcttttccagatag

SEQ ID NO: 9150456 - DNA, 22 bp, Homo sapiens
ataatctggcttgtttgcttaa

SEQ ID NO: 9150457 - DNA, 22 bp, Homo sapiens
ataatctggcttgtttgcttaa

SEQ ID NO: 9150458 - DNA, 22 bp, Homo sapiens
ataatctgagctatttcatgag

SEQ ID NO: 9150459 - DNA, 22 bp, Homo sapiens
ataatccattaattaatgacca

SEQ ID NO: 9150460 - DNA, 22 bp, Homo sapiens
ataaaatttgctactgttaaat

SEQ ID NO: 9150461 - DNA, 22 bp, Homo sapiens
ataaaatttgctactgttaaat

SEQ ID NO: 9150462 - DNA, 22 bp, Homo sapiens
ataaaatttgctactgttaaat

SEQ ID NO: 9150463 - DNA, 22 bp, Homo sapiens
ataaaatttgctactgttaaat

SEQ ID NO: 9150464 - DNA, 22 bp, Homo sapiens
ataaaatttgctactgttaaat

SEQ ID NO: 9150465 - DNA, 22 bp, Homo sapiens
ataaaatgtctccactgggctc

SEQ ID NO: 9150466 - DNA, 22 bp, Homo sapiens
ataaaatggtaaacgaagctga

SEQ ID NO: 9150467 - DNA, 22 bp, Homo sapiens
actgtgcaagtcaaagatgggc

SEQ ID NO: 9150468 - DNA, 22 bp, Homo sapiens
actgtgcaaatgacaggcacac

SEQ ID NO: 9150469 - DNA, 22 bp, Homo sapiens
actgtgatgatgaagcatggtt

SEQ ID NO: 9150470 - DNA, 22 bp, Homo sapiens
actgtgatgcagttgccatcca

SEQ ID NO: 9150471 - DNA, 22 bp, Homo sapiens
ataaacagcataaaatacgctt

SEQ ID NO: 9150472 - DNA, 22 bp, Homo sapiens
ataaacagcctgcccaaattgg

SEQ ID NO: 9150473 - DNA, 21 bp, Homo sapiens
ataaacagcatgtgatccatg

SEQ ID NO: 9150474 - DNA, 22 bp, Homo sapiens
ataaacagtaaatgtgagcagt

SEQ ID NO: 9150475 - DNA, 20 bp, Homo sapiens
actgggagctaacggagatt

SEQ ID NO: 9150476 - DNA, 22 bp, Homo sapiens
actgtaacacaatggtatctgt

SEQ ID NO: 9150477 - DNA, 22 bp, Homo sapiens
actgtaacactcatactgaagt

SEQ ID NO: 9150478 - DNA, 22 bp, Homo sapiens
actgtaccaccttgctcttgtc

SEQ ID NO: 9150479 - DNA, 22 bp, Homo sapiens
actgtacatgtaaacattgtca

SEQ ID NO: 9150480 - DNA, 22 bp, Homo sapiens
actgtagctgccactggatgca

SEQ ID NO: 9150481 - DNA, 22 bp, Homo sapiens
actgtactcttatagccatctg

SEQ ID NO: 9150482 - DNA, 22 bp, Homo sapiens
actgtactgaaaagtaagcaag

SEQ ID NO: 9150483 - DNA, 22 bp, Homo sapiens
actgtactcttctagccatctg

SEQ ID NO: 9150484 - DNA, 22 bp, Homo sapiens
actgtactttagaaagtgtagt

SEQ ID NO: 9150485 - DNA, 22 bp, Homo sapiens
actgggaaagtgctgcctgcag

SEQ ID NO: 9150486 - DNA, 19 bp, Homo sapiens
actgggaaaaaggcactgg

SEQ ID NO: 9150487 - DNA, 22 bp, Homo sapiens
actgggaagacaagaaagatag

SEQ ID NO: 9150488 - DNA, 22 bp, Homo sapiens
actgggaagactggaattgctc

SEQ ID NO: 9150489 - DNA, 22 bp, Homo sapiens
actgggaagagagaattctgtc

SEQ ID NO: 9150490 - DNA, 22 bp, Homo sapiens
actgggaaggagcaggatctgt

SEQ ID NO: 9150491 - DNA, 23 bp, Homo sapiens
actgggaagtttggagagacgca

SEQ ID NO: 9150492 - DNA, 22 bp, Homo sapiens
actgtcaccatcagagcgggaa

SEQ ID NO: 9150493 - DNA, 22 bp, Homo sapiens
actgtcactccaactgagtcgt

SEQ ID NO: 9150494 - DNA, 22 bp, Homo sapiens
actgtcaaggaaacaaaattac

SEQ ID NO: 9150495 - DNA, 22 bp, Homo sapiens
actgtcaagagattcaaattca

SEQ ID NO: 9150496 - DNA, 22 bp, Homo sapiens
actgtcatctggtagatgatgg

SEQ ID NO: 9150497 - DNA, 22 bp, Homo sapiens
ataaaaactgacccatcctttg

SEQ ID NO: 9150498 - DNA, 22 bp, Homo sapiens
actgtcatcttgtaagcaatgt

SEQ ID NO: 9150499 - DNA, 22 bp, Homo sapiens
actgtatattggacaaggaaaa

SEQ ID NO: 9150500 - DNA, 22 bp, Homo sapiens
actgtattcctactagaatcta

SEQ ID NO: 9150501 - DNA, 22 bp, Homo sapiens
actgtcaaaagagattatatta

SEQ ID NO: 9150502 - DNA, 16 bp, Homo sapiens
actgtcaaagtgatga

SEQ ID NO: 9150503 - DNA, 22 bp, Homo sapiens
actgtattggaaatatagcaaa

SEQ ID NO: 9150504 - DNA, 21 bp, Homo sapiens
actgtattgttttcaaggatc

SEQ ID NO: 9150505 - DNA, 22 bp, Homo sapiens
actgtatttggatataagatct

SEQ ID NO: 9150506 - DNA, 22 bp, Homo sapiens
actgtatttccaacagacaaat

SEQ ID NO: 9150507 - DNA, 22 bp, Homo sapiens
acttctggatagagtcagcttt

SEQ ID NO: 9150508 - DNA, 22 bp, Homo sapiens
atacatgttgagaaaatatctg

SEQ ID NO: 9150509 - DNA, 22 bp, Homo sapiens
atacatgttgagaaaatatctg

SEQ ID NO: 9150510 - DNA, 22 bp, Homo sapiens
atacatgttgagaaaatatctg

SEQ ID NO: 9150511 - DNA, 22 bp, Homo sapiens
atacatctagagtcataaaaac

SEQ ID NO: 9150512 - DNA, 22 bp, Homo sapiens
atacattagtgaacaaaagaga

SEQ ID NO: 9150513 - DNA, 22 bp, Homo sapiens
atacattagtgaacaaaagaga

SEQ ID NO: 9150514 - DNA, 22 bp, Homo sapiens
atacattattgttaaagaacat

SEQ ID NO: 9150515 - DNA, 22 bp, Homo sapiens
atacattagaatctggtactca

SEQ ID NO: 9150516 - DNA, 22 bp, Homo sapiens
atacattagaatctggtactca

SEQ ID NO: 9150517 - DNA, 22 bp, Homo sapiens
atacatgttgtaccatatgttt

SEQ ID NO: 9150518 - DNA, 22 bp, Homo sapiens
atacatgttgagaaaatatctg

SEQ ID NO: 9150519 - DNA, 22 bp, Homo sapiens
atactgtaatacctaaatgaac

SEQ ID NO: 9150520 - DNA, 22 bp, Homo sapiens
atactgtaatacctaaatgaac

SEQ ID NO: 9150521 - DNA, 22 bp, Homo sapiens
atactgtaatacctaaatgaac

SEQ ID NO: 9150522 - DNA, 20 bp, Homo sapiens
atactgtacaactataggta

SEQ ID NO: 9150523 - DNA, 20 bp, Homo sapiens
atactgtacaactataggta

SEQ ID NO: 9150524 - DNA, 22 bp, Homo sapiens
atactgtacgctcctggcattt

SEQ ID NO: 9150525 - DNA, 22 bp, Homo sapiens
atactgtacgtcccagatagga

SEQ ID NO: 9150526 - DNA, 22 bp, Homo sapiens
atactgctgctgctgaaatcac

SEQ ID NO: 9150527 - DNA, 22 bp, Homo sapiens
atactggatttgaaacatttca

SEQ ID NO: 9150528 - DNA, 21 bp, Homo sapiens
atactggagccatccccaaag

SEQ ID NO: 9150529 - DNA, 22 bp, Homo sapiens
atactggagaagccaagaagcc

SEQ ID NO: 9150530 - DNA, 22 bp, Homo sapiens
atactggagaagccaagaagcc

SEQ ID NO: 9150531 - DNA, 22 bp, Homo sapiens
actttatttcctattgcatcca

SEQ ID NO: 9150532 - DNA, 22 bp, Homo sapiens
actttatttcctattgcatcca

SEQ ID NO: 9150533 - DNA, 22 bp, Homo sapiens
actttatttcctattgcatcca

SEQ ID NO: 9150534 - DNA, 22 bp, Homo sapiens
actttatttcctattgcatcca

SEQ ID NO: 9150535 - DNA, 22 bp, Homo sapiens
atactgtatcacttgtgagtga

SEQ ID NO: 9150536 - DNA, 22 bp, Homo sapiens
atactgtatcacttgtgagtga

SEQ ID NO: 9150537 - DNA, 22 bp, Homo sapiens
atactgtgtgcagagtcctaat

SEQ ID NO: 9150538 - DNA, 22 bp, Homo sapiens
atactgtagaggcatagctagt

SEQ ID NO: 9150539 - DNA, 22 bp, Homo sapiens
atactgtacgtcccagatagga

SEQ ID NO: 9150540 - DNA, 22 bp, Homo sapiens
atactgtagaggcatagctagt

SEQ ID NO: 9150541 - DNA, 22 bp, Homo sapiens
atactgtatatctgagagccca

SEQ ID NO: 9150542 - DNA, 22 bp, Homo sapiens
atactgtagttgtccaactatc

SEQ ID NO: 9150543 - DNA, 22 bp, Homo sapiens
atactgtatatctgagagccca

SEQ ID NO: 9150544 - DNA, 22 bp, Homo sapiens
atactgtatatttcacatcttg

SEQ ID NO: 9150545 - DNA, 22 bp, Homo sapiens
atactgtagttgtccaactatc

SEQ ID NO: 9150546 - DNA, 22 bp, Homo sapiens
atactgtatatctgagagccca

SEQ ID NO: 9150547 - DNA, 22 bp, Homo sapiens
ataatgcgcctcagaaaacaga

SEQ ID NO: 9150548 - DNA, 22 bp, Homo sapiens
ataatgcgaggagaaaatgaag

SEQ ID NO: 9150549 - DNA, 21 bp, Homo sapiens
acttaaattccttgatattta

SEQ ID NO: 9150550 - DNA, 22 bp, Homo sapiens
acttaaatagaactcctcaata

SEQ ID NO: 9150551 - DNA, 21 bp, Homo sapiens
acttaaattccttgatattta

SEQ ID NO: 9150552 - DNA, 23 bp, Homo sapiens
acttaaatggttctttatctcag

SEQ ID NO: 9150553 - DNA, 20 bp, Homo sapiens
atacacttgcccagcttgtg

SEQ ID NO: 9150554 - DNA, 22 bp, Homo sapiens
acttacccacccctgggttgag

SEQ ID NO: 9150555 - DNA, 22 bp, Homo sapiens
acttacccaagttatttgtagt

SEQ ID NO: 9150556 - DNA, 22 bp, Homo sapiens
atacaggtaggggacatacatc

SEQ ID NO: 9150557 - DNA, 22 bp, Homo sapiens
atacaggtaatttgaataatag

SEQ ID NO: 9150558 - DNA, 22 bp, Homo sapiens
atacagcagtttgtgatcctag

SEQ ID NO: 9150559 - DNA, 22 bp, Homo sapiens
atacaggaactctctacacttt

SEQ ID NO: 9150560 - DNA, 22 bp, Homo sapiens
atacagctttctttcacatgag

SEQ ID NO: 9150561 - DNA, 22 bp, Homo sapiens
atacagcttatgcatatatctc

SEQ ID NO: 9150562 - DNA, 22 bp, Homo sapiens
atacagcagcccttgctttgca

SEQ ID NO: 9150563 - DNA, 22 bp, Homo sapiens
atacagcagtgaataagataaa

SEQ ID NO: 9150564 - DNA, 22 bp, Homo sapiens
atacagccagcttcctgacctt

SEQ ID NO: 9150565 - DNA, 22 bp, Homo sapiens
atacagcctattcttaccattg

SEQ ID NO: 9150566 - DNA, 22 bp, Homo sapiens
acttctgcttgcccagtgacta

SEQ ID NO: 9150567 - DNA, 22 bp, Homo sapiens
acttctgataaagagcatgtgc

SEQ ID NO: 9150568 - DNA, 22 bp, Homo sapiens
atacagtaaccacattctatag

SEQ ID NO: 9150569 - DNA, 22 bp, Homo sapiens
atacaggttctctagggaacag

SEQ ID NO: 9150570 - DNA, 22 bp, Homo sapiens
atacagtaaccacattctatag

SEQ ID NO: 9150571 - DNA, 22 bp, Homo sapiens
atacaggtgtacacacatgcaa

SEQ ID NO: 9150572 - DNA, 22 bp, Homo sapiens
atacaggtggacttcagttagt

SEQ ID NO: 9150573 - DNA, 22 bp, Homo sapiens
actttccacaccattttgtggt

SEQ ID NO: 9150574 - DNA, 22 bp, Homo sapiens
actttcccacttaatgtattta

SEQ ID NO: 9150575 - DNA, 22 bp, Homo sapiens
actttcctagacttcagtgaca

SEQ ID NO: 9150576 - DNA, 22 bp, Homo sapiens
actttcctggccctgtcctctg

SEQ ID NO: 9150577 - DNA, 22 bp, Homo sapiens
actttctcaaatcagactttaa

SEQ ID NO: 9150578 - DNA, 22 bp, Homo sapiens
actttctattcccacagagata

SEQ ID NO: 9150579 - DNA, 22 bp, Homo sapiens
actttcatggtagttgtattct

SEQ ID NO: 9150580 - DNA, 22 bp, Homo sapiens
actttcatttgtaataaacttc

SEQ ID NO: 9150581 - DNA, 22 bp, Homo sapiens
actttcaagaacttctttaatg

SEQ ID NO: 9150582 - DNA, 22 bp, Homo sapiens
actttcacatgtgtgcagacag

SEQ ID NO: 9150583 - DNA, 22 bp, Homo sapiens
atatgcttgtcacacacatcca

SEQ ID NO: 9150584 - DNA, 22 bp, Homo sapiens
atatggaagagcctgggaattt

SEQ ID NO: 9150585 - DNA, 22 bp, Homo sapiens
atatggaatggtaatctacaat

SEQ ID NO: 9150586 - DNA, 22 bp, Homo sapiens
agaaaaggttgaaagtaggatt

SEQ ID NO: 9150587 - DNA, 22 bp, Homo sapiens
actttctcaggaattcacagac

SEQ ID NO: 9150588 - DNA, 20 bp, Homo sapiens
actttctcggtttctcacct

SEQ ID NO: 9150589 - DNA, 22 bp, Homo sapiens
atatgaaagtaagcatgtgtgt

SEQ ID NO: 9150590 - DNA, 22 bp, Homo sapiens
atatgcttgactctttcacatc

SEQ ID NO: 9150591 - DNA, 22 bp, Homo sapiens
atattctgggttagatatgttt

SEQ ID NO: 9150592 - DNA, 21 bp, Homo sapiens
atatttctcataaggttatgg

SEQ ID NO: 9150593 - DNA, 22 bp, Homo sapiens
agaaagctccccatgagatgat

SEQ ID NO: 9150594 - DNA, 22 bp, Homo sapiens
agaaaagtgctctagtgagagc

SEQ ID NO: 9150595 - DNA, 23 bp, Homo sapiens
agaaaagttcatacctttttaac

SEQ ID NO: 9150596 - DNA, 22 bp, Homo sapiens
agaaaagtgctctagtgagagc

SEQ ID NO: 9150597 - DNA, 22 bp, Homo sapiens
agaaaagtgctctagtgagagc

SEQ ID NO: 9150598 - DNA, 22 bp, Homo sapiens
agaaaagtttaaatcttggcac

SEQ ID NO: 9150599 - DNA, 22 bp, Homo sapiens
agaaaagttttctgagactgac

SEQ ID NO: 9150600 - DNA, 22 bp, Homo sapiens
agaaaagttttctgagactgac

SEQ ID NO: 9150601 - DNA, 22 bp, Homo sapiens
atattctagccaaagtgtgagc

SEQ ID NO: 9150602 - DNA, 22 bp, Homo sapiens
atattctataagcagttggaag

SEQ ID NO: 9150603 - DNA, 22 bp, Homo sapiens
atattcctgtttttaacacttt

SEQ ID NO: 9150604 - DNA, 22 bp, Homo sapiens
atattacataaacatgagtgaa

SEQ ID NO: 9150605 - DNA, 22 bp, Homo sapiens
atattacataaacatgagtgaa

SEQ ID NO: 9150606 - DNA, 22 bp, Homo sapiens
atattacacacggtatcacggg

SEQ ID NO: 9150607 - DNA, 22 bp, Homo sapiens
agaacagcttgcctttaataga

SEQ ID NO: 9150608 - DNA, 22 bp, Homo sapiens
agaacaggaggaagccagctcc

SEQ ID NO: 9150609 - DNA, 19 bp, Homo sapiens
agaacagctttttgtgaca

SEQ ID NO: 9150610 - DNA, 22 bp, Homo sapiens
atcatcttcatattcctcagct

SEQ ID NO: 9150611 - DNA, 22 bp, Homo sapiens
atcatcttcgaaaaaagtcaga

SEQ ID NO: 9150612 - DNA, 22 bp, Homo sapiens
atcatcttcgaaaaaagtcaga

SEQ ID NO: 9150613 - DNA, 22 bp, Homo sapiens
atcatcttgaaagtctatgttt

SEQ ID NO: 9150614 - DNA, 22 bp, Homo sapiens
atcatcttatctgactcatttt

SEQ ID NO: 9150615 - DNA, 22 bp, Homo sapiens
atcgctttacagcctgcttcct

SEQ ID NO: 9150616 - DNA, 22 bp, Homo sapiens
atcctttatctttcctaggaat

SEQ ID NO: 9150617 - DNA, 21 bp, Homo sapiens
atctcacagcccagagaagcc

SEQ ID NO: 9150618 - DNA, 23 bp, Homo sapiens
atctaatttctccaaatctctac

SEQ ID NO: 9150619 - DNA, 22 bp, Homo sapiens
atctaaaaggagctctttatct

SEQ ID NO: 9150620 - DNA, 22 bp, Homo sapiens
atctaaagtgtcataagtagct

SEQ ID NO: 9150621 - DNA, 22 bp, Homo sapiens
atctaaagtgtttcatgaaaga

SEQ ID NO: 9150622 - DNA, 22 bp, Homo sapiens
agaacactgggaagttactaac

SEQ ID NO: 9150623 - DNA, 20 bp, Homo sapiens
agaacactggtgtattgtga

SEQ ID NO: 9150624 - DNA, 22 bp, Homo sapiens
agaacactgggaagttactaac

SEQ ID NO: 9150625 - DNA, 22 bp, Homo sapiens
agaacactgctagtataatcac

SEQ ID NO: 9150626 - DNA, 22 bp, Homo sapiens
agaacactgatagctgagggga

SEQ ID NO: 9150627 - DNA, 22 bp, Homo sapiens
agaacactctcctgaaaattaa

SEQ ID NO: 9150628 - DNA, 22 bp, Homo sapiens
agaaagttgttttagccaaacc

SEQ ID NO: 9150629 - DNA, 22 bp, Homo sapiens
agaaagtttattcctatctagc

SEQ ID NO: 9150630 - DNA, 22 bp, Homo sapiens
agaaagtttgagaactgtagat

SEQ ID NO: 9150631 - DNA, 23 bp, Homo sapiens
agaaagtttgtgccttgtgacac

SEQ ID NO: 9150632 - DNA, 22 bp, Homo sapiens
agaacagatgtgggcagacctg

SEQ ID NO: 9150633 - DNA, 22 bp, Homo sapiens
agaacacttttaaatggcttgt

SEQ ID NO: 9150634 - DNA, 18 bp, Homo sapiens
agaacacttggttagatc

SEQ ID NO: 9150635 - DNA, 22 bp, Homo sapiens
agaacacttgctcctgattctc

SEQ ID NO: 9150636 - DNA, 22 bp, Homo sapiens
agaacactgtaaagtcattgaa

SEQ ID NO: 9150637 - DNA, 22 bp, Homo sapiens
agaacagcacaggaagtgtatc

SEQ ID NO: 9150638 - DNA, 22 bp, Homo sapiens
agaacagcaacatcagacaaag

SEQ ID NO: 9150639 - DNA, 22 bp, Homo sapiens
agaacagcaggaaggccaggta

SEQ ID NO: 9150640 - DNA, 22 bp, Homo sapiens
agaacagcagtagtatacagta

SEQ ID NO: 9150641 - DNA, 22 bp, Homo sapiens
agaacagctgattccatgtcaa

SEQ ID NO: 9150642 - DNA, 22 bp, Homo sapiens
agaaagtgcctcccttgggagc

SEQ ID NO: 9150643 - DNA, 22 bp, Homo sapiens
agaaagtacagatgagacactt

SEQ ID NO: 9150644 - DNA, 22 bp, Homo sapiens
agaaagtgcttccctttggact

SEQ ID NO: 9150645 - DNA, 22 bp, Homo sapiens
agaaagtgcttccctttggtga

SEQ ID NO: 9150646 - DNA, 22 bp, Homo sapiens
agaaagttctgtgagttgttca

SEQ ID NO: 9150647 - DNA, 22 bp, Homo sapiens
agaaagttgttggaggaaatga

SEQ ID NO: 9150648 - DNA, 22 bp, Homo sapiens
agaaagttgttttagccaaacc

SEQ ID NO: 9150649 - DNA, 22 bp, Homo sapiens
agaaagttagcagactcttggc

SEQ ID NO: 9150650 - DNA, 22 bp, Homo sapiens
agaaagttatcacaaaattgag

SEQ ID NO: 9150651 - DNA, 22 bp, Homo sapiens
agaaagctccccatgagatgat

SEQ ID NO: 9150652 - DNA, 22 bp, Homo sapiens
agaaagctggaagagctgggat

SEQ ID NO: 9150653 - DNA, 22 bp, Homo sapiens
agaaagggttctctgaggtgct

SEQ ID NO: 9150654 - DNA, 22 bp, Homo sapiens
agaaagggtcactgaaagagga

SEQ ID NO: 9150655 - DNA, 22 bp, Homo sapiens
agaaagggtcactgaaagagga

SEQ ID NO: 9150656 - DNA, 22 bp, Homo sapiens
acgcccggtctccatagttttt

SEQ ID NO: 9150657 - DNA, 22 bp, Homo sapiens
acgcccagactcccatactttg

SEQ ID NO: 9150658 - DNA, 22 bp, Homo sapiens
acgcccagactcccatactttg

SEQ ID NO: 9150659 - DNA, 22 bp, Homo sapiens
acgcatggtaaatccactgact

SEQ ID NO: 9150660 - DNA, 22 bp, Homo sapiens
agtaaaaattgaggtgcaaaat

SEQ ID NO: 9150661 - DNA, 22 bp, Homo sapiens
acggcttcttgactgtgggttg

SEQ ID NO: 9150662 - DNA, 22 bp, Homo sapiens
aggttcttttggccaacctcat

SEQ ID NO: 9150663 - DNA, 22 bp, Homo sapiens
aggttcttggtgtccagatttc

SEQ ID NO: 9150664 - DNA, 22 bp, Homo sapiens
acggcttcttgactgtgggttg

SEQ ID NO: 9150665 - DNA, 22 bp, Homo sapiens
acgcctgtaatcccagcacttt

SEQ ID NO: 9150666 - DNA, 18 bp, Homo sapiens
acggatccgcgggaccgc

SEQ ID NO: 9150667 - DNA, 22 bp, Homo sapiens
acggatttgggttaggtcacca

SEQ ID NO: 9150668 - DNA, 22 bp, Homo sapiens
acggaaggctggagaagtacca

SEQ ID NO: 9150669 - DNA, 22 bp, Homo sapiens
acgctatcaatctagacaaaga

SEQ ID NO: 9150670 - DNA, 22 bp, Homo sapiens
acgcgcaaccaggcatgcacat

SEQ ID NO: 9150671 - DNA, 22 bp, Homo sapiens
agtaaaacagagaaatcactca

SEQ ID NO: 9150672 - DNA, 22 bp, Homo sapiens
agtaaaatcttaagcacagtgg

SEQ ID NO: 9150673 - DNA, 22 bp, Homo sapiens
agtaaacactaaaatgactgcg

SEQ ID NO: 9150674 - DNA, 22 bp, Homo sapiens
agtaaaattgtattggaaaaca

SEQ ID NO: 9150675 - DNA, 22 bp, Homo sapiens
agtaaaattgtattggaaaaca

SEQ ID NO: 9150676 - DNA, 22 bp, Homo sapiens
agtaaaatttctgctgaggaga

SEQ ID NO: 9150677 - DNA, 22 bp, Homo sapiens
actagcaagttttgtgtctgga

SEQ ID NO: 9150678 - DNA, 22 bp, Homo sapiens
actagctgtgacagctgcgtgt

SEQ ID NO: 9150679 - DNA, 22 bp, Homo sapiens
actagacatcgagctacagagt

SEQ ID NO: 9150680 - DNA, 22 bp, Homo sapiens
agtaaacactgtctttatatat

SEQ ID NO: 9150681 - DNA, 22 bp, Homo sapiens
agtaaacagaaagcaagatgat

SEQ ID NO: 9150682 - DNA, 22 bp, Homo sapiens
actagaaattactcagaataaa

SEQ ID NO: 9150683 - DNA, 21 bp, Homo sapiens
agtatttcttcatgtccttgc

SEQ ID NO: 9150684 - DNA, 21 bp, Homo sapiens
agtatttcttcatgtccttgc

SEQ ID NO: 9150685 - DNA, 22 bp, Homo sapiens
agtatttgagaggtccaggtgt

SEQ ID NO: 9150686 - DNA, 22 bp, Homo sapiens
agtatttgaagatgttgagtac

SEQ ID NO: 9150687 - DNA, 22 bp, Homo sapiens
agtatttgatacagtcttctag

SEQ ID NO: 9150688 - DNA, 22 bp, Homo sapiens
agtatttggcctctacagtctc

SEQ ID NO: 9150689 - DNA, 22 bp, Homo sapiens
agtatttgatcagatgatagta

SEQ ID NO: 9150690 - DNA, 22 bp, Homo sapiens
agtatttgcatgttagggacct

SEQ ID NO: 9150691 - DNA, 22 bp, Homo sapiens
agtatttggtgtggtattgacc

SEQ ID NO: 9150692 - DNA, 22 bp, Homo sapiens
agtatttgttgattgatatgaa

SEQ ID NO: 9150693 - DNA, 22 bp, Homo sapiens
agtatttgttgaatgagtgaat

SEQ ID NO: 9150694 - DNA, 22 bp, Homo sapiens
agtatttgtggatttgtattgg

SEQ ID NO: 9150695 - DNA, 22 bp, Homo sapiens
agtcaaactgcctaggaagcag

SEQ ID NO: 9150696 - DNA, 22 bp, Homo sapiens
agtcaaagatgaccgagttcct

SEQ ID NO: 9150697 - DNA, 22 bp, Homo sapiens
agtcaaagctacaggcatttga

SEQ ID NO: 9150698 - DNA, 22 bp, Homo sapiens
agtattttcgccatcacaagaa

SEQ ID NO: 9150699 - DNA, 22 bp, Homo sapiens
agtattttcaaccatagcctgg

SEQ ID NO: 9150700 - DNA, 22 bp, Homo sapiens
agtattttcaaccatagcctgg

SEQ ID NO: 9150701 - DNA, 22 bp, Homo sapiens
agtattttcgccatcacaagaa

SEQ ID NO: 9150702 - DNA, 22 bp, Homo sapiens
actagtgaagaagatttgactg

SEQ ID NO: 9150703 - DNA, 22 bp, Homo sapiens
agtatacatatattagccttcg

SEQ ID NO: 9150704 - DNA, 22 bp, Homo sapiens
actaggggctcaggcccaggga

SEQ ID NO: 9150705 - DNA, 22 bp, Homo sapiens
actaggggctcaggcccaggga

SEQ ID NO: 9150706 - DNA, 22 bp, Homo sapiens
actagtctgcattacaaaatag

SEQ ID NO: 9150707 - DNA, 22 bp, Homo sapiens
actaggaaggcatatgggcaga

SEQ ID NO: 9150708 - DNA, 22 bp, Homo sapiens
actcaggccccatcgcccatct

SEQ ID NO: 9150709 - DNA, 22 bp, Homo sapiens
actcaggcctccttctgtcctt

SEQ ID NO: 9150710 - DNA, 22 bp, Homo sapiens
actcaggcactcagccctcgcc

SEQ ID NO: 9150711 - DNA, 22 bp, Homo sapiens
agtcccagctcagaaccactag

SEQ ID NO: 9150712 - DNA, 22 bp, Homo sapiens
agtcccagctctgccacttact

SEQ ID NO: 9150713 - DNA, 22 bp, Homo sapiens
actcaggcttcaggcacagctg

SEQ ID NO: 9150714 - DNA, 22 bp, Homo sapiens
agtccaggcgggtatagaggct

SEQ ID NO: 9150715 - DNA, 22 bp, Homo sapiens
agtccaggcgggtatagaggct

SEQ ID NO: 9150716 - DNA, 22 bp, Homo sapiens
agtcaacagcattatggatgaa

SEQ ID NO: 9150717 - DNA, 22 bp, Homo sapiens
agtcaaataagagagagatgtt

SEQ ID NO: 9150718 - DNA, 22 bp, Homo sapiens
agtcaacaaaaatgtggagcct

SEQ ID NO: 9150719 - DNA, 22 bp, Homo sapiens
acctgaatccccagggccttcc

SEQ ID NO: 9150720 - DNA, 22 bp, Homo sapiens
acctctgtatagttgcctgtgg

SEQ ID NO: 9150721 - DNA, 22 bp, Homo sapiens
acctctttgaacctcagtgtga

SEQ ID NO: 9150722 - DNA, 22 bp, Homo sapiens
acctctgggcagcacctttgta

SEQ ID NO: 9150723 - DNA, 22 bp, Homo sapiens
acctctgtacctcctctgacag

SEQ ID NO: 9150724 - DNA, 22 bp, Homo sapiens
acctcttaatattgcaccttct

SEQ ID NO: 9150725 - DNA, 22 bp, Homo sapiens
acctctgtatagttgcctgtgg

SEQ ID NO: 9150726 - DNA, 22 bp, Homo sapiens
accctctagagggaagcacttt

SEQ ID NO: 9150727 - DNA, 22 bp, Homo sapiens
acctcctccaaggagccatagg

SEQ ID NO: 9150728 - DNA, 19 bp, Homo sapiens
accctctctgtagaaagat

SEQ ID NO: 9150729 - DNA, 19 bp, Homo sapiens
accctctccccactgggtc

SEQ ID NO: 9150730 - DNA, 22 bp, Homo sapiens
accctctgagaggcacactttg

SEQ ID NO: 9150731 - DNA, 19 bp, Homo sapiens
accctctcagtgcctgagg

SEQ ID NO: 9150732 - DNA, 19 bp, Homo sapiens
accctctcagtgcctgagg

SEQ ID NO: 9150733 - DNA, 22 bp, Homo sapiens
acctgcagtggccactcctaat

SEQ ID NO: 9150734 - DNA, 22 bp, Homo sapiens
acctgcatgatggaacatgagg

SEQ ID NO: 9150735 - DNA, 22 bp, Homo sapiens
acctgcatgatgtctgaagcaa

SEQ ID NO: 9150736 - DNA, 22 bp, Homo sapiens
acctgcaggtgtttccacactt

SEQ ID NO: 9150737 - DNA, 22 bp, Homo sapiens
acctgcagctaaagatgtaggg

SEQ ID NO: 9150738 - DNA, 22 bp, Homo sapiens
acctgcagccacttctctcctt

SEQ ID NO: 9150739 - DNA, 22 bp, Homo sapiens
acctgcaggcacaggtgtgcgc

SEQ ID NO: 9150740 - DNA, 22 bp, Homo sapiens
acctgagggcccaaacttggta

SEQ ID NO: 9150741 - DNA, 20 bp, Homo sapiens
acctgaggtccctatggtct

SEQ ID NO: 9150742 - DNA, 22 bp, Homo sapiens
acctgcaagcattacacttcta

SEQ ID NO: 9150743 - DNA, 22 bp, Homo sapiens
acctgaggctgttagtctaggt

SEQ ID NO: 9150744 - DNA, 22 bp, Homo sapiens
acctgagggagattaggcctga

SEQ ID NO: 9150745 - DNA, 22 bp, Homo sapiens
acctgaggcctccccagcagac

SEQ ID NO: 9150746 - DNA, 22 bp, Homo sapiens
acctgaggcctccccagcagac

SEQ ID NO: 9150747 - DNA, 22 bp, Homo sapiens
acctgaggactggatggtagaa

SEQ ID NO: 9150748 - DNA, 22 bp, Homo sapiens
acctgagacctaatctgactgt

SEQ ID NO: 9150749 - DNA, 22 bp, Homo sapiens
acctgagacctaatctgactgt

SEQ ID NO: 9150750 - DNA, 22 bp, Homo sapiens
aggtctacatgcttaatatatc

SEQ ID NO: 9150751 - DNA, 19 bp, Homo sapiens
aggtccttggctggaagtt

SEQ ID NO: 9150752 - DNA, 22 bp, Homo sapiens
aggtcctgtttcttccctgggg

SEQ ID NO: 9150753 - DNA, 22 bp, Homo sapiens
aggtcctgtttcttccctgggg

SEQ ID NO: 9150754 - DNA, 22 bp, Homo sapiens
aggtccttggttgtctgaagaa

SEQ ID NO: 9150755 - DNA, 20 bp, Homo sapiens
aggtcctgttccttgtctcc

SEQ ID NO: 9150756 - DNA, 22 bp, Homo sapiens
aggtcctgtgtccaggggcctg

SEQ ID NO: 9150757 - DNA, 22 bp, Homo sapiens
aggtcctgtgtccaggggcctg

SEQ ID NO: 9150758 - DNA, 22 bp, Homo sapiens
aggtcctgtggtttgggtaaaa

SEQ ID NO: 9150759 - DNA, 22 bp, Homo sapiens
aggtcctgtcttatctctgtaa

SEQ ID NO: 9150760 - DNA, 22 bp, Homo sapiens
aggtcctgtctatcaccctcgc

SEQ ID NO: 9150761 - DNA, 22 bp, Homo sapiens
aggtcctgtcttatctctgtaa

SEQ ID NO: 9150762 - DNA, 22 bp, Homo sapiens
aggtcctgtctatcaccctcgc

SEQ ID NO: 9150763 - DNA, 22 bp, Homo sapiens
acctggattttgcttagacatg

SEQ ID NO: 9150764 - DNA, 22 bp, Homo sapiens
acctggaggcagaggttgcagt

SEQ ID NO: 9150765 - DNA, 22 bp, Homo sapiens
acctggagggaagttctgactt

SEQ ID NO: 9150766 - DNA, 22 bp, Homo sapiens
acctggagtcatttgaggagta

SEQ ID NO: 9150767 - DNA, 22 bp, Homo sapiens
aggtctctgagtactgctggac

SEQ ID NO: 9150768 - DNA, 22 bp, Homo sapiens
aggtctctcagccctgacattc

SEQ ID NO: 9150769 - DNA, 22 bp, Homo sapiens
aggtctctgagtactgctggac

SEQ ID NO: 9150770 - DNA, 22 bp, Homo sapiens
aggtctccttgtgggtcttgcc

SEQ ID NO: 9150771 - DNA, 18 bp, Homo sapiens
aggtggcctgggagcttt

SEQ ID NO: 9150772 - DNA, 22 bp, Homo sapiens
aggtggcatgcctgagacataa

SEQ ID NO: 9150773 - DNA, 22 bp, Homo sapiens
acctggcacattctaccacagt

SEQ ID NO: 9150774 - DNA, 20 bp, Homo sapiens
acctggctctcaggagcaac

SEQ ID NO: 9150775 - DNA, 22 bp, Homo sapiens
actggaattggaatctggagct

SEQ ID NO: 9150776 - DNA, 22 bp, Homo sapiens
actggaattggaatctggagct

SEQ ID NO: 9150777 - DNA, 22 bp, Homo sapiens
actggaatgtcatcgtgacttt

SEQ ID NO: 9150778 - DNA, 22 bp, Homo sapiens
actggaatcctctagagggtga

SEQ ID NO: 9150779 - DNA, 22 bp, Homo sapiens
actggaataaatggagggatga

SEQ ID NO: 9150780 - DNA, 22 bp, Homo sapiens
actggaaagtattctttcactg

SEQ ID NO: 9150781 - DNA, 22 bp, Homo sapiens
actgctttatctgagaagtcct

SEQ ID NO: 9150782 - DNA, 22 bp, Homo sapiens
agtgtattagttgtccagcagt

SEQ ID NO: 9150783 - DNA, 22 bp, Homo sapiens
agtgtattacagaactgacatt

SEQ ID NO: 9150784 - DNA, 22 bp, Homo sapiens
agtgtattaagttatgaagtta

SEQ ID NO: 9150785 - DNA, 22 bp, Homo sapiens
agtgtattaagttatgaagtta

SEQ ID NO: 9150786 - DNA, 21 bp, Homo sapiens
agtgtgtgataggcaggaaga

SEQ ID NO: 9150787 - DNA, 22 bp, Homo sapiens
agtgttcttctggggtatgctc

SEQ ID NO: 9150788 - DNA, 22 bp, Homo sapiens
actggctttgagggaatagcta

SEQ ID NO: 9150789 - DNA, 18 bp, Homo sapiens
actggctttagcatcaga

SEQ ID NO: 9150790 - DNA, 21 bp, Homo sapiens
actggcttgtatttggtaagc

SEQ ID NO: 9150791 - DNA, 18 bp, Homo sapiens
actggctttagcatcaga

SEQ ID NO: 9150792 - DNA, 22 bp, Homo sapiens
actggcttgtgagacaatgcct

SEQ ID NO: 9150793 - DNA, 21 bp, Homo sapiens
actggcttggctctggctgaa

SEQ ID NO: 9150794 - DNA, 22 bp, Homo sapiens
actggcttggcaggaggaagat

SEQ ID NO: 9150795 - DNA, 22 bp, Homo sapiens
actggctttgcctctgcctctc

SEQ ID NO: 9150796 - DNA, 22 bp, Homo sapiens
actggctttgcctctgcctctc

SEQ ID NO: 9150797 - DNA, 23 bp, Homo sapiens
actggctttgatccagatagatt

SEQ ID NO: 9150798 - DNA, 23 bp, Homo sapiens
actggctttgatccagatagatt

SEQ ID NO: 9150799 - DNA, 22 bp, Homo sapiens
actggctttgggttgccgcaga

SEQ ID NO: 9150800 - DNA, 22 bp, Homo sapiens
actggctttggcttcagatgag

SEQ ID NO: 9150801 - DNA, 22 bp, Homo sapiens
actggctttgggttgccgcaga

SEQ ID NO: 9150802 - DNA, 22 bp, Homo sapiens
agtggcagtagatgagctggtt

SEQ ID NO: 9150803 - DNA, 22 bp, Homo sapiens
agtggcagtagatgagctggtt

SEQ ID NO: 9150804 - DNA, 22 bp, Homo sapiens
agtggcagtagatgagctggtt

SEQ ID NO: 9150805 - DNA, 22 bp, Homo sapiens
agtggcagtggctgggcagagc

SEQ ID NO: 9150806 - DNA, 22 bp, Homo sapiens
actgcacttcagcctgggtgac

SEQ ID NO: 9150807 - DNA, 22 bp, Homo sapiens
actgcacttcagcctgggtgac

SEQ ID NO: 9150808 - DNA, 22 bp, Homo sapiens
agtggcagtggctgggcagagc

SEQ ID NO: 9150809 - DNA, 22 bp, Homo sapiens
agtggcagtggctgggcagagc

SEQ ID NO: 9150810 - DNA, 22 bp, Homo sapiens
agtggcagtggctgggcagagc

SEQ ID NO: 9150811 - DNA, 22 bp, Homo sapiens
agtggcagagccagggttggga

SEQ ID NO: 9150812 - DNA, 22 bp, Homo sapiens
agtggcagtagatgagctggtt

SEQ ID NO: 9150813 - DNA, 22 bp, Homo sapiens
agtggcagtaacattccacaat

SEQ ID NO: 9150814 - DNA, 22 bp, Homo sapiens
agtgtacacttgcagcctcaag

SEQ ID NO: 9150815 - DNA, 22 bp, Homo sapiens
agtgtacatagttaggaacatc

SEQ ID NO: 9150816 - DNA, 22 bp, Homo sapiens
agtgtacatcagaacatatcaa

SEQ ID NO: 9150817 - DNA, 22 bp, Homo sapiens
agtgtacatgtttacagcatct

SEQ ID NO: 9150818 - DNA, 22 bp, Homo sapiens
agtgtagaaggagaaatggatc

SEQ ID NO: 9150819 - DNA, 22 bp, Homo sapiens
actgcacttcagcctgggtgtc

SEQ ID NO: 9150820 - DNA, 22 bp, Homo sapiens
actgcacttcagcctgggtgtc

SEQ ID NO: 9150821 - DNA, 21 bp, Homo sapiens
agtggggtctctgtggaggcc

SEQ ID NO: 9150822 - DNA, 22 bp, Homo sapiens
actgcactttaggccaactagg

SEQ ID NO: 9150823 - DNA, 22 bp, Homo sapiens
actgcagactctacagttataa

SEQ ID NO: 9150824 - DNA, 22 bp, Homo sapiens
actgaggaacatatataagatg

SEQ ID NO: 9150825 - DNA, 22 bp, Homo sapiens
actgaggattagcccaggctag

SEQ ID NO: 9150826 - DNA, 22 bp, Homo sapiens
agtgcatgcgcttgggaggggt

SEQ ID NO: 9150827 - DNA, 22 bp, Homo sapiens
agtgcatgccttcctgtggatg

SEQ ID NO: 9150828 - DNA, 22 bp, Homo sapiens
agtgcatatatgaagagtatga

SEQ ID NO: 9150829 - DNA, 20 bp, Homo sapiens
agtgcatggagggagagggc

SEQ ID NO: 9150830 - DNA, 22 bp, Homo sapiens
actctgtgttttggtggcagca

SEQ ID NO: 9150831 - DNA, 22 bp, Homo sapiens
actcttatggaaattttaacta

SEQ ID NO: 9150832 - DNA, 22 bp, Homo sapiens
agtgcagtaaatgggcattatg

SEQ ID NO: 9150833 - DNA, 22 bp, Homo sapiens
actcttattccctcagaaatat

SEQ ID NO: 9150834 - DNA, 22 bp, Homo sapiens
agtgcaatgaataacagccacc

SEQ ID NO: 9150835 - DNA, 22 bp, Homo sapiens
agtgcaatggtgccatcatagc

SEQ ID NO: 9150836 - DNA, 22 bp, Homo sapiens
agtgcaatgcagtagttcagca

SEQ ID NO: 9150837 - DNA, 22 bp, Homo sapiens
actctaaaagtgaagtgtggtc

SEQ ID NO: 9150838 - DNA, 20 bp, Homo sapiens
agtctgtcaatttacagtgg

SEQ ID NO: 9150839 - DNA, 22 bp, Homo sapiens
agtctgtcagtcattctaacaa

SEQ ID NO: 9150840 - DNA, 22 bp, Homo sapiens
agtctgtctaatattattcagg

SEQ ID NO: 9150841 - DNA, 23 bp, Homo sapiens
actcgtggaattctctgcgatcg

SEQ ID NO: 9150842 - DNA, 22 bp, Homo sapiens
actcgatttcactagagtaact

SEQ ID NO: 9150843 - DNA, 22 bp, Homo sapiens
agtcttctgtttttcagcagct

SEQ ID NO: 9150844 - DNA, 22 bp, Homo sapiens
agtcttgcattttctgaagatg

SEQ ID NO: 9150845 - DNA, 22 bp, Homo sapiens
agtcttgctcttgcatctgctt

SEQ ID NO: 9150846 - DNA, 22 bp, Homo sapiens
agtcccaggcagccgagccggt

SEQ ID NO: 9150847 - DNA, 22 bp, Homo sapiens
agtcccagcttcccccatgcag

SEQ ID NO: 9150848 - DNA, 22 bp, Homo sapiens
agtcccagtgacttggccagaa

SEQ ID NO: 9150849 - DNA, 21 bp, Homo sapiens
agtcccaggggtgagtgatgt

SEQ ID NO: 9150850 - DNA, 19 bp, Homo sapiens
agtcccaggcccgaaagag

SEQ ID NO: 9150851 - DNA, 22 bp, Homo sapiens
agtcccagtgagatgaaccagg

SEQ ID NO: 9150852 - DNA, 22 bp, Homo sapiens
agtcccagtgagatgagccacg

SEQ ID NO: 9150853 - DNA, 22 bp, Homo sapiens
agtcccagtgagatgagccacg

SEQ ID NO: 9150854 - DNA, 22 bp, Homo sapiens
agtcccagttcggttcttcctc

SEQ ID NO: 9150855 - DNA, 22 bp, Homo sapiens
actcctgggttgcagtcctcaa

SEQ ID NO: 9150856 - DNA, 22 bp, Homo sapiens
cagacatatgttttaacagatt

SEQ ID NO: 9150857 - DNA, 22 bp, Homo sapiens
cagacatatgttttaacagatt

SEQ ID NO: 9150858 - DNA, 22 bp, Homo sapiens
cagacatcacactcagattgca

SEQ ID NO: 9150859 - DNA, 20 bp, Homo sapiens
cagacatctccaaatctgtg

SEQ ID NO: 9150860 - DNA, 22 bp, Homo sapiens
cagacatccaggtacgagcttt

SEQ ID NO: 9150861 - DNA, 22 bp, Homo sapiens
cagacatgagatacagctgcta

SEQ ID NO: 9150862 - DNA, 22 bp, Homo sapiens
cagacatgatgtaagcagaggc

SEQ ID NO: 9150863 - DNA, 22 bp, Homo sapiens
cagacatatccctgctccctta

SEQ ID NO: 9150864 - DNA, 22 bp, Homo sapiens
cagacaggttgcaaaacttcaa

SEQ ID NO: 9150865 - DNA, 22 bp, Homo sapiens
cagacaggaagttcagaagaaa

SEQ ID NO: 9150866 - DNA, 22 bp, Homo sapiens
agccagagactgtgtctgtaat

SEQ ID NO: 9150867 - DNA, 22 bp, Homo sapiens
agccagagaacagcaggaaatg

SEQ ID NO: 9150868 - DNA, 22 bp, Homo sapiens
agccagacatggctcctgctcc

SEQ ID NO: 9150869 - DNA, 22 bp, Homo sapiens
agccagactttaaaatagatga

SEQ ID NO: 9150870 - DNA, 22 bp, Homo sapiens
agccagacctcggagtagtgag

SEQ ID NO: 9150871 - DNA, 22 bp, Homo sapiens
agccactgtctgaacttctgtg

SEQ ID NO: 9150872 - DNA, 22 bp, Homo sapiens
agccactgtctgaacttctgtg

SEQ ID NO: 9150873 - DNA, 22 bp, Homo sapiens
agccactgtgagaggaccaggg

SEQ ID NO: 9150874 - DNA, 22 bp, Homo sapiens
cagaatgggaaggactgcagtt

SEQ ID NO: 9150875 - DNA, 22 bp, Homo sapiens
agccagaaaggggcattatctg

SEQ ID NO: 9150876 - DNA, 19 bp, Homo sapiens
agccagaactagtgtttct

SEQ ID NO: 9150877 - DNA, 19 bp, Homo sapiens
agccagaactagtgtttct

SEQ ID NO: 9150878 - DNA, 22 bp, Homo sapiens
agccactgtgcaggagcagtgt

SEQ ID NO: 9150879 - DNA, 22 bp, Homo sapiens
agccactgtgcaggagcagtgt

SEQ ID NO: 9150880 - DNA, 22 bp, Homo sapiens
agccactgtgtgaccagctgtc

SEQ ID NO: 9150881 - DNA, 22 bp, Homo sapiens
agccactgtgtgaccagctgtc

SEQ ID NO: 9150882 - DNA, 22 bp, Homo sapiens
agccactgtgtgaccagctgtc

SEQ ID NO: 9150883 - DNA, 22 bp, Homo sapiens
cagaatgaaatgtaagaacacc

SEQ ID NO: 9150884 - DNA, 22 bp, Homo sapiens
cagaatgagtagcatcttcacc

SEQ ID NO: 9150885 - DNA, 22 bp, Homo sapiens
cagaatcagtgacacatgtata

SEQ ID NO: 9150886 - DNA, 22 bp, Homo sapiens
cagaatcagcccttgctattaa

SEQ ID NO: 9150887 - DNA, 22 bp, Homo sapiens
cagaatatgacaagattttcct

SEQ ID NO: 9150888 - DNA, 22 bp, Homo sapiens
cagaaggagggggcaagccctg

SEQ ID NO: 9150889 - DNA, 22 bp, Homo sapiens
agccacaggaaacagagacagc

SEQ ID NO: 9150890 - DNA, 22 bp, Homo sapiens
agcatatagctatctttgattg

SEQ ID NO: 9150891 - DNA, 22 bp, Homo sapiens
agccacagtctgtagccagctt

SEQ ID NO: 9150892 - DNA, 22 bp, Homo sapiens
agccacagtctgtagccagctt

SEQ ID NO: 9150893 - DNA, 22 bp, Homo sapiens
agccacagtgggctaccagctc

SEQ ID NO: 9150894 - DNA, 22 bp, Homo sapiens
agccaccaccactgaaaggtta

SEQ ID NO: 9150895 - DNA, 22 bp, Homo sapiens
agccacatttttctgctcctga

SEQ ID NO: 9150896 - DNA, 22 bp, Homo sapiens
agccacatggacctgatgctag

SEQ ID NO: 9150897 - DNA, 22 bp, Homo sapiens
agccacatgagtgagccatctt

SEQ ID NO: 9150898 - DNA, 22 bp, Homo sapiens
agccacagtgggctaccagctc

SEQ ID NO: 9150899 - DNA, 20 bp, Homo sapiens
agccacctcatttccctacc

SEQ ID NO: 9150900 - DNA, 22 bp, Homo sapiens
agccacccattcccgagcccta

SEQ ID NO: 9150901 - DNA, 22 bp, Homo sapiens
agccaccctaccagccctgaaa

SEQ ID NO: 9150902 - DNA, 22 bp, Homo sapiens
agccaccctaccagccctgaaa

SEQ ID NO: 9150903 - DNA, 22 bp, Homo sapiens
agccacctcacctgctgccgtt

SEQ ID NO: 9150904 - DNA, 16 bp, Homo sapiens
agccacctcagaggac

SEQ ID NO: 9150905 - DNA, 22 bp, Homo sapiens
agccacctctatcttgggctcc

SEQ ID NO: 9150906 - DNA, 22 bp, Homo sapiens
agccacctctgtgcaggcctcg

SEQ ID NO: 9150907 - DNA, 22 bp, Homo sapiens
agccacctggacacaggcttgc

SEQ ID NO: 9150908 - DNA, 22 bp, Homo sapiens
agccacctcctgctctgctcac

SEQ ID NO: 9150909 - DNA, 22 bp, Homo sapiens
agccaccttcacatggtctatc

SEQ ID NO: 9150910 - DNA, 22 bp, Homo sapiens
agccaccttctccaaggcctag

SEQ ID NO: 9150911 - DNA, 22 bp, Homo sapiens
agccacgtccctgtcagggtca

SEQ ID NO: 9150912 - DNA, 19 bp, Homo sapiens
cagaaatagcgaagtgtaa

SEQ ID NO: 9150913 - DNA, 22 bp, Homo sapiens
agccactgtctgaacttctgtg

SEQ ID NO: 9150914 - DNA, 22 bp, Homo sapiens
agccactgtaaggggaattgcc

SEQ ID NO: 9150915 - DNA, 22 bp, Homo sapiens
agccactgcccttagccatttg

SEQ ID NO: 9150916 - DNA, 22 bp, Homo sapiens
cagaaatatatatgggtcagag

SEQ ID NO: 9150917 - DNA, 22 bp, Homo sapiens
cagaaatatcacctggactcta

SEQ ID NO: 9150918 - DNA, 21 bp, Homo sapiens
cagaaatatgaatgatggtga

SEQ ID NO: 9150919 - DNA, 22 bp, Homo sapiens
cagaaatatcagttgaaagtgc

SEQ ID NO: 9150920 - DNA, 22 bp, Homo sapiens
cagaaatattccaagtactgca

SEQ ID NO: 9150921 - DNA, 22 bp, Homo sapiens
cagaaatatgtgccatgcctta

SEQ ID NO: 9150922 - DNA, 22 bp, Homo sapiens
cagaaatatttattgagtgaca

SEQ ID NO: 9150923 - DNA, 18 bp, Homo sapiens
cagaaatcacaccagcac

SEQ ID NO: 9150924 - DNA, 22 bp, Homo sapiens
cagaaggagcgctaaggtccca

SEQ ID NO: 9150925 - DNA, 22 bp, Homo sapiens
cagaataatattggtctcatag

SEQ ID NO: 9150926 - DNA, 22 bp, Homo sapiens
cagaataagctgtgttgtcaag

SEQ ID NO: 9150927 - DNA, 22 bp, Homo sapiens
agcccagcccgggctgcgcttt

SEQ ID NO: 9150928 - DNA, 22 bp, Homo sapiens
agcccagcaaagggaggttcag

SEQ ID NO: 9150929 - DNA, 22 bp, Homo sapiens
agcccaaggccacacagttagt

SEQ ID NO: 9150930 - DNA, 22 bp, Homo sapiens
agcccagaaatgaaaggatgat

SEQ ID NO: 9150931 - DNA, 22 bp, Homo sapiens
agcccagaaatgaaaggatgat

SEQ ID NO: 9150932 - DNA, 22 bp, Homo sapiens
agcccagaggctgggcgtgcat

SEQ ID NO: 9150933 - DNA, 22 bp, Homo sapiens
agcccagagggtagcagaagaa

SEQ ID NO: 9150934 - DNA, 22 bp, Homo sapiens
agcccagagggtagcagaagaa

SEQ ID NO: 9150935 - DNA, 22 bp, Homo sapiens
cagagaaagggtgaattccttc

SEQ ID NO: 9150936 - DNA, 22 bp, Homo sapiens
agccagtttgcttgtaataaca

SEQ ID NO: 9150937 - DNA, 22 bp, Homo sapiens
cagagaaagaagcccattcatt

SEQ ID NO: 9150938 - DNA, 22 bp, Homo sapiens
agcccaagccagtgcttctaga

SEQ ID NO: 9150939 - DNA, 22 bp, Homo sapiens
agcccaagctatgaggtgacct

SEQ ID NO: 9150940 - DNA, 22 bp, Homo sapiens
agcccaagctatgaggtgacct

SEQ ID NO: 9150941 - DNA, 22 bp, Homo sapiens
agcccaagcctggctggcgatg

SEQ ID NO: 9150942 - DNA, 18 bp, Homo sapiens
agccatatggagactctg

SEQ ID NO: 9150943 - DNA, 22 bp, Homo sapiens
cagagaaactcagatagctgat

SEQ ID NO: 9150944 - DNA, 22 bp, Homo sapiens
cagagaaactcagatagctgat

SEQ ID NO: 9150945 - DNA, 22 bp, Homo sapiens
cagagaaaaaatcctgctctca

SEQ ID NO: 9150946 - DNA, 22 bp, Homo sapiens
cagagaaaaaatcctgctctca

SEQ ID NO: 9150947 - DNA, 22 bp, Homo sapiens
cagactttctggaagctaaaaa

SEQ ID NO: 9150948 - DNA, 22 bp, Homo sapiens
cagaggagttcagtacacagcc

SEQ ID NO: 9150949 - DNA, 21 bp, Homo sapiens
cagaggcaggctctgtgtgtg

SEQ ID NO: 9150950 - DNA, 21 bp, Homo sapiens
cagaggcaggctctgtgtgtg

SEQ ID NO: 9150951 - DNA, 21 bp, Homo sapiens
cagaggcaggtcctgggacgg

SEQ ID NO: 9150952 - DNA, 21 bp, Homo sapiens
cagaggcaggtcctgggacgg

SEQ ID NO: 9150953 - DNA, 22 bp, Homo sapiens
cagaggcagtggggttgctcct

SEQ ID NO: 9150954 - DNA, 22 bp, Homo sapiens
cagaggcattactgaaaaggtg

SEQ ID NO: 9150955 - DNA, 22 bp, Homo sapiens
cagaggcattactgaaaaggtg

SEQ ID NO: 9150956 - DNA, 23 bp, Homo sapiens
cagaggcatcggattcaacatca

SEQ ID NO: 9150957 - DNA, 22 bp, Homo sapiens
agcccaggcagagggatgcttg

SEQ ID NO: 9150958 - DNA, 22 bp, Homo sapiens
cagaggcatataattgctgggg

SEQ ID NO: 9150959 - DNA, 23 bp, Homo sapiens
cagaggcatcggattcaacatca

SEQ ID NO: 9150960 - DNA, 23 bp, Homo sapiens
cagaggcatcggattcaacatca

SEQ ID NO: 9150961 - DNA, 22 bp, Homo sapiens
cagaggcatactcccagtcttg

SEQ ID NO: 9150962 - DNA, 22 bp, Homo sapiens
cagaggcagtggggttgctcct

SEQ ID NO: 9150963 - DNA, 22 bp, Homo sapiens
cagaggctgacaaaatattgct

SEQ ID NO: 9150964 - DNA, 22 bp, Homo sapiens
agcccagggaaccaggaagtgg

SEQ ID NO: 9150965 - DNA, 22 bp, Homo sapiens
agcccagggaaccaggaagtgg

SEQ ID NO: 9150966 - DNA, 22 bp, Homo sapiens
agcccagggaaccaggaagtgg

SEQ ID NO: 9150967 - DNA, 22 bp, Homo sapiens
cagaggctcttcctcactgccc

SEQ ID NO: 9150968 - DNA, 22 bp, Homo sapiens
cagaggctcttcctcactgccc

SEQ ID NO: 9150969 - DNA, 22 bp, Homo sapiens
cagagggacagtatgatgaaag

SEQ ID NO: 9150970 - DNA, 20 bp, Homo sapiens
agcccaggcctgtgtgagtc

SEQ ID NO: 9150971 - DNA, 20 bp, Homo sapiens
agcccaggcctgtgtgagtc

SEQ ID NO: 9150972 - DNA, 20 bp, Homo sapiens
agcccaggcctgtgtgagtc

SEQ ID NO: 9150973 - DNA, 20 bp, Homo sapiens
agcccaggcctgtgtgagtc

SEQ ID NO: 9150974 - DNA, 22 bp, Homo sapiens
agcccaggcagagggatgcttg

SEQ ID NO: 9150975 - DNA, 18 bp, Homo sapiens
agcccaggcatcgtctgc

SEQ ID NO: 9150976 - DNA, 22 bp, Homo sapiens
agcccaggctggagtgcagtgg

SEQ ID NO: 9150977 - DNA, 22 bp, Homo sapiens
agcccaggctggagtgcagtgg

SEQ ID NO: 9150978 - DNA, 22 bp, Homo sapiens
agcccagggaaccaggaagtgg

SEQ ID NO: 9150979 - DNA, 22 bp, Homo sapiens
agcccaggctggagtgcagtgg

SEQ ID NO: 9150980 - DNA, 22 bp, Homo sapiens
agcccaggctggagtgcagtgg

SEQ ID NO: 9150981 - DNA, 22 bp, Homo sapiens
cagcatattcagtgtagctcag

SEQ ID NO: 9150982 - DNA, 22 bp, Homo sapiens
cagccctgagagaaccatctat

SEQ ID NO: 9150983 - DNA, 23 bp, Homo sapiens
cagccctgaaatcgaggtgacac

SEQ ID NO: 9150984 - DNA, 22 bp, Homo sapiens
cagccctgagttagcccacgga

SEQ ID NO: 9150985 - DNA, 22 bp, Homo sapiens
cagccctgagttagcccacgga

SEQ ID NO: 9150986 - DNA, 22 bp, Homo sapiens
cagccctgagttagcccacgga

SEQ ID NO: 9150987 - DNA, 16 bp, Homo sapiens
cagccctgaggaagaa

SEQ ID NO: 9150988 - DNA, 22 bp, Homo sapiens
cagccctgcagagggcgctcct

SEQ ID NO: 9150989 - DNA, 22 bp, Homo sapiens
cagccctgcacgctgcctccgc

SEQ ID NO: 9150990 - DNA, 22 bp, Homo sapiens
cagcagtgtggaagctgagggg

SEQ ID NO: 9150991 - DNA, 22 bp, Homo sapiens
cagcagtgtggaagctgagggg

SEQ ID NO: 9150992 - DNA, 22 bp, Homo sapiens
cagcagtgtgcaggtgtgctgg

SEQ ID NO: 9150993 - DNA, 22 bp, Homo sapiens
cagcaggggaactgtgggccag

SEQ ID NO: 9150994 - DNA, 22 bp, Homo sapiens
cagcaggggaactgtgggccag

SEQ ID NO: 9150995 - DNA, 22 bp, Homo sapiens
cagcaggggaactgtgggccag

SEQ ID NO: 9150996 - DNA, 22 bp, Homo sapiens
cagcaggggtgtcattgtagtt

SEQ ID NO: 9150997 - DNA, 22 bp, Homo sapiens
cagcaggggtgtcattgtagtt

SEQ ID NO: 9150998 - DNA, 22 bp, Homo sapiens
cagcagggggcagcgcagatca

SEQ ID NO: 9150999 - DNA, 22 bp, Homo sapiens
cagcagggttaagtgactcacc

SEQ ID NO: 9151000 - DNA, 22 bp, Homo sapiens
cagcagggtaggttgtatcagt

SEQ ID NO: 9151001 - DNA, 22 bp, Homo sapiens
cagcagggtaggttgtatcagt

SEQ ID NO: 9151002 - DNA, 22 bp, Homo sapiens
cagcagggtatacagggaattt

SEQ ID NO: 9151003 - DNA, 22 bp, Homo sapiens
cagcagggtatacagggaattt

SEQ ID NO: 9151004 - DNA, 22 bp, Homo sapiens
cagcagggtatacagggaattt

SEQ ID NO: 9151005 - DNA, 22 bp, Homo sapiens
agctcagagataatcaagagac

SEQ ID NO: 9151006 - DNA, 21 bp, Homo sapiens
agctcagcaagatggaggctc

SEQ ID NO: 9151007 - DNA, 22 bp, Homo sapiens
agctcagcccgttagtaagccc

SEQ ID NO: 9151008 - DNA, 22 bp, Homo sapiens
agctcagcgggcttctggtaag

SEQ ID NO: 9151009 - DNA, 22 bp, Homo sapiens
agctcagcttcctctccatgct

SEQ ID NO: 9151010 - DNA, 22 bp, Homo sapiens
cagctcaggctctccatgctcc

SEQ ID NO: 9151011 - DNA, 22 bp, Homo sapiens
cagctcaggctctccatgctcc

SEQ ID NO: 9151012 - DNA, 22 bp, Homo sapiens
cagctcaggctctccatgctcc

SEQ ID NO: 9151013 - DNA, 19 bp, Homo sapiens
cagctcaggactcagcccc

SEQ ID NO: 9151014 - DNA, 22 bp, Homo sapiens
cagctcaggcactggcgcggga

SEQ ID NO: 9151015 - DNA, 19 bp, Homo sapiens
cagctcaggactcagcccc

SEQ ID NO: 9151016 - DNA, 22 bp, Homo sapiens
agctcaggcaactctgggcccc

SEQ ID NO: 9151017 - DNA, 22 bp, Homo sapiens
cagcgtctcgttgtgggcctcg

SEQ ID NO: 9151018 - DNA, 23 bp, Homo sapiens
agctcctgaggccagcctctcct

SEQ ID NO: 9151019 - DNA, 23 bp, Homo sapiens
agctcctgaggccagcctctcct

SEQ ID NO: 9151020 - DNA, 22 bp, Homo sapiens
agctcctgatacatgcaggaat

SEQ ID NO: 9151021 - DNA, 22 bp, Homo sapiens
cagctctgagactgaggctatg

SEQ ID NO: 9151022 - DNA, 22 bp, Homo sapiens
cagctctgagactgaggctatg

SEQ ID NO: 9151023 - DNA, 22 bp, Homo sapiens
agctcctgaaaatccagactgg

SEQ ID NO: 9151024 - DNA, 18 bp, Homo sapiens
agctcctgaactctgtgg

SEQ ID NO: 9151025 - DNA, 18 bp, Homo sapiens
agctcctgaactctgtgg

SEQ ID NO: 9151026 - DNA, 22 bp, Homo sapiens
agctcctgaaaagcgcttgctt

SEQ ID NO: 9151027 - DNA, 22 bp, Homo sapiens
cagctcagtgatgccttcacag

SEQ ID NO: 9151028 - DNA, 22 bp, Homo sapiens
cagctcagtctggagagatgca

SEQ ID NO: 9151029 - DNA, 22 bp, Homo sapiens
cagctcagtctggagagatgca

SEQ ID NO: 9151030 - DNA, 22 bp, Homo sapiens
agcctcctggagtttctgggat

SEQ ID NO: 9151031 - DNA, 22 bp, Homo sapiens
cagaggtccctgttcttaagga

SEQ ID NO: 9151032 - DNA, 22 bp, Homo sapiens
cagagggccatctctatcttca

SEQ ID NO: 9151033 - DNA, 22 bp, Homo sapiens
cagagggcactcggagtgacat

SEQ ID NO: 9151034 - DNA, 22 bp, Homo sapiens
agcctctggccctagactgctt

SEQ ID NO: 9151035 - DNA, 22 bp, Homo sapiens
agcctctgggggagctgggagc

SEQ ID NO: 9151036 - DNA, 22 bp, Homo sapiens
agcctctgtagaaagcagtgtg

SEQ ID NO: 9151037 - DNA, 22 bp, Homo sapiens
agcctctgtcaagcttttcaaa

SEQ ID NO: 9151038 - DNA, 22 bp, Homo sapiens
agcctctgtcaagcttttcaaa

SEQ ID NO: 9151039 - DNA, 20 bp, Homo sapiens
agcctctgcccttcccactg

SEQ ID NO: 9151040 - DNA, 20 bp, Homo sapiens
agcctctgcccttcccactg

SEQ ID NO: 9151041 - DNA, 22 bp, Homo sapiens
agcctctgctggccctggcact

SEQ ID NO: 9151042 - DNA, 22 bp, Homo sapiens
agcctctgatggctcccaagga

SEQ ID NO: 9151043 - DNA, 22 bp, Homo sapiens
agcctctgcacgggcacgggtg

SEQ ID NO: 9151044 - DNA, 22 bp, Homo sapiens
agcctctgctggccctggcact

SEQ ID NO: 9151045 - DNA, 18 bp, Homo sapiens
agcctctggcagagagaa

SEQ ID NO: 9151046 - DNA, 22 bp, Homo sapiens
cagcagctcagtctctcagtag

SEQ ID NO: 9151047 - DNA, 22 bp, Homo sapiens
cagcagctcaggctgcttccca

SEQ ID NO: 9151048 - DNA, 22 bp, Homo sapiens
cagcagctcaggctccttccca

SEQ ID NO: 9151049 - DNA, 22 bp, Homo sapiens
cagcagctcaggctgcttccca

SEQ ID NO: 9151050 - DNA, 22 bp, Homo sapiens
cagcagctcctctgcggctatg

SEQ ID NO: 9151051 - DNA, 22 bp, Homo sapiens
cagcagctgactccaagagagc

SEQ ID NO: 9151052 - DNA, 22 bp, Homo sapiens
cagcagctcccatccgctgagc

SEQ ID NO: 9151053 - DNA, 22 bp, Homo sapiens
cagcagctccaaagaatagcca

SEQ ID NO: 9151054 - DNA, 22 bp, Homo sapiens
cagcagctccaaagaatagcca

SEQ ID NO: 9151055 - DNA, 22 bp, Homo sapiens
cagcagctccaaagaatagcca

SEQ ID NO: 9151056 - DNA, 22 bp, Homo sapiens
agcctgagagccaagctgtgca

SEQ ID NO: 9151057 - DNA, 22 bp, Homo sapiens
agcctgagccccatccagctga

SEQ ID NO: 9151058 - DNA, 22 bp, Homo sapiens
agcctgagagccaagctgtgca

SEQ ID NO: 9151059 - DNA, 21 bp, Homo sapiens
agcctgaatcccaccagttca

SEQ ID NO: 9151060 - DNA, 22 bp, Homo sapiens
cagcagctcactcaggtggctc

SEQ ID NO: 9151061 - DNA, 22 bp, Homo sapiens
cagcagctcactgaataatgac

SEQ ID NO: 9151062 - DNA, 22 bp, Homo sapiens
cagcagctcactgaataatgac

SEQ ID NO: 9151063 - DNA, 22 bp, Homo sapiens
agcctgagctgcctgccgcctc

SEQ ID NO: 9151064 - DNA, 22 bp, Homo sapiens
cagcagggcccccgggtgcgcc

SEQ ID NO: 9151065 - DNA, 22 bp, Homo sapiens
cagcagggcccccgggtgcgcc

SEQ ID NO: 9151066 - DNA, 22 bp, Homo sapiens
cagcagggcccccgggtgcgcc

SEQ ID NO: 9151067 - DNA, 22 bp, Homo sapiens
cagcagggcccccgggtgcgcc

SEQ ID NO: 9151068 - DNA, 22 bp, Homo sapiens
cagcaggggaactgtgggccag

SEQ ID NO: 9151069 - DNA, 22 bp, Homo sapiens
cagcagggctgtgctaccccat

SEQ ID NO: 9151070 - DNA, 22 bp, Homo sapiens
cagcaggatatggtggagagag

SEQ ID NO: 9151071 - DNA, 22 bp, Homo sapiens
cagcagggaagctgtgctgttt

SEQ ID NO: 9151072 - DNA, 22 bp, Homo sapiens
cagcagggaagctgtgctgttt

SEQ ID NO: 9151073 - DNA, 22 bp, Homo sapiens
cagcagggaagctgtgctgttt

SEQ ID NO: 9151074 - DNA, 22 bp, Homo sapiens
agcctggcactgccccatccat

SEQ ID NO: 9151075 - DNA, 22 bp, Homo sapiens
agcctggaggtaatgaggaaac

SEQ ID NO: 9151076 - DNA, 22 bp, Homo sapiens
agcctggagttcccaggagaag

SEQ ID NO: 9151077 - DNA, 22 bp, Homo sapiens
cagcagctgaggcgctggcgtg

SEQ ID NO: 9151078 - DNA, 22 bp, Homo sapiens
agcacagttctttctctagctg

SEQ ID NO: 9151079 - DNA, 22 bp, Homo sapiens
agcacagttttcattgcagggt

SEQ ID NO: 9151080 - DNA, 22 bp, Homo sapiens
agcacaggtgaaacagtcaggt

SEQ ID NO: 9151081 - DNA, 22 bp, Homo sapiens
agcacagtaattgatattactg

SEQ ID NO: 9151082 - DNA, 22 bp, Homo sapiens
agcaaagcagtggctaagctga

SEQ ID NO: 9151083 - DNA, 22 bp, Homo sapiens
agcaaagcagtggctaagctga

SEQ ID NO: 9151084 - DNA, 22 bp, Homo sapiens
agcaaagcactttgcatacata

SEQ ID NO: 9151085 - DNA, 22 bp, Homo sapiens
agcaaagcactttgcatacata

SEQ ID NO: 9151086 - DNA, 22 bp, Homo sapiens
agcaaagatgtccggggcaagc

SEQ ID NO: 9151087 - DNA, 22 bp, Homo sapiens
agcaaagcaccatatggcagtt

SEQ ID NO: 9151088 - DNA, 22 bp, Homo sapiens
agcaaagcaccatatggcagtt

SEQ ID NO: 9151089 - DNA, 22 bp, Homo sapiens
agcaaagcaccatatggcagtt

SEQ ID NO: 9151090 - DNA, 20 bp, Homo sapiens
agcaaagcctttagagtttg

SEQ ID NO: 9151091 - DNA, 22 bp, Homo sapiens
agcaaagccgagacagccagtg

SEQ ID NO: 9151092 - DNA, 22 bp, Homo sapiens
agcaaagccgagacagccagtg

SEQ ID NO: 9151093 - DNA, 21 bp, Homo sapiens
agcacagctttaagccatgtg

SEQ ID NO: 9151094 - DNA, 22 bp, Homo sapiens
agcacagcttcaccgagcccat

SEQ ID NO: 9151095 - DNA, 22 bp, Homo sapiens
agcacagcttcaccgagcccat

SEQ ID NO: 9151096 - DNA, 22 bp, Homo sapiens
agcacagcttagcacctggcac

SEQ ID NO: 9151097 - DNA, 22 bp, Homo sapiens
agcacagcttagcacctggcac

SEQ ID NO: 9151098 - DNA, 22 bp, Homo sapiens
agcaaagccgagacagccagtg

SEQ ID NO: 9151099 - DNA, 22 bp, Homo sapiens
agcacaggtgaaacagtcaggt

SEQ ID NO: 9151100 - DNA, 21 bp, Homo sapiens
agcacagctttaagccatgtg

SEQ ID NO: 9151101 - DNA, 21 bp, Homo sapiens
agcacagctttaagccatgtg

SEQ ID NO: 9151102 - DNA, 22 bp, Homo sapiens
agcaaagaagacacaggcttca

SEQ ID NO: 9151103 - DNA, 22 bp, Homo sapiens
agcaaagaaatggaggctcaga

SEQ ID NO: 9151104 - DNA, 22 bp, Homo sapiens
agcaaagaaatggaggctcaga

SEQ ID NO: 9151105 - DNA, 22 bp, Homo sapiens
agcaaagaaatggaggctcaga

SEQ ID NO: 9151106 - DNA, 22 bp, Homo sapiens
agcaaagaagggttcttcatta

SEQ ID NO: 9151107 - DNA, 22 bp, Homo sapiens
agcaaagacagggacgaccaag

SEQ ID NO: 9151108 - DNA, 22 bp, Homo sapiens
agcaaagacagggacgaccaag

SEQ ID NO: 9151109 - DNA, 22 bp, Homo sapiens
agcaaactaattgcagttctgg

SEQ ID NO: 9151110 - DNA, 22 bp, Homo sapiens
agcaaactaattgcagttctgg

SEQ ID NO: 9151111 - DNA, 22 bp, Homo sapiens
agcaaactaattgcagttctgg

SEQ ID NO: 9151112 - DNA, 22 bp, Homo sapiens
caacagagcagttgatcaggaa

SEQ ID NO: 9151113 - DNA, 22 bp, Homo sapiens
caacagagggaatggatctcat

SEQ ID NO: 9151114 - DNA, 22 bp, Homo sapiens
caacagagagaccagaaacagg

SEQ ID NO: 9151115 - DNA, 22 bp, Homo sapiens
caacagctgatctttgatgaag

SEQ ID NO: 9151116 - DNA, 22 bp, Homo sapiens
caacagctggaggcttggcccg

SEQ ID NO: 9151117 - DNA, 22 bp, Homo sapiens
caacagctgatctttgatgaag

SEQ ID NO: 9151118 - DNA, 22 bp, Homo sapiens
agcacattaagtgagttcatgt

SEQ ID NO: 9151119 - DNA, 23 bp, Homo sapiens
caacagctgttagatatgggctt

SEQ ID NO: 9151120 - DNA, 22 bp, Homo sapiens
caaattaatgtgtctcaaaata

SEQ ID NO: 9151121 - DNA, 22 bp, Homo sapiens
caaatattccaggtacatccct

SEQ ID NO: 9151122 - DNA, 22 bp, Homo sapiens
caaatatctttggcaaagagaa

SEQ ID NO: 9151123 - DNA, 20 bp, Homo sapiens
caacactgcccattgtttgc

SEQ ID NO: 9151124 - DNA, 23 bp, Homo sapiens
caacactgccttcaggtgaagaa

SEQ ID NO: 9151125 - DNA, 22 bp, Homo sapiens
caactttagaccccaagtagct

SEQ ID NO: 9151126 - DNA, 22 bp, Homo sapiens
caagacctcaaaatgagagggg

SEQ ID NO: 9151127 - DNA, 22 bp, Homo sapiens
caagacgtgagtcattgtttag

SEQ ID NO: 9151128 - DNA, 22 bp, Homo sapiens
caagacattgattttgtacaga

SEQ ID NO: 9151129 - DNA, 21 bp, Homo sapiens
agcaccaaatgcaggctctgg

SEQ ID NO: 9151130 - DNA, 22 bp, Homo sapiens
agcacattcttgccttaacctc

SEQ ID NO: 9151131 - DNA, 22 bp, Homo sapiens
agcacattctgccttgctttgc

SEQ ID NO: 9151132 - DNA, 22 bp, Homo sapiens
agcaccagcaactatgggctgc

SEQ ID NO: 9151133 - DNA, 22 bp, Homo sapiens
cacaaggaggtcctgaggaagc

SEQ ID NO: 9151134 - DNA, 22 bp, Homo sapiens
cacaaggacatgtatatttatg

SEQ ID NO: 9151135 - DNA, 22 bp, Homo sapiens
cacaagctgggcaagtgtatat

SEQ ID NO: 9151136 - DNA, 22 bp, Homo sapiens
cacaaggactggatggagtggg

SEQ ID NO: 9151137 - DNA, 22 bp, Homo sapiens
cacaaggctttcatctggcata

SEQ ID NO: 9151138 - DNA, 22 bp, Homo sapiens
agcagccaaccttacattcatc

SEQ ID NO: 9151139 - DNA, 22 bp, Homo sapiens
agcagccaaatgaagattttac

SEQ ID NO: 9151140 - DNA, 22 bp, Homo sapiens
agcagccacagtctgggacagg

SEQ ID NO: 9151141 - DNA, 22 bp, Homo sapiens
agcagccacccagctgctcatt

SEQ ID NO: 9151142 - DNA, 22 bp, Homo sapiens
agcagccacagtctgggacagg

SEQ ID NO: 9151143 - DNA, 22 bp, Homo sapiens
agcagccacagtctgggacagg

SEQ ID NO: 9151144 - DNA, 22 bp, Homo sapiens
agcagccacagcagatctgagt

SEQ ID NO: 9151145 - DNA, 22 bp, Homo sapiens
agcagccacagcagatctgagt

SEQ ID NO: 9151146 - DNA, 22 bp, Homo sapiens
agcagccacacgcctccttctc

SEQ ID NO: 9151147 - DNA, 22 bp, Homo sapiens
agcagccaattggaggatgaag

SEQ ID NO: 9151148 - DNA, 22 bp, Homo sapiens
agcagccacacgcctccttctc

SEQ ID NO: 9151149 - DNA, 22 bp, Homo sapiens
agcagccaattggaggatgaag

SEQ ID NO: 9151150 - DNA, 22 bp, Homo sapiens
agcagctccctcctcagccacc

SEQ ID NO: 9151151 - DNA, 22 bp, Homo sapiens
agcagccacccagctgctcatt

SEQ ID NO: 9151152 - DNA, 22 bp, Homo sapiens
agcagccagaaagggcagtcga

SEQ ID NO: 9151153 - DNA, 22 bp, Homo sapiens
agcagccacccagctgctcatt

SEQ ID NO: 9151154 - DNA, 22 bp, Homo sapiens
agcagccagaaatccagaggtg

SEQ ID NO: 9151155 - DNA, 22 bp, Homo sapiens
agcagccagaaagggcagtcga

SEQ ID NO: 9151156 - DNA, 22 bp, Homo sapiens
agcagccagaaagggcagtcga

SEQ ID NO: 9151157 - DNA, 22 bp, Homo sapiens
agcagccacccagctgctcatt

SEQ ID NO: 9151158 - DNA, 22 bp, Homo sapiens
agcagcagggtcattgctcttt

SEQ ID NO: 9151159 - DNA, 22 bp, Homo sapiens
agcagcagggtgatagtgccca

SEQ ID NO: 9151160 - DNA, 22 bp, Homo sapiens
caattttttccatgctcttaca

SEQ ID NO: 9151161 - DNA, 22 bp, Homo sapiens
caattttttccatgctcttaca

SEQ ID NO: 9151162 - DNA, 22 bp, Homo sapiens
agcagcagggtgatagtgccca

SEQ ID NO: 9151163 - DNA, 22 bp, Homo sapiens
agcagcagggtgatagtgccca

SEQ ID NO: 9151164 - DNA, 22 bp, Homo sapiens
agcagcagggacaaaggaacag

SEQ ID NO: 9151165 - DNA, 22 bp, Homo sapiens
agcagcagggacaaaggaacag

SEQ ID NO: 9151166 - DNA, 22 bp, Homo sapiens
agcagcagggacaaaggaacag

SEQ ID NO: 9151167 - DNA, 22 bp, Homo sapiens
agcagcagggcatgtcttactc

SEQ ID NO: 9151168 - DNA, 22 bp, Homo sapiens
agcagcagggctctgcccgtgc

SEQ ID NO: 9151169 - DNA, 22 bp, Homo sapiens
agcagcaggcttaaggaaaagt

SEQ ID NO: 9151170 - DNA, 22 bp, Homo sapiens
agcagcaggcttaaggaaaagt

SEQ ID NO: 9151171 - DNA, 21 bp, Homo sapiens
agcagcagggaagcctcatcc

SEQ ID NO: 9151172 - DNA, 21 bp, Homo sapiens
agcagcagggaagcctcatcc

SEQ ID NO: 9151173 - DNA, 22 bp, Homo sapiens
caagatttggcattctgaggag

SEQ ID NO: 9151174 - DNA, 22 bp, Homo sapiens
caagcagaagcctcaggggcat

SEQ ID NO: 9151175 - DNA, 22 bp, Homo sapiens
caagcagagaagtctctaggct

SEQ ID NO: 9151176 - DNA, 22 bp, Homo sapiens
caagcagacagtaggcctagaa

SEQ ID NO: 9151177 - DNA, 22 bp, Homo sapiens
caagcaatattttagaaaggta

SEQ ID NO: 9151178 - DNA, 22 bp, Homo sapiens
caagcagaaatctagaactcca

SEQ ID NO: 9151179 - DNA, 22 bp, Homo sapiens
caagagctaccctgtgccatat

SEQ ID NO: 9151180 - DNA, 22 bp, Homo sapiens
caagagctaccctgtgccatat

SEQ ID NO: 9151181 - DNA, 22 bp, Homo sapiens
caagagcctttgggcagaagga

SEQ ID NO: 9151182 - DNA, 22 bp, Homo sapiens
caagagctagaaattggttaga

SEQ ID NO: 9151183 - DNA, 22 bp, Homo sapiens
caagagctagactttgtcagga

SEQ ID NO: 9151184 - DNA, 17 bp, Homo sapiens
caagagagatgactgga

SEQ ID NO: 9151185 - DNA, 17 bp, Homo sapiens
caagagagatgactgga

SEQ ID NO: 9151186 - DNA, 22 bp, Homo sapiens
agcagcaggctgtgtggactga

SEQ ID NO: 9151187 - DNA, 22 bp, Homo sapiens
agcagcaggctgtgtggactga

SEQ ID NO: 9151188 - DNA, 22 bp, Homo sapiens
agcagcaggctgggatgagtct

SEQ ID NO: 9151189 - DNA, 22 bp, Homo sapiens
agcagcaggctagggaactgct

SEQ ID NO: 9151190 - DNA, 23 bp, Homo sapiens
agcagcaggaggtattgataagg

SEQ ID NO: 9151191 - DNA, 22 bp, Homo sapiens
agcagcaggattttcgttggga

SEQ ID NO: 9151192 - DNA, 22 bp, Homo sapiens
agcagcaggctagggaactgct

SEQ ID NO: 9151193 - DNA, 22 bp, Homo sapiens
agcagcaggctagggaactgct

SEQ ID NO: 9151194 - DNA, 22 bp, Homo sapiens
agcagcaggaggccattgtctt

SEQ ID NO: 9151195 - DNA, 22 bp, Homo sapiens
agcagcaggagccgtggggtga

SEQ ID NO: 9151196 - DNA, 22 bp, Homo sapiens
agcagcaggaggctgtccacca

SEQ ID NO: 9151197 - DNA, 22 bp, Homo sapiens
agcagcaggaggctgtccacca

SEQ ID NO: 9151198 - DNA, 20 bp, Homo sapiens
agcagcagatgttggaggtg

SEQ ID NO: 9151199 - DNA, 20 bp, Homo sapiens
agcagcagatgttggaggtg

SEQ ID NO: 9151200 - DNA, 22 bp, Homo sapiens
agcagcagctctgttgccctac

SEQ ID NO: 9151201 - DNA, 22 bp, Homo sapiens
caagcagagaagtctctaggct

SEQ ID NO: 9151202 - DNA, 21 bp, Homo sapiens
agcaggcaaaggtgaagtctt

SEQ ID NO: 9151203 - DNA, 22 bp, Homo sapiens
agcaggcacaagaaagggaggt

SEQ ID NO: 9151204 - DNA, 22 bp, Homo sapiens
agcaggagtgtcccctggctgt

SEQ ID NO: 9151205 - DNA, 22 bp, Homo sapiens
cacacactgttaatgtaggagt

SEQ ID NO: 9151206 - DNA, 22 bp, Homo sapiens
agcaggagcatttccatgattc

SEQ ID NO: 9151207 - DNA, 22 bp, Homo sapiens
cacacactggagcaaggagatg

SEQ ID NO: 9151208 - DNA, 22 bp, Homo sapiens
cacacacagttttgtattctgt

SEQ ID NO: 9151209 - DNA, 22 bp, Homo sapiens
cacacactcttcctggcaccta

SEQ ID NO: 9151210 - DNA, 22 bp, Homo sapiens
cacacactgacaccttatcttg

SEQ ID NO: 9151211 - DNA, 22 bp, Homo sapiens
agcagctgcagggagggtctgc

SEQ ID NO: 9151212 - DNA, 22 bp, Homo sapiens
agcagctgcagggagggtctgc

SEQ ID NO: 9151213 - DNA, 22 bp, Homo sapiens
agcagctgcagagggctccccc

SEQ ID NO: 9151214 - DNA, 22 bp, Homo sapiens
agcagctgatggggaaggagtt

SEQ ID NO: 9151215 - DNA, 22 bp, Homo sapiens
agcagctgatggggaaggagtt

SEQ ID NO: 9151216 - DNA, 22 bp, Homo sapiens
agcagctgatggggaaggagtt

SEQ ID NO: 9151217 - DNA, 22 bp, Homo sapiens
agcagctgatcaaagcacttat

SEQ ID NO: 9151218 - DNA, 22 bp, Homo sapiens
agcagctgatggggaaggagtt

SEQ ID NO: 9151219 - DNA, 22 bp, Homo sapiens
agcagctgatcaaagcacttat

SEQ ID NO: 9151220 - DNA, 22 bp, Homo sapiens
agcagctgatcaaagcacttat

SEQ ID NO: 9151221 - DNA, 22 bp, Homo sapiens
agcagctgccactggaatagga

SEQ ID NO: 9151222 - DNA, 22 bp, Homo sapiens
agcagctgccactggaatagga

SEQ ID NO: 9151223 - DNA, 22 bp, Homo sapiens
agcagctgccactggaatagga

SEQ ID NO: 9151224 - DNA, 22 bp, Homo sapiens
agcagctgccagagagagttcc

SEQ ID NO: 9151225 - DNA, 22 bp, Homo sapiens
agcaggcagcctaggaagtgaa

SEQ ID NO: 9151226 - DNA, 22 bp, Homo sapiens
agcaggcagccatttggaaggc

SEQ ID NO: 9151227 - DNA, 22 bp, Homo sapiens
agcaggcagcctaggaagtgaa

SEQ ID NO: 9151228 - DNA, 22 bp, Homo sapiens
agcaggcagccatttggaaggc

SEQ ID NO: 9151229 - DNA, 22 bp, Homo sapiens
agcaggcactatgccaggatct

SEQ ID NO: 9151230 - DNA, 17 bp, Homo sapiens
agcaggcacgtcagcac

SEQ ID NO: 9151231 - DNA, 22 bp, Homo sapiens
agcaggcaggaggctactaagg

SEQ ID NO: 9151232 - DNA, 22 bp, Homo sapiens
agcaggcaggaaggcagcactg

SEQ ID NO: 9151233 - DNA, 22 bp, Homo sapiens
cacagtgttccagagcagtggt

SEQ ID NO: 9151234 - DNA, 22 bp, Homo sapiens
cacagtcctacagagatcagag

SEQ ID NO: 9151235 - DNA, 22 bp, Homo sapiens
cacagttgtctgatttcttcct

SEQ ID NO: 9151236 - DNA, 22 bp, Homo sapiens
cactgcttatgtctccttttca

SEQ ID NO: 9151237 - DNA, 22 bp, Homo sapiens
cactgcttggttgcaacattgc

SEQ ID NO: 9151238 - DNA, 22 bp, Homo sapiens
cactgcttgcagtatgagtgga

SEQ ID NO: 9151239 - DNA, 20 bp, Homo sapiens
agcatacatcataagaaacc

SEQ ID NO: 9151240 - DNA, 22 bp, Homo sapiens
agcatacaggtctgaaacagct

SEQ ID NO: 9151241 - DNA, 22 bp, Homo sapiens
agcatacagttgaaagtggctt

SEQ ID NO: 9151242 - DNA, 22 bp, Homo sapiens
cactgcttatgtctccttttca

SEQ ID NO: 9151243 - DNA, 22 bp, Homo sapiens
cactgcttagttggtaaatgtg

SEQ ID NO: 9151244 - DNA, 22 bp, Homo sapiens
cactgctgatttcataggcagg

SEQ ID NO: 9151245 - DNA, 22 bp, Homo sapiens
cactgctgatttcataggcagg

SEQ ID NO: 9151246 - DNA, 22 bp, Homo sapiens
cactgcttagatcttccttcaa

SEQ ID NO: 9151247 - DNA, 22 bp, Homo sapiens
cactgctacctctgcctcccgg

SEQ ID NO: 9151248 - DNA, 23 bp, Homo sapiens
cactgccttcagttgcttcacct

SEQ ID NO: 9151249 - DNA, 22 bp, Homo sapiens
cactgctattattagacaatgt

SEQ ID NO: 9151250 - DNA, 22 bp, Homo sapiens
cactgctatgatgatgatattt

SEQ ID NO: 9151251 - DNA, 22 bp, Homo sapiens
caccgtggaggagctggagggc

SEQ ID NO: 9151252 - DNA, 22 bp, Homo sapiens
cacctacttccaagagtttcca

SEQ ID NO: 9151253 - DNA, 22 bp, Homo sapiens
cacctagggtttcgcctttctt

SEQ ID NO: 9151254 - DNA, 22 bp, Homo sapiens
cacctagggcatccctgcccca

SEQ ID NO: 9151255 - DNA, 19 bp, Homo sapiens
cacctacttttggatttgc

SEQ ID NO: 9151256 - DNA, 22 bp, Homo sapiens
cacctactttgtgcagatttta

SEQ ID NO: 9151257 - DNA, 22 bp, Homo sapiens
cactgcacttcagcctgggtga

SEQ ID NO: 9151258 - DNA, 22 bp, Homo sapiens
cacctcaggcagcaaagtctca

SEQ ID NO: 9151259 - DNA, 22 bp, Homo sapiens
cacctctttgatttgaggcaag

SEQ ID NO: 9151260 - DNA, 22 bp, Homo sapiens
agcaggggtctctgctaatgaa

SEQ ID NO: 9151261 - DNA, 22 bp, Homo sapiens
agcaggggtctctgctaatgaa

SEQ ID NO: 9151262 - DNA, 22 bp, Homo sapiens
agcaggggtggaaggtagcttt

SEQ ID NO: 9151263 - DNA, 22 bp, Homo sapiens
agcaggggtggaaggtagcttt

SEQ ID NO: 9151264 - DNA, 22 bp, Homo sapiens
agcaggggtggaaggtagcttt

SEQ ID NO: 9151265 - DNA, 22 bp, Homo sapiens
agcaggggtggaaggtagcttt

SEQ ID NO: 9151266 - DNA, 22 bp, Homo sapiens
agcagggttccaggagttgcag

SEQ ID NO: 9151267 - DNA, 22 bp, Homo sapiens
agcagggttctcagttggtgct

SEQ ID NO: 9151268 - DNA, 22 bp, Homo sapiens
caccaggttccgggcagagctg

SEQ ID NO: 9151269 - DNA, 22 bp, Homo sapiens
agcagggtttggggattggcac

SEQ ID NO: 9151270 - DNA, 22 bp, Homo sapiens
caccaggtggaaatgtcacagc

SEQ ID NO: 9151271 - DNA, 22 bp, Homo sapiens
agcaggctgccttccaaagcct

SEQ ID NO: 9151272 - DNA, 23 bp, Homo sapiens
agcaggctgcttctccacagctg

SEQ ID NO: 9151273 - DNA, 22 bp, Homo sapiens
agcagggctggggcacgagcca

SEQ ID NO: 9151274 - DNA, 22 bp, Homo sapiens
agcaggggcagggttttgtgct

SEQ ID NO: 9151275 - DNA, 22 bp, Homo sapiens
agcaggggcagggttttgtgct

SEQ ID NO: 9151276 - DNA, 22 bp, Homo sapiens
agcagggctttgtctctgtgaa

SEQ ID NO: 9151277 - DNA, 22 bp, Homo sapiens
agcagggctttgtctctgtgaa

SEQ ID NO: 9151278 - DNA, 22 bp, Homo sapiens
agcagggctttgtctctgtgaa

SEQ ID NO: 9151279 - DNA, 22 bp, Homo sapiens
agcaggggctcctccacagcca

SEQ ID NO: 9151280 - DNA, 22 bp, Homo sapiens
agcaggggctcctccacagcca

SEQ ID NO: 9151281 - DNA, 22 bp, Homo sapiens
agcaggggctcctccacagcca

SEQ ID NO: 9151282 - DNA, 22 bp, Homo sapiens
agcaggggcagggttttgtgct

SEQ ID NO: 9151283 - DNA, 22 bp, Homo sapiens
agcaggggctcctccacagcca

SEQ ID NO: 9151284 - DNA, 22 bp, Homo sapiens
agcagggggcatccttgccctt

SEQ ID NO: 9151285 - DNA, 22 bp, Homo sapiens
agcagggggcatccttgccctt

SEQ ID NO: 9151286 - DNA, 22 bp, Homo sapiens
agcagggggagttagactagat

SEQ ID NO: 9151287 - DNA, 22 bp, Homo sapiens
agcagggggagttagactagat

SEQ ID NO: 9151288 - DNA, 22 bp, Homo sapiens
agcagggggcatccttgccctt

SEQ ID NO: 9151289 - DNA, 22 bp, Homo sapiens
agcagggggagttagactagat

SEQ ID NO: 9151290 - DNA, 22 bp, Homo sapiens
agcagggggccacagtcacagc

SEQ ID NO: 9151291 - DNA, 22 bp, Homo sapiens
agcagggggccacagtcacagc

SEQ ID NO: 9151292 - DNA, 22 bp, Homo sapiens
agcagggggccacagtcacagc

SEQ ID NO: 9151293 - DNA, 22 bp, Homo sapiens
agcaggggtaacagaaggaaag

SEQ ID NO: 9151294 - DNA, 22 bp, Homo sapiens
agcaggggtctctgctaatgaa

SEQ ID NO: 9151295 - DNA, 22 bp, Homo sapiens
atgacaaattcagaccatagca

SEQ ID NO: 9151296 - DNA, 20 bp, Homo sapiens
atgcacatacgcatgcacat

SEQ ID NO: 9151297 - DNA, 22 bp, Homo sapiens
atgcacataggccaaatcattt

SEQ ID NO: 9151298 - DNA, 22 bp, Homo sapiens
atgacaagggttgacacatgtc

SEQ ID NO: 9151299 - DNA, 22 bp, Homo sapiens
atgacaaattcagaccatagca

SEQ ID NO: 9151300 - DNA, 22 bp, Homo sapiens
atgacaaattcagaccatagca

SEQ ID NO: 9151301 - DNA, 22 bp, Homo sapiens
atgacaaaagaagacatgaggt

SEQ ID NO: 9151302 - DNA, 22 bp, Homo sapiens
atgacaaaagaagacatgaggt

SEQ ID NO: 9151303 - DNA, 22 bp, Homo sapiens
atgacaaaagaagacatgaggt

SEQ ID NO: 9151304 - DNA, 22 bp, Homo sapiens
atgacaaaatgaatgcagctag

SEQ ID NO: 9151305 - DNA, 22 bp, Homo sapiens
atgacaaaataaatggtctctg

SEQ ID NO: 9151306 - DNA, 22 bp, Homo sapiens
atgacaaaattcacaggtgtga

SEQ ID NO: 9151307 - DNA, 22 bp, Homo sapiens
atgacaaaggctgaaagggaaa

SEQ ID NO: 9151308 - DNA, 22 bp, Homo sapiens
atgacaaaggctgaaagggaaa

SEQ ID NO: 9151309 - DNA, 22 bp, Homo sapiens
atgacaaacccaggatgtaaca

SEQ ID NO: 9151310 - DNA, 22 bp, Homo sapiens
agacagacgtagtgtgagagta

SEQ ID NO: 9151311 - DNA, 17 bp, Homo sapiens
agacagacctctgcatc

SEQ ID NO: 9151312 - DNA, 22 bp, Homo sapiens
atgcacatgtatctatatacaa

SEQ ID NO: 9151313 - DNA, 22 bp, Homo sapiens
atgcacatgtatgtcaatattt

SEQ ID NO: 9151314 - DNA, 22 bp, Homo sapiens
atgcactacttggctttactga

SEQ ID NO: 9151315 - DNA, 22 bp, Homo sapiens
atgcactactagatgcaaaagt

SEQ ID NO: 9151316 - DNA, 22 bp, Homo sapiens
atgcacctgaactccatcagct

SEQ ID NO: 9151317 - DNA, 22 bp, Homo sapiens
agacagcatttctagcaccagg

SEQ ID NO: 9151318 - DNA, 22 bp, Homo sapiens
agacagccaatgctggaagatg

SEQ ID NO: 9151319 - DNA, 22 bp, Homo sapiens
agacagccaatgctggaagatg

SEQ ID NO: 9151320 - DNA, 22 bp, Homo sapiens
agacagctgcctccaccacagc

SEQ ID NO: 9151321 - DNA, 21 bp, Homo sapiens
agacagcagatagtcgaaagg

SEQ ID NO: 9151322 - DNA, 22 bp, Homo sapiens
agacagcagaaactagagcact

SEQ ID NO: 9151323 - DNA, 22 bp, Homo sapiens
agacagcagaaactagagcact

SEQ ID NO: 9151324 - DNA, 22 bp, Homo sapiens
agacagacgtagtgtgagagta

SEQ ID NO: 9151325 - DNA, 22 bp, Homo sapiens
agacagcatgagcctgctgatg

SEQ ID NO: 9151326 - DNA, 22 bp, Homo sapiens
agacaggcagaggctgcagagg

SEQ ID NO: 9151327 - DNA, 22 bp, Homo sapiens
agacaggcagaggctgcagagg

SEQ ID NO: 9151328 - DNA, 22 bp, Homo sapiens
agacaggatgcatactcttggt

SEQ ID NO: 9151329 - DNA, 20 bp, Homo sapiens
agacaggagcccccattcag

SEQ ID NO: 9151330 - DNA, 22 bp, Homo sapiens
agacaggacacaagctgcataa

SEQ ID NO: 9151331 - DNA, 22 bp, Homo sapiens
agacaggagagggaactgccgg

SEQ ID NO: 9151332 - DNA, 21 bp, Homo sapiens
agacagctttaaagacacagg

SEQ ID NO: 9151333 - DNA, 23 bp, Homo sapiens
agacagcttagagtttgcctctc

SEQ ID NO: 9151334 - DNA, 22 bp, Homo sapiens
agacagctggtagcacttcctg

SEQ ID NO: 9151335 - DNA, 22 bp, Homo sapiens
agacagctgctcgcagagctat

SEQ ID NO: 9151336 - DNA, 22 bp, Homo sapiens
agacagctgctcgcagagctat

SEQ ID NO: 9151337 - DNA, 22 bp, Homo sapiens
agacagctgggaaatggagtgt

SEQ ID NO: 9151338 - DNA, 22 bp, Homo sapiens
agacatttggaagatacacata

SEQ ID NO: 9151339 - DNA, 22 bp, Homo sapiens
agacatttggaagatacacata

SEQ ID NO: 9151340 - DNA, 22 bp, Homo sapiens
agacatttggaagatacacata

SEQ ID NO: 9151341 - DNA, 22 bp, Homo sapiens
agacatttcctagacatcaatg

SEQ ID NO: 9151342 - DNA, 22 bp, Homo sapiens
agacatttggaagatacacata

SEQ ID NO: 9151343 - DNA, 22 bp, Homo sapiens
agacatatggtgaaacatttta

SEQ ID NO: 9151344 - DNA, 22 bp, Homo sapiens
agacaggcagaggctgcagagg

SEQ ID NO: 9151345 - DNA, 22 bp, Homo sapiens
agacatttattgaacacctagc

SEQ ID NO: 9151346 - DNA, 22 bp, Homo sapiens
atgaaagtgaaggtttactaag

SEQ ID NO: 9151347 - DNA, 22 bp, Homo sapiens
atgaaagtgtttaagtttatgt

SEQ ID NO: 9151348 - DNA, 22 bp, Homo sapiens
atgaaagtacctgtaatatgtt

SEQ ID NO: 9151349 - DNA, 22 bp, Homo sapiens
atgaaagatgatttaaagtact

SEQ ID NO: 9151350 - DNA, 22 bp, Homo sapiens
atgaaagatgatttaaagtact

SEQ ID NO: 9151351 - DNA, 22 bp, Homo sapiens
atgaaagcaacttatttgagat

SEQ ID NO: 9151352 - DNA, 22 bp, Homo sapiens
atgaaagcacgtgggaagataa

SEQ ID NO: 9151353 - DNA, 23 bp, Homo sapiens
atgaaagttcttaaaatgtcatg

SEQ ID NO: 9151354 - DNA, 22 bp, Homo sapiens
atgaaattgatcttgaactttt

SEQ ID NO: 9151355 - DNA, 22 bp, Homo sapiens
atgaacaacttgaagctccatg

SEQ ID NO: 9151356 - DNA, 22 bp, Homo sapiens
agacaaatgaacaaatatgtga

SEQ ID NO: 9151357 - DNA, 22 bp, Homo sapiens
agacaaaggattaatgatgatg

SEQ ID NO: 9151358 - DNA, 22 bp, Homo sapiens
agacaaaggattaatgatgatg

SEQ ID NO: 9151359 - DNA, 22 bp, Homo sapiens
agacaaagacagcatctcaggt

SEQ ID NO: 9151360 - DNA, 22 bp, Homo sapiens
agacaaagaaaccgtagaagca

SEQ ID NO: 9151361 - DNA, 22 bp, Homo sapiens
agacaaagaaaccgtagaagca

SEQ ID NO: 9151362 - DNA, 22 bp, Homo sapiens
agacaaagaaaccgtagaagca

SEQ ID NO: 9151363 - DNA, 22 bp, Homo sapiens
atgaacaatgactacatattga

SEQ ID NO: 9151364 - DNA, 22 bp, Homo sapiens
atgaacaatgactacatattga

SEQ ID NO: 9151365 - DNA, 22 bp, Homo sapiens
atgaacaatctggcaagaactt

SEQ ID NO: 9151366 - DNA, 22 bp, Homo sapiens
atgaacaataatcatgtctatg

SEQ ID NO: 9151367 - DNA, 22 bp, Homo sapiens
atctcaccaagttattacgaga

SEQ ID NO: 9151368 - DNA, 22 bp, Homo sapiens
agaagtgagtgtgactcagcag

SEQ ID NO: 9151369 - DNA, 22 bp, Homo sapiens
agaagtgccgaaaggaagacag

SEQ ID NO: 9151370 - DNA, 22 bp, Homo sapiens
agaagtgctccagtgagttggg

SEQ ID NO: 9151371 - DNA, 22 bp, Homo sapiens
agaagtctattgatggcagtcc

SEQ ID NO: 9151372 - DNA, 19 bp, Homo sapiens
agaagttagacattgcaat

SEQ ID NO: 9151373 - DNA, 19 bp, Homo sapiens
agaagttagacattgcaat

SEQ ID NO: 9151374 - DNA, 22 bp, Homo sapiens
agaagttatccaccttagatgc

SEQ ID NO: 9151375 - DNA, 22 bp, Homo sapiens
agaagtttcacaatgggtttta

SEQ ID NO: 9151376 - DNA, 22 bp, Homo sapiens
agaagtttatttatgccccaat

SEQ ID NO: 9151377 - DNA, 22 bp, Homo sapiens
agaagtttccagtctagtaagg

SEQ ID NO: 9151378 - DNA, 22 bp, Homo sapiens
agaagtttaaccaggtgctact

SEQ ID NO: 9151379 - DNA, 22 bp, Homo sapiens
agaagttaccacatacttctct

SEQ ID NO: 9151380 - DNA, 22 bp, Homo sapiens
agaagttaattcctgaaattct

SEQ ID NO: 9151381 - DNA, 22 bp, Homo sapiens
agaagttaattcctgaaattct

SEQ ID NO: 9151382 - DNA, 20 bp, Homo sapiens
agaagtggctgcagacacta

SEQ ID NO: 9151383 - DNA, 22 bp, Homo sapiens
agaagtttctttgaacgtgtag

SEQ ID NO: 9151384 - DNA, 22 bp, Homo sapiens
agaagtttctctgaacgtgtag

SEQ ID NO: 9151385 - DNA, 22 bp, Homo sapiens
agaagtttgaaattaggagaaa

SEQ ID NO: 9151386 - DNA, 22 bp, Homo sapiens
agaagtttgaaattaggagaaa

SEQ ID NO: 9151387 - DNA, 22 bp, Homo sapiens
agaagtttgaaattaggagaaa

SEQ ID NO: 9151388 - DNA, 22 bp, Homo sapiens
agaagtttgctcacttgggaca

SEQ ID NO: 9151389 - DNA, 22 bp, Homo sapiens
agaagtttgggggcgaaggcag

SEQ ID NO: 9151390 - DNA, 22 bp, Homo sapiens
agaagtttggatgccatcatag

SEQ ID NO: 9151391 - DNA, 20 bp, Homo sapiens
agaagtttgggggtgtggag

SEQ ID NO: 9151392 - DNA, 22 bp, Homo sapiens
agaagtttggtcctataaactc

SEQ ID NO: 9151393 - DNA, 22 bp, Homo sapiens
agaagtttggtcctataaactc

SEQ ID NO: 9151394 - DNA, 22 bp, Homo sapiens
agaagtttggtcctataaactc

SEQ ID NO: 9151395 - DNA, 22 bp, Homo sapiens
agagaagagcaatgataaattt

SEQ ID NO: 9151396 - DNA, 22 bp, Homo sapiens
agagaagacttacagccacagt

SEQ ID NO: 9151397 - DNA, 22 bp, Homo sapiens
atggccagggtggcactgtggt

SEQ ID NO: 9151398 - DNA, 22 bp, Homo sapiens
atggccagcttataggggctca

SEQ ID NO: 9151399 - DNA, 22 bp, Homo sapiens
atggccaggcacctctggctga

SEQ ID NO: 9151400 - DNA, 23 bp, Homo sapiens
agacccagagactggctctgctc

SEQ ID NO: 9151401 - DNA, 22 bp, Homo sapiens
atggccagccactcctgatggc

SEQ ID NO: 9151402 - DNA, 22 bp, Homo sapiens
atggccagcccttcccgcagct

SEQ ID NO: 9151403 - DNA, 22 bp, Homo sapiens
agacattttacattcttccatt

SEQ ID NO: 9151404 - DNA, 22 bp, Homo sapiens
agacattttgcattccctgaag

SEQ ID NO: 9151405 - DNA, 22 bp, Homo sapiens
agacattttagacataaaagat

SEQ ID NO: 9151406 - DNA, 22 bp, Homo sapiens
agacattttagacataaaagat

SEQ ID NO: 9151407 - DNA, 22 bp, Homo sapiens
agaccacagtcaggctcctggt

SEQ ID NO: 9151408 - DNA, 22 bp, Homo sapiens
agaccactaaaactttctctat

SEQ ID NO: 9151409 - DNA, 22 bp, Homo sapiens
agaccactaaaactttctctat

SEQ ID NO: 9151410 - DNA, 22 bp, Homo sapiens
agacattttggaaagtattact

SEQ ID NO: 9151411 - DNA, 22 bp, Homo sapiens
agacattttggaaagtattact

SEQ ID NO: 9151412 - DNA, 22 bp, Homo sapiens
agaccacttggataagaaacag

SEQ ID NO: 9151413 - DNA, 22 bp, Homo sapiens
agaccactcaaaattagtgtct

SEQ ID NO: 9151414 - DNA, 22 bp, Homo sapiens
agaccaggtctttatggctcca

SEQ ID NO: 9151415 - DNA, 22 bp, Homo sapiens
agaccatgggctcctgggacat

SEQ ID NO: 9151416 - DNA, 22 bp, Homo sapiens
agaccagttacattagaacttc

SEQ ID NO: 9151417 - DNA, 22 bp, Homo sapiens
agagaagagtcttgtcaaatta

SEQ ID NO: 9151418 - DNA, 22 bp, Homo sapiens
agagaagattcttatatgtctt

SEQ ID NO: 9151419 - DNA, 22 bp, Homo sapiens
agagaagcagggagtcatctgt

SEQ ID NO: 9151420 - DNA, 22 bp, Homo sapiens
agagaaggaaagctgacatggg

SEQ ID NO: 9151421 - DNA, 22 bp, Homo sapiens
agagacagaggcaatatagctt

SEQ ID NO: 9151422 - DNA, 22 bp, Homo sapiens
agagacagggttttgtcgtgtt

SEQ ID NO: 9151423 - DNA, 22 bp, Homo sapiens
agagacagggttttgtcgtgtt

SEQ ID NO: 9151424 - DNA, 22 bp, Homo sapiens
agagacagggttttgtcgtgtt

SEQ ID NO: 9151425 - DNA, 22 bp, Homo sapiens
agagacagggttttgtcgtgtt

SEQ ID NO: 9151426 - DNA, 22 bp, Homo sapiens
agagacagggttttgtcgtgtt

SEQ ID NO: 9151427 - DNA, 22 bp, Homo sapiens
agagacagggttttgtcgtgtt

SEQ ID NO: 9151428 - DNA, 22 bp, Homo sapiens
agagacccgcagcctcggagct

SEQ ID NO: 9151429 - DNA, 20 bp, Homo sapiens
agagaccctgtagcttgcag

SEQ ID NO: 9151430 - DNA, 22 bp, Homo sapiens
agagaccaagggaatagtctca

SEQ ID NO: 9151431 - DNA, 19 bp, Homo sapiens
agagaccacagagctgcct

SEQ ID NO: 9151432 - DNA, 17 bp, Homo sapiens
atggctcacctgtgggc

SEQ ID NO: 9151433 - DNA, 22 bp, Homo sapiens
agagatgaaaagtggagactgg

SEQ ID NO: 9151434 - DNA, 22 bp, Homo sapiens
agagagttgtatgtttctaaaa

SEQ ID NO: 9151435 - DNA, 22 bp, Homo sapiens
agagagttgtaccacactcata

SEQ ID NO: 9151436 - DNA, 22 bp, Homo sapiens
atggccttagtgatgattaata

SEQ ID NO: 9151437 - DNA, 22 bp, Homo sapiens
atggccgcctgtccttcccgcc

SEQ ID NO: 9151438 - DNA, 22 bp, Homo sapiens
atggggtggagtccgggcagcg

SEQ ID NO: 9151439 - DNA, 22 bp, Homo sapiens
atggggttcacctgacagagaa

SEQ ID NO: 9151440 - DNA, 22 bp, Homo sapiens
agagccaaggcctcagtctcaa

SEQ ID NO: 9151441 - DNA, 22 bp, Homo sapiens
agagcagtcattaatacatgta

SEQ ID NO: 9151442 - DNA, 22 bp, Homo sapiens
agagcagcctcagctccctgtg

SEQ ID NO: 9151443 - DNA, 22 bp, Homo sapiens
agagcagcctgtgatgatgcac

SEQ ID NO: 9151444 - DNA, 22 bp, Homo sapiens
agagcagcctgtgatgatgcac

SEQ ID NO: 9151445 - DNA, 22 bp, Homo sapiens
agagccaagttgtcaaggcact

SEQ ID NO: 9151446 - DNA, 22 bp, Homo sapiens
agagccaaggctgagagctatt

SEQ ID NO: 9151447 - DNA, 22 bp, Homo sapiens
agagccaatcttcagagcagag

SEQ ID NO: 9151448 - DNA, 22 bp, Homo sapiens
agagccacggcaggcctaggaa

SEQ ID NO: 9151449 - DNA, 22 bp, Homo sapiens
agagccactgggagacagagca

SEQ ID NO: 9151450 - DNA, 19 bp, Homo sapiens
agagccagacagcatagga

SEQ ID NO: 9151451 - DNA, 22 bp, Homo sapiens
agagccagaccattgccgtgca

SEQ ID NO: 9151452 - DNA, 22 bp, Homo sapiens
agagccagagacctgggttcac

SEQ ID NO: 9151453 - DNA, 22 bp, Homo sapiens
atgggggcggctgaagcccagg

SEQ ID NO: 9151454 - DNA, 22 bp, Homo sapiens
atggggggatgaaggagtccaa

SEQ ID NO: 9151455 - DNA, 22 bp, Homo sapiens
atggggtgaccatgagcattta

SEQ ID NO: 9151456 - DNA, 20 bp, Homo sapiens
atggggtgagtgacgccctc

SEQ ID NO: 9151457 - DNA, 22 bp, Homo sapiens
atggggtgagactaggattaaa

SEQ ID NO: 9151458 - DNA, 22 bp, Homo sapiens
atggggtggagtccgggcagcg

SEQ ID NO: 9151459 - DNA, 22 bp, Homo sapiens
atgggggcctgaacaggcaaaa

SEQ ID NO: 9151460 - DNA, 22 bp, Homo sapiens
atgggggaaagtacgagcatgg

SEQ ID NO: 9151461 - DNA, 22 bp, Homo sapiens
agagatggatgttattatgggt

SEQ ID NO: 9151462 - DNA, 22 bp, Homo sapiens
agagatgactgatggctgatta

SEQ ID NO: 9151463 - DNA, 22 bp, Homo sapiens
agagatgcagggtacatggaat

SEQ ID NO: 9151464 - DNA, 22 bp, Homo sapiens
agagatgaatcttgagactctg

SEQ ID NO: 9151465 - DNA, 22 bp, Homo sapiens
agagatgacatgagggacttaa

SEQ ID NO: 9151466 - DNA, 19 bp, Homo sapiens
agagatgctaagagtcttt

SEQ ID NO: 9151467 - DNA, 22 bp, Homo sapiens
agagatgctgtgggtagaggca

SEQ ID NO: 9151468 - DNA, 22 bp, Homo sapiens
atgtattttaagatttgcctca

SEQ ID NO: 9151469 - DNA, 22 bp, Homo sapiens
atgtattttaagatttgcctca

SEQ ID NO: 9151470 - DNA, 22 bp, Homo sapiens
atgtattttgccagactgtctc

SEQ ID NO: 9151471 - DNA, 22 bp, Homo sapiens
atgtattttgccagactgtctc

SEQ ID NO: 9151472 - DNA, 22 bp, Homo sapiens
atgtcaaacacaacaccagtgg

SEQ ID NO: 9151473 - DNA, 22 bp, Homo sapiens
agagcctgcagctgtgaagaaa

SEQ ID NO: 9151474 - DNA, 22 bp, Homo sapiens
agagcctggggattggcaaggg

SEQ ID NO: 9151475 - DNA, 22 bp, Homo sapiens
agagcctgggcagctcctctgg

SEQ ID NO: 9151476 - DNA, 22 bp, Homo sapiens
agagcctgcagtggagaccttg

SEQ ID NO: 9151477 - DNA, 22 bp, Homo sapiens
agagcctgggaatttgcatgtt

SEQ ID NO: 9151478 - DNA, 22 bp, Homo sapiens
agagcctggctcccagctaccg

SEQ ID NO: 9151479 - DNA, 22 bp, Homo sapiens
agagcctgcagtggagaccttg

SEQ ID NO: 9151480 - DNA, 22 bp, Homo sapiens
agagcctgcagtggagaccttg

SEQ ID NO: 9151481 - DNA, 22 bp, Homo sapiens
agagccagatggagccgtgtgt

SEQ ID NO: 9151482 - DNA, 22 bp, Homo sapiens
agagccagcaactctagccctg

SEQ ID NO: 9151483 - DNA, 22 bp, Homo sapiens
atgtatttgaaatttgagacat

SEQ ID NO: 9151484 - DNA, 22 bp, Homo sapiens
atgtatttgcgaggttaggaaa

SEQ ID NO: 9151485 - DNA, 22 bp, Homo sapiens
atgtatttgaaatttgagacat

SEQ ID NO: 9151486 - DNA, 22 bp, Homo sapiens
atgtatttgcgtatggacatac

SEQ ID NO: 9151487 - DNA, 22 bp, Homo sapiens
atgtatttgcgtatggacatac

SEQ ID NO: 9151488 - DNA, 22 bp, Homo sapiens
atgtatttgcgtatggacatac

SEQ ID NO: 9151489 - DNA, 22 bp, Homo sapiens
atgtatttgcgaggttaggaaa

SEQ ID NO: 9151490 - DNA, 22 bp, Homo sapiens
atgtatttgcgtatggacatac

SEQ ID NO: 9151491 - DNA, 22 bp, Homo sapiens
atgtatttgcttgttatggatt

SEQ ID NO: 9151492 - DNA, 22 bp, Homo sapiens
atgtatttgcttgttatggatt

SEQ ID NO: 9151493 - DNA, 22 bp, Homo sapiens
atgtggttttggattattcatg

SEQ ID NO: 9151494 - DNA, 22 bp, Homo sapiens
atgtgtaaaaagtgcttaatat

SEQ ID NO: 9151495 - DNA, 22 bp, Homo sapiens
atgtggttgaagaattacatct

SEQ ID NO: 9151496 - DNA, 22 bp, Homo sapiens
atgtgggccgtgcgggtgtcct

SEQ ID NO: 9151497 - DNA, 22 bp, Homo sapiens
agagcctgtgggagatgcagct

SEQ ID NO: 9151498 - DNA, 22 bp, Homo sapiens
agagcctgtgggagatgcagct

SEQ ID NO: 9151499 - DNA, 22 bp, Homo sapiens
agagcctgtgattgtcatcacc

SEQ ID NO: 9151500 - DNA, 22 bp, Homo sapiens
agagcctgtacttttctgtgaa

SEQ ID NO: 9151501 - DNA, 22 bp, Homo sapiens
agagcctgtacttttctgtgaa

SEQ ID NO: 9151502 - DNA, 22 bp, Homo sapiens
agagcctgtacttttctgtgaa

SEQ ID NO: 9151503 - DNA, 22 bp, Homo sapiens
agagcctgtcaattgtaaagag

SEQ ID NO: 9151504 - DNA, 22 bp, Homo sapiens
attcatttgctattgtgtatgg

SEQ ID NO: 9151505 - DNA, 22 bp, Homo sapiens
agaggcctgtgtgctccagtgg

SEQ ID NO: 9151506 - DNA, 22 bp, Homo sapiens
attcatttgctattgtgtatgg

SEQ ID NO: 9151507 - DNA, 22 bp, Homo sapiens
attcatttaggtattcacttac

SEQ ID NO: 9151508 - DNA, 22 bp, Homo sapiens
attcattggcttgaactccacc

SEQ ID NO: 9151509 - DNA, 22 bp, Homo sapiens
attcatttagagggattaagca

SEQ ID NO: 9151510 - DNA, 23 bp, Homo sapiens
agaggctcagcgtccacctctac

SEQ ID NO: 9151511 - DNA, 21 bp, Homo sapiens
agaggcggggttttggaggcc

SEQ ID NO: 9151512 - DNA, 22 bp, Homo sapiens
agaggcggaggttgcagtgagc

SEQ ID NO: 9151513 - DNA, 22 bp, Homo sapiens
agaggcggagcttgcagtgagc

SEQ ID NO: 9151514 - DNA, 22 bp, Homo sapiens
attcattccaggtcagtcagac

SEQ ID NO: 9151515 - DNA, 22 bp, Homo sapiens
attcatgtgccactggtgaaca

SEQ ID NO: 9151516 - DNA, 22 bp, Homo sapiens
attcatgtaaaattggatagac

SEQ ID NO: 9151517 - DNA, 22 bp, Homo sapiens
attcatgcaggattgtctccaa

SEQ ID NO: 9151518 - DNA, 22 bp, Homo sapiens
agaggcaggaagagctgatttt

SEQ ID NO: 9151519 - DNA, 22 bp, Homo sapiens
agaggcaggaagagctgatttt

SEQ ID NO: 9151520 - DNA, 22 bp, Homo sapiens
agaggcagcagtcatactacag

SEQ ID NO: 9151521 - DNA, 17 bp, Homo sapiens
agagggaaaatgcggtt

SEQ ID NO: 9151522 - DNA, 18 bp, Homo sapiens
agagggaaagcaggctga

SEQ ID NO: 9151523 - DNA, 18 bp, Homo sapiens
agagggaaagcaggctga

SEQ ID NO: 9151524 - DNA, 18 bp, Homo sapiens
agagggaatcagttggat

SEQ ID NO: 9151525 - DNA, 22 bp, Homo sapiens
attccagagaaaggcctggctg

SEQ ID NO: 9151526 - DNA, 22 bp, Homo sapiens
attccagacaggtaaattaggt

SEQ ID NO: 9151527 - DNA, 22 bp, Homo sapiens
attccagacaggtaaattaggt

SEQ ID NO: 9151528 - DNA, 22 bp, Homo sapiens
attccagatgaattgcatagtt

SEQ ID NO: 9151529 - DNA, 22 bp, Homo sapiens
agagggaatgtgattgcaccat

SEQ ID NO: 9151530 - DNA, 22 bp, Homo sapiens
agagggagaaaagaatcagttg

SEQ ID NO: 9151531 - DNA, 22 bp, Homo sapiens
attccagttagtggcagcttat

SEQ ID NO: 9151532 - DNA, 22 bp, Homo sapiens
attccagtgtcatgctctcagg

SEQ ID NO: 9151533 - DNA, 22 bp, Homo sapiens
attgaggtcccagaaaggactg

SEQ ID NO: 9151534 - DNA, 22 bp, Homo sapiens
attgcagggactcaataagaat

SEQ ID NO: 9151535 - DNA, 22 bp, Homo sapiens
attgcagtgtgtgttccatgag

SEQ ID NO: 9151536 - DNA, 22 bp, Homo sapiens
attgcagtgatggttgcataat

SEQ ID NO: 9151537 - DNA, 22 bp, Homo sapiens
attgcatatgcagcacatcagg

SEQ ID NO: 9151538 - DNA, 22 bp, Homo sapiens
attgcagtgttgcctggggcct

SEQ ID NO: 9151539 - DNA, 22 bp, Homo sapiens
agaggagcttttggaaaaggcc

SEQ ID NO: 9151540 - DNA, 22 bp, Homo sapiens
agaggacagcccccttgtctgg

SEQ ID NO: 9151541 - DNA, 22 bp, Homo sapiens
agaggacaggttttccatgggc

SEQ ID NO: 9151542 - DNA, 22 bp, Homo sapiens
agaggagcttttggaaaaggcc

SEQ ID NO: 9151543 - DNA, 22 bp, Homo sapiens
agaggagctgggaggccctcgt

SEQ ID NO: 9151544 - DNA, 22 bp, Homo sapiens
agaggagaatccgtttccttgc

SEQ ID NO: 9151545 - DNA, 22 bp, Homo sapiens
agaggaggccaggcccacacct

SEQ ID NO: 9151546 - DNA, 22 bp, Homo sapiens
agaggaggccaggcccacacct

SEQ ID NO: 9151547 - DNA, 22 bp, Homo sapiens
agaggaggctctgggatcgtcc

SEQ ID NO: 9151548 - DNA, 22 bp, Homo sapiens
attattataaagtgcatgacct

SEQ ID NO: 9151549 - DNA, 22 bp, Homo sapiens
attattaaagcttaggtcttat

SEQ ID NO: 9151550 - DNA, 22 bp, Homo sapiens
attattaaagcttaggtcttat

SEQ ID NO: 9151551 - DNA, 22 bp, Homo sapiens
attattaaagcttaggtcttat

SEQ ID NO: 9151552 - DNA, 22 bp, Homo sapiens
attattactcctgattgtactg

SEQ ID NO: 9151553 - DNA, 22 bp, Homo sapiens
agaggcactcgggagtctgtgg

SEQ ID NO: 9151554 - DNA, 22 bp, Homo sapiens
agaggcactcgggagtctgtgg

SEQ ID NO: 9151555 - DNA, 22 bp, Homo sapiens
agaggcactccagccactggtc

SEQ ID NO: 9151556 - DNA, 22 bp, Homo sapiens
attattcaaattcccactatac

SEQ ID NO: 9151557 - DNA, 22 bp, Homo sapiens
attattcaacacttgagaaatt

SEQ ID NO: 9151558 - DNA, 22 bp, Homo sapiens
attattatggttgctcttttcc

SEQ ID NO: 9151559 - DNA, 22 bp, Homo sapiens
attattattgttgatgttaggg

SEQ ID NO: 9151560 - DNA, 21 bp, Homo sapiens
attattatttctgtgtccagc

SEQ ID NO: 9151561 - DNA, 21 bp, Homo sapiens
agagctgggacttgcctgaga

SEQ ID NO: 9151562 - DNA, 21 bp, Homo sapiens
agagctgggacttgcctgaga

SEQ ID NO: 9151563 - DNA, 22 bp, Homo sapiens
agagctgggacttggactcaat

SEQ ID NO: 9151564 - DNA, 22 bp, Homo sapiens
atgtgtacactggacttctgat

SEQ ID NO: 9151565 - DNA, 22 bp, Homo sapiens
atgtgtatacttgtgcttactc

SEQ ID NO: 9151566 - DNA, 22 bp, Homo sapiens
agagctggtgcatattcagaaa

SEQ ID NO: 9151567 - DNA, 22 bp, Homo sapiens
agagctggtttactcaggaatt

SEQ ID NO: 9151568 - DNA, 22 bp, Homo sapiens
agagctggtttactcaggaatt

SEQ ID NO: 9151569 - DNA, 22 bp, Homo sapiens
agagctgtgctttgcaccacgt

SEQ ID NO: 9151570 - DNA, 22 bp, Homo sapiens
agagctgtgctttgcaccacgt

SEQ ID NO: 9151571 - DNA, 22 bp, Homo sapiens
agagctgtggatagtcctggat

SEQ ID NO: 9151572 - DNA, 22 bp, Homo sapiens
agagctgtgctttgcaccacgt

SEQ ID NO: 9151573 - DNA, 22 bp, Homo sapiens
agagctgtcagcgttttggcca

SEQ ID NO: 9151574 - DNA, 22 bp, Homo sapiens
agagctgtgaaaatgaggtttg

SEQ ID NO: 9151575 - DNA, 22 bp, Homo sapiens
agagctgtcacatagagccaga

SEQ ID NO: 9151576 - DNA, 22 bp, Homo sapiens
agagctgtagcttcctagagcc

SEQ ID NO: 9151577 - DNA, 22 bp, Homo sapiens
agagctgtatccccttaccagt

SEQ ID NO: 9151578 - DNA, 22 bp, Homo sapiens
agagctgttaattttgcactgg

SEQ ID NO: 9151579 - DNA, 22 bp, Homo sapiens
agagctgtgtttagtagttacg

SEQ ID NO: 9151580 - DNA, 22 bp, Homo sapiens
agagctgttaattttgcactgg

SEQ ID NO: 9151581 - DNA, 22 bp, Homo sapiens
agagctgtgtcctgtgcactag

SEQ ID NO: 9151582 - DNA, 22 bp, Homo sapiens
agagctgtgtcctgtgcactag

SEQ ID NO: 9151583 - DNA, 22 bp, Homo sapiens
agagctgtgtcctgtgcactag

SEQ ID NO: 9151584 - DNA, 22 bp, Homo sapiens
agagctgtgttaagaacaggcc

SEQ ID NO: 9151585 - DNA, 22 bp, Homo sapiens
agagctgttcagcagccaggtt

SEQ ID NO: 9151586 - DNA, 22 bp, Homo sapiens
agagctgttcagcagccaggtt

SEQ ID NO: 9151587 - DNA, 22 bp, Homo sapiens
agagctgttcaacgtagcaatg

SEQ ID NO: 9151588 - DNA, 22 bp, Homo sapiens
agagctgtttattgatgtcaca

SEQ ID NO: 9151589 - DNA, 22 bp, Homo sapiens
agagctgtttattgatgtcaca

SEQ ID NO: 9151590 - DNA, 22 bp, Homo sapiens
atgtttatgcaaacatgtgagt

SEQ ID NO: 9151591 - DNA, 22 bp, Homo sapiens
agagctgtttggacatctgagt

SEQ ID NO: 9151592 - DNA, 22 bp, Homo sapiens
agagctgtttgtctagagagtg

SEQ ID NO: 9151593 - DNA, 22 bp, Homo sapiens
agagctgtttggacatctgagt

SEQ ID NO: 9151594 - DNA, 22 bp, Homo sapiens
atgtttatggagcaggtattag

SEQ ID NO: 9151595 - DNA, 22 bp, Homo sapiens
agaggacaaaatgagaagtgct

SEQ ID NO: 9151596 - DNA, 22 bp, Homo sapiens
agaggacagacggaaagtgcca

SEQ ID NO: 9151597 - DNA, 22 bp, Homo sapiens
atttcacaaagaacagatgcag

SEQ ID NO: 9151598 - DNA, 22 bp, Homo sapiens
atttattgaagcttattacgtt

SEQ ID NO: 9151599 - DNA, 22 bp, Homo sapiens
agataaattcctaagatttcag

SEQ ID NO: 9151600 - DNA, 22 bp, Homo sapiens
agataaaatggttcaaaggcta

SEQ ID NO: 9151601 - DNA, 22 bp, Homo sapiens
agataaaatggttcaaaggcta

SEQ ID NO: 9151602 - DNA, 22 bp, Homo sapiens
agataaacccaacttaatgaag

SEQ ID NO: 9151603 - DNA, 22 bp, Homo sapiens
agataaaatgattttctggatc

SEQ ID NO: 9151604 - DNA, 17 bp, Homo sapiens
agagttttaagaaattt

SEQ ID NO: 9151605 - DNA, 22 bp, Homo sapiens
agagtttggagagggtgaggca

SEQ ID NO: 9151606 - DNA, 22 bp, Homo sapiens
atttcacatctatctcagattt

SEQ ID NO: 9151607 - DNA, 22 bp, Homo sapiens
atttcacatctatctcagattt

SEQ ID NO: 9151608 - DNA, 22 bp, Homo sapiens
atttcacattaatttgatgctc

SEQ ID NO: 9151609 - DNA, 22 bp, Homo sapiens
atttcactcattcatgttactt

SEQ ID NO: 9151610 - DNA, 22 bp, Homo sapiens
atttcactgcttgagctgcagc

SEQ ID NO: 9151611 - DNA, 22 bp, Homo sapiens
atttcacatctatctcagattt

SEQ ID NO: 9151612 - DNA, 22 bp, Homo sapiens
atttcacagctgtcagtgttac

SEQ ID NO: 9151613 - DNA, 22 bp, Homo sapiens
agatacattagtagttacttgt

SEQ ID NO: 9151614 - DNA, 17 bp, Homo sapiens
atttcacttagcatgag

SEQ ID NO: 9151615 - DNA, 20 bp, Homo sapiens
agatacagtggtttctttag

SEQ ID NO: 9151616 - DNA, 21 bp, Homo sapiens
atttcagaaatattggtggga

SEQ ID NO: 9151617 - DNA, 21 bp, Homo sapiens
atttcagaaatattggtggga

SEQ ID NO: 9151618 - DNA, 20 bp, Homo sapiens
agatacagtttaattactct

SEQ ID NO: 9151619 - DNA, 22 bp, Homo sapiens
attgctgaaagtattttatgac

SEQ ID NO: 9151620 - DNA, 22 bp, Homo sapiens
attgctgaaatgaaaggatatg

SEQ ID NO: 9151621 - DNA, 21 bp, Homo sapiens
attgctctgttgtgtctagaa

SEQ ID NO: 9151622 - DNA, 21 bp, Homo sapiens
attgctctgttgtgtctagaa

SEQ ID NO: 9151623 - DNA, 22 bp, Homo sapiens
attgccaggagggttgagaata

SEQ ID NO: 9151624 - DNA, 23 bp, Homo sapiens
attgccaggatgctgaagcttac

SEQ ID NO: 9151625 - DNA, 22 bp, Homo sapiens
attgcctgccactctgtgagga

SEQ ID NO: 9151626 - DNA, 22 bp, Homo sapiens
agaggtcatatctcagaagaga

SEQ ID NO: 9151627 - DNA, 22 bp, Homo sapiens
agaggtcagctgcatgccacat

SEQ ID NO: 9151628 - DNA, 22 bp, Homo sapiens
agaggtcagaggtcgccaggtc

SEQ ID NO: 9151629 - DNA, 21 bp, Homo sapiens
agaggtctaagattctagctt

SEQ ID NO: 9151630 - DNA, 21 bp, Homo sapiens
agaggtctaagattctagctt

SEQ ID NO: 9151631 - DNA, 22 bp, Homo sapiens
agaggtcagaacaggaaagtgt

SEQ ID NO: 9151632 - DNA, 22 bp, Homo sapiens
attgctgacaccaagtagtagc

SEQ ID NO: 9151633 - DNA, 22 bp, Homo sapiens
attgctgaacttataaatgaat

SEQ ID NO: 9151634 - DNA, 22 bp, Homo sapiens
attgctgaacttataaatgaat

SEQ ID NO: 9151635 - DNA, 22 bp, Homo sapiens
agaggtcttaagatctagactg

SEQ ID NO: 9151636 - DNA, 22 bp, Homo sapiens
agaggtcttttggtctgcagaa

SEQ ID NO: 9151637 - DNA, 22 bp, Homo sapiens
agaggtcttttggtctgcagaa

SEQ ID NO: 9151638 - DNA, 22 bp, Homo sapiens
agagttctgtctgccacacgaa

SEQ ID NO: 9151639 - DNA, 22 bp, Homo sapiens
agagtttaggggacacagaata

SEQ ID NO: 9151640 - DNA, 19 bp, Homo sapiens
agagtttaggtctatcagg

SEQ ID NO: 9151641 - DNA, 22 bp, Homo sapiens
agagtttaggggtaagcatagt

SEQ ID NO: 9151642 - DNA, 22 bp, Homo sapiens
agagtttacagaaataagctgt

SEQ ID NO: 9151643 - DNA, 22 bp, Homo sapiens
agagtttaacacaagaaaagtt

SEQ ID NO: 9151644 - DNA, 22 bp, Homo sapiens
agagtttaaacactgtcacaga

SEQ ID NO: 9151645 - DNA, 22 bp, Homo sapiens
agagttggcccacgtgtaggcg

SEQ ID NO: 9151646 - DNA, 19 bp, Homo sapiens
agagttgggcactgtttca

SEQ ID NO: 9151647 - DNA, 22 bp, Homo sapiens
agagttggagaaattaaaattt

SEQ ID NO: 9151648 - DNA, 22 bp, Homo sapiens
atttgtggctcagagtagggta

SEQ ID NO: 9151649 - DNA, 22 bp, Homo sapiens
atttggctattgaattattcct

SEQ ID NO: 9151650 - DNA, 22 bp, Homo sapiens
atttggctagcttatggttata

SEQ ID NO: 9151651 - DNA, 22 bp, Homo sapiens
atttgttctcataaagaatgaa

SEQ ID NO: 9151652 - DNA, 22 bp, Homo sapiens
atttggattcttatttagcact

SEQ ID NO: 9151653 - DNA, 20 bp, Homo sapiens
atttgtttctactctctgac

SEQ ID NO: 9151654 - DNA, 22 bp, Homo sapiens
caaaaaacacagatgtctgtgt

SEQ ID NO: 9151655 - DNA, 22 bp, Homo sapiens
atttgtttatcgtcgattgtag

SEQ ID NO: 9151656 - DNA, 22 bp, Homo sapiens
atttgtttcagggccttggtat

SEQ ID NO: 9151657 - DNA, 22 bp, Homo sapiens
atttgtttcagggccttggtat

SEQ ID NO: 9151658 - DNA, 20 bp, Homo sapiens
atttgtttctactctctgac

SEQ ID NO: 9151659 - DNA, 22 bp, Homo sapiens
atttgtttatcgtcgattgtag

SEQ ID NO: 9151660 - DNA, 22 bp, Homo sapiens
atttgttgctagcagcactgat

SEQ ID NO: 9151661 - DNA, 22 bp, Homo sapiens
caaaagtaccttgtgtgctttg

SEQ ID NO: 9151662 - DNA, 22 bp, Homo sapiens
caaaaggccagtactttgtttg

SEQ ID NO: 9151663 - DNA, 22 bp, Homo sapiens
caaaaggcaggggaaagagtgc

SEQ ID NO: 9151664 - DNA, 22 bp, Homo sapiens
agatactaaaaggggaagctcc

SEQ ID NO: 9151665 - DNA, 22 bp, Homo sapiens
agatactgaaatccaatggcca

SEQ ID NO: 9151666 - DNA, 22 bp, Homo sapiens
agatactgattctcaatggctc

SEQ ID NO: 9151667 - DNA, 22 bp, Homo sapiens
atttcctggtaccaggctttct

SEQ ID NO: 9151668 - DNA, 22 bp, Homo sapiens
atttctcattttgcttcaaagg

SEQ ID NO: 9151669 - DNA, 22 bp, Homo sapiens
atttctcatctttgtgaatggt

SEQ ID NO: 9151670 - DNA, 22 bp, Homo sapiens
atttctccttgttgcaatgcag

SEQ ID NO: 9151671 - DNA, 22 bp, Homo sapiens
atttctctcattgttagctagg

SEQ ID NO: 9151672 - DNA, 22 bp, Homo sapiens
atttctctcattgttagctagg

SEQ ID NO: 9151673 - DNA, 22 bp, Homo sapiens
atttctctcattgttagctagg

SEQ ID NO: 9151674 - DNA, 22 bp, Homo sapiens
atttctctaagcatccgtttgc

SEQ ID NO: 9151675 - DNA, 22 bp, Homo sapiens
atttctctaagcatccgtttgc

SEQ ID NO: 9151676 - DNA, 22 bp, Homo sapiens
atttctctgcctcagcttctgc

SEQ ID NO: 9151677 - DNA, 22 bp, Homo sapiens
atttctctgcagtgttcggaat

SEQ ID NO: 9151678 - DNA, 22 bp, Homo sapiens
atttctctgcagtgttcggaat

SEQ ID NO: 9151679 - DNA, 22 bp, Homo sapiens
atttctctgcctcagcttctgc

SEQ ID NO: 9151680 - DNA, 22 bp, Homo sapiens
atttctctgcctcagcttctgc

SEQ ID NO: 9151681 - DNA, 18 bp, Homo sapiens
atttctctggggtgattc

SEQ ID NO: 9151682 - DNA, 18 bp, Homo sapiens
atttctctggggtgattc

SEQ ID NO: 9151683 - DNA, 22 bp, Homo sapiens
atttgctttgggacagcttaaa

SEQ ID NO: 9151684 - DNA, 22 bp, Homo sapiens
atttgcttttactatgttaaaa

SEQ ID NO: 9151685 - DNA, 22 bp, Homo sapiens
atttgcttttactatgttaaaa

SEQ ID NO: 9151686 - DNA, 22 bp, Homo sapiens
atttggaggcccatcccttaca

SEQ ID NO: 9151687 - DNA, 17 bp, Homo sapiens
atttggaatttctcttc

SEQ ID NO: 9151688 - DNA, 22 bp, Homo sapiens
atttggattcttatttagcact

SEQ ID NO: 9151689 - DNA, 22 bp, Homo sapiens
atttggatatcactgaatacat

SEQ ID NO: 9151690 - DNA, 22 bp, Homo sapiens
gcatttatttctttactgcatc

SEQ ID NO: 9151691 - DNA, 22 bp, Homo sapiens
gcatttatttctttactgcatc

SEQ ID NO: 9151692 - DNA, 22 bp, Homo sapiens
gcatttatttctttactgcatc

SEQ ID NO: 9151693 - DNA, 22 bp, Homo sapiens
gcatttcagaagcatgccctct

SEQ ID NO: 9151694 - DNA, 18 bp, Homo sapiens
gcatttatgcggggctac

SEQ ID NO: 9151695 - DNA, 22 bp, Homo sapiens
gcatttatattctgttcggata

SEQ ID NO: 9151696 - DNA, 22 bp, Homo sapiens
gcatttattatctgccaggcac

SEQ ID NO: 9151697 - DNA, 22 bp, Homo sapiens
gccaccctgcaaatgcccagga

SEQ ID NO: 9151698 - DNA, 22 bp, Homo sapiens
gccaccctgacgccgcagaccc

SEQ ID NO: 9151699 - DNA, 18 bp, Homo sapiens
gccaccctcctcgtctcc

SEQ ID NO: 9151700 - DNA, 22 bp, Homo sapiens
gccaccctgcaaatgcccagga

SEQ ID NO: 9151701 - DNA, 22 bp, Homo sapiens
gcatttcatgctccttggaacc

SEQ ID NO: 9151702 - DNA, 19 bp, Homo sapiens
gcatttcaggcatgtttgc

SEQ ID NO: 9151703 - DNA, 22 bp, Homo sapiens
gcatttaaatttgaacttcaga

SEQ ID NO: 9151704 - DNA, 23 bp, Homo sapiens
gcattgtctccccacttctgggc

SEQ ID NO: 9151705 - DNA, 22 bp, Homo sapiens
gcattggcatttctccagcgga

SEQ ID NO: 9151706 - DNA, 22 bp, Homo sapiens
gcattgcaaaaagcagcttgat

SEQ ID NO: 9151707 - DNA, 21 bp, Homo sapiens
gccacctcgtctcggagcagc

SEQ ID NO: 9151708 - DNA, 21 bp, Homo sapiens
gccacctcgtctcggagcagc

SEQ ID NO: 9151709 - DNA, 22 bp, Homo sapiens
gccacctctagcaaagctcagc

SEQ ID NO: 9151710 - DNA, 22 bp, Homo sapiens
gccacctcccaggacgaggctg

SEQ ID NO: 9151711 - DNA, 22 bp, Homo sapiens
gccacctcccaggacgaggctg

SEQ ID NO: 9151712 - DNA, 22 bp, Homo sapiens
gccacccttgcgtcactgacat

SEQ ID NO: 9151713 - DNA, 22 bp, Homo sapiens
gccacctgtttcagatgtggtt

SEQ ID NO: 9151714 - DNA, 22 bp, Homo sapiens
gccacctgtttcgcttgcccag

SEQ ID NO: 9151715 - DNA, 22 bp, Homo sapiens
gccacctgtttcgcttgcccag

SEQ ID NO: 9151716 - DNA, 22 bp, Homo sapiens
gccactgttccaccatcttgat

SEQ ID NO: 9151717 - DNA, 22 bp, Homo sapiens
gccactgtggtcctcccatgat

SEQ ID NO: 9151718 - DNA, 22 bp, Homo sapiens
gccactgttcttctttgttcca

SEQ ID NO: 9151719 - DNA, 22 bp, Homo sapiens
gccacttactaacctcctatcc

SEQ ID NO: 9151720 - DNA, 22 bp, Homo sapiens
gccacctgtgtgggcctttgtg

SEQ ID NO: 9151721 - DNA, 22 bp, Homo sapiens
gccacctggacagctgtgccct

SEQ ID NO: 9151722 - DNA, 22 bp, Homo sapiens
gccacctggactcagagccagg

SEQ ID NO: 9151723 - DNA, 22 bp, Homo sapiens
gccacctggacagctgtgccct

SEQ ID NO: 9151724 - DNA, 22 bp, Homo sapiens
gccacctggacagctgtgccct

SEQ ID NO: 9151725 - DNA, 22 bp, Homo sapiens
gccacctgcgggccgtggtgga

SEQ ID NO: 9151726 - DNA, 22 bp, Homo sapiens
gcattgaaatggcaaaaagaga

SEQ ID NO: 9151727 - DNA, 22 bp, Homo sapiens
gcattgaaggcattttatctac

SEQ ID NO: 9151728 - DNA, 22 bp, Homo sapiens
gcattgaaggacttccattata

SEQ ID NO: 9151729 - DNA, 22 bp, Homo sapiens
gcattaaatgctagggacctaa

SEQ ID NO: 9151730 - DNA, 21 bp, Homo sapiens
gcattaaaagcagttgttggt

SEQ ID NO: 9151731 - DNA, 22 bp, Homo sapiens
gcagttttattatgatggaaat

SEQ ID NO: 9151732 - DNA, 19 bp, Homo sapiens
gcataaaatgtcaatgtgt

SEQ ID NO: 9151733 - DNA, 22 bp, Homo sapiens
gcagtttactgtcaataactct

SEQ ID NO: 9151734 - DNA, 21 bp, Homo sapiens
gcagtttatgtaatatgcact

SEQ ID NO: 9151735 - DNA, 22 bp, Homo sapiens
gcagtttctgaatttatccaag

SEQ ID NO: 9151736 - DNA, 16 bp, Homo sapiens
gcagttggggagagct

SEQ ID NO: 9151737 - DNA, 22 bp, Homo sapiens
gcagttggcagggagcccagat

SEQ ID NO: 9151738 - DNA, 22 bp, Homo sapiens
gcagttggcagggagcccagat

SEQ ID NO: 9151739 - DNA, 22 bp, Homo sapiens
gcagttatggtttttattgcag

SEQ ID NO: 9151740 - DNA, 22 bp, Homo sapiens
gcagttagtgaagcagcttaga

SEQ ID NO: 9151741 - DNA, 22 bp, Homo sapiens
gcagttagcttgtcacagtcct

SEQ ID NO: 9151742 - DNA, 22 bp, Homo sapiens
gcagttcctacagtggaaagcg

SEQ ID NO: 9151743 - DNA, 22 bp, Homo sapiens
gcaggtgattcaccctgggcct

SEQ ID NO: 9151744 - DNA, 22 bp, Homo sapiens
gccaggctaagaaaggtgtgat

SEQ ID NO: 9151745 - DNA, 22 bp, Homo sapiens
gccaggcgggtctcaaactcct

SEQ ID NO: 9151746 - DNA, 22 bp, Homo sapiens
gccaggcattattccgatccct

SEQ ID NO: 9151747 - DNA, 22 bp, Homo sapiens
gccaggctaagaaaggtgtgat

SEQ ID NO: 9151748 - DNA, 22 bp, Homo sapiens
gccaggctaagaaaggtgtgat

SEQ ID NO: 9151749 - DNA, 22 bp, Homo sapiens
gccaggctaagaaaggtgtgat

SEQ ID NO: 9151750 - DNA, 22 bp, Homo sapiens
gccaggctcagcagtcaacctg

SEQ ID NO: 9151751 - DNA, 22 bp, Homo sapiens
gccaggctcagtagcgattcct

SEQ ID NO: 9151752 - DNA, 22 bp, Homo sapiens
gccaggctccaggccctcctga

SEQ ID NO: 9151753 - DNA, 22 bp, Homo sapiens
gccaggctccaggccctcctga

SEQ ID NO: 9151754 - DNA, 22 bp, Homo sapiens
gccaggctccaggccctcctga

SEQ ID NO: 9151755 - DNA, 19 bp, Homo sapiens
gccaggctccatagccggc

SEQ ID NO: 9151756 - DNA, 22 bp, Homo sapiens
gccaggctccccggatccctgg

SEQ ID NO: 9151757 - DNA, 22 bp, Homo sapiens
gccaggctccccggatccctgg

SEQ ID NO: 9151758 - DNA, 22 bp, Homo sapiens
gccaggctccccggatccctgg

SEQ ID NO: 9151759 - DNA, 23 bp, Homo sapiens
gccaggctccggtctgtggccac

SEQ ID NO: 9151760 - DNA, 22 bp, Homo sapiens
gcccaagctccgcctcctgtcg

SEQ ID NO: 9151761 - DNA, 20 bp, Homo sapiens
gcccaagcgccggccgcaga

SEQ ID NO: 9151762 - DNA, 22 bp, Homo sapiens
gcccaaggtatatcagagacag

SEQ ID NO: 9151763 - DNA, 21 bp, Homo sapiens
gccatttcacacagacatttg

SEQ ID NO: 9151764 - DNA, 22 bp, Homo sapiens
gccattttctgtcttgtttatt

SEQ ID NO: 9151765 - DNA, 22 bp, Homo sapiens
gccattttgaaaaccgttgcta

SEQ ID NO: 9151766 - DNA, 22 bp, Homo sapiens
gccaggctctcagtgactgccc

SEQ ID NO: 9151767 - DNA, 22 bp, Homo sapiens
gccaggctctcagtgactgccc

SEQ ID NO: 9151768 - DNA, 23 bp, Homo sapiens
gccaggctccggtctgtggccac

SEQ ID NO: 9151769 - DNA, 22 bp, Homo sapiens
gcccaagatcacactggaaatc

SEQ ID NO: 9151770 - DNA, 22 bp, Homo sapiens
gcccaagatctggagctgcagg

SEQ ID NO: 9151771 - DNA, 22 bp, Homo sapiens
gcccaaagtcactcagctagga

SEQ ID NO: 9151772 - DNA, 22 bp, Homo sapiens
gcccaagacatttagtaaagag

SEQ ID NO: 9151773 - DNA, 22 bp, Homo sapiens
gcccaagactgtacagttaaag

SEQ ID NO: 9151774 - DNA, 22 bp, Homo sapiens
gccagctgaggccgtgcaggct

SEQ ID NO: 9151775 - DNA, 22 bp, Homo sapiens
gccagaaggggtggatccaggc

SEQ ID NO: 9151776 - DNA, 22 bp, Homo sapiens
gccagaagactggagtcagctg

SEQ ID NO: 9151777 - DNA, 22 bp, Homo sapiens
gccagctggtaggcacctagcc

SEQ ID NO: 9151778 - DNA, 22 bp, Homo sapiens
gccagctgggccttagggctgg

SEQ ID NO: 9151779 - DNA, 22 bp, Homo sapiens
gccagctggctgcaggtcccag

SEQ ID NO: 9151780 - DNA, 18 bp, Homo sapiens
gccagctgcacggccctc

SEQ ID NO: 9151781 - DNA, 20 bp, Homo sapiens
gccagctggtcccaattatg

SEQ ID NO: 9151782 - DNA, 20 bp, Homo sapiens
gccagctggtcccaattatg

SEQ ID NO: 9151783 - DNA, 22 bp, Homo sapiens
gccagctgtaagcagtgattct

SEQ ID NO: 9151784 - DNA, 22 bp, Homo sapiens
gccagctgtctaagagagtaaa

SEQ ID NO: 9151785 - DNA, 22 bp, Homo sapiens
gccagctgtgcttttcctaaaa

SEQ ID NO: 9151786 - DNA, 22 bp, Homo sapiens
gccagctgttcagacattcttt

SEQ ID NO: 9151787 - DNA, 22 bp, Homo sapiens
gccagctgttcagacattcttt

SEQ ID NO: 9151788 - DNA, 23 bp, Homo sapiens
gccagctttggtctgtctcctag

SEQ ID NO: 9151789 - DNA, 22 bp, Homo sapiens
gccagcttcccatctggcttcc

SEQ ID NO: 9151790 - DNA, 22 bp, Homo sapiens
gccaggaaaagaagctggtgct

SEQ ID NO: 9151791 - DNA, 22 bp, Homo sapiens
gccaggaaagccactggcatac

SEQ ID NO: 9151792 - DNA, 22 bp, Homo sapiens
gccaggaaagccactggcatac

SEQ ID NO: 9151793 - DNA, 19 bp, Homo sapiens
gccaggaaagaatcaggcg

SEQ ID NO: 9151794 - DNA, 22 bp, Homo sapiens
gccaggaaaaaccggccctgct

SEQ ID NO: 9151795 - DNA, 22 bp, Homo sapiens
gccaggaaaaaccggccctgct

SEQ ID NO: 9151796 - DNA, 22 bp, Homo sapiens
gccaggaaaaacgtggtgggag

SEQ ID NO: 9151797 - DNA, 18 bp, Homo sapiens
gccaggaagaggaatgtg

SEQ ID NO: 9151798 - DNA, 22 bp, Homo sapiens
gccaggaagagagagccctcca

SEQ ID NO: 9151799 - DNA, 22 bp, Homo sapiens
gccaggaacacaatgccaagct

SEQ ID NO: 9151800 - DNA, 22 bp, Homo sapiens
gccaggaaattcatgccagatc

SEQ ID NO: 9151801 - DNA, 22 bp, Homo sapiens
gccaggaaagggaattccctga

SEQ ID NO: 9151802 - DNA, 18 bp, Homo sapiens
gccaggaagcatggggac

SEQ ID NO: 9151803 - DNA, 22 bp, Homo sapiens
gccaggaaggctccctggtcac

SEQ ID NO: 9151804 - DNA, 22 bp, Homo sapiens
gccaggaagtgcagccctgcca

SEQ ID NO: 9151805 - DNA, 22 bp, Homo sapiens
gccaggaagtcagccaagccca

SEQ ID NO: 9151806 - DNA, 22 bp, Homo sapiens
gccaggaatcactgctgagtaa

SEQ ID NO: 9151807 - DNA, 22 bp, Homo sapiens
gccaggaatcactgctgagtaa

SEQ ID NO: 9151808 - DNA, 22 bp, Homo sapiens
gccaggaagttgggccagtcta

SEQ ID NO: 9151809 - DNA, 22 bp, Homo sapiens
gcccacagctcgttcctctcct

SEQ ID NO: 9151810 - DNA, 22 bp, Homo sapiens
gccccaggggaggtgccctgca

SEQ ID NO: 9151811 - DNA, 22 bp, Homo sapiens
gcccaaggtcccatggcagcac

SEQ ID NO: 9151812 - DNA, 22 bp, Homo sapiens
gcccaagtcagtgcttctggca

SEQ ID NO: 9151813 - DNA, 22 bp, Homo sapiens
gcccacacagcagatcctttgg

SEQ ID NO: 9151814 - DNA, 22 bp, Homo sapiens
gcccacaccatttattctttgt

SEQ ID NO: 9151815 - DNA, 22 bp, Homo sapiens
gcccacacaccagctcaggagg

SEQ ID NO: 9151816 - DNA, 22 bp, Homo sapiens
gcccctcccagtcaggagcact

SEQ ID NO: 9151817 - DNA, 22 bp, Homo sapiens
gccccaggtggtaaacctaaga

SEQ ID NO: 9151818 - DNA, 22 bp, Homo sapiens
gccccaggtggtaaacctaaga

SEQ ID NO: 9151819 - DNA, 22 bp, Homo sapiens
gcccctccatccatcaccgggg

SEQ ID NO: 9151820 - DNA, 22 bp, Homo sapiens
gccccaggttgcctgtcccagg

SEQ ID NO: 9151821 - DNA, 22 bp, Homo sapiens
gccccaggttgcctgtcccagg

SEQ ID NO: 9151822 - DNA, 22 bp, Homo sapiens
gcccctctccttgtgcacctgc

SEQ ID NO: 9151823 - DNA, 22 bp, Homo sapiens
gcccctccgggcgcgtcatagc

SEQ ID NO: 9151824 - DNA, 22 bp, Homo sapiens
gcccctctcccttgaggcaggc

SEQ ID NO: 9151825 - DNA, 22 bp, Homo sapiens
gcccctggctggccagctcctc

SEQ ID NO: 9151826 - DNA, 22 bp, Homo sapiens
gcccctggctggccagctcctc

SEQ ID NO: 9151827 - DNA, 22 bp, Homo sapiens
gccccttctctgaggaacctgc

SEQ ID NO: 9151828 - DNA, 22 bp, Homo sapiens
gccccttccatcatgtgaggac

SEQ ID NO: 9151829 - DNA, 22 bp, Homo sapiens
gcccggccaggaacagagtata

SEQ ID NO: 9151830 - DNA, 22 bp, Homo sapiens
gcccggcagtcacacacccagg

SEQ ID NO: 9151831 - DNA, 22 bp, Homo sapiens
gcccgtgtctcctgctctgtgg

SEQ ID NO: 9151832 - DNA, 21 bp, Homo sapiens
gccctaggctacctggagcgc

SEQ ID NO: 9151833 - DNA, 21 bp, Homo sapiens
gccctaggctacctggagcgc

SEQ ID NO: 9151834 - DNA, 17 bp, Homo sapiens
gccctgcctgctgccct

SEQ ID NO: 9151835 - DNA, 22 bp, Homo sapiens
gccctgcctgtctgctgggagg

SEQ ID NO: 9151836 - DNA, 22 bp, Homo sapiens
gccctgcctgtctgctgggagg

SEQ ID NO: 9151837 - DNA, 22 bp, Homo sapiens
gccctgctctggtctctgcccg

SEQ ID NO: 9151838 - DNA, 22 bp, Homo sapiens
gccctgctccaggagaataccc

SEQ ID NO: 9151839 - DNA, 22 bp, Homo sapiens
gccctgctgtcttcagagtata

SEQ ID NO: 9151840 - DNA, 22 bp, Homo sapiens
gccctgctgtcttcagagtata

SEQ ID NO: 9151841 - DNA, 22 bp, Homo sapiens
gccctgctgtttagagagctac

SEQ ID NO: 9151842 - DNA, 22 bp, Homo sapiens
gccctgcttctggcatgcagaa

SEQ ID NO: 9151843 - DNA, 22 bp, Homo sapiens
gccctgctgctggcagaggcgc

SEQ ID NO: 9151844 - DNA, 22 bp, Homo sapiens
gccctgctgagtccggctcaga

SEQ ID NO: 9151845 - DNA, 22 bp, Homo sapiens
gccctggaatctctccatggga

SEQ ID NO: 9151846 - DNA, 22 bp, Homo sapiens
gccctggacagtgacggtgacc

SEQ ID NO: 9151847 - DNA, 22 bp, Homo sapiens
gccctggacagtgacggtgacc

SEQ ID NO: 9151848 - DNA, 22 bp, Homo sapiens
gccctgcttctggcatgcagaa

SEQ ID NO: 9151849 - DNA, 22 bp, Homo sapiens
gcctcagggggagaggccagct

SEQ ID NO: 9151850 - DNA, 22 bp, Homo sapiens
gcctcaggtaaaacttgagttt

SEQ ID NO: 9151851 - DNA, 22 bp, Homo sapiens
gcctcaggtaaaacttgagttt

SEQ ID NO: 9151852 - DNA, 19 bp, Homo sapiens
gcctcatttccacctcccc

SEQ ID NO: 9151853 - DNA, 19 bp, Homo sapiens
gcctcatttccacctcccc

SEQ ID NO: 9151854 - DNA, 22 bp, Homo sapiens
gcctcagtgatatgtgggacaa

SEQ ID NO: 9151855 - DNA, 22 bp, Homo sapiens
gcctcagtctcccgagtagctg

SEQ ID NO: 9151856 - DNA, 22 bp, Homo sapiens
gcctcaggtgcatctctcattc

SEQ ID NO: 9151857 - DNA, 22 bp, Homo sapiens
gcctccctccaccactgcaggt

SEQ ID NO: 9151858 - DNA, 18 bp, Homo sapiens
gcctccctggctacactt

SEQ ID NO: 9151859 - DNA, 22 bp, Homo sapiens
gcctgagggctcctagcaggct

SEQ ID NO: 9151860 - DNA, 22 bp, Homo sapiens
gcctgagggctcctagcaggct

SEQ ID NO: 9151861 - DNA, 22 bp, Homo sapiens
gcctgagtcaagatgtggcacc

SEQ ID NO: 9151862 - DNA, 22 bp, Homo sapiens
gcctccctgtttcctgctccaa

SEQ ID NO: 9151863 - DNA, 22 bp, Homo sapiens
gcctgaggaattgagggggtaa

SEQ ID NO: 9151864 - DNA, 22 bp, Homo sapiens
gcctgcagctgcttccacacac

SEQ ID NO: 9151865 - DNA, 22 bp, Homo sapiens
gcctgcagggcccttgtgggtc

SEQ ID NO: 9151866 - DNA, 17 bp, Homo sapiens
gcctgcaggcccgcaga

SEQ ID NO: 9151867 - DNA, 17 bp, Homo sapiens
gcctgcaggcccgcaga

SEQ ID NO: 9151868 - DNA, 17 bp, Homo sapiens
gcctgcaggcccgcaga

SEQ ID NO: 9151869 - DNA, 22 bp, Homo sapiens
gcctgcaggctgtagtttgtga

SEQ ID NO: 9151870 - DNA, 22 bp, Homo sapiens
gcctgcagccagggagttctct

SEQ ID NO: 9151871 - DNA, 22 bp, Homo sapiens
gcctgcagcatgctaggtcttg

SEQ ID NO: 9151872 - DNA, 22 bp, Homo sapiens
gcctgcagaggtgctgctagct

SEQ ID NO: 9151873 - DNA, 22 bp, Homo sapiens
gcctgcagatatataggatggt

SEQ ID NO: 9151874 - DNA, 22 bp, Homo sapiens
gcctgcagccagggagttctct

SEQ ID NO: 9151875 - DNA, 22 bp, Homo sapiens
gcctgcagatatataggatggt

SEQ ID NO: 9151876 - DNA, 22 bp, Homo sapiens
gcctgcagcatgctaggtcttg

SEQ ID NO: 9151877 - DNA, 19 bp, Homo sapiens
gcctgcagaaaaggcaggg

SEQ ID NO: 9151878 - DNA, 20 bp, Homo sapiens
gcctgcagagaaggtcagag

SEQ ID NO: 9151879 - DNA, 22 bp, Homo sapiens
gcctgcagaggtgctgctagct

SEQ ID NO: 9151880 - DNA, 19 bp, Homo sapiens
gcctgcagaaaaggcaggg

SEQ ID NO: 9151881 - DNA, 22 bp, Homo sapiens
gcctgcagaactgtgaggcaat

SEQ ID NO: 9151882 - DNA, 21 bp, Homo sapiens
gcctgcagaccccaccaggct

SEQ ID NO: 9151883 - DNA, 21 bp, Homo sapiens
gcctgcagaccccaccaggct

SEQ ID NO: 9151884 - DNA, 22 bp, Homo sapiens
gcctgcagggtgatgggctgcc

SEQ ID NO: 9151885 - DNA, 22 bp, Homo sapiens
gcctgcagggcctgggcctacc

SEQ ID NO: 9151886 - DNA, 20 bp, Homo sapiens
gcctgcaggttggatgggat

SEQ ID NO: 9151887 - DNA, 22 bp, Homo sapiens
gcctgcagtgagtgcagaaggt

SEQ ID NO: 9151888 - DNA, 23 bp, Homo sapiens
gcctggagaaaagctgcagttca

SEQ ID NO: 9151889 - DNA, 23 bp, Homo sapiens
gcctggagaaaagctgcagttca

SEQ ID NO: 9151890 - DNA, 21 bp, Homo sapiens
gcctgcagttttgaagccctt

SEQ ID NO: 9151891 - DNA, 22 bp, Homo sapiens
gcctgccaaaagaagctgctgg

SEQ ID NO: 9151892 - DNA, 22 bp, Homo sapiens
gcctgcagtgagtgcagaaggt

SEQ ID NO: 9151893 - DNA, 22 bp, Homo sapiens
gcctgcagttctgtgctaggca

SEQ ID NO: 9151894 - DNA, 22 bp, Homo sapiens
gcctgcagttctgtgctaggca

SEQ ID NO: 9151895 - DNA, 22 bp, Homo sapiens
gcctggagaattaaaaggaagg

SEQ ID NO: 9151896 - DNA, 22 bp, Homo sapiens
gcctggagacagcagaggcggc

SEQ ID NO: 9151897 - DNA, 22 bp, Homo sapiens
gcctggagacaaggacaaaggg

SEQ ID NO: 9151898 - DNA, 22 bp, Homo sapiens
gcctggagacaaggacaaaggg

SEQ ID NO: 9151899 - DNA, 22 bp, Homo sapiens
gcctggagaaaggaaggtggga

SEQ ID NO: 9151900 - DNA, 22 bp, Homo sapiens
gcctggagaaaggaaggtggga

SEQ ID NO: 9151901 - DNA, 22 bp, Homo sapiens
gcctggagaagatggaactagc

SEQ ID NO: 9151902 - DNA, 22 bp, Homo sapiens
gcctggagaggaagccggtgga

SEQ ID NO: 9151903 - DNA, 22 bp, Homo sapiens
gcctggagcagacgtgtcccgg

SEQ ID NO: 9151904 - DNA, 22 bp, Homo sapiens
gcctggagacctgctcctctac

SEQ ID NO: 9151905 - DNA, 22 bp, Homo sapiens
gcctggagagcactgtgcgctt

SEQ ID NO: 9151906 - DNA, 22 bp, Homo sapiens
gcctggagtgcagtggcgtgat

SEQ ID NO: 9151907 - DNA, 16 bp, Homo sapiens
gcctggagtggcaggg

SEQ ID NO: 9151908 - DNA, 22 bp, Homo sapiens
gcctggagtggacttggcccct

SEQ ID NO: 9151909 - DNA, 22 bp, Homo sapiens
gcctggagtagcatggcaagcc

SEQ ID NO: 9151910 - DNA, 22 bp, Homo sapiens
gcctggagtagcatggcaagcc

SEQ ID NO: 9151911 - DNA, 22 bp, Homo sapiens
gcctggagcccagtgtggggct

SEQ ID NO: 9151912 - DNA, 22 bp, Homo sapiens
gcctggagcccagtgtggggct

SEQ ID NO: 9151913 - DNA, 22 bp, Homo sapiens
gcaataaagattttactgtcag

SEQ ID NO: 9151914 - DNA, 22 bp, Homo sapiens
gcaataaactctctcaagccac

SEQ ID NO: 9151915 - DNA, 22 bp, Homo sapiens
gcaataaagattttactgtcag

SEQ ID NO: 9151916 - DNA, 22 bp, Homo sapiens
gcaataaaatgtaatgattggg

SEQ ID NO: 9151917 - DNA, 20 bp, Homo sapiens
gcaaggctccaaggggtgtg

SEQ ID NO: 9151918 - DNA, 20 bp, Homo sapiens
gcaaggctccaaggggtgtg

SEQ ID NO: 9151919 - DNA, 22 bp, Homo sapiens
gcaataaataacatggaagaca

SEQ ID NO: 9151920 - DNA, 22 bp, Homo sapiens
gcaatacagtaggtttattggt

SEQ ID NO: 9151921 - DNA, 22 bp, Homo sapiens
gcaatacagtaagagtactgta

SEQ ID NO: 9151922 - DNA, 18 bp, Homo sapiens
gcaaggctcaggccaggc

SEQ ID NO: 9151923 - DNA, 19 bp, Homo sapiens
gagtattccaaggaaactt

SEQ ID NO: 9151924 - DNA, 20 bp, Homo sapiens
gagtatgtaggatggtatca

SEQ ID NO: 9151925 - DNA, 22 bp, Homo sapiens
gagtagggtttccaggttagag

SEQ ID NO: 9151926 - DNA, 22 bp, Homo sapiens
gagtaggaatgttctgccatct

SEQ ID NO: 9151927 - DNA, 18 bp, Homo sapiens
gagtagcattgaggaaac

SEQ ID NO: 9151928 - DNA, 22 bp, Homo sapiens
gagtagcattctagagtatgct

SEQ ID NO: 9151929 - DNA, 22 bp, Homo sapiens
gagtagcagccacagaggaccc

SEQ ID NO: 9151930 - DNA, 22 bp, Homo sapiens
gagtagcagccacagaggaccc

SEQ ID NO: 9151931 - DNA, 22 bp, Homo sapiens
gcaaggaggctggtggaggaag

SEQ ID NO: 9151932 - DNA, 22 bp, Homo sapiens
gcaaggaggctggtggaggaag

SEQ ID NO: 9151933 - DNA, 22 bp, Homo sapiens
gcaaggagcctggaggtgagtg

SEQ ID NO: 9151934 - DNA, 22 bp, Homo sapiens
gcaaggagcctggaggtgagtg

SEQ ID NO: 9151935 - DNA, 22 bp, Homo sapiens
gcaaggagactgtagggccaag

SEQ ID NO: 9151936 - DNA, 22 bp, Homo sapiens
gcaaggagcacctttctggaac

SEQ ID NO: 9151937 - DNA, 22 bp, Homo sapiens
gagtattttcaaattcagcaga

SEQ ID NO: 9151938 - DNA, 22 bp, Homo sapiens
gagtcacaaaagatgcccaggg

SEQ ID NO: 9151939 - DNA, 22 bp, Homo sapiens
gcaaggagactgtagggccaag

SEQ ID NO: 9151940 - DNA, 22 bp, Homo sapiens
gcacagaaccctatctttcgga

SEQ ID NO: 9151941 - DNA, 22 bp, Homo sapiens
gcacagaacttctcttagtagg

SEQ ID NO: 9151942 - DNA, 22 bp, Homo sapiens
gcaatactgagattattgtact

SEQ ID NO: 9151943 - DNA, 22 bp, Homo sapiens
gcaatactaagtgacttttggg

SEQ ID NO: 9151944 - DNA, 22 bp, Homo sapiens
gcacagagacagtcctgagatc

SEQ ID NO: 9151945 - DNA, 22 bp, Homo sapiens
gcacagagacagtcctgagatc

SEQ ID NO: 9151946 - DNA, 22 bp, Homo sapiens
gcacagagagcagtgggggaca

SEQ ID NO: 9151947 - DNA, 20 bp, Homo sapiens
gcacagagatgagcaaagta

SEQ ID NO: 9151948 - DNA, 22 bp, Homo sapiens
gcacagatggtactagcttggt

SEQ ID NO: 9151949 - DNA, 22 bp, Homo sapiens
gcacagagtcactagctaagca

SEQ ID NO: 9151950 - DNA, 22 bp, Homo sapiens
gcacagagtcactagctaagca

SEQ ID NO: 9151951 - DNA, 22 bp, Homo sapiens
gcacagcagctgctcagttgct

SEQ ID NO: 9151952 - DNA, 22 bp, Homo sapiens
gcacagcagacttggtggggct

SEQ ID NO: 9151953 - DNA, 22 bp, Homo sapiens
gcacagcagacttggtggggct

SEQ ID NO: 9151954 - DNA, 22 bp, Homo sapiens
gcacagcagccgaaatgccctt

SEQ ID NO: 9151955 - DNA, 22 bp, Homo sapiens
gcacagcagctgctcagttgct

SEQ ID NO: 9151956 - DNA, 22 bp, Homo sapiens
gcacagcagctgctcagttgct

SEQ ID NO: 9151957 - DNA, 22 bp, Homo sapiens
gcacagcagctgggggccctgg

SEQ ID NO: 9151958 - DNA, 22 bp, Homo sapiens
gcacagcagctgggggccctgg

SEQ ID NO: 9151959 - DNA, 22 bp, Homo sapiens
gcacatgtgggtaagcacatgg

SEQ ID NO: 9151960 - DNA, 18 bp, Homo sapiens
gcacatgtaagagtaaag

SEQ ID NO: 9151961 - DNA, 22 bp, Homo sapiens
gcacatgtgagagtagaggcct

SEQ ID NO: 9151962 - DNA, 22 bp, Homo sapiens
gcacatggtaggcatttgatgt

SEQ ID NO: 9151963 - DNA, 21 bp, Homo sapiens
gcacatgctgtgtgtttctct

SEQ ID NO: 9151964 - DNA, 22 bp, Homo sapiens
gcagagtgaagcagtatggaaa

SEQ ID NO: 9151965 - DNA, 22 bp, Homo sapiens
gcagaggtggcatctgggctct

SEQ ID NO: 9151966 - DNA, 22 bp, Homo sapiens
gcagacaggggcttaggaaagg

SEQ ID NO: 9151967 - DNA, 22 bp, Homo sapiens
gcagacagggctacagaggtac

SEQ ID NO: 9151968 - DNA, 22 bp, Homo sapiens
gcagacagggctacagaggtac

SEQ ID NO: 9151969 - DNA, 22 bp, Homo sapiens
gcagacagggctacagaggtac

SEQ ID NO: 9151970 - DNA, 22 bp, Homo sapiens
gcagacaggcccagtggaggga

SEQ ID NO: 9151971 - DNA, 22 bp, Homo sapiens
gcagagtgagatatgaacccag

SEQ ID NO: 9151972 - DNA, 22 bp, Homo sapiens
gcagagtgagccgaggctgctc

SEQ ID NO: 9151973 - DNA, 22 bp, Homo sapiens
gcagagtgccgagatggaagcg

SEQ ID NO: 9151974 - DNA, 22 bp, Homo sapiens
gcagagtgccgagatggaagcg

SEQ ID NO: 9151975 - DNA, 22 bp, Homo sapiens
gcagcaaacttccacaagtaga

SEQ ID NO: 9151976 - DNA, 22 bp, Homo sapiens
gcagcaaagctcttcatgtgat

SEQ ID NO: 9151977 - DNA, 21 bp, Homo sapiens
gcagcaaatgacaacagtgag

SEQ ID NO: 9151978 - DNA, 22 bp, Homo sapiens
gcagcaagaggtgccatcttga

SEQ ID NO: 9151979 - DNA, 22 bp, Homo sapiens
gcaccactaagagcagggaccg

SEQ ID NO: 9151980 - DNA, 19 bp, Homo sapiens
gcaccagattgagtgacac

SEQ ID NO: 9151981 - DNA, 22 bp, Homo sapiens
gcaccagcctgagcctcttgca

SEQ ID NO: 9151982 - DNA, 22 bp, Homo sapiens
gcaccactagagtagagatggt

SEQ ID NO: 9151983 - DNA, 22 bp, Homo sapiens
gcaccactacactccagcctgg

SEQ ID NO: 9151984 - DNA, 22 bp, Homo sapiens
gcaccagagggggctctgcagg

SEQ ID NO: 9151985 - DNA, 22 bp, Homo sapiens
gcaccagctgcagggtggctga

SEQ ID NO: 9151986 - DNA, 22 bp, Homo sapiens
gcaccagctgccttctgtgccc

SEQ ID NO: 9151987 - DNA, 22 bp, Homo sapiens
gcacccagaggtcagcagtgct

SEQ ID NO: 9151988 - DNA, 22 bp, Homo sapiens
gcaccaggaggcccttctcatc

SEQ ID NO: 9151989 - DNA, 22 bp, Homo sapiens
gcagacagccagactgcactgg

SEQ ID NO: 9151990 - DNA, 22 bp, Homo sapiens
gcagacaggcccagtggaggga

SEQ ID NO: 9151991 - DNA, 22 bp, Homo sapiens
gcagacagcatgttgggctatt

SEQ ID NO: 9151992 - DNA, 22 bp, Homo sapiens
gcagacagatgagggtgctggg

SEQ ID NO: 9151993 - DNA, 22 bp, Homo sapiens
gcagacagatgagggtgctggg

SEQ ID NO: 9151994 - DNA, 22 bp, Homo sapiens
gcagacagatgagggtgctggg

SEQ ID NO: 9151995 - DNA, 22 bp, Homo sapiens
gcagacagaagctaagtagaca

SEQ ID NO: 9151996 - DNA, 22 bp, Homo sapiens
gcagacagaagctaagtagaca

SEQ ID NO: 9151997 - DNA, 22 bp, Homo sapiens
gcagacacttcccactgcagcg

SEQ ID NO: 9151998 - DNA, 22 bp, Homo sapiens
gcagacacagggaaggcaagga

SEQ ID NO: 9151999 - DNA, 22 bp, Homo sapiens
gcagaagggaataaggagcttt

SEQ ID NO: 9152000 - DNA, 22 bp, Homo sapiens
gcaggtgaaagtgagtagtgag

SEQ ID NO: 9152001 - DNA, 22 bp, Homo sapiens
gcaggtgaatgatggactagga

SEQ ID NO: 9152002 - DNA, 22 bp, Homo sapiens
gcaggtgatgtgatgtgagcat

SEQ ID NO: 9152003 - DNA, 22 bp, Homo sapiens
gcaggtctatcaggctgcaggt

SEQ ID NO: 9152004 - DNA, 22 bp, Homo sapiens
gcaggtctggagggcactgggg

SEQ ID NO: 9152005 - DNA, 22 bp, Homo sapiens
gcaggtctcaatctgagcaggc

SEQ ID NO: 9152006 - DNA, 22 bp, Homo sapiens
gcaggtcttgaaggtgtgattt

SEQ ID NO: 9152007 - DNA, 22 bp, Homo sapiens
gcaggtctgttgattacagtca

SEQ ID NO: 9152008 - DNA, 22 bp, Homo sapiens
gcaggtctggcatagagcctgc

SEQ ID NO: 9152009 - DNA, 19 bp, Homo sapiens
gcagggtgttgactgtccc

SEQ ID NO: 9152010 - DNA, 19 bp, Homo sapiens
gcaggtagagacagcagcc

SEQ ID NO: 9152011 - DNA, 22 bp, Homo sapiens
gcaggtagtgatcgagggtgac

SEQ ID NO: 9152012 - DNA, 22 bp, Homo sapiens
gcaggtagtgatcgagggtgac

SEQ ID NO: 9152013 - DNA, 22 bp, Homo sapiens
gcaggtctagaagctgcctctg

SEQ ID NO: 9152014 - DNA, 19 bp, Homo sapiens
gcagggtggcagagctctt

SEQ ID NO: 9152015 - DNA, 22 bp, Homo sapiens
gcagggccagtgcagagaggaa

SEQ ID NO: 9152016 - DNA, 22 bp, Homo sapiens
gcagggccagtgcagagaggaa

SEQ ID NO: 9152017 - DNA, 22 bp, Homo sapiens
gcagggccagtgcagagaggaa

SEQ ID NO: 9152018 - DNA, 22 bp, Homo sapiens
gcagggccaggtacaagaagca

SEQ ID NO: 9152019 - DNA, 22 bp, Homo sapiens
gcagggccaggtacaagaagca

SEQ ID NO: 9152020 - DNA, 22 bp, Homo sapiens
gcagggccagggctcaggctgt

SEQ ID NO: 9152021 - DNA, 22 bp, Homo sapiens
gcagggccagggctcaggctgt

SEQ ID NO: 9152022 - DNA, 22 bp, Homo sapiens
gcagggccagggctcaggctgt

SEQ ID NO: 9152023 - DNA, 22 bp, Homo sapiens
gcagggccagggctcaggctgt

SEQ ID NO: 9152024 - DNA, 22 bp, Homo sapiens
gcagggcatgggccctgtctgc

SEQ ID NO: 9152025 - DNA, 22 bp, Homo sapiens
gcagggcagcttagtccctgtc

SEQ ID NO: 9152026 - DNA, 22 bp, Homo sapiens
gcagggcagggcaagaactggg

SEQ ID NO: 9152027 - DNA, 22 bp, Homo sapiens
gcagggcagggcaagaactggg

SEQ ID NO: 9152028 - DNA, 22 bp, Homo sapiens
gcagggcagtaagagctagagt

SEQ ID NO: 9152029 - DNA, 22 bp, Homo sapiens
gcaggcctcccctgctggagct

SEQ ID NO: 9152030 - DNA, 18 bp, Homo sapiens
gcaggcctagaacttggt

SEQ ID NO: 9152031 - DNA, 22 bp, Homo sapiens
gcaggcctaagagaaggcattg

SEQ ID NO: 9152032 - DNA, 22 bp, Homo sapiens
gcagggcagctcactgtggttc

SEQ ID NO: 9152033 - DNA, 22 bp, Homo sapiens
gcagggcagccacaggccccct

SEQ ID NO: 9152034 - DNA, 22 bp, Homo sapiens
gcagggcagccacaggccccct

SEQ ID NO: 9152035 - DNA, 22 bp, Homo sapiens
gcagggcagctgaagctaggtg

SEQ ID NO: 9152036 - DNA, 22 bp, Homo sapiens
gcagggcagctgaagctaggtg

SEQ ID NO: 9152037 - DNA, 22 bp, Homo sapiens
gcagggcagctgaagctaggtg

SEQ ID NO: 9152038 - DNA, 22 bp, Homo sapiens
gcagggcagcttagtccctgtc

SEQ ID NO: 9152039 - DNA, 19 bp, Homo sapiens
gcaggccaggaggcggagg

SEQ ID NO: 9152040 - DNA, 22 bp, Homo sapiens
gcaggccaggctaggggctgtc

SEQ ID NO: 9152041 - DNA, 22 bp, Homo sapiens
gcaggccagctgtgcagatggg

SEQ ID NO: 9152042 - DNA, 22 bp, Homo sapiens
gcaggccaagccctcgcagaga

SEQ ID NO: 9152043 - DNA, 22 bp, Homo sapiens
gcaggcatggtcgctgccaggt

SEQ ID NO: 9152044 - DNA, 22 bp, Homo sapiens
gcaggccaagccctcgcagaga

SEQ ID NO: 9152045 - DNA, 22 bp, Homo sapiens
gcagctgtcagaagttggaatc

SEQ ID NO: 9152046 - DNA, 22 bp, Homo sapiens
gcagctgtatcacttttaaaca

SEQ ID NO: 9152047 - DNA, 22 bp, Homo sapiens
gcagctgtcagaagttggaatc

SEQ ID NO: 9152048 - DNA, 22 bp, Homo sapiens
gcagctgtagaggggagaaaga

SEQ ID NO: 9152049 - DNA, 23 bp, Homo sapiens
gcagctggttagaagggaaggag

SEQ ID NO: 9152050 - DNA, 22 bp, Homo sapiens
gcagctgtaaagcagaaatagt

SEQ ID NO: 9152051 - DNA, 22 bp, Homo sapiens
gcagccaggaagcccaggacac

SEQ ID NO: 9152052 - DNA, 17 bp, Homo sapiens
gcagccagtgcagcagg

SEQ ID NO: 9152053 - DNA, 22 bp, Homo sapiens
gcagccagtatcctctgagatt

SEQ ID NO: 9152054 - DNA, 22 bp, Homo sapiens
gcagccagtatcctctgagatt

SEQ ID NO: 9152055 - DNA, 22 bp, Homo sapiens
gcagccattgagcgaaaaaatc

SEQ ID NO: 9152056 - DNA, 17 bp, Homo sapiens
gcagccagtgcagcagg

SEQ ID NO: 9152057 - DNA, 22 bp, Homo sapiens
gcagcccaagcctgagcatcct

SEQ ID NO: 9152058 - DNA, 22 bp, Homo sapiens
gcagcccaagagactctgttga

SEQ ID NO: 9152059 - DNA, 22 bp, Homo sapiens
gcagcccaaaaaagaggtagat

SEQ ID NO: 9152060 - DNA, 22 bp, Homo sapiens
gcagcccaaaaaagaggtagat

SEQ ID NO: 9152061 - DNA, 22 bp, Homo sapiens
gcagcccaatggactgagacag

SEQ ID NO: 9152062 - DNA, 22 bp, Homo sapiens
gcagcccaagcctgagcatcct

SEQ ID NO: 9152063 - DNA, 22 bp, Homo sapiens
gcagcccacagctggaggccta

SEQ ID NO: 9152064 - DNA, 22 bp, Homo sapiens
gcagcccacaccactctgctca

SEQ ID NO: 9152065 - DNA, 22 bp, Homo sapiens
gcagcccacaccactctgctca

SEQ ID NO: 9152066 - DNA, 22 bp, Homo sapiens
gcagctggctcagagaggtggg

SEQ ID NO: 9152067 - DNA, 22 bp, Homo sapiens
gcagctggctcagagaggtggg

SEQ ID NO: 9152068 - DNA, 22 bp, Homo sapiens
gcagctgggacactgaggccag

SEQ ID NO: 9152069 - DNA, 22 bp, Homo sapiens
gcagctggggaggtcgtgggga

SEQ ID NO: 9152070 - DNA, 22 bp, Homo sapiens
gcagctggggaggtcgtgggga

SEQ ID NO: 9152071 - DNA, 22 bp, Homo sapiens
gcagctgggtctgtgtgggctg

SEQ ID NO: 9152072 - DNA, 22 bp, Homo sapiens
gcagctgggtctgtgtgggctg

SEQ ID NO: 9152073 - DNA, 21 bp, Homo sapiens
gcagctggtctcagagcttgc

SEQ ID NO: 9152074 - DNA, 21 bp, Homo sapiens
gcagctggtctcagagcttgc

SEQ ID NO: 9152075 - DNA, 21 bp, Homo sapiens
gcagctggtctcagagcttgc

SEQ ID NO: 9152076 - DNA, 21 bp, Homo sapiens
gcagctggtctcagagcttgc

SEQ ID NO: 9152077 - DNA, 22 bp, Homo sapiens
gcagctggtctggcctagagta

SEQ ID NO: 9152078 - DNA, 22 bp, Homo sapiens
gcagctggtctggcctagagta

SEQ ID NO: 9152079 - DNA, 22 bp, Homo sapiens
gcagctggtgcaaatgtcactc

SEQ ID NO: 9152080 - DNA, 22 bp, Homo sapiens
gcagctggttaatgggagaatt

SEQ ID NO: 9152081 - DNA, 22 bp, Homo sapiens
gcagctggttaatgggagaatt

SEQ ID NO: 9152082 - DNA, 22 bp, Homo sapiens
gcagcagcagggagtctgactt

SEQ ID NO: 9152083 - DNA, 19 bp, Homo sapiens
gcagcagcatttggtaata

SEQ ID NO: 9152084 - DNA, 22 bp, Homo sapiens
gcagcagccactattctggcat

SEQ ID NO: 9152085 - DNA, 22 bp, Homo sapiens
gcagcagcaggcgctcggccgt

SEQ ID NO: 9152086 - DNA, 22 bp, Homo sapiens
gcagcagcaggcgctcggccgt

SEQ ID NO: 9152087 - DNA, 22 bp, Homo sapiens
gcagcagcaagaaggttggact

SEQ ID NO: 9152088 - DNA, 22 bp, Homo sapiens
gcagcagattgttttttcacct

SEQ ID NO: 9152089 - DNA, 22 bp, Homo sapiens
gcagcagatgtgggcccagagc

SEQ ID NO: 9152090 - DNA, 22 bp, Homo sapiens
gcagcagatgtgggcccagagc

SEQ ID NO: 9152091 - DNA, 22 bp, Homo sapiens
gcagcagattgttttttcacct

SEQ ID NO: 9152092 - DNA, 22 bp, Homo sapiens
gcagcagaagtagaagtacagg

SEQ ID NO: 9152093 - DNA, 22 bp, Homo sapiens
gcagcagaaggccaaggggagc

SEQ ID NO: 9152094 - DNA, 22 bp, Homo sapiens
gcagcagaaggccaaggggagc

SEQ ID NO: 9152095 - DNA, 22 bp, Homo sapiens
gcagcagaagtagaagtacagg

SEQ ID NO: 9152096 - DNA, 22 bp, Homo sapiens
gcagcagaagtagaagtacagg

SEQ ID NO: 9152097 - DNA, 22 bp, Homo sapiens
gcagcagaagtagaagtacagg

SEQ ID NO: 9152098 - DNA, 22 bp, Homo sapiens
gcagcagaagtagaagtacagg

SEQ ID NO: 9152099 - DNA, 22 bp, Homo sapiens
gcagcagaaggccaaggggagc

SEQ ID NO: 9152100 - DNA, 22 bp, Homo sapiens
gcagcagaaggccaaggggagc

SEQ ID NO: 9152101 - DNA, 22 bp, Homo sapiens
gcagcactaatgggccccagaa

SEQ ID NO: 9152102 - DNA, 22 bp, Homo sapiens
gcagcaaggatgaagcacttgg

SEQ ID NO: 9152103 - DNA, 22 bp, Homo sapiens
gcagcaagaggtttctgttgac

SEQ ID NO: 9152104 - DNA, 22 bp, Homo sapiens
gcagcaatcttcacagtgtcat

SEQ ID NO: 9152105 - DNA, 22 bp, Homo sapiens
gcagcaatcttcacagtgtcat

SEQ ID NO: 9152106 - DNA, 19 bp, Homo sapiens
gcagccaccgcggcggccg

SEQ ID NO: 9152107 - DNA, 22 bp, Homo sapiens
gcagccactttgcaaccaagag

SEQ ID NO: 9152108 - DNA, 22 bp, Homo sapiens
gcagcagccactattctggcat

SEQ ID NO: 9152109 - DNA, 22 bp, Homo sapiens
gcagcagcccagggctctcaga

SEQ ID NO: 9152110 - DNA, 22 bp, Homo sapiens
gcagcagcccagggctctcaga

SEQ ID NO: 9152111 - DNA, 22 bp, Homo sapiens
gcagccaccctcaaggctgaat

SEQ ID NO: 9152112 - DNA, 21 bp, Homo sapiens
gcagccagccgagaccatgcc

SEQ ID NO: 9152113 - DNA, 21 bp, Homo sapiens
gcagccagccgagaccatgcc

SEQ ID NO: 9152114 - DNA, 21 bp, Homo sapiens
gcagccagccgagaccatgcc

SEQ ID NO: 9152115 - DNA, 22 bp, Homo sapiens
gcagccaggaaagctggaccct

SEQ ID NO: 9152116 - DNA, 22 bp, Homo sapiens
gcagccaggaaagctggaccct

SEQ ID NO: 9152117 - DNA, 22 bp, Homo sapiens
gcagccagcccctctgacctct

SEQ ID NO: 9152118 - DNA, 22 bp, Homo sapiens
gcagccagcaggaagcgggaga

SEQ ID NO: 9152119 - DNA, 22 bp, Homo sapiens
gcagccagcaggaagcgggaga

SEQ ID NO: 9152120 - DNA, 22 bp, Homo sapiens
gcagccagagggggtgtgatca

SEQ ID NO: 9152121 - DNA, 22 bp, Homo sapiens
gcagccagaagactcagaacaa

SEQ ID NO: 9152122 - DNA, 22 bp, Homo sapiens
gctgctgtcacggtgctaaggg

SEQ ID NO: 9152123 - DNA, 22 bp, Homo sapiens
gctgctgtcacggtgctaaggg

SEQ ID NO: 9152124 - DNA, 22 bp, Homo sapiens
gctgctgtaatgtgttaagtca

SEQ ID NO: 9152125 - DNA, 18 bp, Homo sapiens
gctgctggtggagggagc

SEQ ID NO: 9152126 - DNA, 18 bp, Homo sapiens
gctgctggtggagggagc

SEQ ID NO: 9152127 - DNA, 22 bp, Homo sapiens
gctgctgtaacactaagtgcag

SEQ ID NO: 9152128 - DNA, 22 bp, Homo sapiens
gctgctggtcctcagagctcat

SEQ ID NO: 9152129 - DNA, 22 bp, Homo sapiens
gctgctggtcctcagagctcat

SEQ ID NO: 9152130 - DNA, 22 bp, Homo sapiens
gctgctggtcctcagagctcat

SEQ ID NO: 9152131 - DNA, 22 bp, Homo sapiens
gctgctggtcctcagagctcat

SEQ ID NO: 9152132 - DNA, 22 bp, Homo sapiens
gctgctggggtggagaaacgct

SEQ ID NO: 9152133 - DNA, 22 bp, Homo sapiens
gctgctgggtccctctgtgcca

SEQ ID NO: 9152134 - DNA, 22 bp, Homo sapiens
gctgctgtctcatgcgatgcgg

SEQ ID NO: 9152135 - DNA, 22 bp, Homo sapiens
gctgctgtcagtggtggcagtt

SEQ ID NO: 9152136 - DNA, 22 bp, Homo sapiens
gctgctgtcagtggtggcagtt

SEQ ID NO: 9152137 - DNA, 22 bp, Homo sapiens
gctgctgtcagtggtggcagtt

SEQ ID NO: 9152138 - DNA, 22 bp, Homo sapiens
gctggagcttgagaggacaggg

SEQ ID NO: 9152139 - DNA, 22 bp, Homo sapiens
gctggagcttgagaggacaggg

SEQ ID NO: 9152140 - DNA, 22 bp, Homo sapiens
gctgcctgaagtgtctacactg

SEQ ID NO: 9152141 - DNA, 23 bp, Homo sapiens
gctgcctctgttggtcttcagtt

SEQ ID NO: 9152142 - DNA, 22 bp, Homo sapiens
gctgctggcgctgggcgtccgg

SEQ ID NO: 9152143 - DNA, 22 bp, Homo sapiens
gctgctggcgctgggcgtccgg

SEQ ID NO: 9152144 - DNA, 22 bp, Homo sapiens
gctgctggaagcatgcgatgaa

SEQ ID NO: 9152145 - DNA, 22 bp, Homo sapiens
gctgctggaagcatgcgatgaa

SEQ ID NO: 9152146 - DNA, 22 bp, Homo sapiens
gctgctggaacaaatcacccca

SEQ ID NO: 9152147 - DNA, 22 bp, Homo sapiens
gctgctgcttgaaggctcggag

SEQ ID NO: 9152148 - DNA, 22 bp, Homo sapiens
gctgctgggggaacagttaaaa

SEQ ID NO: 9152149 - DNA, 22 bp, Homo sapiens
gctgctggggccttccctcggg

SEQ ID NO: 9152150 - DNA, 22 bp, Homo sapiens
gctgctggggccttccctcggg

SEQ ID NO: 9152151 - DNA, 22 bp, Homo sapiens
gctgctggggtcacatggtaag

SEQ ID NO: 9152152 - DNA, 22 bp, Homo sapiens
gctgctggggtcacatggtaag

SEQ ID NO: 9152153 - DNA, 22 bp, Homo sapiens
gctgctgggggaacagttaaaa

SEQ ID NO: 9152154 - DNA, 22 bp, Homo sapiens
gctgctgggcaccccctgagct

SEQ ID NO: 9152155 - DNA, 22 bp, Homo sapiens
gctgctgggcaccccctgagct

SEQ ID NO: 9152156 - DNA, 22 bp, Homo sapiens
gctgctgggcaccccctgagct

SEQ ID NO: 9152157 - DNA, 22 bp, Homo sapiens
gctgctgggatcctgggtctca

SEQ ID NO: 9152158 - DNA, 19 bp, Homo sapiens
gctgctggctctggctgga

SEQ ID NO: 9152159 - DNA, 19 bp, Homo sapiens
gctgctggctctggctgga

SEQ ID NO: 9152160 - DNA, 19 bp, Homo sapiens
gctgctggctctggctgga

SEQ ID NO: 9152161 - DNA, 22 bp, Homo sapiens
gctggcagggttctcactgaaa

SEQ ID NO: 9152162 - DNA, 22 bp, Homo sapiens
gctggcaggtccaagatagagc

SEQ ID NO: 9152163 - DNA, 22 bp, Homo sapiens
gctggagttaggtgggcttgaa

SEQ ID NO: 9152164 - DNA, 22 bp, Homo sapiens
gctggagttgtgggtttactaa

SEQ ID NO: 9152165 - DNA, 22 bp, Homo sapiens
gctggagttggcaaggcatgta

SEQ ID NO: 9152166 - DNA, 22 bp, Homo sapiens
gctggagttggcaaggcatgta

SEQ ID NO: 9152167 - DNA, 22 bp, Homo sapiens
gctggcagggtggttgagagag

SEQ ID NO: 9152168 - DNA, 22 bp, Homo sapiens
gctggagtgcagttgcacagtc

SEQ ID NO: 9152169 - DNA, 22 bp, Homo sapiens
gctggagtgatgcctgtgtctc

SEQ ID NO: 9152170 - DNA, 22 bp, Homo sapiens
gctggagtgctgaggtgcagtg

SEQ ID NO: 9152171 - DNA, 22 bp, Homo sapiens
gctggagtgctgaggtgcagtg

SEQ ID NO: 9152172 - DNA, 22 bp, Homo sapiens
gctggagttagaactagcctgg

SEQ ID NO: 9152173 - DNA, 22 bp, Homo sapiens
gctggagtgctggagtgcagtg

SEQ ID NO: 9152174 - DNA, 22 bp, Homo sapiens
gctggagtgctggagtgcagtg

SEQ ID NO: 9152175 - DNA, 22 bp, Homo sapiens
gctggagtctacattcaagaat

SEQ ID NO: 9152176 - DNA, 16 bp, Homo sapiens
gctggagtcctggagc

SEQ ID NO: 9152177 - DNA, 22 bp, Homo sapiens
gctggagtccctgcctttcctt

SEQ ID NO: 9152178 - DNA, 22 bp, Homo sapiens
gctggagtccagtggtatgatc

SEQ ID NO: 9152179 - DNA, 22 bp, Homo sapiens
gctggagtccagtggcatgatc

SEQ ID NO: 9152180 - DNA, 22 bp, Homo sapiens
gctggagtgagtatgtgtagtc

SEQ ID NO: 9152181 - DNA, 22 bp, Homo sapiens
gctggagtgagtatgtgtagtc

SEQ ID NO: 9152182 - DNA, 22 bp, Homo sapiens
gctggagtctggaggtgtgcca

SEQ ID NO: 9152183 - DNA, 22 bp, Homo sapiens
gctggagtgagggaccatattt

SEQ ID NO: 9152184 - DNA, 22 bp, Homo sapiens
gctggagtcttgaaagtggact

SEQ ID NO: 9152185 - DNA, 22 bp, Homo sapiens
gctggagtcttgaaagtggact

SEQ ID NO: 9152186 - DNA, 22 bp, Homo sapiens
gctggaggtagggaggtcctgt

SEQ ID NO: 9152187 - DNA, 22 bp, Homo sapiens
gctggaggtagggaggtcctgt

SEQ ID NO: 9152188 - DNA, 22 bp, Homo sapiens
gctggaggtagggaggtcctgt

SEQ ID NO: 9152189 - DNA, 22 bp, Homo sapiens
gctggagtaggaccatgcttga

SEQ ID NO: 9152190 - DNA, 22 bp, Homo sapiens
gctggagtacatctttggcggc

SEQ ID NO: 9152191 - DNA, 22 bp, Homo sapiens
gctggagtatctggggaaggag

SEQ ID NO: 9152192 - DNA, 19 bp, Homo sapiens
gctggagtcacttttgaga

SEQ ID NO: 9152193 - DNA, 22 bp, Homo sapiens
gctctgtggcattcatgggcag

SEQ ID NO: 9152194 - DNA, 22 bp, Homo sapiens
gctgagggctgtaacagcagag

SEQ ID NO: 9152195 - DNA, 22 bp, Homo sapiens
gctgagggggaaggaaagctga

SEQ ID NO: 9152196 - DNA, 22 bp, Homo sapiens
gctgagtcagattgcagtcttg

SEQ ID NO: 9152197 - DNA, 22 bp, Homo sapiens
gctgagtggagcagtcagcgct

SEQ ID NO: 9152198 - DNA, 17 bp, Homo sapiens
gctgagtgcagggagtc

SEQ ID NO: 9152199 - DNA, 22 bp, Homo sapiens
gctgagtgtaatgatggcagag

SEQ ID NO: 9152200 - DNA, 22 bp, Homo sapiens
gctgagtgtaatgatggcagag

SEQ ID NO: 9152201 - DNA, 22 bp, Homo sapiens
gctgagttgaaagcagaggata

SEQ ID NO: 9152202 - DNA, 22 bp, Homo sapiens
gctgagtgattgatattttagt

SEQ ID NO: 9152203 - DNA, 22 bp, Homo sapiens
gctgagtgaggtccagagcttg

SEQ ID NO: 9152204 - DNA, 22 bp, Homo sapiens
gctgagtgattcatacgctgct

SEQ ID NO: 9152205 - DNA, 22 bp, Homo sapiens
gctgagtgaggtccagagcttg

SEQ ID NO: 9152206 - DNA, 22 bp, Homo sapiens
gctgagtgaggtccagagcttg

SEQ ID NO: 9152207 - DNA, 22 bp, Homo sapiens
gctgagtgaggaaaaggttata

SEQ ID NO: 9152208 - DNA, 22 bp, Homo sapiens
gctgagtgaggctgtcaaaatg

SEQ ID NO: 9152209 - DNA, 22 bp, Homo sapiens
gctgagtcttgcctgtgctgtc

SEQ ID NO: 9152210 - DNA, 22 bp, Homo sapiens
gctgagtgaaagtttgctgtgt

SEQ ID NO: 9152211 - DNA, 18 bp, Homo sapiens
gctgcaggccctccgagg

SEQ ID NO: 9152212 - DNA, 18 bp, Homo sapiens
gctgcaggccctccgagg

SEQ ID NO: 9152213 - DNA, 18 bp, Homo sapiens
gctgcaggcgcctgcggt

SEQ ID NO: 9152214 - DNA, 18 bp, Homo sapiens
gctgcaggccctccgagg

SEQ ID NO: 9152215 - DNA, 18 bp, Homo sapiens
gctgcaggcgcctgcggt

SEQ ID NO: 9152216 - DNA, 22 bp, Homo sapiens
gctgcaggcgcctgcggtctct

SEQ ID NO: 9152217 - DNA, 22 bp, Homo sapiens
gctgcaggcgcctgcggtctct

SEQ ID NO: 9152218 - DNA, 22 bp, Homo sapiens
gctgcaggcgcctgcggtctct

SEQ ID NO: 9152219 - DNA, 22 bp, Homo sapiens
gctgcaggatgaggctctgctc

SEQ ID NO: 9152220 - DNA, 22 bp, Homo sapiens
gctgataaatagttgatgtacc

SEQ ID NO: 9152221 - DNA, 22 bp, Homo sapiens
gctgcaggcagaatctcccaat

SEQ ID NO: 9152222 - DNA, 22 bp, Homo sapiens
gctgcctcctgagatttgggca

SEQ ID NO: 9152223 - DNA, 22 bp, Homo sapiens
gctgcctctcctgagttgacag

SEQ ID NO: 9152224 - DNA, 22 bp, Homo sapiens
gctgcctcctgaaagcgctctg

SEQ ID NO: 9152225 - DNA, 23 bp, Homo sapiens
gctgcctcctacaaaagcccagc

SEQ ID NO: 9152226 - DNA, 22 bp, Homo sapiens
gctgcctctgcgactctgggcg

SEQ ID NO: 9152227 - DNA, 22 bp, Homo sapiens
gctgcctctgtagctttggacc

SEQ ID NO: 9152228 - DNA, 22 bp, Homo sapiens
gctgcctctcctgagttgacag

SEQ ID NO: 9152229 - DNA, 22 bp, Homo sapiens
gctgcctctgcacagctcactc

SEQ ID NO: 9152230 - DNA, 22 bp, Homo sapiens
gctgcctcccccatggctggaa

SEQ ID NO: 9152231 - DNA, 22 bp, Homo sapiens
gctgcctcccccatggctggaa

SEQ ID NO: 9152232 - DNA, 22 bp, Homo sapiens
gctgcctccgccggctccacag

SEQ ID NO: 9152233 - DNA, 22 bp, Homo sapiens
gctgcctccgccggctccacag

SEQ ID NO: 9152234 - DNA, 22 bp, Homo sapiens
gctgcctcccagagccctgcag

SEQ ID NO: 9152235 - DNA, 22 bp, Homo sapiens
gctgcctcccagagccctgcag

SEQ ID NO: 9152236 - DNA, 22 bp, Homo sapiens
gctgcctccactggctcccagt

SEQ ID NO: 9152237 - DNA, 22 bp, Homo sapiens
gctgcagggagctggaaggctc

SEQ ID NO: 9152238 - DNA, 22 bp, Homo sapiens
gctgcagggaatgtatggattt

SEQ ID NO: 9152239 - DNA, 22 bp, Homo sapiens
gctgcaggctgtggcaggggag

SEQ ID NO: 9152240 - DNA, 22 bp, Homo sapiens
gctgcaggctgtggcaggggag

SEQ ID NO: 9152241 - DNA, 22 bp, Homo sapiens
gctgcaggctgtggcaggggag

SEQ ID NO: 9152242 - DNA, 22 bp, Homo sapiens
gctgcaggctctgcaggaattg

SEQ ID NO: 9152243 - DNA, 22 bp, Homo sapiens
gctgcaggcggccgtggtggcg

SEQ ID NO: 9152244 - DNA, 22 bp, Homo sapiens
gctgcaggcggccgtggtggcg

SEQ ID NO: 9152245 - DNA, 22 bp, Homo sapiens
gctgcaggctctgcaggaattg

SEQ ID NO: 9152246 - DNA, 22 bp, Homo sapiens
gctgcaggggggtctggacttg

SEQ ID NO: 9152247 - DNA, 22 bp, Homo sapiens
gctgcagggctctcacaggggg

SEQ ID NO: 9152248 - DNA, 22 bp, Homo sapiens
gctgcagggctctcacaggggg

SEQ ID NO: 9152249 - DNA, 22 bp, Homo sapiens
gctgcagggctctcacaggggg

SEQ ID NO: 9152250 - DNA, 22 bp, Homo sapiens
gctgcagggagctggaaggctc

SEQ ID NO: 9152251 - DNA, 21 bp, Homo sapiens
gctgcagggcccagggcaccc

SEQ ID NO: 9152252 - DNA, 22 bp, Homo sapiens
gctctctggaggccatggacag

SEQ ID NO: 9152253 - DNA, 22 bp, Homo sapiens
gctctctggaaggtatcattat

SEQ ID NO: 9152254 - DNA, 22 bp, Homo sapiens
gctctctgccatatgaggatac

SEQ ID NO: 9152255 - DNA, 22 bp, Homo sapiens
gctctctgccatatgaggatac

SEQ ID NO: 9152256 - DNA, 22 bp, Homo sapiens
gctctctgcctttctcaatgac

SEQ ID NO: 9152257 - DNA, 22 bp, Homo sapiens
gctctctgcctttctcaatgac

SEQ ID NO: 9152258 - DNA, 22 bp, Homo sapiens
gctctctgcctttctcaatgac

SEQ ID NO: 9152259 - DNA, 22 bp, Homo sapiens
gctctctggaggccatggacag

SEQ ID NO: 9152260 - DNA, 22 bp, Homo sapiens
gctctctggctagtccatcggg

SEQ ID NO: 9152261 - DNA, 22 bp, Homo sapiens
gctctctgggcgggagctaaga

SEQ ID NO: 9152262 - DNA, 22 bp, Homo sapiens
gctctctggctagtccatcggg

SEQ ID NO: 9152263 - DNA, 22 bp, Homo sapiens
gctctctgggtggtgggcaaca

SEQ ID NO: 9152264 - DNA, 22 bp, Homo sapiens
gctctctgggtgtgtctagata

SEQ ID NO: 9152265 - DNA, 22 bp, Homo sapiens
gctctctggttccagtcaggaa

SEQ ID NO: 9152266 - DNA, 22 bp, Homo sapiens
gctctctggttccagtcaggaa

SEQ ID NO: 9152267 - DNA, 22 bp, Homo sapiens
gctctctgtcgttatgcttcat

SEQ ID NO: 9152268 - DNA, 22 bp, Homo sapiens
gctctctgttattaagatcttt

SEQ ID NO: 9152269 - DNA, 22 bp, Homo sapiens
gctctggggttggaaagtgatc

SEQ ID NO: 9152270 - DNA, 22 bp, Homo sapiens
gctctgggtagccactgcctgg

SEQ ID NO: 9152271 - DNA, 19 bp, Homo sapiens
gctctgtgatgctgagggg

SEQ ID NO: 9152272 - DNA, 19 bp, Homo sapiens
gctctgtgatgctgagggg

SEQ ID NO: 9152273 - DNA, 22 bp, Homo sapiens
gctctgtgcagttcagggacac

SEQ ID NO: 9152274 - DNA, 22 bp, Homo sapiens
gctctgtgccacatgcagtgtt

SEQ ID NO: 9152275 - DNA, 20 bp, Homo sapiens
gctctgtgctggcggaggct

SEQ ID NO: 9152276 - DNA, 22 bp, Homo sapiens
gctctgtgcccctgccgtggac

SEQ ID NO: 9152277 - DNA, 22 bp, Homo sapiens
gctctgtgaccttaggcaagtt

SEQ ID NO: 9152278 - DNA, 21 bp, Homo sapiens
gctctgtccctgctgtgtgtc

SEQ ID NO: 9152279 - DNA, 22 bp, Homo sapiens
gctccccattgatctgcaggct

SEQ ID NO: 9152280 - DNA, 22 bp, Homo sapiens
gctccccattgatctgcaggct

SEQ ID NO: 9152281 - DNA, 22 bp, Homo sapiens
gctccccattgatctgcaggct

SEQ ID NO: 9152282 - DNA, 22 bp, Homo sapiens
gctccccttggtcctcctggga

SEQ ID NO: 9152283 - DNA, 22 bp, Homo sapiens
gctccctcatctgtgctgtttt

SEQ ID NO: 9152284 - DNA, 22 bp, Homo sapiens
gctccctcccaccagcctgcag

SEQ ID NO: 9152285 - DNA, 22 bp, Homo sapiens
gctccctcccaccagcctgcag

SEQ ID NO: 9152286 - DNA, 22 bp, Homo sapiens
gctccctcccaccagcctgcag

SEQ ID NO: 9152287 - DNA, 22 bp, Homo sapiens
gctccctccatgaggcagaccg

SEQ ID NO: 9152288 - DNA, 22 bp, Homo sapiens
gctcccagcaattgaggcagcc

SEQ ID NO: 9152289 - DNA, 22 bp, Homo sapiens
gctcccagctggagcctcaaca

SEQ ID NO: 9152290 - DNA, 20 bp, Homo sapiens
gctcccagcctgcagtcccc

SEQ ID NO: 9152291 - DNA, 20 bp, Homo sapiens
gctcccagcctgcagtcccc

SEQ ID NO: 9152292 - DNA, 22 bp, Homo sapiens
gctcccaggaagagaagggcca

SEQ ID NO: 9152293 - DNA, 22 bp, Homo sapiens
gctcccaggaagagaagggcca

SEQ ID NO: 9152294 - DNA, 22 bp, Homo sapiens
gctcccaggatgaggagccagg

SEQ ID NO: 9152295 - DNA, 22 bp, Homo sapiens
gctccctctgctcaggcacttg

SEQ ID NO: 9152296 - DNA, 21 bp, Homo sapiens
gctctccagggccagcccagg

SEQ ID NO: 9152297 - DNA, 21 bp, Homo sapiens
gctctccagggccagcccagg

SEQ ID NO: 9152298 - DNA, 22 bp, Homo sapiens
gctctccaggggctcccaggat

SEQ ID NO: 9152299 - DNA, 22 bp, Homo sapiens
gctctccaggggctcccaggat

SEQ ID NO: 9152300 - DNA, 22 bp, Homo sapiens
gctctccaggtccaagaatcca

SEQ ID NO: 9152301 - DNA, 22 bp, Homo sapiens
gctctccaggtctcatgcactg

SEQ ID NO: 9152302 - DNA, 22 bp, Homo sapiens
gctctctgaggtgctggcagag

SEQ ID NO: 9152303 - DNA, 22 bp, Homo sapiens
gctctctcgtgaacaggtggtt

SEQ ID NO: 9152304 - DNA, 22 bp, Homo sapiens
gctctcctgtgcagatgctgct

SEQ ID NO: 9152305 - DNA, 21 bp, Homo sapiens
gctctctgcatggtggctcag

SEQ ID NO: 9152306 - DNA, 22 bp, Homo sapiens
gctctctgcagcctccttggag

SEQ ID NO: 9152307 - DNA, 22 bp, Homo sapiens
gctctctgcagcctccttggag

SEQ ID NO: 9152308 - DNA, 22 bp, Homo sapiens
gctctctgcaagtcagcagcct

SEQ ID NO: 9152309 - DNA, 22 bp, Homo sapiens
gctctctgaggtgctggcagag

SEQ ID NO: 9152310 - DNA, 22 bp, Homo sapiens
gctcagggcctggctgcggact

SEQ ID NO: 9152311 - DNA, 22 bp, Homo sapiens
gctcagggcctggctgcggact

SEQ ID NO: 9152312 - DNA, 22 bp, Homo sapiens
gctcagggagtttcacagtgta

SEQ ID NO: 9152313 - DNA, 22 bp, Homo sapiens
gctcagggagagagggcagccg

SEQ ID NO: 9152314 - DNA, 22 bp, Homo sapiens
gctagtccacagccatccaggc

SEQ ID NO: 9152315 - DNA, 22 bp, Homo sapiens
gctagtccacagccatccaggc

SEQ ID NO: 9152316 - DNA, 22 bp, Homo sapiens
gctcagggaatgagaagatgtt

SEQ ID NO: 9152317 - DNA, 22 bp, Homo sapiens
gctcagggaaggccacgtgaga

SEQ ID NO: 9152318 - DNA, 22 bp, Homo sapiens
gctcccagatttcagccttgtg

SEQ ID NO: 9152319 - DNA, 22 bp, Homo sapiens
gctcccagactgaccagaggtg

SEQ ID NO: 9152320 - DNA, 23 bp, Homo sapiens
gctcatcaggcttagagtcaagg

SEQ ID NO: 9152321 - DNA, 23 bp, Homo sapiens
gctcatcaggcttagagtcaagg

SEQ ID NO: 9152322 - DNA, 22 bp, Homo sapiens
gctcagtgcagcctttctgtat

SEQ ID NO: 9152323 - DNA, 22 bp, Homo sapiens
gctcagtgcatcattccaggct

SEQ ID NO: 9152324 - DNA, 22 bp, Homo sapiens
gctcagtgaagggtgccaagta

SEQ ID NO: 9152325 - DNA, 22 bp, Homo sapiens
gctcagggcgcgagggacgtgg

SEQ ID NO: 9152326 - DNA, 22 bp, Homo sapiens
gctagggagacttgtgtcatca

SEQ ID NO: 9152327 - DNA, 22 bp, Homo sapiens
gctagggatctgatttgctgtt

SEQ ID NO: 9152328 - DNA, 22 bp, Homo sapiens
gctaggcttcaaaatctccctg

SEQ ID NO: 9152329 - DNA, 20 bp, Homo sapiens
gctaggctgtgtcctgccca

SEQ ID NO: 9152330 - DNA, 22 bp, Homo sapiens
gctagggactagggaaggagca

SEQ ID NO: 9152331 - DNA, 22 bp, Homo sapiens
gctagggcgggagtgctggaga

SEQ ID NO: 9152332 - DNA, 22 bp, Homo sapiens
gctagggcgggagtgctggaga

SEQ ID NO: 9152333 - DNA, 22 bp, Homo sapiens
gctaggagtgggatggaagtcg

SEQ ID NO: 9152334 - DNA, 22 bp, Homo sapiens
gctaggctcggaagcagcaggg

SEQ ID NO: 9152335 - DNA, 22 bp, Homo sapiens
gctaggctgaatatggtgctta

SEQ ID NO: 9152336 - DNA, 22 bp, Homo sapiens
gctaggctcttccatcagggca

SEQ ID NO: 9152337 - DNA, 19 bp, Homo sapiens
gctaggctggccttgaggg

SEQ ID NO: 9152338 - DNA, 22 bp, Homo sapiens
gctaggaacatttatatacaaa

SEQ ID NO: 9152339 - DNA, 22 bp, Homo sapiens
gctagctttataatgctgggcg

SEQ ID NO: 9152340 - DNA, 22 bp, Homo sapiens
gctagctgggtttcactgtgga

SEQ ID NO: 9152341 - DNA, 17 bp, Homo sapiens
gctaggagagggaggag

SEQ ID NO: 9152342 - DNA, 22 bp, Homo sapiens
gctagagtggctaagcctgcag

SEQ ID NO: 9152343 - DNA, 22 bp, Homo sapiens
gcctggcactcaatcatctgct

SEQ ID NO: 9152344 - DNA, 22 bp, Homo sapiens
gcctggagtggtcctgctgccc

SEQ ID NO: 9152345 - DNA, 22 bp, Homo sapiens
gcctggagtggtcctgctgccc

SEQ ID NO: 9152346 - DNA, 22 bp, Homo sapiens
gcctggagtggtcctgctgccc

SEQ ID NO: 9152347 - DNA, 20 bp, Homo sapiens
gcctggagttagttttcctt

SEQ ID NO: 9152348 - DNA, 22 bp, Homo sapiens
gcctggagtgttggtatttctc

SEQ ID NO: 9152349 - DNA, 22 bp, Homo sapiens
gcctggagtgttggtatttctc

SEQ ID NO: 9152350 - DNA, 22 bp, Homo sapiens
gcctggagtggtcctgctgccc

SEQ ID NO: 9152351 - DNA, 22 bp, Homo sapiens
gcctggagttcagccaagtccc

SEQ ID NO: 9152352 - DNA, 22 bp, Homo sapiens
gcctggagttcagccaagtccc

SEQ ID NO: 9152353 - DNA, 20 bp, Homo sapiens
gcctggagttagttttcctt

SEQ ID NO: 9152354 - DNA, 22 bp, Homo sapiens
gctttacattttggaaaggtga

SEQ ID NO: 9152355 - DNA, 22 bp, Homo sapiens
gctttactgagatgacacaggg

SEQ ID NO: 9152356 - DNA, 22 bp, Homo sapiens
gctttgggagtcagatttgcgc

SEQ ID NO: 9152357 - DNA, 22 bp, Homo sapiens
gctttgggggctgcagtgcgtg

SEQ ID NO: 9152358 - DNA, 22 bp, Homo sapiens
gctttggatgtgtgcctgaggt

SEQ ID NO: 9152359 - DNA, 22 bp, Homo sapiens
gctttggtgatacttgctggct

SEQ ID NO: 9152360 - DNA, 22 bp, Homo sapiens
gctttggtcttctagctgtgag

SEQ ID NO: 9152361 - DNA, 22 bp, Homo sapiens
gctttggttcaaccaggcaatt

SEQ ID NO: 9152362 - DNA, 22 bp, Homo sapiens
gctttggtcaggtgtccagccc

SEQ ID NO: 9152363 - DNA, 22 bp, Homo sapiens
gctttggtcaggtgtccagccc

SEQ ID NO: 9152364 - DNA, 22 bp, Homo sapiens
gctttggtacctcctgctgatc

SEQ ID NO: 9152365 - DNA, 22 bp, Homo sapiens
gctttgggtgtcctctgggcct

SEQ ID NO: 9152366 - DNA, 22 bp, Homo sapiens
gcttttgtcattcaaatgctct

SEQ ID NO: 9152367 - DNA, 22 bp, Homo sapiens
gcttttgtcattcaaatgctct

SEQ ID NO: 9152368 - DNA, 23 bp, Homo sapiens
ggaaaaacactgtgtcttggcag

SEQ ID NO: 9152369 - DNA, 18 bp, Homo sapiens
gctttttagtgcatcttc

SEQ ID NO: 9152370 - DNA, 22 bp, Homo sapiens
gctttgtgtgaagtccatggcg

SEQ ID NO: 9152371 - DNA, 22 bp, Homo sapiens
gcttttatttcttcacaaaagt

SEQ ID NO: 9152372 - DNA, 22 bp, Homo sapiens
gcttttctccttagtgtccctg

SEQ ID NO: 9152373 - DNA, 22 bp, Homo sapiens
gcttttctccttagtgtccctg

SEQ ID NO: 9152374 - DNA, 22 bp, Homo sapiens
gctgtttcggcctcctggggaa

SEQ ID NO: 9152375 - DNA, 22 bp, Homo sapiens
gctgtttcctacatggtgttat

SEQ ID NO: 9152376 - DNA, 22 bp, Homo sapiens
gctgtttccccttcacagtggc

SEQ ID NO: 9152377 - DNA, 22 bp, Homo sapiens
gctgtttcgggtggaggtggag

SEQ ID NO: 9152378 - DNA, 22 bp, Homo sapiens
gctgtttctaagctggttccta

SEQ ID NO: 9152379 - DNA, 22 bp, Homo sapiens
gctgtttctgagtagctaggct

SEQ ID NO: 9152380 - DNA, 22 bp, Homo sapiens
gctgtttctttcctggcacttg

SEQ ID NO: 9152381 - DNA, 22 bp, Homo sapiens
gctgtttctgtggtgtatagcc

SEQ ID NO: 9152382 - DNA, 22 bp, Homo sapiens
gctgtttgaggcacatgattaa

SEQ ID NO: 9152383 - DNA, 22 bp, Homo sapiens
gcttaaaagccacttagtctat

SEQ ID NO: 9152384 - DNA, 22 bp, Homo sapiens
gctgttggcgaggagctcagct

SEQ ID NO: 9152385 - DNA, 22 bp, Homo sapiens
gctgtgttttatgttaggttaa

SEQ ID NO: 9152386 - DNA, 22 bp, Homo sapiens
gctgtgtttgacagtagcagac

SEQ ID NO: 9152387 - DNA, 22 bp, Homo sapiens
gctgtgttggtgaagctgtagc

SEQ ID NO: 9152388 - DNA, 22 bp, Homo sapiens
gctgtgtgctcacgtagtggaa

SEQ ID NO: 9152389 - DNA, 22 bp, Homo sapiens
gctttacacagctggttcttgt

SEQ ID NO: 9152390 - DNA, 22 bp, Homo sapiens
gctttacagggcacaaagggag

SEQ ID NO: 9152391 - DNA, 22 bp, Homo sapiens
gctttacagagaaagtttgcct

SEQ ID NO: 9152392 - DNA, 22 bp, Homo sapiens
gcttaaatcccaatgctagacc

SEQ ID NO: 9152393 - DNA, 22 bp, Homo sapiens
gcttaaatcccaatgctagacc

SEQ ID NO: 9152394 - DNA, 21 bp, Homo sapiens
gcttggagtagcttgaaggag

SEQ ID NO: 9152395 - DNA, 22 bp, Homo sapiens
gcttggagatgggggatgagcc

SEQ ID NO: 9152396 - DNA, 22 bp, Homo sapiens
gcttggagaagatgttctcaat

SEQ ID NO: 9152397 - DNA, 22 bp, Homo sapiens
gcttggtagtgtgaactgtctc

SEQ ID NO: 9152398 - DNA, 21 bp, Homo sapiens
gcttggagtagcttgaaggag

SEQ ID NO: 9152399 - DNA, 22 bp, Homo sapiens
gcttgtcatagttgttacaaat

SEQ ID NO: 9152400 - DNA, 17 bp, Homo sapiens
gctgtagtttgataaga

SEQ ID NO: 9152401 - DNA, 22 bp, Homo sapiens
gctgtatgtttatttgggaatt

SEQ ID NO: 9152402 - DNA, 22 bp, Homo sapiens
gctgtattcctgcactgtatag

SEQ ID NO: 9152403 - DNA, 22 bp, Homo sapiens
gctgtcaaggtagaaaacagag

SEQ ID NO: 9152404 - DNA, 22 bp, Homo sapiens
gctgtcacatttggagcactgg

SEQ ID NO: 9152405 - DNA, 22 bp, Homo sapiens
gctgtcacacatgggatctcag

SEQ ID NO: 9152406 - DNA, 22 bp, Homo sapiens
gctgtcacaaattgggttcttt

SEQ ID NO: 9152407 - DNA, 22 bp, Homo sapiens
gctgtcacaaatatttctcagc

SEQ ID NO: 9152408 - DNA, 22 bp, Homo sapiens
gctgtcactggcatgttccggg

SEQ ID NO: 9152409 - DNA, 22 bp, Homo sapiens
gctgtcactcaccaggcctgca

SEQ ID NO: 9152410 - DNA, 22 bp, Homo sapiens
gctgtcaggccatgtgggcctt

SEQ ID NO: 9152411 - DNA, 22 bp, Homo sapiens
gctgtcagaaggtgaagggtaa

SEQ ID NO: 9152412 - DNA, 22 bp, Homo sapiens
gctgtcagtgaggtgagacatg

SEQ ID NO: 9152413 - DNA, 19 bp, Homo sapiens
gctggccacgccccagttg

SEQ ID NO: 9152414 - DNA, 22 bp, Homo sapiens
gctggccacagatccccaggga

SEQ ID NO: 9152415 - DNA, 22 bp, Homo sapiens
gctggccacagatccccaggga

SEQ ID NO: 9152416 - DNA, 22 bp, Homo sapiens
gctggccacagatccccaggga

SEQ ID NO: 9152417 - DNA, 19 bp, Homo sapiens
gctgtaccctgaaaactct

SEQ ID NO: 9152418 - DNA, 22 bp, Homo sapiens
gctgtactgacttgcttagctg

SEQ ID NO: 9152419 - DNA, 19 bp, Homo sapiens
gctgtgtgaccttgggcaa

SEQ ID NO: 9152420 - DNA, 22 bp, Homo sapiens
gctgtgtgactgagagcctggc

SEQ ID NO: 9152421 - DNA, 22 bp, Homo sapiens
gctgtgtgctaggatatgtttt

SEQ ID NO: 9152422 - DNA, 18 bp, Homo sapiens
gctgtgtgcacctgataa

SEQ ID NO: 9152423 - DNA, 22 bp, Homo sapiens
gctgtctggaggctctgaggga

SEQ ID NO: 9152424 - DNA, 22 bp, Homo sapiens
gctgtctgctgtgcactgagca

SEQ ID NO: 9152425 - DNA, 22 bp, Homo sapiens
gctgtctggaggctctgaggga

SEQ ID NO: 9152426 - DNA, 22 bp, Homo sapiens
gctgtctgtctctgtcccacca

SEQ ID NO: 9152427 - DNA, 22 bp, Homo sapiens
gctgtctgtggtgtcagctgac

SEQ ID NO: 9152428 - DNA, 22 bp, Homo sapiens
gctgtctgctgggtcgctcagg

SEQ ID NO: 9152429 - DNA, 22 bp, Homo sapiens
gctgtctcatacaaggccctgc

SEQ ID NO: 9152430 - DNA, 22 bp, Homo sapiens
gctgtcctgggaacaggcacta

SEQ ID NO: 9152431 - DNA, 22 bp, Homo sapiens
gctgtcgtgtgcaagtgacaga

SEQ ID NO: 9152432 - DNA, 22 bp, Homo sapiens
gctgtccttcctggctggggtg

SEQ ID NO: 9152433 - DNA, 22 bp, Homo sapiens
gctgtcctggggagggagaatg

SEQ ID NO: 9152434 - DNA, 23 bp, Homo sapiens
gctgtcctcctgggcccagcagc

SEQ ID NO: 9152435 - DNA, 22 bp, Homo sapiens
gctgtcctcgtctctcacgcaa

SEQ ID NO: 9152436 - DNA, 22 bp, Homo sapiens
gctgtccaggttgtggagcaac

SEQ ID NO: 9152437 - DNA, 22 bp, Homo sapiens
gctgtcagttttacccacagac

SEQ ID NO: 9152438 - DNA, 22 bp, Homo sapiens
gctgtcatagagtgggtgggcc

SEQ ID NO: 9152439 - DNA, 22 bp, Homo sapiens
gctgtccaggttgtggagcaac

SEQ ID NO: 9152440 - DNA, 22 bp, Homo sapiens
ggagaaagctgtagtggaatgt

SEQ ID NO: 9152441 - DNA, 22 bp, Homo sapiens
ggagaaaggataggaatgtgct

SEQ ID NO: 9152442 - DNA, 22 bp, Homo sapiens
ggagaaaggcatagcagaacct

SEQ ID NO: 9152443 - DNA, 22 bp, Homo sapiens
ggagaaaattgatgaagttggc

SEQ ID NO: 9152444 - DNA, 22 bp, Homo sapiens
ggactgggaatcagggagatgc

SEQ ID NO: 9152445 - DNA, 22 bp, Homo sapiens
ggactgggaatcagggagatgc

SEQ ID NO: 9152446 - DNA, 22 bp, Homo sapiens
ggactgctccagtgtgatttgt

SEQ ID NO: 9152447 - DNA, 22 bp, Homo sapiens
ggactgctgtggacagagtcat

SEQ ID NO: 9152448 - DNA, 22 bp, Homo sapiens
ggactgctacaatatacaatta

SEQ ID NO: 9152449 - DNA, 22 bp, Homo sapiens
ggacttgagccgctcggagttc

SEQ ID NO: 9152450 - DNA, 22 bp, Homo sapiens
ggacttctggggactgtagatt

SEQ ID NO: 9152451 - DNA, 22 bp, Homo sapiens
ggactgtctccttgctggtagg

SEQ ID NO: 9152452 - DNA, 22 bp, Homo sapiens
ggacagggctcttggcactcct

SEQ ID NO: 9152453 - DNA, 22 bp, Homo sapiens
ggacagggatcattatctgagc

SEQ ID NO: 9152454 - DNA, 23 bp, Homo sapiens
ggacagggccctgccctatggcc

SEQ ID NO: 9152455 - DNA, 22 bp, Homo sapiens
ggacagggctcttggcactcct

SEQ ID NO: 9152456 - DNA, 19 bp, Homo sapiens
ggacagggggagcttttat

SEQ ID NO: 9152457 - DNA, 22 bp, Homo sapiens
ggacagggtaagtactagtgtg

SEQ ID NO: 9152458 - DNA, 22 bp, Homo sapiens
ggacaggggcgtggggattgtt

SEQ ID NO: 9152459 - DNA, 22 bp, Homo sapiens
ggacaggcccggggagcctgga

SEQ ID NO: 9152460 - DNA, 22 bp, Homo sapiens
ggacaggcccggggagcctgga

SEQ ID NO: 9152461 - DNA, 22 bp, Homo sapiens
ggacagagggttgacagagtat

SEQ ID NO: 9152462 - DNA, 18 bp, Homo sapiens
ggacaggagacatgggtg

SEQ ID NO: 9152463 - DNA, 22 bp, Homo sapiens
ggacaggagtgaggcgggttcc

SEQ ID NO: 9152464 - DNA, 22 bp, Homo sapiens
ggacaggatgctgaagatgaag

SEQ ID NO: 9152465 - DNA, 22 bp, Homo sapiens
ggacaggatgctgaagatgaag

SEQ ID NO: 9152466 - DNA, 22 bp, Homo sapiens
ggacaggataagagacactgcc

SEQ ID NO: 9152467 - DNA, 22 bp, Homo sapiens
ggaagggaatccatctggttag

SEQ ID NO: 9152468 - DNA, 22 bp, Homo sapiens
ggaagggagtagttggaatgca

SEQ ID NO: 9152469 - DNA, 22 bp, Homo sapiens
ggaagggaaaattcattcggct

SEQ ID NO: 9152470 - DNA, 22 bp, Homo sapiens
ggaagggaaaattcattcggct

SEQ ID NO: 9152471 - DNA, 22 bp, Homo sapiens
ggaagggaaaattcattcggct

SEQ ID NO: 9152472 - DNA, 22 bp, Homo sapiens
ggaaggctaataatgcaagaaa

SEQ ID NO: 9152473 - DNA, 22 bp, Homo sapiens
ggaaggcagtgaaggggctgat

SEQ ID NO: 9152474 - DNA, 22 bp, Homo sapiens
ggaaggcagtgaaggggctgat

SEQ ID NO: 9152475 - DNA, 22 bp, Homo sapiens
ggaaggcagtgaaggggctgat

SEQ ID NO: 9152476 - DNA, 19 bp, Homo sapiens
ggaaggccacggcaggctt

SEQ ID NO: 9152477 - DNA, 22 bp, Homo sapiens
ggaaggcagaggtgtcgtgggg

SEQ ID NO: 9152478 - DNA, 19 bp, Homo sapiens
ggaaggcagaggggctgtg

SEQ ID NO: 9152479 - DNA, 22 bp, Homo sapiens
ggaaggcagaggtgtcgtgggg

SEQ ID NO: 9152480 - DNA, 22 bp, Homo sapiens
ggaaggcagaggtgtcgtgggg

SEQ ID NO: 9152481 - DNA, 22 bp, Homo sapiens
ggaaaaacagtctttattattt

SEQ ID NO: 9152482 - DNA, 22 bp, Homo sapiens
ggaaaaacagtctttattattt

SEQ ID NO: 9152483 - DNA, 23 bp, Homo sapiens
ggaaaaacactgtgtcttggcag

SEQ ID NO: 9152484 - DNA, 22 bp, Homo sapiens
ggaaaaatagagtatactttaa

SEQ ID NO: 9152485 - DNA, 22 bp, Homo sapiens
ggaaaaatgacacatatctcaa

SEQ ID NO: 9152486 - DNA, 19 bp, Homo sapiens
ggaaggagagaaatgcatg

SEQ ID NO: 9152487 - DNA, 22 bp, Homo sapiens
ggaaggaagtgcagactttaaa

SEQ ID NO: 9152488 - DNA, 22 bp, Homo sapiens
ggaaggaattccaagactaaag

SEQ ID NO: 9152489 - DNA, 19 bp, Homo sapiens
ggaaggcagaggggctgtg

SEQ ID NO: 9152490 - DNA, 19 bp, Homo sapiens
ggaaggcagaggggctgtg

SEQ ID NO: 9152491 - DNA, 22 bp, Homo sapiens
ggaaggaggggcaaagcagttc

SEQ ID NO: 9152492 - DNA, 21 bp, Homo sapiens
ggaggaaaaaggaatgacttg

SEQ ID NO: 9152493 - DNA, 22 bp, Homo sapiens
ggagctgttggcagctatcttg

SEQ ID NO: 9152494 - DNA, 22 bp, Homo sapiens
ggagctgttgcgcatgcgctcg

SEQ ID NO: 9152495 - DNA, 22 bp, Homo sapiens
ggagctgttgcgcatgcgctcg

SEQ ID NO: 9152496 - DNA, 22 bp, Homo sapiens
ggagctgttgattgtttgagga

SEQ ID NO: 9152497 - DNA, 22 bp, Homo sapiens
ggagctgttcaggactgcttca

SEQ ID NO: 9152498 - DNA, 22 bp, Homo sapiens
ggagctgttatggcataagcat

SEQ ID NO: 9152499 - DNA, 21 bp, Homo sapiens
ggaggaaaaaggaatgacttg

SEQ ID NO: 9152500 - DNA, 22 bp, Homo sapiens
ggaggaggcggcagaagttcct

SEQ ID NO: 9152501 - DNA, 22 bp, Homo sapiens
ggaggaggggtgactgaatgct

SEQ ID NO: 9152502 - DNA, 22 bp, Homo sapiens
ggaggaggggtgactgaatgct

SEQ ID NO: 9152503 - DNA, 21 bp, Homo sapiens
ggagctggggagctggcccca

SEQ ID NO: 9152504 - DNA, 22 bp, Homo sapiens
ggagctggggttggcatcttcc

SEQ ID NO: 9152505 - DNA, 22 bp, Homo sapiens
ggagctggggttggcatcttcc

SEQ ID NO: 9152506 - DNA, 22 bp, Homo sapiens
ggagctggtcagccttgagcat

SEQ ID NO: 9152507 - DNA, 22 bp, Homo sapiens
ggagctggtcagccttgagcat

SEQ ID NO: 9152508 - DNA, 22 bp, Homo sapiens
ggagctgtgcagtgactacaga

SEQ ID NO: 9152509 - DNA, 22 bp, Homo sapiens
ggagctgtgcagtgactacaga

SEQ ID NO: 9152510 - DNA, 22 bp, Homo sapiens
ggagctgtgctgggtgatcagg

SEQ ID NO: 9152511 - DNA, 22 bp, Homo sapiens
ggagctgtctgtagggcacagg

SEQ ID NO: 9152512 - DNA, 22 bp, Homo sapiens
ggagctgtaacgagccattgct

SEQ ID NO: 9152513 - DNA, 22 bp, Homo sapiens
ggagctgtaacgagccattgct

SEQ ID NO: 9152514 - DNA, 22 bp, Homo sapiens
ggagctgtagatcagctaatct

SEQ ID NO: 9152515 - DNA, 22 bp, Homo sapiens
ggagctgttaaatgcagaattt

SEQ ID NO: 9152516 - DNA, 22 bp, Homo sapiens
ggagctgtgttatccattccca

SEQ ID NO: 9152517 - DNA, 22 bp, Homo sapiens
ggagctgtgggacgctgtccca

SEQ ID NO: 9152518 - DNA, 22 bp, Homo sapiens
ggagctgtgttatccattccca

SEQ ID NO: 9152519 - DNA, 22 bp, Homo sapiens
ggagctgttatggcataagcat

SEQ ID NO: 9152520 - DNA, 22 bp, Homo sapiens
ggagctgttatggcataagcat

SEQ ID NO: 9152521 - DNA, 22 bp, Homo sapiens
ggagctgttaaatgcagaattt

SEQ ID NO: 9152522 - DNA, 22 bp, Homo sapiens
ggagctgtgggacgctgtccca

SEQ ID NO: 9152523 - DNA, 22 bp, Homo sapiens
ggagctgtgctgggtgatcagg

SEQ ID NO: 9152524 - DNA, 21 bp, Homo sapiens
ggagctggggagctggcccca

SEQ ID NO: 9152525 - DNA, 18 bp, Homo sapiens
ggagctgggccccactcc

SEQ ID NO: 9152526 - DNA, 22 bp, Homo sapiens
ggagctgggaccctgtcatctg

SEQ ID NO: 9152527 - DNA, 22 bp, Homo sapiens
ggagctgggaattggatcatct

SEQ ID NO: 9152528 - DNA, 22 bp, Homo sapiens
ggagctgggaactatgtagtat

SEQ ID NO: 9152529 - DNA, 22 bp, Homo sapiens
ggagctgggaattggatcatct

SEQ ID NO: 9152530 - DNA, 22 bp, Homo sapiens
ggagctgcatttagggagcctt

SEQ ID NO: 9152531 - DNA, 22 bp, Homo sapiens
ggagcctggtatagtgttgcat

SEQ ID NO: 9152532 - DNA, 22 bp, Homo sapiens
ggagcctgggcattagtaattt

SEQ ID NO: 9152533 - DNA, 22 bp, Homo sapiens
ggagcctgggcctcctgccctt

SEQ ID NO: 9152534 - DNA, 22 bp, Homo sapiens
ggagcctggcctggctctgtgt

SEQ ID NO: 9152535 - DNA, 22 bp, Homo sapiens
ggagctggccgcctatgtgcag

SEQ ID NO: 9152536 - DNA, 22 bp, Homo sapiens
ggagaaagtacagcaggcaaca

SEQ ID NO: 9152537 - DNA, 22 bp, Homo sapiens
ggagaacaggcaagcatctggc

SEQ ID NO: 9152538 - DNA, 22 bp, Homo sapiens
ggagaacaaatatctggcttct

SEQ ID NO: 9152539 - DNA, 22 bp, Homo sapiens
ggagaaaggcatagcagaacct

SEQ ID NO: 9152540 - DNA, 22 bp, Homo sapiens
ggagaagaggagctggaagcct

SEQ ID NO: 9152541 - DNA, 22 bp, Homo sapiens
ggagaagaggagctggaagcct

SEQ ID NO: 9152542 - DNA, 18 bp, Homo sapiens
ggagaagaacagatgtgg

SEQ ID NO: 9152543 - DNA, 22 bp, Homo sapiens
ggagaagattggaattaagcac

SEQ ID NO: 9152544 - DNA, 22 bp, Homo sapiens
ggagaagcagcttcttgatgaa

SEQ ID NO: 9152545 - DNA, 17 bp, Homo sapiens
ggagccaggagcccacc

SEQ ID NO: 9152546 - DNA, 22 bp, Homo sapiens
ggagccaggcaatctgtacttt

SEQ ID NO: 9152547 - DNA, 17 bp, Homo sapiens
ggagccaggagcccacc

SEQ ID NO: 9152548 - DNA, 22 bp, Homo sapiens
ggagccaggcatatcggggcac

SEQ ID NO: 9152549 - DNA, 22 bp, Homo sapiens
ggagcccaagtctgcactcggc

SEQ ID NO: 9152550 - DNA, 18 bp, Homo sapiens
ggagcccagaggacagga

SEQ ID NO: 9152551 - DNA, 18 bp, Homo sapiens
ggagcccagaggacagga

SEQ ID NO: 9152552 - DNA, 18 bp, Homo sapiens
ggagcccagaggtgagtt

SEQ ID NO: 9152553 - DNA, 18 bp, Homo sapiens
ggagcccagaggtgagtt

SEQ ID NO: 9152554 - DNA, 22 bp, Homo sapiens
ggagccagtgccctctggtgga

SEQ ID NO: 9152555 - DNA, 22 bp, Homo sapiens
ggagccagtgccctctggtgga

SEQ ID NO: 9152556 - DNA, 22 bp, Homo sapiens
ggagccctcaccggcgagtgcc

SEQ ID NO: 9152557 - DNA, 22 bp, Homo sapiens
ggagcctggcaatgctgcgtcc

SEQ ID NO: 9152558 - DNA, 22 bp, Homo sapiens
ggagcctggcaatgctgcgtcc

SEQ ID NO: 9152559 - DNA, 22 bp, Homo sapiens
ggagcctggagtttctgatggg

SEQ ID NO: 9152560 - DNA, 22 bp, Homo sapiens
ggagcccaggttgtttgtgcag

SEQ ID NO: 9152561 - DNA, 22 bp, Homo sapiens
ggagcccagtcggggtgtaggt

SEQ ID NO: 9152562 - DNA, 22 bp, Homo sapiens
ggagcccagtcggggtgtaggt

SEQ ID NO: 9152563 - DNA, 22 bp, Homo sapiens
ggagccccaattgagcagtacg

SEQ ID NO: 9152564 - DNA, 22 bp, Homo sapiens
ggagcctggcccggcccttggc

SEQ ID NO: 9152565 - DNA, 19 bp, Homo sapiens
ggagcctggcaggggcgtg

SEQ ID NO: 9152566 - DNA, 23 bp, Homo sapiens
ggagcctggcatatgagacgcat

SEQ ID NO: 9152567 - DNA, 22 bp, Homo sapiens
gtctttatttgagattgtcatt

SEQ ID NO: 9152568 - DNA, 22 bp, Homo sapiens
gtctttatttgagattgtcatt

SEQ ID NO: 9152569 - DNA, 22 bp, Homo sapiens
gtctttatttgagattgtcatt

SEQ ID NO: 9152570 - DNA, 16 bp, Homo sapiens
gtctttattcacttag

SEQ ID NO: 9152571 - DNA, 22 bp, Homo sapiens
gtctttctatgatgaactgttg

SEQ ID NO: 9152572 - DNA, 22 bp, Homo sapiens
gtctttctatgatgaactgttg

SEQ ID NO: 9152573 - DNA, 21 bp, Homo sapiens
gtctttctacctctatgtggc

SEQ ID NO: 9152574 - DNA, 22 bp, Homo sapiens
gtctttgttctgcactattgtc

SEQ ID NO: 9152575 - DNA, 18 bp, Homo sapiens
gtcttttctcccttcctc

SEQ ID NO: 9152576 - DNA, 22 bp, Homo sapiens
gtctttctatgcatagagcaga

SEQ ID NO: 9152577 - DNA, 22 bp, Homo sapiens
gtctttggatgtaagataaagt

SEQ ID NO: 9152578 - DNA, 22 bp, Homo sapiens
gtgaaaaatcatcatgacttga

SEQ ID NO: 9152579 - DNA, 22 bp, Homo sapiens
gtgaaaaatcatcatgacttga

SEQ ID NO: 9152580 - DNA, 22 bp, Homo sapiens
gtgaaaaatgatttgttaactg

SEQ ID NO: 9152581 - DNA, 22 bp, Homo sapiens
gtcttttttacaccttacatca

SEQ ID NO: 9152582 - DNA, 22 bp, Homo sapiens
gtgagctgttggagtggcagag

SEQ ID NO: 9152583 - DNA, 22 bp, Homo sapiens
gtgagctgttttggacccatct

SEQ ID NO: 9152584 - DNA, 22 bp, Homo sapiens
gtgaggaatcggttcacggtga

SEQ ID NO: 9152585 - DNA, 22 bp, Homo sapiens
gtgaggaagtgtttgtcaaatt

SEQ ID NO: 9152586 - DNA, 22 bp, Homo sapiens
gtgaggactagtgggtttgtgc

SEQ ID NO: 9152587 - DNA, 22 bp, Homo sapiens
gtgaggagtctgaagcacataa

SEQ ID NO: 9152588 - DNA, 22 bp, Homo sapiens
gtgaggagctgacactggggtg

SEQ ID NO: 9152589 - DNA, 22 bp, Homo sapiens
gtgaggactggtaaggactgca

SEQ ID NO: 9152590 - DNA, 22 bp, Homo sapiens
gtgaggagctgacactggggtg

SEQ ID NO: 9152591 - DNA, 22 bp, Homo sapiens
gtgagctgtctgagtctcttgg

SEQ ID NO: 9152592 - DNA, 22 bp, Homo sapiens
gtgagcagttgtgagccccaaa

SEQ ID NO: 9152593 - DNA, 22 bp, Homo sapiens
gtgagcagttgtgagccccaaa

SEQ ID NO: 9152594 - DNA, 22 bp, Homo sapiens
gtgagcagtttgttccagaatc

SEQ ID NO: 9152595 - DNA, 22 bp, Homo sapiens
gtgagcagttgtgagccccaaa

SEQ ID NO: 9152596 - DNA, 22 bp, Homo sapiens
gtgagcatatatgtaatcgttt

SEQ ID NO: 9152597 - DNA, 22 bp, Homo sapiens
gtcttgtttgggatgtggatgg

SEQ ID NO: 9152598 - DNA, 22 bp, Homo sapiens
gtctttagttgaaacatgtggt

SEQ ID NO: 9152599 - DNA, 22 bp, Homo sapiens
gtctttagagctcctggcatct

SEQ ID NO: 9152600 - DNA, 20 bp, Homo sapiens
gtcttgtagctcaagttatt

SEQ ID NO: 9152601 - DNA, 22 bp, Homo sapiens
gtcttgtcccagctctgccact

SEQ ID NO: 9152602 - DNA, 22 bp, Homo sapiens
gtcttgttaagattttggaata

SEQ ID NO: 9152603 - DNA, 22 bp, Homo sapiens
gtctttagagctcctggcatct

SEQ ID NO: 9152604 - DNA, 23 bp, Homo sapiens
gtctttatagtggggcactttgt

SEQ ID NO: 9152605 - DNA, 22 bp, Homo sapiens
gtctttatatttactaaagaat

SEQ ID NO: 9152606 - DNA, 22 bp, Homo sapiens
gtctttatctttgaaattagtc

SEQ ID NO: 9152607 - DNA, 22 bp, Homo sapiens
gtctttatatttactaaagaat

SEQ ID NO: 9152608 - DNA, 22 bp, Homo sapiens
gtctttatggtatgaaaactga

SEQ ID NO: 9152609 - DNA, 22 bp, Homo sapiens
gtctttatggtatgaaaactga

SEQ ID NO: 9152610 - DNA, 22 bp, Homo sapiens
gtctttattacaaatccttttc

SEQ ID NO: 9152611 - DNA, 22 bp, Homo sapiens
gtctttattacaaatccttttc

SEQ ID NO: 9152612 - DNA, 20 bp, Homo sapiens
gtctttatgttttatgacct

SEQ ID NO: 9152613 - DNA, 22 bp, Homo sapiens
gtctccagtgttcaggtgactg

SEQ ID NO: 9152614 - DNA, 22 bp, Homo sapiens
gtctccagtgttcaggtgactg

SEQ ID NO: 9152615 - DNA, 22 bp, Homo sapiens
gtctccagggctgctggcgcct

SEQ ID NO: 9152616 - DNA, 22 bp, Homo sapiens
gtctccagtgttcaggtgactg

SEQ ID NO: 9152617 - DNA, 22 bp, Homo sapiens
gtctccagtgttcaggtgactg

SEQ ID NO: 9152618 - DNA, 22 bp, Homo sapiens
gtctccagggctgctggcgcct

SEQ ID NO: 9152619 - DNA, 22 bp, Homo sapiens
gtctccagggctgctggcgcct

SEQ ID NO: 9152620 - DNA, 22 bp, Homo sapiens
gtctccagggctgctggcgcct

SEQ ID NO: 9152621 - DNA, 22 bp, Homo sapiens
gtctccagggctgctggcgcct

SEQ ID NO: 9152622 - DNA, 22 bp, Homo sapiens
gtctccagggacacactagccg

SEQ ID NO: 9152623 - DNA, 22 bp, Homo sapiens
gtctccagggacacactagccg

SEQ ID NO: 9152624 - DNA, 22 bp, Homo sapiens
gtctccagggacacactagccg

SEQ ID NO: 9152625 - DNA, 22 bp, Homo sapiens
gtctccagcccactctagatat

SEQ ID NO: 9152626 - DNA, 22 bp, Homo sapiens
gtctcccaatccgggacagcct

SEQ ID NO: 9152627 - DNA, 22 bp, Homo sapiens
gtcttgcacatcttcactgtta

SEQ ID NO: 9152628 - DNA, 22 bp, Homo sapiens
gtcttgatctcctgaccttgtg

SEQ ID NO: 9152629 - DNA, 22 bp, Homo sapiens
gtctcccaacccctgtgcccag

SEQ ID NO: 9152630 - DNA, 22 bp, Homo sapiens
gtctccagttacagcagccagg

SEQ ID NO: 9152631 - DNA, 22 bp, Homo sapiens
gtctccagttacagcagccagg

SEQ ID NO: 9152632 - DNA, 22 bp, Homo sapiens
gtctccagttacagcagccagg

SEQ ID NO: 9152633 - DNA, 22 bp, Homo sapiens
gtctagaatatctagaaagatc

SEQ ID NO: 9152634 - DNA, 22 bp, Homo sapiens
gtctagaaatgccatacgtgcc

SEQ ID NO: 9152635 - DNA, 22 bp, Homo sapiens
gtctccagcccactctagatat

SEQ ID NO: 9152636 - DNA, 22 bp, Homo sapiens
gtctccagccattctctgatca

SEQ ID NO: 9152637 - DNA, 22 bp, Homo sapiens
gtctccagccattctctgatca

SEQ ID NO: 9152638 - DNA, 22 bp, Homo sapiens
gtctatgatattttgttatagc

SEQ ID NO: 9152639 - DNA, 22 bp, Homo sapiens
gtctccagatatcctacacaac

SEQ ID NO: 9152640 - DNA, 22 bp, Homo sapiens
gtctccagatatcctacacaac

SEQ ID NO: 9152641 - DNA, 22 bp, Homo sapiens
gtctccagaggttacatcctgt

SEQ ID NO: 9152642 - DNA, 22 bp, Homo sapiens
gtctccagaggttacatcctgt

SEQ ID NO: 9152643 - DNA, 22 bp, Homo sapiens
gtctccagaattcttgggaggg

SEQ ID NO: 9152644 - DNA, 22 bp, Homo sapiens
gtctccagaattcttgggaggg

SEQ ID NO: 9152645 - DNA, 22 bp, Homo sapiens
gtctccagaattcttgggaggg

SEQ ID NO: 9152646 - DNA, 22 bp, Homo sapiens
gtctatgtgtaatagcatgtgt

SEQ ID NO: 9152647 - DNA, 22 bp, Homo sapiens
gtctataagtacaattgcactc

SEQ ID NO: 9152648 - DNA, 22 bp, Homo sapiens
gtctatgatattttgttatagc

SEQ ID NO: 9152649 - DNA, 22 bp, Homo sapiens
gtgccagatgctgctttgtttt

SEQ ID NO: 9152650 - DNA, 22 bp, Homo sapiens
gtgccagaggcagtgaggagtt

SEQ ID NO: 9152651 - DNA, 22 bp, Homo sapiens
gtgccagaggcagtgaggagtt

SEQ ID NO: 9152652 - DNA, 22 bp, Homo sapiens
gtgccagaaggttcccgctgca

SEQ ID NO: 9152653 - DNA, 22 bp, Homo sapiens
gtgccagagacatgactagctg

SEQ ID NO: 9152654 - DNA, 22 bp, Homo sapiens
gtgccagactgtgtcttgctaa

SEQ ID NO: 9152655 - DNA, 22 bp, Homo sapiens
gtgccagaatctttgaagagag

SEQ ID NO: 9152656 - DNA, 22 bp, Homo sapiens
gtgccactgataaatcagaatg

SEQ ID NO: 9152657 - DNA, 22 bp, Homo sapiens
gtgcagggtagcgacggcagga

SEQ ID NO: 9152658 - DNA, 22 bp, Homo sapiens
gtgcaggggatcaggttgcagc

SEQ ID NO: 9152659 - DNA, 22 bp, Homo sapiens
gtgcagggcagccgaatgggct

SEQ ID NO: 9152660 - DNA, 22 bp, Homo sapiens
gtgcagggcagccgaatgggct

SEQ ID NO: 9152661 - DNA, 22 bp, Homo sapiens
gtgcagggcagccgaatgggct

SEQ ID NO: 9152662 - DNA, 17 bp, Homo sapiens
gtgcagggatgaaggat

SEQ ID NO: 9152663 - DNA, 22 bp, Homo sapiens
gtgcagggagcccagaaggtcc

SEQ ID NO: 9152664 - DNA, 22 bp, Homo sapiens
gtgcagggctggcaccggaggc

SEQ ID NO: 9152665 - DNA, 22 bp, Homo sapiens
gtgcagggcagccgaatgggct

SEQ ID NO: 9152666 - DNA, 22 bp, Homo sapiens
gtgaggatacttaagagaacac

SEQ ID NO: 9152667 - DNA, 22 bp, Homo sapiens
gtgaggatacttaagagaacac

SEQ ID NO: 9152668 - DNA, 22 bp, Homo sapiens
gtgaggagtctgaagcacataa

SEQ ID NO: 9152669 - DNA, 22 bp, Homo sapiens
gtgcagcaaagtttgagatata

SEQ ID NO: 9152670 - DNA, 22 bp, Homo sapiens
gtgcagcaaactagtgcgaggg

SEQ ID NO: 9152671 - DNA, 22 bp, Homo sapiens
gtgcaggatgttgggaatcagg

SEQ ID NO: 9152672 - DNA, 22 bp, Homo sapiens
gtgcaggatctcagaacaagtg

SEQ ID NO: 9152673 - DNA, 22 bp, Homo sapiens
gtgcaggatctcagaacaagtg

SEQ ID NO: 9152674 - DNA, 22 bp, Homo sapiens
gtgcaggagtaggagagggctt

SEQ ID NO: 9152675 - DNA, 20 bp, Homo sapiens
gtgcagcacttgggggtagg

SEQ ID NO: 9152676 - DNA, 22 bp, Homo sapiens
gtgcagcaaagtttgagatata

SEQ ID NO: 9152677 - DNA, 22 bp, Homo sapiens
gtgcagcaaagtttgagatata

SEQ ID NO: 9152678 - DNA, 22 bp, Homo sapiens
gtgcagcaaagtttgagatata

SEQ ID NO: 9152679 - DNA, 22 bp, Homo sapiens
gtgcaggaggtaacatagcaaa

SEQ ID NO: 9152680 - DNA, 22 bp, Homo sapiens
gtgcaggaggtaacatagcaaa

SEQ ID NO: 9152681 - DNA, 22 bp, Homo sapiens
gtgcaggaggtaacatagcaaa

SEQ ID NO: 9152682 - DNA, 22 bp, Homo sapiens
gtgcaggagtaggagagggctt

SEQ ID NO: 9152683 - DNA, 22 bp, Homo sapiens
gtgcaggatttatagcccagct

SEQ ID NO: 9152684 - DNA, 22 bp, Homo sapiens
gtgcaggatttatagcccagct

SEQ ID NO: 9152685 - DNA, 22 bp, Homo sapiens
gtgcaggatttatagcccagct

SEQ ID NO: 9152686 - DNA, 22 bp, Homo sapiens
gtgcaggatgttgggaatcagg

SEQ ID NO: 9152687 - DNA, 22 bp, Homo sapiens
gtgcccacgaggccaggctggt

SEQ ID NO: 9152688 - DNA, 22 bp, Homo sapiens
gtgcccagctccacctcacaga

SEQ ID NO: 9152689 - DNA, 22 bp, Homo sapiens
gtgccaggtgctaagctgtgct

SEQ ID NO: 9152690 - DNA, 22 bp, Homo sapiens
gtgccagggggcactgaacaga

SEQ ID NO: 9152691 - DNA, 18 bp, Homo sapiens
gtgccaggaggcgcagcc

SEQ ID NO: 9152692 - DNA, 22 bp, Homo sapiens
gtgccagggagtggaggagctt

SEQ ID NO: 9152693 - DNA, 22 bp, Homo sapiens
gtgccaggcctattgttaaact

SEQ ID NO: 9152694 - DNA, 22 bp, Homo sapiens
gtgccaggcccagggagcgggg

SEQ ID NO: 9152695 - DNA, 22 bp, Homo sapiens
gtgctgccggcatagcagtgaa

SEQ ID NO: 9152696 - DNA, 22 bp, Homo sapiens
gtgcccaggcccaaggcaccac

SEQ ID NO: 9152697 - DNA, 22 bp, Homo sapiens
gtgctgaataacagtagaaatt

SEQ ID NO: 9152698 - DNA, 18 bp, Homo sapiens
gtgctgaataactacttt

SEQ ID NO: 9152699 - DNA, 18 bp, Homo sapiens
gtgctgaataactacttt

SEQ ID NO: 9152700 - DNA, 22 bp, Homo sapiens
gtgctgaatttgagaaactctg

SEQ ID NO: 9152701 - DNA, 22 bp, Homo sapiens
gtgctgaattggagatgctcct

SEQ ID NO: 9152702 - DNA, 22 bp, Homo sapiens
gtgctgaatccactcttaggaa

SEQ ID NO: 9152703 - DNA, 22 bp, Homo sapiens
gtgctgaattgtgctctttaca

SEQ ID NO: 9152704 - DNA, 22 bp, Homo sapiens
gtgctgaattgtgctctttaca

SEQ ID NO: 9152705 - DNA, 22 bp, Homo sapiens
gtgctgagtgcagagtgcagag

SEQ ID NO: 9152706 - DNA, 22 bp, Homo sapiens
gtgctgagtgcagagtgcagag

SEQ ID NO: 9152707 - DNA, 22 bp, Homo sapiens
gtccagccaggcctgtctctgg

SEQ ID NO: 9152708 - DNA, 22 bp, Homo sapiens
gtccagccctctgcctccaggt

SEQ ID NO: 9152709 - DNA, 22 bp, Homo sapiens
gtccagctgatcttgacccagc

SEQ ID NO: 9152710 - DNA, 22 bp, Homo sapiens
gtccagctccagggaggcaggc

SEQ ID NO: 9152711 - DNA, 22 bp, Homo sapiens
gtccagagagatcttctgatag

SEQ ID NO: 9152712 - DNA, 21 bp, Homo sapiens
gtccagagagccggctcctga

SEQ ID NO: 9152713 - DNA, 22 bp, Homo sapiens
gtcagaggaggctgagtaggaa

SEQ ID NO: 9152714 - DNA, 22 bp, Homo sapiens
gtcagagctgtgcaaggctgag

SEQ ID NO: 9152715 - DNA, 22 bp, Homo sapiens
gtcagagatggcatgaaagatt

SEQ ID NO: 9152716 - DNA, 22 bp, Homo sapiens
gtcagagatggcatgaaagatt

SEQ ID NO: 9152717 - DNA, 22 bp, Homo sapiens
gtcagagatggcatgaaagatt

SEQ ID NO: 9152718 - DNA, 22 bp, Homo sapiens
gtcaccctgctggctgttcagc

SEQ ID NO: 9152719 - DNA, 19 bp, Homo sapiens
gtcaccatttccaaatgcc

SEQ ID NO: 9152720 - DNA, 22 bp, Homo sapiens
gtcacccgtttgactatccacc

SEQ ID NO: 9152721 - DNA, 22 bp, Homo sapiens
gtcaccctgctgtttgtccatt

SEQ ID NO: 9152722 - DNA, 22 bp, Homo sapiens
gtcactatcctgtgttgtttgt

SEQ ID NO: 9152723 - DNA, 22 bp, Homo sapiens
gtcacctgtgccacatactggg

SEQ ID NO: 9152724 - DNA, 22 bp, Homo sapiens
gtcactggaaatttcctttgtt

SEQ ID NO: 9152725 - DNA, 22 bp, Homo sapiens
gtcactggggccacatgcagaa

SEQ ID NO: 9152726 - DNA, 22 bp, Homo sapiens
gtcactggaattacaggcatgc

SEQ ID NO: 9152727 - DNA, 22 bp, Homo sapiens
gtcactttattaattttggtga

SEQ ID NO: 9152728 - DNA, 22 bp, Homo sapiens
gtcactttacactcctactaaa

SEQ ID NO: 9152729 - DNA, 18 bp, Homo sapiens
gtcactgtgtttctgagc

SEQ ID NO: 9152730 - DNA, 22 bp, Homo sapiens
gtcagaatttacttaatagcca

SEQ ID NO: 9152731 - DNA, 22 bp, Homo sapiens
gtcagaaaccagtcaaacaaga

SEQ ID NO: 9152732 - DNA, 22 bp, Homo sapiens
gtcagaaaccagtcaaacaaga

SEQ ID NO: 9152733 - DNA, 22 bp, Homo sapiens
gtcagaagcatttgtggctgaa

SEQ ID NO: 9152734 - DNA, 22 bp, Homo sapiens
gtcactttctgtgagatgtagt

SEQ ID NO: 9152735 - DNA, 22 bp, Homo sapiens
gtcagaaaacttccctttgagt

SEQ ID NO: 9152736 - DNA, 22 bp, Homo sapiens
gtcagaaaaagcaaggctgggc

SEQ ID NO: 9152737 - DNA, 22 bp, Homo sapiens
gtcggccacgcaggtgcggtag

SEQ ID NO: 9152738 - DNA, 22 bp, Homo sapiens
gtctaaacacagccttttctgt

SEQ ID NO: 9152739 - DNA, 22 bp, Homo sapiens
gtctaaacacaatgcaagaagt

SEQ ID NO: 9152740 - DNA, 22 bp, Homo sapiens
gtcctgctcatttaattcagca

SEQ ID NO: 9152741 - DNA, 22 bp, Homo sapiens
gtcctgctctggcccaggtttg

SEQ ID NO: 9152742 - DNA, 22 bp, Homo sapiens
gtcctggagtggcatggcatgg

SEQ ID NO: 9152743 - DNA, 22 bp, Homo sapiens
gtcctctgtccctggggcacgg

SEQ ID NO: 9152744 - DNA, 22 bp, Homo sapiens
gtcctctgtagggctgggccac

SEQ ID NO: 9152745 - DNA, 22 bp, Homo sapiens
gtcctctggtgaaagcattccc

SEQ ID NO: 9152746 - DNA, 22 bp, Homo sapiens
gtcctctgggctttgagcagtc

SEQ ID NO: 9152747 - DNA, 20 bp, Homo sapiens
gtccaggacccagcaggagg

SEQ ID NO: 9152748 - DNA, 22 bp, Homo sapiens
gtccaggaatcaaaagatggaa

SEQ ID NO: 9152749 - DNA, 22 bp, Homo sapiens
gtccaggaatcaaaagatggaa

SEQ ID NO: 9152750 - DNA, 22 bp, Homo sapiens
gtccaggccatggtggacacag

SEQ ID NO: 9152751 - DNA, 22 bp, Homo sapiens
gtccaggcctgcctctgaggag

SEQ ID NO: 9152752 - DNA, 22 bp, Homo sapiens
gtccaggctgacccctagagga

SEQ ID NO: 9152753 - DNA, 22 bp, Homo sapiens
gtccaggctgacccctagagga

SEQ ID NO: 9152754 - DNA, 22 bp, Homo sapiens
gtcctctgcttcatgccctgat

SEQ ID NO: 9152755 - DNA, 22 bp, Homo sapiens
gtcctctggaagatgagttctt

SEQ ID NO: 9152756 - DNA, 22 bp, Homo sapiens
gtcctctggcctttcccaggac

SEQ ID NO: 9152757 - DNA, 22 bp, Homo sapiens
gtcctctggcctttcccaggac

SEQ ID NO: 9152758 - DNA, 22 bp, Homo sapiens
gtcctctggaggtttttaggtg

SEQ ID NO: 9152759 - DNA, 23 bp, Homo sapiens
gtcctctggagagaaaggcagta

SEQ ID NO: 9152760 - DNA, 22 bp, Homo sapiens
gtcctctgggagccttgagcct

SEQ ID NO: 9152761 - DNA, 22 bp, Homo sapiens
gtcctctgggcagctgccccac

SEQ ID NO: 9152762 - DNA, 22 bp, Homo sapiens
gtcaaatgcacagaaccattaa

SEQ ID NO: 9152763 - DNA, 22 bp, Homo sapiens
gtcaccatctacagctccaaac

SEQ ID NO: 9152764 - DNA, 22 bp, Homo sapiens
gtcaccattgcccactccatgg

SEQ ID NO: 9152765 - DNA, 22 bp, Homo sapiens
gtcaccatggataagaatcact

SEQ ID NO: 9152766 - DNA, 22 bp, Homo sapiens
gtcaaatgcacagaaccattaa

SEQ ID NO: 9152767 - DNA, 22 bp, Homo sapiens
gtcaaatatatgcaaaactatt

SEQ ID NO: 9152768 - DNA, 22 bp, Homo sapiens
gtatttttcattccaagtgaga

SEQ ID NO: 9152769 - DNA, 22 bp, Homo sapiens
gtatttttcattccaagtgaga

SEQ ID NO: 9152770 - DNA, 22 bp, Homo sapiens
gtcaaaaagtagtcatttctgt

SEQ ID NO: 9152771 - DNA, 22 bp, Homo sapiens
gtcaaaacaaagttaagaattc

SEQ ID NO: 9152772 - DNA, 22 bp, Homo sapiens
gtcaaaaagtagtcatttctgt

SEQ ID NO: 9152773 - DNA, 22 bp, Homo sapiens
gtatttttaggtaaggaaagta

SEQ ID NO: 9152774 - DNA, 22 bp, Homo sapiens
gtatttttcagttaggagctta

SEQ ID NO: 9152775 - DNA, 22 bp, Homo sapiens
gtatttttagtagagtcggggt

SEQ ID NO: 9152776 - DNA, 22 bp, Homo sapiens
gtattttcatgatttcagacca

SEQ ID NO: 9152777 - DNA, 22 bp, Homo sapiens
gtattttatggcctggggccta

SEQ ID NO: 9152778 - DNA, 22 bp, Homo sapiens
gtattttcaagagcagtagtat

SEQ ID NO: 9152779 - DNA, 22 bp, Homo sapiens
gtatttttaggtaaggaaagta

SEQ ID NO: 9152780 - DNA, 22 bp, Homo sapiens
gtattttgttagggtgtggtat

SEQ ID NO: 9152781 - DNA, 22 bp, Homo sapiens
gtattttatggcatgcagtggc

SEQ ID NO: 9152782 - DNA, 22 bp, Homo sapiens
gtattttatggcatgcagtggc

SEQ ID NO: 9152783 - DNA, 22 bp, Homo sapiens
gtatttccctgagttctgtgag

SEQ ID NO: 9152784 - DNA, 22 bp, Homo sapiens
gtatttccattagtgtgtgcac

SEQ ID NO: 9152785 - DNA, 22 bp, Homo sapiens
gtatttcccccagactccctgg

SEQ ID NO: 9152786 - DNA, 22 bp, Homo sapiens
gtatacatagatgatgaacaag

SEQ ID NO: 9152787 - DNA, 22 bp, Homo sapiens
gtagttctgcagtgtcacctga

SEQ ID NO: 9152788 - DNA, 22 bp, Homo sapiens
gtagttattgctgtttacttct

SEQ ID NO: 9152789 - DNA, 22 bp, Homo sapiens
gtataaggtatgtaaactattt

SEQ ID NO: 9152790 - DNA, 22 bp, Homo sapiens
gtacaacttctgtagctacttt

SEQ ID NO: 9152791 - DNA, 22 bp, Homo sapiens
gtacaactccccaggcactgct

SEQ ID NO: 9152792 - DNA, 22 bp, Homo sapiens
gtacaagttctactctataaat

SEQ ID NO: 9152793 - DNA, 22 bp, Homo sapiens
gtacaaattttgacatctagga

SEQ ID NO: 9152794 - DNA, 22 bp, Homo sapiens
gtacaaattgatacagatttga

SEQ ID NO: 9152795 - DNA, 22 bp, Homo sapiens
gtacaaattgatacaggttttc

SEQ ID NO: 9152796 - DNA, 22 bp, Homo sapiens
gtacaaaagttattgcggtttt

SEQ ID NO: 9152797 - DNA, 22 bp, Homo sapiens
gtacaaaagttattgcggtttt

SEQ ID NO: 9152798 - DNA, 22 bp, Homo sapiens
gtacaaaagttattgcggtttt

SEQ ID NO: 9152799 - DNA, 22 bp, Homo sapiens
gtaatttttagttcattctatc

SEQ ID NO: 9152800 - DNA, 22 bp, Homo sapiens
gtacaaatacattctgaaggta

SEQ ID NO: 9152801 - DNA, 22 bp, Homo sapiens
gtacaaattaggaagctttgtg

SEQ ID NO: 9152802 - DNA, 22 bp, Homo sapiens
gtacaaatgcaggtttgttaca

SEQ ID NO: 9152803 - DNA, 22 bp, Homo sapiens
gtacaaatgtacacttgtataa

SEQ ID NO: 9152804 - DNA, 22 bp, Homo sapiens
gtacaaatgaaaatagaccact

SEQ ID NO: 9152805 - DNA, 22 bp, Homo sapiens
gtacaaatgagagttctgtttt

SEQ ID NO: 9152806 - DNA, 22 bp, Homo sapiens
gtagggttggagagcacaacca

SEQ ID NO: 9152807 - DNA, 22 bp, Homo sapiens
gtagtaaagcaggttttgctgt

SEQ ID NO: 9152808 - DNA, 22 bp, Homo sapiens
gtagtcccagctaccccggagg

SEQ ID NO: 9152809 - DNA, 22 bp, Homo sapiens
gtagtcccagctaccccggagg

SEQ ID NO: 9152810 - DNA, 22 bp, Homo sapiens
gtagtcttggattttaaaaagt

SEQ ID NO: 9152811 - DNA, 22 bp, Homo sapiens
gtaggcagaccagtggatgggt

SEQ ID NO: 9152812 - DNA, 22 bp, Homo sapiens
gtaggagctcatggggccagga

SEQ ID NO: 9152813 - DNA, 22 bp, Homo sapiens
gtagggttggagagcacaacca

SEQ ID NO: 9152814 - DNA, 22 bp, Homo sapiens
gtaggggtgctgagatctggaa

SEQ ID NO: 9152815 - DNA, 22 bp, Homo sapiens
gtaggaagctctgaggctagtt

SEQ ID NO: 9152816 - DNA, 22 bp, Homo sapiens
gtacaattcctgtcaagctggc

SEQ ID NO: 9152817 - DNA, 22 bp, Homo sapiens
gtaggcaaattatggaacattg

SEQ ID NO: 9152818 - DNA, 22 bp, Homo sapiens
ggtgagaggcctgagagctgga

SEQ ID NO: 9152819 - DNA, 22 bp, Homo sapiens
ggtgagaggcagtgctgtggaa

SEQ ID NO: 9152820 - DNA, 22 bp, Homo sapiens
ggtccctggaaggccaagcttg

SEQ ID NO: 9152821 - DNA, 21 bp, Homo sapiens
ggtgacacgtggccccgctct

SEQ ID NO: 9152822 - DNA, 22 bp, Homo sapiens
ggtccctgctgaagccttggtg

SEQ ID NO: 9152823 - DNA, 22 bp, Homo sapiens
ggtccctggaaggcactagtga

SEQ ID NO: 9152824 - DNA, 22 bp, Homo sapiens
ggtccctgctgaagccttggtg

SEQ ID NO: 9152825 - DNA, 22 bp, Homo sapiens
ggtccctgcctgaggctggcct

SEQ ID NO: 9152826 - DNA, 22 bp, Homo sapiens
ggtgaggaaagatggtgacagt

SEQ ID NO: 9152827 - DNA, 22 bp, Homo sapiens
ggtgaggaaagatggtgacagt

SEQ ID NO: 9152828 - DNA, 22 bp, Homo sapiens
ggtgagcactgccctgggtctc

SEQ ID NO: 9152829 - DNA, 22 bp, Homo sapiens
ggtgaggcagagggagtaacct

SEQ ID NO: 9152830 - DNA, 22 bp, Homo sapiens
ggtgaggaattggggactgacc

SEQ ID NO: 9152831 - DNA, 22 bp, Homo sapiens
ggtgaggaattggggactgacc

SEQ ID NO: 9152832 - DNA, 22 bp, Homo sapiens
ggtgaggaattggggactgacc

SEQ ID NO: 9152833 - DNA, 18 bp, Homo sapiens
ggtgagggagctggaagc

SEQ ID NO: 9152834 - DNA, 18 bp, Homo sapiens
ggtgagggagctggaagc

SEQ ID NO: 9152835 - DNA, 22 bp, Homo sapiens
ggtgagggagtggaacgaggtg

SEQ ID NO: 9152836 - DNA, 22 bp, Homo sapiens
ggtgaggcaggtggctgctgag

SEQ ID NO: 9152837 - DNA, 22 bp, Homo sapiens
ggtggaaggcctggaaggaggc

SEQ ID NO: 9152838 - DNA, 22 bp, Homo sapiens
ggtcccagttgcccaggtcagg

SEQ ID NO: 9152839 - DNA, 22 bp, Homo sapiens
ggtccccccatggtgagcactg

SEQ ID NO: 9152840 - DNA, 22 bp, Homo sapiens
ggtcccaggttgacagggagac

SEQ ID NO: 9152841 - DNA, 22 bp, Homo sapiens
ggtcccaggttgacagggagac

SEQ ID NO: 9152842 - DNA, 22 bp, Homo sapiens
ggtccctgaagaggcctggggt

SEQ ID NO: 9152843 - DNA, 22 bp, Homo sapiens
ggtccctgaagaggcctggggt

SEQ ID NO: 9152844 - DNA, 22 bp, Homo sapiens
ggtccctgaagaggcctggggt

SEQ ID NO: 9152845 - DNA, 22 bp, Homo sapiens
ggtccctgaagaggcctggggt

SEQ ID NO: 9152846 - DNA, 22 bp, Homo sapiens
ggtccctgaagatgcctgagga

SEQ ID NO: 9152847 - DNA, 22 bp, Homo sapiens
ggtccccgtggaggctggagcg

SEQ ID NO: 9152848 - DNA, 22 bp, Homo sapiens
ggtccctgcctgaggctggcct

SEQ ID NO: 9152849 - DNA, 20 bp, Homo sapiens
ggtccctgccctctgtcatc

SEQ ID NO: 9152850 - DNA, 20 bp, Homo sapiens
ggtccctgccctctgtcatc

SEQ ID NO: 9152851 - DNA, 22 bp, Homo sapiens
ggtccctgccctacattttctt

SEQ ID NO: 9152852 - DNA, 22 bp, Homo sapiens
ggtccctgccctacattttctt

SEQ ID NO: 9152853 - DNA, 22 bp, Homo sapiens
ggtccctgccctaaaactcgtc

SEQ ID NO: 9152854 - DNA, 22 bp, Homo sapiens
ggtccctgcccacctgggagct

SEQ ID NO: 9152855 - DNA, 22 bp, Homo sapiens
ggtccctgaagatgcctgagga

SEQ ID NO: 9152856 - DNA, 23 bp, Homo sapiens
ggtccctgacagcgggcaagttg

SEQ ID NO: 9152857 - DNA, 23 bp, Homo sapiens
ggtccctgacagcgggcaagttg

SEQ ID NO: 9152858 - DNA, 23 bp, Homo sapiens
ggtccctgacagcgggcaagttg

SEQ ID NO: 9152859 - DNA, 22 bp, Homo sapiens
ggtccctgcccacctgggagct

SEQ ID NO: 9152860 - DNA, 22 bp, Homo sapiens
ggtccctgcccacctgggagct

SEQ ID NO: 9152861 - DNA, 22 bp, Homo sapiens
ggtccctgcccaaagcccttgg

SEQ ID NO: 9152862 - DNA, 22 bp, Homo sapiens
ggtccctgcccaaagcccttgg

SEQ ID NO: 9152863 - DNA, 22 bp, Homo sapiens
gggttgaggcggatgtcggcgg

SEQ ID NO: 9152864 - DNA, 18 bp, Homo sapiens
gggtggtgtgctcttcgc

SEQ ID NO: 9152865 - DNA, 22 bp, Homo sapiens
gggttgggactgtcatctggag

SEQ ID NO: 9152866 - DNA, 22 bp, Homo sapiens
ggtaaaaatcacaaatacttta

SEQ ID NO: 9152867 - DNA, 22 bp, Homo sapiens
gggttggggcccagcagtctgc

SEQ ID NO: 9152868 - DNA, 22 bp, Homo sapiens
ggtcccagaattggttagcaca

SEQ ID NO: 9152869 - DNA, 22 bp, Homo sapiens
ggtggcaccttgatcttggact

SEQ ID NO: 9152870 - DNA, 22 bp, Homo sapiens
ggtggcacactggggagctcgg

SEQ ID NO: 9152871 - DNA, 22 bp, Homo sapiens
ggtggagtaattcgcagaggtt

SEQ ID NO: 9152872 - DNA, 22 bp, Homo sapiens
ggtggagtaattcgcagaggtt

SEQ ID NO: 9152873 - DNA, 22 bp, Homo sapiens
ggtggagtaattcgcagaggtt

SEQ ID NO: 9152874 - DNA, 22 bp, Homo sapiens
ggtggagagctggatgagaggt

SEQ ID NO: 9152875 - DNA, 19 bp, Homo sapiens
ggtggcagaacgtgggtcc

SEQ ID NO: 9152876 - DNA, 22 bp, Homo sapiens
ggtggcagagacataggacata

SEQ ID NO: 9152877 - DNA, 19 bp, Homo sapiens
ggtgggtgacctccccacc

SEQ ID NO: 9152878 - DNA, 22 bp, Homo sapiens
ggtgggtgcagggggcttctta

SEQ ID NO: 9152879 - DNA, 19 bp, Homo sapiens
ggtgggttggtggttccct

SEQ ID NO: 9152880 - DNA, 22 bp, Homo sapiens
ggtgggtgagccctgggagctg

SEQ ID NO: 9152881 - DNA, 22 bp, Homo sapiens
ggtggggattcctgatcactgt

SEQ ID NO: 9152882 - DNA, 22 bp, Homo sapiens
ggtggggattcctgatcactgt

SEQ ID NO: 9152883 - DNA, 22 bp, Homo sapiens
ggtggggattcctgatcactgt

SEQ ID NO: 9152884 - DNA, 22 bp, Homo sapiens
ggtggggagtcaggcattcttg

SEQ ID NO: 9152885 - DNA, 22 bp, Homo sapiens
ggtgggcgactgagaggggttt

SEQ ID NO: 9152886 - DNA, 22 bp, Homo sapiens
ggtggggagtcaggcattcttg

SEQ ID NO: 9152887 - DNA, 22 bp, Homo sapiens
ggtggggagtcaggcattcttg

SEQ ID NO: 9152888 - DNA, 22 bp, Homo sapiens
ggtgggccacggcataacgggc

SEQ ID NO: 9152889 - DNA, 22 bp, Homo sapiens
ggtgggccaggaaggccgccag

SEQ ID NO: 9152890 - DNA, 22 bp, Homo sapiens
ggtggtggagccagctgggagt

SEQ ID NO: 9152891 - DNA, 19 bp, Homo sapiens
ggtgggttggtggttccct

SEQ ID NO: 9152892 - DNA, 22 bp, Homo sapiens
ggtgggtttggaagagcaggct

SEQ ID NO: 9152893 - DNA, 22 bp, Homo sapiens
ggtggtctgcgcagcccagggt

SEQ ID NO: 9152894 - DNA, 22 bp, Homo sapiens
ggttaaaactgatattatgggt

SEQ ID NO: 9152895 - DNA, 22 bp, Homo sapiens
ggttaaaatctaaaatgtgact

SEQ ID NO: 9152896 - DNA, 21 bp, Homo sapiens
ggttaaaagacacatctgttt

SEQ ID NO: 9152897 - DNA, 19 bp, Homo sapiens
ggttaatgttaggatactt

SEQ ID NO: 9152898 - DNA, 22 bp, Homo sapiens
ggttaaaaataatttacttggc

SEQ ID NO: 9152899 - DNA, 22 bp, Homo sapiens
ggttatttttgattctgtggat

SEQ ID NO: 9152900 - DNA, 22 bp, Homo sapiens
ggttcacactaagcttaagtgg

SEQ ID NO: 9152901 - DNA, 23 bp, Homo sapiens
ggttatttgcatcctgtaattat

SEQ ID NO: 9152902 - DNA, 22 bp, Homo sapiens
ggttcacatattgagagtattc

SEQ ID NO: 9152903 - DNA, 22 bp, Homo sapiens
ggttacatggaagaaatataat

SEQ ID NO: 9152904 - DNA, 23 bp, Homo sapiens
ggttagggaatgatctcaggcat

SEQ ID NO: 9152905 - DNA, 22 bp, Homo sapiens
ggttatttctgattatatgata

SEQ ID NO: 9152906 - DNA, 22 bp, Homo sapiens
ggttggtaactccctgtgcagt

SEQ ID NO: 9152907 - DNA, 22 bp, Homo sapiens
ggttggggcgagctggaggccc

SEQ ID NO: 9152908 - DNA, 22 bp, Homo sapiens
ggttggggcgagctggaggccc

SEQ ID NO: 9152909 - DNA, 17 bp, Homo sapiens
ggttggcttatcccagg

SEQ ID NO: 9152910 - DNA, 22 bp, Homo sapiens
ggttcattctgaagtcttcagc

SEQ ID NO: 9152911 - DNA, 21 bp, Homo sapiens
ggttggtgtgtccagtggcca

SEQ ID NO: 9152912 - DNA, 22 bp, Homo sapiens
ggtttaatggagatatttcaga

SEQ ID NO: 9152913 - DNA, 17 bp, Homo sapiens
ggtttaatccttacctg

SEQ ID NO: 9152914 - DNA, 22 bp, Homo sapiens
gtaattgagttacctggaccag

SEQ ID NO: 9152915 - DNA, 22 bp, Homo sapiens
gtaattgactcagctctgttca

SEQ ID NO: 9152916 - DNA, 22 bp, Homo sapiens
gtaattgaacattaagttgaag

SEQ ID NO: 9152917 - DNA, 22 bp, Homo sapiens
gtaattgaaattgccttgggtt

SEQ ID NO: 9152918 - DNA, 22 bp, Homo sapiens
gtaatttttagttcattctatc

SEQ ID NO: 9152919 - DNA, 21 bp, Homo sapiens
gggtgggtggaattaggagtg

SEQ ID NO: 9152920 - DNA, 21 bp, Homo sapiens
gggtgggtggaattaggagtg

SEQ ID NO: 9152921 - DNA, 22 bp, Homo sapiens
gggtgggtggcagcaccgaggc

SEQ ID NO: 9152922 - DNA, 22 bp, Homo sapiens
gggtgggtggtccgcagacata

SEQ ID NO: 9152923 - DNA, 22 bp, Homo sapiens
gggtggagaggctaagtccagt

SEQ ID NO: 9152924 - DNA, 22 bp, Homo sapiens
gggtggagccagttgactctgt

SEQ ID NO: 9152925 - DNA, 22 bp, Homo sapiens
gggtggagagaaagaaacgtga

SEQ ID NO: 9152926 - DNA, 22 bp, Homo sapiens
gggtggtgtattagagctgcag

SEQ ID NO: 9152927 - DNA, 22 bp, Homo sapiens
gggtggtgtattagagctgcag

SEQ ID NO: 9152928 - DNA, 22 bp, Homo sapiens
gggtggtggccagcagtgggca

SEQ ID NO: 9152929 - DNA, 22 bp, Homo sapiens
gggtggtggccagcagtgggca

SEQ ID NO: 9152930 - DNA, 22 bp, Homo sapiens
gggtggtggcggaggctccagg

SEQ ID NO: 9152931 - DNA, 22 bp, Homo sapiens
gggtggtggcggaggctccagg

SEQ ID NO: 9152932 - DNA, 22 bp, Homo sapiens
gggtgggtggtccgcagacata

SEQ ID NO: 9152933 - DNA, 18 bp, Homo sapiens
gggtgctggggccccttg

SEQ ID NO: 9152934 - DNA, 22 bp, Homo sapiens
gggtgcaggcagcccaggcagg

SEQ ID NO: 9152935 - DNA, 22 bp, Homo sapiens
gggtgctttggctcacgcctgt

SEQ ID NO: 9152936 - DNA, 22 bp, Homo sapiens
gggtggaagccagagaggtcat

SEQ ID NO: 9152937 - DNA, 22 bp, Homo sapiens
gggtgcaggcagcccaggcagg

SEQ ID NO: 9152938 - DNA, 22 bp, Homo sapiens
gggtgcagcagagctcctctgt

SEQ ID NO: 9152939 - DNA, 22 bp, Homo sapiens
gggtgcagcagagctcctctgt

SEQ ID NO: 9152940 - DNA, 22 bp, Homo sapiens
gggtgcagctttgaaagcatgt

SEQ ID NO: 9152941 - DNA, 22 bp, Homo sapiens
gggtgaggcccatttgaggcca

SEQ ID NO: 9152942 - DNA, 22 bp, Homo sapiens
gggtgcagcagagctcctctgt

SEQ ID NO: 9152943 - DNA, 22 bp, Homo sapiens
ggggcccctgtggcttgatgcc

SEQ ID NO: 9152944 - DNA, 22 bp, Homo sapiens
ggggcccctgtggcttgatgcc

SEQ ID NO: 9152945 - DNA, 22 bp, Homo sapiens
ggggcccctgtggcttgatgcc

SEQ ID NO: 9152946 - DNA, 22 bp, Homo sapiens
ggggcccctcggacacgtgcgg

SEQ ID NO: 9152947 - DNA, 22 bp, Homo sapiens
ggggtgagttagcgtcggcttg

SEQ ID NO: 9152948 - DNA, 22 bp, Homo sapiens
ggggcccttgtggctgcaggcc

SEQ ID NO: 9152949 - DNA, 22 bp, Homo sapiens
ggggcccttgtggctgcaggcc

SEQ ID NO: 9152950 - DNA, 22 bp, Homo sapiens
ggggtaggcaggtgatctgatc

SEQ ID NO: 9152951 - DNA, 22 bp, Homo sapiens
ggggccagcttcgcgtgctctt

SEQ ID NO: 9152952 - DNA, 22 bp, Homo sapiens
ggggccaggtccagcttccaaa

SEQ ID NO: 9152953 - DNA, 22 bp, Homo sapiens
ggggccaggtccagcttccaaa

SEQ ID NO: 9152954 - DNA, 22 bp, Homo sapiens
ggggccagcttcgcgtgctctt

SEQ ID NO: 9152955 - DNA, 22 bp, Homo sapiens
ggggccagatatcactaaggtt

SEQ ID NO: 9152956 - DNA, 19 bp, Homo sapiens
ggggtggctggggctccag

SEQ ID NO: 9152957 - DNA, 19 bp, Homo sapiens
ggggtggctggggctccag

SEQ ID NO: 9152958 - DNA, 22 bp, Homo sapiens
ggggtgggagtgccatccttga

SEQ ID NO: 9152959 - DNA, 22 bp, Homo sapiens
ggggtgggagtgccatccttga

SEQ ID NO: 9152960 - DNA, 22 bp, Homo sapiens
ggggtgggagtgccatccttga

SEQ ID NO: 9152961 - DNA, 19 bp, Homo sapiens
ggggtgctagggagggatc

SEQ ID NO: 9152962 - DNA, 22 bp, Homo sapiens
ggggtggattcctacaggtcca

SEQ ID NO: 9152963 - DNA, 22 bp, Homo sapiens
ggggaggacctttccaaggctt

SEQ ID NO: 9152964 - DNA, 22 bp, Homo sapiens
ggggaggagccatgtaactagt

SEQ ID NO: 9152965 - DNA, 22 bp, Homo sapiens
ggggaggcaagatgaagtgagg

SEQ ID NO: 9152966 - DNA, 22 bp, Homo sapiens
ggggaggagtgtacaggtttat

SEQ ID NO: 9152967 - DNA, 22 bp, Homo sapiens
ggggaggcaagatgaagtgagg

SEQ ID NO: 9152968 - DNA, 22 bp, Homo sapiens
ggggaggctgatgtgggcaaag

SEQ ID NO: 9152969 - DNA, 22 bp, Homo sapiens
ggggaggctgatgtgggcaaag

SEQ ID NO: 9152970 - DNA, 22 bp, Homo sapiens
ggggaggacctttccaaggctt

SEQ ID NO: 9152971 - DNA, 22 bp, Homo sapiens
ggggaggaagctggaacacggg

SEQ ID NO: 9152972 - DNA, 22 bp, Homo sapiens
ggggaggaagctggaacacggg

SEQ ID NO: 9152973 - DNA, 22 bp, Homo sapiens
ggggaggaagctggaacacggg

SEQ ID NO: 9152974 - DNA, 22 bp, Homo sapiens
ggggaggaagctggaacacggg

SEQ ID NO: 9152975 - DNA, 22 bp, Homo sapiens
ggggaggaagctggaacacggg

SEQ ID NO: 9152976 - DNA, 22 bp, Homo sapiens
ggggagaccatctgaaggtgat

SEQ ID NO: 9152977 - DNA, 19 bp, Homo sapiens
ggggagaactagagacagc

SEQ ID NO: 9152978 - DNA, 19 bp, Homo sapiens
ggggagaactagagacagc

SEQ ID NO: 9152979 - DNA, 22 bp, Homo sapiens
gggcttctgtacctacctggaa

SEQ ID NO: 9152980 - DNA, 22 bp, Homo sapiens
ggggccactggcaggaccttgg

SEQ ID NO: 9152981 - DNA, 22 bp, Homo sapiens
ggggcattgtgtctgggttcct

SEQ ID NO: 9152982 - DNA, 22 bp, Homo sapiens
ggggcagtgaggtggcagcccg

SEQ ID NO: 9152983 - DNA, 20 bp, Homo sapiens
ggggcagtggctcatgcctg

SEQ ID NO: 9152984 - DNA, 22 bp, Homo sapiens
ggggcatcagaaccctgtggga

SEQ ID NO: 9152985 - DNA, 22 bp, Homo sapiens
ggggagtgacgcagggccatag

SEQ ID NO: 9152986 - DNA, 22 bp, Homo sapiens
ggggagttaaaatgtgctgcaa

SEQ ID NO: 9152987 - DNA, 22 bp, Homo sapiens
ggggatgagactagagctaaag

SEQ ID NO: 9152988 - DNA, 16 bp, Homo sapiens
gggctgggggattctg

SEQ ID NO: 9152989 - DNA, 16 bp, Homo sapiens
gggctgggggattctg

SEQ ID NO: 9152990 - DNA, 22 bp, Homo sapiens
gggctggtgaggctgccctgca

SEQ ID NO: 9152991 - DNA, 22 bp, Homo sapiens
gggctggtgaggctgccctgca

SEQ ID NO: 9152992 - DNA, 22 bp, Homo sapiens
gggctgtgtgcccacttcccat

SEQ ID NO: 9152993 - DNA, 22 bp, Homo sapiens
gggctctgggatgctcttagag

SEQ ID NO: 9152994 - DNA, 22 bp, Homo sapiens
gggctctgggattcagagcaag

SEQ ID NO: 9152995 - DNA, 19 bp, Homo sapiens
gggctctggcctcagtggg

SEQ ID NO: 9152996 - DNA, 22 bp, Homo sapiens
gggcttctcagagaggctttag

SEQ ID NO: 9152997 - DNA, 22 bp, Homo sapiens
gggcttctctcaggggcatgag

SEQ ID NO: 9152998 - DNA, 22 bp, Homo sapiens
gggcttctctgggagtcctggt

SEQ ID NO: 9152999 - DNA, 22 bp, Homo sapiens
gggcttctctttagtgagctga

SEQ ID NO: 9153000 - DNA, 22 bp, Homo sapiens
gggcttctcttatgctaactgg

SEQ ID NO: 9153001 - DNA, 22 bp, Homo sapiens
gggcttctctttagtgagctga

SEQ ID NO: 9153002 - DNA, 22 bp, Homo sapiens
gggcttctgctcttttggtgct

SEQ ID NO: 9153003 - DNA, 22 bp, Homo sapiens
gggcttctggctactgtatgag

SEQ ID NO: 9153004 - DNA, 22 bp, Homo sapiens
gggcttctagaccagcagtgag

SEQ ID NO: 9153005 - DNA, 22 bp, Homo sapiens
gggcttctattcaagtctgttt

SEQ ID NO: 9153006 - DNA, 22 bp, Homo sapiens
gggcttctattcaagtctgttt

SEQ ID NO: 9153007 - DNA, 22 bp, Homo sapiens
gggcttctagaatttctgatat

SEQ ID NO: 9153008 - DNA, 22 bp, Homo sapiens
ggccacagggctgaacgtggac

SEQ ID NO: 9153009 - DNA, 22 bp, Homo sapiens
ggccacagggctgaacgtggac

SEQ ID NO: 9153010 - DNA, 20 bp, Homo sapiens
ggccacagggtgctggtgga

SEQ ID NO: 9153011 - DNA, 20 bp, Homo sapiens
ggccacagggtgctggtgga

SEQ ID NO: 9153012 - DNA, 22 bp, Homo sapiens
ggccacagtctctggaaggatg

SEQ ID NO: 9153013 - DNA, 20 bp, Homo sapiens
ggccacagggtgctggtgga

SEQ ID NO: 9153014 - DNA, 22 bp, Homo sapiens
ggccacagcaatgctgtgatgt

SEQ ID NO: 9153015 - DNA, 22 bp, Homo sapiens
ggccacagcagatgcttcagat

SEQ ID NO: 9153016 - DNA, 22 bp, Homo sapiens
ggccacagcagatgcttcagat

SEQ ID NO: 9153017 - DNA, 22 bp, Homo sapiens
ggccacagcagatgcttcagat

SEQ ID NO: 9153018 - DNA, 22 bp, Homo sapiens
ggccacagagggcgggatgctg

SEQ ID NO: 9153019 - DNA, 22 bp, Homo sapiens
ggcagtggctcctctctactcc

SEQ ID NO: 9153020 - DNA, 22 bp, Homo sapiens
ggccacagagggcgggatgctg

SEQ ID NO: 9153021 - DNA, 22 bp, Homo sapiens
ggccacagagggcgggatgctg

SEQ ID NO: 9153022 - DNA, 17 bp, Homo sapiens
ggccacagagcttgggg

SEQ ID NO: 9153023 - DNA, 22 bp, Homo sapiens
ggccagagttgatggcatcttg

SEQ ID NO: 9153024 - DNA, 22 bp, Homo sapiens
ggccagagttgatggcatcttg

SEQ ID NO: 9153025 - DNA, 19 bp, Homo sapiens
ggccagcacagggctctgt

SEQ ID NO: 9153026 - DNA, 22 bp, Homo sapiens
ggccagcagacctcagggactc

SEQ ID NO: 9153027 - DNA, 19 bp, Homo sapiens
ggccacctctcttcccagg

SEQ ID NO: 9153028 - DNA, 19 bp, Homo sapiens
ggccacctctcttcccagg

SEQ ID NO: 9153029 - DNA, 19 bp, Homo sapiens
ggccacctctcttcccagg

SEQ ID NO: 9153030 - DNA, 22 bp, Homo sapiens
ggccacctctgccctactgagt

SEQ ID NO: 9153031 - DNA, 22 bp, Homo sapiens
ggccagagtctatatgcagaca

SEQ ID NO: 9153032 - DNA, 21 bp, Homo sapiens
ggccacagttagggctcagga

SEQ ID NO: 9153033 - DNA, 21 bp, Homo sapiens
ggccacagttagggctcagga

SEQ ID NO: 9153034 - DNA, 21 bp, Homo sapiens
ggccacagttagggctcagga

SEQ ID NO: 9153035 - DNA, 22 bp, Homo sapiens
ggccacagtgggaaatcctggg

SEQ ID NO: 9153036 - DNA, 22 bp, Homo sapiens
ggccacagtgggaaatcctggg

SEQ ID NO: 9153037 - DNA, 22 bp, Homo sapiens
ggccacctaggagccacagtga

SEQ ID NO: 9153038 - DNA, 22 bp, Homo sapiens
ggccaccagtcctctggcaggg

SEQ ID NO: 9153039 - DNA, 22 bp, Homo sapiens
ggccaccaaagtcctgtggctt

SEQ ID NO: 9153040 - DNA, 22 bp, Homo sapiens
ggcccaggatgcaagaactgaa

SEQ ID NO: 9153041 - DNA, 22 bp, Homo sapiens
ggcccaggatgcaagaactgaa

SEQ ID NO: 9153042 - DNA, 22 bp, Homo sapiens
ggcccaggctggagtgcagtgg

SEQ ID NO: 9153043 - DNA, 22 bp, Homo sapiens
ggcccaggctggagtgcagtgg

SEQ ID NO: 9153044 - DNA, 22 bp, Homo sapiens
ggcccagctgggcggggacacg

SEQ ID NO: 9153045 - DNA, 22 bp, Homo sapiens
ggcccatgcatcctgtgcagcc

SEQ ID NO: 9153046 - DNA, 22 bp, Homo sapiens
ggcccatctcttgctctgggtt

SEQ ID NO: 9153047 - DNA, 22 bp, Homo sapiens
ggcccagtgtaccccaggcagt

SEQ ID NO: 9153048 - DNA, 22 bp, Homo sapiens
ggcccagtgtcccggtcgtggc

SEQ ID NO: 9153049 - DNA, 22 bp, Homo sapiens
ggcccagtgtgggtggatgttg

SEQ ID NO: 9153050 - DNA, 22 bp, Homo sapiens
ggcccaggtccagcgagtacct

SEQ ID NO: 9153051 - DNA, 22 bp, Homo sapiens
ggcccaggctggagtgcggtgg

SEQ ID NO: 9153052 - DNA, 20 bp, Homo sapiens
ggcccagtgaaccaggacgg

SEQ ID NO: 9153053 - DNA, 22 bp, Homo sapiens
ggcccagtctggggccctgtga

SEQ ID NO: 9153054 - DNA, 22 bp, Homo sapiens
ggcccagcgaggccacctacag

SEQ ID NO: 9153055 - DNA, 22 bp, Homo sapiens
ggccagctgagctgctgcacag

SEQ ID NO: 9153056 - DNA, 22 bp, Homo sapiens
ggccagctgagctgctgcacag

SEQ ID NO: 9153057 - DNA, 21 bp, Homo sapiens
ggccagctgcatatgtcactg

SEQ ID NO: 9153058 - DNA, 22 bp, Homo sapiens
ggccagctgccaccagccctat

SEQ ID NO: 9153059 - DNA, 22 bp, Homo sapiens
ggccagctgctcagtgtctctg

SEQ ID NO: 9153060 - DNA, 22 bp, Homo sapiens
ggccagctgctcagtgtctctg

SEQ ID NO: 9153061 - DNA, 21 bp, Homo sapiens
ggccagcagcgtccactgtgg

SEQ ID NO: 9153062 - DNA, 22 bp, Homo sapiens
ggctcagagacctgcgatctga

SEQ ID NO: 9153063 - DNA, 22 bp, Homo sapiens
ggctcactgcaacttccgcctc

SEQ ID NO: 9153064 - DNA, 22 bp, Homo sapiens
ggctcactttggggtcagctgg

SEQ ID NO: 9153065 - DNA, 19 bp, Homo sapiens
ggctctcttaaagctgttt

SEQ ID NO: 9153066 - DNA, 22 bp, Homo sapiens
ggctctcttaactggccatcct

SEQ ID NO: 9153067 - DNA, 22 bp, Homo sapiens
ggctctctggaggagctcaccc

SEQ ID NO: 9153068 - DNA, 22 bp, Homo sapiens
ggctctctccttggctttcaga

SEQ ID NO: 9153069 - DNA, 22 bp, Homo sapiens
ggctctgaaattctcactttta

SEQ ID NO: 9153070 - DNA, 22 bp, Homo sapiens
ggctctgaacatggggaggagt

SEQ ID NO: 9153071 - DNA, 22 bp, Homo sapiens
ggctctgcaaaagtagatactt

SEQ ID NO: 9153072 - DNA, 22 bp, Homo sapiens
ggctctgaattattcctgagtc

SEQ ID NO: 9153073 - DNA, 22 bp, Homo sapiens
ggctctgcagcttgctaactgt

SEQ ID NO: 9153074 - DNA, 22 bp, Homo sapiens
ggctctgcagtgacttgagggg

SEQ ID NO: 9153075 - DNA, 22 bp, Homo sapiens
ggctctgcagagggcccagctt

SEQ ID NO: 9153076 - DNA, 22 bp, Homo sapiens
ggctctgccgtgtgctcacatg

SEQ ID NO: 9153077 - DNA, 22 bp, Homo sapiens
ggctctgccgtgtgctcacatg

SEQ ID NO: 9153078 - DNA, 22 bp, Homo sapiens
ggctctgccatttcctagctgc

SEQ ID NO: 9153079 - DNA, 22 bp, Homo sapiens
ggctctgccacttcttggctgt

SEQ ID NO: 9153080 - DNA, 22 bp, Homo sapiens
ggctagggaaatcctgatccaa

SEQ ID NO: 9153081 - DNA, 22 bp, Homo sapiens
ggctagggacacagctctgctc

SEQ ID NO: 9153082 - DNA, 22 bp, Homo sapiens
ggctcaccatggcctccctgct

SEQ ID NO: 9153083 - DNA, 22 bp, Homo sapiens
ggctcaccattttcactctctg

SEQ ID NO: 9153084 - DNA, 22 bp, Homo sapiens
ggctcaccatggcctccctgct

SEQ ID NO: 9153085 - DNA, 23 bp, Homo sapiens
ggctcacacggagtgcctccacc

SEQ ID NO: 9153086 - DNA, 22 bp, Homo sapiens
ggctcaccattttcactctctg

SEQ ID NO: 9153087 - DNA, 22 bp, Homo sapiens
ggctcactgcaacttccgcctc

SEQ ID NO: 9153088 - DNA, 22 bp, Homo sapiens
ggctcactgcaaactgtgcctc

SEQ ID NO: 9153089 - DNA, 22 bp, Homo sapiens
ggctcactgcaaactgtgcctc

SEQ ID NO: 9153090 - DNA, 22 bp, Homo sapiens
ggctcacgcaattatcccggcc

SEQ ID NO: 9153091 - DNA, 22 bp, Homo sapiens
ggctaggctcacctggagagtt

SEQ ID NO: 9153092 - DNA, 18 bp, Homo sapiens
ggcctctggactggcagc

SEQ ID NO: 9153093 - DNA, 22 bp, Homo sapiens
ggcctctggcaggcaggccctc

SEQ ID NO: 9153094 - DNA, 18 bp, Homo sapiens
ggcctctggactggcagc

SEQ ID NO: 9153095 - DNA, 21 bp, Homo sapiens
ggcctctgccttgccccactc

SEQ ID NO: 9153096 - DNA, 22 bp, Homo sapiens
ggcctctgcaactggctgtggc

SEQ ID NO: 9153097 - DNA, 22 bp, Homo sapiens
ggcctctctggcatggctgccc

SEQ ID NO: 9153098 - DNA, 22 bp, Homo sapiens
ggcctctctgagagcagacgtt

SEQ ID NO: 9153099 - DNA, 22 bp, Homo sapiens
ggcctctctccttggcttgcag

SEQ ID NO: 9153100 - DNA, 22 bp, Homo sapiens
ggcaggcttgatatggggggac

SEQ ID NO: 9153101 - DNA, 18 bp, Homo sapiens
ggcagggaaaagataggg

SEQ ID NO: 9153102 - DNA, 18 bp, Homo sapiens
ggcagggaaaagataggg

SEQ ID NO: 9153103 - DNA, 22 bp, Homo sapiens
ggcagcgagtcgccaagtctcg

SEQ ID NO: 9153104 - DNA, 22 bp, Homo sapiens
ggcagccttgagggaggcctgg

SEQ ID NO: 9153105 - DNA, 21 bp, Homo sapiens
ggcagctcagcagatggggac

SEQ ID NO: 9153106 - DNA, 18 bp, Homo sapiens
ggcagcctggacatgctc

SEQ ID NO: 9153107 - DNA, 22 bp, Homo sapiens
ggcagccatgtcccagggcttc

SEQ ID NO: 9153108 - DNA, 22 bp, Homo sapiens
ggcagccatgtcccagggcttc

SEQ ID NO: 9153109 - DNA, 22 bp, Homo sapiens
ggcagccatgtgggcagcgagt

SEQ ID NO: 9153110 - DNA, 21 bp, Homo sapiens
ggcagcccgccctctcctggc

SEQ ID NO: 9153111 - DNA, 22 bp, Homo sapiens
ggcagccctgtggagaggccca

SEQ ID NO: 9153112 - DNA, 22 bp, Homo sapiens
ggcagggccctgattcctgggg

SEQ ID NO: 9153113 - DNA, 18 bp, Homo sapiens
ggcaggggtgaaccacag

SEQ ID NO: 9153114 - DNA, 22 bp, Homo sapiens
ggcaggggtcctggtgttgact

SEQ ID NO: 9153115 - DNA, 22 bp, Homo sapiens
ggcaggggtcctggtgttgact

SEQ ID NO: 9153116 - DNA, 22 bp, Homo sapiens
ggcagggcttgtctctgtgatg

SEQ ID NO: 9153117 - DNA, 22 bp, Homo sapiens
ggcagggactttgcaaatcttt

SEQ ID NO: 9153118 - DNA, 22 bp, Homo sapiens
ggcagggactttgcaaatcttt

SEQ ID NO: 9153119 - DNA, 22 bp, Homo sapiens
ggcagggactatgtttcatgga

SEQ ID NO: 9153120 - DNA, 22 bp, Homo sapiens
ggcagggaagctggcatcacgg

SEQ ID NO: 9153121 - DNA, 22 bp, Homo sapiens
ggcagggaagctggcatcacgg

SEQ ID NO: 9153122 - DNA, 22 bp, Homo sapiens
ggcagggacaggatagggtttt

SEQ ID NO: 9153123 - DNA, 22 bp, Homo sapiens
ggcagggacaggatagggtttt

SEQ ID NO: 9153124 - DNA, 22 bp, Homo sapiens
ggcagggaaacagctgatccca

SEQ ID NO: 9153125 - DNA, 22 bp, Homo sapiens
ggcagggaaacagctgatccca

SEQ ID NO: 9153126 - DNA, 22 bp, Homo sapiens
ggcagggaaacagctgatccca

SEQ ID NO: 9153127 - DNA, 18 bp, Homo sapiens
ggcagggaaaagataggg

SEQ ID NO: 9153128 - DNA, 22 bp, Homo sapiens
ggcagtgagtcccggagaggcc

SEQ ID NO: 9153129 - DNA, 22 bp, Homo sapiens
ggcagtgagtcccggagaggcc

SEQ ID NO: 9153130 - DNA, 21 bp, Homo sapiens
ggcagtgatgtgaagtgcatc

SEQ ID NO: 9153131 - DNA, 22 bp, Homo sapiens
ggcagtgatgtcaaacagtgaa

SEQ ID NO: 9153132 - DNA, 21 bp, Homo sapiens
ggcagtgatgtgaagtgcatc

SEQ ID NO: 9153133 - DNA, 22 bp, Homo sapiens
ggcagtgatgtcaaacagtgaa

SEQ ID NO: 9153134 - DNA, 22 bp, Homo sapiens
ggcagtgactggggacccccaa

SEQ ID NO: 9153135 - DNA, 22 bp, Homo sapiens
ggcagtgactggggacccccaa

SEQ ID NO: 9153136 - DNA, 22 bp, Homo sapiens
ggcagtgactgttcagacgtcc

SEQ ID NO: 9153137 - DNA, 19 bp, Homo sapiens
ggcagtgagaagactcctg

SEQ ID NO: 9153138 - DNA, 22 bp, Homo sapiens
ggcagtgagctggagggaagga

SEQ ID NO: 9153139 - DNA, 22 bp, Homo sapiens
ggcagtgagaggtctcctggtc

SEQ ID NO: 9153140 - DNA, 22 bp, Homo sapiens
ggcagtgagaggtctcctggtc

SEQ ID NO: 9153141 - DNA, 22 bp, Homo sapiens
ggcagtgagaggtctcctggtc

SEQ ID NO: 9153142 - DNA, 22 bp, Homo sapiens
ggcagtgagctggagggaagga

SEQ ID NO: 9153143 - DNA, 22 bp, Homo sapiens
ggcagtggcagagcttggtcta

SEQ ID NO: 9153144 - DNA, 22 bp, Homo sapiens
ggcagtggcagagcttggtcta

SEQ ID NO: 9153145 - DNA, 22 bp, Homo sapiens
ggaggcaccctatttgaggcct

SEQ ID NO: 9153146 - DNA, 23 bp, Homo sapiens
ggaggcacttaggcagagcagag

SEQ ID NO: 9153147 - DNA, 22 bp, Homo sapiens
ggaggcaacatgcttgtttcta

SEQ ID NO: 9153148 - DNA, 17 bp, Homo sapiens
ggaggcaacagacaggg

SEQ ID NO: 9153149 - DNA, 22 bp, Homo sapiens
ggaggcaacacagggtgtgttt

SEQ ID NO: 9153150 - DNA, 22 bp, Homo sapiens
ggaggcaaagcactttgcttgg

SEQ ID NO: 9153151 - DNA, 22 bp, Homo sapiens
ggaggagtgtggggcactctgc

SEQ ID NO: 9153152 - DNA, 23 bp, Homo sapiens
ggaggagttcccagccctcctgg

SEQ ID NO: 9153153 - DNA, 22 bp, Homo sapiens
ggaggagtgtggggcactctgc

SEQ ID NO: 9153154 - DNA, 23 bp, Homo sapiens
ggaggagttcccagccctcctgg

SEQ ID NO: 9153155 - DNA, 22 bp, Homo sapiens
ggaggaggggtgactgaatgct

SEQ ID NO: 9153156 - DNA, 22 bp, Homo sapiens
ggaggaggggtgactgaatgct

SEQ ID NO: 9153157 - DNA, 22 bp, Homo sapiens
ggaggaggggtttacattggaa

SEQ ID NO: 9153158 - DNA, 19 bp, Homo sapiens
ggcacctttctgctgtgtc

SEQ ID NO: 9153159 - DNA, 19 bp, Homo sapiens
ggcaccttggtcttggact

SEQ ID NO: 9153160 - DNA, 19 bp, Homo sapiens
ggcaccttggctatgcctg

SEQ ID NO: 9153161 - DNA, 22 bp, Homo sapiens
ggcaccagggacaatcctcttc

SEQ ID NO: 9153162 - DNA, 22 bp, Homo sapiens
ggcaccagggcaagggtctttc

SEQ ID NO: 9153163 - DNA, 18 bp, Homo sapiens
ggcacctctcttgcctta

SEQ ID NO: 9153164 - DNA, 16 bp, Homo sapiens
ggcaccagtgaacaca

SEQ ID NO: 9153165 - DNA, 16 bp, Homo sapiens
ggcaccagtgaacaca

SEQ ID NO: 9153166 - DNA, 22 bp, Homo sapiens
ggaggcagaacttcccgtcagt

SEQ ID NO: 9153167 - DNA, 22 bp, Homo sapiens
ggcaccagggaaggaaggctgg

SEQ ID NO: 9153168 - DNA, 22 bp, Homo sapiens
ggaggcacttcccgtctcagcc

SEQ ID NO: 9153169 - DNA, 22 bp, Homo sapiens
ggaggcacttcccgtctcagcc

SEQ ID NO: 9153170 - DNA, 22 bp, Homo sapiens
ggcagcacgacaggagtggaag

SEQ ID NO: 9153171 - DNA, 21 bp, Homo sapiens
ggcagcactacctgaagcata

SEQ ID NO: 9153172 - DNA, 21 bp, Homo sapiens
ggcagcactacctgaagcata

SEQ ID NO: 9153173 - DNA, 22 bp, Homo sapiens
ggcagcaatgctgtgcaggcat

SEQ ID NO: 9153174 - DNA, 22 bp, Homo sapiens
ggcagcactgcagcttgttggg

SEQ ID NO: 9153175 - DNA, 22 bp, Homo sapiens
ggcagcagaactggccctgtat

SEQ ID NO: 9153176 - DNA, 22 bp, Homo sapiens
ggcagcagaactggccctgtat

SEQ ID NO: 9153177 - DNA, 22 bp, Homo sapiens
ggcagatgttgcagtgagcaga

SEQ ID NO: 9153178 - DNA, 22 bp, Homo sapiens
ggcagcaaatattgtcagctgt

SEQ ID NO: 9153179 - DNA, 22 bp, Homo sapiens
ggcagcaaatattgtcagctgt

SEQ ID NO: 9153180 - DNA, 22 bp, Homo sapiens
ggcagcaaccaaccaggcattt

SEQ ID NO: 9153181 - DNA, 19 bp, Homo sapiens
ggcagcaagctctgaaggc

SEQ ID NO: 9153182 - DNA, 22 bp, Homo sapiens
ggcagcaagcagaagttctatg

SEQ ID NO: 9153183 - DNA, 18 bp, Homo sapiens
ggcagcaagaagggaggg

SEQ ID NO: 9153184 - DNA, 22 bp, Homo sapiens
ggcagcaactcggagagaagag

SEQ ID NO: 9153185 - DNA, 22 bp, Homo sapiens
ggcagaggtgaagttcacaagg

SEQ ID NO: 9153186 - DNA, 22 bp, Homo sapiens
ggcagatggagaagcagcaggt

SEQ ID NO: 9153187 - DNA, 22 bp, Homo sapiens
ggcagatggagaagcagcaggt

SEQ ID NO: 9153188 - DNA, 22 bp, Homo sapiens
ggcagatggagaagcagcaggt

SEQ ID NO: 9153189 - DNA, 22 bp, Homo sapiens
ggcagatggggtgacaagagag

SEQ ID NO: 9153190 - DNA, 22 bp, Homo sapiens
ggcagatgttatatgatctgag

SEQ ID NO: 9153191 - DNA, 21 bp, Homo sapiens
ggcactaggcccggaggaagc

SEQ ID NO: 9153192 - DNA, 22 bp, Homo sapiens
ggcactcaataaatgttgccaa

SEQ ID NO: 9153193 - DNA, 23 bp, Homo sapiens
ggcactcggccgtgaactcgtgc

SEQ ID NO: 9153194 - DNA, 22 bp, Homo sapiens
ggcactgagaacaggctgactt

SEQ ID NO: 9153195 - DNA, 21 bp, Homo sapiens
ggcactgagccagatggactc

SEQ ID NO: 9153196 - DNA, 21 bp, Homo sapiens
ggcactgagccagatggactc

SEQ ID NO: 9153197 - DNA, 22 bp, Homo sapiens
ggcactgagcgggctctgagcg

SEQ ID NO: 9153198 - DNA, 22 bp, Homo sapiens
ggcactgactgtgcagcgcacc

SEQ ID NO: 9153199 - DNA, 22 bp, Homo sapiens
ggcactgactgtgcagcgcacc

SEQ ID NO: 9153200 - DNA, 22 bp, Homo sapiens
ggcactgacactagcatggcac

SEQ ID NO: 9153201 - DNA, 22 bp, Homo sapiens
gggagatggctcagaggccgcg

SEQ ID NO: 9153202 - DNA, 22 bp, Homo sapiens
gggagatggctcagaggccgcg

SEQ ID NO: 9153203 - DNA, 22 bp, Homo sapiens
gggaaggccggtccagtcaggt

SEQ ID NO: 9153204 - DNA, 22 bp, Homo sapiens
gggagccacagtgaggtgcatg

SEQ ID NO: 9153205 - DNA, 22 bp, Homo sapiens
gggagccacagtttatagtgat

SEQ ID NO: 9153206 - DNA, 22 bp, Homo sapiens
gggagccacagtgaggtgcatg

SEQ ID NO: 9153207 - DNA, 22 bp, Homo sapiens
gggagccacagtagcagctact

SEQ ID NO: 9153208 - DNA, 22 bp, Homo sapiens
gggagccacagtagcagctact

SEQ ID NO: 9153209 - DNA, 23 bp, Homo sapiens
gggagatgggaaatgaaggctct

SEQ ID NO: 9153210 - DNA, 22 bp, Homo sapiens
gggagccatgctggtcttcttt

SEQ ID NO: 9153211 - DNA, 22 bp, Homo sapiens
gggagccagccatccagaacct

SEQ ID NO: 9153212 - DNA, 22 bp, Homo sapiens
gggagccagcctttgcctataa

SEQ ID NO: 9153213 - DNA, 22 bp, Homo sapiens
gggagccccacctcggtgcccg

SEQ ID NO: 9153214 - DNA, 22 bp, Homo sapiens
gggagccccacctcggtgcccg

SEQ ID NO: 9153215 - DNA, 22 bp, Homo sapiens
gggagccagcagggcatggagc

SEQ ID NO: 9153216 - DNA, 22 bp, Homo sapiens
gggagccagagtcacctagaga

SEQ ID NO: 9153217 - DNA, 22 bp, Homo sapiens
gggagccagcagggcatggagc

SEQ ID NO: 9153218 - DNA, 22 bp, Homo sapiens
gggagccactcagctgagagtt

SEQ ID NO: 9153219 - DNA, 22 bp, Homo sapiens
gggaagatagtgttgagggccc

SEQ ID NO: 9153220 - DNA, 22 bp, Homo sapiens
gggaagcagcattgtgctggct

SEQ ID NO: 9153221 - DNA, 22 bp, Homo sapiens
gggaagcagcattgtgctggct

SEQ ID NO: 9153222 - DNA, 22 bp, Homo sapiens
gggaagatagtgttgagggccc

SEQ ID NO: 9153223 - DNA, 22 bp, Homo sapiens
gggaagagtaactagcccatgt

SEQ ID NO: 9153224 - DNA, 22 bp, Homo sapiens
gggaagagtaactagcccatgt

SEQ ID NO: 9153225 - DNA, 22 bp, Homo sapiens
gggaagagtgtcggttgaagtg

SEQ ID NO: 9153226 - DNA, 22 bp, Homo sapiens
gggaagcaggtgcagctcgcct

SEQ ID NO: 9153227 - DNA, 22 bp, Homo sapiens
gggaagccatgctcagaggtac

SEQ ID NO: 9153228 - DNA, 18 bp, Homo sapiens
gggaagccgggaagccgg

SEQ ID NO: 9153229 - DNA, 22 bp, Homo sapiens
gggaaggcatacctgagggaga

SEQ ID NO: 9153230 - DNA, 22 bp, Homo sapiens
gggaagagggagctggaatgat

SEQ ID NO: 9153231 - DNA, 22 bp, Homo sapiens
ggctgtggtctgggtgctcccc

SEQ ID NO: 9153232 - DNA, 22 bp, Homo sapiens
ggctgtggtcattaggaggttg

SEQ ID NO: 9153233 - DNA, 22 bp, Homo sapiens
ggctgtggtcattaggaggttg

SEQ ID NO: 9153234 - DNA, 22 bp, Homo sapiens
ggctgtggtctgggtgctcccc

SEQ ID NO: 9153235 - DNA, 22 bp, Homo sapiens
ggctgtgggatgcataggagct

SEQ ID NO: 9153236 - DNA, 22 bp, Homo sapiens
ggctgtggccagcggggctgag

SEQ ID NO: 9153237 - DNA, 22 bp, Homo sapiens
ggctgtggccagcggggctgag

SEQ ID NO: 9153238 - DNA, 22 bp, Homo sapiens
ggctgtggccagcggggctgag

SEQ ID NO: 9153239 - DNA, 22 bp, Homo sapiens
ggctgtggcagctggaagtggt

SEQ ID NO: 9153240 - DNA, 22 bp, Homo sapiens
ggctgtggcagctggaagtggt

SEQ ID NO: 9153241 - DNA, 22 bp, Homo sapiens
ggctgtggcagctggaagtggt

SEQ ID NO: 9153242 - DNA, 21 bp, Homo sapiens
ggctgtggagccatgactcac

SEQ ID NO: 9153243 - DNA, 21 bp, Homo sapiens
ggctgtggagccatgactcac

SEQ ID NO: 9153244 - DNA, 22 bp, Homo sapiens
ggctgtggagctgcagagttgg

SEQ ID NO: 9153245 - DNA, 22 bp, Homo sapiens
ggctgtggcattaggtgaggcc

SEQ ID NO: 9153246 - DNA, 22 bp, Homo sapiens
ggctgtggcagctggaagtggt

SEQ ID NO: 9153247 - DNA, 22 bp, Homo sapiens
ggctgtggacactgagctcaga

SEQ ID NO: 9153248 - DNA, 22 bp, Homo sapiens
ggctgtggacactgagctcaga

SEQ ID NO: 9153249 - DNA, 22 bp, Homo sapiens
ggctggccagggccctcgctgg

SEQ ID NO: 9153250 - DNA, 17 bp, Homo sapiens
ggctgcagtccaggagg

SEQ ID NO: 9153251 - DNA, 20 bp, Homo sapiens
ggctgcagtgcacctcatct

SEQ ID NO: 9153252 - DNA, 17 bp, Homo sapiens
ggctgcagtccaggagg

SEQ ID NO: 9153253 - DNA, 22 bp, Homo sapiens
ggctgcagggcagctggtgtgg

SEQ ID NO: 9153254 - DNA, 22 bp, Homo sapiens
ggctgcaggttggttggcagct

SEQ ID NO: 9153255 - DNA, 22 bp, Homo sapiens
ggctgcaggcagggtatccact

SEQ ID NO: 9153256 - DNA, 22 bp, Homo sapiens
ggctgcaggcttccctccagca

SEQ ID NO: 9153257 - DNA, 21 bp, Homo sapiens
ggctgcagggagccctggggt

SEQ ID NO: 9153258 - DNA, 22 bp, Homo sapiens
ggctgccaggagggaggccagt

SEQ ID NO: 9153259 - DNA, 22 bp, Homo sapiens
ggctgccagtgagtgcagaccg

SEQ ID NO: 9153260 - DNA, 22 bp, Homo sapiens
ggctgcctccactgcttgtccc

SEQ ID NO: 9153261 - DNA, 20 bp, Homo sapiens
ggctgcctccttcctttcct

SEQ ID NO: 9153262 - DNA, 22 bp, Homo sapiens
ggctgccacgtcgagggtccaa

SEQ ID NO: 9153263 - DNA, 22 bp, Homo sapiens
ggctgccaggagaagctcagtg

SEQ ID NO: 9153264 - DNA, 22 bp, Homo sapiens
ggctgccaggagaagctcagtg

SEQ ID NO: 9153265 - DNA, 22 bp, Homo sapiens
ggctgcagttgtgtgaaggccg

SEQ ID NO: 9153266 - DNA, 17 bp, Homo sapiens
ggctggaggggacccgg

SEQ ID NO: 9153267 - DNA, 17 bp, Homo sapiens
ggctggaggggacccgg

SEQ ID NO: 9153268 - DNA, 17 bp, Homo sapiens
ggctggaggggacccgg

SEQ ID NO: 9153269 - DNA, 19 bp, Homo sapiens
ggctggagtggccatctgt

SEQ ID NO: 9153270 - DNA, 22 bp, Homo sapiens
ggctggagtgggctccagagtt

SEQ ID NO: 9153271 - DNA, 19 bp, Homo sapiens
ggctggagtggccatctgt

SEQ ID NO: 9153272 - DNA, 22 bp, Homo sapiens
ggctggcagaggggagtctgtg

SEQ ID NO: 9153273 - DNA, 17 bp, Homo sapiens
ggctggagcagctcccc

SEQ ID NO: 9153274 - DNA, 17 bp, Homo sapiens
ggctggagcagctcccc

SEQ ID NO: 9153275 - DNA, 17 bp, Homo sapiens
ggctggagcagctcccc

SEQ ID NO: 9153276 - DNA, 22 bp, Homo sapiens
ggctgcctgctcctcctgcacg

SEQ ID NO: 9153277 - DNA, 22 bp, Homo sapiens
ggctgcctggacctcctctttc

SEQ ID NO: 9153278 - DNA, 22 bp, Homo sapiens
ggctgcctctttcttagtgtct

SEQ ID NO: 9153279 - DNA, 22 bp, Homo sapiens
ggctgcctgctcaggtgcggcg

SEQ ID NO: 9153280 - DNA, 22 bp, Homo sapiens
gggcagagactcagaaacagaa

SEQ ID NO: 9153281 - DNA, 22 bp, Homo sapiens
gggcagagactcagaaacagaa

SEQ ID NO: 9153282 - DNA, 22 bp, Homo sapiens
gggcagagagctggaactcctt

SEQ ID NO: 9153283 - DNA, 22 bp, Homo sapiens
gggcagagactcagaaacagaa

SEQ ID NO: 9153284 - DNA, 22 bp, Homo sapiens
gggcagagagctggaactcctt

SEQ ID NO: 9153285 - DNA, 22 bp, Homo sapiens
gggcagagagctggaactcctt

SEQ ID NO: 9153286 - DNA, 22 bp, Homo sapiens
gggcagagagctggaactcctt

SEQ ID NO: 9153287 - DNA, 20 bp, Homo sapiens
gggcagagccagccagtccc

SEQ ID NO: 9153288 - DNA, 20 bp, Homo sapiens
gggcagagccagccagtccc

SEQ ID NO: 9153289 - DNA, 20 bp, Homo sapiens
gggcagagccagccagtccc

SEQ ID NO: 9153290 - DNA, 20 bp, Homo sapiens
gggcagagccagccagtccc

SEQ ID NO: 9153291 - DNA, 22 bp, Homo sapiens
gggcagaggctctggcccatcc

SEQ ID NO: 9153292 - DNA, 22 bp, Homo sapiens
gggcagaggctctggcccatcc

SEQ ID NO: 9153293 - DNA, 22 bp, Homo sapiens
gggcagaggctctggcccatcc

SEQ ID NO: 9153294 - DNA, 22 bp, Homo sapiens
gggcagaggctctggcccatcc

SEQ ID NO: 9153295 - DNA, 21 bp, Homo sapiens
gggcagaggggcctcctgggt

SEQ ID NO: 9153296 - DNA, 21 bp, Homo sapiens
gggcagaggggcctcctgggt

SEQ ID NO: 9153297 - DNA, 21 bp, Homo sapiens
gggcagaggggcctcctgggt

SEQ ID NO: 9153298 - DNA, 21 bp, Homo sapiens
gggcagaggggcctcctgggt

SEQ ID NO: 9153299 - DNA, 21 bp, Homo sapiens
gggcagaggggcctcctgggt

SEQ ID NO: 9153300 - DNA, 17 bp, Homo sapiens
gggcagggactcctggg

SEQ ID NO: 9153301 - DNA, 17 bp, Homo sapiens
gggcagggactcctggg

SEQ ID NO: 9153302 - DNA, 17 bp, Homo sapiens
gggcagggactcctggg

SEQ ID NO: 9153303 - DNA, 21 bp, Homo sapiens
gggcaggtctctgatgtcaac

SEQ ID NO: 9153304 - DNA, 21 bp, Homo sapiens
gggcaggtctctgatgtcaac

SEQ ID NO: 9153305 - DNA, 21 bp, Homo sapiens
gggcaggtctctgatgtcaac

SEQ ID NO: 9153306 - DNA, 22 bp, Homo sapiens
gggcaggtctgggtcagcctga

SEQ ID NO: 9153307 - DNA, 22 bp, Homo sapiens
gggcaggtgacctcttgtcctg

SEQ ID NO: 9153308 - DNA, 22 bp, Homo sapiens
gggagtgtgcacacatggtata

SEQ ID NO: 9153309 - DNA, 22 bp, Homo sapiens
gggagtgtgcagaagctggggg

SEQ ID NO: 9153310 - DNA, 22 bp, Homo sapiens
gggataggtttggaagaggtgg

SEQ ID NO: 9153311 - DNA, 22 bp, Homo sapiens
gggagtggttgatggtgaaaat

SEQ ID NO: 9153312 - DNA, 22 bp, Homo sapiens
gggagtggttgatggtgaaaat

SEQ ID NO: 9153313 - DNA, 22 bp, Homo sapiens
gggagtgggtttggcctaggcc

SEQ ID NO: 9153314 - DNA, 20 bp, Homo sapiens
gggagtggtggtagcctgtg

SEQ ID NO: 9153315 - DNA, 22 bp, Homo sapiens
gggagtggattatgtggaccca

SEQ ID NO: 9153316 - DNA, 22 bp, Homo sapiens
gggagtgggtttggcctaggcc

SEQ ID NO: 9153317 - DNA, 22 bp, Homo sapiens
gggagtgggtttggcctaggcc

SEQ ID NO: 9153318 - DNA, 22 bp, Homo sapiens
gggagctgaatggcaatggaga

SEQ ID NO: 9153319 - DNA, 22 bp, Homo sapiens
gggaggttgaggctgcagtgag

SEQ ID NO: 9153320 - DNA, 19 bp, Homo sapiens
gggagtcaagagattagtt

SEQ ID NO: 9153321 - DNA, 19 bp, Homo sapiens
gggagtcaagagattagtt

SEQ ID NO: 9153322 - DNA, 22 bp, Homo sapiens
gggaggttgaggctgcagtgag

SEQ ID NO: 9153323 - DNA, 22 bp, Homo sapiens
gggaggttgaggctgcagtgag

SEQ ID NO: 9153324 - DNA, 22 bp, Homo sapiens
gggagtcatgtggctaaatctc

SEQ ID NO: 9153325 - DNA, 22 bp, Homo sapiens
gggagtcagtgaaggagtcaga

SEQ ID NO: 9153326 - DNA, 16 bp, Homo sapiens
gggagtgaaggagggt

SEQ ID NO: 9153327 - DNA, 22 bp, Homo sapiens
gggagtcaggctccctcagaga

SEQ ID NO: 9153328 - DNA, 22 bp, Homo sapiens
gggagtcagagaggtaatggga

SEQ ID NO: 9153329 - DNA, 22 bp, Homo sapiens
gggagtcagagaggtaatggga

SEQ ID NO: 9153330 - DNA, 22 bp, Homo sapiens
gggagtcagtgaaggagtcaga

SEQ ID NO: 9153331 - DNA, 22 bp, Homo sapiens
gggagtcagtgaaggagtcaga

SEQ ID NO: 9153332 - DNA, 22 bp, Homo sapiens
gggagtcaggctccctcagaga

SEQ ID NO: 9153333 - DNA, 22 bp, Homo sapiens
gggagtggattatgtggaccca

SEQ ID NO: 9153334 - DNA, 22 bp, Homo sapiens
gggagtggattatgtggaccca

SEQ ID NO: 9153335 - DNA, 22 bp, Homo sapiens
gggagccttgggagtgccagcc

SEQ ID NO: 9153336 - DNA, 22 bp, Homo sapiens
gggagcgcccctgcctgtttga

SEQ ID NO: 9153337 - DNA, 22 bp, Homo sapiens
gggagcctgtggatgtctgact

SEQ ID NO: 9153338 - DNA, 22 bp, Homo sapiens
gggagcgggactgcgcaggctt

SEQ ID NO: 9153339 - DNA, 22 bp, Homo sapiens
gggagctgaagtaggggtaaat

SEQ ID NO: 9153340 - DNA, 22 bp, Homo sapiens
gggagctgaagtaggggtaaat

SEQ ID NO: 9153341 - DNA, 21 bp, Homo sapiens
gggctcagcgctcggctcctc

SEQ ID NO: 9153342 - DNA, 22 bp, Homo sapiens
gggctcagctgggcgtgctggt

SEQ ID NO: 9153343 - DNA, 22 bp, Homo sapiens
gggctcagctccttccttccta

SEQ ID NO: 9153344 - DNA, 22 bp, Homo sapiens
gggctcagctccttccttccta

SEQ ID NO: 9153345 - DNA, 22 bp, Homo sapiens
gggctcatcagctaggaaaatg

SEQ ID NO: 9153346 - DNA, 22 bp, Homo sapiens
gggctcagttctgcttcatgct

SEQ ID NO: 9153347 - DNA, 22 bp, Homo sapiens
gggctcagacatccctcctgga

SEQ ID NO: 9153348 - DNA, 22 bp, Homo sapiens
gggctcagacatccctcctgga

SEQ ID NO: 9153349 - DNA, 22 bp, Homo sapiens
gggctcagacatccctcctgga

SEQ ID NO: 9153350 - DNA, 22 bp, Homo sapiens
gggctcagaggagtggcctggg

SEQ ID NO: 9153351 - DNA, 22 bp, Homo sapiens
gggctcagaggagtggcctggg

SEQ ID NO: 9153352 - DNA, 23 bp, Homo sapiens
gggctcagatttcattctgtgcc

SEQ ID NO: 9153353 - DNA, 22 bp, Homo sapiens
gggctctggacccaggcaagag

SEQ ID NO: 9153354 - DNA, 22 bp, Homo sapiens
gggctccaaaatctatgtcttc

SEQ ID NO: 9153355 - DNA, 22 bp, Homo sapiens
gggctctgaatcccaggtctgc

SEQ ID NO: 9153356 - DNA, 22 bp, Homo sapiens
gggctccaactacatcagcctt

SEQ ID NO: 9153357 - DNA, 22 bp, Homo sapiens
gggctctgaatgagttaccaag

SEQ ID NO: 9153358 - DNA, 22 bp, Homo sapiens
gggccccttgtatctctggctc

SEQ ID NO: 9153359 - DNA, 22 bp, Homo sapiens
gggccccttgtatctctggctc

SEQ ID NO: 9153360 - DNA, 22 bp, Homo sapiens
gggccccttgctgctctgctgg

SEQ ID NO: 9153361 - DNA, 22 bp, Homo sapiens
gggccccttgctgctctgctgg

SEQ ID NO: 9153362 - DNA, 22 bp, Homo sapiens
gggcccctgggaattctgtgat

SEQ ID NO: 9153363 - DNA, 22 bp, Homo sapiens
gggcccctgggaattctgtgat

SEQ ID NO: 9153364 - DNA, 22 bp, Homo sapiens
gggcccagtaccctctgccaag

SEQ ID NO: 9153365 - DNA, 22 bp, Homo sapiens
gggcccaggcctccttccttcc

SEQ ID NO: 9153366 - DNA, 22 bp, Homo sapiens
gggcccagtaccctctgccaag

SEQ ID NO: 9153367 - DNA, 22 bp, Homo sapiens
gggcaggtgcccagggccagag

SEQ ID NO: 9153368 - DNA, 22 bp, Homo sapiens
gggccggagctgggtcccgcgc

SEQ ID NO: 9153369 - DNA, 22 bp, Homo sapiens
gggccctgtgatttcttgagga

SEQ ID NO: 9153370 - DNA, 19 bp, Homo sapiens
gggcctcacccacacctcc

SEQ ID NO: 9153371 - DNA, 22 bp, Homo sapiens
gggctaggtctgatcagagaag

SEQ ID NO: 9153372 - DNA, 18 bp, Homo sapiens
gggctcacacaggtcatc

SEQ ID NO: 9153373 - DNA, 22 bp, Homo sapiens
gggctcactcatgcaactgcag

SEQ ID NO: 9153374 - DNA, 18 bp, Homo sapiens
gggctcacacaggtcatc

SEQ ID NO: 9153375 - DNA, 22 bp, Homo sapiens
gggccctgggattcagagcaag

SEQ ID NO: 9153376 - DNA, 22 bp, Homo sapiens
gggccctgcctaaggaacacac

SEQ ID NO: 9153377 - DNA, 22 bp, Homo sapiens
gggccctgggattcagagcaag

SEQ ID NO: 9153378 - DNA, 22 bp, Homo sapiens
gggccctgccccgtggctctga

SEQ ID NO: 9153379 - DNA, 22 bp, Homo sapiens
gggccctgccccgtggctctga

SEQ ID NO: 9153380 - DNA, 22 bp, Homo sapiens
gggccctctgcagctgcccagg

SEQ ID NO: 9153381 - DNA, 22 bp, Homo sapiens
gggccctcagtcccaggccttc

SEQ ID NO: 9153382 - DNA, 22 bp, Homo sapiens
tatttgcttgaagcctggttct

SEQ ID NO: 9153383 - DNA, 22 bp, Homo sapiens
tatttgcttggaaacctaatcc

SEQ ID NO: 9153384 - DNA, 22 bp, Homo sapiens
tatttgctttggtcctccaagc

SEQ ID NO: 9153385 - DNA, 22 bp, Homo sapiens
tatttgctttgctttatagaga

SEQ ID NO: 9153386 - DNA, 22 bp, Homo sapiens
tatttggaaacaattcacatgc

SEQ ID NO: 9153387 - DNA, 22 bp, Homo sapiens
tatttgcttttgtgccacagat

SEQ ID NO: 9153388 - DNA, 22 bp, Homo sapiens
tatttgctgacagtgctggagc

SEQ ID NO: 9153389 - DNA, 22 bp, Homo sapiens
tatttgctgaatctgattcaga

SEQ ID NO: 9153390 - DNA, 22 bp, Homo sapiens
tatttgctctcggcccggcccc

SEQ ID NO: 9153391 - DNA, 22 bp, Homo sapiens
tatttgctgtgcttattccatt

SEQ ID NO: 9153392 - DNA, 21 bp, Homo sapiens
tatttgctgccatctttgagg

SEQ ID NO: 9153393 - DNA, 22 bp, Homo sapiens
tattttctggggagagtgaacc

SEQ ID NO: 9153394 - DNA, 22 bp, Homo sapiens
tattttgacgattttatgcaaa

SEQ ID NO: 9153395 - DNA, 22 bp, Homo sapiens
tattttccttggtggacccagt

SEQ ID NO: 9153396 - DNA, 22 bp, Homo sapiens
tattttctggacagtcttgctt

SEQ ID NO: 9153397 - DNA, 23 bp, Homo sapiens
tattttcctggcaacaggggaac

SEQ ID NO: 9153398 - DNA, 23 bp, Homo sapiens
tattttccaaatgatgactacat

SEQ ID NO: 9153399 - DNA, 22 bp, Homo sapiens
tatttaattagtgattgtagag

SEQ ID NO: 9153400 - DNA, 22 bp, Homo sapiens
tatttcttgttattctcgttga

SEQ ID NO: 9153401 - DNA, 22 bp, Homo sapiens
tatttcttgttattctcgttga

SEQ ID NO: 9153402 - DNA, 22 bp, Homo sapiens
tatttgaagggagaaagtgcca

SEQ ID NO: 9153403 - DNA, 22 bp, Homo sapiens
tatttgaagggagaaagtgcca

SEQ ID NO: 9153404 - DNA, 22 bp, Homo sapiens
tatttgacatggtggatttgct

SEQ ID NO: 9153405 - DNA, 22 bp, Homo sapiens
tatttgacactaggtgccctga

SEQ ID NO: 9153406 - DNA, 22 bp, Homo sapiens
tatttgaccgtgaggaatatga

SEQ ID NO: 9153407 - DNA, 22 bp, Homo sapiens
tatttgactcttaggaagactc

SEQ ID NO: 9153408 - DNA, 23 bp, Homo sapiens
tatttgctactggtaattctgga

SEQ ID NO: 9153409 - DNA, 22 bp, Homo sapiens
tatttgctcaataatagtttta

SEQ ID NO: 9153410 - DNA, 22 bp, Homo sapiens
tatttgctccttaggcatattt

SEQ ID NO: 9153411 - DNA, 22 bp, Homo sapiens
tatttgctcaaccctgcctcca

SEQ ID NO: 9153412 - DNA, 22 bp, Homo sapiens
tatttgatggttctaaaacagc

SEQ ID NO: 9153413 - DNA, 22 bp, Homo sapiens
tatttgatagagataaatgata

SEQ ID NO: 9153414 - DNA, 22 bp, Homo sapiens
tatttaaccagttaaatttcca

SEQ ID NO: 9153415 - DNA, 22 bp, Homo sapiens
tatttaactggaaacacaatga

SEQ ID NO: 9153416 - DNA, 22 bp, Homo sapiens
tatttaagatgtgtcataaaga

SEQ ID NO: 9153417 - DNA, 22 bp, Homo sapiens
tatttaaaataagccccagtgg

SEQ ID NO: 9153418 - DNA, 22 bp, Homo sapiens
tatttaaaataagccccagtgg

SEQ ID NO: 9153419 - DNA, 22 bp, Homo sapiens
tatttaaaaagaggccagctgg

SEQ ID NO: 9153420 - DNA, 22 bp, Homo sapiens
tatttaaaaagaggccagctgg

SEQ ID NO: 9153421 - DNA, 22 bp, Homo sapiens
tatttaaaaagaggccagctgg

SEQ ID NO: 9153422 - DNA, 22 bp, Homo sapiens
tatttaaaatagtgctccagca

SEQ ID NO: 9153423 - DNA, 22 bp, Homo sapiens
tatttaaaatagtgctccagca

SEQ ID NO: 9153424 - DNA, 22 bp, Homo sapiens
tatttaaaatagtgctccagca

SEQ ID NO: 9153425 - DNA, 22 bp, Homo sapiens
tattgtgagggcaaagtttcta

SEQ ID NO: 9153426 - DNA, 22 bp, Homo sapiens
tattgtgcccctcccaggaaca

SEQ ID NO: 9153427 - DNA, 22 bp, Homo sapiens
tatttaaaaagaggccagctgg

SEQ ID NO: 9153428 - DNA, 22 bp, Homo sapiens
tattgtatcttaccacatgtat

SEQ ID NO: 9153429 - DNA, 22 bp, Homo sapiens
tattgtatcttctgtttagaag

SEQ ID NO: 9153430 - DNA, 21 bp, Homo sapiens
tattgtcaatctgctttcaga

SEQ ID NO: 9153431 - DNA, 22 bp, Homo sapiens
tattgtcagtgcctgcctcata

SEQ ID NO: 9153432 - DNA, 22 bp, Homo sapiens
tattgtcagtgcctgcctcata

SEQ ID NO: 9153433 - DNA, 22 bp, Homo sapiens
tattgtctgcaaaggtttataa

SEQ ID NO: 9153434 - DNA, 22 bp, Homo sapiens
tattgtctctgcgttgttctat

SEQ ID NO: 9153435 - DNA, 22 bp, Homo sapiens
tattgtctatcgctgctttcat

SEQ ID NO: 9153436 - DNA, 22 bp, Homo sapiens
tattgtctcacagttttggagg

SEQ ID NO: 9153437 - DNA, 23 bp, Homo sapiens
tattacaattggtcttattaaga

SEQ ID NO: 9153438 - DNA, 23 bp, Homo sapiens
tattacaattggtcttattaaga

SEQ ID NO: 9153439 - DNA, 22 bp, Homo sapiens
tattacaatttacattgcactt

SEQ ID NO: 9153440 - DNA, 22 bp, Homo sapiens
tattacaagaaagggcatgaat

SEQ ID NO: 9153441 - DNA, 22 bp, Homo sapiens
tattacaaattataatgggaga

SEQ ID NO: 9153442 - DNA, 22 bp, Homo sapiens
tattaatttaatctccatggta

SEQ ID NO: 9153443 - DNA, 22 bp, Homo sapiens
tattaattcttgccaattctcc

SEQ ID NO: 9153444 - DNA, 22 bp, Homo sapiens
tattaatttaatctccatggta

SEQ ID NO: 9153445 - DNA, 22 bp, Homo sapiens
tcaaatatgtgatagaagctaa

SEQ ID NO: 9153446 - DNA, 22 bp, Homo sapiens
tcaaatatgtgatagaagctaa

SEQ ID NO: 9153447 - DNA, 22 bp, Homo sapiens
tcaaatatgtgatagaagctaa

SEQ ID NO: 9153448 - DNA, 22 bp, Homo sapiens
tcaaatatgtgatagaagctaa

SEQ ID NO: 9153449 - DNA, 22 bp, Homo sapiens
tcaaataccagcaatttcatgt

SEQ ID NO: 9153450 - DNA, 22 bp, Homo sapiens
tcaaatacatggtcaatcaact

SEQ ID NO: 9153451 - DNA, 22 bp, Homo sapiens
tcaaatacatggtcaatcaact

SEQ ID NO: 9153452 - DNA, 22 bp, Homo sapiens
tcaaatacatggtcaatcaact

SEQ ID NO: 9153453 - DNA, 22 bp, Homo sapiens
tcaaatacatggtcaatcaact

SEQ ID NO: 9153454 - DNA, 22 bp, Homo sapiens
tcaaatacatggtcaatcaact

SEQ ID NO: 9153455 - DNA, 22 bp, Homo sapiens
tcaaataatgccattcatcatc

SEQ ID NO: 9153456 - DNA, 22 bp, Homo sapiens
tcaaataatgccattcatcatc

SEQ ID NO: 9153457 - DNA, 22 bp, Homo sapiens
tcaaataaggagtcatgaccat

SEQ ID NO: 9153458 - DNA, 22 bp, Homo sapiens
tcaaagtattttaactgtatcc

SEQ ID NO: 9153459 - DNA, 22 bp, Homo sapiens
tcaaagtaaaagtatagagttt

SEQ ID NO: 9153460 - DNA, 22 bp, Homo sapiens
tcaaagtaggggtaagccaggc

SEQ ID NO: 9153461 - DNA, 22 bp, Homo sapiens
tattttgaggtatttttgagct

SEQ ID NO: 9153462 - DNA, 22 bp, Homo sapiens
tattttgcaaacctgagtttga

SEQ ID NO: 9153463 - DNA, 22 bp, Homo sapiens
tattttgactattaaaccaaca

SEQ ID NO: 9153464 - DNA, 22 bp, Homo sapiens
tattttgtaattggtcatagct

SEQ ID NO: 9153465 - DNA, 22 bp, Homo sapiens
tattttgcgttgagtcagattt

SEQ ID NO: 9153466 - DNA, 20 bp, Homo sapiens
tattttgcaattatggttca

SEQ ID NO: 9153467 - DNA, 22 bp, Homo sapiens
tcaaaaataagatattctggac

SEQ ID NO: 9153468 - DNA, 22 bp, Homo sapiens
tcaaaaataagatattctggac

SEQ ID NO: 9153469 - DNA, 22 bp, Homo sapiens
tcaaagatgatgctgaagttat

SEQ ID NO: 9153470 - DNA, 20 bp, Homo sapiens
tcaaagcaaagggagatgat

SEQ ID NO: 9153471 - DNA, 22 bp, Homo sapiens
tcaaagatagatgttgagaaat

SEQ ID NO: 9153472 - DNA, 22 bp, Homo sapiens
tcaaagatgataggaaatcata

SEQ ID NO: 9153473 - DNA, 22 bp, Homo sapiens
tcaaagatgatgctgaagttat

SEQ ID NO: 9153474 - DNA, 22 bp, Homo sapiens
tcaaagagctctatcttcaaaa

SEQ ID NO: 9153475 - DNA, 22 bp, Homo sapiens
tcaaagagctattcagttgtgg

SEQ ID NO: 9153476 - DNA, 21 bp, Homo sapiens
tcaaagactggggctgtgtgc

SEQ ID NO: 9153477 - DNA, 22 bp, Homo sapiens
tcaaagacatctggtagctgag

SEQ ID NO: 9153478 - DNA, 22 bp, Homo sapiens
tcaaagacagacatcagtcaaa

SEQ ID NO: 9153479 - DNA, 22 bp, Homo sapiens
tcaaactgaattaaacacttgt

SEQ ID NO: 9153480 - DNA, 18 bp, Homo sapiens
tcaaactgtcattggtga

SEQ ID NO: 9153481 - DNA, 22 bp, Homo sapiens
tcaaagaagtgcaaacctcatc

SEQ ID NO: 9153482 - DNA, 22 bp, Homo sapiens
tcaaagaagtgcaaacctcatc

SEQ ID NO: 9153483 - DNA, 20 bp, Homo sapiens
tcaaagaagattcagctcaa

SEQ ID NO: 9153484 - DNA, 22 bp, Homo sapiens
tcaaagaacatcatctgaaatg

SEQ ID NO: 9153485 - DNA, 22 bp, Homo sapiens
tcaaagaagattaccctcccat

SEQ ID NO: 9153486 - DNA, 22 bp, Homo sapiens
tcaaagaatgttatgagggtag

SEQ ID NO: 9153487 - DNA, 17 bp, Homo sapiens
tcaaagaatgcatgcag

SEQ ID NO: 9153488 - DNA, 22 bp, Homo sapiens
tatcatttagagtatttcttca

SEQ ID NO: 9153489 - DNA, 22 bp, Homo sapiens
tatccaaaggaacaatcacagc

SEQ ID NO: 9153490 - DNA, 22 bp, Homo sapiens
tatccaaagagattcatgttct

SEQ ID NO: 9153491 - DNA, 23 bp, Homo sapiens
tatctttttcaatgttggaaata

SEQ ID NO: 9153492 - DNA, 22 bp, Homo sapiens
tatgaaaatttagctgaagcat

SEQ ID NO: 9153493 - DNA, 22 bp, Homo sapiens
tatgaaagcaatcattatgtac

SEQ ID NO: 9153494 - DNA, 22 bp, Homo sapiens
tatgaaagcaatcattatgtac

SEQ ID NO: 9153495 - DNA, 22 bp, Homo sapiens
tatgaaatgatggggaaaatag

SEQ ID NO: 9153496 - DNA, 22 bp, Homo sapiens
tatgaaattgccatttttatgg

SEQ ID NO: 9153497 - DNA, 22 bp, Homo sapiens
tatgaaatggtagtaggaaggg

SEQ ID NO: 9153498 - DNA, 22 bp, Homo sapiens
tatgaaatttctagttctgctt

SEQ ID NO: 9153499 - DNA, 20 bp, Homo sapiens
tatgaagatatgtgaacagc

SEQ ID NO: 9153500 - DNA, 20 bp, Homo sapiens
tatgaagatatgtgaacagc

SEQ ID NO: 9153501 - DNA, 22 bp, Homo sapiens
tatgaaatttaaacacagatca

SEQ ID NO: 9153502 - DNA, 22 bp, Homo sapiens
tatgaaatttaaacacagatca

SEQ ID NO: 9153503 - DNA, 22 bp, Homo sapiens
tatgaagattgcggtctggaat

SEQ ID NO: 9153504 - DNA, 22 bp, Homo sapiens
tatgaatataccacaatttagg

SEQ ID NO: 9153505 - DNA, 22 bp, Homo sapiens
tatgaatataccacaatttagg

SEQ ID NO: 9153506 - DNA, 22 bp, Homo sapiens
tatgacaaatgatatatttggc

SEQ ID NO: 9153507 - DNA, 22 bp, Homo sapiens
tatgacaaagagaggcccatgc

SEQ ID NO: 9153508 - DNA, 22 bp, Homo sapiens
tatgacaaatgatatatttggc

SEQ ID NO: 9153509 - DNA, 20 bp, Homo sapiens
tatgacaacgcagcaaggca

SEQ ID NO: 9153510 - DNA, 20 bp, Homo sapiens
tatgacaacgcagcaaggca

SEQ ID NO: 9153511 - DNA, 22 bp, Homo sapiens
tatgacaagaaatacagaggta

SEQ ID NO: 9153512 - DNA, 20 bp, Homo sapiens
tatgacaacgcagcaaggca

SEQ ID NO: 9153513 - DNA, 22 bp, Homo sapiens
tatgacaagaaatacagaggta

SEQ ID NO: 9153514 - DNA, 22 bp, Homo sapiens
tatgacaaggtggagtatgagt

SEQ ID NO: 9153515 - DNA, 22 bp, Homo sapiens
tatcactacacctggctaatta

SEQ ID NO: 9153516 - DNA, 22 bp, Homo sapiens
tatcactacacctggctaatta

SEQ ID NO: 9153517 - DNA, 22 bp, Homo sapiens
tatcactacacctggctaatta

SEQ ID NO: 9153518 - DNA, 22 bp, Homo sapiens
tatcactacactaagatacaga

SEQ ID NO: 9153519 - DNA, 22 bp, Homo sapiens
tatcacatcaatgttttaaaat

SEQ ID NO: 9153520 - DNA, 22 bp, Homo sapiens
tatcactgacctgtatcagttg

SEQ ID NO: 9153521 - DNA, 18 bp, Homo sapiens
tatcactgctgaacaaga

SEQ ID NO: 9153522 - DNA, 22 bp, Homo sapiens
tatcactacacttcagctttaa

SEQ ID NO: 9153523 - DNA, 22 bp, Homo sapiens
tatcacttgcgttttggcagag

SEQ ID NO: 9153524 - DNA, 22 bp, Homo sapiens
tatcagaaatgccttaaattgg

SEQ ID NO: 9153525 - DNA, 22 bp, Homo sapiens
tatcagcaactcagagcagtct

SEQ ID NO: 9153526 - DNA, 22 bp, Homo sapiens
tatcagatggtgatacatatca

SEQ ID NO: 9153527 - DNA, 22 bp, Homo sapiens
tatcagatgacatcttctatgg

SEQ ID NO: 9153528 - DNA, 17 bp, Homo sapiens
tatcagaatgtgtttac

SEQ ID NO: 9153529 - DNA, 21 bp, Homo sapiens
tatcagaagagaaagaatgat

SEQ ID NO: 9153530 - DNA, 22 bp, Homo sapiens
tatcagaaggaagtgcctttaa

SEQ ID NO: 9153531 - DNA, 22 bp, Homo sapiens
tataaactcctcttgcattcct

SEQ ID NO: 9153532 - DNA, 18 bp, Homo sapiens
tataaacacacttaggtt

SEQ ID NO: 9153533 - DNA, 22 bp, Homo sapiens
tataaactttaaccaggatgtc

SEQ ID NO: 9153534 - DNA, 22 bp, Homo sapiens
tataaagaaggcacagcaagac

SEQ ID NO: 9153535 - DNA, 22 bp, Homo sapiens
tataaaattctcagtttggggt

SEQ ID NO: 9153536 - DNA, 22 bp, Homo sapiens
tataaaatggcatcagctccaa

SEQ ID NO: 9153537 - DNA, 22 bp, Homo sapiens
tataaagctgactcatgaaact

SEQ ID NO: 9153538 - DNA, 22 bp, Homo sapiens
tataaagtttcgaaagatgtat

SEQ ID NO: 9153539 - DNA, 22 bp, Homo sapiens
tataaagagtctcaaagaagtt

SEQ ID NO: 9153540 - DNA, 22 bp, Homo sapiens
tataaagaatccagaagagaca

SEQ ID NO: 9153541 - DNA, 22 bp, Homo sapiens
tataaagagtctatctggtggc

SEQ ID NO: 9153542 - DNA, 22 bp, Homo sapiens
tatgtactacactagaacattt

SEQ ID NO: 9153543 - DNA, 22 bp, Homo sapiens
tatgtacatatacacgtgtgtg

SEQ ID NO: 9153544 - DNA, 22 bp, Homo sapiens
tatgtactcatcaactattgaa

SEQ ID NO: 9153545 - DNA, 22 bp, Homo sapiens
tatgtaaagtagatggcaggta

SEQ ID NO: 9153546 - DNA, 22 bp, Homo sapiens
tatgtacatacatgtgcatacg

SEQ ID NO: 9153547 - DNA, 22 bp, Homo sapiens
tatggtttcaatttctgggtag

SEQ ID NO: 9153548 - DNA, 22 bp, Homo sapiens
tatggcttttaaggagatctga

SEQ ID NO: 9153549 - DNA, 22 bp, Homo sapiens
tatggctttgggccaaatctac

SEQ ID NO: 9153550 - DNA, 22 bp, Homo sapiens
tatggctttaaattgaaggagt

SEQ ID NO: 9153551 - DNA, 22 bp, Homo sapiens
tatggcttttctttcctagtgt

SEQ ID NO: 9153552 - DNA, 21 bp, Homo sapiens
tatggtaaccagacaagaatg

SEQ ID NO: 9153553 - DNA, 22 bp, Homo sapiens
tatgctttgcaattggaaaagg

SEQ ID NO: 9153554 - DNA, 22 bp, Homo sapiens
tatgctttaacattaaacaaca

SEQ ID NO: 9153555 - DNA, 19 bp, Homo sapiens
tatgacaagtactagttct

SEQ ID NO: 9153556 - DNA, 22 bp, Homo sapiens
tatgctttaacattaaacaaca

SEQ ID NO: 9153557 - DNA, 22 bp, Homo sapiens
tatgctttaaccctcttatatt

SEQ ID NO: 9153558 - DNA, 22 bp, Homo sapiens
tatggaaactaattcatttttc

SEQ ID NO: 9153559 - DNA, 22 bp, Homo sapiens
tatggaaaaatgtatcttgtca

SEQ ID NO: 9153560 - DNA, 22 bp, Homo sapiens
tatggaaaaatgtatcttgtca

SEQ ID NO: 9153561 - DNA, 20 bp, Homo sapiens
tatgctttttataagattga

SEQ ID NO: 9153562 - DNA, 22 bp, Homo sapiens
tatggaaagggagtttaatttg

SEQ ID NO: 9153563 - DNA, 22 bp, Homo sapiens
tatggaaagtgttttcttctgt

SEQ ID NO: 9153564 - DNA, 22 bp, Homo sapiens
tatggaaagctctttttgattg

SEQ ID NO: 9153565 - DNA, 22 bp, Homo sapiens
tatggaaataattagacaagtg

SEQ ID NO: 9153566 - DNA, 22 bp, Homo sapiens
tatgtattctcagatttactaa

SEQ ID NO: 9153567 - DNA, 22 bp, Homo sapiens
tatgtattagagctccatgagg

SEQ ID NO: 9153568 - DNA, 22 bp, Homo sapiens
tatgtagtgttgagaatgcttg

SEQ ID NO: 9153569 - DNA, 22 bp, Homo sapiens
tatgtatagagtcttttaaatt

SEQ ID NO: 9153570 - DNA, 22 bp, Homo sapiens
tatgtcatgggtcaaaatgaag

SEQ ID NO: 9153571 - DNA, 22 bp, Homo sapiens
tatgtcatgtcttagagaatga

SEQ ID NO: 9153572 - DNA, 19 bp, Homo sapiens
tatgtccctttcccccatt

SEQ ID NO: 9153573 - DNA, 23 bp, Homo sapiens
tatgtcatgagcatattgaatgt

SEQ ID NO: 9153574 - DNA, 22 bp, Homo sapiens
tatgtcacattgtaacagtgtg

SEQ ID NO: 9153575 - DNA, 22 bp, Homo sapiens
tatgtcactcggctcggcccac

SEQ ID NO: 9153576 - DNA, 22 bp, Homo sapiens
tattaacacgtataaagtgttt

SEQ ID NO: 9153577 - DNA, 22 bp, Homo sapiens
tattaacacgtataaagtgttt

SEQ ID NO: 9153578 - DNA, 22 bp, Homo sapiens
tattaaattatggatttaggag

SEQ ID NO: 9153579 - DNA, 22 bp, Homo sapiens
tattaaattatggatttaggag

SEQ ID NO: 9153580 - DNA, 22 bp, Homo sapiens
tattaaattatggatttaggag

SEQ ID NO: 9153581 - DNA, 22 bp, Homo sapiens
tattaacattttatgaaaataa

SEQ ID NO: 9153582 - DNA, 22 bp, Homo sapiens
tattaacattttatgaaaataa

SEQ ID NO: 9153583 - DNA, 22 bp, Homo sapiens
tattaacattttatgaaaataa

SEQ ID NO: 9153584 - DNA, 22 bp, Homo sapiens
tattaacacgtataaagtgttt

SEQ ID NO: 9153585 - DNA, 22 bp, Homo sapiens
tattaacatgaactgacttttc

SEQ ID NO: 9153586 - DNA, 21 bp, Homo sapiens
tattaatatgtctaagctgat

SEQ ID NO: 9153587 - DNA, 22 bp, Homo sapiens
tattaatatgtgtgtgcatgta

SEQ ID NO: 9153588 - DNA, 22 bp, Homo sapiens
tagcaaatgtgttatgctatgc

SEQ ID NO: 9153589 - DNA, 22 bp, Homo sapiens
tagcagctctttactaaccagt

SEQ ID NO: 9153590 - DNA, 22 bp, Homo sapiens
tagcagctctgattctgggccc

SEQ ID NO: 9153591 - DNA, 22 bp, Homo sapiens
tagcagctcctaaacagtggtg

SEQ ID NO: 9153592 - DNA, 22 bp, Homo sapiens
tagcaacatggttatcacatta

SEQ ID NO: 9153593 - DNA, 22 bp, Homo sapiens
tagcaagaaaacacaagaatta

SEQ ID NO: 9153594 - DNA, 22 bp, Homo sapiens
tagcaagaagctgtcacaggtg

SEQ ID NO: 9153595 - DNA, 22 bp, Homo sapiens
tagcaaatacatgatgtaattt

SEQ ID NO: 9153596 - DNA, 22 bp, Homo sapiens
tagcaaatgggcttgttttcca

SEQ ID NO: 9153597 - DNA, 22 bp, Homo sapiens
tagcaaatgtaaaatgcctaca

SEQ ID NO: 9153598 - DNA, 23 bp, Homo sapiens
tagcaaagttgtttgggaaattt

SEQ ID NO: 9153599 - DNA, 22 bp, Homo sapiens
tagcaaagttttgtggtgatta

SEQ ID NO: 9153600 - DNA, 23 bp, Homo sapiens
tagcaaagttgtttgggaaattt

SEQ ID NO: 9153601 - DNA, 22 bp, Homo sapiens
tagcaaagggaaagaagggcct

SEQ ID NO: 9153602 - DNA, 22 bp, Homo sapiens
tagcaaaggccttggacacgct

SEQ ID NO: 9153603 - DNA, 22 bp, Homo sapiens
tagcaaaggccttggacacgct

SEQ ID NO: 9153604 - DNA, 22 bp, Homo sapiens
tagatctgatacaattcatctg

SEQ ID NO: 9153605 - DNA, 22 bp, Homo sapiens
tagcaaaatgtggatgtagttg

SEQ ID NO: 9153606 - DNA, 22 bp, Homo sapiens
tagcaaactaatacaggctcaa

SEQ ID NO: 9153607 - DNA, 22 bp, Homo sapiens
tagcaaactaccacaaactggg

SEQ ID NO: 9153608 - DNA, 22 bp, Homo sapiens
tagcaaagaagatattattgca

SEQ ID NO: 9153609 - DNA, 22 bp, Homo sapiens
tagcaaagaacctgatacccca

SEQ ID NO: 9153610 - DNA, 22 bp, Homo sapiens
tagcaaaatgtggatgtagttg

SEQ ID NO: 9153611 - DNA, 18 bp, Homo sapiens
tagcaaagatgtggattg

SEQ ID NO: 9153612 - DNA, 21 bp, Homo sapiens
tagcaaagccagatgtatatt

SEQ ID NO: 9153613 - DNA, 22 bp, Homo sapiens
tagctgggaattatctggttgc

SEQ ID NO: 9153614 - DNA, 22 bp, Homo sapiens
tagctgggaattatctggttgc

SEQ ID NO: 9153615 - DNA, 22 bp, Homo sapiens
tagctggctaatagtatgaata

SEQ ID NO: 9153616 - DNA, 22 bp, Homo sapiens
tagctggccctgggactcccgg

SEQ ID NO: 9153617 - DNA, 22 bp, Homo sapiens
tagctgcttctcacatgggcaa

SEQ ID NO: 9153618 - DNA, 22 bp, Homo sapiens
tagctgcctttgggctcctgct

SEQ ID NO: 9153619 - DNA, 19 bp, Homo sapiens
tagctgatagctactttat

SEQ ID NO: 9153620 - DNA, 22 bp, Homo sapiens
tagctgatgaataattattctt

SEQ ID NO: 9153621 - DNA, 22 bp, Homo sapiens
tagcagggtctcaggagtcagg

SEQ ID NO: 9153622 - DNA, 22 bp, Homo sapiens
tagcagggtccaatgtgaggca

SEQ ID NO: 9153623 - DNA, 18 bp, Homo sapiens
tagcagggcttgtccttt

SEQ ID NO: 9153624 - DNA, 22 bp, Homo sapiens
tagcagggtaaatgtagatgga

SEQ ID NO: 9153625 - DNA, 22 bp, Homo sapiens
tagcaggggtagatagagtgtg

SEQ ID NO: 9153626 - DNA, 22 bp, Homo sapiens
tagcagcttccagagagggcag

SEQ ID NO: 9153627 - DNA, 22 bp, Homo sapiens
tagcaggaaacctgtgttgagg

SEQ ID NO: 9153628 - DNA, 22 bp, Homo sapiens
tagcaggaataaaaatgtaccc

SEQ ID NO: 9153629 - DNA, 22 bp, Homo sapiens
tagcaggaaggttcagggccct

SEQ ID NO: 9153630 - DNA, 22 bp, Homo sapiens
tagcaggaagaaagctactcag

SEQ ID NO: 9153631 - DNA, 22 bp, Homo sapiens
tagcaggaccatgacaagaaaa

SEQ ID NO: 9153632 - DNA, 22 bp, Homo sapiens
tagcaggacatgtgcagagaag

SEQ ID NO: 9153633 - DNA, 22 bp, Homo sapiens
tagcaggagagaagttttaagt

SEQ ID NO: 9153634 - DNA, 22 bp, Homo sapiens
tagcaggaccctgagcatccca

SEQ ID NO: 9153635 - DNA, 22 bp, Homo sapiens
tagcaggaccctgagcatccca

SEQ ID NO: 9153636 - DNA, 22 bp, Homo sapiens
tagcaggaatatgaggttaata

SEQ ID NO: 9153637 - DNA, 22 bp, Homo sapiens
tagcaggaataaaaatgtaccc

SEQ ID NO: 9153638 - DNA, 22 bp, Homo sapiens
tagcaggaatgaagttctgagg

SEQ ID NO: 9153639 - DNA, 22 bp, Homo sapiens
tagcaggaattggctgcagctg

SEQ ID NO: 9153640 - DNA, 22 bp, Homo sapiens
tagcagctgtgagtaaaagcca

SEQ ID NO: 9153641 - DNA, 22 bp, Homo sapiens
tagcagctgtcagtttcacata

SEQ ID NO: 9153642 - DNA, 22 bp, Homo sapiens
tagcagctgtggaggggctgtg

SEQ ID NO: 9153643 - DNA, 22 bp, Homo sapiens
tagcagcttaagtaattagaat

SEQ ID NO: 9153644 - DNA, 22 bp, Homo sapiens
tagcagctgcatcattttacag

SEQ ID NO: 9153645 - DNA, 22 bp, Homo sapiens
tagcagctggggctattcatca

SEQ ID NO: 9153646 - DNA, 19 bp, Homo sapiens
tagcagctgccaaaggaga

SEQ ID NO: 9153647 - DNA, 21 bp, Homo sapiens
tagcaggatttggtttatttt

SEQ ID NO: 9153648 - DNA, 22 bp, Homo sapiens
tagcaggaggcagttcctcgct

SEQ ID NO: 9153649 - DNA, 22 bp, Homo sapiens
tagcaggagcagcctgcctaga

SEQ ID NO: 9153650 - DNA, 21 bp, Homo sapiens
tagcaggagcgaattttgatg

SEQ ID NO: 9153651 - DNA, 22 bp, Homo sapiens
tagcaggatttgaagaagatct

SEQ ID NO: 9153652 - DNA, 22 bp, Homo sapiens
tagcaggatcacagggagagcc

SEQ ID NO: 9153653 - DNA, 22 bp, Homo sapiens
tagcaggagtgtgttctatttt

SEQ ID NO: 9153654 - DNA, 21 bp, Homo sapiens
tagcaggaggcccctgcttgc

SEQ ID NO: 9153655 - DNA, 22 bp, Homo sapiens
tagcaggagtgatgttgtgtga

SEQ ID NO: 9153656 - DNA, 22 bp, Homo sapiens
tagcagggatacaaggtcgcct

SEQ ID NO: 9153657 - DNA, 22 bp, Homo sapiens
tagcagggccaggctgggaacc

SEQ ID NO: 9153658 - DNA, 22 bp, Homo sapiens
tagcagggaagatgatcagaat

SEQ ID NO: 9153659 - DNA, 22 bp, Homo sapiens
tagcagggagggccagtgtcaa

SEQ ID NO: 9153660 - DNA, 22 bp, Homo sapiens
tagcagggaaggtgtgctgagc

SEQ ID NO: 9153661 - DNA, 22 bp, Homo sapiens
tagatactgttcaatgatgata

SEQ ID NO: 9153662 - DNA, 22 bp, Homo sapiens
tagatactgcccattgagcaat

SEQ ID NO: 9153663 - DNA, 22 bp, Homo sapiens
tagataggtgattaggaaaagc

SEQ ID NO: 9153664 - DNA, 20 bp, Homo sapiens
tagatccgcagtaaaacttt

SEQ ID NO: 9153665 - DNA, 22 bp, Homo sapiens
tagagaaaagcagggatcagga

SEQ ID NO: 9153666 - DNA, 22 bp, Homo sapiens
tagagaaacagaaccaacaggg

SEQ ID NO: 9153667 - DNA, 22 bp, Homo sapiens
tagagaaaagcagggatcagga

SEQ ID NO: 9153668 - DNA, 22 bp, Homo sapiens
tagagaaacagaaccaacaggg

SEQ ID NO: 9153669 - DNA, 21 bp, Homo sapiens
tagagaaaagaagctgttcct

SEQ ID NO: 9153670 - DNA, 22 bp, Homo sapiens
tagagaaaagcagggatcagga

SEQ ID NO: 9153671 - DNA, 22 bp, Homo sapiens
tagactttgatattgtacaccc

SEQ ID NO: 9153672 - DNA, 22 bp, Homo sapiens
tagactttgatattgtacaccc

SEQ ID NO: 9153673 - DNA, 22 bp, Homo sapiens
tagactttgatattgtacaccc

SEQ ID NO: 9153674 - DNA, 22 bp, Homo sapiens
tagagaactcagtgtgcagcct

SEQ ID NO: 9153675 - DNA, 22 bp, Homo sapiens
tagagaattgtagcctgcaaga

SEQ ID NO: 9153676 - DNA, 22 bp, Homo sapiens
tagagacagaaagtagaatggt

SEQ ID NO: 9153677 - DNA, 22 bp, Homo sapiens
tagagaggtttgaattggctgc

SEQ ID NO: 9153678 - DNA, 16 bp, Homo sapiens
tagagagggcagggag

SEQ ID NO: 9153679 - DNA, 22 bp, Homo sapiens
tagagaggccgcgggtcccctc

SEQ ID NO: 9153680 - DNA, 20 bp, Homo sapiens
tagagagatatgggggttcc

SEQ ID NO: 9153681 - DNA, 22 bp, Homo sapiens
tagaaatgggttacatttagag

SEQ ID NO: 9153682 - DNA, 22 bp, Homo sapiens
tagaaatggagaacagattaat

SEQ ID NO: 9153683 - DNA, 22 bp, Homo sapiens
tagaaatggagaacagattaat

SEQ ID NO: 9153684 - DNA, 22 bp, Homo sapiens
tacttacattagcaaacaaggt

SEQ ID NO: 9153685 - DNA, 22 bp, Homo sapiens
tagaacatgtgaaaatatagcc

SEQ ID NO: 9153686 - DNA, 22 bp, Homo sapiens
tagaacatgtgaaaatatagcc

SEQ ID NO: 9153687 - DNA, 22 bp, Homo sapiens
tagaacatgctcatgtataaat

SEQ ID NO: 9153688 - DNA, 22 bp, Homo sapiens
tagaacatgctcatgtataaat

SEQ ID NO: 9153689 - DNA, 19 bp, Homo sapiens
tagaactgaggacttgcat

SEQ ID NO: 9153690 - DNA, 22 bp, Homo sapiens
tagaactgctctcatacttgct

SEQ ID NO: 9153691 - DNA, 21 bp, Homo sapiens
tagaactgacgatttcagagt

SEQ ID NO: 9153692 - DNA, 22 bp, Homo sapiens
tagaactgacgttagggaagaa

SEQ ID NO: 9153693 - DNA, 22 bp, Homo sapiens
tagaactacaagcattaaaagt

SEQ ID NO: 9153694 - DNA, 22 bp, Homo sapiens
tagaactggcggctagaccact

SEQ ID NO: 9153695 - DNA, 22 bp, Homo sapiens
tagaactgctctcatacttgct

SEQ ID NO: 9153696 - DNA, 22 bp, Homo sapiens
tagaactgtccaagtctgagct

SEQ ID NO: 9153697 - DNA, 22 bp, Homo sapiens
tagaactggaattttgtggttt

SEQ ID NO: 9153698 - DNA, 22 bp, Homo sapiens
tagaactggcggctagaccact

SEQ ID NO: 9153699 - DNA, 22 bp, Homo sapiens
tagaagaacatgtcaaactata

SEQ ID NO: 9153700 - DNA, 22 bp, Homo sapiens
tagaagaaagtgaagctgggga

SEQ ID NO: 9153701 - DNA, 22 bp, Homo sapiens
tagaacttgtgaaatatcaatg

SEQ ID NO: 9153702 - DNA, 22 bp, Homo sapiens
tagaactttcagaaattccaaa

SEQ ID NO: 9153703 - DNA, 22 bp, Homo sapiens
tagaagaaagtgaagctgggga

SEQ ID NO: 9153704 - DNA, 22 bp, Homo sapiens
tagaagcacaggttaaaggcat

SEQ ID NO: 9153705 - DNA, 22 bp, Homo sapiens
tagaagattccagaggcaaagc

SEQ ID NO: 9153706 - DNA, 22 bp, Homo sapiens
tagaagattctgccaagagcgc

SEQ ID NO: 9153707 - DNA, 21 bp, Homo sapiens
tagaagcacataggttcaaag

SEQ ID NO: 9153708 - DNA, 22 bp, Homo sapiens
tagacagatttaaaggaatgga

SEQ ID NO: 9153709 - DNA, 22 bp, Homo sapiens
tagaagcacaggttaaaggcat

SEQ ID NO: 9153710 - DNA, 22 bp, Homo sapiens
tagaagattcatttcctctgaa

SEQ ID NO: 9153711 - DNA, 22 bp, Homo sapiens
taggccagaggagcagctttgg

SEQ ID NO: 9153712 - DNA, 22 bp, Homo sapiens
taggccagattgttatccatgg

SEQ ID NO: 9153713 - DNA, 22 bp, Homo sapiens
taggccagcccttagtcctgtc

SEQ ID NO: 9153714 - DNA, 22 bp, Homo sapiens
taggccagtggcaggttgtgtg

SEQ ID NO: 9153715 - DNA, 22 bp, Homo sapiens
taggcagcgcttggctgtgctt

SEQ ID NO: 9153716 - DNA, 22 bp, Homo sapiens
taggcagaggtatggtaaggac

SEQ ID NO: 9153717 - DNA, 22 bp, Homo sapiens
taggcagatgttaacaggaaaa

SEQ ID NO: 9153718 - DNA, 22 bp, Homo sapiens
tagctgggtctctgttttctca

SEQ ID NO: 9153719 - DNA, 22 bp, Homo sapiens
tagctgggtctctgttttctca

SEQ ID NO: 9153720 - DNA, 22 bp, Homo sapiens
tagctggggctttcattcttgc

SEQ ID NO: 9153721 - DNA, 22 bp, Homo sapiens
tagctggggctttcattcttgc

SEQ ID NO: 9153722 - DNA, 22 bp, Homo sapiens
tagctggggctttcattcttgc

SEQ ID NO: 9153723 - DNA, 22 bp, Homo sapiens
tagctgggttgaggtcatctac

SEQ ID NO: 9153724 - DNA, 22 bp, Homo sapiens
tagctgtgaaacagcagaagag

SEQ ID NO: 9153725 - DNA, 22 bp, Homo sapiens
tagctgtgaagagctaaaaaat

SEQ ID NO: 9153726 - DNA, 22 bp, Homo sapiens
tagctgtgagcacccaggctgt

SEQ ID NO: 9153727 - DNA, 22 bp, Homo sapiens
tagctgtggagcagaggtctcc

SEQ ID NO: 9153728 - DNA, 22 bp, Homo sapiens
tagctgtgcccagggaagttgt

SEQ ID NO: 9153729 - DNA, 22 bp, Homo sapiens
tagctgtgcccgccacccaacg

SEQ ID NO: 9153730 - DNA, 22 bp, Homo sapiens
tagctgtgacgtatctctatgg

SEQ ID NO: 9153731 - DNA, 21 bp, Homo sapiens
tagctgtgcaactttgggcaa

SEQ ID NO: 9153732 - DNA, 20 bp, Homo sapiens
taggcagagctgtgcagcct

SEQ ID NO: 9153733 - DNA, 22 bp, Homo sapiens
taggcagaaaggaaggcaagtt

SEQ ID NO: 9153734 - DNA, 22 bp, Homo sapiens
tagctgtggccttgctggtctg

SEQ ID NO: 9153735 - DNA, 23 bp, Homo sapiens
tagctgtggcgtaaggctcagct

SEQ ID NO: 9153736 - DNA, 22 bp, Homo sapiens
tagctgtgtaagcttggtaaga

SEQ ID NO: 9153737 - DNA, 22 bp, Homo sapiens
tagctgtgtaacatgagaatgt

SEQ ID NO: 9153738 - DNA, 22 bp, Homo sapiens
tagctgtgtaagcttggtaaga

SEQ ID NO: 9153739 - DNA, 22 bp, Homo sapiens
tagctgtgtatggtttacaaat

SEQ ID NO: 9153740 - DNA, 22 bp, Homo sapiens
tagctgtgtagacactcagagc

SEQ ID NO: 9153741 - DNA, 17 bp, Homo sapiens
tagctgtgtttcagcta

SEQ ID NO: 9153742 - DNA, 17 bp, Homo sapiens
tagctgtgtttcagcta

SEQ ID NO: 9153743 - DNA, 22 bp, Homo sapiens
tagctgtgtgtccttgggcaaa

SEQ ID NO: 9153744 - DNA, 22 bp, Homo sapiens
tagctgtgtgatgggaaacctt

SEQ ID NO: 9153745 - DNA, 22 bp, Homo sapiens
tagggcttcaggtgtgaggcag

SEQ ID NO: 9153746 - DNA, 22 bp, Homo sapiens
tagggctgtttaaaagtgaggt

SEQ ID NO: 9153747 - DNA, 22 bp, Homo sapiens
tagggctgtttaaaagtgaggt

SEQ ID NO: 9153748 - DNA, 22 bp, Homo sapiens
tagggctgtgtctccaggacca

SEQ ID NO: 9153749 - DNA, 22 bp, Homo sapiens
tagggctgttagtaattctcag

SEQ ID NO: 9153750 - DNA, 22 bp, Homo sapiens
tagggctgtggtcagtcctcta

SEQ ID NO: 9153751 - DNA, 22 bp, Homo sapiens
tagggctgtgtctccaggacca

SEQ ID NO: 9153752 - DNA, 22 bp, Homo sapiens
tagggctgggtacactcttgcc

SEQ ID NO: 9153753 - DNA, 16 bp, Homo sapiens
tagggctgggaaggag

SEQ ID NO: 9153754 - DNA, 16 bp, Homo sapiens
tagggctgggaaggag

SEQ ID NO: 9153755 - DNA, 19 bp, Homo sapiens
tagggctggccgggcggtg

SEQ ID NO: 9153756 - DNA, 22 bp, Homo sapiens
tagggctggcgtgctcagggaa

SEQ ID NO: 9153757 - DNA, 22 bp, Homo sapiens
tagggctgctgcagatgacagg

SEQ ID NO: 9153758 - DNA, 22 bp, Homo sapiens
tagggctgctttgtattctgct

SEQ ID NO: 9153759 - DNA, 22 bp, Homo sapiens
tagggctgctttgtattctgct

SEQ ID NO: 9153760 - DNA, 22 bp, Homo sapiens
tagggctgaggcaacaagggag

SEQ ID NO: 9153761 - DNA, 22 bp, Homo sapiens
tagggctgccatttgcttttct

SEQ ID NO: 9153762 - DNA, 22 bp, Homo sapiens
tagggctgcagaacaatggcct

SEQ ID NO: 9153763 - DNA, 22 bp, Homo sapiens
tagggctgctgcagatgacagg

SEQ ID NO: 9153764 - DNA, 22 bp, Homo sapiens
tagggctgcctatggctagata

SEQ ID NO: 9153765 - DNA, 22 bp, Homo sapiens
tagggctgcctatggctagata

SEQ ID NO: 9153766 - DNA, 22 bp, Homo sapiens
tagggcagagtccaggatgggc

SEQ ID NO: 9153767 - DNA, 22 bp, Homo sapiens
tagggcagagtccaggatgggc

SEQ ID NO: 9153768 - DNA, 22 bp, Homo sapiens
tagggcagagtccaggatgggc

SEQ ID NO: 9153769 - DNA, 22 bp, Homo sapiens
tagggcagagtccaggatgggc

SEQ ID NO: 9153770 - DNA, 22 bp, Homo sapiens
taggccattccttctcttgatc

SEQ ID NO: 9153771 - DNA, 22 bp, Homo sapiens
tagggcagccacccaggctgct

SEQ ID NO: 9153772 - DNA, 22 bp, Homo sapiens
tagggcagattcggtggagttt

SEQ ID NO: 9153773 - DNA, 22 bp, Homo sapiens
tagggcagccacccaggctgct

SEQ ID NO: 9153774 - DNA, 22 bp, Homo sapiens
tagggcagccacccaggctgct

SEQ ID NO: 9153775 - DNA, 22 bp, Homo sapiens
tagggcagctgcatcaggcact

SEQ ID NO: 9153776 - DNA, 22 bp, Homo sapiens
tagggcagccacccaggctgct

SEQ ID NO: 9153777 - DNA, 22 bp, Homo sapiens
tagggcagctgcatcaggcact

SEQ ID NO: 9153778 - DNA, 22 bp, Homo sapiens
tagggcagccttatagctccca

SEQ ID NO: 9153779 - DNA, 22 bp, Homo sapiens
tagggcagccttatagctccca

SEQ ID NO: 9153780 - DNA, 22 bp, Homo sapiens
tagggctctggtgggctctgtt

SEQ ID NO: 9153781 - DNA, 22 bp, Homo sapiens
tagggctctgctcatcagttgt

SEQ ID NO: 9153782 - DNA, 18 bp, Homo sapiens
tagggctctagggagtga

SEQ ID NO: 9153783 - DNA, 21 bp, Homo sapiens
tagggctctatttttatttca

SEQ ID NO: 9153784 - DNA, 22 bp, Homo sapiens
tagggctctgagagttcagcct

SEQ ID NO: 9153785 - DNA, 21 bp, Homo sapiens
tagggctctctgtgtcaggtg

SEQ ID NO: 9153786 - DNA, 23 bp, Homo sapiens
tagggcagctgggagggacatgc

SEQ ID NO: 9153787 - DNA, 23 bp, Homo sapiens
tagggcagctgggagggacatgc

SEQ ID NO: 9153788 - DNA, 22 bp, Homo sapiens
tagttcttactgttttcagcgt

SEQ ID NO: 9153789 - DNA, 22 bp, Homo sapiens
tagttcttcatgaattcagctt

SEQ ID NO: 9153790 - DNA, 22 bp, Homo sapiens
tagttgaagagatgaatgacca

SEQ ID NO: 9153791 - DNA, 22 bp, Homo sapiens
tagttgaaagggattattgtgg

SEQ ID NO: 9153792 - DNA, 22 bp, Homo sapiens
tagtttactgttcactttgccc

SEQ ID NO: 9153793 - DNA, 22 bp, Homo sapiens
tagtttaatggtcaactaatga

SEQ ID NO: 9153794 - DNA, 22 bp, Homo sapiens
tagtttactcatctataaaatg

SEQ ID NO: 9153795 - DNA, 22 bp, Homo sapiens
tagtttaccaaattgatcttcc

SEQ ID NO: 9153796 - DNA, 22 bp, Homo sapiens
tagttacagtgcatagcaagat

SEQ ID NO: 9153797 - DNA, 22 bp, Homo sapiens
tagttacagcaggcaggatata

SEQ ID NO: 9153798 - DNA, 22 bp, Homo sapiens
tagttagcactcggtctgctct

SEQ ID NO: 9153799 - DNA, 22 bp, Homo sapiens
tagttagcattcagggagctgg

SEQ ID NO: 9153800 - DNA, 22 bp, Homo sapiens
tagttagcctcagagcctttgc

SEQ ID NO: 9153801 - DNA, 22 bp, Homo sapiens
tagttatatccagtctttaaaa

SEQ ID NO: 9153802 - DNA, 22 bp, Homo sapiens
tagttcacccctctttattttc

SEQ ID NO: 9153803 - DNA, 22 bp, Homo sapiens
tagttctataagcagatagagt

SEQ ID NO: 9153804 - DNA, 22 bp, Homo sapiens
tagttcaggaagagaaacaaca

SEQ ID NO: 9153805 - DNA, 22 bp, Homo sapiens
tagtttcatctccaccctgccc

SEQ ID NO: 9153806 - DNA, 22 bp, Homo sapiens
tagtttcatctccaccctgccc

SEQ ID NO: 9153807 - DNA, 22 bp, Homo sapiens
tagtttcagctccttcatcctg

SEQ ID NO: 9153808 - DNA, 22 bp, Homo sapiens
tagtttcatatgcaaaatagta

SEQ ID NO: 9153809 - DNA, 22 bp, Homo sapiens
tagtttcatctccaccctgccc

SEQ ID NO: 9153810 - DNA, 22 bp, Homo sapiens
tagtttatgctgctgcagtgag

SEQ ID NO: 9153811 - DNA, 22 bp, Homo sapiens
tagtttatgctgctgcagtgag

SEQ ID NO: 9153812 - DNA, 22 bp, Homo sapiens
tagtttatgctgctgcagtgag

SEQ ID NO: 9153813 - DNA, 22 bp, Homo sapiens
tagtttcatatgcaaaatagta

SEQ ID NO: 9153814 - DNA, 22 bp, Homo sapiens
tagtttcagattgctttcatat

SEQ ID NO: 9153815 - DNA, 22 bp, Homo sapiens
tagtttatagttagcgagcacg

SEQ ID NO: 9153816 - DNA, 22 bp, Homo sapiens
tagtttatgattttttggaagg

SEQ ID NO: 9153817 - DNA, 22 bp, Homo sapiens
tagtttatagttagcgagcacg

SEQ ID NO: 9153818 - DNA, 22 bp, Homo sapiens
tagtttatgattttttggaagg

SEQ ID NO: 9153819 - DNA, 22 bp, Homo sapiens
tagtttctaaagcttcctaggt

SEQ ID NO: 9153820 - DNA, 22 bp, Homo sapiens
tagtttctaaagcttcctaggt

SEQ ID NO: 9153821 - DNA, 22 bp, Homo sapiens
tagtttctaaagcttcctaggt

SEQ ID NO: 9153822 - DNA, 22 bp, Homo sapiens
tagtttctaaactgaactgtca

SEQ ID NO: 9153823 - DNA, 22 bp, Homo sapiens
tagttttataatgttaacatct

SEQ ID NO: 9153824 - DNA, 18 bp, Homo sapiens
tagtttctaatggccttt

SEQ ID NO: 9153825 - DNA, 18 bp, Homo sapiens
tagtttctaatggccttt

SEQ ID NO: 9153826 - DNA, 22 bp, Homo sapiens
tagttttgattagtattgtctt

SEQ ID NO: 9153827 - DNA, 22 bp, Homo sapiens
tagttttgaggattatatgtga

SEQ ID NO: 9153828 - DNA, 22 bp, Homo sapiens
tagtgccctcccctttgggata

SEQ ID NO: 9153829 - DNA, 22 bp, Homo sapiens
tagtgcttaacacaaagtgatt

SEQ ID NO: 9153830 - DNA, 22 bp, Homo sapiens
tagtgcttaataaatttcagaa

SEQ ID NO: 9153831 - DNA, 22 bp, Homo sapiens
tagtggagaagtggagtctgtg

SEQ ID NO: 9153832 - DNA, 22 bp, Homo sapiens
tagtgctttaagtttacagaga

SEQ ID NO: 9153833 - DNA, 22 bp, Homo sapiens
tagtgctttaggcctgagtgtc

SEQ ID NO: 9153834 - DNA, 22 bp, Homo sapiens
tagtgcttgagtctctccgtac

SEQ ID NO: 9153835 - DNA, 22 bp, Homo sapiens
tagtgcttggccctaccagata

SEQ ID NO: 9153836 - DNA, 22 bp, Homo sapiens
tagttacagaagataagggtat

SEQ ID NO: 9153837 - DNA, 22 bp, Homo sapiens
tagttacaatgggttctgtgac

SEQ ID NO: 9153838 - DNA, 22 bp, Homo sapiens
tagttacaattatgcatggaaa

SEQ ID NO: 9153839 - DNA, 22 bp, Homo sapiens
tagtggagaggatgtggagaaa

SEQ ID NO: 9153840 - DNA, 22 bp, Homo sapiens
tagtggaggggatgcaaagctt

SEQ ID NO: 9153841 - DNA, 22 bp, Homo sapiens
tagtggagaggatgtggagaaa

SEQ ID NO: 9153842 - DNA, 22 bp, Homo sapiens
tagtggaggggatgcaaagctt

SEQ ID NO: 9153843 - DNA, 22 bp, Homo sapiens
tagtggagagttgttttgtgca

SEQ ID NO: 9153844 - DNA, 22 bp, Homo sapiens
tagtggaggcctgttgtgtgca

SEQ ID NO: 9153845 - DNA, 22 bp, Homo sapiens
tagtggaggtggtctgtgaact

SEQ ID NO: 9153846 - DNA, 22 bp, Homo sapiens
tagtggagggtgtagctgctgg

SEQ ID NO: 9153847 - DNA, 22 bp, Homo sapiens
tagtggagtagaaaccaaagaa

SEQ ID NO: 9153848 - DNA, 22 bp, Homo sapiens
tagtggagtagaaaccaaagaa

SEQ ID NO: 9153849 - DNA, 22 bp, Homo sapiens
tagtctctgctttgcccttggc

SEQ ID NO: 9153850 - DNA, 22 bp, Homo sapiens
tagtctctggagactctagggg

SEQ ID NO: 9153851 - DNA, 22 bp, Homo sapiens
tagtgcagaggaggagcctctg

SEQ ID NO: 9153852 - DNA, 22 bp, Homo sapiens
tagtgcaggttaataggacttc

SEQ ID NO: 9153853 - DNA, 22 bp, Homo sapiens
tagtgcaggttaataggacttc

SEQ ID NO: 9153854 - DNA, 22 bp, Homo sapiens
taggggcaggatcctttgagcc

SEQ ID NO: 9153855 - DNA, 22 bp, Homo sapiens
taggggcagaagcggcggtcca

SEQ ID NO: 9153856 - DNA, 22 bp, Homo sapiens
taggggcagaagcggcggtcca

SEQ ID NO: 9153857 - DNA, 22 bp, Homo sapiens
taggggaggggatcatgtgctg

SEQ ID NO: 9153858 - DNA, 22 bp, Homo sapiens
taggggaactggcacagggcag

SEQ ID NO: 9153859 - DNA, 22 bp, Homo sapiens
taggggaactggcacagggcag

SEQ ID NO: 9153860 - DNA, 22 bp, Homo sapiens
taggggagctcgggtgcaatcg

SEQ ID NO: 9153861 - DNA, 20 bp, Homo sapiens
taacatagtccagagaacga

SEQ ID NO: 9153862 - DNA, 20 bp, Homo sapiens
taacatagtccagagaacga

SEQ ID NO: 9153863 - DNA, 22 bp, Homo sapiens
taacatattgtgtggcactagg

SEQ ID NO: 9153864 - DNA, 22 bp, Homo sapiens
taacatgatttgctatttagat

SEQ ID NO: 9153865 - DNA, 22 bp, Homo sapiens
taacatgagagctaagacatta

SEQ ID NO: 9153866 - DNA, 22 bp, Homo sapiens
taacatgaaactccaaatggta

SEQ ID NO: 9153867 - DNA, 22 bp, Homo sapiens
taacagtgtggacttgagatct

SEQ ID NO: 9153868 - DNA, 22 bp, Homo sapiens
taacagtagccttatgtggtct

SEQ ID NO: 9153869 - DNA, 22 bp, Homo sapiens
taacagtaaagtaagttagctt

SEQ ID NO: 9153870 - DNA, 22 bp, Homo sapiens
taaatgttgtaagtacatctaa

SEQ ID NO: 9153871 - DNA, 22 bp, Homo sapiens
taaatgtttagtcttatttggg

SEQ ID NO: 9153872 - DNA, 22 bp, Homo sapiens
taaatgtttagtcttatttggg

SEQ ID NO: 9153873 - DNA, 22 bp, Homo sapiens
taaatgtttagtcttatttggg

SEQ ID NO: 9153874 - DNA, 22 bp, Homo sapiens
taacagcatttgaatgagtaac

SEQ ID NO: 9153875 - DNA, 22 bp, Homo sapiens
taacagccctccctccatcctg

SEQ ID NO: 9153876 - DNA, 22 bp, Homo sapiens
taacagcagtcctcttctcatg

SEQ ID NO: 9153877 - DNA, 22 bp, Homo sapiens
taacagcatatgaaattactgg

SEQ ID NO: 9153878 - DNA, 22 bp, Homo sapiens
taacaggctgatcatatatcct

SEQ ID NO: 9153879 - DNA, 22 bp, Homo sapiens
taacaggatgacagcagacatt

SEQ ID NO: 9153880 - DNA, 22 bp, Homo sapiens
taaatgttactttcctttcaca

SEQ ID NO: 9153881 - DNA, 22 bp, Homo sapiens
taaatgtgttgtggatgaagtt

SEQ ID NO: 9153882 - DNA, 22 bp, Homo sapiens
taaatgtgttagtcatggtttt

SEQ ID NO: 9153883 - DNA, 22 bp, Homo sapiens
taaatgctcaataaatgttgct

SEQ ID NO: 9153884 - DNA, 22 bp, Homo sapiens
taaatgctatcgcataaaacct

SEQ ID NO: 9153885 - DNA, 22 bp, Homo sapiens
taaatgctcaataaatgttgct

SEQ ID NO: 9153886 - DNA, 22 bp, Homo sapiens
taaatgctccatacatacacca

SEQ ID NO: 9153887 - DNA, 22 bp, Homo sapiens
taagagaaggatctgttccagg

SEQ ID NO: 9153888 - DNA, 22 bp, Homo sapiens
taagagcagaggttgaataaat

SEQ ID NO: 9153889 - DNA, 22 bp, Homo sapiens
taagagctacagcccagggttc

SEQ ID NO: 9153890 - DNA, 22 bp, Homo sapiens
taagagctaggattttaaatca

SEQ ID NO: 9153891 - DNA, 21 bp, Homo sapiens
taagagctattattgcaaacc

SEQ ID NO: 9153892 - DNA, 22 bp, Homo sapiens
taagagctccaatatttgtggc

SEQ ID NO: 9153893 - DNA, 22 bp, Homo sapiens
taagagcattgtaaaataatct

SEQ ID NO: 9153894 - DNA, 22 bp, Homo sapiens
taagagcttcttcatttcaact

SEQ ID NO: 9153895 - DNA, 22 bp, Homo sapiens
taagagcttaatctggatcgta

SEQ ID NO: 9153896 - DNA, 22 bp, Homo sapiens
taagagcttagctaaggatgtg

SEQ ID NO: 9153897 - DNA, 22 bp, Homo sapiens
taagagctcccttctccttgca

SEQ ID NO: 9153898 - DNA, 22 bp, Homo sapiens
taagagctgaggcattgggaca

SEQ ID NO: 9153899 - DNA, 22 bp, Homo sapiens
taagagctgttcaggtacccat

SEQ ID NO: 9153900 - DNA, 22 bp, Homo sapiens
taagagctgagcctcgtattca

SEQ ID NO: 9153901 - DNA, 18 bp, Homo sapiens
taacatgttttcattaag

SEQ ID NO: 9153902 - DNA, 22 bp, Homo sapiens
taacatgttaagaaattagata

SEQ ID NO: 9153903 - DNA, 22 bp, Homo sapiens
taacatgttaagaaattagata

SEQ ID NO: 9153904 - DNA, 22 bp, Homo sapiens
taagacaagcctcgcatttgta

SEQ ID NO: 9153905 - DNA, 22 bp, Homo sapiens
taagacaaatactatttcaaga

SEQ ID NO: 9153906 - DNA, 19 bp, Homo sapiens
taagacagattcctagagt

SEQ ID NO: 9153907 - DNA, 22 bp, Homo sapiens
taagacatgtccaggctgtgag

SEQ ID NO: 9153908 - DNA, 22 bp, Homo sapiens
taagacatggttgatctagtgt

SEQ ID NO: 9153909 - DNA, 22 bp, Homo sapiens
taagacatggttgatctagtgt

SEQ ID NO: 9153910 - DNA, 22 bp, Homo sapiens
taagactgtgagctcagagact

SEQ ID NO: 9153911 - DNA, 22 bp, Homo sapiens
taagacatccgttgcttataat

SEQ ID NO: 9153912 - DNA, 22 bp, Homo sapiens
taagacatcctggatgttcaaa

SEQ ID NO: 9153913 - DNA, 22 bp, Homo sapiens
taagacataccaagttgtgtga

SEQ ID NO: 9153914 - DNA, 22 bp, Homo sapiens
taaaactgaatacatactgagg

SEQ ID NO: 9153915 - DNA, 22 bp, Homo sapiens
taaaactgcttggtatggtcta

SEQ ID NO: 9153916 - DNA, 22 bp, Homo sapiens
taaaactgcttggtatggtcta

SEQ ID NO: 9153917 - DNA, 22 bp, Homo sapiens
taaaactgaatacatactgagg

SEQ ID NO: 9153918 - DNA, 22 bp, Homo sapiens
taaaactgaatacatactgagg

SEQ ID NO: 9153919 - DNA, 22 bp, Homo sapiens
taaaactttgaaggtgctcagt

SEQ ID NO: 9153920 - DNA, 22 bp, Homo sapiens
taaaacttctcatttttatggt

SEQ ID NO: 9153921 - DNA, 21 bp, Homo sapiens
taaaactgtaactttgtcctg

SEQ ID NO: 9153922 - DNA, 21 bp, Homo sapiens
taaaactgtaactttgtcctg

SEQ ID NO: 9153923 - DNA, 22 bp, Homo sapiens
taaaacttaactatccagatta

SEQ ID NO: 9153924 - DNA, 22 bp, Homo sapiens
taaaagatatcttagggatttg

SEQ ID NO: 9153925 - DNA, 22 bp, Homo sapiens
taaaagatcactggctgcttta

SEQ ID NO: 9153926 - DNA, 22 bp, Homo sapiens
taaaagatcactggctgcttta

SEQ ID NO: 9153927 - DNA, 22 bp, Homo sapiens
taaaagagaatggataacagag

SEQ ID NO: 9153928 - DNA, 21 bp, Homo sapiens
taaaagatgacaagacagctc

SEQ ID NO: 9153929 - DNA, 21 bp, Homo sapiens
taaaagatgacaagacagctc

SEQ ID NO: 9153930 - DNA, 22 bp, Homo sapiens
taaaagaagcttcaaggccggc

SEQ ID NO: 9153931 - DNA, 22 bp, Homo sapiens
taaaagaagcttcaaggccggc

SEQ ID NO: 9153932 - DNA, 20 bp, Homo sapiens
taaagacataagctactatc

SEQ ID NO: 9153933 - DNA, 22 bp, Homo sapiens
taaagacagatggaccagccat

SEQ ID NO: 9153934 - DNA, 23 bp, Homo sapiens
taaagacagccttcaggattctg

SEQ ID NO: 9153935 - DNA, 22 bp, Homo sapiens
taaagacactggttttaatcat

SEQ ID NO: 9153936 - DNA, 22 bp, Homo sapiens
taaaaggattagcaggatgggc

SEQ ID NO: 9153937 - DNA, 22 bp, Homo sapiens
taaaaggcaatactagatgagt

SEQ ID NO: 9153938 - DNA, 22 bp, Homo sapiens
taaaaggcacttggatgctgag

SEQ ID NO: 9153939 - DNA, 19 bp, Homo sapiens
taaaaggatgtggaaggat

SEQ ID NO: 9153940 - DNA, 22 bp, Homo sapiens
taaaagattttataggaacaag

SEQ ID NO: 9153941 - DNA, 22 bp, Homo sapiens
taaaagattttataggaacaag

SEQ ID NO: 9153942 - DNA, 22 bp, Homo sapiens
taaaagctgagatatcctgtac

SEQ ID NO: 9153943 - DNA, 22 bp, Homo sapiens
taaaagctgagatatcctgtac

SEQ ID NO: 9153944 - DNA, 23 bp, Homo sapiens
taaagcaaagtcaagtgcactcc

SEQ ID NO: 9153945 - DNA, 22 bp, Homo sapiens
taaagcaaaaatgaactgccat

SEQ ID NO: 9153946 - DNA, 22 bp, Homo sapiens
taaagattgctcaaaactgtga

SEQ ID NO: 9153947 - DNA, 22 bp, Homo sapiens
taaagaccaaacacagtgcaga

SEQ ID NO: 9153948 - DNA, 19 bp, Homo sapiens
taaagagaataccggtggc

SEQ ID NO: 9153949 - DNA, 22 bp, Homo sapiens
taaagacatggtgtaggtgaac

SEQ ID NO: 9153950 - DNA, 22 bp, Homo sapiens
taaagcaatttgagcaagttct

SEQ ID NO: 9153951 - DNA, 22 bp, Homo sapiens
taaagcaattactcagtggctt

SEQ ID NO: 9153952 - DNA, 22 bp, Homo sapiens
taaagcaaggcaaattgttggt

SEQ ID NO: 9153953 - DNA, 22 bp, Homo sapiens
taaagcaatgaaagttttgcag

SEQ ID NO: 9153954 - DNA, 22 bp, Homo sapiens
taaagcaaggaatagagtagtc

SEQ ID NO: 9153955 - DNA, 22 bp, Homo sapiens
taaagcaagacacacccatagc

SEQ ID NO: 9153956 - DNA, 22 bp, Homo sapiens
taaagcaagacacacccatagc

SEQ ID NO: 9153957 - DNA, 22 bp, Homo sapiens
taaagcaagacacacccatagc

SEQ ID NO: 9153958 - DNA, 23 bp, Homo sapiens
taaagcaaagtcaagtgcactcc

SEQ ID NO: 9153959 - DNA, 20 bp, Homo sapiens
taaatgcatgaatgtaaggc

SEQ ID NO: 9153960 - DNA, 20 bp, Homo sapiens
taaatgcatgaatgtaaggc

SEQ ID NO: 9153961 - DNA, 22 bp, Homo sapiens
taaatgcagcagtttctgttct

SEQ ID NO: 9153962 - DNA, 22 bp, Homo sapiens
taaatgcaagggaaaggcaaga

SEQ ID NO: 9153963 - DNA, 22 bp, Homo sapiens
taaatgatttatgtatgtgaaa

SEQ ID NO: 9153964 - DNA, 22 bp, Homo sapiens
taaagcacatatcttacaataa

SEQ ID NO: 9153965 - DNA, 22 bp, Homo sapiens
taaagcacatatcttacaataa

SEQ ID NO: 9153966 - DNA, 22 bp, Homo sapiens
taaagcagccagggtctaagcc

SEQ ID NO: 9153967 - DNA, 22 bp, Homo sapiens
taaatgatttatgtatgtgaaa

SEQ ID NO: 9153968 - DNA, 22 bp, Homo sapiens
gtttcacagtctgcagaatttt

SEQ ID NO: 9153969 - DNA, 22 bp, Homo sapiens
gtttcacagtctgcagaatttt

SEQ ID NO: 9153970 - DNA, 22 bp, Homo sapiens
gtttcagaaatggtttatgcaa

SEQ ID NO: 9153971 - DNA, 22 bp, Homo sapiens
gtttcaatttgaatgcgaggct

SEQ ID NO: 9153972 - DNA, 22 bp, Homo sapiens
gtttcaaataggtttcagcaaa

SEQ ID NO: 9153973 - DNA, 22 bp, Homo sapiens
gtttcaaagtcagaaaaggagg

SEQ ID NO: 9153974 - DNA, 22 bp, Homo sapiens
gtttctttctattgactgaaca

SEQ ID NO: 9153975 - DNA, 22 bp, Homo sapiens
gtttcttatttcaactggaaca

SEQ ID NO: 9153976 - DNA, 22 bp, Homo sapiens
gtttcttagacagacattatct

SEQ ID NO: 9153977 - DNA, 22 bp, Homo sapiens
gtttcttttaaaatatgtagac

SEQ ID NO: 9153978 - DNA, 22 bp, Homo sapiens
gtttgaaaaaagcagtatgtaa

SEQ ID NO: 9153979 - DNA, 22 bp, Homo sapiens
gtttgaaaaaagcagtatgtaa

SEQ ID NO: 9153980 - DNA, 22 bp, Homo sapiens
gtttgtttatacaaaagatcct

SEQ ID NO: 9153981 - DNA, 22 bp, Homo sapiens
gtttgtttatacaaaagatcct

SEQ ID NO: 9153982 - DNA, 22 bp, Homo sapiens
gtttgtttatacaaaagatcct

SEQ ID NO: 9153983 - DNA, 22 bp, Homo sapiens
gtttgtttgtagggaagccgtg

SEQ ID NO: 9153984 - DNA, 22 bp, Homo sapiens
gtttgatttgatccggagagat

SEQ ID NO: 9153985 - DNA, 21 bp, Homo sapiens
gtttgacctaaggaaggattt

SEQ ID NO: 9153986 - DNA, 22 bp, Homo sapiens
gtttgattcaagaacaaagagt

SEQ ID NO: 9153987 - DNA, 22 bp, Homo sapiens
gtttgattcaagaacaaagagt

SEQ ID NO: 9153988 - DNA, 22 bp, Homo sapiens
gtttgcagggagagatgtggtg

SEQ ID NO: 9153989 - DNA, 22 bp, Homo sapiens
gtttgcatatttgcacaggaat

SEQ ID NO: 9153990 - DNA, 20 bp, Homo sapiens
gtttgaaatgattggttggt

SEQ ID NO: 9153991 - DNA, 22 bp, Homo sapiens
gtttgaaagtggcaagtccttg

SEQ ID NO: 9153992 - DNA, 22 bp, Homo sapiens
gtttgaaagaccaattagattt

SEQ ID NO: 9153993 - DNA, 22 bp, Homo sapiens
gtttgaaaaaagcagtatgtaa

SEQ ID NO: 9153994 - DNA, 22 bp, Homo sapiens
gtttgaaagaccaattagattt

SEQ ID NO: 9153995 - DNA, 22 bp, Homo sapiens
gttgaatacttgagaaatccat

SEQ ID NO: 9153996 - DNA, 22 bp, Homo sapiens
gttgaatatcccgtatcttaaa

SEQ ID NO: 9153997 - DNA, 21 bp, Homo sapiens
gttgaatatccatgtatgtgt

SEQ ID NO: 9153998 - DNA, 22 bp, Homo sapiens
gttgaatattttaagagttttg

SEQ ID NO: 9153999 - DNA, 22 bp, Homo sapiens
gttgaatatcgtgttcttgttt

SEQ ID NO: 9154000 - DNA, 22 bp, Homo sapiens
gttgacagaaaaataacatagc

SEQ ID NO: 9154001 - DNA, 22 bp, Homo sapiens
gttgaaatcctaaccccctagt

SEQ ID NO: 9154002 - DNA, 22 bp, Homo sapiens
gttgaaatgagggattaatcag

SEQ ID NO: 9154003 - DNA, 22 bp, Homo sapiens
gttgaaatcctaaccccctagt

SEQ ID NO: 9154004 - DNA, 22 bp, Homo sapiens
gttgaaatttgtgataatttag

SEQ ID NO: 9154005 - DNA, 22 bp, Homo sapiens
gttgaaaatgactttataccat

SEQ ID NO: 9154006 - DNA, 22 bp, Homo sapiens
gttcttctcttgtaatggaatc

SEQ ID NO: 9154007 - DNA, 21 bp, Homo sapiens
gttcttgcaggatttccttcc

SEQ ID NO: 9154008 - DNA, 21 bp, Homo sapiens
gttcttgcaggatttccttcc

SEQ ID NO: 9154009 - DNA, 22 bp, Homo sapiens
gttctttaggggcccaatttcc

SEQ ID NO: 9154010 - DNA, 19 bp, Homo sapiens
gttcttttcacctctgtgc

SEQ ID NO: 9154011 - DNA, 19 bp, Homo sapiens
gttcttttcacctctgtgc

SEQ ID NO: 9154012 - DNA, 22 bp, Homo sapiens
gttgaaaatacagattcctagg

SEQ ID NO: 9154013 - DNA, 22 bp, Homo sapiens
gttcttttggtagagtgtgcat

SEQ ID NO: 9154014 - DNA, 22 bp, Homo sapiens
gtttatattcaacggagtatct

SEQ ID NO: 9154015 - DNA, 22 bp, Homo sapiens
gtttatctagtgaagtgaagaa

SEQ ID NO: 9154016 - DNA, 22 bp, Homo sapiens
gtttatgaatgtgtcagacata

SEQ ID NO: 9154017 - DNA, 22 bp, Homo sapiens
gtttatgaatgttactatagag

SEQ ID NO: 9154018 - DNA, 22 bp, Homo sapiens
gtttattagagttttctgtctg

SEQ ID NO: 9154019 - DNA, 22 bp, Homo sapiens
gtttattagagttttctgtctg

SEQ ID NO: 9154020 - DNA, 22 bp, Homo sapiens
gtttattagagttttctgtctg

SEQ ID NO: 9154021 - DNA, 22 bp, Homo sapiens
gtttattaactgtcaagtgatt

SEQ ID NO: 9154022 - DNA, 22 bp, Homo sapiens
gtttattaactgtcaagtgatt

SEQ ID NO: 9154023 - DNA, 22 bp, Homo sapiens
gtttattaactgtcaagtgatt

SEQ ID NO: 9154024 - DNA, 22 bp, Homo sapiens
gtttattatacaacaaaagcta

SEQ ID NO: 9154025 - DNA, 22 bp, Homo sapiens
gtttcaaagcacagctcacatt

SEQ ID NO: 9154026 - DNA, 22 bp, Homo sapiens
gtttattatacaacaaaagcta

SEQ ID NO: 9154027 - DNA, 22 bp, Homo sapiens
gtttcaaagcacagctcacatt

SEQ ID NO: 9154028 - DNA, 22 bp, Homo sapiens
gtttattagagttttctgtctg

SEQ ID NO: 9154029 - DNA, 17 bp, Homo sapiens
gtgctggcctggggctc

SEQ ID NO: 9154030 - DNA, 17 bp, Homo sapiens
gtgctggcctggggctc

SEQ ID NO: 9154031 - DNA, 21 bp, Homo sapiens
gtgctgggacacagccaggct

SEQ ID NO: 9154032 - DNA, 21 bp, Homo sapiens
gtgctgggacacagccaggct

SEQ ID NO: 9154033 - DNA, 22 bp, Homo sapiens
gtgttctttatttagtgatgct

SEQ ID NO: 9154034 - DNA, 22 bp, Homo sapiens
gtgttgactcttggacttcaag

SEQ ID NO: 9154035 - DNA, 22 bp, Homo sapiens
gtgttggacagcttctactgtg

SEQ ID NO: 9154036 - DNA, 22 bp, Homo sapiens
gtgtttgctggagctctgggtc

SEQ ID NO: 9154037 - DNA, 22 bp, Homo sapiens
gtgtttcctcacttctctgact

SEQ ID NO: 9154038 - DNA, 20 bp, Homo sapiens
gtgtttcatgtgatacaatg

SEQ ID NO: 9154039 - DNA, 22 bp, Homo sapiens
gttaaataacctcatgtccgtt

SEQ ID NO: 9154040 - DNA, 18 bp, Homo sapiens
gttaacaattactaacgc

SEQ ID NO: 9154041 - DNA, 22 bp, Homo sapiens
gttataaatacctaataggatt

SEQ ID NO: 9154042 - DNA, 22 bp, Homo sapiens
gttataaatacctaataggatt

SEQ ID NO: 9154043 - DNA, 22 bp, Homo sapiens
gttatacatatgtgttaacaaa

SEQ ID NO: 9154044 - DNA, 22 bp, Homo sapiens
gttatacatatgtgttaacaaa

SEQ ID NO: 9154045 - DNA, 22 bp, Homo sapiens
gttatgtactttttaaatcttg

SEQ ID NO: 9154046 - DNA, 22 bp, Homo sapiens
gttatcatgcttcatcatcact

SEQ ID NO: 9154047 - DNA, 22 bp, Homo sapiens
gttatattggcagaagagaaga

SEQ ID NO: 9154048 - DNA, 22 bp, Homo sapiens
gttatttcagccacagagtgca

SEQ ID NO: 9154049 - DNA, 22 bp, Homo sapiens
gttctgctgtgtctcagcaggt

SEQ ID NO: 9154050 - DNA, 22 bp, Homo sapiens
gttctggaggagagcctggtgt

SEQ ID NO: 9154051 - DNA, 22 bp, Homo sapiens
gttcttcatcattaacactctg

SEQ ID NO: 9154052 - DNA, 22 bp, Homo sapiens
gttattgtccagcacagttggg

SEQ ID NO: 9154053 - DNA, 22 bp, Homo sapiens
gttatttataaggtgtaactcc

SEQ ID NO: 9154054 - DNA, 22 bp, Homo sapiens
gttattgtttatcctgcacccc

SEQ ID NO: 9154055 - DNA, 22 bp, Homo sapiens
gttattgtccatttatttagca

SEQ ID NO: 9154056 - DNA, 22 bp, Homo sapiens
gttatttaactttgtagcatgg

SEQ ID NO: 9154057 - DNA, 22 bp, Homo sapiens
gttattgtgtttgttcagggca

SEQ ID NO: 9154058 - DNA, 22 bp, Homo sapiens
tacaagatgtactaaaaattat

SEQ ID NO: 9154059 - DNA, 22 bp, Homo sapiens
tacaagataagaattggcaagg

SEQ ID NO: 9154060 - DNA, 22 bp, Homo sapiens
tacaagaggtatatagaaacag

SEQ ID NO: 9154061 - DNA, 22 bp, Homo sapiens
tacacaatctgtttttccattt

SEQ ID NO: 9154062 - DNA, 22 bp, Homo sapiens
tacacaactgacaaccattctg

SEQ ID NO: 9154063 - DNA, 22 bp, Homo sapiens
tacaagaaggaaaactagcaat

SEQ ID NO: 9154064 - DNA, 22 bp, Homo sapiens
taatttatttcaactgccaagg

SEQ ID NO: 9154065 - DNA, 22 bp, Homo sapiens
taatttatttcaactgccaagg

SEQ ID NO: 9154066 - DNA, 22 bp, Homo sapiens
tacaacataacgggcattcagt

SEQ ID NO: 9154067 - DNA, 22 bp, Homo sapiens
tacaacataacgggcattcagt

SEQ ID NO: 9154068 - DNA, 21 bp, Homo sapiens
taatttattcagcacagtgtt

SEQ ID NO: 9154069 - DNA, 22 bp, Homo sapiens
taatttatttcaactgccaagg

SEQ ID NO: 9154070 - DNA, 21 bp, Homo sapiens
taatttattcagcacagtgtt

SEQ ID NO: 9154071 - DNA, 22 bp, Homo sapiens
taatttatggtatgtgtgtaat

SEQ ID NO: 9154072 - DNA, 22 bp, Homo sapiens
taatttatgatgcaaagaaaag

SEQ ID NO: 9154073 - DNA, 22 bp, Homo sapiens
taatttatggtatgtgtgtaat

SEQ ID NO: 9154074 - DNA, 22 bp, Homo sapiens
taatttatggtatgtgtgtaat

SEQ ID NO: 9154075 - DNA, 22 bp, Homo sapiens
tacaagaaatttctgcatatat

SEQ ID NO: 9154076 - DNA, 22 bp, Homo sapiens
tacaacattgtgttgcttcata

SEQ ID NO: 9154077 - DNA, 22 bp, Homo sapiens
tacaacattgtgttgcttcata

SEQ ID NO: 9154078 - DNA, 22 bp, Homo sapiens
tacacataggagggtaataaaa

SEQ ID NO: 9154079 - DNA, 22 bp, Homo sapiens
tacacataggtctgaataaaaa

SEQ ID NO: 9154080 - DNA, 22 bp, Homo sapiens
tacagaattagattattagaga

SEQ ID NO: 9154081 - DNA, 22 bp, Homo sapiens
tacagacaaagagcatgcggta

SEQ ID NO: 9154082 - DNA, 22 bp, Homo sapiens
tacagaatgtgtatcattacca

SEQ ID NO: 9154083 - DNA, 20 bp, Homo sapiens
tacagaatgcaataaaatgg

SEQ ID NO: 9154084 - DNA, 22 bp, Homo sapiens
tacacaatgacttaagatgtca

SEQ ID NO: 9154085 - DNA, 22 bp, Homo sapiens
tacacaattctggatgcatgtc

SEQ ID NO: 9154086 - DNA, 22 bp, Homo sapiens
tacacacagaggccatgggatt

SEQ ID NO: 9154087 - DNA, 22 bp, Homo sapiens
tacacacttactggagatgaag

SEQ ID NO: 9154088 - DNA, 22 bp, Homo sapiens
tacacacatgcatttgccttat

SEQ ID NO: 9154089 - DNA, 22 bp, Homo sapiens
tacacatacaccaatgtggtca

SEQ ID NO: 9154090 - DNA, 22 bp, Homo sapiens
tacacatacattgcttacaagg

SEQ ID NO: 9154091 - DNA, 22 bp, Homo sapiens
taagcttcaaagaacatattgg

SEQ ID NO: 9154092 - DNA, 22 bp, Homo sapiens
taaggaaaatggacatcaaaca

SEQ ID NO: 9154093 - DNA, 22 bp, Homo sapiens
taagcctgtgcatgggcagatg

SEQ ID NO: 9154094 - DNA, 22 bp, Homo sapiens
taagcctggttcataatttgct

SEQ ID NO: 9154095 - DNA, 22 bp, Homo sapiens
taagctattcctgaagaaggtt

SEQ ID NO: 9154096 - DNA, 22 bp, Homo sapiens
taagccactagtctgttatgaa

SEQ ID NO: 9154097 - DNA, 22 bp, Homo sapiens
taagcattatggtaaagaagta

SEQ ID NO: 9154098 - DNA, 21 bp, Homo sapiens
taagccaccatgtgaaaccag

SEQ ID NO: 9154099 - DNA, 22 bp, Homo sapiens
taaggaaagtgccatgatttct

SEQ ID NO: 9154100 - DNA, 22 bp, Homo sapiens
taaggaaagtgccatgatttct

SEQ ID NO: 9154101 - DNA, 22 bp, Homo sapiens
taaggaaagtacatgttttgac

SEQ ID NO: 9154102 - DNA, 22 bp, Homo sapiens
taaggaaacaacttgtattttt

SEQ ID NO: 9154103 - DNA, 22 bp, Homo sapiens
taaggaaacaacttgtattttt

SEQ ID NO: 9154104 - DNA, 22 bp, Homo sapiens
taaggaaagtacatgttttgac

SEQ ID NO: 9154105 - DNA, 22 bp, Homo sapiens
taaggaaagtacatgttttgac

SEQ ID NO: 9154106 - DNA, 22 bp, Homo sapiens
taaggaaaatggacatcaaaca

SEQ ID NO: 9154107 - DNA, 22 bp, Homo sapiens
taaggaaaatggacatcaaaca

SEQ ID NO: 9154108 - DNA, 22 bp, Homo sapiens
taaggaaacaacttgtattttt

SEQ ID NO: 9154109 - DNA, 22 bp, Homo sapiens
taaggaagagcttggtaatagg

SEQ ID NO: 9154110 - DNA, 22 bp, Homo sapiens
taaggaaggggaaagacatgtc

SEQ ID NO: 9154111 - DNA, 22 bp, Homo sapiens
taaggaaagtgccatgatttct

SEQ ID NO: 9154112 - DNA, 22 bp, Homo sapiens
taaggaaagtgccatgatttct

SEQ ID NO: 9154113 - DNA, 22 bp, Homo sapiens
taaggaagtcacaagaatcgct

SEQ ID NO: 9154114 - DNA, 22 bp, Homo sapiens
taaggaagtcacaagaatcgct

SEQ ID NO: 9154115 - DNA, 18 bp, Homo sapiens
taaggaagggggtgaaga

SEQ ID NO: 9154116 - DNA, 22 bp, Homo sapiens
taaggaaggggaaagacatgtc

SEQ ID NO: 9154117 - DNA, 22 bp, Homo sapiens
taatatacttcccatagtttga

SEQ ID NO: 9154118 - DNA, 22 bp, Homo sapiens
taatatatacctttgttaggaa

SEQ ID NO: 9154119 - DNA, 22 bp, Homo sapiens
taatatatacctttgttaggaa

SEQ ID NO: 9154120 - DNA, 22 bp, Homo sapiens
taatagtttcataatgtgcttc

SEQ ID NO: 9154121 - DNA, 22 bp, Homo sapiens
taataggagccaggtcacatag

SEQ ID NO: 9154122 - DNA, 22 bp, Homo sapiens
taatataccaaactgtaatttt

SEQ ID NO: 9154123 - DNA, 22 bp, Homo sapiens
taaggagagaatttagaggttt

SEQ ID NO: 9154124 - DNA, 22 bp, Homo sapiens
taaggaatatcataagaagtag

SEQ ID NO: 9154125 - DNA, 22 bp, Homo sapiens
taaggaatagtgctatgaaaaa

SEQ ID NO: 9154126 - DNA, 22 bp, Homo sapiens
taaggattaaataagaatattt

SEQ ID NO: 9154127 - DNA, 22 bp, Homo sapiens
taatagttgtgactttgtaaag

SEQ ID NO: 9154128 - DNA, 22 bp, Homo sapiens
taatagttatggttggttctca

SEQ ID NO: 9154129 - DNA, 22 bp, Homo sapiens
taattgaaatcatttcaattca

SEQ ID NO: 9154130 - DNA, 21 bp, Homo sapiens
taattccagaggtcactgaag

SEQ ID NO: 9154131 - DNA, 22 bp, Homo sapiens
taattcctagaaattattctca

SEQ ID NO: 9154132 - DNA, 21 bp, Homo sapiens
taattccagaggtcactgaag

SEQ ID NO: 9154133 - DNA, 22 bp, Homo sapiens
taattccaagttgagacatgca

SEQ ID NO: 9154134 - DNA, 22 bp, Homo sapiens
taattatttgaagacattagag

SEQ ID NO: 9154135 - DNA, 22 bp, Homo sapiens
taattatttgaagacattagag

SEQ ID NO: 9154136 - DNA, 22 bp, Homo sapiens
taatttatgatgcaaagaaaag

SEQ ID NO: 9154137 - DNA, 22 bp, Homo sapiens
taatttatatggaattgttgct

SEQ ID NO: 9154138 - DNA, 22 bp, Homo sapiens
taatttatagaatttcttggat

SEQ ID NO: 9154139 - DNA, 22 bp, Homo sapiens
taatttatatggaattgttgct

SEQ ID NO: 9154140 - DNA, 22 bp, Homo sapiens
taatttatagaatttcttggat

SEQ ID NO: 9154141 - DNA, 22 bp, Homo sapiens
taattgctcgagaaataacctc

SEQ ID NO: 9154142 - DNA, 22 bp, Homo sapiens
taattgctcttggccgtgccag

SEQ ID NO: 9154143 - DNA, 22 bp, Homo sapiens
taattgcagggagcctgggggc

SEQ ID NO: 9154144 - DNA, 22 bp, Homo sapiens
taattgcagaactttgggaggc

SEQ ID NO: 9154145 - DNA, 22 bp, Homo sapiens
taattgaactaacatgcaaaca

SEQ ID NO: 9154146 - DNA, 22 bp, Homo sapiens
taattgaactaacatgcaaaca

SEQ ID NO: 9154147 - DNA, 22 bp, Homo sapiens
taattgaaatcatttcaattca

SEQ ID NO: 9154148 - DNA, 22 bp, Homo sapiens
taattattatgacaacaattgc

SEQ ID NO: 9154149 - DNA, 22 bp, Homo sapiens
taattattgtctgaagagttat

SEQ ID NO: 9154150 - DNA, 22 bp, Homo sapiens
taatctgtttcccaaggtgata

SEQ ID NO: 9154151 - DNA, 21 bp, Homo sapiens
taatcttcgaaaatgtattag

SEQ ID NO: 9154152 - DNA, 21 bp, Homo sapiens
taatcttcgaaaatgtattag

SEQ ID NO: 9154153 - DNA, 22 bp, Homo sapiens
taatctgttgttaatattgact

SEQ ID NO: 9154154 - DNA, 22 bp, Homo sapiens
taatctgtgtaccttcatcgga

SEQ ID NO: 9154155 - DNA, 22 bp, Homo sapiens
taatctgttgactaacttggga

SEQ ID NO: 9154156 - DNA, 22 bp, Homo sapiens
taatctgtattcctactttgca

SEQ ID NO: 9154157 - DNA, 22 bp, Homo sapiens
taatctgtaatttttgcaatag

SEQ ID NO: 9154158 - DNA, 22 bp, Homo sapiens
taatcctttaggttaaaagagg

SEQ ID NO: 9154159 - DNA, 22 bp, Homo sapiens
taatcctttatggttttcctcc

SEQ ID NO: 9154160 - DNA, 22 bp, Homo sapiens
taatccttcttgtgttcattag

SEQ ID NO: 9154161 - DNA, 22 bp, Homo sapiens
taatccttcttgtgttcattag

SEQ ID NO: 9154162 - DNA, 22 bp, Homo sapiens
taatccttgcttagtgtggggc

SEQ ID NO: 9154163 - DNA, 22 bp, Homo sapiens
taatcctgtgctgtgtaagtac

SEQ ID NO: 9154164 - DNA, 22 bp, Homo sapiens
taatcctggtgagtttgaaaaa

SEQ ID NO: 9154165 - DNA, 22 bp, Homo sapiens
taatcgtatgtgtatcaaatca

SEQ ID NO: 9154166 - DNA, 22 bp, Homo sapiens
taatctctagcccatgcaaaga

SEQ ID NO: 9154167 - DNA, 22 bp, Homo sapiens
taatctcttttaggacagagcc

SEQ ID NO: 9154168 - DNA, 22 bp, Homo sapiens
taatctatcaagcaacaaagtg

SEQ ID NO: 9154169 - DNA, 22 bp, Homo sapiens
taatatatttctgctaagctca

SEQ ID NO: 9154170 - DNA, 22 bp, Homo sapiens
taatatatttctgctaagctca

SEQ ID NO: 9154171 - DNA, 22 bp, Homo sapiens
taatccgtacattattctgaac

SEQ ID NO: 9154172 - DNA, 22 bp, Homo sapiens
taatcctgatcaattttagctt

SEQ ID NO: 9154173 - DNA, 22 bp, Homo sapiens
taatccagggtattctagtttc

SEQ ID NO: 9154174 - DNA, 22 bp, Homo sapiens
taatccaggtaagacataatag

SEQ ID NO: 9154175 - DNA, 22 bp, Homo sapiens
tacagtatggaaaatgtatagt

SEQ ID NO: 9154176 - DNA, 22 bp, Homo sapiens
tacagtatgttcttgaatttgg

SEQ ID NO: 9154177 - DNA, 22 bp, Homo sapiens
tacagtattactgtgttgtttt

SEQ ID NO: 9154178 - DNA, 22 bp, Homo sapiens
tacagtatgttcttgaatttgg

SEQ ID NO: 9154179 - DNA, 22 bp, Homo sapiens
tacagtatatactgtgtgtaga

SEQ ID NO: 9154180 - DNA, 22 bp, Homo sapiens
tacagtatatactgtgtgtaga

SEQ ID NO: 9154181 - DNA, 22 bp, Homo sapiens
tacagtatggaaaatgtatagt

SEQ ID NO: 9154182 - DNA, 22 bp, Homo sapiens
tacagagatgtgaaaagctcta

SEQ ID NO: 9154183 - DNA, 22 bp, Homo sapiens
tacagagatgccgaagagtgaa

SEQ ID NO: 9154184 - DNA, 22 bp, Homo sapiens
tacagacagtttttcagatatt

SEQ ID NO: 9154185 - DNA, 22 bp, Homo sapiens
tacagagatactctagatcaaa

SEQ ID NO: 9154186 - DNA, 22 bp, Homo sapiens
tacagagatactctagatcaaa

SEQ ID NO: 9154187 - DNA, 22 bp, Homo sapiens
tacagtgcatagaggcatgata

SEQ ID NO: 9154188 - DNA, 22 bp, Homo sapiens
tacagtgacctagaataaatac

SEQ ID NO: 9154189 - DNA, 22 bp, Homo sapiens
tacagtatttgaagaatatgag

SEQ ID NO: 9154190 - DNA, 22 bp, Homo sapiens
tacagtctctgataactgtcag

SEQ ID NO: 9154191 - DNA, 22 bp, Homo sapiens
taccaaatgtaatcattctaat

SEQ ID NO: 9154192 - DNA, 18 bp, Homo sapiens
taccaaaggctttctttt

SEQ ID NO: 9154193 - DNA, 22 bp, Homo sapiens
tacatgtatgtgttaatatctg

SEQ ID NO: 9154194 - DNA, 22 bp, Homo sapiens
tacatgtatgtgttaatatctg

SEQ ID NO: 9154195 - DNA, 22 bp, Homo sapiens
tacatgtatgtgttaatatctg

SEQ ID NO: 9154196 - DNA, 22 bp, Homo sapiens
tacatgtatgtgttaatatctg

SEQ ID NO: 9154197 - DNA, 22 bp, Homo sapiens
tacatgtatgtgtacgtgcatg

SEQ ID NO: 9154198 - DNA, 22 bp, Homo sapiens
tacatgtatgtgttaatatctg

SEQ ID NO: 9154199 - DNA, 22 bp, Homo sapiens
tacatgtacatgcataggtaga

SEQ ID NO: 9154200 - DNA, 22 bp, Homo sapiens
tacatgtaattttcatagtaag

SEQ ID NO: 9154201 - DNA, 22 bp, Homo sapiens
tacatgtacatgcataggtaga

SEQ ID NO: 9154202 - DNA, 22 bp, Homo sapiens
tacatgtaattttcatagtaag

SEQ ID NO: 9154203 - DNA, 22 bp, Homo sapiens
tacatgtacatgcataggtaga

SEQ ID NO: 9154204 - DNA, 22 bp, Homo sapiens
tacatgtaagacatgagactct

SEQ ID NO: 9154205 - DNA, 22 bp, Homo sapiens
tacatgtaagacatgagactct

SEQ ID NO: 9154206 - DNA, 22 bp, Homo sapiens
tacatgtaattttcatagtaag

SEQ ID NO: 9154207 - DNA, 23 bp, Homo sapiens
tacatgctataatttcaccctca

SEQ ID NO: 9154208 - DNA, 22 bp, Homo sapiens
tacatgctcagtaactttcagt

SEQ ID NO: 9154209 - DNA, 22 bp, Homo sapiens
tacatgctccactttctcctgt

SEQ ID NO: 9154210 - DNA, 22 bp, Homo sapiens
tacatgcatgtcacagaatgaa

SEQ ID NO: 9154211 - DNA, 22 bp, Homo sapiens
tacatgcatgtgtgtaaatata

SEQ ID NO: 9154212 - DNA, 22 bp, Homo sapiens
tacatgcattggatggcaatag

SEQ ID NO: 9154213 - DNA, 22 bp, Homo sapiens
tacatgcaatgaggattctagt

SEQ ID NO: 9154214 - DNA, 22 bp, Homo sapiens
tacatgcaaggatatttgtgcg

SEQ ID NO: 9154215 - DNA, 22 bp, Homo sapiens
tacatgcaattaagagggtgaa

SEQ ID NO: 9154216 - DNA, 19 bp, Homo sapiens
tacatgcagcaggcacgca

SEQ ID NO: 9154217 - DNA, 19 bp, Homo sapiens
tacatgcacatgtgcgtgc

SEQ ID NO: 9154218 - DNA, 22 bp, Homo sapiens
tacatgcacatgaacatgtgtg

SEQ ID NO: 9154219 - DNA, 22 bp, Homo sapiens
tacatgcatacttgtgtgtgta

SEQ ID NO: 9154220 - DNA, 18 bp, Homo sapiens
tacatgcataaatgaagc

SEQ ID NO: 9154221 - DNA, 22 bp, Homo sapiens
tacatgcatgatacaaagttgc

SEQ ID NO: 9154222 - DNA, 22 bp, Homo sapiens
tacatgaatgtttcaatattgt

SEQ ID NO: 9154223 - DNA, 22 bp, Homo sapiens
tacatgaagaaaattaagcagt

SEQ ID NO: 9154224 - DNA, 22 bp, Homo sapiens
tacatgaagaaaattaagcagt

SEQ ID NO: 9154225 - DNA, 21 bp, Homo sapiens
tactacagtctctttatcagt

SEQ ID NO: 9154226 - DNA, 23 bp, Homo sapiens
tactacagggtcttgctatgaat

SEQ ID NO: 9154227 - DNA, 22 bp, Homo sapiens
taccatttgagagagaacataa

SEQ ID NO: 9154228 - DNA, 22 bp, Homo sapiens
taccatttctacatatcttgtc

SEQ ID NO: 9154229 - DNA, 22 bp, Homo sapiens
tactacaagggccctaaaaggt

SEQ ID NO: 9154230 - DNA, 22 bp, Homo sapiens
tactacaagggccctaaaaggt

SEQ ID NO: 9154231 - DNA, 22 bp, Homo sapiens
tactacaaggccgaagctctca

SEQ ID NO: 9154232 - DNA, 22 bp, Homo sapiens
tactccacacgctattataatg

SEQ ID NO: 9154233 - DNA, 23 bp, Homo sapiens
tactataacgctgtgtcagctcc

SEQ ID NO: 9154234 - DNA, 22 bp, Homo sapiens
tactagttctcatatgaaataa

SEQ ID NO: 9154235 - DNA, 22 bp, Homo sapiens
tactaggaagcagctgcattgg

SEQ ID NO: 9154236 - DNA, 22 bp, Homo sapiens
tactagaaattaccttctcact

SEQ ID NO: 9154237 - DNA, 22 bp, Homo sapiens
tactagaagctgtaatttttca

SEQ ID NO: 9154238 - DNA, 20 bp, Homo sapiens
taccatcatatgcatttaat

SEQ ID NO: 9154239 - DNA, 22 bp, Homo sapiens
taccatgagaatactaagagag

SEQ ID NO: 9154240 - DNA, 19 bp, Homo sapiens
taccatccaagctggtttg

SEQ ID NO: 9154241 - DNA, 22 bp, Homo sapiens
taccatttacttgaaaataaaa

SEQ ID NO: 9154242 - DNA, 19 bp, Homo sapiens
taccatgttgactttcctg

SEQ ID NO: 9154243 - DNA, 22 bp, Homo sapiens
taccatgtcttcaataagtcta

SEQ ID NO: 9154244 - DNA, 22 bp, Homo sapiens
taccatgtcttcaataagtcta

SEQ ID NO: 9154245 - DNA, 22 bp, Homo sapiens
taccagcctgaccctgtctgac

SEQ ID NO: 9154246 - DNA, 22 bp, Homo sapiens
taccagcctctgttgggggtgg

SEQ ID NO: 9154247 - DNA, 22 bp, Homo sapiens
taccagccttttaacatgggcc

SEQ ID NO: 9154248 - DNA, 22 bp, Homo sapiens
taccagcctgaccctgtctgac

SEQ ID NO: 9154249 - DNA, 22 bp, Homo sapiens
taccagcctcagttgtgagccc

SEQ ID NO: 9154250 - DNA, 22 bp, Homo sapiens
taccagcaatgtatgagtgttt

SEQ ID NO: 9154251 - DNA, 22 bp, Homo sapiens
taccaggaatggggtcaccgtc

SEQ ID NO: 9154252 - DNA, 20 bp, Homo sapiens
taccacttatttgaataatt

SEQ ID NO: 9154253 - DNA, 22 bp, Homo sapiens
taccactggcaggccactacta

SEQ ID NO: 9154254 - DNA, 22 bp, Homo sapiens
taccactgctccctgcctgtga

SEQ ID NO: 9154255 - DNA, 22 bp, Homo sapiens
taccactgataccttggagttc

SEQ ID NO: 9154256 - DNA, 22 bp, Homo sapiens
taccagcaactggaagtcagat

SEQ ID NO: 9154257 - DNA, 22 bp, Homo sapiens
taccagcaatgctagtcaactc

SEQ ID NO: 9154258 - DNA, 22 bp, Homo sapiens
taccaatgataagacagataat

SEQ ID NO: 9154259 - DNA, 22 bp, Homo sapiens
taccacagtttatctattcagc

SEQ ID NO: 9154260 - DNA, 22 bp, Homo sapiens
tacttacagaaggaagcaattg

SEQ ID NO: 9154261 - DNA, 22 bp, Homo sapiens
tacttacactgaagcaaagata

SEQ ID NO: 9154262 - DNA, 22 bp, Homo sapiens
tacttacatgaattcaagagca

SEQ ID NO: 9154263 - DNA, 22 bp, Homo sapiens
tacttacagagcttataagtta

SEQ ID NO: 9154264 - DNA, 22 bp, Homo sapiens
tacttaaaactgatagaatctc

SEQ ID NO: 9154265 - DNA, 22 bp, Homo sapiens
tacttacacagctgtagaaggt

SEQ ID NO: 9154266 - DNA, 22 bp, Homo sapiens
tactgttagagcgatttgtcct

SEQ ID NO: 9154267 - DNA, 22 bp, Homo sapiens
tactgttacagggagtgttcaa

SEQ ID NO: 9154268 - DNA, 22 bp, Homo sapiens
tactgttttctttatagtacag

SEQ ID NO: 9154269 - DNA, 22 bp, Homo sapiens
tacttaaaaattatcaaagtgg

SEQ ID NO: 9154270 - DNA, 22 bp, Homo sapiens
tactctaaaaagaagcagatct

SEQ ID NO: 9154271 - DNA, 22 bp, Homo sapiens
tactctggaaaacagaaagttg

SEQ ID NO: 9154272 - DNA, 22 bp, Homo sapiens
tactgaaactcttgtaaatatc

SEQ ID NO: 9154273 - DNA, 22 bp, Homo sapiens
tactgaaagaatacataatttc

SEQ ID NO: 9154274 - DNA, 22 bp, Homo sapiens
tactgtactgcagttctgcaaa

SEQ ID NO: 9154275 - DNA, 22 bp, Homo sapiens
tactgtactcaacatgtgagtt

SEQ ID NO: 9154276 - DNA, 22 bp, Homo sapiens
tactgtactcaacatgtgagtt

SEQ ID NO: 9154277 - DNA, 22 bp, Homo sapiens
tactgtgtgcccagccgagctg

SEQ ID NO: 9154278 - DNA, 22 bp, Homo sapiens
tactgtgtgcccagccgagctg

SEQ ID NO: 9154279 - DNA, 18 bp, Homo sapiens
tcagacaagttagacagg

SEQ ID NO: 9154280 - DNA, 22 bp, Homo sapiens
tcagaattgattttcaaaacag

SEQ ID NO: 9154281 - DNA, 22 bp, Homo sapiens
tcagaatggacccagactatag

SEQ ID NO: 9154282 - DNA, 22 bp, Homo sapiens
tcagaatgggccttcctgtccc

SEQ ID NO: 9154283 - DNA, 22 bp, Homo sapiens
tcagaatgtggagagctgccct

SEQ ID NO: 9154284 - DNA, 22 bp, Homo sapiens
tcagaatgttcctgctgtcagt

SEQ ID NO: 9154285 - DNA, 22 bp, Homo sapiens
tcagaatgtgcagaggaacagt

SEQ ID NO: 9154286 - DNA, 22 bp, Homo sapiens
tcagagttctctgtccagatga

SEQ ID NO: 9154287 - DNA, 22 bp, Homo sapiens
tcagatggaatgatgccactgc

SEQ ID NO: 9154288 - DNA, 22 bp, Homo sapiens
tcagatggaaaggttactgtcc

SEQ ID NO: 9154289 - DNA, 22 bp, Homo sapiens
tcagatggaggcaatgttacct

SEQ ID NO: 9154290 - DNA, 22 bp, Homo sapiens
tcagatggattcattacatgac

SEQ ID NO: 9154291 - DNA, 22 bp, Homo sapiens
tcagatggcataggttggaatt

SEQ ID NO: 9154292 - DNA, 22 bp, Homo sapiens
tcagatggatttatactatttc

SEQ ID NO: 9154293 - DNA, 22 bp, Homo sapiens
tcagatggcacacagagcctgc

SEQ ID NO: 9154294 - DNA, 22 bp, Homo sapiens
tcagatggcacacagagcctgc

SEQ ID NO: 9154295 - DNA, 22 bp, Homo sapiens
tcagatttactgcagagcagat

SEQ ID NO: 9154296 - DNA, 22 bp, Homo sapiens
tcagatgggttttgaaggatgt

SEQ ID NO: 9154297 - DNA, 20 bp, Homo sapiens
tcagatgggagtgagccatc

SEQ ID NO: 9154298 - DNA, 22 bp, Homo sapiens
tcagatggtactaatttaagga

SEQ ID NO: 9154299 - DNA, 22 bp, Homo sapiens
tcagatggttccatcatttttc

SEQ ID NO: 9154300 - DNA, 22 bp, Homo sapiens
tcagatggtcattcactagggt

SEQ ID NO: 9154301 - DNA, 22 bp, Homo sapiens
tcagatttccttgcagtttgga

SEQ ID NO: 9154302 - DNA, 22 bp, Homo sapiens
tcagcaaaggcaattcattatt

SEQ ID NO: 9154303 - DNA, 22 bp, Homo sapiens
tcagcaaaggcaattcattatt

SEQ ID NO: 9154304 - DNA, 22 bp, Homo sapiens
tcagcaggcagaaatctgcaga

SEQ ID NO: 9154305 - DNA, 22 bp, Homo sapiens
tcagcaggcccatcctccaggc

SEQ ID NO: 9154306 - DNA, 22 bp, Homo sapiens
tcagcaggcccatcctccaggc

SEQ ID NO: 9154307 - DNA, 22 bp, Homo sapiens
tcagcaggcaggaggcatgcca

SEQ ID NO: 9154308 - DNA, 22 bp, Homo sapiens
tcagcaggcaggaggcatgcca

SEQ ID NO: 9154309 - DNA, 22 bp, Homo sapiens
tcagcaggcaggaggcatgcca

SEQ ID NO: 9154310 - DNA, 22 bp, Homo sapiens
tcagcaggcagtgggtcacaat

SEQ ID NO: 9154311 - DNA, 22 bp, Homo sapiens
tcagcaggctgtcagcaggggc

SEQ ID NO: 9154312 - DNA, 22 bp, Homo sapiens
tcagcaggctgtcagcaggggc

SEQ ID NO: 9154313 - DNA, 22 bp, Homo sapiens
tcagcaggcggttccttgtggg

SEQ ID NO: 9154314 - DNA, 22 bp, Homo sapiens
tcagcaggcggttccttgtggg

SEQ ID NO: 9154315 - DNA, 22 bp, Homo sapiens
tcagcaggctctggttgaccat

SEQ ID NO: 9154316 - DNA, 22 bp, Homo sapiens
tcagcagggccatgctctctct

SEQ ID NO: 9154317 - DNA, 22 bp, Homo sapiens
tcagcagggccatgctctctct

SEQ ID NO: 9154318 - DNA, 22 bp, Homo sapiens
tcagcagggcatactgagccta

SEQ ID NO: 9154319 - DNA, 22 bp, Homo sapiens
tcagcagggcatactgagccta

SEQ ID NO: 9154320 - DNA, 22 bp, Homo sapiens
tcagcagggaggctctgtgccc

SEQ ID NO: 9154321 - DNA, 22 bp, Homo sapiens
tcagcagggaggctctgtgccc

SEQ ID NO: 9154322 - DNA, 22 bp, Homo sapiens
tcagcagggaggctctgtgccc

SEQ ID NO: 9154323 - DNA, 22 bp, Homo sapiens
tcagcagggaggctctgtgccc

SEQ ID NO: 9154324 - DNA, 22 bp, Homo sapiens
tcagcagggagaggagaatgca

SEQ ID NO: 9154325 - DNA, 22 bp, Homo sapiens
tcagcagggctgtggtgtggct

SEQ ID NO: 9154326 - DNA, 22 bp, Homo sapiens
tcagcagggctgtggtgtggct

SEQ ID NO: 9154327 - DNA, 22 bp, Homo sapiens
tcagcagggctgggagctgtga

SEQ ID NO: 9154328 - DNA, 22 bp, Homo sapiens
tcagcagggctgggagctgtga

SEQ ID NO: 9154329 - DNA, 22 bp, Homo sapiens
tcagcagggcctccttgtgcag

SEQ ID NO: 9154330 - DNA, 22 bp, Homo sapiens
tcagcagggcctccttgtgcag

SEQ ID NO: 9154331 - DNA, 22 bp, Homo sapiens
tcagcaggggccgttgggtgga

SEQ ID NO: 9154332 - DNA, 22 bp, Homo sapiens
tcagcaggggccgttgggtgga

SEQ ID NO: 9154333 - DNA, 17 bp, Homo sapiens
tcagcaggggccaagct

SEQ ID NO: 9154334 - DNA, 22 bp, Homo sapiens
tcagcagggctgtggtgtggct

SEQ ID NO: 9154335 - DNA, 22 bp, Homo sapiens
tcagccaggcacaatggcagct

SEQ ID NO: 9154336 - DNA, 22 bp, Homo sapiens
tcagccaggcacaatggcagct

SEQ ID NO: 9154337 - DNA, 20 bp, Homo sapiens
tcagccagctaacatgggga

SEQ ID NO: 9154338 - DNA, 22 bp, Homo sapiens
tcagctgctcaaatttatgtca

SEQ ID NO: 9154339 - DNA, 22 bp, Homo sapiens
tcagctgctctgttgagctgaa

SEQ ID NO: 9154340 - DNA, 22 bp, Homo sapiens
tcagctgccccgggcactgccc

SEQ ID NO: 9154341 - DNA, 22 bp, Homo sapiens
tcagctgccccgggcactgccc

SEQ ID NO: 9154342 - DNA, 22 bp, Homo sapiens
tcagctgccccgggcactgccc

SEQ ID NO: 9154343 - DNA, 20 bp, Homo sapiens
tcagcatgctcctcagacat

SEQ ID NO: 9154344 - DNA, 22 bp, Homo sapiens
tcagcattctttacaaggatga

SEQ ID NO: 9154345 - DNA, 22 bp, Homo sapiens
tcagcattcctgaagacaagca

SEQ ID NO: 9154346 - DNA, 22 bp, Homo sapiens
tcagcatgttcttaggtcacag

SEQ ID NO: 9154347 - DNA, 22 bp, Homo sapiens
tcagcatgttcttaggtcacag

SEQ ID NO: 9154348 - DNA, 20 bp, Homo sapiens
tcagcatgctcctcagacat

SEQ ID NO: 9154349 - DNA, 22 bp, Homo sapiens
tcagccagaggcttcttggttt

SEQ ID NO: 9154350 - DNA, 22 bp, Homo sapiens
tcagccagaggtggatgagtca

SEQ ID NO: 9154351 - DNA, 22 bp, Homo sapiens
tcagccagcatcagctaagtgc

SEQ ID NO: 9154352 - DNA, 22 bp, Homo sapiens
tcagccaagcgtaggatattgg

SEQ ID NO: 9154353 - DNA, 22 bp, Homo sapiens
tcagccaagctgtgagagagta

SEQ ID NO: 9154354 - DNA, 22 bp, Homo sapiens
tcagccaagcagccatcatctg

SEQ ID NO: 9154355 - DNA, 22 bp, Homo sapiens
tcagccaagaagggaactggtc

SEQ ID NO: 9154356 - DNA, 22 bp, Homo sapiens
tcagcattgtggcagagaatgg

SEQ ID NO: 9154357 - DNA, 22 bp, Homo sapiens
tcagcattgtggcagagaatgg

SEQ ID NO: 9154358 - DNA, 22 bp, Homo sapiens
tcaggacatttgtcagcaggag

SEQ ID NO: 9154359 - DNA, 22 bp, Homo sapiens
tcaggactagacatgaggaagg

SEQ ID NO: 9154360 - DNA, 19 bp, Homo sapiens
tcaggactgacttgaagtc

SEQ ID NO: 9154361 - DNA, 22 bp, Homo sapiens
tcaggacagttccctgcaaatt

SEQ ID NO: 9154362 - DNA, 22 bp, Homo sapiens
tcaggacagccagggtgcagac

SEQ ID NO: 9154363 - DNA, 22 bp, Homo sapiens
tcaggacagggatcacatcatc

SEQ ID NO: 9154364 - DNA, 22 bp, Homo sapiens
tcaggacaggttcgggtgggta

SEQ ID NO: 9154365 - DNA, 22 bp, Homo sapiens
tcaggacagagatcagaacttc

SEQ ID NO: 9154366 - DNA, 22 bp, Homo sapiens
tcaggacagactagactagcgt

SEQ ID NO: 9154367 - DNA, 22 bp, Homo sapiens
tcaggacagccagggtgcagac

SEQ ID NO: 9154368 - DNA, 22 bp, Homo sapiens
tcaggacagaaggctgccaggg

SEQ ID NO: 9154369 - DNA, 22 bp, Homo sapiens
tcaggacagaaggctgccaggg

SEQ ID NO: 9154370 - DNA, 22 bp, Homo sapiens
tcaggacagactagactagcgt

SEQ ID NO: 9154371 - DNA, 22 bp, Homo sapiens
tcaggacacttggcacaaggtc

SEQ ID NO: 9154372 - DNA, 22 bp, Homo sapiens
tcaggacaccctgtgcttcctt

SEQ ID NO: 9154373 - DNA, 22 bp, Homo sapiens
tcaggacaccctgtgcttcctt

SEQ ID NO: 9154374 - DNA, 22 bp, Homo sapiens
tcaggacaatagtgatttttac

SEQ ID NO: 9154375 - DNA, 22 bp, Homo sapiens
tcaggacaacatgttgctaatc

SEQ ID NO: 9154376 - DNA, 22 bp, Homo sapiens
tcaggacaacaagacttgttta

SEQ ID NO: 9154377 - DNA, 22 bp, Homo sapiens
tcaggacaacctgttttcagac

SEQ ID NO: 9154378 - DNA, 22 bp, Homo sapiens
tcaggacaacctgttttcagac

SEQ ID NO: 9154379 - DNA, 18 bp, Homo sapiens
tcagctggggctgcagcc

SEQ ID NO: 9154380 - DNA, 22 bp, Homo sapiens
tcagctgggaagttctcgcttg

SEQ ID NO: 9154381 - DNA, 22 bp, Homo sapiens
tcagctggggccccctctgtcc

SEQ ID NO: 9154382 - DNA, 22 bp, Homo sapiens
tcagctggcaggttctgggaag

SEQ ID NO: 9154383 - DNA, 22 bp, Homo sapiens
tcagctggaagatggtgcagaa

SEQ ID NO: 9154384 - DNA, 23 bp, Homo sapiens
tcagctgcttcctcctgcctgcc

SEQ ID NO: 9154385 - DNA, 22 bp, Homo sapiens
tcagctggagactgctcaatga

SEQ ID NO: 9154386 - DNA, 22 bp, Homo sapiens
tcagctggaagatggtgcagaa

SEQ ID NO: 9154387 - DNA, 22 bp, Homo sapiens
tcagctggaagatggtgcagaa

SEQ ID NO: 9154388 - DNA, 22 bp, Homo sapiens
tcagctggagatccttgttgtg

SEQ ID NO: 9154389 - DNA, 22 bp, Homo sapiens
tcagctggtgagtggatagaca

SEQ ID NO: 9154390 - DNA, 22 bp, Homo sapiens
tcagctggtgaatggactcatc

SEQ ID NO: 9154391 - DNA, 18 bp, Homo sapiens
tcagctggggctgcagcc

SEQ ID NO: 9154392 - DNA, 22 bp, Homo sapiens
tcaggaagggtggtccacaggg

SEQ ID NO: 9154393 - DNA, 22 bp, Homo sapiens
tcaggaagggctcagtctgtgc

SEQ ID NO: 9154394 - DNA, 22 bp, Homo sapiens
tcaggaagggctcagtctgtgc

SEQ ID NO: 9154395 - DNA, 22 bp, Homo sapiens
tcaggaagggtggtccacaggg

SEQ ID NO: 9154396 - DNA, 22 bp, Homo sapiens
tcagaaaccccaacaatggaga

SEQ ID NO: 9154397 - DNA, 22 bp, Homo sapiens
tcagaaaccccaacaatggaga

SEQ ID NO: 9154398 - DNA, 22 bp, Homo sapiens
tcagaaactaaatgtggatttg

SEQ ID NO: 9154399 - DNA, 22 bp, Homo sapiens
tcagaaagaacacaggcagtag

SEQ ID NO: 9154400 - DNA, 22 bp, Homo sapiens
tcagaaagctatatggtgtgtc

SEQ ID NO: 9154401 - DNA, 22 bp, Homo sapiens
tcagaaagctatatggtgtgtc

SEQ ID NO: 9154402 - DNA, 22 bp, Homo sapiens
tcagaaagctatatggtgtgtc

SEQ ID NO: 9154403 - DNA, 22 bp, Homo sapiens
tcagaaagcttagtgtcttgca

SEQ ID NO: 9154404 - DNA, 22 bp, Homo sapiens
tcagaaagcttagtgtcttgca

SEQ ID NO: 9154405 - DNA, 22 bp, Homo sapiens
tcagaaagctgattcttgatac

SEQ ID NO: 9154406 - DNA, 22 bp, Homo sapiens
tcagaaagctgattcttgatac

SEQ ID NO: 9154407 - DNA, 22 bp, Homo sapiens
tcagaacaattgggaaccatta

SEQ ID NO: 9154408 - DNA, 22 bp, Homo sapiens
tcagaaaggagttagaggtctc

SEQ ID NO: 9154409 - DNA, 22 bp, Homo sapiens
tcagaaagcttttacttaaaca

SEQ ID NO: 9154410 - DNA, 22 bp, Homo sapiens
tcagaacaattcctttataaca

SEQ ID NO: 9154411 - DNA, 22 bp, Homo sapiens
tcagaaaggttgagtcatgtgc

SEQ ID NO: 9154412 - DNA, 22 bp, Homo sapiens
tcagaaaggttctatgttttac

SEQ ID NO: 9154413 - DNA, 22 bp, Homo sapiens
tcagaatatgctaatgacattt

SEQ ID NO: 9154414 - DNA, 22 bp, Homo sapiens
tcagaatgaaatttctttcaga

SEQ ID NO: 9154415 - DNA, 22 bp, Homo sapiens
tcagaatctgcatttaacaaaa

SEQ ID NO: 9154416 - DNA, 19 bp, Homo sapiens
tcagaatgactactcatgt

SEQ ID NO: 9154417 - DNA, 23 bp, Homo sapiens
tcagaataataacctagtaactg

SEQ ID NO: 9154418 - DNA, 23 bp, Homo sapiens
tcagaataataacctagtaactg

SEQ ID NO: 9154419 - DNA, 22 bp, Homo sapiens
tcagaataagttatgaaatgaa

SEQ ID NO: 9154420 - DNA, 22 bp, Homo sapiens
tcagaacagcgagaatattcac

SEQ ID NO: 9154421 - DNA, 22 bp, Homo sapiens
tcagaacaggactggctgccat

SEQ ID NO: 9154422 - DNA, 22 bp, Homo sapiens
tcagaacagctctcagatatcc

SEQ ID NO: 9154423 - DNA, 22 bp, Homo sapiens
tcagaacaggttgtactatgtc

SEQ ID NO: 9154424 - DNA, 22 bp, Homo sapiens
tcactgattatgaaaatgaagg

SEQ ID NO: 9154425 - DNA, 22 bp, Homo sapiens
tcactgcaacctccacctcccg

SEQ ID NO: 9154426 - DNA, 22 bp, Homo sapiens
tcactgctcagtctgtactaca

SEQ ID NO: 9154427 - DNA, 22 bp, Homo sapiens
tcagaaaataactgttagtttg

SEQ ID NO: 9154428 - DNA, 22 bp, Homo sapiens
tcaactcatgttattctgtgaa

SEQ ID NO: 9154429 - DNA, 22 bp, Homo sapiens
tcaactttgaaaccatagtgaa

SEQ ID NO: 9154430 - DNA, 22 bp, Homo sapiens
tcaagaaactgtgctacagagt

SEQ ID NO: 9154431 - DNA, 22 bp, Homo sapiens
tcaagaaactgtgctacagagt

SEQ ID NO: 9154432 - DNA, 22 bp, Homo sapiens
tcaactgcaagtttgcttagtt

SEQ ID NO: 9154433 - DNA, 22 bp, Homo sapiens
tcaagaaagggcttcaccagga

SEQ ID NO: 9154434 - DNA, 22 bp, Homo sapiens
tcaagaaatgtgcttggatata

SEQ ID NO: 9154435 - DNA, 22 bp, Homo sapiens
tcaagaaggagactccactgtg

SEQ ID NO: 9154436 - DNA, 22 bp, Homo sapiens
tcaacagacatttttaagcact

SEQ ID NO: 9154437 - DNA, 22 bp, Homo sapiens
tcaacagaagtgatagctatta

SEQ ID NO: 9154438 - DNA, 22 bp, Homo sapiens
tcaacacttttgtctttgtccc

SEQ ID NO: 9154439 - DNA, 22 bp, Homo sapiens
tcaacacttgctggtttcctct

SEQ ID NO: 9154440 - DNA, 22 bp, Homo sapiens
tcaacattcatatatagccaca

SEQ ID NO: 9154441 - DNA, 22 bp, Homo sapiens
tcaaccacagtcccatgtctcc

SEQ ID NO: 9154442 - DNA, 22 bp, Homo sapiens
tcaacaatgggtctgtaatgga

SEQ ID NO: 9154443 - DNA, 22 bp, Homo sapiens
tcaacacaacagagaaatgctg

SEQ ID NO: 9154444 - DNA, 22 bp, Homo sapiens
tcaacaagaataccatcctcct

SEQ ID NO: 9154445 - DNA, 22 bp, Homo sapiens
tcaacaagcattggtggtaaaa

SEQ ID NO: 9154446 - DNA, 22 bp, Homo sapiens
tcaacaagtatttttcaaggct

SEQ ID NO: 9154447 - DNA, 22 bp, Homo sapiens
tcaacaataggatatagcaggt

SEQ ID NO: 9154448 - DNA, 22 bp, Homo sapiens
tcaaatgagtgactcacacagg

SEQ ID NO: 9154449 - DNA, 22 bp, Homo sapiens
tcaaatgagtgactcacacagg

SEQ ID NO: 9154450 - DNA, 22 bp, Homo sapiens
tcaaatgaggctgatgaatgtg

SEQ ID NO: 9154451 - DNA, 22 bp, Homo sapiens
tcacattgctcccatagtggat

SEQ ID NO: 9154452 - DNA, 22 bp, Homo sapiens
tcacattgccgtctgtgcactt

SEQ ID NO: 9154453 - DNA, 22 bp, Homo sapiens
tcacatactgaaagtccagtga

SEQ ID NO: 9154454 - DNA, 22 bp, Homo sapiens
tcacatgctactgagccagacc

SEQ ID NO: 9154455 - DNA, 18 bp, Homo sapiens
tcacagtgctcttgccta

SEQ ID NO: 9154456 - DNA, 22 bp, Homo sapiens
tcacagtgagccatgtcagaga

SEQ ID NO: 9154457 - DNA, 22 bp, Homo sapiens
tcacataaatttaccagatgat

SEQ ID NO: 9154458 - DNA, 22 bp, Homo sapiens
tcacataaattatacaatttca

SEQ ID NO: 9154459 - DNA, 22 bp, Homo sapiens
tcacatacactaggatattttt

SEQ ID NO: 9154460 - DNA, 23 bp, Homo sapiens
tcacataatccttcatccacagg

SEQ ID NO: 9154461 - DNA, 22 bp, Homo sapiens
tcagtattcctggaaatacaag

SEQ ID NO: 9154462 - DNA, 22 bp, Homo sapiens
tcagtccttggaggattctctt

SEQ ID NO: 9154463 - DNA, 22 bp, Homo sapiens
tcagtgttctggatttggggca

SEQ ID NO: 9154464 - DNA, 22 bp, Homo sapiens
tcagtgttgtgcacatacaaaa

SEQ ID NO: 9154465 - DNA, 22 bp, Homo sapiens
tcataaagttacccaaatttta

SEQ ID NO: 9154466 - DNA, 22 bp, Homo sapiens
tcagttaatggattctgtcaga

SEQ ID NO: 9154467 - DNA, 22 bp, Homo sapiens
tcataaatcatactccatttgc

SEQ ID NO: 9154468 - DNA, 22 bp, Homo sapiens
tcataaatcatactccatttgc

SEQ ID NO: 9154469 - DNA, 23 bp, Homo sapiens
tcataaatattagcacagtagga

SEQ ID NO: 9154470 - DNA, 22 bp, Homo sapiens
tcataaatcatactccatttgc

SEQ ID NO: 9154471 - DNA, 23 bp, Homo sapiens
tcataaatattagcacagtagga

SEQ ID NO: 9154472 - DNA, 23 bp, Homo sapiens
tcataaatattagcacagtagga

SEQ ID NO: 9154473 - DNA, 22 bp, Homo sapiens
tcagtgttttccagggtctact

SEQ ID NO: 9154474 - DNA, 22 bp, Homo sapiens
tcagttaatatgggtaaagcat

SEQ ID NO: 9154475 - DNA, 22 bp, Homo sapiens
tcatgcagaggaaggctagttt

SEQ ID NO: 9154476 - DNA, 22 bp, Homo sapiens
tcatgcagagtagaaagggcaa

SEQ ID NO: 9154477 - DNA, 22 bp, Homo sapiens
tcatgaaaaattttccatgtca

SEQ ID NO: 9154478 - DNA, 22 bp, Homo sapiens
tcatctttcctcaaaagatcca

SEQ ID NO: 9154479 - DNA, 22 bp, Homo sapiens
tcatctttgtatccctaacaca

SEQ ID NO: 9154480 - DNA, 22 bp, Homo sapiens
tcatctttaccccttgcttcaa

SEQ ID NO: 9154481 - DNA, 22 bp, Homo sapiens
tcatcttgctgccattgcttta

SEQ ID NO: 9154482 - DNA, 22 bp, Homo sapiens
tcatctgtttctctgtagttct

SEQ ID NO: 9154483 - DNA, 22 bp, Homo sapiens
tcatctgtgaataatgaactgg

SEQ ID NO: 9154484 - DNA, 23 bp, Homo sapiens
tcatctgtaagtatctgtggagt

SEQ ID NO: 9154485 - DNA, 23 bp, Homo sapiens
tcatctgtaacagcctatgaaat

SEQ ID NO: 9154486 - DNA, 23 bp, Homo sapiens
tcatctgtaacagcctatgaaat

SEQ ID NO: 9154487 - DNA, 22 bp, Homo sapiens
tcatctgtcaaattgcaataag

SEQ ID NO: 9154488 - DNA, 22 bp, Homo sapiens
tcatctgtcatccacaaagctg

SEQ ID NO: 9154489 - DNA, 22 bp, Homo sapiens
tcatagaagtagtatccacatt

SEQ ID NO: 9154490 - DNA, 22 bp, Homo sapiens
tcatagatgtgctgtgcacaaa

SEQ ID NO: 9154491 - DNA, 22 bp, Homo sapiens
tcataaatgcagtgtcataaat

SEQ ID NO: 9154492 - DNA, 22 bp, Homo sapiens
tcataaattagctgtctttgaa

SEQ ID NO: 9154493 - DNA, 21 bp, Homo sapiens
tcagtaaacctaaagattgta

SEQ ID NO: 9154494 - DNA, 22 bp, Homo sapiens
tcagtaaaattacagatctaca

SEQ ID NO: 9154495 - DNA, 22 bp, Homo sapiens
tcagtagcagaaagcaatgagt

SEQ ID NO: 9154496 - DNA, 22 bp, Homo sapiens
tcagtagtcttgggccgacttg

SEQ ID NO: 9154497 - DNA, 22 bp, Homo sapiens
tcagggctgcagaagaggcagg

SEQ ID NO: 9154498 - DNA, 22 bp, Homo sapiens
tcagggctgcagaagaggcagg

SEQ ID NO: 9154499 - DNA, 22 bp, Homo sapiens
tcagggctgcatacaggagata

SEQ ID NO: 9154500 - DNA, 22 bp, Homo sapiens
tcagggctgcatacaggagata

SEQ ID NO: 9154501 - DNA, 22 bp, Homo sapiens
tcagggctgcatacaggagata

SEQ ID NO: 9154502 - DNA, 22 bp, Homo sapiens
tcagggctcaccagcctctgcc

SEQ ID NO: 9154503 - DNA, 22 bp, Homo sapiens
tcagggctcaccagcctctgcc

SEQ ID NO: 9154504 - DNA, 22 bp, Homo sapiens
tcagggctcaccagcctctgcc

SEQ ID NO: 9154505 - DNA, 22 bp, Homo sapiens
tcagggctcaccagcctctgcc

SEQ ID NO: 9154506 - DNA, 22 bp, Homo sapiens
tcagggctcagcatctggcatt

SEQ ID NO: 9154507 - DNA, 22 bp, Homo sapiens
tcagggctcagcatctggcatt

SEQ ID NO: 9154508 - DNA, 22 bp, Homo sapiens
tcagggctccggaagtggcctc

SEQ ID NO: 9154509 - DNA, 22 bp, Homo sapiens
tcagggctgactgctactctcc

SEQ ID NO: 9154510 - DNA, 22 bp, Homo sapiens
tcagggccgccggggatctcgc

SEQ ID NO: 9154511 - DNA, 22 bp, Homo sapiens
tcaggctgttagccacctcctc

SEQ ID NO: 9154512 - DNA, 22 bp, Homo sapiens
tcaggcttcactcctgtccaag

SEQ ID NO: 9154513 - DNA, 22 bp, Homo sapiens
tcaggctttgaagtctagctgg

SEQ ID NO: 9154514 - DNA, 22 bp, Homo sapiens
tcaggcttccaacaatgatgtt

SEQ ID NO: 9154515 - DNA, 22 bp, Homo sapiens
tcagggcaggcgagcagctgct

SEQ ID NO: 9154516 - DNA, 22 bp, Homo sapiens
tcaggctttgctctgttgattt

SEQ ID NO: 9154517 - DNA, 22 bp, Homo sapiens
tcaggagacttatgtcacagtg

SEQ ID NO: 9154518 - DNA, 17 bp, Homo sapiens
tcaggctgggtgcagtg

SEQ ID NO: 9154519 - DNA, 17 bp, Homo sapiens
tcaggctgggtgcagtg

SEQ ID NO: 9154520 - DNA, 22 bp, Homo sapiens
tcaggctggtccccacagtgga

SEQ ID NO: 9154521 - DNA, 17 bp, Homo sapiens
tcaggctgggtgcagtg

SEQ ID NO: 9154522 - DNA, 22 bp, Homo sapiens
tcaggctggtccccacagtgga

SEQ ID NO: 9154523 - DNA, 22 bp, Homo sapiens
tcaggctggtggtcagatggct

SEQ ID NO: 9154524 - DNA, 22 bp, Homo sapiens
tcaggctggtggtcagatggct

SEQ ID NO: 9154525 - DNA, 22 bp, Homo sapiens
tcaggctgtaaatggtgtgggt

SEQ ID NO: 9154526 - DNA, 22 bp, Homo sapiens
tcaggctgtaaatggtgtgggt

SEQ ID NO: 9154527 - DNA, 19 bp, Homo sapiens
tcatttacggttttgatga

SEQ ID NO: 9154528 - DNA, 22 bp, Homo sapiens
tcatttacatgtctttctctga

SEQ ID NO: 9154529 - DNA, 22 bp, Homo sapiens
tcatttacatagaaacaatata

SEQ ID NO: 9154530 - DNA, 22 bp, Homo sapiens
tcatttatagctaaccttgaat

SEQ ID NO: 9154531 - DNA, 22 bp, Homo sapiens
tcatttatagctaaccttgaat

SEQ ID NO: 9154532 - DNA, 22 bp, Homo sapiens
tcatttatagaagtgggcagta

SEQ ID NO: 9154533 - DNA, 22 bp, Homo sapiens
tcatttatattgtattctgtag

SEQ ID NO: 9154534 - DNA, 22 bp, Homo sapiens
tcatttataaggatgcaattaa

SEQ ID NO: 9154535 - DNA, 22 bp, Homo sapiens
tcatttatagaagtgggcagta

SEQ ID NO: 9154536 - DNA, 22 bp, Homo sapiens
tcattgttttgattccttcatg

SEQ ID NO: 9154537 - DNA, 22 bp, Homo sapiens
tcattgttgcgttaatgtcttc

SEQ ID NO: 9154538 - DNA, 22 bp, Homo sapiens
tcatttacaggtgaagcaacta

SEQ ID NO: 9154539 - DNA, 22 bp, Homo sapiens
tcattgccatggcatttgcaga

SEQ ID NO: 9154540 - DNA, 22 bp, Homo sapiens
tcattgctggctctggagtatg

SEQ ID NO: 9154541 - DNA, 22 bp, Homo sapiens
tcattggtaattatttttgaca

SEQ ID NO: 9154542 - DNA, 22 bp, Homo sapiens
tcattgtatactttatttatga

SEQ ID NO: 9154543 - DNA, 22 bp, Homo sapiens
tcattgtattcagaactgaaga

SEQ ID NO: 9154544 - DNA, 22 bp, Homo sapiens
tcattgtattaaaatattggtt

SEQ ID NO: 9154545 - DNA, 22 bp, Homo sapiens
tcattgtagggcatttagagag

SEQ ID NO: 9154546 - DNA, 22 bp, Homo sapiens
tcattgtatactttatttatga

SEQ ID NO: 9154547 - DNA, 22 bp, Homo sapiens
tcattgtagggcatttagagag

SEQ ID NO: 9154548 - DNA, 22 bp, Homo sapiens
tcatgcaggtttccagccagat

SEQ ID NO: 9154549 - DNA, 22 bp, Homo sapiens
tcatgcaggacttacgagagat

SEQ ID NO: 9154550 - DNA, 22 bp, Homo sapiens
tcatgcaggtttccagccagat

SEQ ID NO: 9154551 - DNA, 22 bp, Homo sapiens
tcatttatattgtattctgtag

SEQ ID NO: 9154552 - DNA, 22 bp, Homo sapiens
tcatttatattgtattctgtag

SEQ ID NO: 9154553 - DNA, 22 bp, Homo sapiens
tcatttatcatttgtgctgtag

SEQ ID NO: 9154554 - DNA, 22 bp, Homo sapiens
tcatttatcatttgtgctgtag

SEQ ID NO: 9154555 - DNA, 23 bp, Homo sapiens
tcatttcaggttgcatggtacca

SEQ ID NO: 9154556 - DNA, 22 bp, Homo sapiens
tcatttcagttcagaggccttt

SEQ ID NO: 9154557 - DNA, 23 bp, Homo sapiens
tcatttcatccagccttgagagt

SEQ ID NO: 9154558 - DNA, 22 bp, Homo sapiens
tcatttctatctatgcagcttc

SEQ ID NO: 9154559 - DNA, 22 bp, Homo sapiens
tcatttctccgacctgctgtcc

SEQ ID NO: 9154560 - DNA, 22 bp, Homo sapiens
tcatttctccgacctgctgtcc

SEQ ID NO: 9154561 - DNA, 22 bp, Homo sapiens
tcatttctcccggccaaaaact

SEQ ID NO: 9154562 - DNA, 22 bp, Homo sapiens
tcatttctattgctactgtctg

SEQ ID NO: 9154563 - DNA, 22 bp, Homo sapiens
tcatttctattgctactgtctg

SEQ ID NO: 9154564 - DNA, 22 bp, Homo sapiens
tcatttctcccggccaaaaact

SEQ ID NO: 9154565 - DNA, 22 bp, Homo sapiens
tcatttctcccggccaaaaact

SEQ ID NO: 9154566 - DNA, 22 bp, Homo sapiens
tcatttctcctaagtgaaatat

SEQ ID NO: 9154567 - DNA, 22 bp, Homo sapiens
tcatttctctgagtctgataat

SEQ ID NO: 9154568 - DNA, 22 bp, Homo sapiens
tcatttctgttgtgcatcactg

SEQ ID NO: 9154569 - DNA, 22 bp, Homo sapiens
tcatttctgagccttccatgat

SEQ ID NO: 9154570 - DNA, 22 bp, Homo sapiens
tcatttcttaactagagtgaac

SEQ ID NO: 9154571 - DNA, 22 bp, Homo sapiens
tcatttcttaactagagtgaac

SEQ ID NO: 9154572 - DNA, 20 bp, Homo sapiens
tcatttcttggggttccaag

SEQ ID NO: 9154573 - DNA, 22 bp, Homo sapiens
tcatttggaagcctgagagtgt

SEQ ID NO: 9154574 - DNA, 22 bp, Homo sapiens
tccaatcatgagtctatactag

SEQ ID NO: 9154575 - DNA, 22 bp, Homo sapiens
tccaatcagggaaagccaggtc

SEQ ID NO: 9154576 - DNA, 22 bp, Homo sapiens
tccaatcagctcctatgagaat

SEQ ID NO: 9154577 - DNA, 22 bp, Homo sapiens
tccaatcaattgttctacctga

SEQ ID NO: 9154578 - DNA, 22 bp, Homo sapiens
tccaatcaactctggactcctg

SEQ ID NO: 9154579 - DNA, 22 bp, Homo sapiens
tccaatgttcctgctttcagct

SEQ ID NO: 9154580 - DNA, 22 bp, Homo sapiens
tccaatgttccagggtaaatgt

SEQ ID NO: 9154581 - DNA, 22 bp, Homo sapiens
tccaatgttcctgctttcagct

SEQ ID NO: 9154582 - DNA, 22 bp, Homo sapiens
tccaatggggcctctctgtcag

SEQ ID NO: 9154583 - DNA, 22 bp, Homo sapiens
tccaatgtgtttgtggcatgga

SEQ ID NO: 9154584 - DNA, 22 bp, Homo sapiens
tccaatgtgactatcagggagc

SEQ ID NO: 9154585 - DNA, 23 bp, Homo sapiens
tccaattcaattgggtcaggaag

SEQ ID NO: 9154586 - DNA, 22 bp, Homo sapiens
tccaagggttcatgtgcattca

SEQ ID NO: 9154587 - DNA, 23 bp, Homo sapiens
tccaaggttgttgtggaaggggc

SEQ ID NO: 9154588 - DNA, 23 bp, Homo sapiens
tccaaggttgttgtggaaggggc

SEQ ID NO: 9154589 - DNA, 22 bp, Homo sapiens
tccaagggctttggcgtgaagt

SEQ ID NO: 9154590 - DNA, 23 bp, Homo sapiens
tccaagggctacaaacacagacc

SEQ ID NO: 9154591 - DNA, 22 bp, Homo sapiens
tccaagggctcatggacacttt

SEQ ID NO: 9154592 - DNA, 22 bp, Homo sapiens
tccaagggcatgctgaaataag

SEQ ID NO: 9154593 - DNA, 22 bp, Homo sapiens
tccaaggcctggcagcacaaag

SEQ ID NO: 9154594 - DNA, 22 bp, Homo sapiens
tccaagggaaactgcacttcta

SEQ ID NO: 9154595 - DNA, 22 bp, Homo sapiens
tccaagggcagcagccatagcc

SEQ ID NO: 9154596 - DNA, 22 bp, Homo sapiens
tccaagggaatgtgggcaatgc

SEQ ID NO: 9154597 - DNA, 22 bp, Homo sapiens
tccaagggcaacaatggaacac

SEQ ID NO: 9154598 - DNA, 22 bp, Homo sapiens
tccaagggaatttaaagttgct

SEQ ID NO: 9154599 - DNA, 22 bp, Homo sapiens
tccaaggactaaattctagatt

SEQ ID NO: 9154600 - DNA, 22 bp, Homo sapiens
tccaaggagtcttaagttacat

SEQ ID NO: 9154601 - DNA, 22 bp, Homo sapiens
tccaaggaggagctggagattg

SEQ ID NO: 9154602 - DNA, 22 bp, Homo sapiens
tccaaggaggctttgacgtcca

SEQ ID NO: 9154603 - DNA, 22 bp, Homo sapiens
tccaaggagcagatccagagga

SEQ ID NO: 9154604 - DNA, 22 bp, Homo sapiens
tccaaggactcttgtcagctgt

SEQ ID NO: 9154605 - DNA, 22 bp, Homo sapiens
tccaaggagcagatccagagga

SEQ ID NO: 9154606 - DNA, 22 bp, Homo sapiens
tccaaatattcggtctttctga

SEQ ID NO: 9154607 - DNA, 22 bp, Homo sapiens
tccaaatattcatctacttctg

SEQ ID NO: 9154608 - DNA, 18 bp, Homo sapiens
tccaaaatcatgtatttt

SEQ ID NO: 9154609 - DNA, 22 bp, Homo sapiens
tccaaacgggagccaaatgagc

SEQ ID NO: 9154610 - DNA, 22 bp, Homo sapiens
tccaaacgggagccaaatgagc

SEQ ID NO: 9154611 - DNA, 19 bp, Homo sapiens
tccaaagaagttcacattt

SEQ ID NO: 9154612 - DNA, 22 bp, Homo sapiens
tccaaagcagacagggggcgta

SEQ ID NO: 9154613 - DNA, 22 bp, Homo sapiens
tccaaagaggattcagggacct

SEQ ID NO: 9154614 - DNA, 22 bp, Homo sapiens
tccaaagcatttggctcccacc

SEQ ID NO: 9154615 - DNA, 22 bp, Homo sapiens
tccaaagcatctgagtgtgcat

SEQ ID NO: 9154616 - DNA, 22 bp, Homo sapiens
tccaaagccccatgcactttct

SEQ ID NO: 9154617 - DNA, 16 bp, Homo sapiens
tccaaagcccgacttc

SEQ ID NO: 9154618 - DNA, 18 bp, Homo sapiens
tccaaagccagagaagtt

SEQ ID NO: 9154619 - DNA, 22 bp, Homo sapiens
tccaaaggggcagtgtccagcc

SEQ ID NO: 9154620 - DNA, 18 bp, Homo sapiens
tccaaaggtcccctccca

SEQ ID NO: 9154621 - DNA, 22 bp, Homo sapiens
tccaaaggccctaataagcttg

SEQ ID NO: 9154622 - DNA, 22 bp, Homo sapiens
tccaaagtaatttcacttctgt

SEQ ID NO: 9154623 - DNA, 22 bp, Homo sapiens
tccaaaggaagaggctgtcagt

SEQ ID NO: 9154624 - DNA, 22 bp, Homo sapiens
tccaaagccgactgacatctga

SEQ ID NO: 9154625 - DNA, 22 bp, Homo sapiens
tccaaagccgactgacatctga

SEQ ID NO: 9154626 - DNA, 21 bp, Homo sapiens
tccaaaggagactgagtgtgt

SEQ ID NO: 9154627 - DNA, 22 bp, Homo sapiens
tccaaatatacagaatctcctc

SEQ ID NO: 9154628 - DNA, 22 bp, Homo sapiens
tcatttgtggaagtgattgtgg

SEQ ID NO: 9154629 - DNA, 22 bp, Homo sapiens
tcatttgtacttgtgtgcttgt

SEQ ID NO: 9154630 - DNA, 22 bp, Homo sapiens
tcatttgtaccattttttaaga

SEQ ID NO: 9154631 - DNA, 21 bp, Homo sapiens
tcatttttattgctaccttgc

SEQ ID NO: 9154632 - DNA, 21 bp, Homo sapiens
tcatttttattgctaccttgc

SEQ ID NO: 9154633 - DNA, 22 bp, Homo sapiens
tcatttttcacacagggtcacc

SEQ ID NO: 9154634 - DNA, 22 bp, Homo sapiens
tcatttgttcatctgctcttct

SEQ ID NO: 9154635 - DNA, 22 bp, Homo sapiens
tccaaaaaacgtttgaatagtt

SEQ ID NO: 9154636 - DNA, 22 bp, Homo sapiens
tcatttttgaccatgggtagga

SEQ ID NO: 9154637 - DNA, 22 bp, Homo sapiens
tcatttttgtctccggtttgtg

SEQ ID NO: 9154638 - DNA, 22 bp, Homo sapiens
tcattttttgcatacctgtgtc

SEQ ID NO: 9154639 - DNA, 22 bp, Homo sapiens
tcattttttgcatacctgtgtc

SEQ ID NO: 9154640 - DNA, 22 bp, Homo sapiens
tcatttttctcttacacgtaga

SEQ ID NO: 9154641 - DNA, 22 bp, Homo sapiens
tcatttttctcttacacgtaga

SEQ ID NO: 9154642 - DNA, 22 bp, Homo sapiens
tcatttttctcttacacgtaga

SEQ ID NO: 9154643 - DNA, 22 bp, Homo sapiens
tcctcaaagttgtataaatatt

SEQ ID NO: 9154644 - DNA, 22 bp, Homo sapiens
tcctcaaatatttacttactga

SEQ ID NO: 9154645 - DNA, 22 bp, Homo sapiens
tcctcagaagaacccctagatt

SEQ ID NO: 9154646 - DNA, 22 bp, Homo sapiens
tcctcagaaacccctgtgaggt

SEQ ID NO: 9154647 - DNA, 22 bp, Homo sapiens
tcctcagaaacccctgtgaggt

SEQ ID NO: 9154648 - DNA, 22 bp, Homo sapiens
tcctcagaatcacctggcagct

SEQ ID NO: 9154649 - DNA, 22 bp, Homo sapiens
tcctcagaatggatggcagggg

SEQ ID NO: 9154650 - DNA, 22 bp, Homo sapiens
tcctcacagctggttcattcag

SEQ ID NO: 9154651 - DNA, 19 bp, Homo sapiens
tcctcaggggctcacagac

SEQ ID NO: 9154652 - DNA, 22 bp, Homo sapiens
tcctcaggggtttcaggtgtac

SEQ ID NO: 9154653 - DNA, 22 bp, Homo sapiens
tcctcagcatggaatctggact

SEQ ID NO: 9154654 - DNA, 23 bp, Homo sapiens
tcctcagcatgttttgtcatgta

SEQ ID NO: 9154655 - DNA, 22 bp, Homo sapiens
tcctcagcaggtctgtgtacca

SEQ ID NO: 9154656 - DNA, 22 bp, Homo sapiens
tcctcagacttccctttgtgta

SEQ ID NO: 9154657 - DNA, 22 bp, Homo sapiens
tcctcagagatgggcatctaag

SEQ ID NO: 9154658 - DNA, 22 bp, Homo sapiens
tcctcagagatgggcatctaag

SEQ ID NO: 9154659 - DNA, 22 bp, Homo sapiens
tcctcagagatgggcatctaag

SEQ ID NO: 9154660 - DNA, 22 bp, Homo sapiens
tcctcagagcatagcgctgtct

SEQ ID NO: 9154661 - DNA, 22 bp, Homo sapiens
tcctcagatataaatgagggtg

SEQ ID NO: 9154662 - DNA, 22 bp, Homo sapiens
tcctagagagtaatacagtttt

SEQ ID NO: 9154663 - DNA, 22 bp, Homo sapiens
tcctagaataatctttgactgc

SEQ ID NO: 9154664 - DNA, 22 bp, Homo sapiens
tcctagaatagtgtgtctggag

SEQ ID NO: 9154665 - DNA, 22 bp, Homo sapiens
tccctgggactcagacatggaa

SEQ ID NO: 9154666 - DNA, 22 bp, Homo sapiens
tccctgggacggccttttggag

SEQ ID NO: 9154667 - DNA, 22 bp, Homo sapiens
tccgtatttgactattgcaccg

SEQ ID NO: 9154668 - DNA, 22 bp, Homo sapiens
tccggtccgggtactcctctct

SEQ ID NO: 9154669 - DNA, 22 bp, Homo sapiens
tccgtgttctccagagataatc

SEQ ID NO: 9154670 - DNA, 22 bp, Homo sapiens
tccgttgacactgcatggagat

SEQ ID NO: 9154671 - DNA, 22 bp, Homo sapiens
tccgttctctaggagaaacttc

SEQ ID NO: 9154672 - DNA, 22 bp, Homo sapiens
tccgttgagtcagcttcggacc

SEQ ID NO: 9154673 - DNA, 22 bp, Homo sapiens
tccgttgacttggaagccctga

SEQ ID NO: 9154674 - DNA, 22 bp, Homo sapiens
tccgttgacagggcacttgaca

SEQ ID NO: 9154675 - DNA, 22 bp, Homo sapiens
tcctaaaggctgcttttatatt

SEQ ID NO: 9154676 - DNA, 19 bp, Homo sapiens
tccctggcgcctctcgggc

SEQ ID NO: 9154677 - DNA, 22 bp, Homo sapiens
tccctggcagctgtcctttcag

SEQ ID NO: 9154678 - DNA, 22 bp, Homo sapiens
tccctggccattcctctaggcc

SEQ ID NO: 9154679 - DNA, 22 bp, Homo sapiens
tccctggccattcctctaggcc

SEQ ID NO: 9154680 - DNA, 22 bp, Homo sapiens
tccctggctgtgttcaggtgcg

SEQ ID NO: 9154681 - DNA, 22 bp, Homo sapiens
tccctgggaacaaaggatgaga

SEQ ID NO: 9154682 - DNA, 22 bp, Homo sapiens
tccctggaggtgtttgctcagg

SEQ ID NO: 9154683 - DNA, 20 bp, Homo sapiens
tccctggaggtggtggcatc

SEQ ID NO: 9154684 - DNA, 22 bp, Homo sapiens
tccctggcagctgtcctttcag

SEQ ID NO: 9154685 - DNA, 22 bp, Homo sapiens
tccctggacaacagacttcact

SEQ ID NO: 9154686 - DNA, 23 bp, Homo sapiens
tccctggaggcaggtccagggcc

SEQ ID NO: 9154687 - DNA, 22 bp, Homo sapiens
tcccctttgtaagatggaaacg

SEQ ID NO: 9154688 - DNA, 22 bp, Homo sapiens
tcccctttgtcttcctgtgggt

SEQ ID NO: 9154689 - DNA, 22 bp, Homo sapiens
tcccagggactggatgatgcag

SEQ ID NO: 9154690 - DNA, 22 bp, Homo sapiens
tcccagggacccagcctgatac

SEQ ID NO: 9154691 - DNA, 22 bp, Homo sapiens
tcccagggactctctgccttcc

SEQ ID NO: 9154692 - DNA, 22 bp, Homo sapiens
tcccagggactctctgccttcc

SEQ ID NO: 9154693 - DNA, 22 bp, Homo sapiens
tcccagggacaccaagctgttt

SEQ ID NO: 9154694 - DNA, 22 bp, Homo sapiens
tcccagggacccagcctgatac

SEQ ID NO: 9154695 - DNA, 22 bp, Homo sapiens
tcccagggacccagcctgatac

SEQ ID NO: 9154696 - DNA, 22 bp, Homo sapiens
tccctcagatgagctcctagca

SEQ ID NO: 9154697 - DNA, 22 bp, Homo sapiens
tcccagggacaccaagctgttt

SEQ ID NO: 9154698 - DNA, 22 bp, Homo sapiens
tcccagggacaccaagctgttt

SEQ ID NO: 9154699 - DNA, 22 bp, Homo sapiens
tcccagggacaccaagctgttt

SEQ ID NO: 9154700 - DNA, 23 bp, Homo sapiens
tcccagggaaggtgagcgaggct

SEQ ID NO: 9154701 - DNA, 23 bp, Homo sapiens
tcccagggaaggtgagcgaggct

SEQ ID NO: 9154702 - DNA, 20 bp, Homo sapiens
tcccaggctgggctccagct

SEQ ID NO: 9154703 - DNA, 22 bp, Homo sapiens
tcccaggctaggcctctgcgtt

SEQ ID NO: 9154704 - DNA, 22 bp, Homo sapiens
tcccaggctaccagtgaggtca

SEQ ID NO: 9154705 - DNA, 22 bp, Homo sapiens
tccctgagaaagcccaggaggt

SEQ ID NO: 9154706 - DNA, 22 bp, Homo sapiens
tccctgaaatttgaagaggaat

SEQ ID NO: 9154707 - DNA, 22 bp, Homo sapiens
tccctgagactctggagtgtaa

SEQ ID NO: 9154708 - DNA, 22 bp, Homo sapiens
tccctctgtgttgggcatgcct

SEQ ID NO: 9154709 - DNA, 22 bp, Homo sapiens
tccctgaaacatctctgtggat

SEQ ID NO: 9154710 - DNA, 22 bp, Homo sapiens
tccctgaaacatctctgtggat

SEQ ID NO: 9154711 - DNA, 22 bp, Homo sapiens
tccctgaaatttgaagaggaat

SEQ ID NO: 9154712 - DNA, 22 bp, Homo sapiens
tccctgaatctcgaactagcct

SEQ ID NO: 9154713 - DNA, 22 bp, Homo sapiens
tccctgaagccagggaaggaag

SEQ ID NO: 9154714 - DNA, 22 bp, Homo sapiens
tccctgaaccactagtgatgag

SEQ ID NO: 9154715 - DNA, 22 bp, Homo sapiens
tccctctgctagtgcttgagct

SEQ ID NO: 9154716 - DNA, 22 bp, Homo sapiens
tccctctgctagtgcttgagct

SEQ ID NO: 9154717 - DNA, 22 bp, Homo sapiens
tccctctggtcctcggtggaga

SEQ ID NO: 9154718 - DNA, 22 bp, Homo sapiens
tccctctgggctggagcagggt

SEQ ID NO: 9154719 - DNA, 22 bp, Homo sapiens
tccctcagcttgtctccatgca

SEQ ID NO: 9154720 - DNA, 23 bp, Homo sapiens
tccctcaggccttatctccatct

SEQ ID NO: 9154721 - DNA, 22 bp, Homo sapiens
tccctcagtccctggacaggca

SEQ ID NO: 9154722 - DNA, 22 bp, Homo sapiens
tccctcagtccctggacaggca

SEQ ID NO: 9154723 - DNA, 22 bp, Homo sapiens
tccctccacacctgctggtacc

SEQ ID NO: 9154724 - DNA, 19 bp, Homo sapiens
tccctcagtctgccaggcc

SEQ ID NO: 9154725 - DNA, 19 bp, Homo sapiens
tccctcagtctgccaggcc

SEQ ID NO: 9154726 - DNA, 22 bp, Homo sapiens
tccctccccacttctgagcttt

SEQ ID NO: 9154727 - DNA, 22 bp, Homo sapiens
tccctccaggcagctgggtact

SEQ ID NO: 9154728 - DNA, 22 bp, Homo sapiens
tccctccccacttctgagcttt

SEQ ID NO: 9154729 - DNA, 22 bp, Homo sapiens
tcccagagcagtactccaggag

SEQ ID NO: 9154730 - DNA, 22 bp, Homo sapiens
tcccagagcagtactccaggag

SEQ ID NO: 9154731 - DNA, 22 bp, Homo sapiens
tcccagagcagtactccaggag

SEQ ID NO: 9154732 - DNA, 22 bp, Homo sapiens
tcccagagcagatgtgctaaag

SEQ ID NO: 9154733 - DNA, 22 bp, Homo sapiens
tcccagagacagagcctcctcc

SEQ ID NO: 9154734 - DNA, 22 bp, Homo sapiens
tcccagagaagagctggatgga

SEQ ID NO: 9154735 - DNA, 22 bp, Homo sapiens
tcccagagacatcatttctccg

SEQ ID NO: 9154736 - DNA, 22 bp, Homo sapiens
tcccagagacagagcctcctcc

SEQ ID NO: 9154737 - DNA, 22 bp, Homo sapiens
tcccagagatttcctctccttc

SEQ ID NO: 9154738 - DNA, 22 bp, Homo sapiens
tcccagagacatcatttctccg

SEQ ID NO: 9154739 - DNA, 22 bp, Homo sapiens
tcccagagatttcctctccttc

SEQ ID NO: 9154740 - DNA, 22 bp, Homo sapiens
tcccaaatataatgcaagagac

SEQ ID NO: 9154741 - DNA, 22 bp, Homo sapiens
tcccaaagtattagcatttcaa

SEQ ID NO: 9154742 - DNA, 22 bp, Homo sapiens
tcccaaaggtccgagcgggaat

SEQ ID NO: 9154743 - DNA, 22 bp, Homo sapiens
tcccaagacgatgtgcttggcc

SEQ ID NO: 9154744 - DNA, 22 bp, Homo sapiens
tcccaagagctactcaatggaa

SEQ ID NO: 9154745 - DNA, 22 bp, Homo sapiens
tcccaaatataatgcaagagac

SEQ ID NO: 9154746 - DNA, 22 bp, Homo sapiens
tcccagagaaagtcaaggtctt

SEQ ID NO: 9154747 - DNA, 22 bp, Homo sapiens
tcccaagattattgagggaggg

SEQ ID NO: 9154748 - DNA, 22 bp, Homo sapiens
tcccagagaagagctggatgga

SEQ ID NO: 9154749 - DNA, 22 bp, Homo sapiens
tcccagagaagagctggatgga

SEQ ID NO: 9154750 - DNA, 22 bp, Homo sapiens
tcccagagaagagctggatgga

SEQ ID NO: 9154751 - DNA, 22 bp, Homo sapiens
tcccaagatgacacagtggacg

SEQ ID NO: 9154752 - DNA, 22 bp, Homo sapiens
tccatgggaagattttgagtgg

SEQ ID NO: 9154753 - DNA, 22 bp, Homo sapiens
tccatgtgaccttgagctgctt

SEQ ID NO: 9154754 - DNA, 22 bp, Homo sapiens
tccattatacttctgattcaaa

SEQ ID NO: 9154755 - DNA, 19 bp, Homo sapiens
tccatgtgtttcagacctg

SEQ ID NO: 9154756 - DNA, 22 bp, Homo sapiens
tccattatacttctgattcaaa

SEQ ID NO: 9154757 - DNA, 22 bp, Homo sapiens
tccattatacttctgattcaaa

SEQ ID NO: 9154758 - DNA, 17 bp, Homo sapiens
tccattcctaaggccct

SEQ ID NO: 9154759 - DNA, 22 bp, Homo sapiens
tccattcttttgctgtcttcct

SEQ ID NO: 9154760 - DNA, 22 bp, Homo sapiens
tccattcttttgctgtcttcct

SEQ ID NO: 9154761 - DNA, 22 bp, Homo sapiens
tccattctttttacctctcaga

SEQ ID NO: 9154762 - DNA, 22 bp, Homo sapiens
tccattctatgcttacatttat

SEQ ID NO: 9154763 - DNA, 22 bp, Homo sapiens
tccattcattcattgatgaaca

SEQ ID NO: 9154764 - DNA, 22 bp, Homo sapiens
tccattctacaaggtagcaggg

SEQ ID NO: 9154765 - DNA, 22 bp, Homo sapiens
tccattgacacaacaggaggaa

SEQ ID NO: 9154766 - DNA, 22 bp, Homo sapiens
tccattctttttacctctcaga

SEQ ID NO: 9154767 - DNA, 22 bp, Homo sapiens
tccattgtgttacagagcattc

SEQ ID NO: 9154768 - DNA, 22 bp, Homo sapiens
tccattgtgattatatacaaaa

SEQ ID NO: 9154769 - DNA, 22 bp, Homo sapiens
tccatttagctggcaaacaatg

SEQ ID NO: 9154770 - DNA, 22 bp, Homo sapiens
tccatttagctggcaaacaatg

SEQ ID NO: 9154771 - DNA, 22 bp, Homo sapiens
tccatttactattctcatatcg

SEQ ID NO: 9154772 - DNA, 22 bp, Homo sapiens
tccatttactattctcatatcg

SEQ ID NO: 9154773 - DNA, 22 bp, Homo sapiens
tcccagccggtgcctgggtccc

SEQ ID NO: 9154774 - DNA, 22 bp, Homo sapiens
tcccagccggtgcctgggtccc

SEQ ID NO: 9154775 - DNA, 22 bp, Homo sapiens
tcccagcctcctgacagttttg

SEQ ID NO: 9154776 - DNA, 23 bp, Homo sapiens
tcccagcctcttctcttgcatac

SEQ ID NO: 9154777 - DNA, 22 bp, Homo sapiens
tcccagcccaggtatgatgata

SEQ ID NO: 9154778 - DNA, 22 bp, Homo sapiens
tcccagcattaatgcctgtcag

SEQ ID NO: 9154779 - DNA, 22 bp, Homo sapiens
tcccagaggtctctgctggttc

SEQ ID NO: 9154780 - DNA, 22 bp, Homo sapiens
tcccagaggtctctgctggttc

SEQ ID NO: 9154781 - DNA, 22 bp, Homo sapiens
tcccagaggctccagtctctat

SEQ ID NO: 9154782 - DNA, 22 bp, Homo sapiens
tcccagaggtctctgctggttc

SEQ ID NO: 9154783 - DNA, 22 bp, Homo sapiens
tcccagaggtctctgctggttc

SEQ ID NO: 9154784 - DNA, 22 bp, Homo sapiens
tcccagaggttgagtcacttat

SEQ ID NO: 9154785 - DNA, 22 bp, Homo sapiens
tcccagaggttgagtcacttat

SEQ ID NO: 9154786 - DNA, 22 bp, Homo sapiens
tcccagaggttgagtcacttat

SEQ ID NO: 9154787 - DNA, 22 bp, Homo sapiens
tcccagagtattagcaattgct

SEQ ID NO: 9154788 - DNA, 22 bp, Homo sapiens
tcccagagtattagcaattgct

SEQ ID NO: 9154789 - DNA, 22 bp, Homo sapiens
tcccagaggcagttggtaactt

SEQ ID NO: 9154790 - DNA, 22 bp, Homo sapiens
tcccagaggctccagtctctat

SEQ ID NO: 9154791 - DNA, 22 bp, Homo sapiens
tcccagaggctccagtctctat

SEQ ID NO: 9154792 - DNA, 22 bp, Homo sapiens
tcccagaggctccagtctctat

SEQ ID NO: 9154793 - DNA, 22 bp, Homo sapiens
tcccagaggcagttggtaactt

SEQ ID NO: 9154794 - DNA, 22 bp, Homo sapiens
tcccagaggactgttggtgcta

SEQ ID NO: 9154795 - DNA, 22 bp, Homo sapiens
tcccagagccaagctatggatg

SEQ ID NO: 9154796 - DNA, 22 bp, Homo sapiens
tcccagaggactgttggtgcta

SEQ ID NO: 9154797 - DNA, 22 bp, Homo sapiens
tcccagaggactgttggtgcta

SEQ ID NO: 9154798 - DNA, 22 bp, Homo sapiens
tcccagagccaagctatggatg

SEQ ID NO: 9154799 - DNA, 22 bp, Homo sapiens
tcccagagccaagctatggatg

SEQ ID NO: 9154800 - DNA, 22 bp, Homo sapiens
tcccagagccaagctatggatg

SEQ ID NO: 9154801 - DNA, 22 bp, Homo sapiens
tcccagccttccttgtggtgaa

SEQ ID NO: 9154802 - DNA, 22 bp, Homo sapiens
tcccagcctttctttctccagc

SEQ ID NO: 9154803 - DNA, 22 bp, Homo sapiens
tcccaggcgcctggtggggagc

SEQ ID NO: 9154804 - DNA, 22 bp, Homo sapiens
tcccaggcgcctggtggggagc

SEQ ID NO: 9154805 - DNA, 22 bp, Homo sapiens
tcccaggccataaaactcagag

SEQ ID NO: 9154806 - DNA, 22 bp, Homo sapiens
tcccaggctaccagtgaggtca

SEQ ID NO: 9154807 - DNA, 22 bp, Homo sapiens
tcccagcctggaccctgccagt

SEQ ID NO: 9154808 - DNA, 22 bp, Homo sapiens
tcccagcctgacagtgcatcaa

SEQ ID NO: 9154809 - DNA, 22 bp, Homo sapiens
tcccagccttccagtctggttt

SEQ ID NO: 9154810 - DNA, 22 bp, Homo sapiens
tcccagccttccagtctggttt

SEQ ID NO: 9154811 - DNA, 22 bp, Homo sapiens
tcccagccttatctcccctggc

SEQ ID NO: 9154812 - DNA, 22 bp, Homo sapiens
tcccagcctggaccctgccagt

SEQ ID NO: 9154813 - DNA, 22 bp, Homo sapiens
tccaggtgggctgcacccaggc

SEQ ID NO: 9154814 - DNA, 22 bp, Homo sapiens
tccaggtttcgctacaggagag

SEQ ID NO: 9154815 - DNA, 22 bp, Homo sapiens
tccaggtgtgctctgtgccctg

SEQ ID NO: 9154816 - DNA, 22 bp, Homo sapiens
tccatgctcttgtctagcctcc

SEQ ID NO: 9154817 - DNA, 21 bp, Homo sapiens
tccagtcaacttggcttggct

SEQ ID NO: 9154818 - DNA, 19 bp, Homo sapiens
tccaggtggagagacaccc

SEQ ID NO: 9154819 - DNA, 22 bp, Homo sapiens
tccaggtctggttggacaggtt

SEQ ID NO: 9154820 - DNA, 22 bp, Homo sapiens
tccaggtctggttggacaggtt

SEQ ID NO: 9154821 - DNA, 22 bp, Homo sapiens
tccaggtcttcctattccaggt

SEQ ID NO: 9154822 - DNA, 22 bp, Homo sapiens
tccaggtgagtgcaggtgcaga

SEQ ID NO: 9154823 - DNA, 22 bp, Homo sapiens
tccaggtctggcctgctaggca

SEQ ID NO: 9154824 - DNA, 21 bp, Homo sapiens
tccagggctttgattctctca

SEQ ID NO: 9154825 - DNA, 22 bp, Homo sapiens
tccagggcttggctgggacggt

SEQ ID NO: 9154826 - DNA, 22 bp, Homo sapiens
tccagggcttggctgggacggt

SEQ ID NO: 9154827 - DNA, 19 bp, Homo sapiens
tccagggctttatggcttt

SEQ ID NO: 9154828 - DNA, 19 bp, Homo sapiens
tccagggctttatggcttt

SEQ ID NO: 9154829 - DNA, 18 bp, Homo sapiens
tccagggcttcctcctct

SEQ ID NO: 9154830 - DNA, 18 bp, Homo sapiens
tccagggcttcctcctct

SEQ ID NO: 9154831 - DNA, 22 bp, Homo sapiens
tccagggcttgacagggtgcct

SEQ ID NO: 9154832 - DNA, 22 bp, Homo sapiens
tccagggcttgacagggtgcct

SEQ ID NO: 9154833 - DNA, 22 bp, Homo sapiens
tccagggcttgacagggtgcct

SEQ ID NO: 9154834 - DNA, 22 bp, Homo sapiens
tccagggcttgacagggtgcct

SEQ ID NO: 9154835 - DNA, 22 bp, Homo sapiens
tccagggaaggtgtgaggctgg

SEQ ID NO: 9154836 - DNA, 22 bp, Homo sapiens
tccagggaaggtgtgaggctgg

SEQ ID NO: 9154837 - DNA, 21 bp, Homo sapiens
tccagggaatttcaactttta

SEQ ID NO: 9154838 - DNA, 22 bp, Homo sapiens
tccagggaaggtgtgaggctgg

SEQ ID NO: 9154839 - DNA, 21 bp, Homo sapiens
tccagggaatttcaactttta

SEQ ID NO: 9154840 - DNA, 22 bp, Homo sapiens
tccagggaaggtgtgaggctgg

SEQ ID NO: 9154841 - DNA, 22 bp, Homo sapiens
tccagggaagagcagaggctac

SEQ ID NO: 9154842 - DNA, 22 bp, Homo sapiens
tccagggaagagcagaggctac

SEQ ID NO: 9154843 - DNA, 21 bp, Homo sapiens
tccagggaacttctcaggaat

SEQ ID NO: 9154844 - DNA, 21 bp, Homo sapiens
tccagggaacttctcaggaat

SEQ ID NO: 9154845 - DNA, 21 bp, Homo sapiens
tccagggaacttctcaggaat

SEQ ID NO: 9154846 - DNA, 23 bp, Homo sapiens
tccaggctgggacttcaactggc

SEQ ID NO: 9154847 - DNA, 22 bp, Homo sapiens
tccaggctgggctgaagggtgc

SEQ ID NO: 9154848 - DNA, 22 bp, Homo sapiens
tccagggctgggttggctcagc

SEQ ID NO: 9154849 - DNA, 22 bp, Homo sapiens
tccagggctgggttggctcagc

SEQ ID NO: 9154850 - DNA, 23 bp, Homo sapiens
tccagggctggccagacctcggt

SEQ ID NO: 9154851 - DNA, 23 bp, Homo sapiens
tccagggctggccagacctcggt

SEQ ID NO: 9154852 - DNA, 22 bp, Homo sapiens
tccagggctgacttgggagagg

SEQ ID NO: 9154853 - DNA, 22 bp, Homo sapiens
tccaggctagaagtcacaggcc

SEQ ID NO: 9154854 - DNA, 22 bp, Homo sapiens
tccaggctagaagtcacaggcc

SEQ ID NO: 9154855 - DNA, 22 bp, Homo sapiens
tccaggctacttggattcctgg

SEQ ID NO: 9154856 - DNA, 22 bp, Homo sapiens
tccaggctagagtgcagtggcc

SEQ ID NO: 9154857 - DNA, 22 bp, Homo sapiens
tccaggctagcctggtagagaa

SEQ ID NO: 9154858 - DNA, 21 bp, Homo sapiens
tccaggctggaaggggcgttg

SEQ ID NO: 9154859 - DNA, 21 bp, Homo sapiens
tccaggctggaaggggcgttg

SEQ ID NO: 9154860 - DNA, 21 bp, Homo sapiens
tccaggctggaaggggcgttg

SEQ ID NO: 9154861 - DNA, 22 bp, Homo sapiens
tccaggctggagtgcagtggcg

SEQ ID NO: 9154862 - DNA, 22 bp, Homo sapiens
tccaggctggacatgaggcggg

SEQ ID NO: 9154863 - DNA, 22 bp, Homo sapiens
tccaggctggagtgcagtggca

SEQ ID NO: 9154864 - DNA, 22 bp, Homo sapiens
tccaggctggacatgaggcggg

SEQ ID NO: 9154865 - DNA, 22 bp, Homo sapiens
tccaggctggacatgaggcggg

SEQ ID NO: 9154866 - DNA, 22 bp, Homo sapiens
tccaggctggacatgaggcggg

SEQ ID NO: 9154867 - DNA, 22 bp, Homo sapiens
tccaggctggctcttcaaaatt

SEQ ID NO: 9154868 - DNA, 22 bp, Homo sapiens
tccaggctggctcttcaaaatt

SEQ ID NO: 9154869 - DNA, 22 bp, Homo sapiens
tccaggctggcctcgcgtgaca

SEQ ID NO: 9154870 - DNA, 22 bp, Homo sapiens
tccaggctggcctcgcgtgaca

SEQ ID NO: 9154871 - DNA, 18 bp, Homo sapiens
tccaggctggattgatga

SEQ ID NO: 9154872 - DNA, 22 bp, Homo sapiens
tccaggcctctagcccctatct

SEQ ID NO: 9154873 - DNA, 22 bp, Homo sapiens
tccaggcctctagccctctctt

SEQ ID NO: 9154874 - DNA, 18 bp, Homo sapiens
tccaggcctgaagtgtcc

SEQ ID NO: 9154875 - DNA, 22 bp, Homo sapiens
tccaggcctggctccattcagt

SEQ ID NO: 9154876 - DNA, 22 bp, Homo sapiens
tccaggccttgacaggtcagtt

SEQ ID NO: 9154877 - DNA, 22 bp, Homo sapiens
tccaggctaattttgcattgtt

SEQ ID NO: 9154878 - DNA, 22 bp, Homo sapiens
tccaggctaattttgcattgtt

SEQ ID NO: 9154879 - DNA, 22 bp, Homo sapiens
tccaggctacttggattcctgg

SEQ ID NO: 9154880 - DNA, 22 bp, Homo sapiens
tccaggctaattttgcattgtt

SEQ ID NO: 9154881 - DNA, 20 bp, Homo sapiens
tccaggccttgttctcagat

SEQ ID NO: 9154882 - DNA, 22 bp, Homo sapiens
tcctctggtacttaaagtgctt

SEQ ID NO: 9154883 - DNA, 22 bp, Homo sapiens
tcctctggggcgtggtcctgga

SEQ ID NO: 9154884 - DNA, 22 bp, Homo sapiens
tcctctggggcgtggtcctgga

SEQ ID NO: 9154885 - DNA, 22 bp, Homo sapiens
tcctcttctgtggattccctga

SEQ ID NO: 9154886 - DNA, 22 bp, Homo sapiens
tcctctttaaatgcttttatct

SEQ ID NO: 9154887 - DNA, 22 bp, Homo sapiens
tcctcttgggaatacctttcta

SEQ ID NO: 9154888 - DNA, 22 bp, Homo sapiens
tcctctttctcaacattagtta

SEQ ID NO: 9154889 - DNA, 22 bp, Homo sapiens
tcctctttaaatgcttttatct

SEQ ID NO: 9154890 - DNA, 22 bp, Homo sapiens
tcctctttaaatgcttttatct

SEQ ID NO: 9154891 - DNA, 22 bp, Homo sapiens
tcctctttaaatgcttttatct

SEQ ID NO: 9154892 - DNA, 22 bp, Homo sapiens
tcctctttctcaacattagtta

SEQ ID NO: 9154893 - DNA, 22 bp, Homo sapiens
tcctcttcaaaatagctctgaa

SEQ ID NO: 9154894 - DNA, 22 bp, Homo sapiens
tcctgagacatctctgctggtc

SEQ ID NO: 9154895 - DNA, 20 bp, Homo sapiens
tcctgagacctgggaaggtt

SEQ ID NO: 9154896 - DNA, 22 bp, Homo sapiens
tcctgagagcagctgctttgga

SEQ ID NO: 9154897 - DNA, 22 bp, Homo sapiens
tcctgagagccttggcttcaga

SEQ ID NO: 9154898 - DNA, 22 bp, Homo sapiens
tcctgaaggagcagttgctggg

SEQ ID NO: 9154899 - DNA, 22 bp, Homo sapiens
tcctgaagctctcttaaggaaa

SEQ ID NO: 9154900 - DNA, 22 bp, Homo sapiens
tcctgaagcctgagtgatgact

SEQ ID NO: 9154901 - DNA, 22 bp, Homo sapiens
tcctgaaggcagatggggatca

SEQ ID NO: 9154902 - DNA, 22 bp, Homo sapiens
tcctgagaaggcacagcttgca

SEQ ID NO: 9154903 - DNA, 22 bp, Homo sapiens
tcctgaagagccctgctctgtg

SEQ ID NO: 9154904 - DNA, 22 bp, Homo sapiens
tcctgaagaacgaagtcatgta

SEQ ID NO: 9154905 - DNA, 22 bp, Homo sapiens
tcctgaagaacgaagtcatgta

SEQ ID NO: 9154906 - DNA, 22 bp, Homo sapiens
tcctgaagaggctacactgctt

SEQ ID NO: 9154907 - DNA, 22 bp, Homo sapiens
tcctgaagatgaaaagagaggt

SEQ ID NO: 9154908 - DNA, 19 bp, Homo sapiens
tcctgaaaacttctggaat

SEQ ID NO: 9154909 - DNA, 19 bp, Homo sapiens
tcctgaaaacttctggaat

SEQ ID NO: 9154910 - DNA, 22 bp, Homo sapiens
tcctctttctcaacattagtta

SEQ ID NO: 9154911 - DNA, 22 bp, Homo sapiens
tcctgaaatgtgcacatgacat

SEQ ID NO: 9154912 - DNA, 22 bp, Homo sapiens
tcctgaaattctggttgtcact

SEQ ID NO: 9154913 - DNA, 22 bp, Homo sapiens
tcctgaaatttgttttaattct

SEQ ID NO: 9154914 - DNA, 23 bp, Homo sapiens
tcctgaggaatggcatctcacat

SEQ ID NO: 9154915 - DNA, 22 bp, Homo sapiens
tcctgaggaaagttcatgaatg

SEQ ID NO: 9154916 - DNA, 22 bp, Homo sapiens
tcctgaggagaagagtgctagg

SEQ ID NO: 9154917 - DNA, 22 bp, Homo sapiens
tcctgaggactaacaggaagga

SEQ ID NO: 9154918 - DNA, 22 bp, Homo sapiens
tcctgaggaccctgtcaggggc

SEQ ID NO: 9154919 - DNA, 22 bp, Homo sapiens
tcctgaggaccctgtcaggggc

SEQ ID NO: 9154920 - DNA, 22 bp, Homo sapiens
tcctgaggaatgtgaagagaac

SEQ ID NO: 9154921 - DNA, 22 bp, Homo sapiens
tcctgagtgagagctgggaggt

SEQ ID NO: 9154922 - DNA, 22 bp, Homo sapiens
tcctgagtgagagctgggaggt

SEQ ID NO: 9154923 - DNA, 22 bp, Homo sapiens
tcctgaggttttaaaactattc

SEQ ID NO: 9154924 - DNA, 22 bp, Homo sapiens
tcctgaggatggttgaagtgca

SEQ ID NO: 9154925 - DNA, 22 bp, Homo sapiens
tcctgaggcacaatcctagaat

SEQ ID NO: 9154926 - DNA, 22 bp, Homo sapiens
tcctgaggcacaatcctagaat

SEQ ID NO: 9154927 - DNA, 22 bp, Homo sapiens
tcctgaggccctgttagggtct

SEQ ID NO: 9154928 - DNA, 22 bp, Homo sapiens
tcctgaggctaaagtgcagtgg

SEQ ID NO: 9154929 - DNA, 22 bp, Homo sapiens
tcctgagataaatctcatgtga

SEQ ID NO: 9154930 - DNA, 22 bp, Homo sapiens
tcctgagatccttttagggatc

SEQ ID NO: 9154931 - DNA, 20 bp, Homo sapiens
tcctgagcctccaccatgtc

SEQ ID NO: 9154932 - DNA, 20 bp, Homo sapiens
tcctgagcctccaccatgtc

SEQ ID NO: 9154933 - DNA, 22 bp, Homo sapiens
tcctgagcacctatgccatggc

SEQ ID NO: 9154934 - DNA, 22 bp, Homo sapiens
tcctgagccctggggtcagtgt

SEQ ID NO: 9154935 - DNA, 22 bp, Homo sapiens
tcctgcagacctcagtcaggtc

SEQ ID NO: 9154936 - DNA, 22 bp, Homo sapiens
tcctgcagacctcagtcaggtc

SEQ ID NO: 9154937 - DNA, 19 bp, Homo sapiens
tcctgcagaccagacctgt

SEQ ID NO: 9154938 - DNA, 19 bp, Homo sapiens
tcctgcagaccagacctgt

SEQ ID NO: 9154939 - DNA, 22 bp, Homo sapiens
tcctgcagacctcagtcaggtc

SEQ ID NO: 9154940 - DNA, 22 bp, Homo sapiens
tcctgcagacctcagtcaggtc

SEQ ID NO: 9154941 - DNA, 22 bp, Homo sapiens
tcctgcagagacagaggcctca

SEQ ID NO: 9154942 - DNA, 22 bp, Homo sapiens
tcctgcacaccttgagcttgga

SEQ ID NO: 9154943 - DNA, 22 bp, Homo sapiens
tcctgcacagttggtgcttgaa

SEQ ID NO: 9154944 - DNA, 21 bp, Homo sapiens
tcctgcagaatgccttcctac

SEQ ID NO: 9154945 - DNA, 21 bp, Homo sapiens
tcctgcagaatgccttcctac

SEQ ID NO: 9154946 - DNA, 22 bp, Homo sapiens
tcctgcagagccgccctcaggt

SEQ ID NO: 9154947 - DNA, 22 bp, Homo sapiens
tcctgcagagccgccctcaggt

SEQ ID NO: 9154948 - DNA, 22 bp, Homo sapiens
tcctgcagagccgccctcaggt

SEQ ID NO: 9154949 - DNA, 22 bp, Homo sapiens
tcctgcagagacagaggcctca

SEQ ID NO: 9154950 - DNA, 22 bp, Homo sapiens
tcctgcagagtcccactgattt

SEQ ID NO: 9154951 - DNA, 22 bp, Homo sapiens
tcctgcagagtcccactgattt

SEQ ID NO: 9154952 - DNA, 22 bp, Homo sapiens
tcctgcagatcaaagcctttga

SEQ ID NO: 9154953 - DNA, 22 bp, Homo sapiens
tcctgcagccaagggtcatcga

SEQ ID NO: 9154954 - DNA, 22 bp, Homo sapiens
tcctgcagccactgcaggcaga

SEQ ID NO: 9154955 - DNA, 22 bp, Homo sapiens
tcctgcagccactgcaggcaga

SEQ ID NO: 9154956 - DNA, 22 bp, Homo sapiens
tcctgcagccaagggtcatcga

SEQ ID NO: 9154957 - DNA, 22 bp, Homo sapiens
tcctgcagccaagggtcatcga

SEQ ID NO: 9154958 - DNA, 22 bp, Homo sapiens
tcctgcagcatccgtcgtctgt

SEQ ID NO: 9154959 - DNA, 22 bp, Homo sapiens
tcctgcagccactgcaggcaga

SEQ ID NO: 9154960 - DNA, 22 bp, Homo sapiens
tcctgcagccattagaggtcaa

SEQ ID NO: 9154961 - DNA, 22 bp, Homo sapiens
tcctgcagccattagaggtcaa

SEQ ID NO: 9154962 - DNA, 21 bp, Homo sapiens
tcctgcagggcagcagagtgg

SEQ ID NO: 9154963 - DNA, 22 bp, Homo sapiens
tcctgcaggggctgaggaacca

SEQ ID NO: 9154964 - DNA, 21 bp, Homo sapiens
tcctgcagggcagcagagtgg

SEQ ID NO: 9154965 - DNA, 22 bp, Homo sapiens
tcctgcaggcttgagtcctcag

SEQ ID NO: 9154966 - DNA, 22 bp, Homo sapiens
tcctgcaggcttgagtcctcag

SEQ ID NO: 9154967 - DNA, 22 bp, Homo sapiens
tcctgcaggtggatgattctct

SEQ ID NO: 9154968 - DNA, 19 bp, Homo sapiens
tcctgcaggtggcttgcag

SEQ ID NO: 9154969 - DNA, 20 bp, Homo sapiens
tcctgcagtcgctagcgccc

SEQ ID NO: 9154970 - DNA, 20 bp, Homo sapiens
tcctgcagtcgctagcgccc

SEQ ID NO: 9154971 - DNA, 22 bp, Homo sapiens
tcctgcagtctgcactctgcct

SEQ ID NO: 9154972 - DNA, 22 bp, Homo sapiens
tcctgccctaagatgttatatt

SEQ ID NO: 9154973 - DNA, 22 bp, Homo sapiens
tcctgccccactgtttgaaaga

SEQ ID NO: 9154974 - DNA, 22 bp, Homo sapiens
tcctgcccagagctctccactc

SEQ ID NO: 9154975 - DNA, 22 bp, Homo sapiens
tcctgccctcgggggtgttcca

SEQ ID NO: 9154976 - DNA, 22 bp, Homo sapiens
tcctgccctgaaaagtcagtct

SEQ ID NO: 9154977 - DNA, 18 bp, Homo sapiens
tcctgcagcttctatgta

SEQ ID NO: 9154978 - DNA, 22 bp, Homo sapiens
tcctgcagctgcagacctgggg

SEQ ID NO: 9154979 - DNA, 18 bp, Homo sapiens
tcctgcagcttctatgta

SEQ ID NO: 9154980 - DNA, 21 bp, Homo sapiens
tcctgcaggaggcctgagagg

SEQ ID NO: 9154981 - DNA, 22 bp, Homo sapiens
tcctgcaggccagaggggtgag

SEQ ID NO: 9154982 - DNA, 22 bp, Homo sapiens
tcctgcaggccagaggggtgag

SEQ ID NO: 9154983 - DNA, 22 bp, Homo sapiens
tcctgcaggcttgagtcctcag

SEQ ID NO: 9154984 - DNA, 22 bp, Homo sapiens
tcctgcaggcctgttcccagta

SEQ ID NO: 9154985 - DNA, 22 bp, Homo sapiens
tcctgcaggcctgttcccagta

SEQ ID NO: 9154986 - DNA, 22 bp, Homo sapiens
tcctgcaggccagaggggtgag

SEQ ID NO: 9154987 - DNA, 22 bp, Homo sapiens
tcctgcaggcctgttcccagta

SEQ ID NO: 9154988 - DNA, 22 bp, Homo sapiens
tcctgcagctctgagaagcatc

SEQ ID NO: 9154989 - DNA, 22 bp, Homo sapiens
tcctgcagctgaagctcatgtg

SEQ ID NO: 9154990 - DNA, 22 bp, Homo sapiens
tcctgcagctgaagctcatgtg

SEQ ID NO: 9154991 - DNA, 22 bp, Homo sapiens
tcctgcagctgaagctcatgtg

SEQ ID NO: 9154992 - DNA, 22 bp, Homo sapiens
tcctgcctcaggctctggagta

SEQ ID NO: 9154993 - DNA, 22 bp, Homo sapiens
tcctgcctaccttgcggaggtg

SEQ ID NO: 9154994 - DNA, 22 bp, Homo sapiens
tcctgccgtcctccggggcctc

SEQ ID NO: 9154995 - DNA, 22 bp, Homo sapiens
tcctgcctcttgccttcttcac

SEQ ID NO: 9154996 - DNA, 22 bp, Homo sapiens
gagtaaatgtcactgttgctgt

SEQ ID NO: 9154997 - DNA, 22 bp, Homo sapiens
gaggtgggagggcagtccctaa

SEQ ID NO: 9154998 - DNA, 23 bp, Homo sapiens
gaggtgtgaattctgggtgctgc

SEQ ID NO: 9154999 - DNA, 22 bp, Homo sapiens
gaggtgggagggcagtccctaa

SEQ ID NO: 9155000 - DNA, 22 bp, Homo sapiens
gaggtggcttagtctctggaca

SEQ ID NO: 9155001 - DNA, 22 bp, Homo sapiens
gaggtggatgttgcagtgagct

SEQ ID NO: 9155002 - DNA, 22 bp, Homo sapiens
gaggtgagaagggggtcagatg

SEQ ID NO: 9155003 - DNA, 22 bp, Homo sapiens
gaggtgcctggcgatgtctctg

SEQ ID NO: 9155004 - DNA, 22 bp, Homo sapiens
gaggtgcctggcgatgtctctg

SEQ ID NO: 9155005 - DNA, 22 bp, Homo sapiens
gaggtcctctgtgtccgcgggc

SEQ ID NO: 9155006 - DNA, 18 bp, Homo sapiens
gaggtcctgctctagccc

SEQ ID NO: 9155007 - DNA, 22 bp, Homo sapiens
gaggtctgggatggggcctgaa

SEQ ID NO: 9155008 - DNA, 22 bp, Homo sapiens
gaggtctgggatggggcctgaa

SEQ ID NO: 9155009 - DNA, 22 bp, Homo sapiens
gaggtctgggcttgggcctggt

SEQ ID NO: 9155010 - DNA, 22 bp, Homo sapiens
gaggtctgggcttgggcctggt

SEQ ID NO: 9155011 - DNA, 22 bp, Homo sapiens
gaggtctggaccaagtcgcccc

SEQ ID NO: 9155012 - DNA, 22 bp, Homo sapiens
gaggtctggaccaagtcgcccc

SEQ ID NO: 9155013 - DNA, 22 bp, Homo sapiens
gaggtctgagtgcggaaagcct

SEQ ID NO: 9155014 - DNA, 22 bp, Homo sapiens
gaggtctgccttcaggagagtt

SEQ ID NO: 9155015 - DNA, 22 bp, Homo sapiens
gagggtgggctcctatctgggt

SEQ ID NO: 9155016 - DNA, 22 bp, Homo sapiens
gagggtgcaggaggatggtagt

SEQ ID NO: 9155017 - DNA, 22 bp, Homo sapiens
gagggtcctggctaagtctgac

SEQ ID NO: 9155018 - DNA, 22 bp, Homo sapiens
gagggctgatgttgccacctca

SEQ ID NO: 9155019 - DNA, 22 bp, Homo sapiens
gagggtctcttaatgccagggg

SEQ ID NO: 9155020 - DNA, 22 bp, Homo sapiens
gagggtctcttaatgccagggg

SEQ ID NO: 9155021 - DNA, 22 bp, Homo sapiens
gagggctgataacaggaataca

SEQ ID NO: 9155022 - DNA, 22 bp, Homo sapiens
gagggctgataacaggaataca

SEQ ID NO: 9155023 - DNA, 22 bp, Homo sapiens
gagggctgatgcttacttattt

SEQ ID NO: 9155024 - DNA, 22 bp, Homo sapiens
gagggtggaagagctgctgaga

SEQ ID NO: 9155025 - DNA, 22 bp, Homo sapiens
gaggccttgggatgtgccacgg

SEQ ID NO: 9155026 - DNA, 19 bp, Homo sapiens
gaggcgaggcgtgcaggag

SEQ ID NO: 9155027 - DNA, 22 bp, Homo sapiens
gaggccttagagcttttctaga

SEQ ID NO: 9155028 - DNA, 22 bp, Homo sapiens
gaggccttagagcttttctaga

SEQ ID NO: 9155029 - DNA, 22 bp, Homo sapiens
gaggcctggtgctgtgtccaca

SEQ ID NO: 9155030 - DNA, 22 bp, Homo sapiens
gaggcctggtagccgagcccca

SEQ ID NO: 9155031 - DNA, 22 bp, Homo sapiens
gaggcctggtgtgtctcccgct

SEQ ID NO: 9155032 - DNA, 22 bp, Homo sapiens
gaggcctggtttccagcatcct

SEQ ID NO: 9155033 - DNA, 22 bp, Homo sapiens
gaggctggtaggaaaggaaaca

SEQ ID NO: 9155034 - DNA, 22 bp, Homo sapiens
gaggctggttctgaagtactgt

SEQ ID NO: 9155035 - DNA, 22 bp, Homo sapiens
gaggctggttcccttgatcttt

SEQ ID NO: 9155036 - DNA, 22 bp, Homo sapiens
gaggctaagcactggcatttct

SEQ ID NO: 9155037 - DNA, 22 bp, Homo sapiens
gagggacagctaaagagaaatt

SEQ ID NO: 9155038 - DNA, 22 bp, Homo sapiens
gagggaagtcataatgttctag

SEQ ID NO: 9155039 - DNA, 22 bp, Homo sapiens
gagggaagtcataatgttctag

SEQ ID NO: 9155040 - DNA, 22 bp, Homo sapiens
gagggacagctaaagagaaatt

SEQ ID NO: 9155041 - DNA, 22 bp, Homo sapiens
gagggaaggtcacccttgtagc

SEQ ID NO: 9155042 - DNA, 22 bp, Homo sapiens
gagggaaggagagttgtagctg

SEQ ID NO: 9155043 - DNA, 22 bp, Homo sapiens
gagggaagattccccatatggg

SEQ ID NO: 9155044 - DNA, 22 bp, Homo sapiens
gagggaaggacccattttaagt

SEQ ID NO: 9155045 - DNA, 22 bp, Homo sapiens
gagggaagaggcctgacatttt

SEQ ID NO: 9155046 - DNA, 22 bp, Homo sapiens
gagggaagagggtttgaattca

SEQ ID NO: 9155047 - DNA, 21 bp, Homo sapiens
gaggctgtctgctgctggcct

SEQ ID NO: 9155048 - DNA, 22 bp, Homo sapiens
gagggccctggctggctccagc

SEQ ID NO: 9155049 - DNA, 22 bp, Homo sapiens
gagggctgataacaggaataca

SEQ ID NO: 9155050 - DNA, 22 bp, Homo sapiens
gagggctgataaatgcgcatgg

SEQ ID NO: 9155051 - DNA, 22 bp, Homo sapiens
gagggctgataaatgcgcatgg

SEQ ID NO: 9155052 - DNA, 22 bp, Homo sapiens
gagggctgaagtgttttatgag

SEQ ID NO: 9155053 - DNA, 22 bp, Homo sapiens
gaggcaaagcatgtggctcagg

SEQ ID NO: 9155054 - DNA, 22 bp, Homo sapiens
gaggatttgatggctttctccc

SEQ ID NO: 9155055 - DNA, 22 bp, Homo sapiens
gaggatggaggcagttagggcc

SEQ ID NO: 9155056 - DNA, 22 bp, Homo sapiens
gaggatggtatgaggcaagcaa

SEQ ID NO: 9155057 - DNA, 21 bp, Homo sapiens
gaggccactaataggggcaga

SEQ ID NO: 9155058 - DNA, 22 bp, Homo sapiens
gaggccactgtccctgccttcc

SEQ ID NO: 9155059 - DNA, 22 bp, Homo sapiens
gaggccactgtccctgccttcc

SEQ ID NO: 9155060 - DNA, 22 bp, Homo sapiens
gaggccacggaagggagctgtg

SEQ ID NO: 9155061 - DNA, 22 bp, Homo sapiens
gaggccacggttttccttgggg

SEQ ID NO: 9155062 - DNA, 22 bp, Homo sapiens
gaggccacggttttccttgggg

SEQ ID NO: 9155063 - DNA, 22 bp, Homo sapiens
gaggccacggttttccttgggg

SEQ ID NO: 9155064 - DNA, 22 bp, Homo sapiens
gaggccacgtgcttatgtttct

SEQ ID NO: 9155065 - DNA, 22 bp, Homo sapiens
gaggccacggaagggagctgtg

SEQ ID NO: 9155066 - DNA, 22 bp, Homo sapiens
gaggccagaagtctgagatcag

SEQ ID NO: 9155067 - DNA, 22 bp, Homo sapiens
gaggccagaagtctgagatcag

SEQ ID NO: 9155068 - DNA, 22 bp, Homo sapiens
gaggccacttcctactggagga

SEQ ID NO: 9155069 - DNA, 22 bp, Homo sapiens
gaggccacttcctactggagga

SEQ ID NO: 9155070 - DNA, 22 bp, Homo sapiens
gaggcctggaccagccacagag

SEQ ID NO: 9155071 - DNA, 22 bp, Homo sapiens
gaggcctggaattccagcctgg

SEQ ID NO: 9155072 - DNA, 22 bp, Homo sapiens
gaggccagatactctcttctgc

SEQ ID NO: 9155073 - DNA, 22 bp, Homo sapiens
gaggccagagttccccgagtca

SEQ ID NO: 9155074 - DNA, 22 bp, Homo sapiens
gaggccagaatgagtctctggg

SEQ ID NO: 9155075 - DNA, 22 bp, Homo sapiens
gaggccagaatgagtctctggg

SEQ ID NO: 9155076 - DNA, 22 bp, Homo sapiens
gaggagagaagctaacggtgct

SEQ ID NO: 9155077 - DNA, 22 bp, Homo sapiens
gaggagtctagtttatggcttc

SEQ ID NO: 9155078 - DNA, 22 bp, Homo sapiens
gaggaggttgacggcactgtga

SEQ ID NO: 9155079 - DNA, 22 bp, Homo sapiens
gaggagtctttccctaagtcct

SEQ ID NO: 9155080 - DNA, 22 bp, Homo sapiens
gaggagtctttccctaagtcct

SEQ ID NO: 9155081 - DNA, 22 bp, Homo sapiens
gaggagtctttttagggcctga

SEQ ID NO: 9155082 - DNA, 22 bp, Homo sapiens
gaggagtgccagccgtggagtc

SEQ ID NO: 9155083 - DNA, 18 bp, Homo sapiens
gaggatggaaggagatgc

SEQ ID NO: 9155084 - DNA, 18 bp, Homo sapiens
gaggatggaaggagatgc

SEQ ID NO: 9155085 - DNA, 22 bp, Homo sapiens
gaggatggaggcagttagggcc

SEQ ID NO: 9155086 - DNA, 22 bp, Homo sapiens
gaggagagaagctaacggtgct

SEQ ID NO: 9155087 - DNA, 22 bp, Homo sapiens
gaggagagaacattcctccata

SEQ ID NO: 9155088 - DNA, 22 bp, Homo sapiens
gaggagagaacattcctccata

SEQ ID NO: 9155089 - DNA, 22 bp, Homo sapiens
gaggagaaattatccttggtgt

SEQ ID NO: 9155090 - DNA, 22 bp, Homo sapiens
gaggagaaagcagtgatttgtg

SEQ ID NO: 9155091 - DNA, 22 bp, Homo sapiens
gaggacagtgtgatctgccagc

SEQ ID NO: 9155092 - DNA, 17 bp, Homo sapiens
gaggacagggaagtagg

SEQ ID NO: 9155093 - DNA, 17 bp, Homo sapiens
gaggacagggaagtagg

SEQ ID NO: 9155094 - DNA, 22 bp, Homo sapiens
gagctggtcgaaatgggctgac

SEQ ID NO: 9155095 - DNA, 22 bp, Homo sapiens
gagctggtgatcagctggagga

SEQ ID NO: 9155096 - DNA, 22 bp, Homo sapiens
gagctgggtgtttatttgccaa

SEQ ID NO: 9155097 - DNA, 22 bp, Homo sapiens
gagctgggtctccaccttggca

SEQ ID NO: 9155098 - DNA, 22 bp, Homo sapiens
gagctgggtctccaccttggca

SEQ ID NO: 9155099 - DNA, 22 bp, Homo sapiens
gagctgggtctccaccttggca

SEQ ID NO: 9155100 - DNA, 22 bp, Homo sapiens
gagctgggtatatggctttatg

SEQ ID NO: 9155101 - DNA, 22 bp, Homo sapiens
gagctggtcagtttcagggcca

SEQ ID NO: 9155102 - DNA, 22 bp, Homo sapiens
gagctggtcagtttcaggagag

SEQ ID NO: 9155103 - DNA, 22 bp, Homo sapiens
gagctccagcatctctgccaaa

SEQ ID NO: 9155104 - DNA, 22 bp, Homo sapiens
gagctccagggaacagcagcta

SEQ ID NO: 9155105 - DNA, 22 bp, Homo sapiens
gagctcctgaaacgttcctgcc

SEQ ID NO: 9155106 - DNA, 22 bp, Homo sapiens
gagctcctgctgcatcctgcct

SEQ ID NO: 9155107 - DNA, 22 bp, Homo sapiens
gagctcctcccagggtagcact

SEQ ID NO: 9155108 - DNA, 22 bp, Homo sapiens
gagctcctatggtcggtggctc

SEQ ID NO: 9155109 - DNA, 22 bp, Homo sapiens
gagctgggcacacgccacttga

SEQ ID NO: 9155110 - DNA, 22 bp, Homo sapiens
gagctgggcacacgccacttga

SEQ ID NO: 9155111 - DNA, 22 bp, Homo sapiens
gagctgggcacacgccacttga

SEQ ID NO: 9155112 - DNA, 22 bp, Homo sapiens
gagctgggcctcagaacacagt

SEQ ID NO: 9155113 - DNA, 22 bp, Homo sapiens
gagctgggtatatggctttatg

SEQ ID NO: 9155114 - DNA, 22 bp, Homo sapiens
gagctgggattcatctatgtct

SEQ ID NO: 9155115 - DNA, 22 bp, Homo sapiens
gagctgggatttgaacctggga

SEQ ID NO: 9155116 - DNA, 22 bp, Homo sapiens
gagctgtgcttataccaattca

SEQ ID NO: 9155117 - DNA, 22 bp, Homo sapiens
gagctgtgtatgcatcattctg

SEQ ID NO: 9155118 - DNA, 22 bp, Homo sapiens
gagctgtgtgcctggatggtct

SEQ ID NO: 9155119 - DNA, 22 bp, Homo sapiens
gagctgtgtgcctggatggtct

SEQ ID NO: 9155120 - DNA, 22 bp, Homo sapiens
gagctgtgtatgcatcattctg

SEQ ID NO: 9155121 - DNA, 22 bp, Homo sapiens
gaggacaggagactcactgttt

SEQ ID NO: 9155122 - DNA, 17 bp, Homo sapiens
gaggacagggaagtagg

SEQ ID NO: 9155123 - DNA, 22 bp, Homo sapiens
gagctgtgccaatctgtctggg

SEQ ID NO: 9155124 - DNA, 20 bp, Homo sapiens
gagctgtgctctcaggagcc

SEQ ID NO: 9155125 - DNA, 22 bp, Homo sapiens
gagctgtgattggtgtctcact

SEQ ID NO: 9155126 - DNA, 22 bp, Homo sapiens
gagctgtgccaatctgtctggg

SEQ ID NO: 9155127 - DNA, 22 bp, Homo sapiens
gagctgtgccaatctgtctggg

SEQ ID NO: 9155128 - DNA, 20 bp, Homo sapiens
gagctgtgctctcaggagcc

SEQ ID NO: 9155129 - DNA, 22 bp, Homo sapiens
gagctgtggaaggcagggacca

SEQ ID NO: 9155130 - DNA, 22 bp, Homo sapiens
gagctgtggtcaacaggaaatt

SEQ ID NO: 9155131 - DNA, 22 bp, Homo sapiens
gagctgtgaaaagtgcctgggg

SEQ ID NO: 9155132 - DNA, 22 bp, Homo sapiens
gagctgtgaaaagtgcctgggg

SEQ ID NO: 9155133 - DNA, 22 bp, Homo sapiens
gagctgtctggggactctgggt

SEQ ID NO: 9155134 - DNA, 18 bp, Homo sapiens
gagctgtctgagctggtc

SEQ ID NO: 9155135 - DNA, 22 bp, Homo sapiens
gagctgtgaaaagtgcctgggg

SEQ ID NO: 9155136 - DNA, 22 bp, Homo sapiens
gagctgtgacacgcagcccagg

SEQ ID NO: 9155137 - DNA, 22 bp, Homo sapiens
gagctgtgacacgcagcccagg

SEQ ID NO: 9155138 - DNA, 22 bp, Homo sapiens
gagctgtgacacgcagcccagg

SEQ ID NO: 9155139 - DNA, 22 bp, Homo sapiens
gagctgtgagggacacattgct

SEQ ID NO: 9155140 - DNA, 22 bp, Homo sapiens
gagctgtgattggtgtctcact

SEQ ID NO: 9155141 - DNA, 22 bp, Homo sapiens
gagctgtgattggtgtctcact

SEQ ID NO: 9155142 - DNA, 22 bp, Homo sapiens
gagctggtgtgtgcccgagcac

SEQ ID NO: 9155143 - DNA, 22 bp, Homo sapiens
gagctggttctgtccagggaat

SEQ ID NO: 9155144 - DNA, 22 bp, Homo sapiens
gagctgtccaagatggtcgtaa

SEQ ID NO: 9155145 - DNA, 22 bp, Homo sapiens
gagctggttctgtccagggaat

SEQ ID NO: 9155146 - DNA, 22 bp, Homo sapiens
gagctgtctctatatgaatgct

SEQ ID NO: 9155147 - DNA, 22 bp, Homo sapiens
gagctgtctctttgggcctttt

SEQ ID NO: 9155148 - DNA, 22 bp, Homo sapiens
gagctgtcctaccaggagtcct

SEQ ID NO: 9155149 - DNA, 22 bp, Homo sapiens
gagctgtcctaccaggagtcct

SEQ ID NO: 9155150 - DNA, 22 bp, Homo sapiens
gagctgtccgcccctgggccga

SEQ ID NO: 9155151 - DNA, 22 bp, Homo sapiens
gagcaggcattctagtggctga

SEQ ID NO: 9155152 - DNA, 22 bp, Homo sapiens
gagcaggcattctagtggctga

SEQ ID NO: 9155153 - DNA, 22 bp, Homo sapiens
gagcaggcaactctgcagtgcc

SEQ ID NO: 9155154 - DNA, 22 bp, Homo sapiens
gagcaggcaactctgcagtgcc

SEQ ID NO: 9155155 - DNA, 22 bp, Homo sapiens
gagcaggcaaagatgaaaggag

SEQ ID NO: 9155156 - DNA, 22 bp, Homo sapiens
gagcaggatgggagctggggcc

SEQ ID NO: 9155157 - DNA, 22 bp, Homo sapiens
gagcaggacgtgggaatgggaa

SEQ ID NO: 9155158 - DNA, 22 bp, Homo sapiens
gagcaggatgggagctggggcc

SEQ ID NO: 9155159 - DNA, 22 bp, Homo sapiens
gagcaggatggcacttctgtga

SEQ ID NO: 9155160 - DNA, 22 bp, Homo sapiens
gagctcagagcctatagttggt

SEQ ID NO: 9155161 - DNA, 22 bp, Homo sapiens
gagctcagaggcgtctttgtcc

SEQ ID NO: 9155162 - DNA, 22 bp, Homo sapiens
gagctcagaggattctggggag

SEQ ID NO: 9155163 - DNA, 22 bp, Homo sapiens
gagcaggcctggggtgaggcct

SEQ ID NO: 9155164 - DNA, 22 bp, Homo sapiens
gagcaggctctgcctgtgtgtc

SEQ ID NO: 9155165 - DNA, 22 bp, Homo sapiens
gagcaggcctggggtgaggcct

SEQ ID NO: 9155166 - DNA, 22 bp, Homo sapiens
gagcaggcctggggtgaggcct

SEQ ID NO: 9155167 - DNA, 22 bp, Homo sapiens
gagcaggccagcaatggaaggg

SEQ ID NO: 9155168 - DNA, 22 bp, Homo sapiens
gagctccaccaccttcaggcag

SEQ ID NO: 9155169 - DNA, 22 bp, Homo sapiens
gagctccacttagcaaggccac

SEQ ID NO: 9155170 - DNA, 22 bp, Homo sapiens
gagctcagggcattgagcaaga

SEQ ID NO: 9155171 - DNA, 22 bp, Homo sapiens
gagctcagtgtagtcatggctt

SEQ ID NO: 9155172 - DNA, 22 bp, Homo sapiens
gagctcagtgtagtcatggctt

SEQ ID NO: 9155173 - DNA, 22 bp, Homo sapiens
gagctcatccccatggtccgtc

SEQ ID NO: 9155174 - DNA, 18 bp, Homo sapiens
gagctcagcgtgtttcta

SEQ ID NO: 9155175 - DNA, 22 bp, Homo sapiens
gagctcaggagcatcagaagaa

SEQ ID NO: 9155176 - DNA, 22 bp, Homo sapiens
gagctcaggagcatcagaagaa

SEQ ID NO: 9155177 - DNA, 22 bp, Homo sapiens
gagctcaggagcatcagaagaa

SEQ ID NO: 9155178 - DNA, 22 bp, Homo sapiens
gagctcagcccaaagagcagtg

SEQ ID NO: 9155179 - DNA, 22 bp, Homo sapiens
gagctcagcccaaagagcagtg

SEQ ID NO: 9155180 - DNA, 22 bp, Homo sapiens
gagctcagcccaaagagcagtg

SEQ ID NO: 9155181 - DNA, 22 bp, Homo sapiens
gagctcagcccaaagagcagtg

SEQ ID NO: 9155182 - DNA, 22 bp, Homo sapiens
gagctcagattctggtgtcaga

SEQ ID NO: 9155183 - DNA, 22 bp, Homo sapiens
gagcaagattttataagttgtg

SEQ ID NO: 9155184 - DNA, 22 bp, Homo sapiens
gagcaagactcactgcatcttg

SEQ ID NO: 9155185 - DNA, 22 bp, Homo sapiens
gagcaagactacaggcagatga

SEQ ID NO: 9155186 - DNA, 22 bp, Homo sapiens
gagcaagactacaggcagatga

SEQ ID NO: 9155187 - DNA, 22 bp, Homo sapiens
gagcaagattaaaaggctgggt

SEQ ID NO: 9155188 - DNA, 22 bp, Homo sapiens
gagcaagattaaaaggctgggt

SEQ ID NO: 9155189 - DNA, 22 bp, Homo sapiens
gagcaagatcctgtttttctat

SEQ ID NO: 9155190 - DNA, 22 bp, Homo sapiens
gagcaagagtgttggactttga

SEQ ID NO: 9155191 - DNA, 22 bp, Homo sapiens
gagcacagaaggagaaatatgg

SEQ ID NO: 9155192 - DNA, 22 bp, Homo sapiens
gagcacagaatcttcccatgca

SEQ ID NO: 9155193 - DNA, 22 bp, Homo sapiens
gagcacagaactaaatgctggt

SEQ ID NO: 9155194 - DNA, 22 bp, Homo sapiens
gagcaacacattgaatgaggat

SEQ ID NO: 9155195 - DNA, 22 bp, Homo sapiens
gagcaacactccacattgctag

SEQ ID NO: 9155196 - DNA, 22 bp, Homo sapiens
gagcaacagggcgaggagaact

SEQ ID NO: 9155197 - DNA, 19 bp, Homo sapiens
gagcaacatatgtaaactc

SEQ ID NO: 9155198 - DNA, 22 bp, Homo sapiens
gagcaagaccctgggttctctc

SEQ ID NO: 9155199 - DNA, 22 bp, Homo sapiens
gagcaaagcttttagggccttt

SEQ ID NO: 9155200 - DNA, 22 bp, Homo sapiens
gagcaaaataaattctgacaaa

SEQ ID NO: 9155201 - DNA, 22 bp, Homo sapiens
gagaggagttactatttccgag

SEQ ID NO: 9155202 - DNA, 22 bp, Homo sapiens
gagaggagttactatttccgag

SEQ ID NO: 9155203 - DNA, 22 bp, Homo sapiens
gagaggagtccctatcacagtt

SEQ ID NO: 9155204 - DNA, 22 bp, Homo sapiens
gagaggcagaggcctgaaaccg

SEQ ID NO: 9155205 - DNA, 22 bp, Homo sapiens
gagaggcaggcgctgcaatggt

SEQ ID NO: 9155206 - DNA, 22 bp, Homo sapiens
gagaggcaggaatcctgggtga

SEQ ID NO: 9155207 - DNA, 22 bp, Homo sapiens
gagatttcacccctcttaacct

SEQ ID NO: 9155208 - DNA, 22 bp, Homo sapiens
gagatttcacccctcttaacct

SEQ ID NO: 9155209 - DNA, 22 bp, Homo sapiens
gagatttccatattttgtaaca

SEQ ID NO: 9155210 - DNA, 22 bp, Homo sapiens
gagcagagcttctcaaagtaaa

SEQ ID NO: 9155211 - DNA, 18 bp, Homo sapiens
gagcagaggagggttttt

SEQ ID NO: 9155212 - DNA, 19 bp, Homo sapiens
gagcagcttcctatctggt

SEQ ID NO: 9155213 - DNA, 22 bp, Homo sapiens
gagcagagacagtacaactggc

SEQ ID NO: 9155214 - DNA, 22 bp, Homo sapiens
gagcagagaatccagctaagtg

SEQ ID NO: 9155215 - DNA, 22 bp, Homo sapiens
gagcaggacgtgggaatgggaa

SEQ ID NO: 9155216 - DNA, 22 bp, Homo sapiens
gagcaggacagcagcttcctgg

SEQ ID NO: 9155217 - DNA, 22 bp, Homo sapiens
gagcaggaaggccagaagggtc

SEQ ID NO: 9155218 - DNA, 22 bp, Homo sapiens
gagcaggaaggccagaagggtc

SEQ ID NO: 9155219 - DNA, 22 bp, Homo sapiens
gagcaggaaggccagaagggtc

SEQ ID NO: 9155220 - DNA, 22 bp, Homo sapiens
gagcaggaacagatcccttgga

SEQ ID NO: 9155221 - DNA, 22 bp, Homo sapiens
gagcagcttgcgctgtcttcac

SEQ ID NO: 9155222 - DNA, 15 bp, Homo sapiens
gagcaggaaacttgg

SEQ ID NO: 9155223 - DNA, 22 bp, Homo sapiens
gagcaggaactgaaaatgagac

SEQ ID NO: 9155224 - DNA, 22 bp, Homo sapiens
gagcagaactactcacatatcg

SEQ ID NO: 9155225 - DNA, 22 bp, Homo sapiens
gagcagaacaggccgggtggga

SEQ ID NO: 9155226 - DNA, 22 bp, Homo sapiens
gagcagaaagttatgtcttgca

SEQ ID NO: 9155227 - DNA, 22 bp, Homo sapiens
gagcagaaagttatgtcttgca

SEQ ID NO: 9155228 - DNA, 22 bp, Homo sapiens
gagcacctcaatttgctatttg

SEQ ID NO: 9155229 - DNA, 22 bp, Homo sapiens
gagcaccgcctccacgatgccc

SEQ ID NO: 9155230 - DNA, 22 bp, Homo sapiens
gagcactgagctggaattggag

SEQ ID NO: 9155231 - DNA, 23 bp, Homo sapiens
gagcaccagggcttttgagacat

SEQ ID NO: 9155232 - DNA, 22 bp, Homo sapiens
gagcacccatgcagagggaaca

SEQ ID NO: 9155233 - DNA, 22 bp, Homo sapiens
gagcacatgagaggaaatcaaa

SEQ ID NO: 9155234 - DNA, 22 bp, Homo sapiens
gagcacagtgtgttgtgatttc

SEQ ID NO: 9155235 - DNA, 22 bp, Homo sapiens
gagcacagtaaagcagtgtcac

SEQ ID NO: 9155236 - DNA, 22 bp, Homo sapiens
gagagaagggacttctacactt

SEQ ID NO: 9155237 - DNA, 22 bp, Homo sapiens
gagagaagaatgttccgaggcc

SEQ ID NO: 9155238 - DNA, 22 bp, Homo sapiens
gagagaatgtacatgctagggg

SEQ ID NO: 9155239 - DNA, 22 bp, Homo sapiens
gagagaagggggatatgagcct

SEQ ID NO: 9155240 - DNA, 22 bp, Homo sapiens
gagagaagggggatatgagcct

SEQ ID NO: 9155241 - DNA, 22 bp, Homo sapiens
gagagaagggggatatgagcct

SEQ ID NO: 9155242 - DNA, 22 bp, Homo sapiens
gagagaagaaagccatggtcct

SEQ ID NO: 9155243 - DNA, 22 bp, Homo sapiens
gagagaagaacaatgtcattca

SEQ ID NO: 9155244 - DNA, 22 bp, Homo sapiens
gagaagccgagtcagctgagcc

SEQ ID NO: 9155245 - DNA, 22 bp, Homo sapiens
gagaaggaagttgagccagcat

SEQ ID NO: 9155246 - DNA, 22 bp, Homo sapiens
gagaagcaatcgtgacatctcc

SEQ ID NO: 9155247 - DNA, 22 bp, Homo sapiens
gagaagcaatcagtggccaccc

SEQ ID NO: 9155248 - DNA, 22 bp, Homo sapiens
gagaagcaggtttagcagacaa

SEQ ID NO: 9155249 - DNA, 22 bp, Homo sapiens
gagaagccgagtcagctgagcc

SEQ ID NO: 9155250 - DNA, 22 bp, Homo sapiens
gagaaagggaacttacagagtg

SEQ ID NO: 9155251 - DNA, 22 bp, Homo sapiens
gagaaagggaacttacagagtg

SEQ ID NO: 9155252 - DNA, 22 bp, Homo sapiens
gagaaagggaacttacagagtg

SEQ ID NO: 9155253 - DNA, 22 bp, Homo sapiens
gagaacaggctctggagtcaga

SEQ ID NO: 9155254 - DNA, 22 bp, Homo sapiens
gagaaagggataatttgaagag

SEQ ID NO: 9155255 - DNA, 22 bp, Homo sapiens
gagaacattaatagttaatttt

SEQ ID NO: 9155256 - DNA, 21 bp, Homo sapiens
gagaactgaaccagagcagct

SEQ ID NO: 9155257 - DNA, 22 bp, Homo sapiens
gagaactgattagcatttgcca

SEQ ID NO: 9155258 - DNA, 22 bp, Homo sapiens
gagaagcaatcagcagccaccc

SEQ ID NO: 9155259 - DNA, 16 bp, Homo sapiens
gagaagagcccggcag

SEQ ID NO: 9155260 - DNA, 22 bp, Homo sapiens
gagagcaggaggcagcgggacg

SEQ ID NO: 9155261 - DNA, 22 bp, Homo sapiens
gagagcatgtggtctagtttta

SEQ ID NO: 9155262 - DNA, 22 bp, Homo sapiens
gagagcaggctctcgggggcca

SEQ ID NO: 9155263 - DNA, 23 bp, Homo sapiens
gagagcccattggcaggggtacc

SEQ ID NO: 9155264 - DNA, 22 bp, Homo sapiens
gagagagaaaatgactccggac

SEQ ID NO: 9155265 - DNA, 22 bp, Homo sapiens
gagagagaaggcctgtgggtgt

SEQ ID NO: 9155266 - DNA, 22 bp, Homo sapiens
gagagagaaggcctgtgggtgt

SEQ ID NO: 9155267 - DNA, 22 bp, Homo sapiens
gagagagaaccccgtgcccttc

SEQ ID NO: 9155268 - DNA, 22 bp, Homo sapiens
gagagacagcacacagtgtggg

SEQ ID NO: 9155269 - DNA, 22 bp, Homo sapiens
gagagacagcagaacgtgcagc

SEQ ID NO: 9155270 - DNA, 22 bp, Homo sapiens
gagagacagcagaacgtgcagc

SEQ ID NO: 9155271 - DNA, 18 bp, Homo sapiens
gagaggagccagaatttt

SEQ ID NO: 9155272 - DNA, 18 bp, Homo sapiens
gagaggagccagaatttt

SEQ ID NO: 9155273 - DNA, 22 bp, Homo sapiens
gagaggaggtggctatgacagc

SEQ ID NO: 9155274 - DNA, 22 bp, Homo sapiens
gagaggaggtggctatgacagc

SEQ ID NO: 9155275 - DNA, 22 bp, Homo sapiens
gagaggaggtggctatgacagc

SEQ ID NO: 9155276 - DNA, 22 bp, Homo sapiens
gagaggaggtggctatgacagc

SEQ ID NO: 9155277 - DNA, 22 bp, Homo sapiens
gagaggaggtggctatgacagc

SEQ ID NO: 9155278 - DNA, 22 bp, Homo sapiens
gagaggagtagacactttggtt

SEQ ID NO: 9155279 - DNA, 22 bp, Homo sapiens
gagaggaggtggctatgacagc

SEQ ID NO: 9155280 - DNA, 22 bp, Homo sapiens
gagaggagtaggctgatggtgc

SEQ ID NO: 9155281 - DNA, 22 bp, Homo sapiens
gagaggagtccctatcacagtt

SEQ ID NO: 9155282 - DNA, 22 bp, Homo sapiens
gagaggagtccctatcacagtt

SEQ ID NO: 9155283 - DNA, 22 bp, Homo sapiens
gagaggagtagacactttggtt

SEQ ID NO: 9155284 - DNA, 22 bp, Homo sapiens
gagaggagtagacactttggtt

SEQ ID NO: 9155285 - DNA, 22 bp, Homo sapiens
gagaggagtaggctgatggtgc

SEQ ID NO: 9155286 - DNA, 22 bp, Homo sapiens
gagaggagaagcctgcgcttca

SEQ ID NO: 9155287 - DNA, 22 bp, Homo sapiens
gagaggagaagcctgcgcttca

SEQ ID NO: 9155288 - DNA, 22 bp, Homo sapiens
gagaggagacttatccagattg

SEQ ID NO: 9155289 - DNA, 18 bp, Homo sapiens
gagaggagccagaatttt

SEQ ID NO: 9155290 - DNA, 22 bp, Homo sapiens
gagaggagacttatccagattg

SEQ ID NO: 9155291 - DNA, 22 bp, Homo sapiens
gagagctgtaatagtcatgtct

SEQ ID NO: 9155292 - DNA, 22 bp, Homo sapiens
gagagctgtaatagtcatgtct

SEQ ID NO: 9155293 - DNA, 17 bp, Homo sapiens
gagagccctcagatgtc

SEQ ID NO: 9155294 - DNA, 22 bp, Homo sapiens
gagagctgtcagcgtagcaccg

SEQ ID NO: 9155295 - DNA, 22 bp, Homo sapiens
gagagctgtcagcgtagcaccg

SEQ ID NO: 9155296 - DNA, 22 bp, Homo sapiens
gagagctgtcagcgtagcaccg

SEQ ID NO: 9155297 - DNA, 22 bp, Homo sapiens
gagagctgtcagcgtagcaccg

SEQ ID NO: 9155298 - DNA, 22 bp, Homo sapiens
gaatgcaaagctctctatgtta

SEQ ID NO: 9155299 - DNA, 22 bp, Homo sapiens
gaatgcagatggctggtgtatg

SEQ ID NO: 9155300 - DNA, 22 bp, Homo sapiens
gaatgctaagcatgtgggagtt

SEQ ID NO: 9155301 - DNA, 22 bp, Homo sapiens
gaagaaggtggcccaggggtag

SEQ ID NO: 9155302 - DNA, 22 bp, Homo sapiens
gaagaaggtgccagaggcttac

SEQ ID NO: 9155303 - DNA, 22 bp, Homo sapiens
gaagaaggtgctacacagggca

SEQ ID NO: 9155304 - DNA, 22 bp, Homo sapiens
gaagaaggtgctacacagggca

SEQ ID NO: 9155305 - DNA, 22 bp, Homo sapiens
gaatgtttttcattggtgactc

SEQ ID NO: 9155306 - DNA, 22 bp, Homo sapiens
gaattaactggcagttagtgct

SEQ ID NO: 9155307 - DNA, 22 bp, Homo sapiens
gaattaaaatagttttggtcga

SEQ ID NO: 9155308 - DNA, 22 bp, Homo sapiens
gaattaaaatagttttggtcga

SEQ ID NO: 9155309 - DNA, 22 bp, Homo sapiens
gaatgtaagtgggcagaagaca

SEQ ID NO: 9155310 - DNA, 22 bp, Homo sapiens
gaatgtaaaattgcctacaaga

SEQ ID NO: 9155311 - DNA, 22 bp, Homo sapiens
gaatgtaaaattgcctacaaga

SEQ ID NO: 9155312 - DNA, 19 bp, Homo sapiens
gaatgggaatgggaaagct

SEQ ID NO: 9155313 - DNA, 22 bp, Homo sapiens
gaatgctttgggaattcagaat

SEQ ID NO: 9155314 - DNA, 22 bp, Homo sapiens
gaatgctggcttacaggcagtt

SEQ ID NO: 9155315 - DNA, 22 bp, Homo sapiens
gaatgctggcttacaggcagtt

SEQ ID NO: 9155316 - DNA, 22 bp, Homo sapiens
gaatgctggcttacaggcagtt

SEQ ID NO: 9155317 - DNA, 18 bp, Homo sapiens
gacaaaagtacagacaga

SEQ ID NO: 9155318 - DNA, 18 bp, Homo sapiens
gacaaaagtacagacaga

SEQ ID NO: 9155319 - DNA, 18 bp, Homo sapiens
gacaaaagtacagacaga

SEQ ID NO: 9155320 - DNA, 22 bp, Homo sapiens
gacaaaagtgttttgaacaagg

SEQ ID NO: 9155321 - DNA, 22 bp, Homo sapiens
gacaaaagtgttttgaacaagg

SEQ ID NO: 9155322 - DNA, 20 bp, Homo sapiens
gaattttatgaacactacca

SEQ ID NO: 9155323 - DNA, 22 bp, Homo sapiens
gaatttatctacgttaagtatg

SEQ ID NO: 9155324 - DNA, 22 bp, Homo sapiens
gaatttacaagttgaataacaa

SEQ ID NO: 9155325 - DNA, 22 bp, Homo sapiens
gaattttattactagtcaactg

SEQ ID NO: 9155326 - DNA, 22 bp, Homo sapiens
gaattttgcttttatgtcaagt

SEQ ID NO: 9155327 - DNA, 22 bp, Homo sapiens
gaatttttctggaagcaattat

SEQ ID NO: 9155328 - DNA, 22 bp, Homo sapiens
gaatttttctggaagcaattat

SEQ ID NO: 9155329 - DNA, 22 bp, Homo sapiens
gacaaaacacattagtttaaaa

SEQ ID NO: 9155330 - DNA, 20 bp, Homo sapiens
gacaacagagtaccaggaag

SEQ ID NO: 9155331 - DNA, 22 bp, Homo sapiens
gacaacagcatatggactgtca

SEQ ID NO: 9155332 - DNA, 22 bp, Homo sapiens
gacaaagtcaacagtactctca

SEQ ID NO: 9155333 - DNA, 21 bp, Homo sapiens
gacaaagtgaagcaggcagga

SEQ ID NO: 9155334 - DNA, 22 bp, Homo sapiens
gacaaagcagacaagataattc

SEQ ID NO: 9155335 - DNA, 22 bp, Homo sapiens
gacaaagcctaagaagtattta

SEQ ID NO: 9155336 - DNA, 22 bp, Homo sapiens
gacaaatgaagtcactgacctt

SEQ ID NO: 9155337 - DNA, 22 bp, Homo sapiens
gaccttcagtgtgtttctcaca

SEQ ID NO: 9155338 - DNA, 22 bp, Homo sapiens
gacctggcctgcacagccctta

SEQ ID NO: 9155339 - DNA, 22 bp, Homo sapiens
gacctggcctgcacagccctta

SEQ ID NO: 9155340 - DNA, 23 bp, Homo sapiens
gacctggctttgaatcttgactc

SEQ ID NO: 9155341 - DNA, 22 bp, Homo sapiens
gacctggggtaagcttggcaac

SEQ ID NO: 9155342 - DNA, 22 bp, Homo sapiens
gacctggctttgggccccggca

SEQ ID NO: 9155343 - DNA, 22 bp, Homo sapiens
gaccttcttgctgtgtcctaac

SEQ ID NO: 9155344 - DNA, 22 bp, Homo sapiens
gactatgtgtattttactcacc

SEQ ID NO: 9155345 - DNA, 22 bp, Homo sapiens
gactatgtgtgctttgtgaatg

SEQ ID NO: 9155346 - DNA, 22 bp, Homo sapiens
gactatgtgaagtgtgaatagg

SEQ ID NO: 9155347 - DNA, 22 bp, Homo sapiens
gactatgtaatggatggcatga

SEQ ID NO: 9155348 - DNA, 22 bp, Homo sapiens
gactatgtgggagggacaagga

SEQ ID NO: 9155349 - DNA, 22 bp, Homo sapiens
gactatgtgcctgcgagtgtca

SEQ ID NO: 9155350 - DNA, 22 bp, Homo sapiens
gacctggaagaactgaggcctt

SEQ ID NO: 9155351 - DNA, 22 bp, Homo sapiens
gacctggaagatggtcctcacc

SEQ ID NO: 9155352 - DNA, 22 bp, Homo sapiens
gacctggaggcttttcccaaga

SEQ ID NO: 9155353 - DNA, 22 bp, Homo sapiens
gacctggaggatcctcttcttg

SEQ ID NO: 9155354 - DNA, 22 bp, Homo sapiens
gacctggattcaaattcagact

SEQ ID NO: 9155355 - DNA, 22 bp, Homo sapiens
gacctggaatgaagggtccctc

SEQ ID NO: 9155356 - DNA, 22 bp, Homo sapiens
gacctggaagatggtcctcacc

SEQ ID NO: 9155357 - DNA, 22 bp, Homo sapiens
gacctggactgagttagatggc

SEQ ID NO: 9155358 - DNA, 22 bp, Homo sapiens
gacctggaatttgtgtgtgttc

SEQ ID NO: 9155359 - DNA, 22 bp, Homo sapiens
gacatgcatgaatgcaggtctc

SEQ ID NO: 9155360 - DNA, 22 bp, Homo sapiens
gacatgcatgaatgcaggtctc

SEQ ID NO: 9155361 - DNA, 22 bp, Homo sapiens
gacatggatacttgataagggg

SEQ ID NO: 9155362 - DNA, 22 bp, Homo sapiens
gacatgtattagtcatgcacag

SEQ ID NO: 9155363 - DNA, 22 bp, Homo sapiens
gacagccaggtctgatgaccca

SEQ ID NO: 9155364 - DNA, 22 bp, Homo sapiens
gacagccatcagcacacgctgc

SEQ ID NO: 9155365 - DNA, 22 bp, Homo sapiens
gacagcctcatgaggagcaaaa

SEQ ID NO: 9155366 - DNA, 22 bp, Homo sapiens
gacagcctcatgtgcatgaact

SEQ ID NO: 9155367 - DNA, 22 bp, Homo sapiens
gacagcctcatgtgcatgaact

SEQ ID NO: 9155368 - DNA, 22 bp, Homo sapiens
gacagtccttgcccagtatcta

SEQ ID NO: 9155369 - DNA, 22 bp, Homo sapiens
gacagtctggcctaaagggtta

SEQ ID NO: 9155370 - DNA, 19 bp, Homo sapiens
gacagtgcagttgtagtac

SEQ ID NO: 9155371 - DNA, 22 bp, Homo sapiens
gacatacagaatctgcagactt

SEQ ID NO: 9155372 - DNA, 22 bp, Homo sapiens
gacatacagcatggtctatgaa

SEQ ID NO: 9155373 - DNA, 22 bp, Homo sapiens
gacatcaatattctgcagggat

SEQ ID NO: 9155374 - DNA, 22 bp, Homo sapiens
gacatagacaaagtcattgtca

SEQ ID NO: 9155375 - DNA, 22 bp, Homo sapiens
cttcactgtttggttcacagca

SEQ ID NO: 9155376 - DNA, 22 bp, Homo sapiens
cttcactgtttggttcacagca

SEQ ID NO: 9155377 - DNA, 22 bp, Homo sapiens
cttcactgtgcttcaagcagct

SEQ ID NO: 9155378 - DNA, 22 bp, Homo sapiens
cttcactgggctcctgagaggg

SEQ ID NO: 9155379 - DNA, 22 bp, Homo sapiens
cttcactggatctttgatttca

SEQ ID NO: 9155380 - DNA, 22 bp, Homo sapiens
cttcactggaatctgtaatagt

SEQ ID NO: 9155381 - DNA, 22 bp, Homo sapiens
cttccaggacaccagggtagta

SEQ ID NO: 9155382 - DNA, 22 bp, Homo sapiens
cttccagggtccaggaagagcc

SEQ ID NO: 9155383 - DNA, 22 bp, Homo sapiens
cttcagaaataacaacaattac

SEQ ID NO: 9155384 - DNA, 22 bp, Homo sapiens
cttccaggtaggcctaaggcag

SEQ ID NO: 9155385 - DNA, 22 bp, Homo sapiens
cttcacagtctttatttcctcc

SEQ ID NO: 9155386 - DNA, 22 bp, Homo sapiens
cttcacatctccctaaaacagc

SEQ ID NO: 9155387 - DNA, 19 bp, Homo sapiens
cttcacatctgtgagggga

SEQ ID NO: 9155388 - DNA, 22 bp, Homo sapiens
cttcacatctccctaaaacagc

SEQ ID NO: 9155389 - DNA, 22 bp, Homo sapiens
cttcactgatgggacagctcaa

SEQ ID NO: 9155390 - DNA, 22 bp, Homo sapiens
cttcacattgggcttgatatga

SEQ ID NO: 9155391 - DNA, 22 bp, Homo sapiens
cttcacattgggcttgatatga

SEQ ID NO: 9155392 - DNA, 23 bp, Homo sapiens
ctgttaaattccttaagagcagg

SEQ ID NO: 9155393 - DNA, 22 bp, Homo sapiens
cttcaaagggtcactatttatc

SEQ ID NO: 9155394 - DNA, 22 bp, Homo sapiens
cttcaaatacaagtagattatg

SEQ ID NO: 9155395 - DNA, 20 bp, Homo sapiens
ctgttaaaaggtatgaattc

SEQ ID NO: 9155396 - DNA, 22 bp, Homo sapiens
cttcacagtataggtccctgag

SEQ ID NO: 9155397 - DNA, 22 bp, Homo sapiens
cttcacagtcaccctgctgtgt

SEQ ID NO: 9155398 - DNA, 22 bp, Homo sapiens
cttcacaggcaagtctgttttt

SEQ ID NO: 9155399 - DNA, 22 bp, Homo sapiens
cttcacagccaacatgggcaca

SEQ ID NO: 9155400 - DNA, 22 bp, Homo sapiens
cttcacagccaacatgggcaca

SEQ ID NO: 9155401 - DNA, 22 bp, Homo sapiens
cttcacagccaacatgggcaca

SEQ ID NO: 9155402 - DNA, 22 bp, Homo sapiens
cttcacagcatgagctttggag

SEQ ID NO: 9155403 - DNA, 22 bp, Homo sapiens
cttcacagatgctgagagggct

SEQ ID NO: 9155404 - DNA, 22 bp, Homo sapiens
cttcttcataggcagtcctgtt

SEQ ID NO: 9155405 - DNA, 22 bp, Homo sapiens
cttcttcatctgtaaaacttgg

SEQ ID NO: 9155406 - DNA, 22 bp, Homo sapiens
cttcttcatctgtaaaacttgg

SEQ ID NO: 9155407 - DNA, 22 bp, Homo sapiens
cttcttcagcacaatattgatg

SEQ ID NO: 9155408 - DNA, 22 bp, Homo sapiens
cttcttcagcacaatattgatg

SEQ ID NO: 9155409 - DNA, 20 bp, Homo sapiens
cttcttcagcctatgcttca

SEQ ID NO: 9155410 - DNA, 22 bp, Homo sapiens
cttcttcagaggccagcctctg

SEQ ID NO: 9155411 - DNA, 22 bp, Homo sapiens
cttcttcacactggtctgaagc

SEQ ID NO: 9155412 - DNA, 22 bp, Homo sapiens
cttcccttctgtgcagggcaga

SEQ ID NO: 9155413 - DNA, 22 bp, Homo sapiens
cttcttcaacctgaaagtttca

SEQ ID NO: 9155414 - DNA, 22 bp, Homo sapiens
cttcttcaacctgaaagtttca

SEQ ID NO: 9155415 - DNA, 22 bp, Homo sapiens
cttcttcaagagaatgggagac

SEQ ID NO: 9155416 - DNA, 22 bp, Homo sapiens
cttccctgagctttctcaggct

SEQ ID NO: 9155417 - DNA, 22 bp, Homo sapiens
cttccctgataagagcctcaga

SEQ ID NO: 9155418 - DNA, 22 bp, Homo sapiens
cttccctgagctttctcaggct

SEQ ID NO: 9155419 - DNA, 19 bp, Homo sapiens
cttcccctgttacctcact

SEQ ID NO: 9155420 - DNA, 22 bp, Homo sapiens
cttccctcctggattccagact

SEQ ID NO: 9155421 - DNA, 18 bp, Homo sapiens
cttccctcttcctttgtc

SEQ ID NO: 9155422 - DNA, 22 bp, Homo sapiens
cttcccagaccttagagtgcag

SEQ ID NO: 9155423 - DNA, 22 bp, Homo sapiens
cttcccagaacaatgtaggctt

SEQ ID NO: 9155424 - DNA, 22 bp, Homo sapiens
cttccaggtccttcttgagaag

SEQ ID NO: 9155425 - DNA, 22 bp, Homo sapiens
cttcccagaacaatgtaggctt

SEQ ID NO: 9155426 - DNA, 22 bp, Homo sapiens
cttcccagacggggtggcagcc

SEQ ID NO: 9155427 - DNA, 22 bp, Homo sapiens
cttcccagcacctcagtctggc

SEQ ID NO: 9155428 - DNA, 22 bp, Homo sapiens
cttcccaggtgctcttagcatg

SEQ ID NO: 9155429 - DNA, 22 bp, Homo sapiens
cttcccagcacctcagtctggc

SEQ ID NO: 9155430 - DNA, 22 bp, Homo sapiens
cttccccaggacctctgctaaa

SEQ ID NO: 9155431 - DNA, 22 bp, Homo sapiens
cttgctttgtccagaaattcag

SEQ ID NO: 9155432 - DNA, 22 bp, Homo sapiens
cttgctttccaaatgactcact

SEQ ID NO: 9155433 - DNA, 22 bp, Homo sapiens
cttgctttccaaatgactcact

SEQ ID NO: 9155434 - DNA, 22 bp, Homo sapiens
cttgctttcagtctcggcctca

SEQ ID NO: 9155435 - DNA, 22 bp, Homo sapiens
cttgcttttgctgatgattaag

SEQ ID NO: 9155436 - DNA, 22 bp, Homo sapiens
cttggaaagttatcattttcct

SEQ ID NO: 9155437 - DNA, 22 bp, Homo sapiens
cttggaaaggttttacaaagcg

SEQ ID NO: 9155438 - DNA, 22 bp, Homo sapiens
cttgcttgttttgaagaaagat

SEQ ID NO: 9155439 - DNA, 22 bp, Homo sapiens
cttgctttatctggtttctcat

SEQ ID NO: 9155440 - DNA, 22 bp, Homo sapiens
cttgctttatctggtttctcat

SEQ ID NO: 9155441 - DNA, 22 bp, Homo sapiens
cttgctttcagtctcggcctca

SEQ ID NO: 9155442 - DNA, 22 bp, Homo sapiens
cttgcttctgctgcactatcct

SEQ ID NO: 9155443 - DNA, 22 bp, Homo sapiens
cttgcttcattagtgtcttagt

SEQ ID NO: 9155444 - DNA, 22 bp, Homo sapiens
cttgctgtcttgcatttagagc

SEQ ID NO: 9155445 - DNA, 22 bp, Homo sapiens
cttgctgtgtggtgttctcaga

SEQ ID NO: 9155446 - DNA, 19 bp, Homo sapiens
cttggagaaggctatgacc

SEQ ID NO: 9155447 - DNA, 22 bp, Homo sapiens
cttggagacaggacaggcagaa

SEQ ID NO: 9155448 - DNA, 22 bp, Homo sapiens
cttggactttagtctctctcca

SEQ ID NO: 9155449 - DNA, 22 bp, Homo sapiens
cttggaaggctggttctccctc

SEQ ID NO: 9155450 - DNA, 22 bp, Homo sapiens
cttggaaggacgggctgtatct

SEQ ID NO: 9155451 - DNA, 22 bp, Homo sapiens
cttcttcctgctgcagcctcca

SEQ ID NO: 9155452 - DNA, 22 bp, Homo sapiens
cttcttctcaaggggcaggtgg

SEQ ID NO: 9155453 - DNA, 22 bp, Homo sapiens
cttcttctctacatcctttgat

SEQ ID NO: 9155454 - DNA, 22 bp, Homo sapiens
cttcttctctacatcctttgat

SEQ ID NO: 9155455 - DNA, 22 bp, Homo sapiens
cttcttcatgtattgatagtct

SEQ ID NO: 9155456 - DNA, 22 bp, Homo sapiens
cttcttcccagcttccctcacc

SEQ ID NO: 9155457 - DNA, 22 bp, Homo sapiens
cttgcctctgctaatggtttct

SEQ ID NO: 9155458 - DNA, 22 bp, Homo sapiens
cttgctggggtaagtctgtgct

SEQ ID NO: 9155459 - DNA, 19 bp, Homo sapiens
cttgctgggtggtttctgc

SEQ ID NO: 9155460 - DNA, 22 bp, Homo sapiens
cttgctggtggtgttttctatg

SEQ ID NO: 9155461 - DNA, 22 bp, Homo sapiens
cttgctggtggtgttttctatg

SEQ ID NO: 9155462 - DNA, 22 bp, Homo sapiens
cttgctgtcccttggtatgaac

SEQ ID NO: 9155463 - DNA, 22 bp, Homo sapiens
cttgcctccctcagctcacagc

SEQ ID NO: 9155464 - DNA, 19 bp, Homo sapiens
cttcttcttggcagccaag

SEQ ID NO: 9155465 - DNA, 22 bp, Homo sapiens
cttgcctacttgtcaaccagca

SEQ ID NO: 9155466 - DNA, 19 bp, Homo sapiens
cttcttcttggcagccaag

SEQ ID NO: 9155467 - DNA, 22 bp, Homo sapiens
cttcttcttcccccttcagggg

SEQ ID NO: 9155468 - DNA, 22 bp, Homo sapiens
cttcttcttcccccttcagggg

SEQ ID NO: 9155469 - DNA, 22 bp, Homo sapiens
cttcttctctacatcctttgat

SEQ ID NO: 9155470 - DNA, 22 bp, Homo sapiens
cttcttctggtttatgtggcaa

SEQ ID NO: 9155471 - DNA, 22 bp, Homo sapiens
cttcttctggacaggcagctcc

SEQ ID NO: 9155472 - DNA, 22 bp, Homo sapiens
cttggagatacagaggacattt

SEQ ID NO: 9155473 - DNA, 22 bp, Homo sapiens
cttggaggaaaggcagggagac

SEQ ID NO: 9155474 - DNA, 22 bp, Homo sapiens
cttggaggaaggggctcttctg

SEQ ID NO: 9155475 - DNA, 22 bp, Homo sapiens
cttggaggtggaagttgcagtg

SEQ ID NO: 9155476 - DNA, 22 bp, Homo sapiens
cttggaggtggaagttgcagtg

SEQ ID NO: 9155477 - DNA, 22 bp, Homo sapiens
cttggaggaggtggtgcttgat

SEQ ID NO: 9155478 - DNA, 22 bp, Homo sapiens
ctttcctagttggtcccagcac

SEQ ID NO: 9155479 - DNA, 22 bp, Homo sapiens
ctttcctccactccctaggctt

SEQ ID NO: 9155480 - DNA, 22 bp, Homo sapiens
ctttccaccaactcacttccct

SEQ ID NO: 9155481 - DNA, 22 bp, Homo sapiens
ctttccaccaactcacttccct

SEQ ID NO: 9155482 - DNA, 22 bp, Homo sapiens
cttggagtgaatgggggcaggt

SEQ ID NO: 9155483 - DNA, 22 bp, Homo sapiens
ctttcctccactccctaggctt

SEQ ID NO: 9155484 - DNA, 22 bp, Homo sapiens
ctttcctccactccctaggctt

SEQ ID NO: 9155485 - DNA, 22 bp, Homo sapiens
ctttcctctggcactgtctggt

SEQ ID NO: 9155486 - DNA, 22 bp, Homo sapiens
ctttcctggctggcagttgtgg

SEQ ID NO: 9155487 - DNA, 22 bp, Homo sapiens
ctttccttaataagcaggtata

SEQ ID NO: 9155488 - DNA, 22 bp, Homo sapiens
ctttctctgtgtggtaaagggc

SEQ ID NO: 9155489 - DNA, 22 bp, Homo sapiens
ctttctctgtggtgaggagggt

SEQ ID NO: 9155490 - DNA, 20 bp, Homo sapiens
ctttctctaatttataagta

SEQ ID NO: 9155491 - DNA, 20 bp, Homo sapiens
ctttctctaatttataagta

SEQ ID NO: 9155492 - DNA, 20 bp, Homo sapiens
ctttctctaatttataagta

SEQ ID NO: 9155493 - DNA, 22 bp, Homo sapiens
ctttctctggaggggagtggtt

SEQ ID NO: 9155494 - DNA, 22 bp, Homo sapiens
ctttctcagtgttaattacttt

SEQ ID NO: 9155495 - DNA, 22 bp, Homo sapiens
ctttctccagagctgcttattt

SEQ ID NO: 9155496 - DNA, 22 bp, Homo sapiens
ctttctcttacccaaggatctg

SEQ ID NO: 9155497 - DNA, 22 bp, Homo sapiens
ctttctcttacccaaggatctg

SEQ ID NO: 9155498 - DNA, 22 bp, Homo sapiens
ctttctctgtgtttcacatgct

SEQ ID NO: 9155499 - DNA, 22 bp, Homo sapiens
ctttctctgtgtttcacatgct

SEQ ID NO: 9155500 - DNA, 22 bp, Homo sapiens
ctttggaagtgatagatatgat

SEQ ID NO: 9155501 - DNA, 22 bp, Homo sapiens
ctttggaatattttattgagaa

SEQ ID NO: 9155502 - DNA, 22 bp, Homo sapiens
ctttggaataatcaagctctga

SEQ ID NO: 9155503 - DNA, 22 bp, Homo sapiens
ctttggaatcattgcttattca

SEQ ID NO: 9155504 - DNA, 22 bp, Homo sapiens
ctttggagggcctttcctagcc

SEQ ID NO: 9155505 - DNA, 19 bp, Homo sapiens
ctttggaggatgaggctgg

SEQ ID NO: 9155506 - DNA, 22 bp, Homo sapiens
ctttggaggacctatgtgcaat

SEQ ID NO: 9155507 - DNA, 22 bp, Homo sapiens
ctttggaggaaaattgaggtca

SEQ ID NO: 9155508 - DNA, 19 bp, Homo sapiens
ctttggagaatggtttgct

SEQ ID NO: 9155509 - DNA, 20 bp, Homo sapiens
ctttggagaaagatgcaata

SEQ ID NO: 9155510 - DNA, 22 bp, Homo sapiens
ctttggagaaaagttcttgggc

SEQ ID NO: 9155511 - DNA, 22 bp, Homo sapiens
ctttggcaagggttttaattgt

SEQ ID NO: 9155512 - DNA, 20 bp, Homo sapiens
ctttttctccagctctgagc

SEQ ID NO: 9155513 - DNA, 20 bp, Homo sapiens
ctttttctccagctctgagc

SEQ ID NO: 9155514 - DNA, 22 bp, Homo sapiens
ctttttctaatcataattgtct

SEQ ID NO: 9155515 - DNA, 22 bp, Homo sapiens
ctttttcctcgtagagcctaat

SEQ ID NO: 9155516 - DNA, 22 bp, Homo sapiens
ctttttctaatcataattgtct

SEQ ID NO: 9155517 - DNA, 22 bp, Homo sapiens
ctttttctgatgttccatgatt

SEQ ID NO: 9155518 - DNA, 22 bp, Homo sapiens
ctttttctgatgttccatgatt

SEQ ID NO: 9155519 - DNA, 22 bp, Homo sapiens
ctttttctgatgttccatgatt

SEQ ID NO: 9155520 - DNA, 22 bp, Homo sapiens
ctttttcttctaggtgtgcctg

SEQ ID NO: 9155521 - DNA, 22 bp, Homo sapiens
cttttggcctcaaaggaaagaa

SEQ ID NO: 9155522 - DNA, 22 bp, Homo sapiens
cttttggcctcaaaggaaagaa

SEQ ID NO: 9155523 - DNA, 22 bp, Homo sapiens
cttttgttaggagaaaacatca

SEQ ID NO: 9155524 - DNA, 22 bp, Homo sapiens
cttttgttaggagaaaacatca

SEQ ID NO: 9155525 - DNA, 22 bp, Homo sapiens
cttttgttaggagaaaacatca

SEQ ID NO: 9155526 - DNA, 22 bp, Homo sapiens
cttttgttctacagctggggaa

SEQ ID NO: 9155527 - DNA, 22 bp, Homo sapiens
ctttttcccaggtggagagagg

SEQ ID NO: 9155528 - DNA, 22 bp, Homo sapiens
ctttggcactgcgcagccattt

SEQ ID NO: 9155529 - DNA, 22 bp, Homo sapiens
ctttggcacagtctcatttgat

SEQ ID NO: 9155530 - DNA, 22 bp, Homo sapiens
ctttggcaatgtcattttcaat

SEQ ID NO: 9155531 - DNA, 20 bp, Homo sapiens
ctttggcaatgagaacaggg

SEQ ID NO: 9155532 - DNA, 22 bp, Homo sapiens
gaaagaatgctatagtgacttc

SEQ ID NO: 9155533 - DNA, 22 bp, Homo sapiens
gaaagaatgagcatcatgactt

SEQ ID NO: 9155534 - DNA, 22 bp, Homo sapiens
gaaactttcatgaatataagat

SEQ ID NO: 9155535 - DNA, 22 bp, Homo sapiens
gaaactttggctaaaagccaga

SEQ ID NO: 9155536 - DNA, 22 bp, Homo sapiens
gaaagaagctttagatggctat

SEQ ID NO: 9155537 - DNA, 22 bp, Homo sapiens
gaaactgggaagtcccagatca

SEQ ID NO: 9155538 - DNA, 22 bp, Homo sapiens
gaaactgtgatcgtgttctggg

SEQ ID NO: 9155539 - DNA, 22 bp, Homo sapiens
gaaactgtgaggatcttaactt

SEQ ID NO: 9155540 - DNA, 22 bp, Homo sapiens
gaaactgtatgtagtttttggg

SEQ ID NO: 9155541 - DNA, 22 bp, Homo sapiens
gaaactagatgtattagagatt

SEQ ID NO: 9155542 - DNA, 22 bp, Homo sapiens
gaaactctcgcatcctgggaac

SEQ ID NO: 9155543 - DNA, 22 bp, Homo sapiens
gaaacctgtgctgatttgttag

SEQ ID NO: 9155544 - DNA, 22 bp, Homo sapiens
gaaacctgtcccctcttcctca

SEQ ID NO: 9155545 - DNA, 22 bp, Homo sapiens
gaaacctggttctgcgtgaggg

SEQ ID NO: 9155546 - DNA, 18 bp, Homo sapiens
gaaacctgaggaagaaag

SEQ ID NO: 9155547 - DNA, 22 bp, Homo sapiens
gaaacctgagccagagtgggga

SEQ ID NO: 9155548 - DNA, 22 bp, Homo sapiens
gaaacctgagtgcagatcagga

SEQ ID NO: 9155549 - DNA, 22 bp, Homo sapiens
gaaacctgggatatataagttt

SEQ ID NO: 9155550 - DNA, 22 bp, Homo sapiens
gaaacccttcctagagggcaag

SEQ ID NO: 9155551 - DNA, 22 bp, Homo sapiens
gaaacccaaactaagacagtag

SEQ ID NO: 9155552 - DNA, 22 bp, Homo sapiens
gaaaccagtttgtaccaagatc

SEQ ID NO: 9155553 - DNA, 21 bp, Homo sapiens
gaaaccaggttatcaatcaca

SEQ ID NO: 9155554 - DNA, 22 bp, Homo sapiens
gaaaaatgctccaaatctgtgg

SEQ ID NO: 9155555 - DNA, 22 bp, Homo sapiens
gaaaaatgagctgatgtcaggg

SEQ ID NO: 9155556 - DNA, 22 bp, Homo sapiens
gaaaaatgagctgatgtcaggg

SEQ ID NO: 9155557 - DNA, 22 bp, Homo sapiens
gaaaaatgagctgatgtcaggg

SEQ ID NO: 9155558 - DNA, 22 bp, Homo sapiens
gaaaacactttgatctgaaagt

SEQ ID NO: 9155559 - DNA, 22 bp, Homo sapiens
gaaacagcacgtttggagagat

SEQ ID NO: 9155560 - DNA, 22 bp, Homo sapiens
gaaacagcccctgtgtgaagca

SEQ ID NO: 9155561 - DNA, 22 bp, Homo sapiens
gaaacagctagaaagccattgg

SEQ ID NO: 9155562 - DNA, 22 bp, Homo sapiens
gaaaccagataagggaggctga

SEQ ID NO: 9155563 - DNA, 22 bp, Homo sapiens
gaaacagctttaagtgatactg

SEQ ID NO: 9155564 - DNA, 22 bp, Homo sapiens
gaaaccagcatttaaaccagga

SEQ ID NO: 9155565 - DNA, 22 bp, Homo sapiens
gaaaccagctagaggcagaggg

SEQ ID NO: 9155566 - DNA, 22 bp, Homo sapiens
ctttttgtgtatgctacagttg

SEQ ID NO: 9155567 - DNA, 22 bp, Homo sapiens
cttttttaaggtagctcctcct

SEQ ID NO: 9155568 - DNA, 22 bp, Homo sapiens
ctttttgttgtccacactagga

SEQ ID NO: 9155569 - DNA, 22 bp, Homo sapiens
cttttttaaggtagctcctcct

SEQ ID NO: 9155570 - DNA, 22 bp, Homo sapiens
gaaaaaggataaatacagtgtt

SEQ ID NO: 9155571 - DNA, 22 bp, Homo sapiens
gaaatattgtactggagatgtt

SEQ ID NO: 9155572 - DNA, 22 bp, Homo sapiens
gaaatattgtactggagatgtt

SEQ ID NO: 9155573 - DNA, 22 bp, Homo sapiens
gaaatattgggactcagagctt

SEQ ID NO: 9155574 - DNA, 22 bp, Homo sapiens
gaaatattgtactggagatgtt

SEQ ID NO: 9155575 - DNA, 22 bp, Homo sapiens
gaaatattgggactcagagctt

SEQ ID NO: 9155576 - DNA, 22 bp, Homo sapiens
gaaatgtctttgacaagagagg

SEQ ID NO: 9155577 - DNA, 20 bp, Homo sapiens
gaaatgtctatgataatgat

SEQ ID NO: 9155578 - DNA, 22 bp, Homo sapiens
gaaatattcttgtcttgttttc

SEQ ID NO: 9155579 - DNA, 22 bp, Homo sapiens
gaaatattcttgtcttgttttc

SEQ ID NO: 9155580 - DNA, 22 bp, Homo sapiens
gaaatattcttgtcttgttttc

SEQ ID NO: 9155581 - DNA, 22 bp, Homo sapiens
gaaatattacagtggaggggat

SEQ ID NO: 9155582 - DNA, 22 bp, Homo sapiens
gaaatattacagtggaggggat

SEQ ID NO: 9155583 - DNA, 22 bp, Homo sapiens
gaaatattacagtggaggggat

SEQ ID NO: 9155584 - DNA, 22 bp, Homo sapiens
gaaatatacattgcaggaagag

SEQ ID NO: 9155585 - DNA, 22 bp, Homo sapiens
gaaagacatagttgcaagatgg

SEQ ID NO: 9155586 - DNA, 22 bp, Homo sapiens
gaaagactcttgatgtctttgg

SEQ ID NO: 9155587 - DNA, 22 bp, Homo sapiens
gaaagaccgtttgggctctaaa

SEQ ID NO: 9155588 - DNA, 22 bp, Homo sapiens
gaaagaccagaattatggactc

SEQ ID NO: 9155589 - DNA, 22 bp, Homo sapiens
gaaagaccagcatgaggcttta

SEQ ID NO: 9155590 - DNA, 22 bp, Homo sapiens
gaaatacagaaagggctgaatg

SEQ ID NO: 9155591 - DNA, 22 bp, Homo sapiens
gaaatacagaaagggctgaatg

SEQ ID NO: 9155592 - DNA, 22 bp, Homo sapiens
gaaatacaggaatgccacacag

SEQ ID NO: 9155593 - DNA, 22 bp, Homo sapiens
gaaatacaggaatgccacacag

SEQ ID NO: 9155594 - DNA, 22 bp, Homo sapiens
gaagaagcaggagtgtgtagca

SEQ ID NO: 9155595 - DNA, 22 bp, Homo sapiens
gaagaagagataatggggagca

SEQ ID NO: 9155596 - DNA, 19 bp, Homo sapiens
gaagaagcttgagaagtag

SEQ ID NO: 9155597 - DNA, 22 bp, Homo sapiens
gaagaagggagtgacaaatgca

SEQ ID NO: 9155598 - DNA, 17 bp, Homo sapiens
gaagaaggaatctagaa

SEQ ID NO: 9155599 - DNA, 19 bp, Homo sapiens
gaacttggccaggcacagt

SEQ ID NO: 9155600 - DNA, 22 bp, Homo sapiens
gaacttgcagctgtgatttgtg

SEQ ID NO: 9155601 - DNA, 22 bp, Homo sapiens
gaacttggacctggtcctttgg

SEQ ID NO: 9155602 - DNA, 22 bp, Homo sapiens
gaacttggaactggggctactg

SEQ ID NO: 9155603 - DNA, 22 bp, Homo sapiens
gaacttggtattccttttaaca

SEQ ID NO: 9155604 - DNA, 20 bp, Homo sapiens
gaacttgggcaagtggctta

SEQ ID NO: 9155605 - DNA, 22 bp, Homo sapiens
gaacttgggagaagggagtgtg

SEQ ID NO: 9155606 - DNA, 22 bp, Homo sapiens
gaacttggcctgtctgtctggc

SEQ ID NO: 9155607 - DNA, 22 bp, Homo sapiens
gaagaacacttcatgattcatt

SEQ ID NO: 9155608 - DNA, 22 bp, Homo sapiens
gaagaaattgaattcatgagct

SEQ ID NO: 9155609 - DNA, 22 bp, Homo sapiens
gaaatgttatgagatatgtact

SEQ ID NO: 9155610 - DNA, 22 bp, Homo sapiens
gaaatgtgtgacaagtttcaat

SEQ ID NO: 9155611 - DNA, 22 bp, Homo sapiens
gaaattaaccacctttggcttt

SEQ ID NO: 9155612 - DNA, 22 bp, Homo sapiens
gaaattaaccacctttggcttt

SEQ ID NO: 9155613 - DNA, 22 bp, Homo sapiens
gaaattaaccacctttggcttt

SEQ ID NO: 9155614 - DNA, 22 bp, Homo sapiens
gaaattaagcaggggtctgtgg

SEQ ID NO: 9155615 - DNA, 22 bp, Homo sapiens
gaaattaagcaggggtctgtgg

SEQ ID NO: 9155616 - DNA, 22 bp, Homo sapiens
ctggttttaagctgtcagagag

SEQ ID NO: 9155617 - DNA, 22 bp, Homo sapiens
ctggttttatgttatagatgga

SEQ ID NO: 9155618 - DNA, 22 bp, Homo sapiens
ctgtccagtgcagagaacagag

SEQ ID NO: 9155619 - DNA, 22 bp, Homo sapiens
ctgtccagtgcagagaacagag

SEQ ID NO: 9155620 - DNA, 21 bp, Homo sapiens
ctgtcatgcaaccattctcca

SEQ ID NO: 9155621 - DNA, 22 bp, Homo sapiens
ctgtcagttctatctttgtgct

SEQ ID NO: 9155622 - DNA, 22 bp, Homo sapiens
ctggttctgatgttcttggctt

SEQ ID NO: 9155623 - DNA, 22 bp, Homo sapiens
ctgtccccgcgagtccagagct

SEQ ID NO: 9155624 - DNA, 22 bp, Homo sapiens
ctgtccccattgtttgagggtt

SEQ ID NO: 9155625 - DNA, 22 bp, Homo sapiens
ctgtccctcagttctgggcaaa

SEQ ID NO: 9155626 - DNA, 21 bp, Homo sapiens
ctgtccccagtgagcaccccc

SEQ ID NO: 9155627 - DNA, 21 bp, Homo sapiens
ctgtccccagtgagcaccccc

SEQ ID NO: 9155628 - DNA, 22 bp, Homo sapiens
ctgtcccatccttactctaccc

SEQ ID NO: 9155629 - DNA, 22 bp, Homo sapiens
ctgtcccagatgttctcagcac

SEQ ID NO: 9155630 - DNA, 22 bp, Homo sapiens
ctgtcccagatgttctcagcac

SEQ ID NO: 9155631 - DNA, 22 bp, Homo sapiens
ctgtggacaggggcgcagaggt

SEQ ID NO: 9155632 - DNA, 22 bp, Homo sapiens
ctgtggagttccatcaggggag

SEQ ID NO: 9155633 - DNA, 22 bp, Homo sapiens
ctgtgagggcagggaccagagg

SEQ ID NO: 9155634 - DNA, 22 bp, Homo sapiens
ctgtgaggcgggtggagtggag

SEQ ID NO: 9155635 - DNA, 22 bp, Homo sapiens
ctgtgaggcggaaaggactctc

SEQ ID NO: 9155636 - DNA, 22 bp, Homo sapiens
ctgtgaggcgggtggagtggag

SEQ ID NO: 9155637 - DNA, 22 bp, Homo sapiens
ctgtgaggccctgggtgctgga

SEQ ID NO: 9155638 - DNA, 22 bp, Homo sapiens
ctgtgagctgggtggccaggac

SEQ ID NO: 9155639 - DNA, 22 bp, Homo sapiens
ctgtgacttagagtgagtagag

SEQ ID NO: 9155640 - DNA, 22 bp, Homo sapiens
ctgtgagaagaatcccacctga

SEQ ID NO: 9155641 - DNA, 22 bp, Homo sapiens
ctgtgagaaataaatgtttgct

SEQ ID NO: 9155642 - DNA, 22 bp, Homo sapiens
ctgtgagacctgatttcttcat

SEQ ID NO: 9155643 - DNA, 22 bp, Homo sapiens
ctgtgagactgatagggaagag

SEQ ID NO: 9155644 - DNA, 22 bp, Homo sapiens
ctgtgagaaaggtgatggaggt

SEQ ID NO: 9155645 - DNA, 22 bp, Homo sapiens
ctgtgagaaaggtgatggaggt

SEQ ID NO: 9155646 - DNA, 22 bp, Homo sapiens
ctgtgagactgatagggaagag

SEQ ID NO: 9155647 - DNA, 22 bp, Homo sapiens
ctgtgagagtggtggcctaggc

SEQ ID NO: 9155648 - DNA, 22 bp, Homo sapiens
ctgtgagatatgcatatgctct

SEQ ID NO: 9155649 - DNA, 22 bp, Homo sapiens
ctgtgagatgaccaactgactg

SEQ ID NO: 9155650 - DNA, 22 bp, Homo sapiens
ctgtgagatgtttctggttaga

SEQ ID NO: 9155651 - DNA, 22 bp, Homo sapiens
ctgtgagatgtttctggttaga

SEQ ID NO: 9155652 - DNA, 22 bp, Homo sapiens
ctgtgagatttttaaataactt

SEQ ID NO: 9155653 - DNA, 22 bp, Homo sapiens
ctgtgaattaagtattgttatc

SEQ ID NO: 9155654 - DNA, 22 bp, Homo sapiens
ctgtgaaatgctttgcgatggt

SEQ ID NO: 9155655 - DNA, 22 bp, Homo sapiens
ctgtgaaatgctttgcgatggt

SEQ ID NO: 9155656 - DNA, 22 bp, Homo sapiens
ctgtgacagggatcagaatgca

SEQ ID NO: 9155657 - DNA, 22 bp, Homo sapiens
ctgtgacagtttctcagaattt

SEQ ID NO: 9155658 - DNA, 22 bp, Homo sapiens
ctgtctgttatctcaccagtcc

SEQ ID NO: 9155659 - DNA, 22 bp, Homo sapiens
ctgtctgtgtggacacggctgc

SEQ ID NO: 9155660 - DNA, 22 bp, Homo sapiens
ctgtctgtgtggacacggctgc

SEQ ID NO: 9155661 - DNA, 21 bp, Homo sapiens
ctgtccctctttgcttccctc

SEQ ID NO: 9155662 - DNA, 22 bp, Homo sapiens
ctgtctgttgaccatagtttgc

SEQ ID NO: 9155663 - DNA, 22 bp, Homo sapiens
ctgtccctcatcacctctgggt

SEQ ID NO: 9155664 - DNA, 19 bp, Homo sapiens
ctgtccctcccaggtatga

SEQ ID NO: 9155665 - DNA, 22 bp, Homo sapiens
ctgtccctcatcacctctgggt

SEQ ID NO: 9155666 - DNA, 19 bp, Homo sapiens
ctgtccctcccaggtatga

SEQ ID NO: 9155667 - DNA, 22 bp, Homo sapiens
ctgtgtttctaagtaaaggagc

SEQ ID NO: 9155668 - DNA, 22 bp, Homo sapiens
ctgtgttggcttttctcttgta

SEQ ID NO: 9155669 - DNA, 22 bp, Homo sapiens
ctgtgtttggacaacttttcag

SEQ ID NO: 9155670 - DNA, 22 bp, Homo sapiens
ctgtgtttgatgagaagccacc

SEQ ID NO: 9155671 - DNA, 22 bp, Homo sapiens
ctgtgttttgagatattattaa

SEQ ID NO: 9155672 - DNA, 23 bp, Homo sapiens
ctgtgtgtgccgagggtggccac

SEQ ID NO: 9155673 - DNA, 22 bp, Homo sapiens
ctgtgtgtgagaagcaggttga

SEQ ID NO: 9155674 - DNA, 22 bp, Homo sapiens
ctgtgtgtgctacaggcttcca

SEQ ID NO: 9155675 - DNA, 22 bp, Homo sapiens
ctgtggtctgtaggagtgatgg

SEQ ID NO: 9155676 - DNA, 20 bp, Homo sapiens
ctgtggtgagcaggagagta

SEQ ID NO: 9155677 - DNA, 22 bp, Homo sapiens
ctgtgggtattaaaaatgaatt

SEQ ID NO: 9155678 - DNA, 22 bp, Homo sapiens
ctgtggggccaaattctcctct

SEQ ID NO: 9155679 - DNA, 22 bp, Homo sapiens
ctgtgggtgaagacaagggaga

SEQ ID NO: 9155680 - DNA, 22 bp, Homo sapiens
ctgtgggtgaagacaagggaga

SEQ ID NO: 9155681 - DNA, 22 bp, Homo sapiens
ctgtgggtggctgtgccccagg

SEQ ID NO: 9155682 - DNA, 19 bp, Homo sapiens
ctgtgggtgtgcaagggtg

SEQ ID NO: 9155683 - DNA, 19 bp, Homo sapiens
ctgtgggtgtgcaagggtg

SEQ ID NO: 9155684 - DNA, 18 bp, Homo sapiens
ctgtgggctggtgcatga

SEQ ID NO: 9155685 - DNA, 18 bp, Homo sapiens
ctgtgggctggtgcatga

SEQ ID NO: 9155686 - DNA, 22 bp, Homo sapiens
ctgtgggcttgaggttagacag

SEQ ID NO: 9155687 - DNA, 22 bp, Homo sapiens
ctgtggggaaagggtcctgctc

SEQ ID NO: 9155688 - DNA, 22 bp, Homo sapiens
ctgtgggctgaaagtgctcccg

SEQ ID NO: 9155689 - DNA, 22 bp, Homo sapiens
ctgtgggctcctgcagctcagg

SEQ ID NO: 9155690 - DNA, 22 bp, Homo sapiens
ctgtgggctcctgcagctcagg

SEQ ID NO: 9155691 - DNA, 22 bp, Homo sapiens
ctgtgggctgaaagtgctcccg

SEQ ID NO: 9155692 - DNA, 22 bp, Homo sapiens
ctgtggcttctgggtcagttca

SEQ ID NO: 9155693 - DNA, 22 bp, Homo sapiens
ctgtggcttctgggtcagttca

SEQ ID NO: 9155694 - DNA, 22 bp, Homo sapiens
ctgtggcttctgcttgggcctc

SEQ ID NO: 9155695 - DNA, 22 bp, Homo sapiens
ctgtggcttctaggtccccgat

SEQ ID NO: 9155696 - DNA, 22 bp, Homo sapiens
ctgtggcttcagcattcagagc

SEQ ID NO: 9155697 - DNA, 22 bp, Homo sapiens
ctgtggcattgtgaggactgca

SEQ ID NO: 9155698 - DNA, 22 bp, Homo sapiens
ctgtggcatttagaggttgcgt

SEQ ID NO: 9155699 - DNA, 22 bp, Homo sapiens
ctgtgggagggaaggcgcggcc

SEQ ID NO: 9155700 - DNA, 22 bp, Homo sapiens
ctgtgggagggtgagagaacca

SEQ ID NO: 9155701 - DNA, 22 bp, Homo sapiens
ctgtgggagcactggggaccga

SEQ ID NO: 9155702 - DNA, 22 bp, Homo sapiens
ctgtggctttctctgcctcctt

SEQ ID NO: 9155703 - DNA, 22 bp, Homo sapiens
ctgtgggcgcctgtcagcctca

SEQ ID NO: 9155704 - DNA, 22 bp, Homo sapiens
ctgtgggcgcctgtcagcctca

SEQ ID NO: 9155705 - DNA, 22 bp, Homo sapiens
ctgtgggctcccagcttctctc

SEQ ID NO: 9155706 - DNA, 19 bp, Homo sapiens
ctgtgggcggaggaggggc

SEQ ID NO: 9155707 - DNA, 22 bp, Homo sapiens
ctgtgggcctagtctggcctag

SEQ ID NO: 9155708 - DNA, 22 bp, Homo sapiens
ctgtgggcatttgagtgtgggt

SEQ ID NO: 9155709 - DNA, 22 bp, Homo sapiens
ctgtgggcagctcctcctgtca

SEQ ID NO: 9155710 - DNA, 22 bp, Homo sapiens
ctgtgggcagctcctcctgtca

SEQ ID NO: 9155711 - DNA, 22 bp, Homo sapiens
ctgtgggcagctcctcctgtca

SEQ ID NO: 9155712 - DNA, 22 bp, Homo sapiens
ctgtggcagggaagaggccatg

SEQ ID NO: 9155713 - DNA, 22 bp, Homo sapiens
ctgtggcagggaagaggccatg

SEQ ID NO: 9155714 - DNA, 22 bp, Homo sapiens
ctgtggcaggtgtctggggcag

SEQ ID NO: 9155715 - DNA, 20 bp, Homo sapiens
ctgtggcatctgtcatggtg

SEQ ID NO: 9155716 - DNA, 20 bp, Homo sapiens
ctgtggcatctgtcatggtg

SEQ ID NO: 9155717 - DNA, 20 bp, Homo sapiens
ctgtggcatcttgaaggagg

SEQ ID NO: 9155718 - DNA, 22 bp, Homo sapiens
ctgtggcattgccgaggctggc

SEQ ID NO: 9155719 - DNA, 22 bp, Homo sapiens
ctgtggcattgccgaggctggc

SEQ ID NO: 9155720 - DNA, 22 bp, Homo sapiens
ctgtggcattgccgaggctggc

SEQ ID NO: 9155721 - DNA, 22 bp, Homo sapiens
ctgtggcattgtgaggactgca

SEQ ID NO: 9155722 - DNA, 22 bp, Homo sapiens
ctgtggcattgccgaggctggc

SEQ ID NO: 9155723 - DNA, 22 bp, Homo sapiens
ctgtggagtttgtggcgctgac

SEQ ID NO: 9155724 - DNA, 22 bp, Homo sapiens
ctgtggagtttgtggcgctgac

SEQ ID NO: 9155725 - DNA, 23 bp, Homo sapiens
ctgtggcaagtcctgcacctgcc

SEQ ID NO: 9155726 - DNA, 22 bp, Homo sapiens
ctgtggatttaggcagagctga

SEQ ID NO: 9155727 - DNA, 22 bp, Homo sapiens
ctgtggcacatgtggcaaggcc

SEQ ID NO: 9155728 - DNA, 22 bp, Homo sapiens
ctgtggcaagtctgcctgtcac

SEQ ID NO: 9155729 - DNA, 22 bp, Homo sapiens
ctgtggcaggaagggactagca

SEQ ID NO: 9155730 - DNA, 22 bp, Homo sapiens
ctgtggcactcaagaagcctcc

SEQ ID NO: 9155731 - DNA, 22 bp, Homo sapiens
ctggtagctcctgaatatccct

SEQ ID NO: 9155732 - DNA, 22 bp, Homo sapiens
ctggtggggagtcctggtctcc

SEQ ID NO: 9155733 - DNA, 22 bp, Homo sapiens
ctggtggttcaggagaatggct

SEQ ID NO: 9155734 - DNA, 22 bp, Homo sapiens
ctggtgggtagagggcatcagg

SEQ ID NO: 9155735 - DNA, 22 bp, Homo sapiens
ctggtgtaccttggctcaggca

SEQ ID NO: 9155736 - DNA, 22 bp, Homo sapiens
ctggtgtggcggcgccctgtag

SEQ ID NO: 9155737 - DNA, 22 bp, Homo sapiens
ctggttattattcttggaatgc

SEQ ID NO: 9155738 - DNA, 22 bp, Homo sapiens
ctggtacagggaaataaaggaa

SEQ ID NO: 9155739 - DNA, 22 bp, Homo sapiens
ctggtacaaaatgctgatatca

SEQ ID NO: 9155740 - DNA, 22 bp, Homo sapiens
ctggtacagtgttacaaaatgg

SEQ ID NO: 9155741 - DNA, 22 bp, Homo sapiens
ctgggttttattacagtgagct

SEQ ID NO: 9155742 - DNA, 22 bp, Homo sapiens
ctgggtttagggtctccccttg

SEQ ID NO: 9155743 - DNA, 22 bp, Homo sapiens
ctgggttgccctgggcctgtga

SEQ ID NO: 9155744 - DNA, 22 bp, Homo sapiens
ctgggttctatttttggcttca

SEQ ID NO: 9155745 - DNA, 22 bp, Homo sapiens
ctgggttcttggcacagcagga

SEQ ID NO: 9155746 - DNA, 22 bp, Homo sapiens
ctgggttctatttttggcttca

SEQ ID NO: 9155747 - DNA, 22 bp, Homo sapiens
ctgggttccatgtagccaagag

SEQ ID NO: 9155748 - DNA, 22 bp, Homo sapiens
ctgggttctctgcttagggcct

SEQ ID NO: 9155749 - DNA, 22 bp, Homo sapiens
ctgggttctatttttggcttca

SEQ ID NO: 9155750 - DNA, 22 bp, Homo sapiens
ctgggtgcttactttgtgctag

SEQ ID NO: 9155751 - DNA, 22 bp, Homo sapiens
ctgggtggttctaactgttgat

SEQ ID NO: 9155752 - DNA, 22 bp, Homo sapiens
ctgggttccatgtagccaagag

SEQ ID NO: 9155753 - DNA, 22 bp, Homo sapiens
ctgggggcagcaagaagccatg

SEQ ID NO: 9155754 - DNA, 22 bp, Homo sapiens
ctgggggccttacggaactcca

SEQ ID NO: 9155755 - DNA, 22 bp, Homo sapiens
ctggggctgtaggaggacttat

SEQ ID NO: 9155756 - DNA, 22 bp, Homo sapiens
ctggggctggtgaggcaggctc

SEQ ID NO: 9155757 - DNA, 22 bp, Homo sapiens
ctggggctggtgaggcaggctc

SEQ ID NO: 9155758 - DNA, 22 bp, Homo sapiens
ctgggctctaagggagcaccgt

SEQ ID NO: 9155759 - DNA, 20 bp, Homo sapiens
ctgggctcggtggccctggc

SEQ ID NO: 9155760 - DNA, 22 bp, Homo sapiens
ctgggctctaagggagcaccgt

SEQ ID NO: 9155761 - DNA, 18 bp, Homo sapiens
ctgggctcgagagatcct

SEQ ID NO: 9155762 - DNA, 20 bp, Homo sapiens
ctgggctcggtggccctggc

SEQ ID NO: 9155763 - DNA, 22 bp, Homo sapiens
ctgggctcctaaccatccaggt

SEQ ID NO: 9155764 - DNA, 22 bp, Homo sapiens
ctgggctccctcatgtgtctgc

SEQ ID NO: 9155765 - DNA, 22 bp, Homo sapiens
ctgggctcctaaccatccaggt

SEQ ID NO: 9155766 - DNA, 22 bp, Homo sapiens
ctggggtggtgcaggcctcatg

SEQ ID NO: 9155767 - DNA, 22 bp, Homo sapiens
ctggggtggtgcaggcctcatg

SEQ ID NO: 9155768 - DNA, 22 bp, Homo sapiens
ctggggtggtgcaggcctcatg

SEQ ID NO: 9155769 - DNA, 22 bp, Homo sapiens
ctggggtgtctcgtctgccatt

SEQ ID NO: 9155770 - DNA, 22 bp, Homo sapiens
ctggggtggaggagctcccctg

SEQ ID NO: 9155771 - DNA, 22 bp, Homo sapiens
ctggggtggatgggtccaagtt

SEQ ID NO: 9155772 - DNA, 22 bp, Homo sapiens
ctggggtcagggatcagagagc

SEQ ID NO: 9155773 - DNA, 22 bp, Homo sapiens
ctggggtccttgccatgtgtca

SEQ ID NO: 9155774 - DNA, 22 bp, Homo sapiens
ctggggtctcaattctagcggg

SEQ ID NO: 9155775 - DNA, 22 bp, Homo sapiens
ctggggtgaaggattacctgag

SEQ ID NO: 9155776 - DNA, 22 bp, Homo sapiens
ctggggggctactgacagagga

SEQ ID NO: 9155777 - DNA, 22 bp, Homo sapiens
ctggggggctactgacagagga

SEQ ID NO: 9155778 - DNA, 22 bp, Homo sapiens
ctggggggctactgacagagga

SEQ ID NO: 9155779 - DNA, 22 bp, Homo sapiens
ctggggggctactgacagagga

SEQ ID NO: 9155780 - DNA, 22 bp, Homo sapiens
ctgggggtcgcgcctctgggca

SEQ ID NO: 9155781 - DNA, 22 bp, Homo sapiens
ctgggggtcgcgcctctgggca

SEQ ID NO: 9155782 - DNA, 22 bp, Homo sapiens
ctggagccttcaccaggggaaa

SEQ ID NO: 9155783 - DNA, 22 bp, Homo sapiens
ctggagctcagcccaggttcca

SEQ ID NO: 9155784 - DNA, 22 bp, Homo sapiens
ctggagctccagggtctcctct

SEQ ID NO: 9155785 - DNA, 22 bp, Homo sapiens
ctggagctccagggtctcctct

SEQ ID NO: 9155786 - DNA, 22 bp, Homo sapiens
ctggagctccagggtctcctct

SEQ ID NO: 9155787 - DNA, 22 bp, Homo sapiens
ctgggaggcggaggttgcagtg

SEQ ID NO: 9155788 - DNA, 22 bp, Homo sapiens
ctgggaggcggagcttgcagtg

SEQ ID NO: 9155789 - DNA, 22 bp, Homo sapiens
ctgggagtactgggggatgtca

SEQ ID NO: 9155790 - DNA, 22 bp, Homo sapiens
ctgggagtcaccaggagcaagg

SEQ ID NO: 9155791 - DNA, 22 bp, Homo sapiens
ctgggagtcaccaggagcaagg

SEQ ID NO: 9155792 - DNA, 22 bp, Homo sapiens
ctgggagtcaccaggagcaagg

SEQ ID NO: 9155793 - DNA, 22 bp, Homo sapiens
ctgggagtggtgacagctctcg

SEQ ID NO: 9155794 - DNA, 22 bp, Homo sapiens
ctgggagtctggcctctggtcc

SEQ ID NO: 9155795 - DNA, 22 bp, Homo sapiens
ctgggagtccctggaatagctc

SEQ ID NO: 9155796 - DNA, 22 bp, Homo sapiens
ctgggagtccaggatacagatg

SEQ ID NO: 9155797 - DNA, 22 bp, Homo sapiens
ctgggagtctaagctagcaccg

SEQ ID NO: 9155798 - DNA, 22 bp, Homo sapiens
ctgggagtctaagctagcaccg

SEQ ID NO: 9155799 - DNA, 22 bp, Homo sapiens
ctgggatccacgggctcccaag

SEQ ID NO: 9155800 - DNA, 22 bp, Homo sapiens
ctgggatgatagtgctagtatt

SEQ ID NO: 9155801 - DNA, 22 bp, Homo sapiens
ctgggatccacgggctcccaag

SEQ ID NO: 9155802 - DNA, 22 bp, Homo sapiens
ctgggatgcggaggttgcggtg

SEQ ID NO: 9155803 - DNA, 22 bp, Homo sapiens
ctgggatgctccggcctggatg

SEQ ID NO: 9155804 - DNA, 19 bp, Homo sapiens
ctgggagttcactgctgcc

SEQ ID NO: 9155805 - DNA, 19 bp, Homo sapiens
ctgggagttcactgctgcc

SEQ ID NO: 9155806 - DNA, 22 bp, Homo sapiens
ctgggagtgttctaggtcacat

SEQ ID NO: 9155807 - DNA, 22 bp, Homo sapiens
ctgggagtgttctaggtcacat

SEQ ID NO: 9155808 - DNA, 22 bp, Homo sapiens
ctgggagtgttctaggtcacat

SEQ ID NO: 9155809 - DNA, 22 bp, Homo sapiens
ctgggcccacgagggctctggg

SEQ ID NO: 9155810 - DNA, 22 bp, Homo sapiens
ctgggcccacgagggctctggg

SEQ ID NO: 9155811 - DNA, 22 bp, Homo sapiens
ctgggccaggaccagggttgaa

SEQ ID NO: 9155812 - DNA, 22 bp, Homo sapiens
ctgggccagatccagcctcaca

SEQ ID NO: 9155813 - DNA, 19 bp, Homo sapiens
ctgggatgtctcctcccag

SEQ ID NO: 9155814 - DNA, 22 bp, Homo sapiens
ctgggatggctttcctgcatta

SEQ ID NO: 9155815 - DNA, 22 bp, Homo sapiens
ctgggatggctccgctgctgct

SEQ ID NO: 9155816 - DNA, 22 bp, Homo sapiens
ctgggctcagtgtctcactcct

SEQ ID NO: 9155817 - DNA, 22 bp, Homo sapiens
ctgggctccactacttgctaac

SEQ ID NO: 9155818 - DNA, 22 bp, Homo sapiens
ctgggctccactcccacagtgt

SEQ ID NO: 9155819 - DNA, 22 bp, Homo sapiens
ctgggctcagcccatgctgtcc

SEQ ID NO: 9155820 - DNA, 22 bp, Homo sapiens
ctgggctcagtggctcatggct

SEQ ID NO: 9155821 - DNA, 22 bp, Homo sapiens
ctgggcctccacgggccatcac

SEQ ID NO: 9155822 - DNA, 22 bp, Homo sapiens
ctgggcctccacgggccatcac

SEQ ID NO: 9155823 - DNA, 22 bp, Homo sapiens
ctgggctcaaatcctggccctg

SEQ ID NO: 9155824 - DNA, 22 bp, Homo sapiens
ctgggctcaagaagtcttccct

SEQ ID NO: 9155825 - DNA, 22 bp, Homo sapiens
ctgggctcaaatcctggccctg

SEQ ID NO: 9155826 - DNA, 22 bp, Homo sapiens
ctgggctcagcaggccaaggcc

SEQ ID NO: 9155827 - DNA, 22 bp, Homo sapiens
ctgggctcagcaggccaaggcc

SEQ ID NO: 9155828 - DNA, 22 bp, Homo sapiens
ctgggctcagcaggccaaggcc

SEQ ID NO: 9155829 - DNA, 22 bp, Homo sapiens
ctgggccctatggaagaaaggg

SEQ ID NO: 9155830 - DNA, 22 bp, Homo sapiens
ctgggcccaggcggctctcgga

SEQ ID NO: 9155831 - DNA, 22 bp, Homo sapiens
ctgggccctatggaagaaaggg

SEQ ID NO: 9155832 - DNA, 22 bp, Homo sapiens
ctgggcctagcaacagaggagt

SEQ ID NO: 9155833 - DNA, 22 bp, Homo sapiens
ctgggcctagcaacagaggagt

SEQ ID NO: 9155834 - DNA, 22 bp, Homo sapiens
ctgggcctcacacccaccaaat

SEQ ID NO: 9155835 - DNA, 22 bp, Homo sapiens
ctgggcctcacacccaccaaat

SEQ ID NO: 9155836 - DNA, 22 bp, Homo sapiens
ctgggcctcaccctagaccaat

SEQ ID NO: 9155837 - DNA, 23 bp, Homo sapiens
ctgggcctatggtctgaatccaa

SEQ ID NO: 9155838 - DNA, 22 bp, Homo sapiens
ctgggcctcatccagccacaac

SEQ ID NO: 9155839 - DNA, 22 bp, Homo sapiens
ctgggcctcatccccagagttt

SEQ ID NO: 9155840 - DNA, 22 bp, Homo sapiens
tttggaatattaaaatgtctca

SEQ ID NO: 9155841 - DNA, 22 bp, Homo sapiens
tttggaatggtaccttcagttg

SEQ ID NO: 9155842 - DNA, 22 bp, Homo sapiens
tttggaatgttaggtgtctcat

SEQ ID NO: 9155843 - DNA, 22 bp, Homo sapiens
tttggaatgtagtttaatcatc

SEQ ID NO: 9155844 - DNA, 20 bp, Homo sapiens
ctctgggctgcaccctcgcc

SEQ ID NO: 9155845 - DNA, 23 bp, Homo sapiens
ctctgggtccgatgtcctgacag

SEQ ID NO: 9155846 - DNA, 22 bp, Homo sapiens
tttgttcattaaaagtgctgta

SEQ ID NO: 9155847 - DNA, 22 bp, Homo sapiens
ctctgggtgtgacagcacctgg

SEQ ID NO: 9155848 - DNA, 22 bp, Homo sapiens
ctctgggtgttaatgtcagtgt

SEQ ID NO: 9155849 - DNA, 22 bp, Homo sapiens
tttgttcagctctcattgatta

SEQ ID NO: 9155850 - DNA, 21 bp, Homo sapiens
tttgttcaggcaagttacagt

SEQ ID NO: 9155851 - DNA, 22 bp, Homo sapiens
ctctgggtgggcagcagatgga

SEQ ID NO: 9155852 - DNA, 22 bp, Homo sapiens
ctctgggtgcagcgctgaccgg

SEQ ID NO: 9155853 - DNA, 17 bp, Homo sapiens
ctctgggtgcctgtgtg

SEQ ID NO: 9155854 - DNA, 22 bp, Homo sapiens
ctctgggtggtctcactgagtg

SEQ ID NO: 9155855 - DNA, 22 bp, Homo sapiens
ctctgggtgtcttaggagctca

SEQ ID NO: 9155856 - DNA, 22 bp, Homo sapiens
ctctgggtctacctgtggccag

SEQ ID NO: 9155857 - DNA, 20 bp, Homo sapiens
ctctgggtcgagacagactt

SEQ ID NO: 9155858 - DNA, 22 bp, Homo sapiens
ctctgggtcctggggctacaag

SEQ ID NO: 9155859 - DNA, 22 bp, Homo sapiens
ctctgggtctataatgcagctg

SEQ ID NO: 9155860 - DNA, 22 bp, Homo sapiens
ctctgggtctccctgaggctaa

SEQ ID NO: 9155861 - DNA, 22 bp, Homo sapiens
ttttgctgtgtccttgagccgg

SEQ ID NO: 9155862 - DNA, 21 bp, Homo sapiens
ttttgctgttttagaatgaga

SEQ ID NO: 9155863 - DNA, 22 bp, Homo sapiens
ttttgctgttatatgctattat

SEQ ID NO: 9155864 - DNA, 22 bp, Homo sapiens
ttttgctggggtggctagctta

SEQ ID NO: 9155865 - DNA, 22 bp, Homo sapiens
ttttgcctaagaatctctctga

SEQ ID NO: 9155866 - DNA, 17 bp, Homo sapiens
ttttctctcttggattc

SEQ ID NO: 9155867 - DNA, 17 bp, Homo sapiens
ttttctctcttggattc

SEQ ID NO: 9155868 - DNA, 17 bp, Homo sapiens
ttttctctcttggattc

SEQ ID NO: 9155869 - DNA, 22 bp, Homo sapiens
ttttctctccaggtggggtgat

SEQ ID NO: 9155870 - DNA, 22 bp, Homo sapiens
ctctgtgtggtagattccatta

SEQ ID NO: 9155871 - DNA, 22 bp, Homo sapiens
ctctgtgttcagcctagcagaa

SEQ ID NO: 9155872 - DNA, 22 bp, Homo sapiens
ctctgtgtggtcctctgtattg

SEQ ID NO: 9155873 - DNA, 22 bp, Homo sapiens
ctctgtgggccagagaggcccc

SEQ ID NO: 9155874 - DNA, 22 bp, Homo sapiens
ctctgtgggccagagaggcccc

SEQ ID NO: 9155875 - DNA, 22 bp, Homo sapiens
ctctgtgggggagaggcagctg

SEQ ID NO: 9155876 - DNA, 22 bp, Homo sapiens
ctctgtgggggagaggcagctg

SEQ ID NO: 9155877 - DNA, 22 bp, Homo sapiens
ctctgtggtaaaatagcagtat

SEQ ID NO: 9155878 - DNA, 22 bp, Homo sapiens
ctctgtggctacacaaacctcc

SEQ ID NO: 9155879 - DNA, 22 bp, Homo sapiens
ctctgtgggaggaggagtaggc

SEQ ID NO: 9155880 - DNA, 22 bp, Homo sapiens
ctctgtgccagtctgcactcgg

SEQ ID NO: 9155881 - DNA, 22 bp, Homo sapiens
ctctgtgcgggccatggtcagg

SEQ ID NO: 9155882 - DNA, 22 bp, Homo sapiens
tttgttctagatcgtgtttgtg

SEQ ID NO: 9155883 - DNA, 22 bp, Homo sapiens
tttgttcccagatttgctggca

SEQ ID NO: 9155884 - DNA, 22 bp, Homo sapiens
tttgttcattttgagctcatca

SEQ ID NO: 9155885 - DNA, 22 bp, Homo sapiens
tttgcaaacggccctgagtccc

SEQ ID NO: 9155886 - DNA, 22 bp, Homo sapiens
tttgcaaaccggagctctgcaa

SEQ ID NO: 9155887 - DNA, 22 bp, Homo sapiens
tttgcaaacattcagggctcca

SEQ ID NO: 9155888 - DNA, 22 bp, Homo sapiens
tttgcaaacacttaagaagaga

SEQ ID NO: 9155889 - DNA, 22 bp, Homo sapiens
tttgcaaacacttaagaagaga

SEQ ID NO: 9155890 - DNA, 22 bp, Homo sapiens
tttgagaactttggtattttcc

SEQ ID NO: 9155891 - DNA, 22 bp, Homo sapiens
tttgcaaaatgaggtgaagagt

SEQ ID NO: 9155892 - DNA, 22 bp, Homo sapiens
tttgagaagatgtaatgttaag

SEQ ID NO: 9155893 - DNA, 22 bp, Homo sapiens
tttgactgttttatgaggtggt

SEQ ID NO: 9155894 - DNA, 22 bp, Homo sapiens
tttgactcttctagcaagtgtg

SEQ ID NO: 9155895 - DNA, 22 bp, Homo sapiens
tttgactcttgcccagtttggc

SEQ ID NO: 9155896 - DNA, 22 bp, Homo sapiens
tttgactgtgccacccagggtg

SEQ ID NO: 9155897 - DNA, 22 bp, Homo sapiens
tttgactgcccgagcctcccag

SEQ ID NO: 9155898 - DNA, 19 bp, Homo sapiens
tttgactcctcatttttat

SEQ ID NO: 9155899 - DNA, 22 bp, Homo sapiens
tttgactccagagcccattttt

SEQ ID NO: 9155900 - DNA, 22 bp, Homo sapiens
tttgactcctttgtgaaaagag

SEQ ID NO: 9155901 - DNA, 22 bp, Homo sapiens
tttgactctagtcatagaagtg

SEQ ID NO: 9155902 - DNA, 22 bp, Homo sapiens
tttgactctagtcatagaagtg

SEQ ID NO: 9155903 - DNA, 22 bp, Homo sapiens
tttgagaaaaagtgatgatgat

SEQ ID NO: 9155904 - DNA, 22 bp, Homo sapiens
tttgagaaaggggatttaattc

SEQ ID NO: 9155905 - DNA, 22 bp, Homo sapiens
tttgagaaccctgtattttaag

SEQ ID NO: 9155906 - DNA, 22 bp, Homo sapiens
ctctggcctgcttcctcaggta

SEQ ID NO: 9155907 - DNA, 22 bp, Homo sapiens
ctctggccgagcatgggggtta

SEQ ID NO: 9155908 - DNA, 22 bp, Homo sapiens
ctctggccccagtggccccttg

SEQ ID NO: 9155909 - DNA, 22 bp, Homo sapiens
ctctggagtgcagcctggtggc

SEQ ID NO: 9155910 - DNA, 22 bp, Homo sapiens
ctctggcacactccttccaggt

SEQ ID NO: 9155911 - DNA, 22 bp, Homo sapiens
tttgaaacctagttatatgact

SEQ ID NO: 9155912 - DNA, 22 bp, Homo sapiens
tttgaaactcatgatcatcact

SEQ ID NO: 9155913 - DNA, 22 bp, Homo sapiens
tttgaaactctgaacatgtttc

SEQ ID NO: 9155914 - DNA, 22 bp, Homo sapiens
tttgaaacaggtgattcagcta

SEQ ID NO: 9155915 - DNA, 22 bp, Homo sapiens
tttgaaaattagacacaggcta

SEQ ID NO: 9155916 - DNA, 22 bp, Homo sapiens
tttgaaaagaaccatcgcctta

SEQ ID NO: 9155917 - DNA, 22 bp, Homo sapiens
tttgaaaatttaagtgctacac

SEQ ID NO: 9155918 - DNA, 22 bp, Homo sapiens
tttgaaaattagacacaggcta

SEQ ID NO: 9155919 - DNA, 22 bp, Homo sapiens
ctctgaagggagggccaagccc

SEQ ID NO: 9155920 - DNA, 22 bp, Homo sapiens
ctctgaagatggtaccagcttt

SEQ ID NO: 9155921 - DNA, 22 bp, Homo sapiens
tttgaaaagaaccatcgcctta

SEQ ID NO: 9155922 - DNA, 22 bp, Homo sapiens
tttgaaaacttaatttggtcgt

SEQ ID NO: 9155923 - DNA, 22 bp, Homo sapiens
tttgaaaacttaatttggtcgt

SEQ ID NO: 9155924 - DNA, 22 bp, Homo sapiens
tttgaaaaaggcctttggtatg

SEQ ID NO: 9155925 - DNA, 22 bp, Homo sapiens
tttgaaaaaggcctttggtatg

SEQ ID NO: 9155926 - DNA, 22 bp, Homo sapiens
ctctgcagaatttgagctgctc

SEQ ID NO: 9155927 - DNA, 22 bp, Homo sapiens
ctctgcagagcctccagcccag

SEQ ID NO: 9155928 - DNA, 22 bp, Homo sapiens
ctctgcacctacacaacaggaa

SEQ ID NO: 9155929 - DNA, 22 bp, Homo sapiens
ctctgcactgtccggctttctt

SEQ ID NO: 9155930 - DNA, 22 bp, Homo sapiens
tttgacattttctcactgtgtt

SEQ ID NO: 9155931 - DNA, 22 bp, Homo sapiens
tttgaccagaggtccctggaaa

SEQ ID NO: 9155932 - DNA, 22 bp, Homo sapiens
tttgacattggcttattctgtt

SEQ ID NO: 9155933 - DNA, 22 bp, Homo sapiens
tttgaatagaggcccctcagaa

SEQ ID NO: 9155934 - DNA, 19 bp, Homo sapiens
tttgacgttgaatatcact

SEQ ID NO: 9155935 - DNA, 20 bp, Homo sapiens
tttgactaggtaagtgcttt

SEQ ID NO: 9155936 - DNA, 22 bp, Homo sapiens
tttgaccgtatcatattgacag

SEQ ID NO: 9155937 - DNA, 22 bp, Homo sapiens
tttgactcagcaaattcacagg

SEQ ID NO: 9155938 - DNA, 20 bp, Homo sapiens
tttgactcaggcctttagcc

SEQ ID NO: 9155939 - DNA, 22 bp, Homo sapiens
tttgactcattaaagtctccgt

SEQ ID NO: 9155940 - DNA, 22 bp, Homo sapiens
ctctgagtttcatttccctcct

SEQ ID NO: 9155941 - DNA, 22 bp, Homo sapiens
ctctgaggtttcctcacaagct

SEQ ID NO: 9155942 - DNA, 19 bp, Homo sapiens
tttgaaagagttttattgg

SEQ ID NO: 9155943 - DNA, 22 bp, Homo sapiens
ctctgaggttcctttgccctcg

SEQ ID NO: 9155944 - DNA, 22 bp, Homo sapiens
ctctgaggttccctgggtccca

SEQ ID NO: 9155945 - DNA, 23 bp, Homo sapiens
tttatgctatactggaagggaaa

SEQ ID NO: 9155946 - DNA, 22 bp, Homo sapiens
tttatgctactcaatagtcagt

SEQ ID NO: 9155947 - DNA, 22 bp, Homo sapiens
tttatgctgaggcccaggaata

SEQ ID NO: 9155948 - DNA, 21 bp, Homo sapiens
tttatgcagataatgctattt

SEQ ID NO: 9155949 - DNA, 22 bp, Homo sapiens
tttatgcagcactttacatttg

SEQ ID NO: 9155950 - DNA, 22 bp, Homo sapiens
tttattcactggggtctgcccg

SEQ ID NO: 9155951 - DNA, 22 bp, Homo sapiens
tttattcactggggtctgcccg

SEQ ID NO: 9155952 - DNA, 22 bp, Homo sapiens
tttattcactcattcagccagt

SEQ ID NO: 9155953 - DNA, 22 bp, Homo sapiens
tttattcagcagcagcagtggt

SEQ ID NO: 9155954 - DNA, 22 bp, Homo sapiens
tttattcacttcagtgccaaag

SEQ ID NO: 9155955 - DNA, 22 bp, Homo sapiens
tttattcacttcagtgccaaag

SEQ ID NO: 9155956 - DNA, 19 bp, Homo sapiens
tttattcacctttaccttg

SEQ ID NO: 9155957 - DNA, 19 bp, Homo sapiens
tttattcacctttaccttg

SEQ ID NO: 9155958 - DNA, 22 bp, Homo sapiens
tttattcactcattcagccagt

SEQ ID NO: 9155959 - DNA, 22 bp, Homo sapiens
tttatgtaagtggaatgatgcc

SEQ ID NO: 9155960 - DNA, 22 bp, Homo sapiens
ctccaggatgttagacgtccag

SEQ ID NO: 9155961 - DNA, 22 bp, Homo sapiens
ctccaggatgttagacgtccag

SEQ ID NO: 9155962 - DNA, 22 bp, Homo sapiens
ctccaggatacctgttcctata

SEQ ID NO: 9155963 - DNA, 22 bp, Homo sapiens
ctccaggatacctgttcctata

SEQ ID NO: 9155964 - DNA, 19 bp, Homo sapiens
ctccaggatggctgggcga

SEQ ID NO: 9155965 - DNA, 22 bp, Homo sapiens
ctccaggaggttgctgcttcct

SEQ ID NO: 9155966 - DNA, 22 bp, Homo sapiens
ctccaggagggggatggctgta

SEQ ID NO: 9155967 - DNA, 22 bp, Homo sapiens
ctccaggagggggatggctgta

SEQ ID NO: 9155968 - DNA, 22 bp, Homo sapiens
ctccaggactgaggacagagct

SEQ ID NO: 9155969 - DNA, 22 bp, Homo sapiens
ctccaggagctgtgtctttctt

SEQ ID NO: 9155970 - DNA, 22 bp, Homo sapiens
ctccaggagggggatggctgta

SEQ ID NO: 9155971 - DNA, 22 bp, Homo sapiens
ctccaggagggcttcctgtgat

SEQ ID NO: 9155972 - DNA, 22 bp, Homo sapiens
ctccaggccaagattaagtaat

SEQ ID NO: 9155973 - DNA, 22 bp, Homo sapiens
ctccaggccagggaagtggaca

SEQ ID NO: 9155974 - DNA, 22 bp, Homo sapiens
ctccaggccagggaagtggaca

SEQ ID NO: 9155975 - DNA, 22 bp, Homo sapiens
ctccaggccatggctgcggagg

SEQ ID NO: 9155976 - DNA, 22 bp, Homo sapiens
ctccaggccatggctgcggagg

SEQ ID NO: 9155977 - DNA, 22 bp, Homo sapiens
ctccaggcccctggccttctgc

SEQ ID NO: 9155978 - DNA, 22 bp, Homo sapiens
ctccaggcccacgtcgaggagg

SEQ ID NO: 9155979 - DNA, 22 bp, Homo sapiens
tttcagaaattgttattattct

SEQ ID NO: 9155980 - DNA, 22 bp, Homo sapiens
tttcagaaattgttattattct

SEQ ID NO: 9155981 - DNA, 22 bp, Homo sapiens
tttcagaacagggattgggcct

SEQ ID NO: 9155982 - DNA, 22 bp, Homo sapiens
tttcagaacataatgtgagcat

SEQ ID NO: 9155983 - DNA, 22 bp, Homo sapiens
tttcagaaattatattagatgc

SEQ ID NO: 9155984 - DNA, 22 bp, Homo sapiens
tttcagaaccgctaaaataaat

SEQ ID NO: 9155985 - DNA, 22 bp, Homo sapiens
tttcagaaccgctaaaataaat

SEQ ID NO: 9155986 - DNA, 22 bp, Homo sapiens
tttcagaaccgctaaaataaat

SEQ ID NO: 9155987 - DNA, 22 bp, Homo sapiens
tttcagaagtcaactaggtaaa

SEQ ID NO: 9155988 - DNA, 22 bp, Homo sapiens
tttattcatcatctgttcatat

SEQ ID NO: 9155989 - DNA, 22 bp, Homo sapiens
tttattcagcagcagcagtggt

SEQ ID NO: 9155990 - DNA, 20 bp, Homo sapiens
tttattcagcctaccctctt

SEQ ID NO: 9155991 - DNA, 22 bp, Homo sapiens
tttattcattgtttcgtcgcag

SEQ ID NO: 9155992 - DNA, 22 bp, Homo sapiens
tttattcatcatctgttcatat

SEQ ID NO: 9155993 - DNA, 22 bp, Homo sapiens
tttcagaatagcaaagcaagct

SEQ ID NO: 9155994 - DNA, 22 bp, Homo sapiens
tttcagaatagcaaagcaagct

SEQ ID NO: 9155995 - DNA, 22 bp, Homo sapiens
tttcagaatatcgattcagtga

SEQ ID NO: 9155996 - DNA, 22 bp, Homo sapiens
ctccttcatgtcatgtgtccgg

SEQ ID NO: 9155997 - DNA, 22 bp, Homo sapiens
ctccttcagctgaatccctgct

SEQ ID NO: 9155998 - DNA, 22 bp, Homo sapiens
tttccaatttggtagtcatcgg

SEQ ID NO: 9155999 - DNA, 22 bp, Homo sapiens
tttccacaatttgagcagcaga

SEQ ID NO: 9156000 - DNA, 22 bp, Homo sapiens
tttccacacaggctctactact

SEQ ID NO: 9156001 - DNA, 22 bp, Homo sapiens
tttccacccagagcatttgttt

SEQ ID NO: 9156002 - DNA, 22 bp, Homo sapiens
tttccactcctattgcatctca

SEQ ID NO: 9156003 - DNA, 22 bp, Homo sapiens
tttccacatcaccatgaggtga

SEQ ID NO: 9156004 - DNA, 22 bp, Homo sapiens
tttccacactcactgcactcat

SEQ ID NO: 9156005 - DNA, 22 bp, Homo sapiens
tttccacactgcagccagcaaa

SEQ ID NO: 9156006 - DNA, 22 bp, Homo sapiens
tttccactctggccaccatctt

SEQ ID NO: 9156007 - DNA, 22 bp, Homo sapiens
tttccactctggccaccatctt

SEQ ID NO: 9156008 - DNA, 22 bp, Homo sapiens
tttcctttctagaagcctaaat

SEQ ID NO: 9156009 - DNA, 22 bp, Homo sapiens
tttcattataaaaagttggctt

SEQ ID NO: 9156010 - DNA, 18 bp, Homo sapiens
tttcattataaagcaggc

SEQ ID NO: 9156011 - DNA, 22 bp, Homo sapiens
tttcattacgtgtttgacttgt

SEQ ID NO: 9156012 - DNA, 22 bp, Homo sapiens
tttcatgtttatggaaaatgag

SEQ ID NO: 9156013 - DNA, 22 bp, Homo sapiens
tttcatgttacatttaaaatgt

SEQ ID NO: 9156014 - DNA, 22 bp, Homo sapiens
tttcatgttggatactgtttca

SEQ ID NO: 9156015 - DNA, 19 bp, Homo sapiens
ctctctggcggtgtctgcg

SEQ ID NO: 9156016 - DNA, 19 bp, Homo sapiens
ctctctggcggtgtctgcg

SEQ ID NO: 9156017 - DNA, 18 bp, Homo sapiens
ctctctggtctggatccc

SEQ ID NO: 9156018 - DNA, 22 bp, Homo sapiens
tttctcaactgtattatgcaga

SEQ ID NO: 9156019 - DNA, 22 bp, Homo sapiens
tttctcaagctgtttgccaatt

SEQ ID NO: 9156020 - DNA, 22 bp, Homo sapiens
tttctacatgtcagtaactgat

SEQ ID NO: 9156021 - DNA, 22 bp, Homo sapiens
tttctcaaatactgttccagga

SEQ ID NO: 9156022 - DNA, 22 bp, Homo sapiens
ctctctggtttcagcgaagggg

SEQ ID NO: 9156023 - DNA, 18 bp, Homo sapiens
ctctctggtctggatccc

SEQ ID NO: 9156024 - DNA, 22 bp, Homo sapiens
ctctctgtcttggcatttggtc

SEQ ID NO: 9156025 - DNA, 22 bp, Homo sapiens
ctctctgtggtggctgtcccat

SEQ ID NO: 9156026 - DNA, 22 bp, Homo sapiens
ctctctgtggtggctgtcccat

SEQ ID NO: 9156027 - DNA, 22 bp, Homo sapiens
ctctctgtggtggctgtcccat

SEQ ID NO: 9156028 - DNA, 22 bp, Homo sapiens
ctctctgttatgctttcatgaa

SEQ ID NO: 9156029 - DNA, 22 bp, Homo sapiens
ctctcttcccgtgagtgttgca

SEQ ID NO: 9156030 - DNA, 22 bp, Homo sapiens
ctctctttcattggtcgccttg

SEQ ID NO: 9156031 - DNA, 22 bp, Homo sapiens
ctctctttcattggtcgccttg

SEQ ID NO: 9156032 - DNA, 22 bp, Homo sapiens
ctctctttcattggtcgccttg

SEQ ID NO: 9156033 - DNA, 18 bp, Homo sapiens
ctctctttccactctttg

SEQ ID NO: 9156034 - DNA, 18 bp, Homo sapiens
ctctgaaagacacaccag

SEQ ID NO: 9156035 - DNA, 22 bp, Homo sapiens
ctctgaaagacaagctctcatt

SEQ ID NO: 9156036 - DNA, 22 bp, Homo sapiens
ctctgaaagagtttagtattat

SEQ ID NO: 9156037 - DNA, 22 bp, Homo sapiens
ctctgaaattggccctcagcag

SEQ ID NO: 9156038 - DNA, 22 bp, Homo sapiens
ctctgaaagttagagaaaatag

SEQ ID NO: 9156039 - DNA, 22 bp, Homo sapiens
ctctgaaagttagagaaaatag

SEQ ID NO: 9156040 - DNA, 22 bp, Homo sapiens
ctctgaaagcaaaactagagaa

SEQ ID NO: 9156041 - DNA, 22 bp, Homo sapiens
ctctgaaagcaaaactagagaa

SEQ ID NO: 9156042 - DNA, 22 bp, Homo sapiens
ctctctttctgaatgaggacta

SEQ ID NO: 9156043 - DNA, 22 bp, Homo sapiens
ctctctttctgaatgaggacta

SEQ ID NO: 9156044 - DNA, 18 bp, Homo sapiens
ctctctttccactctttg

SEQ ID NO: 9156045 - DNA, 22 bp, Homo sapiens
ctctgaaactcctgcaccttct

SEQ ID NO: 9156046 - DNA, 22 bp, Homo sapiens
ctctgaaactccagccccaggt

SEQ ID NO: 9156047 - DNA, 22 bp, Homo sapiens
ctctgaaaatgtggtggggaaa

SEQ ID NO: 9156048 - DNA, 22 bp, Homo sapiens
ctctctttttcgtgtgccgaag

SEQ ID NO: 9156049 - DNA, 22 bp, Homo sapiens
ctctctttgatgtataaataat

SEQ ID NO: 9156050 - DNA, 22 bp, Homo sapiens
ctctctttgatgtataaataat

SEQ ID NO: 9156051 - DNA, 22 bp, Homo sapiens
ctgctgtgacagctgccgtgtt

SEQ ID NO: 9156052 - DNA, 22 bp, Homo sapiens
ctgctgtgagcactccagcctg

SEQ ID NO: 9156053 - DNA, 22 bp, Homo sapiens
ctgctgtgacagctgccgtgtt

SEQ ID NO: 9156054 - DNA, 22 bp, Homo sapiens
ctgctgtgagtggttcttgcct

SEQ ID NO: 9156055 - DNA, 22 bp, Homo sapiens
ctgctgtgagcactccagcctg

SEQ ID NO: 9156056 - DNA, 22 bp, Homo sapiens
ctgctgtctttatttcactgct

SEQ ID NO: 9156057 - DNA, 23 bp, Homo sapiens
ctgctgtgaaacatggttttggt

SEQ ID NO: 9156058 - DNA, 22 bp, Homo sapiens
ctgctgtctagtatcttaaaaa

SEQ ID NO: 9156059 - DNA, 22 bp, Homo sapiens
ctgctgtgagtttggaggtcta

SEQ ID NO: 9156060 - DNA, 22 bp, Homo sapiens
ctgctgtgagtttggaggtcta

SEQ ID NO: 9156061 - DNA, 22 bp, Homo sapiens
ctggaaagtgctgagacaattg

SEQ ID NO: 9156062 - DNA, 22 bp, Homo sapiens
ctggaaggagaaggaggctgtg

SEQ ID NO: 9156063 - DNA, 22 bp, Homo sapiens
ctggaaggagaaggaggctgtg

SEQ ID NO: 9156064 - DNA, 22 bp, Homo sapiens
ctggaagcttgtttgccagtct

SEQ ID NO: 9156065 - DNA, 22 bp, Homo sapiens
ctggaagcttgtttgccagtct

SEQ ID NO: 9156066 - DNA, 22 bp, Homo sapiens
ctggaagctggaacaggtgtgg

SEQ ID NO: 9156067 - DNA, 22 bp, Homo sapiens
ctggaagctggaacaggtgtgg

SEQ ID NO: 9156068 - DNA, 20 bp, Homo sapiens
ctggaagcctttccagagca

SEQ ID NO: 9156069 - DNA, 22 bp, Homo sapiens
ctggaagagtcctaaacagata

SEQ ID NO: 9156070 - DNA, 22 bp, Homo sapiens
ctggaagagtaatataaattag

SEQ ID NO: 9156071 - DNA, 22 bp, Homo sapiens
ctggaagaggggaaatgccatg

SEQ ID NO: 9156072 - DNA, 22 bp, Homo sapiens
ctggaagaggaagccagctgga

SEQ ID NO: 9156073 - DNA, 19 bp, Homo sapiens
ctggaaggagggactgttc

SEQ ID NO: 9156074 - DNA, 22 bp, Homo sapiens
ctggaagggagcactgtagaga

SEQ ID NO: 9156075 - DNA, 22 bp, Homo sapiens
ctggaagggtcagagtgatgag

SEQ ID NO: 9156076 - DNA, 22 bp, Homo sapiens
ctggagaaacatcaggcatagg

SEQ ID NO: 9156077 - DNA, 22 bp, Homo sapiens
ctggagagaccgaaagaggctg

SEQ ID NO: 9156078 - DNA, 22 bp, Homo sapiens
ctggaaggttcctcccagctcc

SEQ ID NO: 9156079 - DNA, 22 bp, Homo sapiens
ctggaagggtctacttagcaga

SEQ ID NO: 9156080 - DNA, 22 bp, Homo sapiens
ctggaaggtggatggcgaggcc

SEQ ID NO: 9156081 - DNA, 22 bp, Homo sapiens
ctggaaggtgactgtcttgaat

SEQ ID NO: 9156082 - DNA, 22 bp, Homo sapiens
ctggagaggccccaagatattt

SEQ ID NO: 9156083 - DNA, 22 bp, Homo sapiens
ctggagaggctgggaacaggtt

SEQ ID NO: 9156084 - DNA, 22 bp, Homo sapiens
ctggagagagaaaaagccttaa

SEQ ID NO: 9156085 - DNA, 22 bp, Homo sapiens
ctggagagatcctcctgaaaaa

SEQ ID NO: 9156086 - DNA, 22 bp, Homo sapiens
ctggagagagaaaaagccttaa

SEQ ID NO: 9156087 - DNA, 22 bp, Homo sapiens
ctggagaggctgggaacaggtt

SEQ ID NO: 9156088 - DNA, 22 bp, Homo sapiens
ctggagaggctgggaacaggtt

SEQ ID NO: 9156089 - DNA, 22 bp, Homo sapiens
ctggagaggctgggaacaggtt

SEQ ID NO: 9156090 - DNA, 22 bp, Homo sapiens
ctggagagggagccctggcagt

SEQ ID NO: 9156091 - DNA, 22 bp, Homo sapiens
ctggagagggagccctggcagt

SEQ ID NO: 9156092 - DNA, 22 bp, Homo sapiens
ctggagagggagccctggcagt

SEQ ID NO: 9156093 - DNA, 22 bp, Homo sapiens
ctggagagggagctgttggaag

SEQ ID NO: 9156094 - DNA, 22 bp, Homo sapiens
ctggagagttggaagatggact

SEQ ID NO: 9156095 - DNA, 22 bp, Homo sapiens
ctggagagttggaagatggact

SEQ ID NO: 9156096 - DNA, 22 bp, Homo sapiens
ctggagcaaaagtgactcctct

SEQ ID NO: 9156097 - DNA, 22 bp, Homo sapiens
ctggagattaagttctcagcca

SEQ ID NO: 9156098 - DNA, 22 bp, Homo sapiens
ctggagatgtccgggtgctgtt

SEQ ID NO: 9156099 - DNA, 22 bp, Homo sapiens
ctggagcaaaagtgactcctct

SEQ ID NO: 9156100 - DNA, 22 bp, Homo sapiens
ctggagagttggaagatggact

SEQ ID NO: 9156101 - DNA, 22 bp, Homo sapiens
ctggagatactgctctccatat

SEQ ID NO: 9156102 - DNA, 22 bp, Homo sapiens
ctggagcagcaggtggccaggg

SEQ ID NO: 9156103 - DNA, 22 bp, Homo sapiens
ctggagcagcaggtggccaggg

SEQ ID NO: 9156104 - DNA, 22 bp, Homo sapiens
ctggagcaggcttgtcccagct

SEQ ID NO: 9156105 - DNA, 22 bp, Homo sapiens
ctggagcagcaggtggccaggg

SEQ ID NO: 9156106 - DNA, 22 bp, Homo sapiens
ctggagcaggtttaggagtccc

SEQ ID NO: 9156107 - DNA, 22 bp, Homo sapiens
ctggagccggaccagggacggt

SEQ ID NO: 9156108 - DNA, 22 bp, Homo sapiens
ctggagccgcatggagcaggga

SEQ ID NO: 9156109 - DNA, 22 bp, Homo sapiens
ctggagccctgaatgggcagga

SEQ ID NO: 9156110 - DNA, 22 bp, Homo sapiens
ctggagccggcgagccccagcc

SEQ ID NO: 9156111 - DNA, 22 bp, Homo sapiens
ctgctggtaccagtggccgtca

SEQ ID NO: 9156112 - DNA, 19 bp, Homo sapiens
ctgctgggtgctgagggag

SEQ ID NO: 9156113 - DNA, 19 bp, Homo sapiens
ctgctgggtgctgagggag

SEQ ID NO: 9156114 - DNA, 19 bp, Homo sapiens
ctgctgggtgctgagggag

SEQ ID NO: 9156115 - DNA, 19 bp, Homo sapiens
ctgctgggtgctgagggag

SEQ ID NO: 9156116 - DNA, 22 bp, Homo sapiens
ctgctggggtcagagcactggg

SEQ ID NO: 9156117 - DNA, 22 bp, Homo sapiens
ctgctgggtctatgcaagtgga

SEQ ID NO: 9156118 - DNA, 22 bp, Homo sapiens
ctgctgggtctatgcaagtgga

SEQ ID NO: 9156119 - DNA, 22 bp, Homo sapiens
ctgctgggtctatgcaagtgga

SEQ ID NO: 9156120 - DNA, 22 bp, Homo sapiens
ctgctgggtctatgcaagtgga

SEQ ID NO: 9156121 - DNA, 22 bp, Homo sapiens
ctgctgtaatgagtcagcatct

SEQ ID NO: 9156122 - DNA, 22 bp, Homo sapiens
ctgctgtaatgagtcagcatct

SEQ ID NO: 9156123 - DNA, 22 bp, Homo sapiens
ctgctggttagtcttagtggga

SEQ ID NO: 9156124 - DNA, 22 bp, Homo sapiens
ctgctggttgcacagagctagg

SEQ ID NO: 9156125 - DNA, 22 bp, Homo sapiens
ctgctggtgatgtctgggcatg

SEQ ID NO: 9156126 - DNA, 22 bp, Homo sapiens
ctgctggtgcagagtggggctg

SEQ ID NO: 9156127 - DNA, 22 bp, Homo sapiens
ctgctgtccaacctgcactcgc

SEQ ID NO: 9156128 - DNA, 22 bp, Homo sapiens
ctgctgtcatctggcgctgtgc

SEQ ID NO: 9156129 - DNA, 22 bp, Homo sapiens
ctgctgtcaaaaatcactccat

SEQ ID NO: 9156130 - DNA, 22 bp, Homo sapiens
ctgctgtcatagccatccctcc

SEQ ID NO: 9156131 - DNA, 22 bp, Homo sapiens
ctgctgtcatagccatccctcc

SEQ ID NO: 9156132 - DNA, 22 bp, Homo sapiens
ctgctgtccaggagtgccctgt

SEQ ID NO: 9156133 - DNA, 22 bp, Homo sapiens
ctgctgtcccagcctcctcaca

SEQ ID NO: 9156134 - DNA, 22 bp, Homo sapiens
ctgctgtcgccgagctgcatgc

SEQ ID NO: 9156135 - DNA, 22 bp, Homo sapiens
ctgctgtcgccacggtcgccgc

SEQ ID NO: 9156136 - DNA, 22 bp, Homo sapiens
ctgctgtcctatctctttgttc

SEQ ID NO: 9156137 - DNA, 22 bp, Homo sapiens
ctgctgtcctatctctttgttc

SEQ ID NO: 9156138 - DNA, 22 bp, Homo sapiens
ctgctgagagccccagctgaga

SEQ ID NO: 9156139 - DNA, 22 bp, Homo sapiens
ctgctgagagccccagctgaga

SEQ ID NO: 9156140 - DNA, 22 bp, Homo sapiens
ctgctgagatgccaggagctct

SEQ ID NO: 9156141 - DNA, 22 bp, Homo sapiens
ctgctgagagctgaaggctgta

SEQ ID NO: 9156142 - DNA, 20 bp, Homo sapiens
ctgctgagagcctggcttgc

SEQ ID NO: 9156143 - DNA, 22 bp, Homo sapiens
ctgctgagagctgaaggctgta

SEQ ID NO: 9156144 - DNA, 22 bp, Homo sapiens
ctgctgaacctttgctagataa

SEQ ID NO: 9156145 - DNA, 22 bp, Homo sapiens
ctgctgaagttcagctcctttt

SEQ ID NO: 9156146 - DNA, 22 bp, Homo sapiens
ctgctgaaaacaataatgatga

SEQ ID NO: 9156147 - DNA, 22 bp, Homo sapiens
ctgctcttcccactcactccca

SEQ ID NO: 9156148 - DNA, 22 bp, Homo sapiens
ctgctcttcccactcactccca

SEQ ID NO: 9156149 - DNA, 22 bp, Homo sapiens
ctgctcttcccactcactccca

SEQ ID NO: 9156150 - DNA, 22 bp, Homo sapiens
ctgctcttgagggactgcggtc

SEQ ID NO: 9156151 - DNA, 22 bp, Homo sapiens
ctgctgaagttgttggtctttt

SEQ ID NO: 9156152 - DNA, 19 bp, Homo sapiens
ctgctgaattagctctgga

SEQ ID NO: 9156153 - DNA, 22 bp, Homo sapiens
ctgctgaatgtctctttggttt

SEQ ID NO: 9156154 - DNA, 22 bp, Homo sapiens
ctgctgacagccctgcttcagg

SEQ ID NO: 9156155 - DNA, 22 bp, Homo sapiens
ctgctgagaacccagattacta

SEQ ID NO: 9156156 - DNA, 22 bp, Homo sapiens
ctgctgagactggctttgtgtc

SEQ ID NO: 9156157 - DNA, 22 bp, Homo sapiens
ctgctgagagatgccaatctca

SEQ ID NO: 9156158 - DNA, 19 bp, Homo sapiens
ctgctgaattagctctgga

SEQ ID NO: 9156159 - DNA, 22 bp, Homo sapiens
ctgctgagaaatgcatccagtt

SEQ ID NO: 9156160 - DNA, 22 bp, Homo sapiens
ctgcccctgccaggcagctgtc

SEQ ID NO: 9156161 - DNA, 22 bp, Homo sapiens
ctgcccctgccaggcagctgtc

SEQ ID NO: 9156162 - DNA, 22 bp, Homo sapiens
ctgcccctgccaggcagctgtc

SEQ ID NO: 9156163 - DNA, 22 bp, Homo sapiens
ctgcctggggaatgtgaggatt

SEQ ID NO: 9156164 - DNA, 22 bp, Homo sapiens
ctgcccctgctcatggctgtcc

SEQ ID NO: 9156165 - DNA, 22 bp, Homo sapiens
ctgcctggggaatgtgaggatt

SEQ ID NO: 9156166 - DNA, 22 bp, Homo sapiens
ctgcctgtgtgtgcctgcagaa

SEQ ID NO: 9156167 - DNA, 22 bp, Homo sapiens
ctgcctgttagtctagcagtta

SEQ ID NO: 9156168 - DNA, 22 bp, Homo sapiens
ctgcctgtttcctcttgctccc

SEQ ID NO: 9156169 - DNA, 22 bp, Homo sapiens
ctgccttgaggaggttgtggga

SEQ ID NO: 9156170 - DNA, 22 bp, Homo sapiens
ctgccttccaaccccagactcc

SEQ ID NO: 9156171 - DNA, 22 bp, Homo sapiens
ctgccttccaaccccagactcc

SEQ ID NO: 9156172 - DNA, 22 bp, Homo sapiens
ctgccttcatctctgagctggg

SEQ ID NO: 9156173 - DNA, 22 bp, Homo sapiens
ctgctctgtggtccatgagaca

SEQ ID NO: 9156174 - DNA, 21 bp, Homo sapiens
ctgctctgacagtgaggccag

SEQ ID NO: 9156175 - DNA, 22 bp, Homo sapiens
ctgctctgtttcttagctgggt

SEQ ID NO: 9156176 - DNA, 22 bp, Homo sapiens
ctgctcttcacactacacccgt

SEQ ID NO: 9156177 - DNA, 22 bp, Homo sapiens
ctgctctgttcccccatcatct

SEQ ID NO: 9156178 - DNA, 22 bp, Homo sapiens
ctgcctttgcccttgacactgt

SEQ ID NO: 9156179 - DNA, 21 bp, Homo sapiens
ctgctctgacagtgaggccag

SEQ ID NO: 9156180 - DNA, 21 bp, Homo sapiens
ctgctctgacagtgaggccag

SEQ ID NO: 9156181 - DNA, 22 bp, Homo sapiens
ctgccttggttcccagccagca

SEQ ID NO: 9156182 - DNA, 22 bp, Homo sapiens
ctgccttggtttctagcagggc

SEQ ID NO: 9156183 - DNA, 22 bp, Homo sapiens
ctgccttggtttctagcagggc

SEQ ID NO: 9156184 - DNA, 22 bp, Homo sapiens
ctgccttgtcttgttttcaggg

SEQ ID NO: 9156185 - DNA, 22 bp, Homo sapiens
ctgcctttgaaagttctgttga

SEQ ID NO: 9156186 - DNA, 22 bp, Homo sapiens
ctgcctttgcccttgacactgt

SEQ ID NO: 9156187 - DNA, 22 bp, Homo sapiens
ctgaggtgtgagccacttcccc

SEQ ID NO: 9156188 - DNA, 22 bp, Homo sapiens
ctgcagcctcaacctcctgagc

SEQ ID NO: 9156189 - DNA, 22 bp, Homo sapiens
ctgcagcctcaacctcctgagc

SEQ ID NO: 9156190 - DNA, 22 bp, Homo sapiens
ctgcagcctaggtgcagctggg

SEQ ID NO: 9156191 - DNA, 22 bp, Homo sapiens
ctgcagctgtctctactgggca

SEQ ID NO: 9156192 - DNA, 22 bp, Homo sapiens
ctgcagctgtagaggacagtgg

SEQ ID NO: 9156193 - DNA, 22 bp, Homo sapiens
ctgcaggaaggggacggagtgg

SEQ ID NO: 9156194 - DNA, 22 bp, Homo sapiens
ctgcaggaatctgtgctaggtg

SEQ ID NO: 9156195 - DNA, 22 bp, Homo sapiens
ctgcaggactgaaagatgaggt

SEQ ID NO: 9156196 - DNA, 22 bp, Homo sapiens
ctgcaggactgaaagatgaggt

SEQ ID NO: 9156197 - DNA, 22 bp, Homo sapiens
ctgcaggagcaaagcctctgct

SEQ ID NO: 9156198 - DNA, 22 bp, Homo sapiens
ctgcaggactgaaagatgaggt

SEQ ID NO: 9156199 - DNA, 22 bp, Homo sapiens
ctgcaggacgaccgcctcatct

SEQ ID NO: 9156200 - DNA, 22 bp, Homo sapiens
ctgcaggacgaccgcctcatct

SEQ ID NO: 9156201 - DNA, 22 bp, Homo sapiens
ctgcaggaattcaaagtgagct

SEQ ID NO: 9156202 - DNA, 22 bp, Homo sapiens
ctgcaggacagggaggagcaag

SEQ ID NO: 9156203 - DNA, 22 bp, Homo sapiens
ctgcaggacagggccggaggcc

SEQ ID NO: 9156204 - DNA, 22 bp, Homo sapiens
ctgcaggacagggaggagcaag

SEQ ID NO: 9156205 - DNA, 22 bp, Homo sapiens
ctgcaggcatctaactgtgggc

SEQ ID NO: 9156206 - DNA, 22 bp, Homo sapiens
ctgcaggcatctaactgtgggc

SEQ ID NO: 9156207 - DNA, 22 bp, Homo sapiens
ctgcaggattctcccagttgga

SEQ ID NO: 9156208 - DNA, 22 bp, Homo sapiens
ctgcaggatttcatgggctgac

SEQ ID NO: 9156209 - DNA, 21 bp, Homo sapiens
ctgcaggatgctgaagccagg

SEQ ID NO: 9156210 - DNA, 22 bp, Homo sapiens
ctgcaggagtgaaagcaggcct

SEQ ID NO: 9156211 - DNA, 22 bp, Homo sapiens
ctgcaggagcaagcctgggaga

SEQ ID NO: 9156212 - DNA, 22 bp, Homo sapiens
ctgcaggaggatcctgagagtg

SEQ ID NO: 9156213 - DNA, 22 bp, Homo sapiens
ctgcaggagtgaaagcaggcct

SEQ ID NO: 9156214 - DNA, 22 bp, Homo sapiens
ctgcaggagtgaaagcaggcct

SEQ ID NO: 9156215 - DNA, 22 bp, Homo sapiens
ctgcaggagggctggggaagcc

SEQ ID NO: 9156216 - DNA, 22 bp, Homo sapiens
ctgcccacactcatggggaagg

SEQ ID NO: 9156217 - DNA, 22 bp, Homo sapiens
ctgcccacacctgagctgggcc

SEQ ID NO: 9156218 - DNA, 22 bp, Homo sapiens
ctgccattaaagagcgttcaga

SEQ ID NO: 9156219 - DNA, 22 bp, Homo sapiens
ctgccattggattttcacattt

SEQ ID NO: 9156220 - DNA, 20 bp, Homo sapiens
ctgcccagccactgagggat

SEQ ID NO: 9156221 - DNA, 20 bp, Homo sapiens
ctgcccagccactgagggat
